United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 39

SEQ ID NO: 1395196 - RNA, 18 nt, Human
caaggcuagaaccaccug

SEQ ID NO: 1395197 - RNA, 19 nt, Human
gcauggccacaucugagcc

SEQ ID NO: 1395198 - RNA, 18 nt, Human
caugaagauguagaggag

SEQ ID NO: 1395199 - RNA, 15 nt, Human
cgagacaagcagccc

SEQ ID NO: 1395200 - RNA, 15 nt, Human
aagaaggaaagauuu

SEQ ID NO: 1395201 - RNA, 18 nt, Human
ugaagcuguguccucaug

SEQ ID NO: 1395202 - RNA, 12 nt, Human
gcaaagcccagc

SEQ ID NO: 1395203 - RNA, 13 nt, Human
guggcgcuggcug

SEQ ID NO: 1395204 - RNA, 16 nt, Human
ucuuggucucaguguc

SEQ ID NO: 1395205 - RNA, 15 nt, Human
cccugccccccagcc

SEQ ID NO: 1395206 - RNA, 21 nt, Human
acaagaaggaaagauuuuguu

SEQ ID NO: 1395207 - RNA, 14 nt, Human
acuuggucugugag

SEQ ID NO: 1395208 - RNA, 16 nt, Human
acuuuuauaagaaaua

SEQ ID NO: 1395209 - RNA, 12 nt, Human
cggccggcgcgc

SEQ ID NO: 1395210 - RNA, 12 nt, Human
caacccaaaugu

SEQ ID NO: 1395211 - RNA, 17 nt, Human
caaauccaaugaaauga

SEQ ID NO: 1395212 - RNA, 17 nt, Human
uaucuuuuuuuuaauaa

SEQ ID NO: 1395213 - RNA, 17 nt, Human
uaauuccacagcugcuc

SEQ ID NO: 1395214 - RNA, 23 nt, Human
uccaacuaucucauuuccaagca

SEQ ID NO: 1395215 - RNA, 22 nt, Human
cugaggcuccacuuggucugug

SEQ ID NO: 1395216 - RNA, 13 nt, Human
agcgacagugaga

SEQ ID NO: 1395217 - RNA, 21 nt, Human
ugcucaauaaaguacaagagc

SEQ ID NO: 1395218 - RNA, 19 nt, Human
aucuauguagaauauauuu

SEQ ID NO: 1395219 - RNA, 17 nt, Human
ccaagcugguggcucug

SEQ ID NO: 1395220 - RNA, 22 nt, Human
uauuccuuuuucucuccucucc

SEQ ID NO: 1395221 - RNA, 16 nt, Human
auuuuuuuuuuuaaaa

SEQ ID NO: 1395222 - RNA, 19 nt, Human
uggcaaacugccaucauuu

SEQ ID NO: 1395223 - RNA, 13 nt, Human
uucuauaauuuaa

SEQ ID NO: 1395224 - RNA, 14 nt, Human
gagcucagcccugg

SEQ ID NO: 1395225 - RNA, 13 nt, Human
gggaaagaagagc

SEQ ID NO: 1395226 - RNA, 19 nt, Human
ucgcccacuuccucccggc

SEQ ID NO: 1395227 - RNA, 22 nt, Human
cccagcccuccuuaucaaagga

SEQ ID NO: 1395228 - RNA, 23 nt, Human
cgagccccaggcggguccggguc

SEQ ID NO: 1395229 - RNA, 13 nt, Human
ugauuauauguca

SEQ ID NO: 1395230 - RNA, 14 nt, Human
ugcuagaacucccu

SEQ ID NO: 1395231 - RNA, 13 nt, Human
acggggugaaacc

SEQ ID NO: 1395232 - RNA, 15 nt, Human
gccccugcacuccag

SEQ ID NO: 1395233 - RNA, 16 nt, Human
uucacauuuaaauaaa

SEQ ID NO: 1395234 - RNA, 12 nt, Human
ugagagacacac

SEQ ID NO: 1395235 - RNA, 15 nt, Human
gcugcgcucggccug

SEQ ID NO: 1395236 - RNA, 13 nt, Human
aaagaagagccgg

SEQ ID NO: 1395237 - RNA, 21 nt, Human
guccccuauccuacuuccccu

SEQ ID NO: 1395238 - RNA, 21 nt, Human
aagaaauaggaaauauuuuaa

SEQ ID NO: 1395239 - RNA, 15 nt, Human
ugagcgcccacuaga

SEQ ID NO: 1395240 - RNA, 15 nt, Human
cagucucccucccuu

SEQ ID NO: 1395241 - RNA, 22 nt, Human
uguauacugugugcuaaaacaa

SEQ ID NO: 1395242 - RNA, 18 nt, Human
gaaggugaucuggcucug

SEQ ID NO: 1395243 - RNA, 22 nt, Human
ccggcgcgcucaucccacccgc

SEQ ID NO: 1395244 - RNA, 18 nt, Human
auuuauuacuguaagaaa

SEQ ID NO: 1395245 - RNA, 23 nt, Human
uaagaauucuguugauggaaaua

SEQ ID NO: 1395246 - RNA, 18 nt, Human
gaugccccgucccccucu

SEQ ID NO: 1395247 - RNA, 21 nt, Human
ccaaagugugacucauuaaau

SEQ ID NO: 1395248 - RNA, 16 nt, Human
uaccccuggccaagga

SEQ ID NO: 1395249 - RNA, 19 nt, Human
auaaaagacagugaaagaa

SEQ ID NO: 1395250 - RNA, 22 nt, Human
guguccccuauccuacuucccc

SEQ ID NO: 1395251 - RNA, 14 nt, Human
gauuaguacacacu

SEQ ID NO: 1395252 - RNA, 12 nt, Human
ucaccccuugcc

SEQ ID NO: 1395253 - RNA, 17 nt, Human
gucucagcuucacccug

SEQ ID NO: 1395254 - RNA, 19 nt, Human
uccuauaauuuuagacauu

SEQ ID NO: 1395255 - RNA, 20 nt, Human
aaaaaccugagccccaaaag

SEQ ID NO: 1395256 - RNA, 23 nt, Human
gauauuaaccaggggccaugaau

SEQ ID NO: 1395257 - RNA, 16 nt, Human
guuggcuguuccugca

SEQ ID NO: 1395258 - RNA, 14 nt, Human
augcuccuccaggg

SEQ ID NO: 1395259 - RNA, 21 nt, Human
aaaaacguauugcauuuaauu

SEQ ID NO: 1395260 - RNA, 15 nt, Human
ucaguuuuugugaaa

SEQ ID NO: 1395261 - RNA, 18 nt, Human
gaaguaaauguuguuuua

SEQ ID NO: 1395262 - RNA, 22 nt, Human
cuucagccugaaagaggaauga

SEQ ID NO: 1395263 - RNA, 13 nt, Human
uaaaaguuuaagu

SEQ ID NO: 1395264 - RNA, 21 nt, Human
aguuagcuuucuuccuggauu

SEQ ID NO: 1395265 - RNA, 22 nt, Human
auauauauuuuuuuuuuuaaaa

SEQ ID NO: 1395266 - RNA, 12 nt, Human
gucauuguucuu

SEQ ID NO: 1395267 - RNA, 17 nt, Human
gccgggaaagaagagcc

SEQ ID NO: 1395268 - RNA, 22 nt, Human
caagcacuaaacaaagagugaa

SEQ ID NO: 1395269 - RNA, 21 nt, Human
acuauuauauuuccaagaaau

SEQ ID NO: 1395270 - RNA, 22 nt, Human
uacaugagguacugagagugaa

SEQ ID NO: 1395271 - RNA, 15 nt, Human
agcucuaucaccaag

SEQ ID NO: 1395272 - RNA, 19 nt, Human
ucagguguguugcaguguc

SEQ ID NO: 1395273 - RNA, 19 nt, Human
uauguagaauauauuuccu

SEQ ID NO: 1395274 - RNA, 13 nt, Human
uuauucacaagac

SEQ ID NO: 1395275 - RNA, 11 nt, Human
gggaaagaaga

SEQ ID NO: 1395276 - RNA, 14 nt, Human
cucuugaggcacag

SEQ ID NO: 1395277 - RNA, 23 nt, Human
uagauaggucagugcaaauacuc

SEQ ID NO: 1395278 - RNA, 22 nt, Human
caccucccccaucucuucuggg

SEQ ID NO: 1395279 - RNA, 21 nt, Human
gauguggggaaguuaggaacu

SEQ ID NO: 1395280 - RNA, 23 nt, Human
uuguaacaagccuccuuuuaaag

SEQ ID NO: 1395281 - RNA, 23 nt, Human
agcccuccuuaucaaaggacacc

SEQ ID NO: 1395282 - RNA, 22 nt, Human
cauaaauguugacaugggacau

SEQ ID NO: 1395283 - RNA, 17 nt, Human
cauccuagucucuauca

SEQ ID NO: 1395284 - RNA, 20 nt, Human
acaagacccaaaaggcagaa

SEQ ID NO: 1395285 - RNA, 13 nt, Human
guuuucccaucuc

SEQ ID NO: 1395286 - RNA, 17 nt, Human
auuagcauggccacauc

SEQ ID NO: 1395287 - RNA, 22 nt, Human
gucucuacuaaaaauacaaaaa

SEQ ID NO: 1395288 - RNA, 15 nt, Human
ugcuguauuuuaaaa

SEQ ID NO: 1395289 - RNA, 15 nt, Human
cauuuacuuuuaaac

SEQ ID NO: 1395290 - RNA, 22 nt, Human
caaacaauuugaauauaaauuu

SEQ ID NO: 1395291 - RNA, 14 nt, Human
caauugacuauagu

SEQ ID NO: 1395292 - RNA, 16 nt, Human
uuagauagaugaagaa

SEQ ID NO: 1395293 - RNA, 16 nt, Human
ugcuguauuuuaaaag

SEQ ID NO: 1395294 - RNA, 15 nt, Human
gggaaagaagagccg

SEQ ID NO: 1395295 - RNA, 21 nt, Human
cauuucuugagguaaaagcau

SEQ ID NO: 1395296 - RNA, 15 nt, Human
uggaaacgaagcacc

SEQ ID NO: 1395297 - RNA, 15 nt, Human
cuugugaggagcugg

SEQ ID NO: 1395298 - RNA, 16 nt, Human
aguuuauauagaaaug

SEQ ID NO: 1395299 - RNA, 14 nt, Human
aaauaggaaauauu

SEQ ID NO: 1395300 - RNA, 16 nt, Human
cuuauaauuuaaaaua

SEQ ID NO: 1395301 - RNA, 23 nt, Human
auauaacaaugcuguauuuuaaa

SEQ ID NO: 1395302 - RNA, 20 nt, Human
agccuuggggcugaugcagu

SEQ ID NO: 1395303 - RNA, 12 nt, Human
auauaaauaaaa

SEQ ID NO: 1395304 - RNA, 22 nt, Human
caagcucuaucaccaaggagcc

SEQ ID NO: 1395305 - RNA, 15 nt, Human
uaucaguccaaaggg

SEQ ID NO: 1395306 - RNA, 19 nt, Human
ccccucuggcuccagcugg

SEQ ID NO: 1395307 - RNA, 15 nt, Human
gcugguggcgcuggc

SEQ ID NO: 1395308 - RNA, 21 nt, Human
cugcgcucggccugcucgccc

SEQ ID NO: 1395309 - RNA, 15 nt, Human
auuuaauuauuucac

SEQ ID NO: 1395310 - RNA, 16 nt, Human
guuuuuuuuuaaaaaa

SEQ ID NO: 1395311 - RNA, 14 nt, Human
ugguauguuuucag

SEQ ID NO: 1395312 - RNA, 15 nt, Human
acucaacaaacauaa

SEQ ID NO: 1395313 - RNA, 13 nt, Human
uaaauauauauuu

SEQ ID NO: 1395314 - RNA, 18 nt, Human
gagccgggaaagaagagc

SEQ ID NO: 1395315 - RNA, 22 nt, Human
uaauaggcguaacuaauuuuaa

SEQ ID NO: 1395316 - RNA, 16 nt, Human
ugugcauauuuuauua

SEQ ID NO: 1395317 - RNA, 20 nt, Human
ggagccugaucaccugcccu

SEQ ID NO: 1395318 - RNA, 16 nt, Human
cagcuuuccucaaaac

SEQ ID NO: 1395319 - RNA, 21 nt, Human
auuccuuuuucucuccucucc

SEQ ID NO: 1395320 - RNA, 19 nt, Human
acuggacucaccuccccca

SEQ ID NO: 1395321 - RNA, 15 nt, Human
ucauaagaauucugu

SEQ ID NO: 1395322 - RNA, 22 nt, Human
auauaaauaaaaauaauccuca

SEQ ID NO: 1395323 - RNA, 16 nt, Human
cugagcauuuaauaug

SEQ ID NO: 1395324 - RNA, 23 nt, Human
gcauuguuggcuguuccugcagu

SEQ ID NO: 1395325 - RNA, 15 nt, Human
uggauuccucacuuu

SEQ ID NO: 1395326 - RNA, 21 nt, Human
uagggugauauuaaccagggg

SEQ ID NO: 1395327 - RNA, 17 nt, Human
cuggacucaccuccccc

SEQ ID NO: 1395328 - RNA, 19 nt, Human
auucccagccagcacagcc

SEQ ID NO: 1395329 - RNA, 16 nt, Human
ccuacaugagguacug

SEQ ID NO: 1395330 - RNA, 19 nt, Human
ggaaaaaauaacaaugaaa

SEQ ID NO: 1395331 - RNA, 16 nt, Human
gccaaggaugccccgu

SEQ ID NO: 1395332 - RNA, 21 nt, Human
uuuguauaaaauaauuuuuau

SEQ ID NO: 1395333 - RNA, 21 nt, Human
uuccuaauuccacagcugcuc

SEQ ID NO: 1395334 - RNA, 14 nt, Human
guagcuaaauauau

SEQ ID NO: 1395335 - RNA, 19 nt, Human
uaucucauuuccaagcaag

SEQ ID NO: 1395336 - RNA, 17 nt, Human
uaaauuuaucauuuagu

SEQ ID NO: 1395337 - RNA, 13 nt, Human
cucgccacgcucu

SEQ ID NO: 1395338 - RNA, 17 nt, Human
aauguuguuuuaggaau

SEQ ID NO: 1395339 - RNA, 20 nt, Human
agaggagaaacuggaacucu

SEQ ID NO: 1395340 - RNA, 17 nt, Human
agccuccagcugccccg

SEQ ID NO: 1395341 - RNA, 19 nt, Human
ucuguuuucccuccuugga

SEQ ID NO: 1395342 - RNA, 18 nt, Human
uuauuauauauauauauu

SEQ ID NO: 1395343 - RNA, 18 nt, Human
agccugaucaccugcccu

SEQ ID NO: 1395344 - RNA, 11 nt, Human
gcgcuggcugc

SEQ ID NO: 1395345 - RNA, 23 nt, Human
acguaaucguguccccuauccua

SEQ ID NO: 1395346 - RNA, 12 nt, Human
uacuaaaugcuc

SEQ ID NO: 1395347 - RNA, 13 nt, Human
uaugaaauauuau

SEQ ID NO: 1395348 - RNA, 13 nt, Human
ggaaguagaggag

SEQ ID NO: 1395349 - RNA, 20 nt, Human
cucuguucugcacacagcac

SEQ ID NO: 1395350 - RNA, 13 nt, Human
aggggcgcucgcu

SEQ ID NO: 1395351 - RNA, 20 nt, Human
gauugugccccugcacucca

SEQ ID NO: 1395352 - RNA, 17 nt, Human
uccuuggugccuggagc

SEQ ID NO: 1395353 - RNA, 12 nt, Human
uugggcaggcag

SEQ ID NO: 1395354 - RNA, 18 nt, Human
aaauggaaguaaauguug

SEQ ID NO: 1395355 - RNA, 22 nt, Human
uagaaauguauucuuuuaguuu

SEQ ID NO: 1395356 - RNA, 18 nt, Human
gaaaauaacgauaaaaga

SEQ ID NO: 1395357 - RNA, 22 nt, Human
uggacgagaaaacaauaacgau

SEQ ID NO: 1395358 - RNA, 19 nt, Human
gccccccagcccuccuuau

SEQ ID NO: 1395359 - RNA, 15 nt, Human
auaucuuaucuuccu

SEQ ID NO: 1395360 - RNA, 11 nt, Human
cgauaaaagac

SEQ ID NO: 1395361 - RNA, 11 nt, Human
cauaugaaaag

SEQ ID NO: 1395362 - RNA, 18 nt, Human
gagccucagucucccucc

SEQ ID NO: 1395363 - RNA, 18 nt, Human
cagauuugagcucagccc

SEQ ID NO: 1395364 - RNA, 19 nt, Human
uggugaacuugguuuuaau

SEQ ID NO: 1395365 - RNA, 14 nt, Human
ucagucucccuccc

SEQ ID NO: 1395366 - RNA, 18 nt, Human
cuccccaaaugcuuucca

SEQ ID NO: 1395367 - RNA, 18 nt, Human
aaggaugccccguccccc

SEQ ID NO: 1395368 - RNA, 12 nt, Human
uauuauuuuuua

SEQ ID NO: 1395369 - RNA, 19 nt, Human
gucaaauugugugaaaggu

SEQ ID NO: 1395370 - RNA, 15 nt, Human
uccgcuacuuccagg

SEQ ID NO: 1395371 - RNA, 18 nt, Human
uguauucuuuuaguuuuu

SEQ ID NO: 1395372 - RNA, 19 nt, Human
ucucuaucauuaaaguucu

SEQ ID NO: 1395373 - RNA, 16 nt, Human
augcuaagugaaauaa

SEQ ID NO: 1395374 - RNA, 20 nt, Human
cccggccgcgcugcgcgccg

SEQ ID NO: 1395375 - RNA, 19 nt, Human
ccugccuaagugcagcccc

SEQ ID NO: 1395376 - RNA, 13 nt, Human
acuguaaaauaau

SEQ ID NO: 1395377 - RNA, 20 nt, Human
agagacacacugaagaagca

SEQ ID NO: 1395378 - RNA, 15 nt, Human
augguuguauuauuu

SEQ ID NO: 1395379 - RNA, 16 nt, Human
aaaauaauccucaguu

SEQ ID NO: 1395380 - RNA, 22 nt, Human
cgcccacuuccucccggccgcg

SEQ ID NO: 1395381 - RNA, 23 nt, Human
cuggggcuuuaacuccugcuaga

SEQ ID NO: 1395382 - RNA, 16 nt, Human
cucagcccuggugggc

SEQ ID NO: 1395383 - RNA, 12 nt, Human
cauaaaguaugu

SEQ ID NO: 1395384 - RNA, 15 nt, Human
ugcaauuccacuuau

SEQ ID NO: 1395385 - RNA, 18 nt, Human
gcagcccuuagcccuucc

SEQ ID NO: 1395386 - RNA, 12 nt, Human
acugaaaucaua

SEQ ID NO: 1395387 - RNA, 19 nt, Human
ccgggcgugguggugagug

SEQ ID NO: 1395388 - RNA, 22 nt, Human
aucucuucuggguuccuuccuc

SEQ ID NO: 1395389 - RNA, 17 nt, Human
gacaaggaaaaaauaac

SEQ ID NO: 1395390 - RNA, 20 nt, Human
guauuauuuuuuaaaaaaau

SEQ ID NO: 1395391 - RNA, 23 nt, Human
acuaguuguaauuuuuuuguggg

SEQ ID NO: 1395392 - RNA, 12 nt, Human
caccuccuaaga

SEQ ID NO: 1395393 - RNA, 15 nt, Human
gcagagguugcagug

SEQ ID NO: 1395394 - RNA, 16 nt, Human
uaucuuccuauaauuu

SEQ ID NO: 1395395 - RNA, 19 nt, Human
gcagggugaacugcagcga

SEQ ID NO: 1395396 - RNA, 13 nt, Human
cuaggcauagccc

SEQ ID NO: 1395397 - RNA, 17 nt, Human
ucagacauagaauuaac

SEQ ID NO: 1395398 - RNA, 16 nt, Human
uaaaggaauuuaaaaa

SEQ ID NO: 1395399 - RNA, 17 nt, Human
auaaaguacaagagcuu

SEQ ID NO: 1395400 - RNA, 15 nt, Human
auaauuuugugaagc

SEQ ID NO: 1395401 - RNA, 11 nt, Human
ccacaucugag

SEQ ID NO: 1395402 - RNA, 17 nt, Human
cgauaaaagacagugaa

SEQ ID NO: 1395403 - RNA, 20 nt, Human
caccuccuaagaaggcaccu

SEQ ID NO: 1395404 - RNA, 19 nt, Human
acuauuuaauuauuucacu

SEQ ID NO: 1395405 - RNA, 14 nt, Human
cucccuuggggccu

SEQ ID NO: 1395406 - RNA, 16 nt, Human
ucuuauaauuuaaaau

SEQ ID NO: 1395407 - RNA, 14 nt, Human
cagcaucagcaucc

SEQ ID NO: 1395408 - RNA, 18 nt, Human
aauuuuagacauucuuua

SEQ ID NO: 1395409 - RNA, 21 nt, Human
cuggaaacacauguuccccuu

SEQ ID NO: 1395410 - RNA, 22 nt, Human
gaaaaucuuauaauuuaaaaua

SEQ ID NO: 1395411 - RNA, 14 nt, Human
agauguagaggaga

SEQ ID NO: 1395412 - RNA, 20 nt, Human
auuacauuuguauaaaauaa

SEQ ID NO: 1395413 - RNA, 13 nt, Human
acuaauuuuaaaa

SEQ ID NO: 1395414 - RNA, 20 nt, Human
uugaacccgggaggcagagg

SEQ ID NO: 1395415 - RNA, 20 nt, Human
cugagguuguguguggaagg

SEQ ID NO: 1395416 - RNA, 16 nt, Human
aagcauuuagauguau

SEQ ID NO: 1395417 - RNA, 18 nt, Human
gaccccugagcuugcaga

SEQ ID NO: 1395418 - RNA, 12 nt, Human
aauuuuaaaaug

SEQ ID NO: 1395419 - RNA, 18 nt, Human
acagagacagaaagcaga

SEQ ID NO: 1395420 - RNA, 22 nt, Human
gaauaaccaacacccugagguu

SEQ ID NO: 1395421 - RNA, 17 nt, Human
ccacugcagaagacagu

SEQ ID NO: 1395422 - RNA, 14 nt, Human
aagcaucacaugaa

SEQ ID NO: 1395423 - RNA, 21 nt, Human
gccugagaccaaggcccccgg

SEQ ID NO: 1395424 - RNA, 13 nt, Human
uuuaaaaaagaaa

SEQ ID NO: 1395425 - RNA, 18 nt, Human
uggcuguuaaucuuucaa

SEQ ID NO: 1395426 - RNA, 22 nt, Human
gcauccuagucucuaucauuaa

SEQ ID NO: 1395427 - RNA, 14 nt, Human
gcuuuaacuccugc

SEQ ID NO: 1395428 - RNA, 14 nt, Human
ccugcugagcccca

SEQ ID NO: 1395429 - RNA, 18 nt, Human
uauuuucuauaauuuaaa

SEQ ID NO: 1395430 - RNA, 19 nt, Human
acggagccgggaaagaaga

SEQ ID NO: 1395431 - RNA, 20 nt, Human
agaugcaguucugaagaaga

SEQ ID NO: 1395432 - RNA, 15 nt, Human
cuaguaauuggaaag

SEQ ID NO: 1395433 - RNA, 22 nt, Human
aauuuuagacauucuuuaucuu

SEQ ID NO: 1395434 - RNA, 14 nt, Human
cuuuuaguuuuuaa

SEQ ID NO: 1395435 - RNA, 16 nt, Human
uuauaauuuaaaauau

SEQ ID NO: 1395436 - RNA, 13 nt, Human
aaacauccuacaa

SEQ ID NO: 1395437 - RNA, 23 nt, Human
ucccuagaaagccaugugcagcc

SEQ ID NO: 1395438 - RNA, 20 nt, Human
aaaugauguuucauaagaau

SEQ ID NO: 1395439 - RNA, 19 nt, Human
gguuuaauaauuuuuaauu

SEQ ID NO: 1395440 - RNA, 21 nt, Human
cuggguuuuggggggacgcua

SEQ ID NO: 1395441 - RNA, 14 nt, Human
cgugcuugucccug

SEQ ID NO: 1395442 - RNA, 17 nt, Human
ggccaugggacagggag

SEQ ID NO: 1395443 - RNA, 18 nt, Human
uccuaauuccacagcugc

SEQ ID NO: 1395444 - RNA, 19 nt, Human
uugugccccugcacuccag

SEQ ID NO: 1395445 - RNA, 12 nt, Human
gccggcgcgcuc

SEQ ID NO: 1395446 - RNA, 18 nt, Human
uauaggauguggggaagu

SEQ ID NO: 1395447 - RNA, 14 nt, Human
ccugccccccagcc

SEQ ID NO: 1395448 - RNA, 21 nt, Human
guauacugugugcuaaaacaa

SEQ ID NO: 1395449 - RNA, 22 nt, Human
cuccagccugagcgacagugag

SEQ ID NO: 1395450 - RNA, 16 nt, Human
ucaucaaugaaugaau

SEQ ID NO: 1395451 - RNA, 14 nt, Human
ggggcggggagcga

SEQ ID NO: 1395452 - RNA, 17 nt, Human
uuccaagccucaugucc

SEQ ID NO: 1395453 - RNA, 14 nt, Human
cucaacaaacauaa

SEQ ID NO: 1395454 - RNA, 21 nt, Human
ccugaucaccugcccugcuga

SEQ ID NO: 1395455 - RNA, 23 nt, Human
auuuuauagcuacuaauuuuaaa

SEQ ID NO: 1395456 - RNA, 17 nt, Human
ccuuggugccuggagcc

SEQ ID NO: 1395457 - RNA, 17 nt, Human
cagugaaagaaaauaac

SEQ ID NO: 1395458 - RNA, 16 nt, Human
uggcgcuggcugcgcu

SEQ ID NO: 1395459 - RNA, 21 nt, Human
aauuccugacugcuaguuuau

SEQ ID NO: 1395460 - RNA, 18 nt, Human
cauggaauuggagcucgu

SEQ ID NO: 1395461 - RNA, 18 nt, Human
ccugaggugagcaucauc

SEQ ID NO: 1395462 - RNA, 13 nt, Human
cugccuucucaac

SEQ ID NO: 1395463 - RNA, 20 nt, Human
ccagcuugaaaccuucacuu

SEQ ID NO: 1395464 - RNA, 15 nt, Human
gccuaauuuguuuuc

SEQ ID NO: 1395465 - RNA, 20 nt, Human
aagggcuguuauaaucuuuc

SEQ ID NO: 1395466 - RNA, 18 nt, Human
aucuacacuccagugaga

SEQ ID NO: 1395467 - RNA, 23 nt, Human
caacacccugagguugugugugg

SEQ ID NO: 1395468 - RNA, 12 nt, Human
gaauuggagcuc

SEQ ID NO: 1395469 - RNA, 21 nt, Human
ccuccccaaaugcuuuccaug

SEQ ID NO: 1395470 - RNA, 19 nt, Human
gguuccuuccucugagccu

SEQ ID NO: 1395471 - RNA, 17 nt, Human
cugccucagaaaacaag

SEQ ID NO: 1395472 - RNA, 18 nt, Human
accaagcugguggcucug

SEQ ID NO: 1395473 - RNA, 15 nt, Human
guaaggggaauugag

SEQ ID NO: 1395474 - RNA, 15 nt, Human
cacaggacagcccuu

SEQ ID NO: 1395475 - RNA, 18 nt, Human
ugaaaaaguucugcagau

SEQ ID NO: 1395476 - RNA, 22 nt, Human
ugagacucugucucaguccaug

SEQ ID NO: 1395477 - RNA, 13 nt, Human
auauuuuauuaua

SEQ ID NO: 1395478 - RNA, 16 nt, Human
caggcugagccucagu

SEQ ID NO: 1395479 - RNA, 20 nt, Human
aauaauuuuuauauuugaaa

SEQ ID NO: 1395480 - RNA, 23 nt, Human
cacaagaaaugaaagcagggacu

SEQ ID NO: 1395481 - RNA, 16 nt, Human
auacauguuacaacac

SEQ ID NO: 1395482 - RNA, 15 nt, Human
accaaggcugauuaa

SEQ ID NO: 1395483 - RNA, 23 nt, Human
gauagauaggucagugcaaauac

SEQ ID NO: 1395484 - RNA, 21 nt, Human
cugcccugcugagucccaggc

SEQ ID NO: 1395485 - RNA, 16 nt, Human
aaaugggaaacaaaag

SEQ ID NO: 1395486 - RNA, 15 nt, Human
gcgagcgcgcgcgcc

SEQ ID NO: 1395487 - RNA, 12 nt, Human
ccccuugccaua

SEQ ID NO: 1395488 - RNA, 14 nt, Human
uauguauauuuuau

SEQ ID NO: 1395489 - RNA, 18 nt, Human
auucuugccaaauauaaa

SEQ ID NO: 1395490 - RNA, 19 nt, Human
aaaaucuuauaauuuaaaa

SEQ ID NO: 1395491 - RNA, 17 nt, Human
cucaugagggcuggaug

SEQ ID NO: 1395492 - RNA, 13 nt, Human
cugaagcuguguc

SEQ ID NO: 1395493 - RNA, 18 nt, Human
agccggagccuccagcug

SEQ ID NO: 1395494 - RNA, 19 nt, Human
uaucacuugucaauaaaau

SEQ ID NO: 1395495 - RNA, 12 nt, Human
auaacuggaaac

SEQ ID NO: 1395496 - RNA, 16 nt, Human
aaaaauuccaagugau

SEQ ID NO: 1395497 - RNA, 16 nt, Human
agugagacagcucugc

SEQ ID NO: 1395498 - RNA, 22 nt, Human
cuccuccagggagucucagcuu

SEQ ID NO: 1395499 - RNA, 14 nt, Human
cacuuauaggaauu

SEQ ID NO: 1395500 - RNA, 21 nt, Human
auacauaaaguaugugcauau

SEQ ID NO: 1395501 - RNA, 15 nt, Human
aauugacccacaaga

SEQ ID NO: 1395502 - RNA, 15 nt, Human
ugccccgucccccuc

SEQ ID NO: 1395503 - RNA, 19 nt, Human
auaaaagacaaggaaaaaa

SEQ ID NO: 1395504 - RNA, 23 nt, Human
cauuguggucacaggaaguagag

SEQ ID NO: 1395505 - RNA, 16 nt, Human
ccuccuuaucaaagga

SEQ ID NO: 1395506 - RNA, 19 nt, Human
auaucaguuauuuuuaaac

SEQ ID NO: 1395507 - RNA, 17 nt, Human
uccagcuggccgggagc

SEQ ID NO: 1395508 - RNA, 14 nt, Human
ugcaccuccaugga

SEQ ID NO: 1395509 - RNA, 18 nt, Human
uucaauaucuuuuuuuua

SEQ ID NO: 1395510 - RNA, 20 nt, Human
ccuccugccuaagugcagcc

SEQ ID NO: 1395511 - RNA, 15 nt, Human
uuaauuuguaguguu

SEQ ID NO: 1395512 - RNA, 21 nt, Human
cgcccacuuccucccggccgc

SEQ ID NO: 1395513 - RNA, 18 nt, Human
cuggguuaggccuugccu

SEQ ID NO: 1395514 - RNA, 20 nt, Human
aaacuuuaugcuaagugaaa

SEQ ID NO: 1395515 - RNA, 21 nt, Human
cauuuucuucucacauuuaua

SEQ ID NO: 1395516 - RNA, 16 nt, Human
aucaauuuaaaaaaaa

SEQ ID NO: 1395517 - RNA, 18 nt, Human
gccuccagcugccccggg

SEQ ID NO: 1395518 - RNA, 15 nt, Human
gaaagaaaauaacga

SEQ ID NO: 1395519 - RNA, 16 nt, Human
cgcuuccgcauccuag

SEQ ID NO: 1395520 - RNA, 15 nt, Human
cuccucaacucugag

SEQ ID NO: 1395521 - RNA, 14 nt, Human
uugaaauuguauua

SEQ ID NO: 1395522 - RNA, 20 nt, Human
gaaauacacuguuaucuuca

SEQ ID NO: 1395523 - RNA, 21 nt, Human
auuuacaaaugggaaacaaaa

SEQ ID NO: 1395524 - RNA, 19 nt, Human
cacaggaaccacaagacug

SEQ ID NO: 1395525 - RNA, 14 nt, Human
uauuauauuuccaa

SEQ ID NO: 1395526 - RNA, 14 nt, Human
uuuuauaagaaaua

SEQ ID NO: 1395527 - RNA, 18 nt, Human
agauccccaagccuggca

SEQ ID NO: 1395528 - RNA, 18 nt, Human
cagccucuuagaugcagu

SEQ ID NO: 1395529 - RNA, 15 nt, Human
uguauuuuaaaagaa

SEQ ID NO: 1395530 - RNA, 16 nt, Human
auauuuccaagaaaua

SEQ ID NO: 1395531 - RNA, 12 nt, Human
uacuauuuaauu

SEQ ID NO: 1395532 - RNA, 18 nt, Human
cuggggcuuuaacuccug

SEQ ID NO: 1395533 - RNA, 16 nt, Human
cacuaguauuucuaug

SEQ ID NO: 1395534 - RNA, 22 nt, Human
cuagucucuaucauuaaaguuc

SEQ ID NO: 1395535 - RNA, 21 nt, Human
agaauucuguugauggaaaua

SEQ ID NO: 1395536 - RNA, 21 nt, Human
uacauaaaguaugugcauauu

SEQ ID NO: 1395537 - RNA, 20 nt, Human
acggacgaaccuugaaaacu

SEQ ID NO: 1395538 - RNA, 18 nt, Human
aaaagacaaggaaaaaau

SEQ ID NO: 1395539 - RNA, 19 nt, Human
cagaaagcagaacagugau

SEQ ID NO: 1395540 - RNA, 13 nt, Human
uauuucuaugaaa

SEQ ID NO: 1395541 - RNA, 21 nt, Human
uguccucaugagggcuggaug

SEQ ID NO: 1395542 - RNA, 22 nt, Human
uaaacuguaaagcuuugugcag

SEQ ID NO: 1395543 - RNA, 23 nt, Human
cccagcccuccuuaucaaaggac

SEQ ID NO: 1395544 - RNA, 16 nt, Human
auuccaccuacaugag

SEQ ID NO: 1395545 - RNA, 21 nt, Human
cuuccaggcuggcgugcagca

SEQ ID NO: 1395546 - RNA, 19 nt, Human
ggagccugaucaccugccc

SEQ ID NO: 1395547 - RNA, 21 nt, Human
augucauuugcuggagcucug

SEQ ID NO: 1395548 - RNA, 19 nt, Human
caaguaaaaggaaaugcuc

SEQ ID NO: 1395549 - RNA, 18 nt, Human
ugaagaagcuagaaaaca

SEQ ID NO: 1395550 - RNA, 14 nt, Human
caaaugcauuucua

SEQ ID NO: 1395551 - RNA, 11 nt, Human
uuuuuuuaaaa

SEQ ID NO: 1395552 - RNA, 21 nt, Human
cuaagcuucacuguaaaauaa

SEQ ID NO: 1395553 - RNA, 15 nt, Human
uaacgauaaaagaca

SEQ ID NO: 1395554 - RNA, 23 nt, Human
caacggggugaaacccugucucu

SEQ ID NO: 1395555 - RNA, 21 nt, Human
gcacuguggguagacacacau

SEQ ID NO: 1395556 - RNA, 14 nt, Human
agaauauauuuccu

SEQ ID NO: 1395557 - RNA, 15 nt, Human
cagugaaagaaaaua

SEQ ID NO: 1395558 - RNA, 17 nt, Human
agcucugcccauccugc

SEQ ID NO: 1395559 - RNA, 21 nt, Human
gcucggccugcucgcccacuu

SEQ ID NO: 1395560 - RNA, 20 nt, Human
ugguuguauuauuuuuuaaa

SEQ ID NO: 1395561 - RNA, 18 nt, Human
accauuuuugaaaccaaa

SEQ ID NO: 1395562 - RNA, 18 nt, Human
ccugucacgugugggcaa

SEQ ID NO: 1395563 - RNA, 16 nt, Human
uuccgcauccuagucu

SEQ ID NO: 1395564 - RNA, 17 nt, Human
cugguggcgcuggcugc

SEQ ID NO: 1395565 - RNA, 21 nt, Human
ccgacggagccgggaaagaag

SEQ ID NO: 1395566 - RNA, 13 nt, Human
ccugccccccagc

SEQ ID NO: 1395567 - RNA, 19 nt, Human
uggaacaguuaccucugcc

SEQ ID NO: 1395568 - RNA, 14 nt, Human
uucuaugaaauauu

SEQ ID NO: 1395569 - RNA, 14 nt, Human
ggagcaucuccuca

SEQ ID NO: 1395570 - RNA, 16 nt, Human
uaagaaauaggaaaua

SEQ ID NO: 1395571 - RNA, 18 nt, Human
aguucuccacuagcuaug

SEQ ID NO: 1395572 - RNA, 22 nt, Human
auaucuuuuuuuuaauaaacca

SEQ ID NO: 1395573 - RNA, 15 nt, Human
ccuggugggcagaga

SEQ ID NO: 1395574 - RNA, 19 nt, Human
cauggccacaucugagccc

SEQ ID NO: 1395575 - RNA, 13 nt, Human
acacuuaaaaaug

SEQ ID NO: 1395576 - RNA, 13 nt, Human
aaauccuugaaga

SEQ ID NO: 1395577 - RNA, 18 nt, Human
gcagugucugcuggagac

SEQ ID NO: 1395578 - RNA, 15 nt, Human
ucaccagucccuccc

SEQ ID NO: 1395579 - RNA, 12 nt, Human
gcauccuagucu

SEQ ID NO: 1395580 - RNA, 17 nt, Human
agcuaaauauauauuuu

SEQ ID NO: 1395581 - RNA, 14 nt, Human
uacccccugggagc

SEQ ID NO: 1395582 - RNA, 22 nt, Human
agacucgggauuaguacacacu

SEQ ID NO: 1395583 - RNA, 20 nt, Human
agaagagccggagccuccag

SEQ ID NO: 1395584 - RNA, 21 nt, Human
aauuuacagagacagaaagca

SEQ ID NO: 1395585 - RNA, 12 nt, Human
cagauuuuccug

SEQ ID NO: 1395586 - RNA, 15 nt, Human
guuuuauuauauaua

SEQ ID NO: 1395587 - RNA, 20 nt, Human
aaggagccaaacauccuaca

SEQ ID NO: 1395588 - RNA, 18 nt, Human
aucuauguagaauauauu

SEQ ID NO: 1395589 - RNA, 18 nt, Human
uuuaguuauaaaaauaua

SEQ ID NO: 1395590 - RNA, 11 nt, Human
agaauauauuu

SEQ ID NO: 1395591 - RNA, 20 nt, Human
aucauuuaguuauaaaaaua

SEQ ID NO: 1395592 - RNA, 19 nt, Human
cagagucaagggugugugc

SEQ ID NO: 1395593 - RNA, 15 nt, Human
aauuuaucauuuagu

SEQ ID NO: 1395594 - RNA, 14 nt, Human
gaaacgaagcacca

SEQ ID NO: 1395595 - RNA, 12 nt, Human
cuguuaucuuca

SEQ ID NO: 1395596 - RNA, 13 nt, Human
uuuaaaaaaaaac

SEQ ID NO: 1395597 - RNA, 20 nt, Human
ugagucccaggcugagccuc

SEQ ID NO: 1395598 - RNA, 14 nt, Human
uucccgcuguuccu

SEQ ID NO: 1395599 - RNA, 15 nt, Human
auauugacuuuuuau

SEQ ID NO: 1395600 - RNA, 20 nt, Human
ucagaaggaaagaauaacca

SEQ ID NO: 1395601 - RNA, 16 nt, Human
gggccgacggagccgg

SEQ ID NO: 1395602 - RNA, 14 nt, Human
agaugcuagaacuc

SEQ ID NO: 1395603 - RNA, 21 nt, Human
uggggaauauguuagagaauu

SEQ ID NO: 1395604 - RNA, 22 nt, Human
aauaauccuaaacauaugaauu

SEQ ID NO: 1395605 - RNA, 12 nt, Human
auuauauuucca

SEQ ID NO: 1395606 - RNA, 20 nt, Human
aaucuuucacaggggacagg

SEQ ID NO: 1395607 - RNA, 13 nt, Human
acaauaaaagaca

SEQ ID NO: 1395608 - RNA, 19 nt, Human
acagucaccucauggaauu

SEQ ID NO: 1395609 - RNA, 15 nt, Human
ggaaauauuuuaaug

SEQ ID NO: 1395610 - RNA, 14 nt, Human
cuggccgggagccu

SEQ ID NO: 1395611 - RNA, 17 nt, Human
uagaauauauuuccuua

SEQ ID NO: 1395612 - RNA, 15 nt, Human
cccccagcccuccuu

SEQ ID NO: 1395613 - RNA, 16 nt, Human
gaaucacuugaacccg

SEQ ID NO: 1395614 - RNA, 16 nt, Human
ccgcauccuagucucu

SEQ ID NO: 1395615 - RNA, 23 nt, Human
aaagcccagcuugaaaccuucac

SEQ ID NO: 1395616 - RNA, 12 nt, Human
aauuuaaauaua

SEQ ID NO: 1395617 - RNA, 18 nt, Human
auguuucauaagaauucu

SEQ ID NO: 1395618 - RNA, 16 nt, Human
ucuucucagaaggaaa

SEQ ID NO: 1395619 - RNA, 16 nt, Human
ccugagaccaaggccc

SEQ ID NO: 1395620 - RNA, 19 nt, Human
ggccugcucgcccacuucc

SEQ ID NO: 1395621 - RNA, 14 nt, Human
augggccauaugaa

SEQ ID NO: 1395622 - RNA, 20 nt, Human
uauuuauuacuguaagaaaa

SEQ ID NO: 1395623 - RNA, 23 nt, Human
auaaaguaugugcauauuuuauu

SEQ ID NO: 1395624 - RNA, 19 nt, Human
ugaucaccugcccugcuga

SEQ ID NO: 1395625 - RNA, 21 nt, Human
auauaugcuaagucuuauaua

SEQ ID NO: 1395626 - RNA, 23 nt, Human
uacuuccagggcuacgcgcgcuc

SEQ ID NO: 1395627 - RNA, 16 nt, Human
accuccuaagaaggca

SEQ ID NO: 1395628 - RNA, 20 nt, Human
aacaaugcuguauuuuaaaa

SEQ ID NO: 1395629 - RNA, 14 nt, Human
cgcuccgcgcagcu

SEQ ID NO: 1395630 - RNA, 15 nt, Human
uccgcauccuagucu

SEQ ID NO: 1395631 - RNA, 17 nt, Human
ugaccacugcagaagac

SEQ ID NO: 1395632 - RNA, 19 nt, Human
uggggcuuuaacuccugcu

SEQ ID NO: 1395633 - RNA, 13 nt, Human
ucugcagcuucca

SEQ ID NO: 1395634 - RNA, 22 nt, Human
gagucaagggugugugcagcau

SEQ ID NO: 1395635 - RNA, 13 nt, Human
aucauuaaaguuc

SEQ ID NO: 1395636 - RNA, 22 nt, Human
uauuucagauaaucacaauaca

SEQ ID NO: 1395637 - RNA, 18 nt, Human
acauuuauauuuuuguga

SEQ ID NO: 1395638 - RNA, 14 nt, Human
uuuguauaaaauaa

SEQ ID NO: 1395639 - RNA, 21 nt, Human
cacuugaacccgggaggcaga

SEQ ID NO: 1395640 - RNA, 23 nt, Human
aaccugccagcuggccuugugag

SEQ ID NO: 1395641 - RNA, 18 nt, Human
acauguuacaacacggac

SEQ ID NO: 1395642 - RNA, 19 nt, Human
accuccuaagaaggcaccu

SEQ ID NO: 1395643 - RNA, 16 nt, Human
agugaaggauuuaugu

SEQ ID NO: 1395644 - RNA, 21 nt, Human
ugccuaggcauagcccugccu

SEQ ID NO: 1395645 - RNA, 14 nt, Human
agggcuaauaucuu

SEQ ID NO: 1395646 - RNA, 16 nt, Human
aaauaguuuaugauuc

SEQ ID NO: 1395647 - RNA, 12 nt, Human
agugcagccccg

SEQ ID NO: 1395648 - RNA, 14 nt, Human
ggaaucuuguaaag

SEQ ID NO: 1395649 - RNA, 17 nt, Human
caauaacgauaaaagac

SEQ ID NO: 1395650 - RNA, 24 nt, Human
cuggcuaauuagcauggccacauc

SEQ ID NO: 1395651 - RNA, 21 nt, Human
aaagcugaaauggacuuuugu

SEQ ID NO: 1395652 - RNA, 15 nt, Human
uguuaucuucacuuu

SEQ ID NO: 1395653 - RNA, 18 nt, Human
auggaaguaaauguuguu

SEQ ID NO: 1395654 - RNA, 22 nt, Human
gagucccaggcugagccucagu

SEQ ID NO: 1395655 - RNA, 14 nt, Human
auauuugaaauauu

SEQ ID NO: 1395656 - RNA, 15 nt, Human
uccacaaguaaaagg

SEQ ID NO: 1395657 - RNA, 21 nt, Human
ugcccauccugccccugagcc

SEQ ID NO: 1395658 - RNA, 15 nt, Human
cacuuccucccggcc

SEQ ID NO: 1395659 - RNA, 14 nt, Human
cggggagcgagccc

SEQ ID NO: 1395660 - RNA, 21 nt, Human
uuccuagucuguuuucccucc

SEQ ID NO: 1395661 - RNA, 18 nt, Human
cuuuccaugaguugcagu

SEQ ID NO: 1395662 - RNA, 11 nt, Human
ugggggcagca

SEQ ID NO: 1395663 - RNA, 21 nt, Human
augcuacaggauuugaaauug

SEQ ID NO: 1395664 - RNA, 16 nt, Human
cuacacuccagugaga

SEQ ID NO: 1395665 - RNA, 19 nt, Human
acuauuauauuuccaagaa

SEQ ID NO: 1395666 - RNA, 22 nt, Human
ggcauuuaggccaugggacagg

SEQ ID NO: 1395667 - RNA, 15 nt, Human
uugacacuuaaaaau

SEQ ID NO: 1395668 - RNA, 23 nt, Human
auuucugagcauuuaauauggau

SEQ ID NO: 1395669 - RNA, 21 nt, Human
ucaagucuuucacauuuaaau

SEQ ID NO: 1395670 - RNA, 22 nt, Human
cgcgcagcucaggcuggcaccg

SEQ ID NO: 1395671 - RNA, 20 nt, Human
caucccuagaaagccaugug

SEQ ID NO: 1395672 - RNA, 18 nt, Human
uagcccuuccccucugca

SEQ ID NO: 1395673 - RNA, 13 nt, Human
auccugaggcucc

SEQ ID NO: 1395674 - RNA, 16 nt, Human
gacauuugcucaugga

SEQ ID NO: 1395675 - RNA, 16 nt, Human
cugagccucagucucc

SEQ ID NO: 1395676 - RNA, 16 nt, Human
agacauugaggcaggc

SEQ ID NO: 1395677 - RNA, 16 nt, Human
gcuucacuguaaaaua

SEQ ID NO: 1395678 - RNA, 12 nt, Human
gaaucuuguaaa

SEQ ID NO: 1395679 - RNA, 17 nt, Human
caaauauaaauaaaaau

SEQ ID NO: 1395680 - RNA, 22 nt, Human
acauccuacaagacacagugac

SEQ ID NO: 1395681 - RNA, 23 nt, Human
ggucucagugucaaugcagcccc

SEQ ID NO: 1395682 - RNA, 17 nt, Human
cgcucaucccacccgcc

SEQ ID NO: 1395683 - RNA, 13 nt, Human
gguccacaacaca

SEQ ID NO: 1395684 - RNA, 22 nt, Human
cuuccccucugcagcuuccagg

SEQ ID NO: 1395685 - RNA, 16 nt, Human
uuagagaauuuccuua

SEQ ID NO: 1395686 - RNA, 14 nt, Human
ucaaugcagccccc

SEQ ID NO: 1395687 - RNA, 12 nt, Human
uaagaagacugc

SEQ ID NO: 1395688 - RNA, 15 nt, Human
cauuuaguuauaaaa

SEQ ID NO: 1395689 - RNA, 20 nt, Human
ccugccuaagugcagccccg

SEQ ID NO: 1395690 - RNA, 18 nt, Human
ucucuaggaaauauuuau

SEQ ID NO: 1395691 - RNA, 15 nt, Human
cuggacucaccuccc

SEQ ID NO: 1395692 - RNA, 14 nt, Human
agacaucaacagau

SEQ ID NO: 1395693 - RNA, 17 nt, Human
caaacauauauaacaau

SEQ ID NO: 1395694 - RNA, 22 nt, Human
agaagcaccaaucaugaauuag

SEQ ID NO: 1395695 - RNA, 18 nt, Human
uuaucauuuaguuauaaa

SEQ ID NO: 1395696 - RNA, 19 nt, Human
aaugaauggcuaagcaaaa

SEQ ID NO: 1395697 - RNA, 21 nt, Human
ccuggugccucaccccuugcc

SEQ ID NO: 1395698 - RNA, 15 nt, Human
acaaggaaaaaauaa

SEQ ID NO: 1395699 - RNA, 21 nt, Human
caagacccaaaaggcagaagc

SEQ ID NO: 1395700 - RNA, 13 nt, Human
gauuguaaaaugg

SEQ ID NO: 1395701 - RNA, 19 nt, Human
aauuuuuauauuugaaaua

SEQ ID NO: 1395702 - RNA, 12 nt, Human
guaaaggcaaac

SEQ ID NO: 1395703 - RNA, 22 nt, Human
agccaaacauccuacaagacac

SEQ ID NO: 1395704 - RNA, 13 nt, Human
caccaaggagcca

SEQ ID NO: 1395705 - RNA, 14 nt, Human
cggagccuccagcu

SEQ ID NO: 1395706 - RNA, 16 nt, Human
uuauauuuccaagaaa

SEQ ID NO: 1395707 - RNA, 23 nt, Human
cagcaccuccuaagaaggcaccu

SEQ ID NO: 1395708 - RNA, 21 nt, Human
caggcacuaucuggguuuugg

SEQ ID NO: 1395709 - RNA, 17 nt, Human
gcagcaucagcaucccu

SEQ ID NO: 1395710 - RNA, 19 nt, Human
ugcuugucccuguggaagu

SEQ ID NO: 1395711 - RNA, 21 nt, Human
cucaguccaugaagauguaga

SEQ ID NO: 1395712 - RNA, 21 nt, Human
cuaccaaaaaucucaauauuu

SEQ ID NO: 1395713 - RNA, 14 nt, Human
acuaauuuuaaaau

SEQ ID NO: 1395714 - RNA, 20 nt, Human
auauauuuuuuuuuuuaaaa

SEQ ID NO: 1395715 - RNA, 22 nt, Human
uguucugauauuggacaguaaa

SEQ ID NO: 1395716 - RNA, 17 nt, Human
aaagcagggacuugaac

SEQ ID NO: 1395717 - RNA, 20 nt, Human
cuacuuccccuuccuaauuc

SEQ ID NO: 1395718 - RNA, 22 nt, Human
cucuggccuucggccuccaucc

SEQ ID NO: 1395719 - RNA, 14 nt, Human
cgagccccaggcgg

SEQ ID NO: 1395720 - RNA, 10 nt, Human
acuuccuccc

SEQ ID NO: 1395721 - RNA, 14 nt, Human
gaaggugaucuggc

SEQ ID NO: 1395722 - RNA, 21 nt, Human
aggacagcccuucuuuccaca

SEQ ID NO: 1395723 - RNA, 16 nt, Human
cccccagcccuccuua

SEQ ID NO: 1395724 - RNA, 16 nt, Human
uuaaauuguaauaggc

SEQ ID NO: 1395725 - RNA, 15 nt, Human
uagagaauuuccuua

SEQ ID NO: 1395726 - RNA, 14 nt, Human
gcgcccucuggcug

SEQ ID NO: 1395727 - RNA, 18 nt, Human
caugaauuaguuuuauau

SEQ ID NO: 1395728 - RNA, 20 nt, Human
caagccuccuuuuaaaguaa

SEQ ID NO: 1395729 - RNA, 23 nt, Human
auucugagguaaccucauuauca

SEQ ID NO: 1395730 - RNA, 22 nt, Human
gcuaaaacaagcacuaaacaaa

SEQ ID NO: 1395731 - RNA, 15 nt, Human
aaauauaaauaaaaa

SEQ ID NO: 1395732 - RNA, 17 nt, Human
ccaccugcugagcccca

SEQ ID NO: 1395733 - RNA, 22 nt, Human
cccacuuccucccggccgcgcu

SEQ ID NO: 1395734 - RNA, 23 nt, Human
gccugaguguugccuaauuuguu

SEQ ID NO: 1395735 - RNA, 18 nt, Human
gagucccaggcugagccu

SEQ ID NO: 1395736 - RNA, 13 nt, Human
ccaaaagguauuu

SEQ ID NO: 1395737 - RNA, 19 nt, Human
caacucccugccccccagc

SEQ ID NO: 1395738 - RNA, 18 nt, Human
cccacuggacucaccucc

SEQ ID NO: 1395739 - RNA, 19 nt, Human
aauuuuguuauguauauuu

SEQ ID NO: 1395740 - RNA, 15 nt, Human
uagaauauauuuccu

SEQ ID NO: 1395741 - RNA, 20 nt, Human
cccugccccccagcccuccu

SEQ ID NO: 1395742 - RNA, 16 nt, Human
cggagccuccagcugc

SEQ ID NO: 1395743 - RNA, 13 nt, Human
cacuuugaagagu

SEQ ID NO: 1395744 - RNA, 21 nt, Human
aagacaagaaggaaagauuuu

SEQ ID NO: 1395745 - RNA, 18 nt, Human
cagaaagcagaacaguga

SEQ ID NO: 1395746 - RNA, 16 nt, Human
cuagaaccaccugccu

SEQ ID NO: 1395747 - RNA, 18 nt, Human
cuuucacauuuaaauaaa

SEQ ID NO: 1395748 - RNA, 18 nt, Human
gaaacaaaaggauaauga

SEQ ID NO: 1395749 - RNA, 14 nt, Human
uuaugauuaaguaa

SEQ ID NO: 1395750 - RNA, 23 nt, Human
cucuugaggcacagaaacuccug

SEQ ID NO: 1395751 - RNA, 14 nt, Human
agucucccucccuu

SEQ ID NO: 1395752 - RNA, 15 nt, Human
auuugguaaggggaa

SEQ ID NO: 1395753 - RNA, 16 nt, Human
uugccauaauuacuau

SEQ ID NO: 1395754 - RNA, 13 nt, Human
ugaauauaaauuu

SEQ ID NO: 1395755 - RNA, 20 nt, Human
uuuaaauaaaguguuugaaa

SEQ ID NO: 1395756 - RNA, 14 nt, Human
cuucucuucacagu

SEQ ID NO: 1395757 - RNA, 14 nt, Human
ccaccugcugagcc

SEQ ID NO: 1395758 - RNA, 14 nt, Human
cuggagcucugccc

SEQ ID NO: 1395759 - RNA, 16 nt, Human
guuccuuccucugagc

SEQ ID NO: 1395760 - RNA, 22 nt, Human
ccccuuccuaauuccacagcug

SEQ ID NO: 1395761 - RNA, 15 nt, Human
guucugcagauaaac

SEQ ID NO: 1395762 - RNA, 16 nt, Human
cucgccacgcucuggg

SEQ ID NO: 1395763 - RNA, 20 nt, Human
gggagccccaauucgauccc

SEQ ID NO: 1395764 - RNA, 17 nt, Human
aggguguguaaguagau

SEQ ID NO: 1395765 - RNA, 18 nt, Human
agagaaugagagacacac

SEQ ID NO: 1395766 - RNA, 16 nt, Human
ccacuuccucccggcc

SEQ ID NO: 1395767 - RNA, 13 nt, Human
auccuagucucua

SEQ ID NO: 1395768 - RNA, 19 nt, Human
ucaguuauuauauuuacaa

SEQ ID NO: 1395769 - RNA, 14 nt, Human
cccugccccccagc

SEQ ID NO: 1395770 - RNA, 19 nt, Human
cuccucggacggcuccgga

SEQ ID NO: 1395771 - RNA, 15 nt, Human
agacagcucugcaua

SEQ ID NO: 1395772 - RNA, 17 nt, Human
gugggauacuauuuaau

SEQ ID NO: 1395773 - RNA, 12 nt, Human
aagagcuuaaca

SEQ ID NO: 1395774 - RNA, 14 nt, Human
agaaauaggaaaua

SEQ ID NO: 1395775 - RNA, 22 nt, Human
augguuguauuauuuuuuaaaa

SEQ ID NO: 1395776 - RNA, 15 nt, Human
cuucaacucccugcc

SEQ ID NO: 1395777 - RNA, 15 nt, Human
auuucacuuuagaaa

SEQ ID NO: 1395778 - RNA, 19 nt, Human
aagccaugugcagccacca

SEQ ID NO: 1395779 - RNA, 15 nt, Human
aucaaaggacaccau

SEQ ID NO: 1395780 - RNA, 19 nt, Human
caucaaggguacacugccu

SEQ ID NO: 1395781 - RNA, 21 nt, Human
gcgcucggccugcucgcccac

SEQ ID NO: 1395782 - RNA, 12 nt, Human
aucuucacuuuu

SEQ ID NO: 1395783 - RNA, 21 nt, Human
augugcauauuuuauuauagu

SEQ ID NO: 1395784 - RNA, 20 nt, Human
uauguccuuggugccuggag

SEQ ID NO: 1395785 - RNA, 14 nt, Human
cucaggcuggcacc

SEQ ID NO: 1395786 - RNA, 21 nt, Human
cccccucuccucucuuccucc

SEQ ID NO: 1395787 - RNA, 20 nt, Human
aaaacuuauccuccaugaau

SEQ ID NO: 1395788 - RNA, 14 nt, Human
agcucguggaacag

SEQ ID NO: 1395789 - RNA, 14 nt, Human
auuuuaucugcuau

SEQ ID NO: 1395790 - RNA, 22 nt, Human
caugaguaacugauuuguaaca

SEQ ID NO: 1395791 - RNA, 13 nt, Human
aagacaaggaaaa

SEQ ID NO: 1395792 - RNA, 17 nt, Human
uguaaaggaauuuaaaa

SEQ ID NO: 1395793 - RNA, 13 nt, Human
aggcauagcccug

SEQ ID NO: 1395794 - RNA, 19 nt, Human
gagcucaccagucccuccc

SEQ ID NO: 1395795 - RNA, 15 nt, Human
aguaugugcauauuu

SEQ ID NO: 1395796 - RNA, 14 nt, Human
ucucagaaggaaag

SEQ ID NO: 1395797 - RNA, 22 nt, Human
auuuucuucucacauuuauauu

SEQ ID NO: 1395798 - RNA, 19 nt, Human
aauguuuacagauccccaa

SEQ ID NO: 1395799 - RNA, 15 nt, Human
ucuugaggcacagaa

SEQ ID NO: 1395800 - RNA, 12 nt, Human
aaaagaaagaaa

SEQ ID NO: 1395801 - RNA, 15 nt, Human
ucccacccgcccacc

SEQ ID NO: 1395802 - RNA, 16 nt, Human
cacgggggccaaggau

SEQ ID NO: 1395803 - RNA, 18 nt, Human
uguugcagugucugcugg

SEQ ID NO: 1395804 - RNA, 22 nt, Human
aaagggcauggguuuuauuaua

SEQ ID NO: 1395805 - RNA, 13 nt, Human
cugcacuccagcc

SEQ ID NO: 1395806 - RNA, 21 nt, Human
ugaccauacuaauuauacccc

SEQ ID NO: 1395807 - RNA, 15 nt, Human
gucccaggcugagcc

SEQ ID NO: 1395808 - RNA, 21 nt, Human
caucccacccgcccaccgcag

SEQ ID NO: 1395809 - RNA, 17 nt, Human
ugaaaaucuuauaauuu

SEQ ID NO: 1395810 - RNA, 15 nt, Human
cgcgcugcgcgccgc

SEQ ID NO: 1395811 - RNA, 17 nt, Human
auuuaguuauaaaaaua

SEQ ID NO: 1395812 - RNA, 14 nt, Human
cagagucaagggug

SEQ ID NO: 1395813 - RNA, 21 nt, Human
auuauauggcuugaguuuaaa

SEQ ID NO: 1395814 - RNA, 13 nt, Human
gagacagcucugc

SEQ ID NO: 1395815 - RNA, 11 nt, Human
ugugugcagca

SEQ ID NO: 1395816 - RNA, 19 nt, Human
agguaaccucauuaucagu

SEQ ID NO: 1395817 - RNA, 21 nt, Human
ugaacaaauuuacagagacag

SEQ ID NO: 1395818 - RNA, 14 nt, Human
acauagugaggagc

SEQ ID NO: 1395819 - RNA, 22 nt, Human
uuuauugaggcuuuaaaacuua

SEQ ID NO: 1395820 - RNA, 12 nt, Human
cccccagcccuc

SEQ ID NO: 1395821 - RNA, 19 nt, Human
aaacaauaacgauaaaaga

SEQ ID NO: 1395822 - RNA, 17 nt, Human
agauagaugaagaagcu

SEQ ID NO: 1395823 - RNA, 21 nt, Human
acugccaaaacaucaaccugc

SEQ ID NO: 1395824 - RNA, 15 nt, Human
ggccugagaccaagg

SEQ ID NO: 1395825 - RNA, 22 nt, Human
uccaugaguugcaguuuuuucc

SEQ ID NO: 1395826 - RNA, 18 nt, Human
gcgcuggcugcgcucggc

SEQ ID NO: 1395827 - RNA, 20 nt, Human
caaauguucaucaaugaaug

SEQ ID NO: 1395828 - RNA, 17 nt, Human
augccccgucccccucu

SEQ ID NO: 1395829 - RNA, 17 nt, Human
aaggugaucuggcucug

SEQ ID NO: 1395830 - RNA, 22 nt, Human
acuuugauuuuauaugcuauuu

SEQ ID NO: 1395831 - RNA, 14 nt, Human
cgucccccucuggc

SEQ ID NO: 1395832 - RNA, 18 nt, Human
ccaaccuggaguugaaaa

SEQ ID NO: 1395833 - RNA, 15 nt, Human
ucuuauaauuuaaaa

SEQ ID NO: 1395834 - RNA, 21 nt, Human
cuauguucuaagaagugaaaa

SEQ ID NO: 1395835 - RNA, 23 nt, Human
guuguaauuuuuuugugggaaau

SEQ ID NO: 1395836 - RNA, 21 nt, Human
acagugaaagaaaauaacaau

SEQ ID NO: 1395837 - RNA, 19 nt, Human
gccugaucaccugcccugc

SEQ ID NO: 1395838 - RNA, 17 nt, Human
agaugggagaaucacuu

SEQ ID NO: 1395839 - RNA, 17 nt, Human
aguaaaaggaaaugcuc

SEQ ID NO: 1395840 - RNA, 16 nt, Human
uauuuuaauguuucuu

SEQ ID NO: 1395841 - RNA, 13 nt, Human
uuuauuauauaua

SEQ ID NO: 1395842 - RNA, 21 nt, Human
uacuucccgcuguuccucgcc

SEQ ID NO: 1395843 - RNA, 19 nt, Human
gaaaaugucauuguucuug

SEQ ID NO: 1395844 - RNA, 22 nt, Human
guacacugccuucucaacucca

SEQ ID NO: 1395845 - RNA, 17 nt, Human
guggcucugugugcucu

SEQ ID NO: 1395846 - RNA, 14 nt, Human
cugaacccagggaa

SEQ ID NO: 1395847 - RNA, 12 nt, Human
uuaauaaaccau

SEQ ID NO: 1395848 - RNA, 15 nt, Human
acaucaacagauaaa

SEQ ID NO: 1395849 - RNA, 23 nt, Human
acucuauguucuaagaagugaaa

SEQ ID NO: 1395850 - RNA, 16 nt, Human
gacaaggaaaaaauaa

SEQ ID NO: 1395851 - RNA, 23 nt, Human
ucggccuccauccugaggcucca

SEQ ID NO: 1395852 - RNA, 20 nt, Human
cagcuggccgggagccugau

SEQ ID NO: 1395853 - RNA, 14 nt, Human
cagucucccucccu

SEQ ID NO: 1395854 - RNA, 19 nt, Human
cuaguaucaaaagaaagaa

SEQ ID NO: 1395855 - RNA, 21 nt, Human
aaagaaaauaacgauaaaaga

SEQ ID NO: 1395856 - RNA, 20 nt, Human
ugagagugaacaaauuuaca

SEQ ID NO: 1395857 - RNA, 14 nt, Human
cuggaaaucagggu

SEQ ID NO: 1395858 - RNA, 15 nt, Human
ugaaacccugucucu

SEQ ID NO: 1395859 - RNA, 14 nt, Human
cauggccacaucug

SEQ ID NO: 1395860 - RNA, 18 nt, Human
auggccacaucugagccc

SEQ ID NO: 1395861 - RNA, 19 nt, Human
cccccucuggcuccagcug

SEQ ID NO: 1395862 - RNA, 10 nt, Human
uuuuuaaaaa

SEQ ID NO: 1395863 - RNA, 12 nt, Human
ccaggcugagcc

SEQ ID NO: 1395864 - RNA, 21 nt, Human
uaguauuucuaugaaauauua

SEQ ID NO: 1395865 - RNA, 20 nt, Human
ucauucacucaacaaacaua

SEQ ID NO: 1395866 - RNA, 20 nt, Human
gcccauccugccccugagcc

SEQ ID NO: 1395867 - RNA, 23 nt, Human
agaaugauuaugaauuacauuug

SEQ ID NO: 1395868 - RNA, 16 nt, Human
ccucaaaacuucagac

SEQ ID NO: 1395869 - RNA, 16 nt, Human
gcaucccuagaaagcc

SEQ ID NO: 1395870 - RNA, 23 nt, Human
uagacacacaugaaguccaagca

SEQ ID NO: 1395871 - RNA, 19 nt, Human
aaaacguauugcauuuaau

SEQ ID NO: 1395872 - RNA, 19 nt, Human
auuucuucaacucccugcc

SEQ ID NO: 1395873 - RNA, 18 nt, Human
gcauggccacaucugagc

SEQ ID NO: 1395874 - RNA, 19 nt, Human
acugccaucauuuacuuuu

SEQ ID NO: 1395875 - RNA, 12 nt, Human
cucuaucauuaa

SEQ ID NO: 1395876 - RNA, 18 nt, Human
agauauuaacugagaagg

SEQ ID NO: 1395877 - RNA, 16 nt, Human
uuuauauuugaaauau

SEQ ID NO: 1395878 - RNA, 17 nt, Human
auaaaguaugugcauau

SEQ ID NO: 1395879 - RNA, 22 nt, Human
aaaaaaccugagccccaaaagg

SEQ ID NO: 1395880 - RNA, 15 nt, Human
uuuaauaauuuuuaa

SEQ ID NO: 1395881 - RNA, 13 nt, Human
agccuccagcugc

SEQ ID NO: 1395882 - RNA, 13 nt, Human
guuuaaguucuau

SEQ ID NO: 1395883 - RNA, 14 nt, Human
ucuccucaacucug

SEQ ID NO: 1395884 - RNA, 17 nt, Human
aguugauaaguacauga

SEQ ID NO: 1395885 - RNA, 13 nt, Human
ugaaagaaaauaa

SEQ ID NO: 1395886 - RNA, 22 nt, Human
agaugaucaguaugaaaauguc

SEQ ID NO: 1395887 - RNA, 22 nt, Human
aucuauguagaauauauuuccu

SEQ ID NO: 1395888 - RNA, 18 nt, Human
cagucucccucccuuggg

SEQ ID NO: 1395889 - RNA, 14 nt, Human
aggggaccagagag

SEQ ID NO: 1395890 - RNA, 16 nt, Human
agccucagucucccuc

SEQ ID NO: 1395891 - RNA, 13 nt, Human
caucugagccccg

SEQ ID NO: 1395892 - RNA, 21 nt, Human
gcgccgcgcuccucggacggc

SEQ ID NO: 1395893 - RNA, 19 nt, Human
aggucuaccaaaaaucuca

SEQ ID NO: 1395894 - RNA, 21 nt, Human
uuuucaggcuagauguaugua

SEQ ID NO: 1395895 - RNA, 21 nt, Human
ccggccuuugcaccuccaugg

SEQ ID NO: 1395896 - RNA, 12 nt, Human
cugaggagcugu

SEQ ID NO: 1395897 - RNA, 17 nt, Human
aauaacgauaaaagaca

SEQ ID NO: 1395898 - RNA, 15 nt, Human
aagccaugugcagcc

SEQ ID NO: 1395899 - RNA, 18 nt, Human
cagagacagaaagcagaa

SEQ ID NO: 1395900 - RNA, 14 nt, Human
uaauccuaaacaua

SEQ ID NO: 1395901 - RNA, 16 nt, Human
gacaagcucacagacc

SEQ ID NO: 1395902 - RNA, 21 nt, Human
cuagucuguuuucccuccuug

SEQ ID NO: 1395903 - RNA, 17 nt, Human
acacuguuaucuucacu

SEQ ID NO: 1395904 - RNA, 14 nt, Human
auugucuagugaaa

SEQ ID NO: 1395905 - RNA, 18 nt, Human
aauccacacugagcugag

SEQ ID NO: 1395906 - RNA, 20 nt, Human
auuuugugauugauuauaug

SEQ ID NO: 1395907 - RNA, 19 nt, Human
cuucuggguuccuuccucu

SEQ ID NO: 1395908 - RNA, 17 nt, Human
uugccaaauauaaauaa

SEQ ID NO: 1395909 - RNA, 17 nt, Human
aaauauaaauaaaaaua

SEQ ID NO: 1395910 - RNA, 20 nt, Human
ugaggcuccacuuggucugu

SEQ ID NO: 1395911 - RNA, 22 nt, Human
cucagcccuggugggcagagag

SEQ ID NO: 1395912 - RNA, 21 nt, Human
caccagucugacuguuuccau

SEQ ID NO: 1395913 - RNA, 22 nt, Human
aaacguauucaaacaauuugaa

SEQ ID NO: 1395914 - RNA, 17 nt, Human
ccuacuuccccuuccua

SEQ ID NO: 1395915 - RNA, 19 nt, Human
auuuuagauagaugaagaa

SEQ ID NO: 1395916 - RNA, 14 nt, Human
ggcuccagcuggcc

SEQ ID NO: 1395917 - RNA, 21 nt, Human
uaggugacuauuauauuucca

SEQ ID NO: 1395918 - RNA, 16 nt, Human
cuucggccuccauccu

SEQ ID NO: 1395919 - RNA, 17 nt, Human
augauuaaguaaugaua

SEQ ID NO: 1395920 - RNA, 21 nt, Human
cucaagcuaugugagcucacc

SEQ ID NO: 1395921 - RNA, 16 nt, Human
cuccauccugaggcuc

SEQ ID NO: 1395922 - RNA, 18 nt, Human
ugcagugucugcuggaga

SEQ ID NO: 1395923 - RNA, 15 nt, Human
uuacagagacagaaa

SEQ ID NO: 1395924 - RNA, 17 nt, Human
cccggccggcgcgcuca

SEQ ID NO: 1395925 - RNA, 11 nt, Human
ggggaggggcg

SEQ ID NO: 1395926 - RNA, 18 nt, Human
auuuuagacauucuuuau

SEQ ID NO: 1395927 - RNA, 17 nt, Human
cuaucucauuuccaagc

SEQ ID NO: 1395928 - RNA, 15 nt, Human
cgcucggccugcucg

SEQ ID NO: 1395929 - RNA, 22 nt, Human
cgcgcgccuccgcuacuuccag

SEQ ID NO: 1395930 - RNA, 14 nt, Human
aaauuuaucauuua

SEQ ID NO: 1395931 - RNA, 16 nt, Human
aagacugcacaucaaa

SEQ ID NO: 1395932 - RNA, 17 nt, Human
cagacaucaacagauaa

SEQ ID NO: 1395933 - RNA, 22 nt, Human
cuggugucuucaggggccacac

SEQ ID NO: 1395934 - RNA, 22 nt, Human
cacuaguauuucuaugaaauau

SEQ ID NO: 1395935 - RNA, 19 nt, Human
cuaagcuucacuguaaaau

SEQ ID NO: 1395936 - RNA, 13 nt, Human
aaguaaaggcaaa

SEQ ID NO: 1395937 - RNA, 19 nt, Human
acuccuguucaugcccaua

SEQ ID NO: 1395938 - RNA, 19 nt, Human
cauggaauuggagcucgug

SEQ ID NO: 1395939 - RNA, 15 nt, Human
ccugcaaagcccagc

SEQ ID NO: 1395940 - RNA, 11 nt, Human
agugucugcug

SEQ ID NO: 1395941 - RNA, 15 nt, Human
aagccuggcaaggga

SEQ ID NO: 1395942 - RNA, 21 nt, Human
ugaaacgaggauugggaaaaa

SEQ ID NO: 1395943 - RNA, 18 nt, Human
uuuugugaagcaaaauuu

SEQ ID NO: 1395944 - RNA, 20 nt, Human
ggccaugggacagggaggac

SEQ ID NO: 1395945 - RNA, 16 nt, Human
cauuucuaaagccauu

SEQ ID NO: 1395946 - RNA, 20 nt, Human
cugcucgcccacuuccuccc

SEQ ID NO: 1395947 - RNA, 20 nt, Human
cugucacgugugggcaaugu

SEQ ID NO: 1395948 - RNA, 23 nt, Human
accuccauggaaacgaagcacca

SEQ ID NO: 1395949 - RNA, 19 nt, Human
caagaaggaaagauuuugu

SEQ ID NO: 1395950 - RNA, 13 nt, Human
ugggaggcugaga

SEQ ID NO: 1395951 - RNA, 20 nt, Human
uccuccaugaauaucaguua

SEQ ID NO: 1395952 - RNA, 16 nt, Human
uaaaauccauacauuu

SEQ ID NO: 1395953 - RNA, 17 nt, Human
auguuucauaagaauuc

SEQ ID NO: 1395954 - RNA, 20 nt, Human
gccgggcgugguggugagug

SEQ ID NO: 1395955 - RNA, 19 nt, Human
ccucucuuccucccuggaa

SEQ ID NO: 1395956 - RNA, 16 nt, Human
gaaguaucuugguugu

SEQ ID NO: 1395957 - RNA, 22 nt, Human
uauuucuaugaaauauuauguu

SEQ ID NO: 1395958 - RNA, 19 nt, Human
acuucccgcuguuccucgc

SEQ ID NO: 1395959 - RNA, 21 nt, Human
auccccaagccuggcaaggga

SEQ ID NO: 1395960 - RNA, 15 nt, Human
gccuugggaccccug

SEQ ID NO: 1395961 - RNA, 17 nt, Human
augaauaucaguuauuu

SEQ ID NO: 1395962 - RNA, 18 nt, Human
ugcucgcccacuuccucc

SEQ ID NO: 1395963 - RNA, 19 nt, Human
cuggacucaccucccccau

SEQ ID NO: 1395964 - RNA, 20 nt, Human
ucuucuggguuccuuccucu

SEQ ID NO: 1395965 - RNA, 14 nt, Human
aucaguuauuuuua

SEQ ID NO: 1395966 - RNA, 21 nt, Human
ccuaauuuguuuucccuucuu

SEQ ID NO: 1395967 - RNA, 17 nt, Human
ccaaaagguauuuuaau

SEQ ID NO: 1395968 - RNA, 14 nt, Human
uauuuauuuuaaua

SEQ ID NO: 1395969 - RNA, 22 nt, Human
cucugagccuugggaccccuga

SEQ ID NO: 1395970 - RNA, 23 nt, Human
aguacucauacauguuacaacac

SEQ ID NO: 1395971 - RNA, 13 nt, Human
cgagccccaggcg

SEQ ID NO: 1395972 - RNA, 16 nt, Human
uccucacuuugaagag

SEQ ID NO: 1395973 - RNA, 14 nt, Human
uauauuuccuuauu

SEQ ID NO: 1395974 - RNA, 17 nt, Human
cugagcgacagugagac

SEQ ID NO: 1395975 - RNA, 20 nt, Human
ccagcuggccgggagccuga

SEQ ID NO: 1395976 - RNA, 19 nt, Human
agacagugaaagaaaauaa

SEQ ID NO: 1395977 - RNA, 17 nt, Human
guuuaauucugaaagca

SEQ ID NO: 1395978 - RNA, 16 nt, Human
cugcgcgccgcgcucc

SEQ ID NO: 1395979 - RNA, 13 nt, Human
uaagugcagcccc

SEQ ID NO: 1395980 - RNA, 17 nt, Human
cucugauccgagcucag

SEQ ID NO: 1395981 - RNA, 14 nt, Human
auuguccaggucua

SEQ ID NO: 1395982 - RNA, 16 nt, Human
uggcaauugacuauag

SEQ ID NO: 1395983 - RNA, 19 nt, Human
gcacacagcacgggggcca

SEQ ID NO: 1395984 - RNA, 18 nt, Human
aaacugccaucauuuacu

SEQ ID NO: 1395985 - RNA, 14 nt, Human
uauaauuuaaaaua

SEQ ID NO: 1395986 - RNA, 14 nt, Human
auuauuuuuuaaaa

SEQ ID NO: 1395987 - RNA, 21 nt, Human
gcuccgcgcagcucaggcugg

SEQ ID NO: 1395988 - RNA, 12 nt, Human
aaaugaaagcag

SEQ ID NO: 1395989 - RNA, 20 nt, Human
agcauuguuggcuguuccug

SEQ ID NO: 1395990 - RNA, 14 nt, Human
auauauuuuagaua

SEQ ID NO: 1395991 - RNA, 19 nt, Human
guuauuauauuuacaaaug

SEQ ID NO: 1395992 - RNA, 15 nt, Human
cccugagguugugug

SEQ ID NO: 1395993 - RNA, 12 nt, Human
caaccugccagc

SEQ ID NO: 1395994 - RNA, 21 nt, Human
caaggaaaaaauaacaaugaa

SEQ ID NO: 1395995 - RNA, 15 nt, Human
cagcgaguacuuccc

SEQ ID NO: 1395996 - RNA, 18 nt, Human
ugagcucagcccuggugg

SEQ ID NO: 1395997 - RNA, 21 nt, Human
cccuagaaagccaugugcagc

SEQ ID NO: 1395998 - RNA, 13 nt, Human
agaauauauuucc

SEQ ID NO: 1395999 - RNA, 14 nt, Human
acaagagcuuaaca

SEQ ID NO: 1396000 - RNA, 19 nt, Human
gagguacugagagugaaca

SEQ ID NO: 1396001 - RNA, 12 nt, Human
acccccugggag

SEQ ID NO: 1396002 - RNA, 13 nt, Human
uauauuuuagaua

SEQ ID NO: 1396003 - RNA, 21 nt, Human
agucacuaguuguaauuuuuu

SEQ ID NO: 1396004 - RNA, 22 nt, Human
cggagccgggaaagaagagccg

SEQ ID NO: 1396005 - RNA, 16 nt, Human
ggggcagcaccuccua

SEQ ID NO: 1396006 - RNA, 22 nt, Human
ucugguagcuaaauauauauuu

SEQ ID NO: 1396007 - RNA, 16 nt, Human
agugucaaugcagccc

SEQ ID NO: 1396008 - RNA, 18 nt, Human
uucucuaggaaauauuua

SEQ ID NO: 1396009 - RNA, 22 nt, Human
uaucuauguagaauauauuucc

SEQ ID NO: 1396010 - RNA, 14 nt, Human
cuacaagacacagu

SEQ ID NO: 1396011 - RNA, 21 nt, Human
acucauuaaauggaaguaaau

SEQ ID NO: 1396012 - RNA, 20 nt, Human
caagcucuaucaccaaggag

SEQ ID NO: 1396013 - RNA, 11 nt, Human
uuauauuucca

SEQ ID NO: 1396014 - RNA, 16 nt, Human
ucagucucccucccuu

SEQ ID NO: 1396015 - RNA, 21 nt, Human
cuuucaugaaggggcggcggc

SEQ ID NO: 1396016 - RNA, 19 nt, Human
aaagacagugaaagaaaau

SEQ ID NO: 1396017 - RNA, 14 nt, Human
uuucuaugaaauau

SEQ ID NO: 1396018 - RNA, 11 nt, Human
ucaccugcccu

SEQ ID NO: 1396019 - RNA, 16 nt, Human
acggagccgggaaaga

SEQ ID NO: 1396020 - RNA, 14 nt, Human
cauuaaaguucuag

SEQ ID NO: 1396021 - RNA, 21 nt, Human
gcaggaccaucccggccggcg

SEQ ID NO: 1396022 - RNA, 13 nt, Human
uguuuucccuccu

SEQ ID NO: 1396023 - RNA, 20 nt, Human
ggguuccuuccucugagccu

SEQ ID NO: 1396024 - RNA, 18 nt, Human
uacauuuguauaaaauaa

SEQ ID NO: 1396025 - RNA, 23 nt, Human
ugucuucaggggccacaccaacc

SEQ ID NO: 1396026 - RNA, 23 nt, Human
ugauguuucauaagaauucuguu

SEQ ID NO: 1396027 - RNA, 22 nt, Human
agcuuguauuccuuuuucucuc

SEQ ID NO: 1396028 - RNA, 14 nt, Human
uauaaauaaaaaua

SEQ ID NO: 1396029 - RNA, 18 nt, Human
gccggagccuccagcugc

SEQ ID NO: 1396030 - RNA, 20 nt, Human
gagccucagucucccucccu

SEQ ID NO: 1396031 - RNA, 11 nt, Human
acuuugaagag

SEQ ID NO: 1396032 - RNA, 17 nt, Human
gacagugaaagaaaaua

SEQ ID NO: 1396033 - RNA, 15 nt, Human
cuaagcaaaauguga

SEQ ID NO: 1396034 - RNA, 16 nt, Human
acuaguuucccuugca

SEQ ID NO: 1396035 - RNA, 15 nt, Human
augugcagccaccag

SEQ ID NO: 1396036 - RNA, 20 nt, Human
guccccuauccuacuucccc

SEQ ID NO: 1396037 - RNA, 22 nt, Human
uuccccuuccuaauuccacagc

SEQ ID NO: 1396038 - RNA, 19 nt, Human
aaaguaugugcauauuuua

SEQ ID NO: 1396039 - RNA, 21 nt, Human
cuaguaucaaaagaaagaaaa

SEQ ID NO: 1396040 - RNA, 13 nt, Human
ucuuauaauuuaa

SEQ ID NO: 1396041 - RNA, 22 nt, Human
ugaauuguaggugacuauuaua

SEQ ID NO: 1396042 - RNA, 22 nt, Human
guggcgcuggcugcgcucggcc

SEQ ID NO: 1396043 - RNA, 14 nt, Human
ccaaugaaaugagu

SEQ ID NO: 1396044 - RNA, 22 nt, Human
auaacaaugcuguauuuuaaaa

SEQ ID NO: 1396045 - RNA, 21 nt, Human
cagagguccacaacacacaga

SEQ ID NO: 1396046 - RNA, 23 nt, Human
gcuggcgugcagcaucagcaucc

SEQ ID NO: 1396047 - RNA, 13 nt, Human
uggcuccagcugg

SEQ ID NO: 1396048 - RNA, 17 nt, Human
ugaucaccugcccugcu

SEQ ID NO: 1396049 - RNA, 19 nt, Human
uguuaucuucacuuuuaua

SEQ ID NO: 1396050 - RNA, 21 nt, Human
agaagcuagaaaacaggcaaa

SEQ ID NO: 1396051 - RNA, 18 nt, Human
ugcauagguuuaauaauu

SEQ ID NO: 1396052 - RNA, 15 nt, Human
agcaccaucauuccc

SEQ ID NO: 1396053 - RNA, 24 nt, Human
ugucuugaauuguaggugacuauu

SEQ ID NO: 1396054 - RNA, 18 nt, Human
uuuuaaaaaagaaacauu

SEQ ID NO: 1396055 - RNA, 14 nt, Human
auuuauuaaguauu

SEQ ID NO: 1396056 - RNA, 21 nt, Human
accagagccugaguguugccu

SEQ ID NO: 1396057 - RNA, 20 nt, Human
cucgcccacuuccucccggc

SEQ ID NO: 1396058 - RNA, 18 nt, Human
augggggcagcaccuccu

SEQ ID NO: 1396059 - RNA, 20 nt, Human
uaaaacaagcacuaaacaaa

SEQ ID NO: 1396060 - RNA, 19 nt, Human
gcacuaguauuucuaugaa

SEQ ID NO: 1396061 - RNA, 14 nt, Human
cucgcccacuuccu

SEQ ID NO: 1396062 - RNA, 14 nt, Human
aucuauguagaaua

SEQ ID NO: 1396063 - RNA, 11 nt, Human
caucuagugag

SEQ ID NO: 1396064 - RNA, 16 nt, Human
aaugaaagcagggacu

SEQ ID NO: 1396065 - RNA, 11 nt, Human
ccugagcccca

SEQ ID NO: 1396066 - RNA, 13 nt, Human
aggauuugaaauu

SEQ ID NO: 1396067 - RNA, 12 nt, Human
uauuuuaauguu

SEQ ID NO: 1396068 - RNA, 19 nt, Human
caaagugucuugaauugua

SEQ ID NO: 1396069 - RNA, 16 nt, Human
auuuguauaaaauaau

SEQ ID NO: 1396070 - RNA, 20 nt, Human
cccuuccuaauuccacagcu

SEQ ID NO: 1396071 - RNA, 22 nt, Human
ugaguguugccuaauuuguuuu

SEQ ID NO: 1396072 - RNA, 18 nt, Human
gcccacuuccucccggcc

SEQ ID NO: 1396073 - RNA, 17 nt, Human
accugagccccaaaagg

SEQ ID NO: 1396074 - RNA, 20 nt, Human
auuuauugaggcuuuaaaac

SEQ ID NO: 1396075 - RNA, 19 nt, Human
ucaauucuugccaaauaua

SEQ ID NO: 1396076 - RNA, 14 nt, Human
cacuaaacaaagag

SEQ ID NO: 1396077 - RNA, 18 nt, Human
gaagcaccaaucaugaau

SEQ ID NO: 1396078 - RNA, 22 nt, Human
uuccuagucuguuuucccuccu

SEQ ID NO: 1396079 - RNA, 17 nt, Human
uuauaaucuuucacagg

SEQ ID NO: 1396080 - RNA, 14 nt, Human
cccggccggcgcgc

SEQ ID NO: 1396081 - RNA, 14 nt, Human
ccacuggacucacc

SEQ ID NO: 1396082 - RNA, 23 nt, Human
ggaugaauuaaguuuuuuuuuaa

SEQ ID NO: 1396083 - RNA, 14 nt, Human
gaaaaaauaacaau

SEQ ID NO: 1396084 - RNA, 18 nt, Human
ugggauacuauuuaauua

SEQ ID NO: 1396085 - RNA, 15 nt, Human
ggacucaccuccccc

SEQ ID NO: 1396086 - RNA, 22 nt, Human
accaaucaugaauuaguuuuau

SEQ ID NO: 1396087 - RNA, 15 nt, Human
gucaaugcagccccc

SEQ ID NO: 1396088 - RNA, 18 nt, Human
uuggggccuaugcagagg

SEQ ID NO: 1396089 - RNA, 22 nt, Human
cuggguuccuuccucugagccu

SEQ ID NO: 1396090 - RNA, 15 nt, Human
ccgucccccucuggc

SEQ ID NO: 1396091 - RNA, 17 nt, Human
ccugucgguuuauucac

SEQ ID NO: 1396092 - RNA, 23 nt, Human
gggccuaugcagagguccacaac

SEQ ID NO: 1396093 - RNA, 21 nt, Human
cugagccucagucucccuccc

SEQ ID NO: 1396094 - RNA, 19 nt, Human
ugaucaguaugaaaauguc

SEQ ID NO: 1396095 - RNA, 17 nt, Human
acuugaacccauauuug

SEQ ID NO: 1396096 - RNA, 14 nt, Human
aguuuuuuuuuaaa

SEQ ID NO: 1396097 - RNA, 18 nt, Human
auagucaaauugugugaa

SEQ ID NO: 1396098 - RNA, 14 nt, Human
ugagguugugugug

SEQ ID NO: 1396099 - RNA, 16 nt, Human
ggccuccauccugagg

SEQ ID NO: 1396100 - RNA, 18 nt, Human
agaagcaacccaaauguu

SEQ ID NO: 1396101 - RNA, 14 nt, Human
ccugagaccaaggc

SEQ ID NO: 1396102 - RNA, 22 nt, Human
uuuuauagcuacuaauuuuaaa

SEQ ID NO: 1396103 - RNA, 18 nt, Human
uaaaauccauacauuugu

SEQ ID NO: 1396104 - RNA, 21 nt, Human
cagcccuuagcccuuccccuc

SEQ ID NO: 1396105 - RNA, 18 nt, Human
cucuauguucuaagaagu

SEQ ID NO: 1396106 - RNA, 14 nt, Human
gccucagucucccu

SEQ ID NO: 1396107 - RNA, 13 nt, Human
cauggaaaaguuu

SEQ ID NO: 1396108 - RNA, 21 nt, Human
cuccagggagucucagcuuca

SEQ ID NO: 1396109 - RNA, 13 nt, Human
gaagagccggagc

SEQ ID NO: 1396110 - RNA, 13 nt, Human
cgcugcgcgccgc

SEQ ID NO: 1396111 - RNA, 20 nt, Human
ggccuaugcagagguccaca

SEQ ID NO: 1396112 - RNA, 14 nt, Human
ccacccgcccaccg

SEQ ID NO: 1396113 - RNA, 22 nt, Human
cuuguaaaggaauuuaaaaauc

SEQ ID NO: 1396114 - RNA, 21 nt, Human
acaguuaccucugccucagaa

SEQ ID NO: 1396115 - RNA, 12 nt, Human
ggcugaugcagu

SEQ ID NO: 1396116 - RNA, 17 nt, Human
uaaaagacaaggaaaaa

SEQ ID NO: 1396117 - RNA, 18 nt, Human
gcuccgcgcagcucaggc

SEQ ID NO: 1396118 - RNA, 15 nt, Human
cgcgccgcgcuccuc

SEQ ID NO: 1396119 - RNA, 15 nt, Human
ugaaauuguauuaca

SEQ ID NO: 1396120 - RNA, 22 nt, Human
uaauucugguagcuaaauauau

SEQ ID NO: 1396121 - RNA, 20 nt, Human
aaauccuugaagauuuacca

SEQ ID NO: 1396122 - RNA, 17 nt, Human
cuuccucugagccuugg

SEQ ID NO: 1396123 - RNA, 21 nt, Human
accaacacccugagguugugu

SEQ ID NO: 1396124 - RNA, 16 nt, Human
aagaagcuagaaaaca

SEQ ID NO: 1396125 - RNA, 23 nt, Human
cuggccgggagccugaucaccug

SEQ ID NO: 1396126 - RNA, 16 nt, Human
ugacuuaaugccacua

SEQ ID NO: 1396127 - RNA, 17 nt, Human
ucucuggccuucggccu

SEQ ID NO: 1396128 - RNA, 13 nt, Human
uaacgauaaaaga

SEQ ID NO: 1396129 - RNA, 12 nt, Human
agacagugaaag

SEQ ID NO: 1396130 - RNA, 22 nt, Human
cugcuggagacauugaggcagg

SEQ ID NO: 1396131 - RNA, 15 nt, Human
cuggaaacacauguu

SEQ ID NO: 1396132 - RNA, 18 nt, Human
uaaguuuuuuuuuaaaaa

SEQ ID NO: 1396133 - RNA, 19 nt, Human
ugagguaaccucauuauca

SEQ ID NO: 1396134 - RNA, 16 nt, Human
cuggcugcgcucggcc

SEQ ID NO: 1396135 - RNA, 14 nt, Human
ugaggcuuuaaaac

SEQ ID NO: 1396136 - RNA, 17 nt, Human
gaucuggcucuggacag

SEQ ID NO: 1396137 - RNA, 13 nt, Human
ucacuguaaaaua

SEQ ID NO: 1396138 - RNA, 22 nt, Human
aggcccccgggccgacggagcc

SEQ ID NO: 1396139 - RNA, 21 nt, Human
uuacauuuguauaaaauaauu

SEQ ID NO: 1396140 - RNA, 20 nt, Human
cuauguagaauauauuuccu

SEQ ID NO: 1396141 - RNA, 17 nt, Human
uacaaaugcauuucuaa

SEQ ID NO: 1396142 - RNA, 23 nt, Human
cuuaagaagacugcauuauauuu

SEQ ID NO: 1396143 - RNA, 16 nt, Human
uacaaaugggaaacaa

SEQ ID NO: 1396144 - RNA, 16 nt, Human
gucuaucuuugagcgc

SEQ ID NO: 1396145 - RNA, 18 nt, Human
uguacuuuauuuucuaua

SEQ ID NO: 1396146 - RNA, 14 nt, Human
gagccgggaaagaa

SEQ ID NO: 1396147 - RNA, 16 nt, Human
cauagaaguaaaaaca

SEQ ID NO: 1396148 - RNA, 17 nt, Human
gcucaccagucccuccc

SEQ ID NO: 1396149 - RNA, 22 nt, Human
aacucccugccccccagcccuc

SEQ ID NO: 1396150 - RNA, 12 nt, Human
cagacacaugug

SEQ ID NO: 1396151 - RNA, 20 nt, Human
cuggccuucggccuccaucc

SEQ ID NO: 1396152 - RNA, 15 nt, Human
cuggguuccuuccuc

SEQ ID NO: 1396153 - RNA, 12 nt, Human
agaaaacaauaa

SEQ ID NO: 1396154 - RNA, 12 nt, Human
ggggcggcggcc

SEQ ID NO: 1396155 - RNA, 22 nt, Human
aaucacuggcuguuaaucuuuc

SEQ ID NO: 1396156 - RNA, 14 nt, Human
cugaggcuccacuu

SEQ ID NO: 1396157 - RNA, 12 nt, Human
cagugaaagaaa

SEQ ID NO: 1396158 - RNA, 17 nt, Human
agcccuuccccucugca

SEQ ID NO: 1396159 - RNA, 15 nt, Human
gucucuugaggcaca

SEQ ID NO: 1396160 - RNA, 16 nt, Human
gcugcgcgccgcgcuc

SEQ ID NO: 1396161 - RNA, 16 nt, Human
cgcccacuuccucccg

SEQ ID NO: 1396162 - RNA, 20 nt, Human
uccucaugagggcuggaugc

SEQ ID NO: 1396163 - RNA, 23 nt, Human
cacagaaacuccuguucaugccc

SEQ ID NO: 1396164 - RNA, 23 nt, Human
ugaaaugaguuuuucuuuucauu

SEQ ID NO: 1396165 - RNA, 16 nt, Human
agguugcagugagccg

SEQ ID NO: 1396166 - RNA, 18 nt, Human
cugcugguggcgcuggcu

SEQ ID NO: 1396167 - RNA, 23 nt, Human
uuuauuaggaguaccauaauucu

SEQ ID NO: 1396168 - RNA, 16 nt, Human
gaaaaaauaacaauga

SEQ ID NO: 1396169 - RNA, 15 nt, Human
uauuuauuuuaauaa

SEQ ID NO: 1396170 - RNA, 21 nt, Human
aaaagguauuuuaaucaccaa

SEQ ID NO: 1396171 - RNA, 17 nt, Human
aaauguucaucaaugaa

SEQ ID NO: 1396172 - RNA, 19 nt, Human
cugccaaaacaucaaccug

SEQ ID NO: 1396173 - RNA, 14 nt, Human
gcuggcaccgcugu

SEQ ID NO: 1396174 - RNA, 14 nt, Human
guaacugauuugua

SEQ ID NO: 1396175 - RNA, 18 nt, Human
uaaaagacaaggaaaaaa

SEQ ID NO: 1396176 - RNA, 21 nt, Human
uucccgcuguuccucgccacg

SEQ ID NO: 1396177 - RNA, 23 nt, Human
aaagaugaucaguaugaaaaugu

SEQ ID NO: 1396178 - RNA, 22 nt, Human
uguuuuuccaguaguuagcuuu

SEQ ID NO: 1396179 - RNA, 22 nt, Human
gcagagagguagggauggggcu

SEQ ID NO: 1396180 - RNA, 14 nt, Human
gagcccauggcacu

SEQ ID NO: 1396181 - RNA, 13 nt, Human
aaaaauccuacuu

SEQ ID NO: 1396182 - RNA, 15 nt, Human
agucucuaucauuaa

SEQ ID NO: 1396183 - RNA, 16 nt, Human
cuaguuuauauagaaa

SEQ ID NO: 1396184 - RNA, 21 nt, Human
uauaaaauaauuuuuauauuu

SEQ ID NO: 1396185 - RNA, 21 nt, Human
ccauaccccuggccaaggaag

SEQ ID NO: 1396186 - RNA, 23 nt, Human
gcuggccuugugaggagcuggaa

SEQ ID NO: 1396187 - RNA, 15 nt, Human
caaggaaaaaauaac

SEQ ID NO: 1396188 - RNA, 17 nt, Human
uuucacauuuaaauaaa

SEQ ID NO: 1396189 - RNA, 13 nt, Human
auaacuggaaacu

SEQ ID NO: 1396190 - RNA, 17 nt, Human
uuauaucaauuuaaaaa

SEQ ID NO: 1396191 - RNA, 14 nt, Human
cacccugagguugu

SEQ ID NO: 1396192 - RNA, 22 nt, Human
ucuagcaugucgucaaagcuga

SEQ ID NO: 1396193 - RNA, 19 nt, Human
agucccuccccaaaugcuu

SEQ ID NO: 1396194 - RNA, 20 nt, Human
gcuuccaggcuggcgugcag

SEQ ID NO: 1396195 - RNA, 14 nt, Human
agcuggaaacacau

SEQ ID NO: 1396196 - RNA, 23 nt, Human
agccaccaguccauugggcaggc

SEQ ID NO: 1396197 - RNA, 20 nt, Human
cagccugagcgacagugaga

SEQ ID NO: 1396198 - RNA, 17 nt, Human
uaucaguuauuuuuaaa

SEQ ID NO: 1396199 - RNA, 13 nt, Human
uuuucuuuucauu

SEQ ID NO: 1396200 - RNA, 20 nt, Human
ccgcagggugaacugcagcg

SEQ ID NO: 1396201 - RNA, 22 nt, Human
uguugcccacagcuguaugauu

SEQ ID NO: 1396202 - RNA, 17 nt, Human
caagaaaugaaagcagg

SEQ ID NO: 1396203 - RNA, 18 nt, Human
auuauuucacuuuagaaa

SEQ ID NO: 1396204 - RNA, 20 nt, Human
auauuuuauaucaauuuaaa

SEQ ID NO: 1396205 - RNA, 16 nt, Human
aucaguuauuuuuaaa

SEQ ID NO: 1396206 - RNA, 12 nt, Human
guagacacacau

SEQ ID NO: 1396207 - RNA, 24 nt, Human
uuugugggaaauccacacugagcu

SEQ ID NO: 1396208 - RNA, 12 nt, Human
agcuuggaaugu

SEQ ID NO: 1396209 - RNA, 17 nt, Human
agacacacugaagaagc

SEQ ID NO: 1396210 - RNA, 21 nt, Human
ccaaauauaaauaaaaauaau

SEQ ID NO: 1396211 - RNA, 17 nt, Human
cuccuaagaaggcaccu

SEQ ID NO: 1396212 - RNA, 23 nt, Human
uguucccuggggcuuuaacuccu

SEQ ID NO: 1396213 - RNA, 19 nt, Human
uuuccugaaaacccuugcc

SEQ ID NO: 1396214 - RNA, 14 nt, Human
aagaagugaaaauc

SEQ ID NO: 1396215 - RNA, 16 nt, Human
cuucaacucccugccc

SEQ ID NO: 1396216 - RNA, 11 nt, Human
auaauuuaaau

SEQ ID NO: 1396217 - RNA, 15 nt, Human
gaagauguagaggag

SEQ ID NO: 1396218 - RNA, 20 nt, Human
caccgcagggugaacugcag

SEQ ID NO: 1396219 - RNA, 14 nt, Human
aucuaugccacaag

SEQ ID NO: 1396220 - RNA, 19 nt, Human
ucugagcauuuaauaugga

SEQ ID NO: 1396221 - RNA, 17 nt, Human
acuauuuaauuauuuca

SEQ ID NO: 1396222 - RNA, 20 nt, Human
agagccggagccuccagcug

SEQ ID NO: 1396223 - RNA, 22 nt, Human
gaauuucuucaacucccugccc

SEQ ID NO: 1396224 - RNA, 15 nt, Human
ucuggcuccagcugg

SEQ ID NO: 1396225 - RNA, 13 nt, Human
ucuauaauuuaaa

SEQ ID NO: 1396226 - RNA, 18 nt, Human
uuuguuaaaugauuucau

SEQ ID NO: 1396227 - RNA, 13 nt, Human
uuuagugaaauau

SEQ ID NO: 1396228 - RNA, 22 nt, Human
ugucucuacuaaaaauacaaaa

SEQ ID NO: 1396229 - RNA, 14 nt, Human
auaaauaaaaauaa

SEQ ID NO: 1396230 - RNA, 14 nt, Human
aaauauaaauaaaa

SEQ ID NO: 1396231 - RNA, 14 nt, Human
uggacucaccuccc

SEQ ID NO: 1396232 - RNA, 15 nt, Human
aagccagauuuuccu

SEQ ID NO: 1396233 - RNA, 17 nt, Human
agggcauagaaguaaaa

SEQ ID NO: 1396234 - RNA, 14 nt, Human
acgcgcgcuccgcg

SEQ ID NO: 1396235 - RNA, 17 nt, Human
auguugacaugggacau

SEQ ID NO: 1396236 - RNA, 22 nt, Human
uuuaauaauguuucaaacauau

SEQ ID NO: 1396237 - RNA, 22 nt, Human
gugccucaccccuugccauaau

SEQ ID NO: 1396238 - RNA, 15 nt, Human
uaaaagacaaggaaa

SEQ ID NO: 1396239 - RNA, 17 nt, Human
uauauuuccaagaaaua

SEQ ID NO: 1396240 - RNA, 15 nt, Human
uaggaaauauuuauu

SEQ ID NO: 1396241 - RNA, 22 nt, Human
caccagucugacuguuuccauc

SEQ ID NO: 1396242 - RNA, 17 nt, Human
cuuccuaauuccacagc

SEQ ID NO: 1396243 - RNA, 16 nt, Human
cauggguuuuauuaua

SEQ ID NO: 1396244 - RNA, 21 nt, Human
uguaaaauggugugaccacug

SEQ ID NO: 1396245 - RNA, 20 nt, Human
ucaagucuuucacauuuaaa

SEQ ID NO: 1396246 - RNA, 15 nt, Human
cuaucuuugagcgcc

SEQ ID NO: 1396247 - RNA, 17 nt, Human
aacugccaucauuuacu

SEQ ID NO: 1396248 - RNA, 16 nt, Human
gcugcugguggcgcug

SEQ ID NO: 1396249 - RNA, 19 nt, Human
ucaccaaggcugauuaaac

SEQ ID NO: 1396250 - RNA, 20 nt, Human
ucucguugacccucacagga

SEQ ID NO: 1396251 - RNA, 15 nt, Human
gaauauauuuccuua

SEQ ID NO: 1396252 - RNA, 18 nt, Human
ccaagccuggcaagggaa

SEQ ID NO: 1396253 - RNA, 21 nt, Human
auuauauuuccaagaaauauu

SEQ ID NO: 1396254 - RNA, 20 nt, Human
uaacaagccuccuuuuaaag

SEQ ID NO: 1396255 - RNA, 12 nt, Human
gaugagagaaca

SEQ ID NO: 1396256 - RNA, 21 nt, Human
auacuauuuaauuauuucacu

SEQ ID NO: 1396257 - RNA, 16 nt, Human
ucgcuuccgcauccua

SEQ ID NO: 1396258 - RNA, 13 nt, Human
uuccucugagccu

SEQ ID NO: 1396259 - RNA, 20 nt, Human
acuuuauuuucuauaauuua

SEQ ID NO: 1396260 - RNA, 15 nt, Human
gccgacggagccggg

SEQ ID NO: 1396261 - RNA, 13 nt, Human
gccuccagcugcc

SEQ ID NO: 1396262 - RNA, 19 nt, Human
agugaggagcuuugaaacg

SEQ ID NO: 1396263 - RNA, 14 nt, Human
ggcaccucucuggg

SEQ ID NO: 1396264 - RNA, 17 nt, Human
cccacuggacucaccuc

SEQ ID NO: 1396265 - RNA, 17 nt, Human
ccgcgcagcucaggcug

SEQ ID NO: 1396266 - RNA, 19 nt, Human
ugaacaaauuuacagagac

SEQ ID NO: 1396267 - RNA, 14 nt, Human
aucucuucucagaa

SEQ ID NO: 1396268 - RNA, 13 nt, Human
auaaauaaaaaua

SEQ ID NO: 1396269 - RNA, 14 nt, Human
ggccacaucugagc

SEQ ID NO: 1396270 - RNA, 16 nt, Human
uucaguuauuauauuu

SEQ ID NO: 1396271 - RNA, 14 nt, Human
uauuugaaauauug

SEQ ID NO: 1396272 - RNA, 21 nt, Human
aauauauuuccuuauucagaa

SEQ ID NO: 1396273 - RNA, 12 nt, Human
cggcccugugcg

SEQ ID NO: 1396274 - RNA, 12 nt, Human
ggaggcugagau

SEQ ID NO: 1396275 - RNA, 19 nt, Human
uguaaagguccuggcaaag

SEQ ID NO: 1396276 - RNA, 15 nt, Human
gugggccugagacca

SEQ ID NO: 1396277 - RNA, 13 nt, Human
gcagaacagugau

SEQ ID NO: 1396278 - RNA, 19 nt, Human
auuggagcucgugggacag

SEQ ID NO: 1396279 - RNA, 18 nt, Human
augagcacgcauggaaaa

SEQ ID NO: 1396280 - RNA, 22 nt, Human
caauaaaagacaaggaaaaaau

SEQ ID NO: 1396281 - RNA, 20 nt, Human
cgcucggccugcucgcccac

SEQ ID NO: 1396282 - RNA, 13 nt, Human
gcuggagcucugc

SEQ ID NO: 1396283 - RNA, 19 nt, Human
ugagucccaggcugagccu

SEQ ID NO: 1396284 - RNA, 14 nt, Human
ugacacuuaaaaau

SEQ ID NO: 1396285 - RNA, 21 nt, Human
auauuuuuuuuuuuaaaaaaa

SEQ ID NO: 1396286 - RNA, 15 nt, Human
auccuagucucuauc

SEQ ID NO: 1396287 - RNA, 15 nt, Human
gagaugcuagaacuc

SEQ ID NO: 1396288 - RNA, 20 nt, Human
gggaggcagagguugcagug

SEQ ID NO: 1396289 - RNA, 14 nt, Human
cccugccucaagcu

SEQ ID NO: 1396290 - RNA, 15 nt, Human
uccucaacucugagu

SEQ ID NO: 1396291 - RNA, 18 nt, Human
ucaccagucccuccccaa

SEQ ID NO: 1396292 - RNA, 16 nt, Human
cagggcuacgcgcgcu

SEQ ID NO: 1396293 - RNA, 19 nt, Human
agaguuuagcuggaaaagu

SEQ ID NO: 1396294 - RNA, 22 nt, Human
cuuaucuauguagaauauauuu

SEQ ID NO: 1396295 - RNA, 21 nt, Human
uuacaaugcauucugagguaa

SEQ ID NO: 1396296 - RNA, 12 nt, Human
ucuacacuccag

SEQ ID NO: 1396297 - RNA, 13 nt, Human
aagaaaauaacga

SEQ ID NO: 1396298 - RNA, 22 nt, Human
aggauggcuaguaucaaaagaa

SEQ ID NO: 1396299 - RNA, 16 nt, Human
ccucagucucccuccc

SEQ ID NO: 1396300 - RNA, 23 nt, Human
uuucccaucucagguguguugca

SEQ ID NO: 1396301 - RNA, 15 nt, Human
ccccugagcuugcag

SEQ ID NO: 1396302 - RNA, 15 nt, Human
ccugccccccagccc

SEQ ID NO: 1396303 - RNA, 14 nt, Human
ggacucaccucccc

SEQ ID NO: 1396304 - RNA, 18 nt, Human
cccaggcugagccucagu

SEQ ID NO: 1396305 - RNA, 21 nt, Human
uauacugugugcuaaaacaag

SEQ ID NO: 1396306 - RNA, 21 nt, Human
uuauagcuacuaauuuuaaaa

SEQ ID NO: 1396307 - RNA, 22 nt, Human
ccagcuggccuugugaggagcu

SEQ ID NO: 1396308 - RNA, 20 nt, Human
uguaaagcuuugugcagauu

SEQ ID NO: 1396309 - RNA, 20 nt, Human
acuagaguuuagcuggaaaa

SEQ ID NO: 1396310 - RNA, 15 nt, Human
cagccagcacagccu

SEQ ID NO: 1396311 - RNA, 17 nt, Human
gccaugggacagggagg

SEQ ID NO: 1396312 - RNA, 21 nt, Human
uuuauauaagcuuguauuccu

SEQ ID NO: 1396313 - RNA, 15 nt, Human
cuuccucccggccgc

SEQ ID NO: 1396314 - RNA, 22 nt, Human
ggacagcccuucuuuccacaga

SEQ ID NO: 1396315 - RNA, 18 nt, Human
uuccuaauaaagcuucug

SEQ ID NO: 1396316 - RNA, 20 nt, Human
aggugacuauuauauuucca

SEQ ID NO: 1396317 - RNA, 24 nt, Human
uaauuuaaaauaugcucuaaacau

SEQ ID NO: 1396318 - RNA, 14 nt, Human
cggacggcuccgga

SEQ ID NO: 1396319 - RNA, 17 nt, Human
ugaacuugguuuuaauu

SEQ ID NO: 1396320 - RNA, 16 nt, Human
gucuguuuucccuccu

SEQ ID NO: 1396321 - RNA, 19 nt, Human
ccagaucuaugccacaaga

SEQ ID NO: 1396322 - RNA, 18 nt, Human
ugccuaggcauagcccug

SEQ ID NO: 1396323 - RNA, 16 nt, Human
ugagcucagcccuggu

SEQ ID NO: 1396324 - RNA, 14 nt, Human
cuaaacauaugaau

SEQ ID NO: 1396325 - RNA, 12 nt, Human
agggauggggcu

SEQ ID NO: 1396326 - RNA, 17 nt, Human
auauuugaaauauugac

SEQ ID NO: 1396327 - RNA, 18 nt, Human
guuucaaacauauauaac

SEQ ID NO: 1396328 - RNA, 14 nt, Human
ggaaagaagagccg

SEQ ID NO: 1396329 - RNA, 14 nt, Human
accauuuuuacuug

SEQ ID NO: 1396330 - RNA, 12 nt, Human
uucagccugaaa

SEQ ID NO: 1396331 - RNA, 17 nt, Human
cauuguuggcuguuccu

SEQ ID NO: 1396332 - RNA, 20 nt, Human
uuaaugccacuaaauugaca

SEQ ID NO: 1396333 - RNA, 16 nt, Human
ugugcagccaccaguc

SEQ ID NO: 1396334 - RNA, 14 nt, Human
auuuucuauaauuu

SEQ ID NO: 1396335 - RNA, 21 nt, Human
auguuuaauucugaaagcaac

SEQ ID NO: 1396336 - RNA, 13 nt, Human
aagcauuccaacu

SEQ ID NO: 1396337 - RNA, 12 nt, Human
gcccccgggccg

SEQ ID NO: 1396338 - RNA, 23 nt, Human
cagagguugcagugagccgagau

SEQ ID NO: 1396339 - RNA, 20 nt, Human
ucuguuuucccuccuuggag

SEQ ID NO: 1396340 - RNA, 22 nt, Human
aagcugguggcucugugugcuc

SEQ ID NO: 1396341 - RNA, 18 nt, Human
ccauccugccccugagcc

SEQ ID NO: 1396342 - RNA, 20 nt, Human
uuccacagaagcuccaggua

SEQ ID NO: 1396343 - RNA, 14 nt, Human
aauauuauuuuaua

SEQ ID NO: 1396344 - RNA, 19 nt, Human
cuucccgcuguuccucgcc

SEQ ID NO: 1396345 - RNA, 13 nt, Human
agcucugcccauc

SEQ ID NO: 1396346 - RNA, 22 nt, Human
cuuuccacagaagcuccaggua

SEQ ID NO: 1396347 - RNA, 12 nt, Human
aauaauuuuuaa

SEQ ID NO: 1396348 - RNA, 20 nt, Human
agggaagacaagaaggaaag

SEQ ID NO: 1396349 - RNA, 19 nt, Human
ccccugcaaagcccagcuu

SEQ ID NO: 1396350 - RNA, 16 nt, Human
ggcgggagggcgcggg

SEQ ID NO: 1396351 - RNA, 13 nt, Human
ccagcccuccuua

SEQ ID NO: 1396352 - RNA, 20 nt, Human
cuggcuaauuagcauggcca

SEQ ID NO: 1396353 - RNA, 12 nt, Human
auggguuuuauu

SEQ ID NO: 1396354 - RNA, 22 nt, Human
auauuuuagauagaugaagaag

SEQ ID NO: 1396355 - RNA, 21 nt, Human
uauuacuguaagaaaauauca

SEQ ID NO: 1396356 - RNA, 13 nt, Human
uaauuuuuauauu

SEQ ID NO: 1396357 - RNA, 14 nt, Human
aauauuuauuuuaa

SEQ ID NO: 1396358 - RNA, 19 nt, Human
cucauggaauuggagcucg

SEQ ID NO: 1396359 - RNA, 22 nt, Human
gugaacaaauuuacagagacag

SEQ ID NO: 1396360 - RNA, 15 nt, Human
acuuuuauaagaaau

SEQ ID NO: 1396361 - RNA, 19 nt, Human
ucuuaucuuccuauaauuu

SEQ ID NO: 1396362 - RNA, 13 nt, Human
agacacagugacc

SEQ ID NO: 1396363 - RNA, 19 nt, Human
agauuugagcucagcccug

SEQ ID NO: 1396364 - RNA, 20 nt, Human
acaaugacuuguacucugaa

SEQ ID NO: 1396365 - RNA, 21 nt, Human
uaaaagacagugaaagaaaau

SEQ ID NO: 1396366 - RNA, 18 nt, Human
uuauuauagucacuaguu

SEQ ID NO: 1396367 - RNA, 13 nt, Human
aguuguaauuuuu

SEQ ID NO: 1396368 - RNA, 22 nt, Human
agggagucucagcuucacccug

SEQ ID NO: 1396369 - RNA, 21 nt, Human
ucacaugaacuuguaaaggaa

SEQ ID NO: 1396370 - RNA, 23 nt, Human
caucaacagauaaauaguuuaug

SEQ ID NO: 1396371 - RNA, 20 nt, Human
uuagcauaguaccucugcua

SEQ ID NO: 1396372 - RNA, 13 nt, Human
aucucaauauuuc

SEQ ID NO: 1396373 - RNA, 14 nt, Human
gaucuaugccacaa

SEQ ID NO: 1396374 - RNA, 15 nt, Human
auaucaauuuaaaaa

SEQ ID NO: 1396375 - RNA, 22 nt, Human
cuuguacucugaaaguuuugga

SEQ ID NO: 1396376 - RNA, 13 nt, Human
aacaagccuccuu

SEQ ID NO: 1396377 - RNA, 16 nt, Human
aauauuuuaauguuuc

SEQ ID NO: 1396378 - RNA, 14 nt, Human
aaaagaaagaaaau

SEQ ID NO: 1396379 - RNA, 20 nt, Human
ucgcaggaccaucccggccg

SEQ ID NO: 1396380 - RNA, 16 nt, Human
auccuugaagauuuac

SEQ ID NO: 1396381 - RNA, 19 nt, Human
auaauuuuuauauuugaaa

SEQ ID NO: 1396382 - RNA, 15 nt, Human
aaagaaagaaaauca

SEQ ID NO: 1396383 - RNA, 19 nt, Human
cagauccccaagccuggca

SEQ ID NO: 1396384 - RNA, 22 nt, Human
cucagcuucacccugaggugag

SEQ ID NO: 1396385 - RNA, 17 nt, Human
aauaugcucuaaacaug

SEQ ID NO: 1396386 - RNA, 16 nt, Human
gcagcucaggcuggca

SEQ ID NO: 1396387 - RNA, 23 nt, Human
cccggccggcgcgcucaucccac

SEQ ID NO: 1396388 - RNA, 19 nt, Human
uccccuauccuacuucccc

SEQ ID NO: 1396389 - RNA, 14 nt, Human
gcuccgcgcagcuc

SEQ ID NO: 1396390 - RNA, 12 nt, Human
ucuuucaugaag

SEQ ID NO: 1396391 - RNA, 18 nt, Human
uaaauguuguuuuaggaa

SEQ ID NO: 1396392 - RNA, 16 nt, Human
gccgcgcugcgcgccg

SEQ ID NO: 1396393 - RNA, 22 nt, Human
ucuuccuggauuccucacuuug

SEQ ID NO: 1396394 - RNA, 23 nt, Human
cccuagaaagccaugugcagcca

SEQ ID NO: 1396395 - RNA, 17 nt, Human
agggagucucagcuuca

SEQ ID NO: 1396396 - RNA, 13 nt, Human
cauuuguauaaaa

SEQ ID NO: 1396397 - RNA, 15 nt, Human
aaaaaauaacaauga

SEQ ID NO: 1396398 - RNA, 17 nt, Human
cuggcugcgcucggccu

SEQ ID NO: 1396399 - RNA, 21 nt, Human
gaagugaaaaucuacacucca

SEQ ID NO: 1396400 - RNA, 22 nt, Human
aucaccaaggcugauuaaacca

SEQ ID NO: 1396401 - RNA, 13 nt, Human
aauaucucuucuc

SEQ ID NO: 1396402 - RNA, 15 nt, Human
cccggccggcgcgcu

SEQ ID NO: 1396403 - RNA, 14 nt, Human
ggaaguagaggagg

SEQ ID NO: 1396404 - RNA, 22 nt, Human
auguccuuggugccuggagccu

SEQ ID NO: 1396405 - RNA, 19 nt, Human
uuuuaucugcuaugcuauu

SEQ ID NO: 1396406 - RNA, 14 nt, Human
gcgcugcgcgccgc

SEQ ID NO: 1396407 - RNA, 17 nt, Human
caaagagaaagaggguu

SEQ ID NO: 1396408 - RNA, 20 nt, Human
auaagccagacaucaacaga

SEQ ID NO: 1396409 - RNA, 21 nt, Human
cucagcuucacccugagguga

SEQ ID NO: 1396410 - RNA, 20 nt, Human
ucaaaacuucagacauagaa

SEQ ID NO: 1396411 - RNA, 21 nt, Human
gauaaaagacagugaaagaaa

SEQ ID NO: 1396412 - RNA, 20 nt, Human
gagcaucaucuucuggguua

SEQ ID NO: 1396413 - RNA, 14 nt, Human
aucaaaagaaagaa

SEQ ID NO: 1396414 - RNA, 15 nt, Human
uaguauggcaaacug

SEQ ID NO: 1396415 - RNA, 23 nt, Human
cacuggacucaccucccccaucu

SEQ ID NO: 1396416 - RNA, 16 nt, Human
agggaggacgcucucu

SEQ ID NO: 1396417 - RNA, 16 nt, Human
ugcauagguuuaauaa

SEQ ID NO: 1396418 - RNA, 16 nt, Human
guuucacaccuuaucu

SEQ ID NO: 1396419 - RNA, 23 nt, Human
caucucuucuggguuccuuccuc

SEQ ID NO: 1396420 - RNA, 14 nt, Human
ucccacccgcccac

SEQ ID NO: 1396421 - RNA, 13 nt, Human
accaacacccuga

SEQ ID NO: 1396422 - RNA, 13 nt, Human
auuuuuuaaaaaa

SEQ ID NO: 1396423 - RNA, 13 nt, Human
ugaaauuguauua

SEQ ID NO: 1396424 - RNA, 14 nt, Human
aaugauuaugaauu

SEQ ID NO: 1396425 - RNA, 16 nt, Human
ucugcagauaaacagu

SEQ ID NO: 1396426 - RNA, 20 nt, Human
ugauuauaugucacuuugcu

SEQ ID NO: 1396427 - RNA, 21 nt, Human
ccagggcuacgcgcgcuccgc

SEQ ID NO: 1396428 - RNA, 14 nt, Human
aucaccaaggcuga

SEQ ID NO: 1396429 - RNA, 23 nt, Human
agcagcccuuagcccuuccccuc

SEQ ID NO: 1396430 - RNA, 16 nt, Human
ucucuaggaaauauuu

SEQ ID NO: 1396431 - RNA, 22 nt, Human
ucauucccguugaacgucacau

SEQ ID NO: 1396432 - RNA, 18 nt, Human
aggaaaaaauaacaauga

SEQ ID NO: 1396433 - RNA, 19 nt, Human
caggcagauguuccuaaua

SEQ ID NO: 1396434 - RNA, 15 nt, Human
gcgcgccuccgcuac

SEQ ID NO: 1396435 - RNA, 18 nt, Human
guauuauuuuuuaaaaaa

SEQ ID NO: 1396436 - RNA, 11 nt, Human
auuuuugaagc

SEQ ID NO: 1396437 - RNA, 14 nt, Human
cucugccucagaaa

SEQ ID NO: 1396438 - RNA, 15 nt, Human
agccgggaaagaaga

SEQ ID NO: 1396439 - RNA, 17 nt, Human
cgccuccgcuacuucca

SEQ ID NO: 1396440 - RNA, 19 nt, Human
gccgcgcugcgcgccgcgc

SEQ ID NO: 1396441 - RNA, 14 nt, Human
uuuuaaaaaagaaa

SEQ ID NO: 1396442 - RNA, 18 nt, Human
acugugugcuaaaacaag

SEQ ID NO: 1396443 - RNA, 14 nt, Human
auggaaguaaaugu

SEQ ID NO: 1396444 - RNA, 11 nt, Human
guauggcaaac

SEQ ID NO: 1396445 - RNA, 16 nt, Human
aaaagcaucacaugaa

SEQ ID NO: 1396446 - RNA, 23 nt, Human
ccccucuggcuccagcuggccgg

SEQ ID NO: 1396447 - RNA, 15 nt, Human
agacaaggaaaaaau

SEQ ID NO: 1396448 - RNA, 15 nt, Human
gaauaaccaacaccc

SEQ ID NO: 1396449 - RNA, 16 nt, Human
gugagacagcucugca

SEQ ID NO: 1396450 - RNA, 15 nt, Human
ugguuuagaaagcuu

SEQ ID NO: 1396451 - RNA, 21 nt, Human
gacagaaagcagaacagugau

SEQ ID NO: 1396452 - RNA, 16 nt, Human
uggcaagcucuaucac

SEQ ID NO: 1396453 - RNA, 15 nt, Human
aagcacuaaacaaag

SEQ ID NO: 1396454 - RNA, 19 nt, Human
cccugcaaagcccagcuug

SEQ ID NO: 1396455 - RNA, 23 nt, Human
ucuagcaugucgucaaagcugaa

SEQ ID NO: 1396456 - RNA, 15 nt, Human
agccugaaagaggaa

SEQ ID NO: 1396457 - RNA, 17 nt, Human
cugcacuccagccugag

SEQ ID NO: 1396458 - RNA, 23 nt, Human
uaagaaauaggaaauauuuuaau

SEQ ID NO: 1396459 - RNA, 18 nt, Human
acaaaaggauaaugaaua

SEQ ID NO: 1396460 - RNA, 15 nt, Human
aagaagugaaaaucu

SEQ ID NO: 1396461 - RNA, 15 nt, Human
cucguggaacaguua

SEQ ID NO: 1396462 - RNA, 21 nt, Human
gacagugaaagaaaauaacaa

SEQ ID NO: 1396463 - RNA, 22 nt, Human
ccaaacauccuacaagacacag

SEQ ID NO: 1396464 - RNA, 14 nt, Human
cugguggcucugug

SEQ ID NO: 1396465 - RNA, 13 nt, Human
uaacaauaaaaga

SEQ ID NO: 1396466 - RNA, 20 nt, Human
uuucuuccuggauuccucac

SEQ ID NO: 1396467 - RNA, 21 nt, Human
uaucuuccuauaauuuuagac

SEQ ID NO: 1396468 - RNA, 14 nt, Human
acuuugauuuuaua

SEQ ID NO: 1396469 - RNA, 14 nt, Human
ugacuauuauauuu

SEQ ID NO: 1396470 - RNA, 17 nt, Human
aaagaaacauuugguaa

SEQ ID NO: 1396471 - RNA, 23 nt, Human
uugauuuuauaugcuauuuauua

SEQ ID NO: 1396472 - RNA, 18 nt, Human
aacaaugcuguauuuuaa

SEQ ID NO: 1396473 - RNA, 17 nt, Human
cauuuguauaaaauaau

SEQ ID NO: 1396474 - RNA, 16 nt, Human
aaauccacacugagcu

SEQ ID NO: 1396475 - RNA, 13 nt, Human
ccuuugcaccucc

SEQ ID NO: 1396476 - RNA, 14 nt, Human
guccacaaguaaaa

SEQ ID NO: 1396477 - RNA, 13 nt, Human
ccccucugcagcu

SEQ ID NO: 1396478 - RNA, 18 nt, Human
ugagccaccaagcuggug

SEQ ID NO: 1396479 - RNA, 21 nt, Human
caaagcccagcuugaaaccuu

SEQ ID NO: 1396480 - RNA, 20 nt, Human
acaugagguacugagaguga

SEQ ID NO: 1396481 - RNA, 21 nt, Human
cuccauggaaacgaagcacca

SEQ ID NO: 1396482 - RNA, 17 nt, Human
ucuggaggucucugaac

SEQ ID NO: 1396483 - RNA, 23 nt, Human
auaucuuuuuuuuaauaaaccau

SEQ ID NO: 1396484 - RNA, 23 nt, Human
gguggcgcuggcugcgcucggcc

SEQ ID NO: 1396485 - RNA, 20 nt, Human
gcucgcccacuuccucccgg

SEQ ID NO: 1396486 - RNA, 14 nt, Human
cgcucgcuuccgca

SEQ ID NO: 1396487 - RNA, 14 nt, Human
gcuggcgugcagca

SEQ ID NO: 1396488 - RNA, 15 nt, Human
aaaacaggcaaauuc

SEQ ID NO: 1396489 - RNA, 19 nt, Human
agaaaauaacaauaaaaga

SEQ ID NO: 1396490 - RNA, 18 nt, Human
auaggaaauauuuuaaug

SEQ ID NO: 1396491 - RNA, 19 nt, Human
cuguuauuuuaucugcuau

SEQ ID NO: 1396492 - RNA, 17 nt, Human
agcuacuaauuuuaaaa

SEQ ID NO: 1396493 - RNA, 22 nt, Human
ccgcgcagcucaggcuggcacc

SEQ ID NO: 1396494 - RNA, 16 nt, Human
caugguuuagaaagcu

SEQ ID NO: 1396495 - RNA, 22 nt, Human
ucugcuggagacauugaggcag

SEQ ID NO: 1396496 - RNA, 23 nt, Human
uguucuugugaacccaaagugug

SEQ ID NO: 1396497 - RNA, 18 nt, Human
uggcucuggacaggcacu

SEQ ID NO: 1396498 - RNA, 17 nt, Human
uaucaauuuaaaaaaaa

SEQ ID NO: 1396499 - RNA, 17 nt, Human
gggagcgagccccaggc

SEQ ID NO: 1396500 - RNA, 13 nt, Human
augcuagaacucc

SEQ ID NO: 1396501 - RNA, 23 nt, Human
cuucaacucccugccccccagcc

SEQ ID NO: 1396502 - RNA, 21 nt, Human
gaaaugaguuuuucuuuucau

SEQ ID NO: 1396503 - RNA, 14 nt, Human
caugaacuuguaaa

SEQ ID NO: 1396504 - RNA, 16 nt, Human
cucucuuccucccugg

SEQ ID NO: 1396505 - RNA, 17 nt, Human
auaucuuaucuuccuau

SEQ ID NO: 1396506 - RNA, 18 nt, Human
uuguaaaggaauuuaaaa

SEQ ID NO: 1396507 - RNA, 13 nt, Human
acagcccuucuuu

SEQ ID NO: 1396508 - RNA, 13 nt, Human
guaacuaauuuua

SEQ ID NO: 1396509 - RNA, 14 nt, Human
cugcaaagcccagc

SEQ ID NO: 1396510 - RNA, 21 nt, Human
ugccagcuggccuugugagga

SEQ ID NO: 1396511 - RNA, 20 nt, Human
uuaaauggucaauuuuguua

SEQ ID NO: 1396512 - RNA, 21 nt, Human
uuauuuucuauaauuuaaaua

SEQ ID NO: 1396513 - RNA, 16 nt, Human
ggaugccccguccccc

SEQ ID NO: 1396514 - RNA, 16 nt, Human
uagaaaacaggcaaau

SEQ ID NO: 1396515 - RNA, 14 nt, Human
cuuucauaauaagu

SEQ ID NO: 1396516 - RNA, 15 nt, Human
cccaucucaggugug

SEQ ID NO: 1396517 - RNA, 15 nt, Human
gcuaauaucuuaucu

SEQ ID NO: 1396518 - RNA, 23 nt, Human
acgaggauugggaaaaaguaauu

SEQ ID NO: 1396519 - RNA, 15 nt, Human
cugcagauaaacagu

SEQ ID NO: 1396520 - RNA, 17 nt, Human
ucuuuaucuuuuuagua

SEQ ID NO: 1396521 - RNA, 22 nt, Human
ggggugguuuucccaucucagg

SEQ ID NO: 1396522 - RNA, 17 nt, Human
cguaaucguguccccua

SEQ ID NO: 1396523 - RNA, 19 nt, Human
augcagagguccacaacac

SEQ ID NO: 1396524 - RNA, 18 nt, Human
gaugcaguucugaagaag

SEQ ID NO: 1396525 - RNA, 14 nt, Human
acacugaagaagca

SEQ ID NO: 1396526 - RNA, 16 nt, Human
uuucacauuuaaauaa

SEQ ID NO: 1396527 - RNA, 14 nt, Human
auuucuaugaaaua

SEQ ID NO: 1396528 - RNA, 14 nt, Human
cagugaaagaaaau

SEQ ID NO: 1396529 - RNA, 19 nt, Human
auuuacagagacagaaagc

SEQ ID NO: 1396530 - RNA, 14 nt, Human
ccgcuuaagcuuuc

SEQ ID NO: 1396531 - RNA, 13 nt, Human
cuaugaaauauua

SEQ ID NO: 1396532 - RNA, 22 nt, Human
uuuauggcacuaguauuucuau

SEQ ID NO: 1396533 - RNA, 14 nt, Human
cauuuaguuauaaa

SEQ ID NO: 1396534 - RNA, 23 nt, Human
ugaauuauguuugcauguucacu

SEQ ID NO: 1396535 - RNA, 23 nt, Human
augucaauucuugccaaauauaa

SEQ ID NO: 1396536 - RNA, 12 nt, Human
aggggcgcucgc

SEQ ID NO: 1396537 - RNA, 22 nt, Human
caaugcuguauuuuaaaagaau

SEQ ID NO: 1396538 - RNA, 20 nt, Human
cugagaccaaggcccccggg

SEQ ID NO: 1396539 - RNA, 17 nt, Human
aauaaaguguuugaaag

SEQ ID NO: 1396540 - RNA, 13 nt, Human
acaagagcuuaac

SEQ ID NO: 1396541 - RNA, 15 nt, Human
acuauuauauuucca

SEQ ID NO: 1396542 - RNA, 18 nt, Human
ccacuuggucugugagau

SEQ ID NO: 1396543 - RNA, 15 nt, Human
uggcuaauuagcaug

SEQ ID NO: 1396544 - RNA, 22 nt, Human
ccauuucuugagguaaaagcau

SEQ ID NO: 1396545 - RNA, 17 nt, Human
agucugacuguuuccau

SEQ ID NO: 1396546 - RNA, 19 nt, Human
acagugauuaccagggacu

SEQ ID NO: 1396547 - RNA, 15 nt, Human
aaaaaagaaacauuu

SEQ ID NO: 1396548 - RNA, 16 nt, Human
cugcugagucccaggc

SEQ ID NO: 1396549 - RNA, 15 nt, Human
ccggagccuccagcu

SEQ ID NO: 1396550 - RNA, 15 nt, Human
uucggccuccauccu

SEQ ID NO: 1396551 - RNA, 17 nt, Human
uaugcuauugaaguuuu

SEQ ID NO: 1396552 - RNA, 13 nt, Human
cuuaucaaaggac

SEQ ID NO: 1396553 - RNA, 23 nt, Human
caggaaucacuggcuguuaaucu

SEQ ID NO: 1396554 - RNA, 15 nt, Human
aguucugaagaagau

SEQ ID NO: 1396555 - RNA, 21 nt, Human
ugccuguaaucacagcuacuu

SEQ ID NO: 1396556 - RNA, 19 nt, Human
uuauggcacuaguauuucu

SEQ ID NO: 1396557 - RNA, 16 nt, Human
caugggacagggagga

SEQ ID NO: 1396558 - RNA, 21 nt, Human
agggugauauuaaccaggggc

SEQ ID NO: 1396559 - RNA, 20 nt, Human
uuguaggugacuauuauauu

SEQ ID NO: 1396560 - RNA, 23 nt, Human
uguugcccacagcuguaugauuc

SEQ ID NO: 1396561 - RNA, 14 nt, Human
cuuguacucugaaa

SEQ ID NO: 1396562 - RNA, 23 nt, Human
uaauuuguaguguuggagaagaa

SEQ ID NO: 1396563 - RNA, 15 nt, Human
cuacuaauuuuaaaa

SEQ ID NO: 1396564 - RNA, 18 nt, Human
ccacaucugagccccgaa

SEQ ID NO: 1396565 - RNA, 15 nt, Human
gcaagcucuaucacc

SEQ ID NO: 1396566 - RNA, 15 nt, Human
aguuuauauagaaau

SEQ ID NO: 1396567 - RNA, 14 nt, Human
cuauuauauuucca

SEQ ID NO: 1396568 - RNA, 18 nt, Human
gccccgucccccucuggc

SEQ ID NO: 1396569 - RNA, 14 nt, Human
cagccaccagucca

SEQ ID NO: 1396570 - RNA, 18 nt, Human
cuccauuuuuagugaaau

SEQ ID NO: 1396571 - RNA, 14 nt, Human
acgcauggaaaagu

SEQ ID NO: 1396572 - RNA, 20 nt, Human
gacauuugcucauggaauug

SEQ ID NO: 1396573 - RNA, 20 nt, Human
agcucaggcuggcaccgcug

SEQ ID NO: 1396574 - RNA, 21 nt, Human
aaauaauuuuuauauuugaaa

SEQ ID NO: 1396575 - RNA, 22 nt, Human
agcuaaugaaguguuuagcaua

SEQ ID NO: 1396576 - RNA, 15 nt, Human
ccuugccaugugcua

SEQ ID NO: 1396577 - RNA, 16 nt, Human
gaaauguauucuuuua

SEQ ID NO: 1396578 - RNA, 20 nt, Human
aaaaucuuauaauuuaaaau

SEQ ID NO: 1396579 - RNA, 16 nt, Human
agucucuaucauuaaa

SEQ ID NO: 1396580 - RNA, 19 nt, Human
cuggcucuggacaggcacu

SEQ ID NO: 1396581 - RNA, 18 nt, Human
aucagcaucccuagaaag

SEQ ID NO: 1396582 - RNA, 19 nt, Human
gcaggcacugccaaaacau

SEQ ID NO: 1396583 - RNA, 14 nt, Human
agugucuugaauug

SEQ ID NO: 1396584 - RNA, 14 nt, Human
acccugaggugagc

SEQ ID NO: 1396585 - RNA, 14 nt, Human
cacaacacacagau

SEQ ID NO: 1396586 - RNA, 17 nt, Human
ugaaggauuuauguuua

SEQ ID NO: 1396587 - RNA, 17 nt, Human
gcaagcucuaucaccaa

SEQ ID NO: 1396588 - RNA, 10 nt, Human
accugagccc

SEQ ID NO: 1396589 - RNA, 14 nt, Human
uaaaguaugugcau

SEQ ID NO: 1396590 - RNA, 14 nt, Human
gggcuggaugcucu

SEQ ID NO: 1396591 - RNA, 19 nt, Human
cucggccugcucgcccacu

SEQ ID NO: 1396592 - RNA, 20 nt, Human
ucuaugagggcuaauaucuu

SEQ ID NO: 1396593 - RNA, 20 nt, Human
cagucccuccccaaaugcuu

SEQ ID NO: 1396594 - RNA, 16 nt, Human
uggucugugagaugcu

SEQ ID NO: 1396595 - RNA, 23 nt, Human
uggcuugaguuuaaauuguaaua

SEQ ID NO: 1396596 - RNA, 15 nt, Human
gacaguauggcagcu

SEQ ID NO: 1396597 - RNA, 18 nt, Human
cgcgagcgcgcgcgcccu

SEQ ID NO: 1396598 - RNA, 19 nt, Human
ccgcagggugaacugcagc

SEQ ID NO: 1396599 - RNA, 20 nt, Human
agcugccccggggaggggcg

SEQ ID NO: 1396600 - RNA, 11 nt, Human
uuauuuuuaaa

SEQ ID NO: 1396601 - RNA, 14 nt, Human
caaggcuagaacca

SEQ ID NO: 1396602 - RNA, 17 nt, Human
cucgugggacagucacc

SEQ ID NO: 1396603 - RNA, 20 nt, Human
cugccgugggccugagacca

SEQ ID NO: 1396604 - RNA, 15 nt, Human
gaaaacaaggaugaa

SEQ ID NO: 1396605 - RNA, 18 nt, Human
agucuucagcagagaagu

SEQ ID NO: 1396606 - RNA, 22 nt, Human
uuugaaacgaggauugggaaaa

SEQ ID NO: 1396607 - RNA, 13 nt, Human
aucuggcucugga

SEQ ID NO: 1396608 - RNA, 15 nt, Human
ggccuucggccucca

SEQ ID NO: 1396609 - RNA, 13 nt, Human
cagcucaggcugg

SEQ ID NO: 1396610 - RNA, 23 nt, Human
aggaccggccuuugcaccuccau

SEQ ID NO: 1396611 - RNA, 15 nt, Human
ggccuccauccugag

SEQ ID NO: 1396612 - RNA, 20 nt, Human
cccugcacuccagccugagc

SEQ ID NO: 1396613 - RNA, 13 nt, Human
cggccgcgcugcg

SEQ ID NO: 1396614 - RNA, 14 nt, Human
uuccccucugcagc

SEQ ID NO: 1396615 - RNA, 19 nt, Human
acuuuuauaagaaauagga

SEQ ID NO: 1396616 - RNA, 17 nt, Human
ccucagucucccucccu

SEQ ID NO: 1396617 - RNA, 18 nt, Human
guuaguauuguccagguc

SEQ ID NO: 1396618 - RNA, 12 nt, Human
cacaacacacag

SEQ ID NO: 1396619 - RNA, 14 nt, Human
aaauauuauuuuau

SEQ ID NO: 1396620 - RNA, 22 nt, Human
gaggggagcaugggaagugacg

SEQ ID NO: 1396621 - RNA, 14 nt, Human
uaguaucaaaagaa

SEQ ID NO: 1396622 - RNA, 13 nt, Human
cccuccuuaucaa

SEQ ID NO: 1396623 - RNA, 16 nt, Human
uuuucucuaggaaaua

SEQ ID NO: 1396624 - RNA, 19 nt, Human
aguauuucuaugaaauauu

SEQ ID NO: 1396625 - RNA, 18 nt, Human
ugaggcaggcacugccaa

SEQ ID NO: 1396626 - RNA, 14 nt, Human
gcuggagcucugcc

SEQ ID NO: 1396627 - RNA, 14 nt, Human
aauggcuaagcaaa

SEQ ID NO: 1396628 - RNA, 14 nt, Human
agaaaauaacaaua

SEQ ID NO: 1396629 - RNA, 18 nt, Human
aaauaacgauaaaagaca

SEQ ID NO: 1396630 - RNA, 22 nt, Human
auauuuccuuauucagaauuuc

SEQ ID NO: 1396631 - RNA, 22 nt, Human
aaugggcacaggguuuauguuu

SEQ ID NO: 1396632 - RNA, 21 nt, Human
uggggcuuuaacuccugcuag

SEQ ID NO: 1396633 - RNA, 24 nt, Human
cauaugaaaaggcuaagcuucacu

SEQ ID NO: 1396634 - RNA, 17 nt, Human
ggagggcgcggggcggg

SEQ ID NO: 1396635 - RNA, 20 nt, Human
ccauuguggucacaggaagu

SEQ ID NO: 1396636 - RNA, 18 nt, Human
cuaauaucuuaucuuccu

SEQ ID NO: 1396637 - RNA, 21 nt, Human
uccccuugggggugguggaug

SEQ ID NO: 1396638 - RNA, 17 nt, Human
cccccugcaaagcccag

SEQ ID NO: 1396639 - RNA, 15 nt, Human
ugauuucauucaaua

SEQ ID NO: 1396640 - RNA, 21 nt, Human
uuccugacugcuaguuuauau

SEQ ID NO: 1396641 - RNA, 14 nt, Human
uuaauuauuucacu

SEQ ID NO: 1396642 - RNA, 16 nt, Human
aauugacccacaagaa

SEQ ID NO: 1396643 - RNA, 22 nt, Human
gaugcaguuguugcccacagcu

SEQ ID NO: 1396644 - RNA, 22 nt, Human
aaacaaggaugaauuaaguuuu

SEQ ID NO: 1396645 - RNA, 16 nt, Human
agauagaugaagaagc

SEQ ID NO: 1396646 - RNA, 21 nt, Human
ggaagacaagaaggaaagauu

SEQ ID NO: 1396647 - RNA, 21 nt, Human
uuuuauggcacuaguauuucu

SEQ ID NO: 1396648 - RNA, 14 nt, Human
ggccuucggccucc

SEQ ID NO: 1396649 - RNA, 19 nt, Human
ggagcuggaaacacauguu

SEQ ID NO: 1396650 - RNA, 13 nt, Human
cugggucgccggc

SEQ ID NO: 1396651 - RNA, 17 nt, Human
cugagaugggagaauca

SEQ ID NO: 1396652 - RNA, 20 nt, Human
uugauaaguacaugauaagc

SEQ ID NO: 1396653 - RNA, 16 nt, Human
ccuagucucuaucauu

SEQ ID NO: 1396654 - RNA, 21 nt, Human
aguuguugcccacagcuguau

SEQ ID NO: 1396655 - RNA, 14 nt, Human
cagauccuggaaau

SEQ ID NO: 1396656 - RNA, 15 nt, Human
cugcacuccagccug

SEQ ID NO: 1396657 - RNA, 16 nt, Human
ccuggugggcagagag

SEQ ID NO: 1396658 - RNA, 23 nt, Human
uuuccaucaaggguacacugccu

SEQ ID NO: 1396659 - RNA, 16 nt, Human
agaugcuagaacuccc

SEQ ID NO: 1396660 - RNA, 18 nt, Human
uauauuuuuuuuuuuaaa

SEQ ID NO: 1396661 - RNA, 16 nt, Human
cacuuaaaaaugguuu

SEQ ID NO: 1396662 - RNA, 19 nt, Human
gacagucaccucauggaau

SEQ ID NO: 1396663 - RNA, 19 nt, Human
caguccauugggcaggcag

SEQ ID NO: 1396664 - RNA, 15 nt, Human
agaaaacaauaacga

SEQ ID NO: 1396665 - RNA, 21 nt, Human
auuauauuuauuacuguaaga

SEQ ID NO: 1396666 - RNA, 22 nt, Human
uauccuacuuccccuuccuaau

SEQ ID NO: 1396667 - RNA, 22 nt, Human
cuucaacucccugccccccagc

SEQ ID NO: 1396668 - RNA, 23 nt, Human
cucaggggggugguuuucccauc

SEQ ID NO: 1396669 - RNA, 19 nt, Human
aagcuaugugagcucacca

SEQ ID NO: 1396670 - RNA, 16 nt, Human
ugaaauuguauuacaa

SEQ ID NO: 1396671 - RNA, 12 nt, Human
uuauuucacuuu

SEQ ID NO: 1396672 - RNA, 21 nt, Human
aucuuguaaagguccuggcaa

SEQ ID NO: 1396673 - RNA, 18 nt, Human
uaauuagcauggccacau

SEQ ID NO: 1396674 - RNA, 15 nt, Human
ccucucuuccucccu

SEQ ID NO: 1396675 - RNA, 21 nt, Human
cucaaaacuucagacauagaa

SEQ ID NO: 1396676 - RNA, 20 nt, Human
acuaaauugacacuuaaaaa

SEQ ID NO: 1396677 - RNA, 16 nt, Human
ugcacaucaaaauaug

SEQ ID NO: 1396678 - RNA, 13 nt, Human
gagccggagccuc

SEQ ID NO: 1396679 - RNA, 17 nt, Human
agacagugaaagaaaau

SEQ ID NO: 1396680 - RNA, 22 nt, Human
agcauuguuggcuguuccugca

SEQ ID NO: 1396681 - RNA, 14 nt, Human
uugccaugugcuag

SEQ ID NO: 1396682 - RNA, 18 nt, Human
cuuuucccaacuccagaa

SEQ ID NO: 1396683 - RNA, 18 nt, Human
auaauccuaaacauauga

SEQ ID NO: 1396684 - RNA, 21 nt, Human
cuggccaccugcugagcccca

SEQ ID NO: 1396685 - RNA, 17 nt, Human
uguuggcuguuccugca

SEQ ID NO: 1396686 - RNA, 20 nt, Human
augcuucuguuuuauaauuu

SEQ ID NO: 1396687 - RNA, 23 nt, Human
ugucacgugugggcaauguuccc

SEQ ID NO: 1396688 - RNA, 14 nt, Human
auuuaauuauuuca

SEQ ID NO: 1396689 - RNA, 17 nt, Human
uggcuaagcaaaaugug

SEQ ID NO: 1396690 - RNA, 13 nt, Human
auugauuauaugu

SEQ ID NO: 1396691 - RNA, 20 nt, Human
cucagcuucacccugaggug

SEQ ID NO: 1396692 - RNA, 21 nt, Human
cugccccggggaggggcgcuc

SEQ ID NO: 1396693 - RNA, 20 nt, Human
uuauucacuguauguccuug

SEQ ID NO: 1396694 - RNA, 19 nt, Human
ggcugcugguggcgcuggc

SEQ ID NO: 1396695 - RNA, 20 nt, Human
accugauuucugagcauuua

SEQ ID NO: 1396696 - RNA, 15 nt, Human
uacuaauuuuaaaau

SEQ ID NO: 1396697 - RNA, 13 nt, Human
ggcaggcacugcc

SEQ ID NO: 1396698 - RNA, 18 nt, Human
uucagcagagaaguuuuc

SEQ ID NO: 1396699 - RNA, 22 nt, Human
aggacaccauuuuggcaagcuc

SEQ ID NO: 1396700 - RNA, 23 nt, Human
aucaccaaggcugauuaaaccaa

SEQ ID NO: 1396701 - RNA, 15 nt, Human
uauaauuuaaauaua

SEQ ID NO: 1396702 - RNA, 23 nt, Human
augaauaucaguuauuuuuaaac

SEQ ID NO: 1396703 - RNA, 18 nt, Human
agcuuugugcagauucuu

SEQ ID NO: 1396704 - RNA, 19 nt, Human
gaaggcaccucucuggguu

SEQ ID NO: 1396705 - RNA, 19 nt, Human
ugcagcgaguacuucccgc

SEQ ID NO: 1396706 - RNA, 19 nt, Human
uucccuugaugaagaaguu

SEQ ID NO: 1396707 - RNA, 22 nt, Human
gcacagccucuuagaugcaguu

SEQ ID NO: 1396708 - RNA, 16 nt, Human
gagcaucaucuucugg

SEQ ID NO: 1396709 - RNA, 16 nt, Human
cuguggauuuaaugug

SEQ ID NO: 1396710 - RNA, 13 nt, Human
aauuuuuauauuu

SEQ ID NO: 1396711 - RNA, 19 nt, Human
cugagccucagucucccuc

SEQ ID NO: 1396712 - RNA, 14 nt, Human
uaauaucuuaucuu

SEQ ID NO: 1396713 - RNA, 12 nt, Human
gccccugagccc

SEQ ID NO: 1396714 - RNA, 15 nt, Human
aucaauuuaaaaaaa

SEQ ID NO: 1396715 - RNA, 19 nt, Human
ugggacaggggagaaccua

SEQ ID NO: 1396716 - RNA, 15 nt, Human
auauuuuuuguuaaa

SEQ ID NO: 1396717 - RNA, 20 nt, Human
aacaagccuccuuuuaaagu

SEQ ID NO: 1396718 - RNA, 19 nt, Human
guggauuuaauguggaaau

SEQ ID NO: 1396719 - RNA, 20 nt, Human
ugcagccaccaguccauugg

SEQ ID NO: 1396720 - RNA, 15 nt, Human
ccggggaggggcgcu

SEQ ID NO: 1396721 - RNA, 17 nt, Human
uaagaaauaggaaauau

SEQ ID NO: 1396722 - RNA, 22 nt, Human
aaagagugaaggauuuauguuu

SEQ ID NO: 1396723 - RNA, 17 nt, Human
aucaaggguacacugcc

SEQ ID NO: 1396724 - RNA, 21 nt, Human
cagugagacagcucugcauac

SEQ ID NO: 1396725 - RNA, 14 nt, Human
cugucucaguccau

SEQ ID NO: 1396726 - RNA, 15 nt, Human
ccaucccggccggcg

SEQ ID NO: 1396727 - RNA, 22 nt, Human
gcugguggcgcuggcugcgcuc

SEQ ID NO: 1396728 - RNA, 14 nt, Human
uugcuggagcucug

SEQ ID NO: 1396729 - RNA, 15 nt, Human
aggaacuggugucuu

SEQ ID NO: 1396730 - RNA, 14 nt, Human
uuagagaauuuccu

SEQ ID NO: 1396731 - RNA, 19 nt, Human
auacuaauuauacccccug

SEQ ID NO: 1396732 - RNA, 15 nt, Human
auuauagucacuagu

SEQ ID NO: 1396733 - RNA, 17 nt, Human
aacaguuaccucugccu

SEQ ID NO: 1396734 - RNA, 22 nt, Human
gucucagcuucacccugaggug

SEQ ID NO: 1396735 - RNA, 20 nt, Human
accgcuguacgcgagcgcgc

SEQ ID NO: 1396736 - RNA, 17 nt, Human
ccucuggcuccagcugg

SEQ ID NO: 1396737 - RNA, 17 nt, Human
ugacuauuauauuucca

SEQ ID NO: 1396738 - RNA, 17 nt, Human
cuaauaucuuaucuucc

SEQ ID NO: 1396739 - RNA, 16 nt, Human
acaaggaugaauuaag

SEQ ID NO: 1396740 - RNA, 21 nt, Human
cuuguuggacgagaaaacaau

SEQ ID NO: 1396741 - RNA, 21 nt, Human
cacuaucuggguuuugggggg

SEQ ID NO: 1396742 - RNA, 20 nt, Human
auucccagccagcacagccu

SEQ ID NO: 1396743 - RNA, 19 nt, Human
caugaguaacugauuugua

SEQ ID NO: 1396744 - RNA, 18 nt, Human
ugcccauaccccuggcca

SEQ ID NO: 1396745 - RNA, 19 nt, Human
augaguaacugauuuguaa

SEQ ID NO: 1396746 - RNA, 15 nt, Human
ggcuggcgugcagca

SEQ ID NO: 1396747 - RNA, 22 nt, Human
ucuggguuccuuccucugagcc

SEQ ID NO: 1396748 - RNA, 19 nt, Human
cggggcggggagcgagccc

SEQ ID NO: 1396749 - RNA, 21 nt, Human
auucauagcagcuuauucaca

SEQ ID NO: 1396750 - RNA, 18 nt, Human
ucuaugaaauauuauguu

SEQ ID NO: 1396751 - RNA, 16 nt, Human
acagagacagaaagca

SEQ ID NO: 1396752 - RNA, 23 nt, Human
auuuuagauagaugaagaagcua

SEQ ID NO: 1396753 - RNA, 12 nt, Human
gacgagaaaaca

SEQ ID NO: 1396754 - RNA, 18 nt, Human
aguuuauauagaaaugua

SEQ ID NO: 1396755 - RNA, 19 nt, Human
auucagaauuucuaaaagu

SEQ ID NO: 1396756 - RNA, 20 nt, Human
gagccugaucaccugcccug

SEQ ID NO: 1396757 - RNA, 20 nt, Human
ccaggcggguccgggucgca

SEQ ID NO: 1396758 - RNA, 14 nt, Human
caucauuuacuuuu

SEQ ID NO: 1396759 - RNA, 23 nt, Human
guaauuccguagguuauuuucag

SEQ ID NO: 1396760 - RNA, 22 nt, Human
ccacagcuguaugauucccagc

SEQ ID NO: 1396761 - RNA, 12 nt, Human
cuuccucugagc

SEQ ID NO: 1396762 - RNA, 12 nt, Human
aauaaaguacaa

SEQ ID NO: 1396763 - RNA, 19 nt, Human
gacggagccgggaaagaag

SEQ ID NO: 1396764 - RNA, 18 nt, Human
caaggcugauuaaaccaa

SEQ ID NO: 1396765 - RNA, 15 nt, Human
aauacuuuauaaagg

SEQ ID NO: 1396766 - RNA, 17 nt, Human
acaagaaaugaaagcag

SEQ ID NO: 1396767 - RNA, 22 nt, Human
aaaugauguuucauaagaauuc

SEQ ID NO: 1396768 - RNA, 19 nt, Human
ucccgcuguuccucgccac

SEQ ID NO: 1396769 - RNA, 13 nt, Human
agacagcucugca

SEQ ID NO: 1396770 - RNA, 20 nt, Human
cggagccuccagcugccccg

SEQ ID NO: 1396771 - RNA, 21 nt, Human
ccuccagcugccccggggagg

SEQ ID NO: 1396772 - RNA, 21 nt, Human
uugccuaggcauagcccugcc

SEQ ID NO: 1396773 - RNA, 19 nt, Human
ccccugagcuugcagagau

SEQ ID NO: 1396774 - RNA, 19 nt, Human
aagucuuucacauuuaaau

SEQ ID NO: 1396775 - RNA, 14 nt, Human
uaaauaguuuauga

SEQ ID NO: 1396776 - RNA, 13 nt, Human
uauauauuuuuuu

SEQ ID NO: 1396777 - RNA, 21 nt, Human
cgagccccaggcggguccggg

SEQ ID NO: 1396778 - RNA, 22 nt, Human
gcuaauuagcauggccacaucu

SEQ ID NO: 1396779 - RNA, 15 nt, Human
cuccagggagucuca

SEQ ID NO: 1396780 - RNA, 16 nt, Human
cauuuaguuauaaaaa

SEQ ID NO: 1396781 - RNA, 15 nt, Human
uaaaaggaaaugcuc

SEQ ID NO: 1396782 - RNA, 13 nt, Human
aggcuagauguau

SEQ ID NO: 1396783 - RNA, 17 nt, Human
ggagcucguggaacagu

SEQ ID NO: 1396784 - RNA, 19 nt, Human
cucugcauacucauuagga

SEQ ID NO: 1396785 - RNA, 12 nt, Human
uucucuaggaaa

SEQ ID NO: 1396786 - RNA, 15 nt, Human
uaacaauaaaagaca

SEQ ID NO: 1396787 - RNA, 20 nt, Human
aaaacaagcacuaaacaaag

SEQ ID NO: 1396788 - RNA, 20 nt, Human
uaucuucacuuuuauaagaa

SEQ ID NO: 1396789 - RNA, 21 nt, Human
gcuggccaccugcugagcccc

SEQ ID NO: 1396790 - RNA, 20 nt, Human
cggcccugugcggccugguc

SEQ ID NO: 1396791 - RNA, 14 nt, Human
ggccgggagccuga

SEQ ID NO: 1396792 - RNA, 16 nt, Human
ucagcagagaaguuuu

SEQ ID NO: 1396793 - RNA, 22 nt, Human
cacuuccaagagccuuuuuuug

SEQ ID NO: 1396794 - RNA, 19 nt, Human
ccccuauccuacuuccccu

SEQ ID NO: 1396795 - RNA, 18 nt, Human
uaauuauuucacuuuaga

SEQ ID NO: 1396796 - RNA, 18 nt, Human
acauuugcucauggaauu

SEQ ID NO: 1396797 - RNA, 22 nt, Human
caucucuucuggguuccuuccu

SEQ ID NO: 1396798 - RNA, 13 nt, Human
ccaaggaugcccc

SEQ ID NO: 1396799 - RNA, 14 nt, Human
accacaagacugca

SEQ ID NO: 1396800 - RNA, 21 nt, Human
auuuuccugaaaacccuugcc

SEQ ID NO: 1396801 - RNA, 15 nt, Human
acaugugcuggccac

SEQ ID NO: 1396802 - RNA, 16 nt, Human
ccugccccccagcccu

SEQ ID NO: 1396803 - RNA, 15 nt, Human
uguuaaaugauuuca

SEQ ID NO: 1396804 - RNA, 18 nt, Human
cuucacuguaaaauaaua

SEQ ID NO: 1396805 - RNA, 16 nt, Human
ggggagcgagccccag

SEQ ID NO: 1396806 - RNA, 23 nt, Human
auuauauggcuugaguuuaaauu

SEQ ID NO: 1396807 - RNA, 11 nt, Human
uaguuagcuuu

SEQ ID NO: 1396808 - RNA, 21 nt, Human
cuauuuaauuauuucacuuua

SEQ ID NO: 1396809 - RNA, 13 nt, Human
aucaaugaaugaa

SEQ ID NO: 1396810 - RNA, 15 nt, Human
uacaggauuugaaau

SEQ ID NO: 1396811 - RNA, 22 nt, Human
gcuccgcgcagcucaggcuggc

SEQ ID NO: 1396812 - RNA, 20 nt, Human
gaauucauucacucaacaaa

SEQ ID NO: 1396813 - RNA, 20 nt, Human
cacagcacgggggccaagga

SEQ ID NO: 1396814 - RNA, 15 nt, Human
ugcuucuguuuuaua

SEQ ID NO: 1396815 - RNA, 22 nt, Human
uaaaauaauuuuuauauuugaa

SEQ ID NO: 1396816 - RNA, 21 nt, Human
gccuuuucccaacuccagaaa

SEQ ID NO: 1396817 - RNA, 18 nt, Human
agcugcucaauaaaguac

SEQ ID NO: 1396818 - RNA, 18 nt, Human
acugacucuuaagaagac

SEQ ID NO: 1396819 - RNA, 19 nt, Human
aaaagacagugaaagaaaa

SEQ ID NO: 1396820 - RNA, 19 nt, Human
auucuuuacccccugggag

SEQ ID NO: 1396821 - RNA, 16 nt, Human
cgcucaucccacccgc

SEQ ID NO: 1396822 - RNA, 23 nt, Human
uaaaagacagugaaagaaaauaa

SEQ ID NO: 1396823 - RNA, 16 nt, Human
cuguucgcgcgccucc

SEQ ID NO: 1396824 - RNA, 19 nt, Human
caaggaugccccguccccc

SEQ ID NO: 1396825 - RNA, 17 nt, Human
gucaaagcugaaaugga

SEQ ID NO: 1396826 - RNA, 22 nt, Human
aaauaacaaugaaaguugauaa

SEQ ID NO: 1396827 - RNA, 17 nt, Human
gggaaauccacacugag

SEQ ID NO: 1396828 - RNA, 17 nt, Human
gcgcccucuggcugcug

SEQ ID NO: 1396829 - RNA, 14 nt, Human
caccaaccuucuga

SEQ ID NO: 1396830 - RNA, 14 nt, Human
gcgagcgcgcgcgc

SEQ ID NO: 1396831 - RNA, 22 nt, Human
cuaccuguucgcgcgccuccgc

SEQ ID NO: 1396832 - RNA, 18 nt, Human
cagggaggacgcucucug

SEQ ID NO: 1396833 - RNA, 22 nt, Human
acaugagguacugagagugaac

SEQ ID NO: 1396834 - RNA, 16 nt, Human
uuaauaauuuuuaauu

SEQ ID NO: 1396835 - RNA, 15 nt, Human
aaauaauuuuuauau

SEQ ID NO: 1396836 - RNA, 14 nt, Human
uauaauuuaaauau

SEQ ID NO: 1396837 - RNA, 19 nt, Human
ccuccauccugaggcucca

SEQ ID NO: 1396838 - RNA, 21 nt, Human
uguauaaaauaauuuuuauau

SEQ ID NO: 1396839 - RNA, 19 nt, Human
cggccugcucgcccacuuc

SEQ ID NO: 1396840 - RNA, 21 nt, Human
aaguuuaugguuguauuauuu

SEQ ID NO: 1396841 - RNA, 20 nt, Human
cuuauucacaagacccaaaa

SEQ ID NO: 1396842 - RNA, 18 nt, Human
ugccuaauuuguuuuccc

SEQ ID NO: 1396843 - RNA, 17 nt, Human
aauaacaauaaaagaca

SEQ ID NO: 1396844 - RNA, 20 nt, Human
guguggaaggugaucuggcu

SEQ ID NO: 1396845 - RNA, 19 nt, Human
uaccuccaaggaccggccu

SEQ ID NO: 1396846 - RNA, 16 nt, Human
caaguaaaaggaaaug

SEQ ID NO: 1396847 - RNA, 13 nt, Human
auuccucacuuug

SEQ ID NO: 1396848 - RNA, 18 nt, Human
ccgcuacuuccagggcua

SEQ ID NO: 1396849 - RNA, 15 nt, Human
aagaaaauaacaaua

SEQ ID NO: 1396850 - RNA, 20 nt, Human
gcagagaugaggccgccaug

SEQ ID NO: 1396851 - RNA, 17 nt, Human
auucagaauuucuaaaa

SEQ ID NO: 1396852 - RNA, 13 nt, Human
cuuagcccuuccc

SEQ ID NO: 1396853 - RNA, 16 nt, Human
guucugcacacagcac

SEQ ID NO: 1396854 - RNA, 15 nt, Human
agagacagaaagcag

SEQ ID NO: 1396855 - RNA, 16 nt, Human
cccuauccuacuuccc

SEQ ID NO: 1396856 - RNA, 18 nt, Human
ccggagccuccagcugcc

SEQ ID NO: 1396857 - RNA, 15 nt, Human
cugccagcuggccuu

SEQ ID NO: 1396858 - RNA, 14 nt, Human
ugagcuugcagaga

SEQ ID NO: 1396859 - RNA, 18 nt, Human
cccaagccuggcaaggga

SEQ ID NO: 1396860 - RNA, 18 nt, Human
uaaaagacagugaaagaa

SEQ ID NO: 1396861 - RNA, 19 nt, Human
uacaaaaaaaaaaaaaaau

SEQ ID NO: 1396862 - RNA, 16 nt, Human
ugacacuuaaaaaugg

SEQ ID NO: 1396863 - RNA, 13 nt, Human
gcucucuggccuu

SEQ ID NO: 1396864 - RNA, 22 nt, Human
uuuccaagcaaguauuagaaua

SEQ ID NO: 1396865 - RNA, 17 nt, Human
agcgacagugagacucu

SEQ ID NO: 1396866 - RNA, 10 nt, Human
ggggaggggc

SEQ ID NO: 1396867 - RNA, 16 nt, Human
auaucaauuuaaaaaa

SEQ ID NO: 1396868 - RNA, 15 nt, Human
cuuaagaagacugca

SEQ ID NO: 1396869 - RNA, 20 nt, Human
ugagcgcccacuagacccac

SEQ ID NO: 1396870 - RNA, 21 nt, Human
aucuuuuuuuuaauaaaccau

SEQ ID NO: 1396871 - RNA, 18 nt, Human
agucuguuuucccuccuu

SEQ ID NO: 1396872 - RNA, 18 nt, Human
aagggaauuucuucaacu

SEQ ID NO: 1396873 - RNA, 15 nt, Human
auagaaguaaaaaca

SEQ ID NO: 1396874 - RNA, 12 nt, Human
uuuuuuuuaaaa

SEQ ID NO: 1396875 - RNA, 15 nt, Human
cggagccuccagcug

SEQ ID NO: 1396876 - RNA, 13 nt, Human
cgcgagcgcgcgc

SEQ ID NO: 1396877 - RNA, 21 nt, Human
gucucagugucaaugcagccc

SEQ ID NO: 1396878 - RNA, 22 nt, Human
accuaacgaaguauccuucagc

SEQ ID NO: 1396879 - RNA, 13 nt, Human
ccaccugccuaua

SEQ ID NO: 1396880 - RNA, 20 nt, Human
gcgcgcucaucccacccgcc

SEQ ID NO: 1396881 - RNA, 17 nt, Human
uucacuuuuauaagaaa

SEQ ID NO: 1396882 - RNA, 16 nt, Human
gaauggcuaagcaaaa

SEQ ID NO: 1396883 - RNA, 18 nt, Human
auuaaguuuuuuuuuaaa

SEQ ID NO: 1396884 - RNA, 12 nt, Human
guugauggaaau

SEQ ID NO: 1396885 - RNA, 21 nt, Human
cuguguccucaugagggcugg

SEQ ID NO: 1396886 - RNA, 20 nt, Human
gaaaauaacgauaaaagaca

SEQ ID NO: 1396887 - RNA, 11 nt, Human
agacacaugug

SEQ ID NO: 1396888 - RNA, 12 nt, Human
cuuaucuuccua

SEQ ID NO: 1396889 - RNA, 14 nt, Human
aaaagacagugaaa

SEQ ID NO: 1396890 - RNA, 23 nt, Human
aagagccggagccuccagcugcc

SEQ ID NO: 1396891 - RNA, 12 nt, Human
gguauuuuaauc

SEQ ID NO: 1396892 - RNA, 16 nt, Human
agcuugaaaccuucac

SEQ ID NO: 1396893 - RNA, 17 nt, Human
ucugugagaugcuagaa

SEQ ID NO: 1396894 - RNA, 19 nt, Human
cgcucugggucgccggcau

SEQ ID NO: 1396895 - RNA, 17 nt, Human
aaaguacaagagcuuaa

SEQ ID NO: 1396896 - RNA, 17 nt, Human
caaggcccccgggccga

SEQ ID NO: 1396897 - RNA, 16 nt, Human
uuuuagugaaauauua

SEQ ID NO: 1396898 - RNA, 17 nt, Human
guccaaagggcaugggu

SEQ ID NO: 1396899 - RNA, 16 nt, Human
agccuacuaaaugcuc

SEQ ID NO: 1396900 - RNA, 22 nt, Human
auaaaguaugugcauauuuuau

SEQ ID NO: 1396901 - RNA, 11 nt, Human
auuuaaaaauc

SEQ ID NO: 1396902 - RNA, 14 nt, Human
aagugugacucauu

SEQ ID NO: 1396903 - RNA, 22 nt, Human
aauuuaaaaaaaaaccugagcc

SEQ ID NO: 1396904 - RNA, 14 nt, Human
uggcuugaguuuaa

SEQ ID NO: 1396905 - RNA, 16 nt, Human
cugaucaccugcccug

SEQ ID NO: 1396906 - RNA, 20 nt, Human
auuuucaguuauuauauuua

SEQ ID NO: 1396907 - RNA, 16 nt, Human
aauuccacagcugcuc

SEQ ID NO: 1396908 - RNA, 24 nt, Human
ucucuaucauuaaaguucuaguga

SEQ ID NO: 1396909 - RNA, 21 nt, Human
cagcucaggcuggcaccgcug

SEQ ID NO: 1396910 - RNA, 17 nt, Human
gcgccuccgcuacuucc

SEQ ID NO: 1396911 - RNA, 20 nt, Human
agcccuggugggcagagagg

SEQ ID NO: 1396912 - RNA, 13 nt, Human
aaauaaaaauaau

SEQ ID NO: 1396913 - RNA, 19 nt, Human
cuuacucuugauuguggga

SEQ ID NO: 1396914 - RNA, 20 nt, Human
auacugugugcuaaaacaag

SEQ ID NO: 1396915 - RNA, 20 nt, Human
cgcgcucaucccacccgccc

SEQ ID NO: 1396916 - RNA, 13 nt, Human
uuaaaaaagaaac

SEQ ID NO: 1396917 - RNA, 14 nt, Human
ugagaugcuagaac

SEQ ID NO: 1396918 - RNA, 18 nt, Human
uaguaucaaaagaaagaa

SEQ ID NO: 1396919 - RNA, 19 nt, Human
cucuugaggcacagaaacu

SEQ ID NO: 1396920 - RNA, 19 nt, Human
auuuccuuauucagaauuu

SEQ ID NO: 1396921 - RNA, 16 nt, Human
agggcaguguucccug

SEQ ID NO: 1396922 - RNA, 19 nt, Human
cucugccucagaaaacaag

SEQ ID NO: 1396923 - RNA, 21 nt, Human
cuguuaucuucacuuuuauaa

SEQ ID NO: 1396924 - RNA, 19 nt, Human
gcggcccugugcggccugg

SEQ ID NO: 1396925 - RNA, 22 nt, Human
cgugcuugucccuguggaagua

SEQ ID NO: 1396926 - RNA, 23 nt, Human
cuagacccacuggacucaccucc

SEQ ID NO: 1396927 - RNA, 19 nt, Human
gaaagaaaauaacaauaaa

SEQ ID NO: 1396928 - RNA, 18 nt, Human
ggcucuggacaggcacua

SEQ ID NO: 1396929 - RNA, 14 nt, Human
gggaagacaagaag

SEQ ID NO: 1396930 - RNA, 19 nt, Human
aagugugacucauuaaaug

SEQ ID NO: 1396931 - RNA, 16 nt, Human
ugagaugcuagaacuc

SEQ ID NO: 1396932 - RNA, 20 nt, Human
aaauaauuuuuauauuugaa

SEQ ID NO: 1396933 - RNA, 20 nt, Human
aaaagacagugaaagaaaau

SEQ ID NO: 1396934 - RNA, 17 nt, Human
agaaaugaaagcaggga

SEQ ID NO: 1396935 - RNA, 21 nt, Human
ugaauuguaggugacuauuau

SEQ ID NO: 1396936 - RNA, 12 nt, Human
acaugagguacu

SEQ ID NO: 1396937 - RNA, 18 nt, Human
cccgggccgacggagccg

SEQ ID NO: 1396938 - RNA, 22 nt, Human
gccccggggaggggcgcucgcu

SEQ ID NO: 1396939 - RNA, 13 nt, Human
uccucccggccgc

SEQ ID NO: 1396940 - RNA, 22 nt, Human
aauuuuuucucuaggaaauauu

SEQ ID NO: 1396941 - RNA, 21 nt, Human
gccucaagcuaugugagcuca

SEQ ID NO: 1396942 - RNA, 19 nt, Human
gucuuucacauuuaaauaa

SEQ ID NO: 1396943 - RNA, 18 nt, Human
gccuuggggcugaugcag

SEQ ID NO: 1396944 - RNA, 15 nt, Human
auaggaaauauuuua

SEQ ID NO: 1396945 - RNA, 15 nt, Human
augaauuaaguuuuu

SEQ ID NO: 1396946 - RNA, 22 nt, Human
cagcacgggggccaaggaugcc

SEQ ID NO: 1396947 - RNA, 22 nt, Human
gcggggagcgagccccaggcgg

SEQ ID NO: 1396948 - RNA, 21 nt, Human
aaaauaugccccauucaacau

SEQ ID NO: 1396949 - RNA, 20 nt, Human
acggcuccggacgcugcugc

SEQ ID NO: 1396950 - RNA, 13 nt, Human
uuuuaaaaaagaa

SEQ ID NO: 1396951 - RNA, 22 nt, Human
cauuuaguuauaaaaauauaua

SEQ ID NO: 1396952 - RNA, 16 nt, Human
uauguucuaagaagug

SEQ ID NO: 1396953 - RNA, 17 nt, Human
ucuauguagaauauauu

SEQ ID NO: 1396954 - RNA, 15 nt, Human
aaggaauuuaaaaau

SEQ ID NO: 1396955 - RNA, 13 nt, Human
aaaugggaaacaa

SEQ ID NO: 1396956 - RNA, 16 nt, Human
acaugaacuuguaaag

SEQ ID NO: 1396957 - RNA, 22 nt, Human
cggccugcucgcccacuuccuc

SEQ ID NO: 1396958 - RNA, 17 nt, Human
ccagggaagacaagaag

SEQ ID NO: 1396959 - RNA, 20 nt, Human
uuucuucaacucccugcccc

SEQ ID NO: 1396960 - RNA, 13 nt, Human
aacaauaaaagac

SEQ ID NO: 1396961 - RNA, 18 nt, Human
acaugaacuuguaaagga

SEQ ID NO: 1396962 - RNA, 13 nt, Human
aacucuauaaugu

SEQ ID NO: 1396963 - RNA, 23 nt, Human
cagagucaagggugugugcagca

SEQ ID NO: 1396964 - RNA, 20 nt, Human
gcauuguuggcuguuccugc

SEQ ID NO: 1396965 - RNA, 12 nt, Human
ucugcacacagc

SEQ ID NO: 1396966 - RNA, 22 nt, Human
accccugagcuugcagagauga

SEQ ID NO: 1396967 - RNA, 15 nt, Human
aaaauaacaaugaaa

SEQ ID NO: 1396968 - RNA, 18 nt, Human
aacugccaucauuuacuu

SEQ ID NO: 1396969 - RNA, 15 nt, Human
cuugaaaacuuuaug

SEQ ID NO: 1396970 - RNA, 21 nt, Human
agucuguuuucccuccuugga

SEQ ID NO: 1396971 - RNA, 13 nt, Human
gccacaagaaccc

SEQ ID NO: 1396972 - RNA, 18 nt, Human
cuguuuucccuccuugga

SEQ ID NO: 1396973 - RNA, 17 nt, Human
guuuuaggaauacauaa

SEQ ID NO: 1396974 - RNA, 14 nt, Human
uuccgcauccuagu

SEQ ID NO: 1396975 - RNA, 21 nt, Human
agcccuucuuuccacagaagc

SEQ ID NO: 1396976 - RNA, 19 nt, Human
agagccuuuuuuugaaaaa

SEQ ID NO: 1396977 - RNA, 16 nt, Human
uacauuuguauaaaau

SEQ ID NO: 1396978 - RNA, 14 nt, Human
aauuguauuacaaa

SEQ ID NO: 1396979 - RNA, 20 nt, Human
auauguuagagaauuuccuu

SEQ ID NO: 1396980 - RNA, 18 nt, Human
uuacaaaugggaaacaaa

SEQ ID NO: 1396981 - RNA, 16 nt, Human
uuucuauaauuuaaau

SEQ ID NO: 1396982 - RNA, 17 nt, Human
agguccacaacacacag

SEQ ID NO: 1396983 - RNA, 13 nt, Human
ccucccccaucuc

SEQ ID NO: 1396984 - RNA, 19 nt, Human
ccaccugccuauauuuuuu

SEQ ID NO: 1396985 - RNA, 19 nt, Human
aagguccuggcaaagauga

SEQ ID NO: 1396986 - RNA, 17 nt, Human
ucgcagacacaugugcu

SEQ ID NO: 1396987 - RNA, 16 nt, Human
ugaaguccaagcauuu

SEQ ID NO: 1396988 - RNA, 17 nt, Human
agugauuaccagggacu

SEQ ID NO: 1396989 - RNA, 16 nt, Human
aaagacaaggaaaaaa

SEQ ID NO: 1396990 - RNA, 15 nt, Human
uuaaguauuuuauua

SEQ ID NO: 1396991 - RNA, 16 nt, Human
aauuacauuuguauaa

SEQ ID NO: 1396992 - RNA, 23 nt, Human
acugcuaguuuauauagaaaugu

SEQ ID NO: 1396993 - RNA, 20 nt, Human
uaugaaaaggcuaagcuuca

SEQ ID NO: 1396994 - RNA, 17 nt, Human
ugguucccuugaugaag

SEQ ID NO: 1396995 - RNA, 13 nt, Human
aguuaccucugcc

SEQ ID NO: 1396996 - RNA, 21 nt, Human
cggcuccggacgcugcugccg

SEQ ID NO: 1396997 - RNA, 19 nt, Human
ccauccugccccugagccc

SEQ ID NO: 1396998 - RNA, 19 nt, Human
uggccacaucugagccccg

SEQ ID NO: 1396999 - RNA, 23 nt, Human
uauuuuauuaggaguaccauaau

SEQ ID NO: 1397000 - RNA, 12 nt, Human
auuuuaaaagaa

SEQ ID NO: 1397001 - RNA, 14 nt, Human
agcgcgcgcgcccu

SEQ ID NO: 1397002 - RNA, 13 nt, Human
auaauuuuagaca

SEQ ID NO: 1397003 - RNA, 19 nt, Human
ugagcgcccacuagaccca

SEQ ID NO: 1397004 - RNA, 17 nt, Human
aaauccuacuuucauaa

SEQ ID NO: 1397005 - RNA, 16 nt, Human
ugacaagcucacagac

SEQ ID NO: 1397006 - RNA, 18 nt, Human
auccccaagccuggcaag

SEQ ID NO: 1397007 - RNA, 15 nt, Human
uaaaguaaaggcaaa

SEQ ID NO: 1397008 - RNA, 19 nt, Human
gcuguacgcgagcgcgcgc

SEQ ID NO: 1397009 - RNA, 19 nt, Human
auguuuacagauccccaag

SEQ ID NO: 1397010 - RNA, 12 nt, Human
cuccagcugccc

SEQ ID NO: 1397011 - RNA, 18 nt, Human
aaagagugaaggauuuau

SEQ ID NO: 1397012 - RNA, 20 nt, Human
uaaaagacaaggaaaaaaua

SEQ ID NO: 1397013 - RNA, 12 nt, Human
auuuaucauuua

SEQ ID NO: 1397014 - RNA, 16 nt, Human
cuuagcccuuccccuc

SEQ ID NO: 1397015 - RNA, 15 nt, Human
gacucaccuccccca

SEQ ID NO: 1397016 - RNA, 18 nt, Human
ucucagguguguugcagu

SEQ ID NO: 1397017 - RNA, 12 nt, Human
augaccaacauc

SEQ ID NO: 1397018 - RNA, 12 nt, Human
gcgagccccagg

SEQ ID NO: 1397019 - RNA, 22 nt, Human
agaaauaggaaauauuuuaaug

SEQ ID NO: 1397020 - RNA, 15 nt, Human
agucuguuuucccuc

SEQ ID NO: 1397021 - RNA, 13 nt, Human
caagaaggaaaga

SEQ ID NO: 1397022 - RNA, 18 nt, Human
agccgggaaagaagagcc

SEQ ID NO: 1397023 - RNA, 20 nt, Human
ugauuucugagcauuuaaua

SEQ ID NO: 1397024 - RNA, 17 nt, Human
uccucugagccuuggga

SEQ ID NO: 1397025 - RNA, 16 nt, Human
aaaaugugauauguac

SEQ ID NO: 1397026 - RNA, 23 nt, Human
agcuggaaacacauguuccccuu

SEQ ID NO: 1397027 - RNA, 18 nt, Human
acuguaaagcuuugugca

SEQ ID NO: 1397028 - RNA, 23 nt, Human
aucuaugccacaagaacccccuu

SEQ ID NO: 1397029 - RNA, 15 nt, Human
cucgugggacaguca

SEQ ID NO: 1397030 - RNA, 18 nt, Human
acugccuucucaacucca

SEQ ID NO: 1397031 - RNA, 15 nt, Human
cucaacaaacauaau

SEQ ID NO: 1397032 - RNA, 17 nt, Human
agaaucacuugaacccg

SEQ ID NO: 1397033 - RNA, 20 nt, Human
agaagaacugaaaucauacu

SEQ ID NO: 1397034 - RNA, 16 nt, Human
uauaaauuuaucauuu

SEQ ID NO: 1397035 - RNA, 22 nt, Human
ugaguuuuucuuuucauuuacc

SEQ ID NO: 1397036 - RNA, 23 nt, Human
ugcagagguccacaacacacaga

SEQ ID NO: 1397037 - RNA, 14 nt, Human
uaauuauuucacuu

SEQ ID NO: 1397038 - RNA, 19 nt, Human
uguuugccgcuuaagcuuu

SEQ ID NO: 1397039 - RNA, 13 nt, Human
acuauuauauuuc

SEQ ID NO: 1397040 - RNA, 21 nt, Human
aacuuauccuccaugaauauc

SEQ ID NO: 1397041 - RNA, 22 nt, Human
uugaaaaucuuauaauuuaaaa

SEQ ID NO: 1397042 - RNA, 14 nt, Human
cuuggucugugaga

SEQ ID NO: 1397043 - RNA, 13 nt, Human
uguauauuuuaua

SEQ ID NO: 1397044 - RNA, 18 nt, Human
aagaccucauuuugaagg

SEQ ID NO: 1397045 - RNA, 16 nt, Human
auccaaugaaaugagu

SEQ ID NO: 1397046 - RNA, 14 nt, Human
auaaaauaauuuuu

SEQ ID NO: 1397047 - RNA, 16 nt, Human
ccaccugcugagcccc

SEQ ID NO: 1397048 - RNA, 16 nt, Human
uauccuacuuccccuu

SEQ ID NO: 1397049 - RNA, 15 nt, Human
gccucuuagaugcag

SEQ ID NO: 1397050 - RNA, 20 nt, Human
aauuuugugaagcaaaauuu

SEQ ID NO: 1397051 - RNA, 22 nt, Human
aaauguugacaugggacauuug

SEQ ID NO: 1397052 - RNA, 20 nt, Human
caaacugccaucauuuacuu

SEQ ID NO: 1397053 - RNA, 16 nt, Human
uucucuaggaaauauu

SEQ ID NO: 1397054 - RNA, 16 nt, Human
uggaaacgaagcacca

SEQ ID NO: 1397055 - RNA, 19 nt, Human
uaucuauguagaauauauu

SEQ ID NO: 1397056 - RNA, 13 nt, Human
cguugagccacca

SEQ ID NO: 1397057 - RNA, 18 nt, Human
cuggaaacuucagcgguu

SEQ ID NO: 1397058 - RNA, 19 nt, Human
cugacugcuaguuuauaua

SEQ ID NO: 1397059 - RNA, 14 nt, Human
cucaacucugagug

SEQ ID NO: 1397060 - RNA, 19 nt, Human
cccugccccccagcccucc

SEQ ID NO: 1397061 - RNA, 21 nt, Human
cccccauuguggucacaggaa

SEQ ID NO: 1397062 - RNA, 21 nt, Human
aggcucuuuugggauuuuuga

SEQ ID NO: 1397063 - RNA, 19 nt, Human
uagugagcagucaggaaag

SEQ ID NO: 1397064 - RNA, 16 nt, Human
acugcuaguuuauaua

SEQ ID NO: 1397065 - RNA, 14 nt, Human
agccuccagcugcc

SEQ ID NO: 1397066 - RNA, 14 nt, Human
cugggucgccggca

SEQ ID NO: 1397067 - RNA, 20 nt, Human
ucuucagcagagaaguuuuc

SEQ ID NO: 1397068 - RNA, 19 nt, Human
uuuauaucaauuuaaaaaa

SEQ ID NO: 1397069 - RNA, 14 nt, Human
uuuuauaugcuauu

SEQ ID NO: 1397070 - RNA, 20 nt, Human
gaacguaaucguguccccua

SEQ ID NO: 1397071 - RNA, 16 nt, Human
ugcuauugaaguuuug

SEQ ID NO: 1397072 - RNA, 13 nt, Human
uuaugcuaaguga

SEQ ID NO: 1397073 - RNA, 13 nt, Human
uuauaaaaauaua

SEQ ID NO: 1397074 - RNA, 23 nt, Human
uccaaacugacucuuaagaagac

SEQ ID NO: 1397075 - RNA, 21 nt, Human
gccacgcucugggucgccggc

SEQ ID NO: 1397076 - RNA, 14 nt, Human
uaaauaaaaauaau

SEQ ID NO: 1397077 - RNA, 16 nt, Human
aagaaaauaacaauaa

SEQ ID NO: 1397078 - RNA, 17 nt, Human
gacgagaaaacaauaac

SEQ ID NO: 1397079 - RNA, 20 nt, Human
caaacauccuacaagacaca

SEQ ID NO: 1397080 - RNA, 20 nt, Human
uaaaagacagugaaagaaaa

SEQ ID NO: 1397081 - RNA, 22 nt, Human
uccgcauccuagucucuaucau

SEQ ID NO: 1397082 - RNA, 18 nt, Human
auguuaaaacugggacag

SEQ ID NO: 1397083 - RNA, 14 nt, Human
aauaguuuaugauu

SEQ ID NO: 1397084 - RNA, 16 nt, Human
ugugagaugcuagaac

SEQ ID NO: 1397085 - RNA, 15 nt, Human
auaaaguguuugaaa

SEQ ID NO: 1397086 - RNA, 19 nt, Human
gcuccgcgcagcucaggcu

SEQ ID NO: 1397087 - RNA, 16 nt, Human
uaaugaauacuuuaua

SEQ ID NO: 1397088 - RNA, 16 nt, Human
auccuacaagacacag

SEQ ID NO: 1397089 - RNA, 16 nt, Human
aacaauuugaauauaa

SEQ ID NO: 1397090 - RNA, 17 nt, Human
ccacuggacucaccucc

SEQ ID NO: 1397091 - RNA, 19 nt, Human
uuugccaaguucuccacua

SEQ ID NO: 1397092 - RNA, 14 nt, Human
acuggacucaccuc

SEQ ID NO: 1397093 - RNA, 15 nt, Human
ugagcucaccagucc

SEQ ID NO: 1397094 - RNA, 16 nt, Human
gcagugucugcuggag

SEQ ID NO: 1397095 - RNA, 17 nt, Human
cucguggaacaguuacc

SEQ ID NO: 1397096 - RNA, 18 nt, Human
ggcacagaaacuccuguu

SEQ ID NO: 1397097 - RNA, 21 nt, Human
ggagacauugaggcaggcacu

SEQ ID NO: 1397098 - RNA, 14 nt, Human
gugagcuacaaaug

SEQ ID NO: 1397099 - RNA, 13 nt, Human
ugcauuucuaaag

SEQ ID NO: 1397100 - RNA, 12 nt, Human
acaagacacagu

SEQ ID NO: 1397101 - RNA, 11 nt, Human
caacucccugc

SEQ ID NO: 1397102 - RNA, 20 nt, Human
guaucaaaagaaagaaaauc

SEQ ID NO: 1397103 - RNA, 18 nt, Human
cacuccagugagacagcu

SEQ ID NO: 1397104 - RNA, 17 nt, Human
ccugcucgcccacuucc

SEQ ID NO: 1397105 - RNA, 23 nt, Human
uaucuauguagaauauauuuccu

SEQ ID NO: 1397106 - RNA, 14 nt, Human
aaaauacaaaaaaa

SEQ ID NO: 1397107 - RNA, 23 nt, Human
ccacaccaaccuucugaggagcu

SEQ ID NO: 1397108 - RNA, 18 nt, Human
aucuggcucuggacaggc

SEQ ID NO: 1397109 - RNA, 15 nt, Human
aaucucaauauuuca

SEQ ID NO: 1397110 - RNA, 14 nt, Human
ccggggaggggcgc

SEQ ID NO: 1397111 - RNA, 16 nt, Human
aaaguguuugaaagcu

SEQ ID NO: 1397112 - RNA, 14 nt, Human
cgcugcgcgccgcg

SEQ ID NO: 1397113 - RNA, 18 nt, Human
cccucuggcuccagcugg

SEQ ID NO: 1397114 - RNA, 15 nt, Human
uuauagcuacuaauu

SEQ ID NO: 1397115 - RNA, 21 nt, Human
auaauuuuuauauuugaaaua

SEQ ID NO: 1397116 - RNA, 16 nt, Human
cccacuggacucaccu

SEQ ID NO: 1397117 - RNA, 19 nt, Human
gcuguuccucgccacgcuc

SEQ ID NO: 1397118 - RNA, 21 nt, Human
accaaggagccaaacauccua

SEQ ID NO: 1397119 - RNA, 17 nt, Human
uuaaauggucaauuuug

SEQ ID NO: 1397120 - RNA, 12 nt, Human
caggacagcccu

SEQ ID NO: 1397121 - RNA, 20 nt, Human
aagcuucacuguaaaauaau

SEQ ID NO: 1397122 - RNA, 19 nt, Human
aaaauaacaauaaaagaca

SEQ ID NO: 1397123 - RNA, 12 nt, Human
aaugcagccccc

SEQ ID NO: 1397124 - RNA, 17 nt, Human
uuauauuugaaauauug

SEQ ID NO: 1397125 - RNA, 13 nt, Human
cugugcggccugg

SEQ ID NO: 1397126 - RNA, 18 nt, Human
uuuuagugaaauauuauu

SEQ ID NO: 1397127 - RNA, 17 nt, Human
uuuccaugaguugcagu

SEQ ID NO: 1397128 - RNA, 15 nt, Human
acagugaaagaaaau

SEQ ID NO: 1397129 - RNA, 12 nt, Human
gaagaccucauu

SEQ ID NO: 1397130 - RNA, 14 nt, Human
ugagacucugucuc

SEQ ID NO: 1397131 - RNA, 16 nt, Human
ugagccccgaaucuga

SEQ ID NO: 1397132 - RNA, 14 nt, Human
uauuaaguauuuua

SEQ ID NO: 1397133 - RNA, 14 nt, Human
gaaagcagaacagu

SEQ ID NO: 1397134 - RNA, 21 nt, Human
auguuuacagauccccaagcc

SEQ ID NO: 1397135 - RNA, 23 nt, Human
aauguauucuuuuaguuuuuaaa

SEQ ID NO: 1397136 - RNA, 23 nt, Human
ugucaauucuugccaaauauaaa

SEQ ID NO: 1397137 - RNA, 15 nt, Human
acaaaugggaaacaa

SEQ ID NO: 1397138 - RNA, 15 nt, Human
cuuuucccaacucca

SEQ ID NO: 1397139 - RNA, 18 nt, Human
cuccgcgcagcucaggcu

SEQ ID NO: 1397140 - RNA, 18 nt, Human
ccaaccuucugaggagcu

SEQ ID NO: 1397141 - RNA, 16 nt, Human
caauaacgauaaaaga

SEQ ID NO: 1397142 - RNA, 16 nt, Human
uguucuaagaagugaa

SEQ ID NO: 1397143 - RNA, 18 nt, Human
aaaaucuuauaauuuaaa

SEQ ID NO: 1397144 - RNA, 22 nt, Human
cgcuggcugcgcucggccugcu

SEQ ID NO: 1397145 - RNA, 15 nt, Human
uccuacaagacacag

SEQ ID NO: 1397146 - RNA, 20 nt, Human
uccaagccucauguccacug

SEQ ID NO: 1397147 - RNA, 16 nt, Human
ccagucccuccccaaa

SEQ ID NO: 1397148 - RNA, 17 nt, Human
ccaaaaaucucaauauu

SEQ ID NO: 1397149 - RNA, 16 nt, Human
uaaacuuugauuuuau

SEQ ID NO: 1397150 - RNA, 12 nt, Human
cuacaagacaca

SEQ ID NO: 1397151 - RNA, 16 nt, Human
ugaauuaguuuuauau

SEQ ID NO: 1397152 - RNA, 14 nt, Human
cucaccccuugcca

SEQ ID NO: 1397153 - RNA, 14 nt, Human
gcgcgcuccgcgca

SEQ ID NO: 1397154 - RNA, 14 nt, Human
uugauggaaauaca

SEQ ID NO: 1397155 - RNA, 20 nt, Human
gacggcuccggacgcugcug

SEQ ID NO: 1397156 - RNA, 21 nt, Human
gccugaucaccugcccugcug

SEQ ID NO: 1397157 - RNA, 17 nt, Human
uuucauaagaauucugu

SEQ ID NO: 1397158 - RNA, 12 nt, Human
cauagaaguaaa

SEQ ID NO: 1397159 - RNA, 14 nt, Human
acagaauuuuaugc

SEQ ID NO: 1397160 - RNA, 16 nt, Human
uuugcuguuauuuuau

SEQ ID NO: 1397161 - RNA, 19 nt, Human
uaggugacuauuauauuuc

SEQ ID NO: 1397162 - RNA, 13 nt, Human
auaacgauaaaag

SEQ ID NO: 1397163 - RNA, 16 nt, Human
uaacaauaaaagacaa

SEQ ID NO: 1397164 - RNA, 21 nt, Human
ugaugcuacaggauuugaaau

SEQ ID NO: 1397165 - RNA, 19 nt, Human
gagacauugaggcaggcac

SEQ ID NO: 1397166 - RNA, 20 nt, Human
auaacaaugcuguauuuuaa

SEQ ID NO: 1397167 - RNA, 20 nt, Human
gcuggagacauugaggcagg

SEQ ID NO: 1397168 - RNA, 15 nt, Human
agagugugaggaaaa

SEQ ID NO: 1397169 - RNA, 22 nt, Human
cugggacaggggagaaccuagg

SEQ ID NO: 1397170 - RNA, 17 nt, Human
ccccuggccaaggaaga

SEQ ID NO: 1397171 - RNA, 21 nt, Human
gcugagucccaggcugagccu

SEQ ID NO: 1397172 - RNA, 21 nt, Human
acgcucucuggccuucggccu

SEQ ID NO: 1397173 - RNA, 14 nt, Human
auauauuuccuuau

SEQ ID NO: 1397174 - RNA, 14 nt, Human
uggccaccugcuga

SEQ ID NO: 1397175 - RNA, 14 nt, Human
uggcucugugugcu

SEQ ID NO: 1397176 - RNA, 23 nt, Human
ucaauaucuuuuuuuuaauaaac

SEQ ID NO: 1397177 - RNA, 18 nt, Human
augauguuucauaagaau

SEQ ID NO: 1397178 - RNA, 14 nt, Human
cauuuacuuuuaaa

SEQ ID NO: 1397179 - RNA, 21 nt, Human
ccuagucucuaucauuaaagu

SEQ ID NO: 1397180 - RNA, 23 nt, Human
gagaaaugagcacgcauggaaaa

SEQ ID NO: 1397181 - RNA, 12 nt, Human
cucauggaauug

SEQ ID NO: 1397182 - RNA, 16 nt, Human
aaauauuauguuaaaa

SEQ ID NO: 1397183 - RNA, 19 nt, Human
cuaccuguucgcgcgccuc

SEQ ID NO: 1397184 - RNA, 16 nt, Human
guccauugggcaggca

SEQ ID NO: 1397185 - RNA, 20 nt, Human
uuaacacaugauccugcaau

SEQ ID NO: 1397186 - RNA, 19 nt, Human
auuauuuuuuaaaaaaauu

SEQ ID NO: 1397187 - RNA, 16 nt, Human
cugcucucaguucacu

SEQ ID NO: 1397188 - RNA, 23 nt, Human
aucacagcuacuugggaggcuga

SEQ ID NO: 1397189 - RNA, 20 nt, Human
agcuacuaauuuuaaaaugu

SEQ ID NO: 1397190 - RNA, 17 nt, Human
aaauaacgauaaaagac

SEQ ID NO: 1397191 - RNA, 18 nt, Human
cauagguuuaauaauuuu

SEQ ID NO: 1397192 - RNA, 16 nt, Human
accucugccucagaaa

SEQ ID NO: 1397193 - RNA, 20 nt, Human
accucauggaauuggagcuc

SEQ ID NO: 1397194 - RNA, 18 nt, Human
uggagggaagccuugggg

SEQ ID NO: 1397195 - RNA, 13 nt, Human
cacacugaagaag

SEQ ID NO: 1397196 - RNA, 21 nt, Human
aaacgaggauugggaaaaagu

SEQ ID NO: 1397197 - RNA, 18 nt, Human
ggagccgggaaagaagag

SEQ ID NO: 1397198 - RNA, 22 nt, Human
agaauuuuaugcggcauuuucu

SEQ ID NO: 1397199 - RNA, 20 nt, Human
cuggccaccugcugagcccc

SEQ ID NO: 1397200 - RNA, 16 nt, Human
ugacuauuauauuucc

SEQ ID NO: 1397201 - RNA, 22 nt, Human
cuugaauuguaggugacuauua

SEQ ID NO: 1397202 - RNA, 15 nt, Human
uuagugaaauauuau

SEQ ID NO: 1397203 - RNA, 16 nt, Human
ugcucgcccacuuccu

SEQ ID NO: 1397204 - RNA, 20 nt, Human
aagucuuucacauuuaaaua

SEQ ID NO: 1397205 - RNA, 15 nt, Human
aggcagauguuccua

SEQ ID NO: 1397206 - RNA, 23 nt, Human
ggauguggggaaguuaggaacug

SEQ ID NO: 1397207 - RNA, 15 nt, Human
aaaagacaaggaaaa

SEQ ID NO: 1397208 - RNA, 15 nt, Human
ucaagggugugugca

SEQ ID NO: 1397209 - RNA, 12 nt, Human
gacagugaaaga

SEQ ID NO: 1397210 - RNA, 19 nt, Human
agccugaucaccugcccug

SEQ ID NO: 1397211 - RNA, 12 nt, Human
cuaagaagugaa

SEQ ID NO: 1397212 - RNA, 14 nt, Human
acuuuuauaagaaa

SEQ ID NO: 1397213 - RNA, 16 nt, Human
ccccugcacuccagcc

SEQ ID NO: 1397214 - RNA, 18 nt, Human
gagcgacagugagacucu

SEQ ID NO: 1397215 - RNA, 21 nt, Human
gcggcgggagggcgcggggcg

SEQ ID NO: 1397216 - RNA, 13 nt, Human
uagcauggccaca

SEQ ID NO: 1397217 - RNA, 15 nt, Human
uggacgagaaaacaa

SEQ ID NO: 1397218 - RNA, 20 nt, Human
uaauaucuuaucuuccuaua

SEQ ID NO: 1397219 - RNA, 23 nt, Human
uuuauaugcuucuguuuuauaau

SEQ ID NO: 1397220 - RNA, 19 nt, Human
uuccucccuucucuucaca

SEQ ID NO: 1397221 - RNA, 17 nt, Human
ccccaguuguuucuacu

SEQ ID NO: 1397222 - RNA, 15 nt, Human
ccgugggccugagac

SEQ ID NO: 1397223 - RNA, 13 nt, Human
agagguccacaac

SEQ ID NO: 1397224 - RNA, 13 nt, Human
cccaaaaggcaga

SEQ ID NO: 1397225 - RNA, 19 nt, Human
augaaagcagggacuugaa

SEQ ID NO: 1397226 - RNA, 21 nt, Human
caguaguuagcuuucuuccug

SEQ ID NO: 1397227 - RNA, 18 nt, Human
ggaggacgcucucuggcc

SEQ ID NO: 1397228 - RNA, 18 nt, Human
ucuucuggguuccuuccu

SEQ ID NO: 1397229 - RNA, 13 nt, Human
cgggaggcagagg

SEQ ID NO: 1397230 - RNA, 22 nt, Human
uuauaagaaauaggaaauauuu

SEQ ID NO: 1397231 - RNA, 20 nt, Human
auguuucuuggggaauaugu

SEQ ID NO: 1397232 - RNA, 21 nt, Human
uccuucagccugaaagaggaa

SEQ ID NO: 1397233 - RNA, 19 nt, Human
uguggauuuaauguggaaa

SEQ ID NO: 1397234 - RNA, 21 nt, Human
aagacucgggauuaguacaca

SEQ ID NO: 1397235 - RNA, 15 nt, Human
ucauaauaaguugca

SEQ ID NO: 1397236 - RNA, 22 nt, Human
cuuccuaauuccacagcugcuc

SEQ ID NO: 1397237 - RNA, 18 nt, Human
aaaaguucugcagauaaa

SEQ ID NO: 1397238 - RNA, 20 nt, Human
aauuuuuucucuaggaaaua

SEQ ID NO: 1397239 - RNA, 15 nt, Human
uaucaauuuaaaaaa

SEQ ID NO: 1397240 - RNA, 12 nt, Human
cauuauauuuau

SEQ ID NO: 1397241 - RNA, 17 nt, Human
uugcaguuuuuuccuag

SEQ ID NO: 1397242 - RNA, 22 nt, Human
caguauggcagcuuuccucaaa

SEQ ID NO: 1397243 - RNA, 22 nt, Human
gacacaugugcuggccaccugc

SEQ ID NO: 1397244 - RNA, 15 nt, Human
aauauauuuccuuau

SEQ ID NO: 1397245 - RNA, 11 nt, Human
aauuccacagc

SEQ ID NO: 1397246 - RNA, 17 nt, Human
cuacacuccagugagac

SEQ ID NO: 1397247 - RNA, 19 nt, Human
aaugagcacgcauggaaaa

SEQ ID NO: 1397248 - RNA, 13 nt, Human
caacucccugccc

SEQ ID NO: 1397249 - RNA, 10 nt, Human
caacucccug

SEQ ID NO: 1397250 - RNA, 20 nt, Human
uaauucugguagcuaaauau

SEQ ID NO: 1397251 - RNA, 15 nt, Human
cagaauucauucacu

SEQ ID NO: 1397252 - RNA, 17 nt, Human
gacucaccucccccauc

SEQ ID NO: 1397253 - RNA, 14 nt, Human
ugcucauggaauug

SEQ ID NO: 1397254 - RNA, 18 nt, Human
gcacuccagccugagcga

SEQ ID NO: 1397255 - RNA, 18 nt, Human
uauaacaaugcuguauuu

SEQ ID NO: 1397256 - RNA, 17 nt, Human
ggcucuggacaggcacu

SEQ ID NO: 1397257 - RNA, 18 nt, Human
uauguuagagaauuuccu

SEQ ID NO: 1397258 - RNA, 22 nt, Human
gauaaaagacagugaaagaaaa

SEQ ID NO: 1397259 - RNA, 22 nt, Human
auauauaacaaugcuguauuuu

SEQ ID NO: 1397260 - RNA, 17 nt, Human
gccugagcgacagugag

SEQ ID NO: 1397261 - RNA, 14 nt, Human
guccauugggcagg

SEQ ID NO: 1397262 - RNA, 14 nt, Human
agcguugagccacc

SEQ ID NO: 1397263 - RNA, 19 nt, Human
acauuuguauaaaauaauu

SEQ ID NO: 1397264 - RNA, 17 nt, Human
guagaaugggggcagca

SEQ ID NO: 1397265 - RNA, 15 nt, Human
aggcaccucucuggg

SEQ ID NO: 1397266 - RNA, 16 nt, Human
uaaaagacaaggaaaa

SEQ ID NO: 1397267 - RNA, 18 nt, Human
ugugaccacugcagaaga

SEQ ID NO: 1397268 - RNA, 20 nt, Human
cucccugccccccagcccuc

SEQ ID NO: 1397269 - RNA, 15 nt, Human
guuauaaaaauauau

SEQ ID NO: 1397270 - RNA, 18 nt, Human
uuuuaucugcuaugcuau

SEQ ID NO: 1397271 - RNA, 23 nt, Human
gccccugcacuccagccugagcg

SEQ ID NO: 1397272 - RNA, 17 nt, Human
aaacauccuacaagaca

SEQ ID NO: 1397273 - RNA, 14 nt, Human
auuauuucacuuua

SEQ ID NO: 1397274 - RNA, 16 nt, Human
cugcugagccccaagu

SEQ ID NO: 1397275 - RNA, 20 nt, Human
uuaaguuuuuuuuuaaaaaa

SEQ ID NO: 1397276 - RNA, 18 nt, Human
aaauauuuauuuuaauaa

SEQ ID NO: 1397277 - RNA, 13 nt, Human
acaagaaggaaag

SEQ ID NO: 1397278 - RNA, 20 nt, Human
agccuaguugaucagcuuau

SEQ ID NO: 1397279 - RNA, 11 nt, Human
cuauuuaauua

SEQ ID NO: 1397280 - RNA, 18 nt, Human
aaguugauaugccuuuuc

SEQ ID NO: 1397281 - RNA, 17 nt, Human
cucagucucccucccuu

SEQ ID NO: 1397282 - RNA, 12 nt, Human
cuucaacucccu

SEQ ID NO: 1397283 - RNA, 16 nt, Human
ucuuuuaguuuuuaaa

SEQ ID NO: 1397284 - RNA, 17 nt, Human
auuuuaauaauguuuca

SEQ ID NO: 1397285 - RNA, 16 nt, Human
uagcuacuaauuuuaa

SEQ ID NO: 1397286 - RNA, 16 nt, Human
ucaguuuuugugaaaa

SEQ ID NO: 1397287 - RNA, 18 nt, Human
uaauuuuaacucuauaau

SEQ ID NO: 1397288 - RNA, 17 nt, Human
gccccccagcccuccuu

SEQ ID NO: 1397289 - RNA, 13 nt, Human
ugugcuggccacc

SEQ ID NO: 1397290 - RNA, 13 nt, Human
ugagcgacaguga

SEQ ID NO: 1397291 - RNA, 16 nt, Human
auuugaugcuacagga

SEQ ID NO: 1397292 - RNA, 17 nt, Human
agagacagaaagcagaa

SEQ ID NO: 1397293 - RNA, 12 nt, Human
uuuuauauuuga

SEQ ID NO: 1397294 - RNA, 15 nt, Human
gagcgcgcgcgcccu

SEQ ID NO: 1397295 - RNA, 22 nt, Human
aauuguaggugacuauuauauu

SEQ ID NO: 1397296 - RNA, 18 nt, Human
ccugcucgcccacuuccu

SEQ ID NO: 1397297 - RNA, 18 nt, Human
ggccacaucugagccccg

SEQ ID NO: 1397298 - RNA, 22 nt, Human
uggagacauugaggcaggcacu

SEQ ID NO: 1397299 - RNA, 21 nt, Human
cccccucuggcuccagcuggc

SEQ ID NO: 1397300 - RNA, 20 nt, Human
uaacgauaaaagacagugaa

SEQ ID NO: 1397301 - RNA, 16 nt, Human
aaauaacaaugaaagu

SEQ ID NO: 1397302 - RNA, 15 nt, Human
cucgcccacuuccuc

SEQ ID NO: 1397303 - RNA, 18 nt, Human
uuauuacuguaagaaaau

SEQ ID NO: 1397304 - RNA, 17 nt, Human
gcaucuccucaacucug

SEQ ID NO: 1397305 - RNA, 18 nt, Human
agugucaaugcagccccc

SEQ ID NO: 1397306 - RNA, 23 nt, Human
uuagaugcaguucugaagaagau

SEQ ID NO: 1397307 - RNA, 13 nt, Human
aaaauaacaauga

SEQ ID NO: 1397308 - RNA, 14 nt, Human
gaggcacagaaacu

SEQ ID NO: 1397309 - RNA, 20 nt, Human
uguaauaggcguaacuaauu

SEQ ID NO: 1397310 - RNA, 18 nt, Human
uagugaaauauuauuuua

SEQ ID NO: 1397311 - RNA, 18 nt, Human
cuaauuagcauggccaca

SEQ ID NO: 1397312 - RNA, 22 nt, Human
ggcuaagcuucacuguaaaaua

SEQ ID NO: 1397313 - RNA, 16 nt, Human
gcagcaucagcauccc

SEQ ID NO: 1397314 - RNA, 23 nt, Human
accucucuggguugaagggcagu

SEQ ID NO: 1397315 - RNA, 23 nt, Human
uugaaguuuuggcaauugacuau

SEQ ID NO: 1397316 - RNA, 12 nt, Human
gauaaaagacag

SEQ ID NO: 1397317 - RNA, 22 nt, Human
uuuccuuauucagaauuucuaa

SEQ ID NO: 1397318 - RNA, 16 nt, Human
auaguaccucugcuau

SEQ ID NO: 1397319 - RNA, 13 nt, Human
cacauuuaaauaa

SEQ ID NO: 1397320 - RNA, 15 nt, Human
ccucauguccacugg

SEQ ID NO: 1397321 - RNA, 22 nt, Human
accauuucuugagguaaaagca

SEQ ID NO: 1397322 - RNA, 17 nt, Human
ccugagcuugcagagau

SEQ ID NO: 1397323 - RNA, 17 nt, Human
agaagagccggagccuc

SEQ ID NO: 1397324 - RNA, 13 nt, Human
cugagagugaaca

SEQ ID NO: 1397325 - RNA, 16 nt, Human
cacgugugggcaaugu

SEQ ID NO: 1397326 - RNA, 19 nt, Human
auuguaguccuguaaugga

SEQ ID NO: 1397327 - RNA, 18 nt, Human
acucuuaagaagacugca

SEQ ID NO: 1397328 - RNA, 18 nt, Human
acggcuccggacgcugcu

SEQ ID NO: 1397329 - RNA, 20 nt, Human
aguuguuucuacuacaugga

SEQ ID NO: 1397330 - RNA, 18 nt, Human
auagcuacuaauuuuaaa

SEQ ID NO: 1397331 - RNA, 15 nt, Human
cuaagugcagccccg

SEQ ID NO: 1397332 - RNA, 12 nt, Human
uaccuccaagga

SEQ ID NO: 1397333 - RNA, 22 nt, Human
caaggaugccccgucccccucu

SEQ ID NO: 1397334 - RNA, 21 nt, Human
ccccugcaaagcccagcuuga

SEQ ID NO: 1397335 - RNA, 18 nt, Human
gcccuggugggcagagag

SEQ ID NO: 1397336 - RNA, 16 nt, Human
gaccaaggcccccggg

SEQ ID NO: 1397337 - RNA, 18 nt, Human
guuuaugguuguauuauu

SEQ ID NO: 1397338 - RNA, 16 nt, Human
cuggccuucggccucc

SEQ ID NO: 1397339 - RNA, 21 nt, Human
aaugucauuguucuugugaac

SEQ ID NO: 1397340 - RNA, 16 nt, Human
acauccuacaagacac

SEQ ID NO: 1397341 - RNA, 18 nt, Human
ugaagagugugaggaaaa

SEQ ID NO: 1397342 - RNA, 17 nt, Human
auauuuuuuuuuuuaaa

SEQ ID NO: 1397343 - RNA, 23 nt, Human
ucaugcccauaccccuggccaag

SEQ ID NO: 1397344 - RNA, 16 nt, Human
ugcaugguuuagaaag

SEQ ID NO: 1397345 - RNA, 22 nt, Human
auauaugcuaagucuuauauau

SEQ ID NO: 1397346 - RNA, 15 nt, Human
aucuuuaacccacua

SEQ ID NO: 1397347 - RNA, 23 nt, Human
cucuacuaaaaauacaaaaaaaa

SEQ ID NO: 1397348 - RNA, 22 nt, Human
uuguucuugugaacccaaagug

SEQ ID NO: 1397349 - RNA, 15 nt, Human
aaggaaaaaauaaca

SEQ ID NO: 1397350 - RNA, 13 nt, Human
gggcggggagcga

SEQ ID NO: 1397351 - RNA, 13 nt, Human
aucuacacuccag

SEQ ID NO: 1397352 - RNA, 16 nt, Human
aaguaaaggcaaacuu

SEQ ID NO: 1397353 - RNA, 15 nt, Human
cugaaagaggaauga

SEQ ID NO: 1397354 - RNA, 18 nt, Human
uaauuuuagacauucuuu

SEQ ID NO: 1397355 - RNA, 14 nt, Human
gcguugagccacca

SEQ ID NO: 1397356 - RNA, 18 nt, Human
aagaaauaggaaauauuu

SEQ ID NO: 1397357 - RNA, 17 nt, Human
uucacuguaaaauaaua

SEQ ID NO: 1397358 - RNA, 12 nt, Human
aagaaaauaacg

SEQ ID NO: 1397359 - RNA, 16 nt, Human
guuaucuucacuuuua

SEQ ID NO: 1397360 - RNA, 15 nt, Human
gcuguuaaucuuuca

SEQ ID NO: 1397361 - RNA, 23 nt, Human
aggagcuguugagguaccuccaa

SEQ ID NO: 1397362 - RNA, 13 nt, Human
ugugcggccuggu

SEQ ID NO: 1397363 - RNA, 22 nt, Human
cgggucgcaggaccaucccggc

SEQ ID NO: 1397364 - RNA, 23 nt, Human
uugacccucacaggagcaucucc

SEQ ID NO: 1397365 - RNA, 23 nt, Human
ucuccauguacuggcaagaccug

SEQ ID NO: 1397366 - RNA, 14 nt, Human
auauuuauuuuaau

SEQ ID NO: 1397367 - RNA, 15 nt, Human
auuucauucaauauc

SEQ ID NO: 1397368 - RNA, 14 nt, Human
gauaaaagacagug

SEQ ID NO: 1397369 - RNA, 19 nt, Human
caagcagcccuuagcccuu

SEQ ID NO: 1397370 - RNA, 21 nt, Human
gaaaaaaagcuuuuuuugaau

SEQ ID NO: 1397371 - RNA, 18 nt, Human
gccuucggccuccauccu

SEQ ID NO: 1397372 - RNA, 19 nt, Human
uuggcaagcucuaucacca

SEQ ID NO: 1397373 - RNA, 19 nt, Human
cuguacgcgagcgcgcgcg

SEQ ID NO: 1397374 - RNA, 17 nt, Human
cggcccugugcggccug

SEQ ID NO: 1397375 - RNA, 18 nt, Human
ggaacuggugucuucagg

SEQ ID NO: 1397376 - RNA, 15 nt, Human
gcuguauuuuaaaag

SEQ ID NO: 1397377 - RNA, 19 nt, Human
ccuccagggagucucagcu

SEQ ID NO: 1397378 - RNA, 19 nt, Human
ggagggcgcggggcgggga

SEQ ID NO: 1397379 - RNA, 18 nt, Human
acacuguuaucuucacuu

SEQ ID NO: 1397380 - RNA, 17 nt, Human
gccuccuuuuaaaguaa

SEQ ID NO: 1397381 - RNA, 15 nt, Human
uuggggaauauguua

SEQ ID NO: 1397382 - RNA, 13 nt, Human
cgcgcccucuggc

SEQ ID NO: 1397383 - RNA, 20 nt, Human
agccuuuuuuugaaaaaaag

SEQ ID NO: 1397384 - RNA, 14 nt, Human
aagcugaguguuuc

SEQ ID NO: 1397385 - RNA, 20 nt, Human
gaaacauuugguaaggggaa

SEQ ID NO: 1397386 - RNA, 19 nt, Human
cuccgcuacuuccagggcu

SEQ ID NO: 1397387 - RNA, 17 nt, Human
uccauccugaggcucca

SEQ ID NO: 1397388 - RNA, 22 nt, Human
gaagugaaaaucuacacuccag

SEQ ID NO: 1397389 - RNA, 20 nt, Human
uauaugcuaagucuuauaua

SEQ ID NO: 1397390 - RNA, 14 nt, Human
ugagcucagcccug

SEQ ID NO: 1397391 - RNA, 13 nt, Human
cccggccgcgcug

SEQ ID NO: 1397392 - RNA, 17 nt, Human
guauuauuuuuuaaaaa

SEQ ID NO: 1397393 - RNA, 13 nt, Human
aaguucuagugac

SEQ ID NO: 1397394 - RNA, 17 nt, Human
cuucugaggagcuguug

SEQ ID NO: 1397395 - RNA, 18 nt, Human
ucuucaacucccugcccc

SEQ ID NO: 1397396 - RNA, 17 nt, Human
aucauuuacuuuuaaac

SEQ ID NO: 1397397 - RNA, 20 nt, Human
ccucaagcuaugugagcuca

SEQ ID NO: 1397398 - RNA, 17 nt, Human
auguuuacagaucccca

SEQ ID NO: 1397399 - RNA, 18 nt, Human
uaaugaauacuuuauaaa

SEQ ID NO: 1397400 - RNA, 15 nt, Human
agugacaagcucaca

SEQ ID NO: 1397401 - RNA, 15 nt, Human
uuuuaggaauacaua

SEQ ID NO: 1397402 - RNA, 21 nt, Human
cucuucuggguuccuuccucu

SEQ ID NO: 1397403 - RNA, 15 nt, Human
ccagauccuggaaau

SEQ ID NO: 1397404 - RNA, 17 nt, Human
aggcuagaaccaccugc

SEQ ID NO: 1397405 - RNA, 22 nt, Human
gcgcggcgggagggcgcggggc

SEQ ID NO: 1397406 - RNA, 17 nt, Human
acuaguuguaauuuuuu

SEQ ID NO: 1397407 - RNA, 17 nt, Human
acuuccagauccuggaa

SEQ ID NO: 1397408 - RNA, 23 nt, Human
gucucagcuucacccugagguga

SEQ ID NO: 1397409 - RNA, 15 nt, Human
uuuaugguuguauua

SEQ ID NO: 1397410 - RNA, 15 nt, Human
uucacuguaaaauaa

SEQ ID NO: 1397411 - RNA, 16 nt, Human
cagaagcaacccaaau

SEQ ID NO: 1397412 - RNA, 16 nt, Human
auuuuaauaauguuuc

SEQ ID NO: 1397413 - RNA, 17 nt, Human
ccugccccccagcccuc

SEQ ID NO: 1397414 - RNA, 23 nt, Human
cucagucucccucccuuggggcc

SEQ ID NO: 1397415 - RNA, 14 nt, Human
caucucaggugugu

SEQ ID NO: 1397416 - RNA, 15 nt, Human
gcagcucaggcuggc

SEQ ID NO: 1397417 - RNA, 15 nt, Human
gcccugugcggccug

SEQ ID NO: 1397418 - RNA, 16 nt, Human
ccuuccccucugcagc

SEQ ID NO: 1397419 - RNA, 14 nt, Human
ugaagauguagagg

SEQ ID NO: 1397420 - RNA, 19 nt, Human
uauauuuuugugauuuugu

SEQ ID NO: 1397421 - RNA, 15 nt, Human
acgagauacagaauu

SEQ ID NO: 1397422 - RNA, 18 nt, Human
caguuguugcccacagcu

SEQ ID NO: 1397423 - RNA, 19 nt, Human
cuuccagauccuggaaauc

SEQ ID NO: 1397424 - RNA, 20 nt, Human
ucacaugaacuuguaaagga

SEQ ID NO: 1397425 - RNA, 18 nt, Human
ggggcuuuaacuccugcu

SEQ ID NO: 1397426 - RNA, 20 nt, Human
uaguuauaaaaauauauagc

SEQ ID NO: 1397427 - RNA, 23 nt, Human
caauaacgauaaaagacagugaa

SEQ ID NO: 1397428 - RNA, 14 nt, Human
uccagauccuggaa

SEQ ID NO: 1397429 - RNA, 20 nt, Human
cugcacacagcacgggggcc

SEQ ID NO: 1397430 - RNA, 15 nt, Human
ccacaucugagcccc

SEQ ID NO: 1397431 - RNA, 17 nt, Human
uaauuuuuauauuugaa

SEQ ID NO: 1397432 - RNA, 16 nt, Human
uguugagguaccucca

SEQ ID NO: 1397433 - RNA, 22 nt, Human
aaccuacacgagauacagaauu

SEQ ID NO: 1397434 - RNA, 16 nt, Human
augaauacuuuauaaa

SEQ ID NO: 1397435 - RNA, 17 nt, Human
aaccuagggugauauua

SEQ ID NO: 1397436 - RNA, 19 nt, Human
uggagccuacuaaaugcuc

SEQ ID NO: 1397437 - RNA, 22 nt, Human
auggaaauguuuacagaucccc

SEQ ID NO: 1397438 - RNA, 22 nt, Human
cagaucuaugccacaagaaccc

SEQ ID NO: 1397439 - RNA, 14 nt, Human
ccagcuggccggga

SEQ ID NO: 1397440 - RNA, 13 nt, Human
agaaaugaaagca

SEQ ID NO: 1397441 - RNA, 21 nt, Human
cccuauccuacuuccccuucc

SEQ ID NO: 1397442 - RNA, 15 nt, Human
uagggugauauuaac

SEQ ID NO: 1397443 - RNA, 19 nt, Human
aaauaugccccauucaaca

SEQ ID NO: 1397444 - RNA, 21 nt, Human
gcccugcugagucccaggcug

SEQ ID NO: 1397445 - RNA, 22 nt, Human
gugugaccacugcagaagacag

SEQ ID NO: 1397446 - RNA, 14 nt, Human
ugugaaaagcucca

SEQ ID NO: 1397447 - RNA, 23 nt, Human
agcaugucgucaaagcugaaaug

SEQ ID NO: 1397448 - RNA, 19 nt, Human
cagcuacuugggaggcuga

SEQ ID NO: 1397449 - RNA, 16 nt, Human
uuguaaaggaauuuaa

SEQ ID NO: 1397450 - RNA, 21 nt, Human
accaccugccuauauuuuuug

SEQ ID NO: 1397451 - RNA, 15 nt, Human
aucaguaugaaaaug

SEQ ID NO: 1397452 - RNA, 15 nt, Human
ccagcacagccucuu

SEQ ID NO: 1397453 - RNA, 16 nt, Human
cagucucccucccuug

SEQ ID NO: 1397454 - RNA, 18 nt, Human
ccuuugcaccuccaugga

SEQ ID NO: 1397455 - RNA, 19 nt, Human
uaaugaaguguuuagcaua

SEQ ID NO: 1397456 - RNA, 21 nt, Human
auuuuuucucuaggaaauauu

SEQ ID NO: 1397457 - RNA, 14 nt, Human
acgagaaaacaaua

SEQ ID NO: 1397458 - RNA, 16 nt, Human
acauuuauauuuuugu

SEQ ID NO: 1397459 - RNA, 23 nt, Human
uguggaaggugaucuggcucugg

SEQ ID NO: 1397460 - RNA, 20 nt, Human
cucggacggcuccggacgcu

SEQ ID NO: 1397461 - RNA, 14 nt, Human
gaacgagacaagca

SEQ ID NO: 1397462 - RNA, 21 nt, Human
gccaaauauaaauaaaaauaa

SEQ ID NO: 1397463 - RNA, 13 nt, Human
aucaggcuggcca

SEQ ID NO: 1397464 - RNA, 20 nt, Human
agcagcccuuagcccuuccc

SEQ ID NO: 1397465 - RNA, 19 nt, Human
gaaaauaacgauaaaagac

SEQ ID NO: 1397466 - RNA, 19 nt, Human
uauacugugugcuaaaaca

SEQ ID NO: 1397467 - RNA, 16 nt, Human
agagguccacaacaca

SEQ ID NO: 1397468 - RNA, 14 nt, Human
cgcgcccucuggcu

SEQ ID NO: 1397469 - RNA, 23 nt, Human
cucagcccuggugggcagagagg

SEQ ID NO: 1397470 - RNA, 20 nt, Human
uaugcuauuuauuaaguauu

SEQ ID NO: 1397471 - RNA, 23 nt, Human
uccagguagaggguguguaagua

SEQ ID NO: 1397472 - RNA, 20 nt, Human
aaagacagugaaagaaaaua

SEQ ID NO: 1397473 - RNA, 14 nt, Human
ccggagccuccagc

SEQ ID NO: 1397474 - RNA, 18 nt, Human
cauguuccccuugggggu

SEQ ID NO: 1397475 - RNA, 14 nt, Human
cggccggcgcgcuc

SEQ ID NO: 1397476 - RNA, 17 nt, Human
cucacaggagcaucucc

SEQ ID NO: 1397477 - RNA, 18 nt, Human
accaccugccuauauuuu

SEQ ID NO: 1397478 - RNA, 17 nt, Human
ggcuccggacgcugcug

SEQ ID NO: 1397479 - RNA, 18 nt, Human
uauuuucaguuauuauau

SEQ ID NO: 1397480 - RNA, 20 nt, Human
uguuggugaacuugguuuua

SEQ ID NO: 1397481 - RNA, 20 nt, Human
augucgucaaagcugaaaug

SEQ ID NO: 1397482 - RNA, 22 nt, Human
cagacacaugugcuggccaccu

SEQ ID NO: 1397483 - RNA, 14 nt, Human
cugcugguggcgcu

SEQ ID NO: 1397484 - RNA, 22 nt, Human
agaaagugacaagcucacagac

SEQ ID NO: 1397485 - RNA, 19 nt, Human
cuucacccugaggugagca

SEQ ID NO: 1397486 - RNA, 15 nt, Human
uuucccagucuucag

SEQ ID NO: 1397487 - RNA, 22 nt, Human
aauugacccacaagaaaugaaa

SEQ ID NO: 1397488 - RNA, 20 nt, Human
aaggaugccccgucccccuc

SEQ ID NO: 1397489 - RNA, 23 nt, Human
agggcgcggggcggggagcgagc

SEQ ID NO: 1397490 - RNA, 11 nt, Human
uucacagggga

SEQ ID NO: 1397491 - RNA, 19 nt, Human
gaaugggggcagcaccucc

SEQ ID NO: 1397492 - RNA, 17 nt, Human
cgcgccuccgcuacuuc

SEQ ID NO: 1397493 - RNA, 19 nt, Human
uggaaauguuuacagaucc

SEQ ID NO: 1397494 - RNA, 23 nt, Human
aucucuucuggguuccuuccucu

SEQ ID NO: 1397495 - RNA, 15 nt, Human
ggagccuccagcugc

SEQ ID NO: 1397496 - RNA, 17 nt, Human
auuauuuuuuaaaaaaa

SEQ ID NO: 1397497 - RNA, 13 nt, Human
cgaguacuucccg

SEQ ID NO: 1397498 - RNA, 18 nt, Human
uuccaagaaauauuccuu

SEQ ID NO: 1397499 - RNA, 15 nt, Human
cauuccaagccucau

SEQ ID NO: 1397500 - RNA, 15 nt, Human
aauauaaauaaaaau

SEQ ID NO: 1397501 - RNA, 15 nt, Human
uauaaauaaaaauaa

SEQ ID NO: 1397502 - RNA, 22 nt, Human
aucuucacuuuuauaagaaaua

SEQ ID NO: 1397503 - RNA, 16 nt, Human
uagaauauauuuccuu

SEQ ID NO: 1397504 - RNA, 22 nt, Human
agaagagccggagccuccagcu

SEQ ID NO: 1397505 - RNA, 15 nt, Human
uuauaugcuauuuau

SEQ ID NO: 1397506 - RNA, 14 nt, Human
ucucuaucauuaaa

SEQ ID NO: 1397507 - RNA, 21 nt, Human
caauuuuguuauguauauuuu

SEQ ID NO: 1397508 - RNA, 21 nt, Human
aauucauucacucaacaaaca

SEQ ID NO: 1397509 - RNA, 13 nt, Human
ugaaaaucuuaua

SEQ ID NO: 1397510 - RNA, 23 nt, Human
gcugccccggggaggggcgcucg

SEQ ID NO: 1397511 - RNA, 18 nt, Human
cacaaguaaaaggaaaug

SEQ ID NO: 1397512 - RNA, 22 nt, Human
aagacccaaaaggcagaagcaa

SEQ ID NO: 1397513 - RNA, 12 nt, Human
gaaggggcggcg

SEQ ID NO: 1397514 - RNA, 21 nt, Human
aauuuuuauauuugaaauauu

SEQ ID NO: 1397515 - RNA, 23 nt, Human
aucuuccuauaauuuuagacauu

SEQ ID NO: 1397516 - RNA, 18 nt, Human
uguaaaggaauuuaaaaa

SEQ ID NO: 1397517 - RNA, 22 nt, Human
acccugaggugagcaucaucuu

SEQ ID NO: 1397518 - RNA, 15 nt, Human
uugacccacaagaaa

SEQ ID NO: 1397519 - RNA, 19 nt, Human
auauauuuuuuuuuuuaaa

SEQ ID NO: 1397520 - RNA, 15 nt, Human
auauagaaauguauu

SEQ ID NO: 1397521 - RNA, 22 nt, Human
gaaaacaauaacgauaaaagac

SEQ ID NO: 1397522 - RNA, 20 nt, Human
uagaugcaguucugaagaag

SEQ ID NO: 1397523 - RNA, 18 nt, Human
agcaaaauuuuuucucua

SEQ ID NO: 1397524 - RNA, 21 nt, Human
aaacaauaacgauaaaagaca

SEQ ID NO: 1397525 - RNA, 20 nt, Human
aauaagccagacaucaacag

SEQ ID NO: 1397526 - RNA, 18 nt, Human
cggagccuccagcugccc

SEQ ID NO: 1397527 - RNA, 19 nt, Human
agagaacagggcugaagcu

SEQ ID NO: 1397528 - RNA, 21 nt, Human
aauuaaguuuuuuuuuaaaaa

SEQ ID NO: 1397529 - RNA, 16 nt, Human
ugaaguacucauacau

SEQ ID NO: 1397530 - RNA, 18 nt, Human
uaauaauguuucaaacau

SEQ ID NO: 1397531 - RNA, 17 nt, Human
aagcuuuuuuugaauca

SEQ ID NO: 1397532 - RNA, 22 nt, Human
aaguggaacgagacaagcagcc

SEQ ID NO: 1397533 - RNA, 11 nt, Human
cuguuuuauaa

SEQ ID NO: 1397534 - RNA, 12 nt, Human
ccugccagcugg

SEQ ID NO: 1397535 - RNA, 17 nt, Human
ucuauaauguguucauu

SEQ ID NO: 1397536 - RNA, 17 nt, Human
ccagggcuacgcgcgcu

SEQ ID NO: 1397537 - RNA, 20 nt, Human
aaugauguuucauaagaauu

SEQ ID NO: 1397538 - RNA, 22 nt, Human
gacucaccucccccaucucuuc

SEQ ID NO: 1397539 - RNA, 15 nt, Human
gagccggagccucca

SEQ ID NO: 1397540 - RNA, 12 nt, Human
caugggaaguga

SEQ ID NO: 1397541 - RNA, 19 nt, Human
uugugggauacuauuuaau

SEQ ID NO: 1397542 - RNA, 23 nt, Human
aacuuguaaaggaauuuaaaaau

SEQ ID NO: 1397543 - RNA, 21 nt, Human
ggcgcuggcugcgcucggccu

SEQ ID NO: 1397544 - RNA, 23 nt, Human
ggacggcuccggacgcugcugcc

SEQ ID NO: 1397545 - RNA, 18 nt, Human
cugagggcauagaaguaa

SEQ ID NO: 1397546 - RNA, 17 nt, Human
gaagcaccaaucaugaa

SEQ ID NO: 1397547 - RNA, 23 nt, Human
ggccugcucgcccacuuccuccc

SEQ ID NO: 1397548 - RNA, 15 nt, Human
guuuuucuuuucauu

SEQ ID NO: 1397549 - RNA, 23 nt, Human
gcugaguguuucacaccuuaucu

SEQ ID NO: 1397550 - RNA, 18 nt, Human
caaguaaaaggaaaugcu

SEQ ID NO: 1397551 - RNA, 24 nt, Human
gucgcaggaccaucccggccggcg

SEQ ID NO: 1397552 - RNA, 17 nt, Human
cacauguuccccuuggg

SEQ ID NO: 1397553 - RNA, 23 nt, Human
gaaaaugucauuguucuugugaa

SEQ ID NO: 1397554 - RNA, 23 nt, Human
gccgggaaagaagagccggagcc

SEQ ID NO: 1397555 - RNA, 23 nt, Human
auguuaaaacugggacaggggag

SEQ ID NO: 1397556 - RNA, 20 nt, Human
cugauauuggacaguaaaau

SEQ ID NO: 1397557 - RNA, 12 nt, Human
uccaaagggcau

SEQ ID NO: 1397558 - RNA, 19 nt, Human
ucaguccaugaagauguag

SEQ ID NO: 1397559 - RNA, 16 nt, Human
cagggcucacagaauu

SEQ ID NO: 1397560 - RNA, 18 nt, Human
uaagcuucacuguaaaau

SEQ ID NO: 1397561 - RNA, 17 nt, Human
gggcaguguucccuggg

SEQ ID NO: 1397562 - RNA, 21 nt, Human
auauauuuuuuuuuuuaaaaa

SEQ ID NO: 1397563 - RNA, 22 nt, Human
agcuguguccucaugagggcug

SEQ ID NO: 1397564 - RNA, 12 nt, Human
uuauucacugua

SEQ ID NO: 1397565 - RNA, 23 nt, Human
aauauuuauuuuaauaauguuuc

SEQ ID NO: 1397566 - RNA, 14 nt, Human
cccugaggugagca

SEQ ID NO: 1397567 - RNA, 10 nt, Human
auguuuucag

SEQ ID NO: 1397568 - RNA, 17 nt, Human
auaauuuaaauauaugc

SEQ ID NO: 1397569 - RNA, 18 nt, Human
ccuugggaccccugagcu

SEQ ID NO: 1397570 - RNA, 12 nt, Human
gguuuauauaag

SEQ ID NO: 1397571 - RNA, 15 nt, Human
augggacagggagga

SEQ ID NO: 1397572 - RNA, 22 nt, Human
aaaucaggguuaguauugucca

SEQ ID NO: 1397573 - RNA, 17 nt, Human
acaaaugggaaacaaaa

SEQ ID NO: 1397574 - RNA, 15 nt, Human
uugccuaauuuguuu

SEQ ID NO: 1397575 - RNA, 17 nt, Human
uaacugauuuguaacaa

SEQ ID NO: 1397576 - RNA, 22 nt, Human
agacccacuggacucaccuccc

SEQ ID NO: 1397577 - RNA, 15 nt, Human
auaauccuaaacaua

SEQ ID NO: 1397578 - RNA, 16 nt, Human
cuguacgcgagcgcgc

SEQ ID NO: 1397579 - RNA, 23 nt, Human
aauaauccucaguuuuugugaaa

SEQ ID NO: 1397580 - RNA, 20 nt, Human
cugcacuccagccugagcga

SEQ ID NO: 1397581 - RNA, 22 nt, Human
caucaucuucuggguuaggccu

SEQ ID NO: 1397582 - RNA, 19 nt, Human
cccacuggacucaccuccc

SEQ ID NO: 1397583 - RNA, 22 nt, Human
auucugagguaaccucauuauc

SEQ ID NO: 1397584 - RNA, 22 nt, Human
ggcagcuuuccucaaaacuuca

SEQ ID NO: 1397585 - RNA, 12 nt, Human
ugacauuagaug

SEQ ID NO: 1397586 - RNA, 19 nt, Human
gaccggccuuugcaccucc

SEQ ID NO: 1397587 - RNA, 12 nt, Human
agaauauauuuc

SEQ ID NO: 1397588 - RNA, 15 nt, Human
gacagggaggacgcu

SEQ ID NO: 1397589 - RNA, 16 nt, Human
gccaaggaagaucccu

SEQ ID NO: 1397590 - RNA, 14 nt, Human
cugcuaguuuauau

SEQ ID NO: 1397591 - RNA, 15 nt, Human
uuaauucugaaagca

SEQ ID NO: 1397592 - RNA, 15 nt, Human
acugaagaagcacca

SEQ ID NO: 1397593 - RNA, 13 nt, Human
gcccccgggccga

SEQ ID NO: 1397594 - RNA, 15 nt, Human
cuguauguccuuggu

SEQ ID NO: 1397595 - RNA, 19 nt, Human
agacucgggauuaguacac

SEQ ID NO: 1397596 - RNA, 17 nt, Human
ucauacuucuuaggguu

SEQ ID NO: 1397597 - RNA, 21 nt, Human
gacagucaccucauggaauug

SEQ ID NO: 1397598 - RNA, 16 nt, Human
aaaauaacaauaaaag

SEQ ID NO: 1397599 - RNA, 20 nt, Human
uggaaacacauguuccccuu

SEQ ID NO: 1397600 - RNA, 22 nt, Human
uucauucacucaacaaacauaa

SEQ ID NO: 1397601 - RNA, 14 nt, Human
auuuccaagaaaua

SEQ ID NO: 1397602 - RNA, 19 nt, Human
guauucuuuuaguuuuuaa

SEQ ID NO: 1397603 - RNA, 21 nt, Human
ugagcucagcccuggugggca

SEQ ID NO: 1397604 - RNA, 18 nt, Human
auuuuaacucuauaaugu

SEQ ID NO: 1397605 - RNA, 17 nt, Human
ccaguaguuagcuuucu

SEQ ID NO: 1397606 - RNA, 14 nt, Human
cagagaaguuuucu

SEQ ID NO: 1397607 - RNA, 14 nt, Human
auccuugaagauuu

SEQ ID NO: 1397608 - RNA, 17 nt, Human
ugcacaucaaaauaugc

SEQ ID NO: 1397609 - RNA, 23 nt, Human
auaauguguucauucuggaauaa

SEQ ID NO: 1397610 - RNA, 23 nt, Human
ggcuaagcuucacuguaaaauaa

SEQ ID NO: 1397611 - RNA, 18 nt, Human
cccacuagacccacugga

SEQ ID NO: 1397612 - RNA, 18 nt, Human
gcuauaggauguggggaa

SEQ ID NO: 1397613 - RNA, 16 nt, Human
guugauggaaauacac

SEQ ID NO: 1397614 - RNA, 18 nt, Human
gaagagccggagccucca

SEQ ID NO: 1397615 - RNA, 15 nt, Human
ggcaauagucaaauu

SEQ ID NO: 1397616 - RNA, 16 nt, Human
acauuugcucauggaa

SEQ ID NO: 1397617 - RNA, 16 nt, Human
aagguccuggcaaaga

SEQ ID NO: 1397618 - RNA, 16 nt, Human
uccuguaauggaagca

SEQ ID NO: 1397619 - RNA, 15 nt, Human
ccaaggagccaaaca

SEQ ID NO: 1397620 - RNA, 23 nt, Human
uuuuauagcuacuaauuuuaaaa

SEQ ID NO: 1397621 - RNA, 19 nt, Human
agcuacuaauuuuaaaaug

SEQ ID NO: 1397622 - RNA, 17 nt, Human
caggagcaucuccucaa

SEQ ID NO: 1397623 - RNA, 12 nt, Human
aagaaaauaaca

SEQ ID NO: 1397624 - RNA, 23 nt, Human
gcuaugcuauugaaguuuuggca

SEQ ID NO: 1397625 - RNA, 16 nt, Human
agcccugccucaagcu

SEQ ID NO: 1397626 - RNA, 19 nt, Human
cagagaugaggccgccaug

SEQ ID NO: 1397627 - RNA, 19 nt, Human
uauuuuaauaauguuucaa

SEQ ID NO: 1397628 - RNA, 14 nt, Human
gcugauuaaaccaa

SEQ ID NO: 1397629 - RNA, 22 nt, Human
ugauaguuguaccgcaauguga

SEQ ID NO: 1397630 - RNA, 23 nt, Human
gcccuggugccucaccccuugcc

SEQ ID NO: 1397631 - RNA, 21 nt, Human
auggaaauacacuguuaucuu

SEQ ID NO: 1397632 - RNA, 18 nt, Human
cuaggcauagcccugccu

SEQ ID NO: 1397633 - RNA, 21 nt, Human
gaaauguuuacagauccccaa

SEQ ID NO: 1397634 - RNA, 16 nt, Human
aauaaaguguuugaaa

SEQ ID NO: 1397635 - RNA, 15 nt, Human
gccccauucaacauc

SEQ ID NO: 1397636 - RNA, 23 nt, Human
ggaacaguuaccucugccucaga

SEQ ID NO: 1397637 - RNA, 21 nt, Human
uugaggcacagaaacuccugu

SEQ ID NO: 1397638 - RNA, 14 nt, Human
uuaaacuuugauuu

SEQ ID NO: 1397639 - RNA, 14 nt, Human
cgagcgcgcgcgcc

SEQ ID NO: 1397640 - RNA, 15 nt, Human
caggaaguagaggag

SEQ ID NO: 1397641 - RNA, 12 nt, Human
ucccccucuggc

SEQ ID NO: 1397642 - RNA, 21 nt, Human
gagcaucuccucaacucugag

SEQ ID NO: 1397643 - RNA, 19 nt, Human
gcccacuuccucccggccg

SEQ ID NO: 1397644 - RNA, 13 nt, Human
ccuccuuuuaaag

SEQ ID NO: 1397645 - RNA, 13 nt, Human
gggcggcggcccu

SEQ ID NO: 1397646 - RNA, 23 nt, Human
gaggcauuuaggccaugggacag

SEQ ID NO: 1397647 - RNA, 17 nt, Human
ucgggauuaguacacac

SEQ ID NO: 1397648 - RNA, 17 nt, Human
augaucaguaugaaaau

SEQ ID NO: 1397649 - RNA, 15 nt, Human
uucacauuuaaauaa

SEQ ID NO: 1397650 - RNA, 13 nt, Human
gggcugaagcugu

SEQ ID NO: 1397651 - RNA, 15 nt, Human
ugagguaaccucauu

SEQ ID NO: 1397652 - RNA, 20 nt, Human
uagucucuaucauuaaaguu

SEQ ID NO: 1397653 - RNA, 12 nt, Human
aauacuuuauaa

SEQ ID NO: 1397654 - RNA, 19 nt, Human
ugccucaagcuaugugagc

SEQ ID NO: 1397655 - RNA, 21 nt, Human
ugcuggccaccugcugagccc

SEQ ID NO: 1397656 - RNA, 21 nt, Human
cuucucacauuuauauuuuug

SEQ ID NO: 1397657 - RNA, 20 nt, Human
augguuuagaaagcuugccc

SEQ ID NO: 1397658 - RNA, 17 nt, Human
auuuucuauaauuuaaa

SEQ ID NO: 1397659 - RNA, 11 nt, Human
acugggacagg

SEQ ID NO: 1397660 - RNA, 22 nt, Human
ucccuagaaagccaugugcagc

SEQ ID NO: 1397661 - RNA, 13 nt, Human
cacaacuauauug

SEQ ID NO: 1397662 - RNA, 14 nt, Human
uaugaauuacauuu

SEQ ID NO: 1397663 - RNA, 13 nt, Human
gaaccuaggguga

SEQ ID NO: 1397664 - RNA, 19 nt, Human
gcucauggaauuggagcuc

SEQ ID NO: 1397665 - RNA, 16 nt, Human
gcaggcagauguuccu

SEQ ID NO: 1397666 - RNA, 17 nt, Human
gccaugugcagccacca

SEQ ID NO: 1397667 - RNA, 16 nt, Human
uggggauagugaggca

SEQ ID NO: 1397668 - RNA, 17 nt, Human
uccuacaagacacagug

SEQ ID NO: 1397669 - RNA, 18 nt, Human
auuugcuggagcucugcc

SEQ ID NO: 1397670 - RNA, 13 nt, Human
uauuuaauuauuu

SEQ ID NO: 1397671 - RNA, 17 nt, Human
gccgcgcugcgcgccgc

SEQ ID NO: 1397672 - RNA, 17 nt, Human
ccaaggaugccccgucc

SEQ ID NO: 1397673 - RNA, 21 nt, Human
uccauccugaggcuccacuug

SEQ ID NO: 1397674 - RNA, 21 nt, Human
gagccggagccuccagcugcc

SEQ ID NO: 1397675 - RNA, 23 nt, Human
cacagauuugagcucagcccugg

SEQ ID NO: 1397676 - RNA, 17 nt, Human
gaaugagagacacacug

SEQ ID NO: 1397677 - RNA, 13 nt, Human
ugccuaauuuguu

SEQ ID NO: 1397678 - RNA, 13 nt, Human
acaaggaaaaaau

SEQ ID NO: 1397679 - RNA, 22 nt, Human
uuugcuguuauuuuaucugcua

SEQ ID NO: 1397680 - RNA, 15 nt, Human
aaaugauguuucaua

SEQ ID NO: 1397681 - RNA, 18 nt, Human
ccuguucgcgcgccuccg

SEQ ID NO: 1397682 - RNA, 13 nt, Human
gcuacgcgcgcuc

SEQ ID NO: 1397683 - RNA, 18 nt, Human
uuuucucuccucucccca

SEQ ID NO: 1397684 - RNA, 22 nt, Human
cccaugauguuuagaaacacaa

SEQ ID NO: 1397685 - RNA, 20 nt, Human
ggcuaauaucuuaucuuccu

SEQ ID NO: 1397686 - RNA, 22 nt, Human
cccuauccuacuuccccuuccu

SEQ ID NO: 1397687 - RNA, 13 nt, Human
cuucucaacucca

SEQ ID NO: 1397688 - RNA, 19 nt, Human
cuccuuggagacagggccc

SEQ ID NO: 1397689 - RNA, 16 nt, Human
cuggguugaagggcag

SEQ ID NO: 1397690 - RNA, 20 nt, Human
acaagacacagugaccauac

SEQ ID NO: 1397691 - RNA, 20 nt, Human
agaaggcuguggauuuaaug

SEQ ID NO: 1397692 - RNA, 15 nt, Human
aaaaauaacaaugaa

SEQ ID NO: 1397693 - RNA, 23 nt, Human
augaauuaaguuuuuuuuuaaaa

SEQ ID NO: 1397694 - RNA, 16 nt, Human
cauuuguauaaaauaa

SEQ ID NO: 1397695 - RNA, 13 nt, Human
cucaccuccccca

SEQ ID NO: 1397696 - RNA, 14 nt, Human
acuauuauauuucc

SEQ ID NO: 1397697 - RNA, 15 nt, Human
uuauuuuuaaacugu

SEQ ID NO: 1397698 - RNA, 16 nt, Human
uguccccuauccuacu

SEQ ID NO: 1397699 - RNA, 14 nt, Human
cugagucccaggcu

SEQ ID NO: 1397700 - RNA, 14 nt, Human
ccaucccggccggc

SEQ ID NO: 1397701 - RNA, 12 nt, Human
gcucagcccugg

SEQ ID NO: 1397702 - RNA, 15 nt, Human
cgcgcuccgcgcagc

SEQ ID NO: 1397703 - RNA, 18 nt, Human
cagcuuauugucuaguga

SEQ ID NO: 1397704 - RNA, 18 nt, Human
auaaaguguuugaaagcu

SEQ ID NO: 1397705 - RNA, 13 nt, Human
ucaucccacccgc

SEQ ID NO: 1397706 - RNA, 13 nt, Human
aacacaacuauau

SEQ ID NO: 1397707 - RNA, 20 nt, Human
ccagggcuacgcgcgcuccg

SEQ ID NO: 1397708 - RNA, 17 nt, Human
uuauuacuguaagaaaa

SEQ ID NO: 1397709 - RNA, 17 nt, Human
caggaaucacuggcugu

SEQ ID NO: 1397710 - RNA, 18 nt, Human
auaccccuggccaaggaa

SEQ ID NO: 1397711 - RNA, 15 nt, Human
aaugauuaugaauua

SEQ ID NO: 1397712 - RNA, 16 nt, Human
aguaaaggcaaacuua

SEQ ID NO: 1397713 - RNA, 16 nt, Human
gcuccggacgcugcug

SEQ ID NO: 1397714 - RNA, 16 nt, Human
gaagccagaucuaugc

SEQ ID NO: 1397715 - RNA, 19 nt, Human
guacaagagcuuaacagug

SEQ ID NO: 1397716 - RNA, 22 nt, Human
aaagcuuugugcagauucuuua

SEQ ID NO: 1397717 - RNA, 22 nt, Human
agcccuccuuaucaaaggacac

SEQ ID NO: 1397718 - RNA, 17 nt, Human
cugcgcucggccugcuc

SEQ ID NO: 1397719 - RNA, 14 nt, Human
acaagcagcccuua

SEQ ID NO: 1397720 - RNA, 20 nt, Human
accucugccucagaaaacaa

SEQ ID NO: 1397721 - RNA, 20 nt, Human
uguaaaggaauuuaaaaauc

SEQ ID NO: 1397722 - RNA, 13 nt, Human
gggaggggcgcuc

SEQ ID NO: 1397723 - RNA, 21 nt, Human
aaaugucuugcuugauuguau

SEQ ID NO: 1397724 - RNA, 14 nt, Human
aagcaacccaaaug

SEQ ID NO: 1397725 - RNA, 13 nt, Human
auaaaaauauaua

SEQ ID NO: 1397726 - RNA, 21 nt, Human
cuugaggcacagaaacuccug

SEQ ID NO: 1397727 - RNA, 19 nt, Human
gaggcagagguugcaguga

SEQ ID NO: 1397728 - RNA, 22 nt, Human
ggacaguaaaauccacagacca

SEQ ID NO: 1397729 - RNA, 20 nt, Human
uaagugaaauaagccagaca

SEQ ID NO: 1397730 - RNA, 20 nt, Human
uuucauaagaauucuguuga

SEQ ID NO: 1397731 - RNA, 18 nt, Human
gaaaauaacaauaaaaga

SEQ ID NO: 1397732 - RNA, 14 nt, Human
augauguuuagaaa

SEQ ID NO: 1397733 - RNA, 18 nt, Human
gcuccauuuuuagugaaa

SEQ ID NO: 1397734 - RNA, 20 nt, Human
cugguggcgcuggcugcgcu

SEQ ID NO: 1397735 - RNA, 20 nt, Human
cuaaaugucaaucagccuag

SEQ ID NO: 1397736 - RNA, 15 nt, Human
gcaacccaaauguuc

SEQ ID NO: 1397737 - RNA, 21 nt, Human
aagaagagccggagccuccag

SEQ ID NO: 1397738 - RNA, 22 nt, Human
ucugcuaugcuauugaaguuuu

SEQ ID NO: 1397739 - RNA, 17 nt, Human
cuccuuaucaaaggaca

SEQ ID NO: 1397740 - RNA, 17 nt, Human
uauuuauuaaguauuuu

SEQ ID NO: 1397741 - RNA, 17 nt, Human
acaucgcagacacaugu

SEQ ID NO: 1397742 - RNA, 17 nt, Human
uccugccccugagccca

SEQ ID NO: 1397743 - RNA, 17 nt, Human
auaucaauuuaaaaaaa

SEQ ID NO: 1397744 - RNA, 17 nt, Human
agcuggaaacacauguu

SEQ ID NO: 1397745 - RNA, 20 nt, Human
aaugaauacuuuauaaagga

SEQ ID NO: 1397746 - RNA, 11 nt, Human
caauaaaagac

SEQ ID NO: 1397747 - RNA, 12 nt, Human
aggaaauauuuu

SEQ ID NO: 1397748 - RNA, 14 nt, Human
cugccagcuggccu

SEQ ID NO: 1397749 - RNA, 17 nt, Human
uuccaagugauugaaac

SEQ ID NO: 1397750 - RNA, 21 nt, Human
ucuuaggguuaugauuaagua

SEQ ID NO: 1397751 - RNA, 15 nt, Human
auuuauuaaguauuu

SEQ ID NO: 1397752 - RNA, 20 nt, Human
uuauugaggcuuuaaaacuu

SEQ ID NO: 1397753 - RNA, 23 nt, Human
caccaaggagccaaacauccuac

SEQ ID NO: 1397754 - RNA, 16 nt, Human
uccuagucucuaucau

SEQ ID NO: 1397755 - RNA, 16 nt, Human
ccccaucucuucuggg

SEQ ID NO: 1397756 - RNA, 20 nt, Human
cgcaggaccaucccggccgg

SEQ ID NO: 1397757 - RNA, 15 nt, Human
cuguaaaauaauaac

SEQ ID NO: 1397758 - RNA, 14 nt, Human
cucagucucccucc

SEQ ID NO: 1397759 - RNA, 18 nt, Human
acaagccuccuuuuaaag

SEQ ID NO: 1397760 - RNA, 20 nt, Human
agcccuuccccucugcagcu

SEQ ID NO: 1397761 - RNA, 12 nt, Human
cuuaagcuuuca

SEQ ID NO: 1397762 - RNA, 12 nt, Human
uguuugaaagcu

SEQ ID NO: 1397763 - RNA, 18 nt, Human
cagagucaagggugugug

SEQ ID NO: 1397764 - RNA, 24 nt, Human
ccccugagcuugcagagaugaggc

SEQ ID NO: 1397765 - RNA, 18 nt, Human
ccucaagcuaugugagcu

SEQ ID NO: 1397766 - RNA, 12 nt, Human
ugugaggagcug

SEQ ID NO: 1397767 - RNA, 15 nt, Human
ugccccccagcccuc

SEQ ID NO: 1397768 - RNA, 14 nt, Human
ccucuccucucuuc

SEQ ID NO: 1397769 - RNA, 14 nt, Human
acccaaaaggcaga

SEQ ID NO: 1397770 - RNA, 17 nt, Human
guguccccuauccuacu

SEQ ID NO: 1397771 - RNA, 16 nt, Human
gacauagaauuaacac

SEQ ID NO: 1397772 - RNA, 15 nt, Human
aguaaauguuguuuu

SEQ ID NO: 1397773 - RNA, 22 nt, Human
uggguuccuuccucugagccuu

SEQ ID NO: 1397774 - RNA, 20 nt, Human
ucacuguauguccuuggugc

SEQ ID NO: 1397775 - RNA, 17 nt, Human
ucuauaauuuaaauaua

SEQ ID NO: 1397776 - RNA, 22 nt, Human
caggggccacaccaaccuucug

SEQ ID NO: 1397777 - RNA, 20 nt, Human
aauuguaggugacuauuaua

SEQ ID NO: 1397778 - RNA, 22 nt, Human
cacagauuugagcucagcccug

SEQ ID NO: 1397779 - RNA, 16 nt, Human
ccugagcuugcagaga

SEQ ID NO: 1397780 - RNA, 17 nt, Human
aguuauuuuuaaacugu

SEQ ID NO: 1397781 - RNA, 14 nt, Human
gccgcgcuccucgg

SEQ ID NO: 1397782 - RNA, 15 nt, Human
uccauccugaggcuc

SEQ ID NO: 1397783 - RNA, 14 nt, Human
ucuauaauuuaaau

SEQ ID NO: 1397784 - RNA, 21 nt, Human
aauaauguuucaaacauauau

SEQ ID NO: 1397785 - RNA, 23 nt, Human
ggaugguucccuugaugaagaag

SEQ ID NO: 1397786 - RNA, 14 nt, Human
ccuugaugaagaag

SEQ ID NO: 1397787 - RNA, 21 nt, Human
agucaagggugugugcagcau

SEQ ID NO: 1397788 - RNA, 20 nt, Human
uguaagaaaauaucacuugu

SEQ ID NO: 1397789 - RNA, 23 nt, Human
gggaaacaaaaggauaaugaaua

SEQ ID NO: 1397790 - RNA, 13 nt, Human
gagccuccagcug

SEQ ID NO: 1397791 - RNA, 16 nt, Human
cugagcuugcagagau

SEQ ID NO: 1397792 - RNA, 15 nt, Human
uauuucacuuuagaa

SEQ ID NO: 1397793 - RNA, 17 nt, Human
caaccuucugaggagcu

SEQ ID NO: 1397794 - RNA, 20 nt, Human
agaauucuguugauggaaau

SEQ ID NO: 1397795 - RNA, 17 nt, Human
cagggcugaagcugugu

SEQ ID NO: 1397796 - RNA, 16 nt, Human
ucuucaacucccugcc

SEQ ID NO: 1397797 - RNA, 14 nt, Human
uaacuaauuuuaac

SEQ ID NO: 1397798 - RNA, 12 nt, Human
cuggcuccagcu

SEQ ID NO: 1397799 - RNA, 17 nt, Human
gcuguacgcgagcgcgc

SEQ ID NO: 1397800 - RNA, 21 nt, Human
augaauacuuuauaaaggauu

SEQ ID NO: 1397801 - RNA, 14 nt, Human
ucuuuuuuuuaaua

SEQ ID NO: 1397802 - RNA, 16 nt, Human
cuuuuaguuuuuaaag

SEQ ID NO: 1397803 - RNA, 17 nt, Human
ugaauauaaauuuauca

SEQ ID NO: 1397804 - RNA, 15 nt, Human
caggcaaauuccuga

SEQ ID NO: 1397805 - RNA, 17 nt, Human
aggccaugggacaggga

SEQ ID NO: 1397806 - RNA, 12 nt, Human
ucuuaagaagac

SEQ ID NO: 1397807 - RNA, 18 nt, Human
acaaaugcauuucuaaag

SEQ ID NO: 1397808 - RNA, 20 nt, Human
aagacagugaaagaaaauaa

SEQ ID NO: 1397809 - RNA, 21 nt, Human
aacuuguaaaggaauuuaaaa

SEQ ID NO: 1397810 - RNA, 21 nt, Human
aggguuaugauuaaguaauga

SEQ ID NO: 1397811 - RNA, 19 nt, Human
ucuugugaacccaaagugu

SEQ ID NO: 1397812 - RNA, 22 nt, Human
ugguuguauuauuuuuuaaaaa

SEQ ID NO: 1397813 - RNA, 17 nt, Human
cgcgagcgcgcgcgccc

SEQ ID NO: 1397814 - RNA, 14 nt, Human
auuuaaauauaugc

SEQ ID NO: 1397815 - RNA, 16 nt, Human
uagaaagccaugugca

SEQ ID NO: 1397816 - RNA, 18 nt, Human
ccugccuaagugcagccc

SEQ ID NO: 1397817 - RNA, 22 nt, Human
aaacauguuuaucguauuugau

SEQ ID NO: 1397818 - RNA, 13 nt, Human
uccccaaaugcuu

SEQ ID NO: 1397819 - RNA, 19 nt, Human
ggaauuucuucaacucccu

SEQ ID NO: 1397820 - RNA, 19 nt, Human
agcucugcccauccugccc

SEQ ID NO: 1397821 - RNA, 19 nt, Human
cgccacgcucugggucgcc

SEQ ID NO: 1397822 - RNA, 19 nt, Human
agucaaauugugugaaagg

SEQ ID NO: 1397823 - RNA, 14 nt, Human
agcucuaucaccaa

SEQ ID NO: 1397824 - RNA, 16 nt, Human
uccugcaauuccacuu

SEQ ID NO: 1397825 - RNA, 16 nt, Human
cagauccccaagccug

SEQ ID NO: 1397826 - RNA, 21 nt, Human
ggaaagaauaaccaacacccu

SEQ ID NO: 1397827 - RNA, 14 nt, Human
uugugauugauuau

SEQ ID NO: 1397828 - RNA, 21 nt, Human
uauaagaaauaggaaauauuu

SEQ ID NO: 1397829 - RNA, 13 nt, Human
augaguugcaguu

SEQ ID NO: 1397830 - RNA, 17 nt, Human
acucaccucccccaucu

SEQ ID NO: 1397831 - RNA, 19 nt, Human
ggagccuccagcugccccg

SEQ ID NO: 1397832 - RNA, 18 nt, Human
uauagcuacuaauuuuaa

SEQ ID NO: 1397833 - RNA, 16 nt, Human
cuuuaugcuaagugaa

SEQ ID NO: 1397834 - RNA, 19 nt, Human
acaauaacgauaaaagaca

SEQ ID NO: 1397835 - RNA, 17 nt, Human
gaaaaucaggcuggcca

SEQ ID NO: 1397836 - RNA, 13 nt, Human
agccgggaaagaa

SEQ ID NO: 1397837 - RNA, 23 nt, Human
gcuuuggucuaucuuugagcgcc

SEQ ID NO: 1397838 - RNA, 15 nt, Human
ugcagccaccagucc

SEQ ID NO: 1397839 - RNA, 20 nt, Human
cuugccauaauuacuauguc

SEQ ID NO: 1397840 - RNA, 16 nt, Human
uauaugucacuuugcu

SEQ ID NO: 1397841 - RNA, 19 nt, Human
aagcuuguauuccuuuuuc

SEQ ID NO: 1397842 - RNA, 20 nt, Human
guugagccaccaagcuggug

SEQ ID NO: 1397843 - RNA, 14 nt, Human
aauauuauguuaaa

SEQ ID NO: 1397844 - RNA, 14 nt, Human
caguucugaagaag

SEQ ID NO: 1397845 - RNA, 18 nt, Human
ugggcacaggguuuaugu

SEQ ID NO: 1397846 - RNA, 20 nt, Human
uuugcaagccagauuuuccu

SEQ ID NO: 1397847 - RNA, 22 nt, Human
uuuauagcuacuaauuuuaaaa

SEQ ID NO: 1397848 - RNA, 16 nt, Human
gcgcagcucaggcugg

SEQ ID NO: 1397849 - RNA, 15 nt, Human
uagauaggccauggg

SEQ ID NO: 1397850 - RNA, 23 nt, Human
gucucccucccuuggggccuaug

SEQ ID NO: 1397851 - RNA, 15 nt, Human
gccuaagugcagccc

SEQ ID NO: 1397852 - RNA, 14 nt, Human
gaaaacaauaacga

SEQ ID NO: 1397853 - RNA, 13 nt, Human
aguaugaaaaugu

SEQ ID NO: 1397854 - RNA, 19 nt, Human
uuuccaagaaauauuccuu

SEQ ID NO: 1397855 - RNA, 14 nt, Human
auuuguauaaaaua

SEQ ID NO: 1397856 - RNA, 16 nt, Human
cugcacuccagccuga

SEQ ID NO: 1397857 - RNA, 13 nt, Human
acaagaaaugaaa

SEQ ID NO: 1397858 - RNA, 14 nt, Pseudomonas aeruginosa PA01
uuuuucgucgccag

SEQ ID NO: 1397859 - RNA, 16 nt, Pseudomonas aeruginosa PA01
uuuucaauuccgccgc

SEQ ID NO: 1397860 - RNA, 13 nt, Pseudomonas aeruginosa PA01
uuugccgucggcg

SEQ ID NO: 1397861 - RNA, 13 nt, Pseudomonas aeruginosa PA01
uuugggagcagga

SEQ ID NO: 1397862 - RNA, 14 nt, Pseudomonas aeruginosa PA01
uuugcagggcgauc

SEQ ID NO: 1397863 - RNA, 23 nt, Pseudomonas aeruginosa PA01
uuucggcgagauugcgcugagcg

SEQ ID NO: 1397864 - RNA, 15 nt, Pseudomonas aeruginosa PA01
uuugcaaucggcgag

SEQ ID NO: 1397865 - RNA, 14 nt, Pseudomonas aeruginosa PA01
uuucgcagucgggc

SEQ ID NO: 1397866 - RNA, 23 nt, Pseudomonas aeruginosa PA01
uuucgcuuugcgcgcaguaggcg

SEQ ID NO: 1397867 - RNA, 17 nt, Pseudomonas aeruginosa PA01
uuucaugcggccgaugc

SEQ ID NO: 1397868 - RNA, 22 nt, Pseudomonas aeruginosa PA01
uuucauggccuggcgcucagcg

SEQ ID NO: 1397869 - RNA, 14 nt, Pseudomonas aeruginosa PA01
uuuccgcggcguug

SEQ ID NO: 1397870 - RNA, 13 nt, Pseudomonas aeruginosa PA01
uuucauugcgcac

SEQ ID NO: 1397871 - RNA, 18 nt, Pseudomonas aeruginosa PA01
uuuccgucucaggcgcca

SEQ ID NO: 1397872 - RNA, 18 nt, Pseudomonas aeruginosa PA01
uuuccguuguggcggcgc

SEQ ID NO: 1397873 - RNA, 14 nt, Pseudomonas aeruginosa PA01
uuuccucggccaug

SEQ ID NO: 1397874 - RNA, 13 nt, Pseudomonas aeruginosa PA01
uuuccucgucgcc

SEQ ID NO: 1397875 - RNA, 17 nt, Pseudomonas aeruginosa PA01
uuuccgcuguccgccgc

SEQ ID NO: 1397876 - RNA, 19 nt, Pseudomonas aeruginosa PA01
uuuccggcgcggccugcag

SEQ ID NO: 1397877 - RNA, 18 nt, Pseudomonas aeruginosa PA01
uuuccggcuugccgaugu

SEQ ID NO: 1397878 - RNA, 16 nt, Pseudomonas aeruginosa PA01
uuucgaagccgccgcc

SEQ ID NO: 1397879 - RNA, 21 nt, Pseudomonas aeruginosa PA01
uuuccuuagaggcucagccga

SEQ ID NO: 1397880 - RNA, 19 nt, Pseudomonas aeruginosa PA01
uuuccugcuccagcagggc

SEQ ID NO: 1397881 - RNA, 20 nt, Pseudomonas aeruginosa PA01
uuguccacgucguaggccga

SEQ ID NO: 1397882 - RNA, 12 nt, Pseudomonas aeruginosa PA01
uugucccugcgg

SEQ ID NO: 1397883 - RNA, 22 nt, Pseudomonas aeruginosa PA01
uuggggacagggcggcagcgug

SEQ ID NO: 1397884 - RNA, 16 nt, Pseudomonas aeruginosa PA01
uugggucaucgaacau

SEQ ID NO: 1397885 - RNA, 21 nt, Pseudomonas aeruginosa PA01
uuggucaccacguugcgccgc

SEQ ID NO: 1397886 - RNA, 23 nt, Pseudomonas aeruginosa PA01
uuggcgaaguucccgccgcucug

SEQ ID NO: 1397887 - RNA, 18 nt, Pseudomonas aeruginosa PA01
uuggcgaauagccggcgc

SEQ ID NO: 1397888 - RNA, 14 nt, Pseudomonas aeruginosa PA01
uuggugcugcgcgc

SEQ ID NO: 1397889 - RNA, 21 nt, Pseudomonas aeruginosa PA01
uuggugcugcgcgcggcccac

SEQ ID NO: 1397890 - RNA, 17 nt, Pseudomonas aeruginosa PA01
uugguacagcucgcgca

SEQ ID NO: 1397891 - RNA, 23 nt, Pseudomonas aeruginosa PA01
uuggucaggucgacgccgccgag

SEQ ID NO: 1397892 - RNA, 18 nt, Pseudomonas aeruginosa PA01
uuggucgggcgccgcgcc

SEQ ID NO: 1397893 - RNA, 12 nt, Pseudomonas aeruginosa PA01
uugcggcgcggc

SEQ ID NO: 1397894 - RNA, 15 nt, Pseudomonas aeruginosa PA01
uugcgcuggccggca

SEQ ID NO: 1397895 - RNA, 17 nt, Pseudomonas aeruginosa PA01
uugcgcuggccggcaac

SEQ ID NO: 1397896 - RNA, 13 nt, Pseudomonas aeruginosa PA01
uugcgcucgagcc

SEQ ID NO: 1397897 - RNA, 18 nt, Pseudomonas aeruginosa PA01
uugcgcuccacccaggcg

SEQ ID NO: 1397898 - RNA, 15 nt, Pseudomonas aeruginosa PA01
uugcgucccuuggcg

SEQ ID NO: 1397899 - RNA, 19 nt, Pseudomonas aeruginosa PA01
uugcgggcgcgccugagcu

SEQ ID NO: 1397900 - RNA, 18 nt, Pseudomonas aeruginosa PA01
uugcgggucagaccacga

SEQ ID NO: 1397901 - RNA, 20 nt, Pseudomonas aeruginosa PA01
uugcggucauccgccggcgc

SEQ ID NO: 1397902 - RNA, 17 nt, Pseudomonas aeruginosa PA01
uugcgguccagcgagcg

SEQ ID NO: 1397903 - RNA, 19 nt, Pseudomonas aeruginosa PA01
uugcgcaccgccugcagca

SEQ ID NO: 1397904 - RNA, 22 nt, Pseudomonas aeruginosa PA01
uugcgaucgaggaugaucggcu

SEQ ID NO: 1397905 - RNA, 23 nt, Pseudomonas aeruginosa PA01
uugcgauagaccaggaaggccgg

SEQ ID NO: 1397906 - RNA, 19 nt, Pseudomonas aeruginosa PA01
uugcgccagagcaggcgga

SEQ ID NO: 1397907 - RNA, 17 nt, Pseudomonas aeruginosa PA01
uugcgccaggcccggcg

SEQ ID NO: 1397908 - RNA, 20 nt, Pseudomonas aeruginosa PA01
uugcgccaggcccggcgcug

SEQ ID NO: 1397909 - RNA, 22 nt, Pseudomonas aeruginosa PA01
uugcgcaggcgguaggugagcg

SEQ ID NO: 1397910 - RNA, 12 nt, Pseudomonas aeruginosa PA01
uugcgccucguc

SEQ ID NO: 1397911 - RNA, 22 nt, Pseudomonas aeruginosa PA01
uugcgccauuucaaggcgacgc

SEQ ID NO: 1397912 - RNA, 23 nt, Pseudomonas aeruginosa PA01
uugcgccgaauccaggccgacga

SEQ ID NO: 1397913 - RNA, 18 nt, Pseudomonas aeruginosa PA01
uugcgccgccucgcgcaa

SEQ ID NO: 1397914 - RNA, 13 nt, Pseudomonas aeruginosa PA01
uugcccucgcgcu

SEQ ID NO: 1397915 - RNA, 19 nt, Pseudomonas aeruginosa PA01
uugcccucgcgcuggaccc

SEQ ID NO: 1397916 - RNA, 17 nt, Pseudomonas aeruginosa PA01
uugcccucggcgcccgc

SEQ ID NO: 1397917 - RNA, 18 nt, Pseudomonas aeruginosa PA01
uugcccucggcgcccgcc

SEQ ID NO: 1397918 - RNA, 13 nt, Pseudomonas aeruginosa PA01
uugccgacgccgc

SEQ ID NO: 1397919 - RNA, 20 nt, Pseudomonas aeruginosa PA01
uugccgaagcgcucggucag

SEQ ID NO: 1397920 - RNA, 13 nt, Pseudomonas aeruginosa PA01
uugcccuggccgg

SEQ ID NO: 1397921 - RNA, 21 nt, Pseudomonas aeruginosa PA01
uugccgagcgcgaucagccgc

SEQ ID NO: 1397922 - RNA, 23 nt, Pseudomonas aeruginosa PA01
uugccgaugccggaaagccuggc

SEQ ID NO: 1397923 - RNA, 21 nt, Pseudomonas aeruginosa PA01
uugccgaucaucuucuggaca

SEQ ID NO: 1397924 - RNA, 21 nt, Pseudomonas aeruginosa PA01
uugccgccgcuggccuggcca

SEQ ID NO: 1397925 - RNA, 11 nt, Pseudomonas aeruginosa PA01
uugccgccaga

SEQ ID NO: 1397926 - RNA, 14 nt, Pseudomonas aeruginosa PA01
uugccgcgcccggc

SEQ ID NO: 1397927 - RNA, 21 nt, Pseudomonas aeruginosa PA01
uugccuccgcucugcuggcca

SEQ ID NO: 1397928 - RNA, 16 nt, Pseudomonas aeruginosa PA01
uugcgacugacgcuca

SEQ ID NO: 1397929 - RNA, 19 nt, Pseudomonas aeruginosa PA01
uugccggcggcgcugagga

SEQ ID NO: 1397930 - RNA, 12 nt, Pseudomonas aeruginosa PA01
uugccggcgcca

SEQ ID NO: 1397931 - RNA, 22 nt, Pseudomonas aeruginosa PA01
uugccggaaagcaguucgcccg

SEQ ID NO: 1397932 - RNA, 19 nt, Pseudomonas aeruginosa PA01
uugccgggcuuccuggccg

SEQ ID NO: 1397933 - RNA, 17 nt, Pseudomonas aeruginosa PA01
uugccggguuucgucgg

SEQ ID NO: 1397934 - RNA, 15 nt, Pseudomonas aeruginosa PA01
uugccguagcgaugc

SEQ ID NO: 1397935 - RNA, 18 nt, Pseudomonas aeruginosa PA01
uugccguccagccggcgc

SEQ ID NO: 1397936 - RNA, 14 nt, Pseudomonas aeruginosa PA01
uugccguccgucgg

SEQ ID NO: 1397937 - RNA, 15 nt, Pseudomonas aeruginosa PA01
uugccguccuucagg

SEQ ID NO: 1397938 - RNA, 23 nt, Pseudomonas aeruginosa PA01
uugccguccuucaggacgaaacc

SEQ ID NO: 1397939 - RNA, 19 nt, Pseudomonas aeruginosa PA01
uugcuguugccgcugcagg

SEQ ID NO: 1397940 - RNA, 19 nt, Pseudomonas aeruginosa PA01
uugcuugcgcucgagccgg

SEQ ID NO: 1397941 - RNA, 18 nt, Pseudomonas aeruginosa PA01
uugcugcuugcgcgcggc

SEQ ID NO: 1397942 - RNA, 21 nt, Pseudomonas aeruginosa PA01
uugcugcccuggcgcgcgccc

SEQ ID NO: 1397943 - RNA, 20 nt, Pseudomonas aeruginosa PA01
uugcuggcgcgauccgcgcg

SEQ ID NO: 1397944 - RNA, 20 nt, Pseudomonas aeruginosa PA01
uugcugacggcguggcggau

SEQ ID NO: 1397945 - RNA, 23 nt, Pseudomonas aeruginosa PA01
uugcugaccggauguucgaaggc

SEQ ID NO: 1397946 - RNA, 22 nt, Pseudomonas aeruginosa PA01
uugcugaaagcgauagccgggg

SEQ ID NO: 1397947 - RNA, 14 nt, Pseudomonas aeruginosa PA01
uuggcaucgccgcc

SEQ ID NO: 1397948 - RNA, 22 nt, Pseudomonas aeruginosa PA01
uuggcagauuccuggaccccgc

SEQ ID NO: 1397949 - RNA, 14 nt, Pseudomonas aeruginosa PA01
uuggacagcgucug

SEQ ID NO: 1397950 - RNA, 22 nt, Pseudomonas aeruginosa PA01
uuggaauugcugacggcguggc

SEQ ID NO: 1397951 - RNA, 18 nt, Pseudomonas aeruginosa PA01
uuggccgaaucgaacagg

SEQ ID NO: 1397952 - RNA, 23 nt, Pseudomonas aeruginosa PA01
uuggccgaaagcacugcggcggu

SEQ ID NO: 1397953 - RNA, 12 nt, Pseudomonas aeruginosa PA01
uuggccgcagca

SEQ ID NO: 1397954 - RNA, 13 nt, Pseudomonas aeruginosa PA01
uuggccgggccga

SEQ ID NO: 1397955 - RNA, 19 nt, Pseudomonas aeruginosa PA01
uuggccgggccgaugcgcg

SEQ ID NO: 1397956 - RNA, 15 nt, Pseudomonas aeruginosa PA01
uuggccagccgcgcg

SEQ ID NO: 1397957 - RNA, 16 nt, Pseudomonas aeruginosa PA01
uuggccagcgccacca

SEQ ID NO: 1397958 - RNA, 21 nt, Pseudomonas aeruginosa PA01
uuggccaggaagcgggccucg

SEQ ID NO: 1397959 - RNA, 14 nt, Pseudomonas aeruginosa PA01
uuggccccgccgag

SEQ ID NO: 1397960 - RNA, 19 nt, Pseudomonas aeruginosa PA01
uuggcccaauccgcgccgg

SEQ ID NO: 1397961 - RNA, 23 nt, Pseudomonas aeruginosa PA01
uuggccaccugcaucacguacgg

SEQ ID NO: 1397962 - RNA, 19 nt, Pseudomonas aeruginosa PA01
uuggccagcaggcgccgcg

SEQ ID NO: 1397963 - RNA, 22 nt, Pseudomonas aeruginosa PA01
uugccaggaggauucgccagcc

SEQ ID NO: 1397964 - RNA, 16 nt, Pseudomonas aeruginosa PA01
uugccauccuccagca

SEQ ID NO: 1397965 - RNA, 22 nt, Pseudomonas aeruginosa PA01
uugcagggggcuuugcggcccu

SEQ ID NO: 1397966 - RNA, 18 nt, Pseudomonas aeruginosa PA01
uugccagccggccuugcu

SEQ ID NO: 1397967 - RNA, 12 nt, Pseudomonas aeruginosa PA01
uugcccggcgag

SEQ ID NO: 1397968 - RNA, 13 nt, Pseudomonas aeruginosa PA01
uugcccaccagcg

SEQ ID NO: 1397969 - RNA, 21 nt, Pseudomonas aeruginosa PA01
uugcccacggccaggcccacg

SEQ ID NO: 1397970 - RNA, 21 nt, Pseudomonas aeruginosa PA01
uugcccagccgacgcgcagcg

SEQ ID NO: 1397971 - RNA, 19 nt, Pseudomonas aeruginosa PA01
uugcccagguagucgccca

SEQ ID NO: 1397972 - RNA, 22 nt, Pseudomonas aeruginosa PA01
uugcccagguagucgcccagcg

SEQ ID NO: 1397973 - RNA, 19 nt, Pseudomonas aeruginosa PA01
uugcaggcccggccgccug

SEQ ID NO: 1397974 - RNA, 19 nt, Pseudomonas aeruginosa PA01
uugcaccgcuugccagccg

SEQ ID NO: 1397975 - RNA, 13 nt, Pseudomonas aeruginosa PA01
uugcagccaccag

SEQ ID NO: 1397976 - RNA, 15 nt, Pseudomonas aeruginosa PA01
uugcagccagccguc

SEQ ID NO: 1397977 - RNA, 20 nt, Pseudomonas aeruginosa PA01
uugcagcaacucgccgccga

SEQ ID NO: 1397978 - RNA, 16 nt, Pseudomonas aeruginosa PA01
uugaucgccgcgccgc

SEQ ID NO: 1397979 - RNA, 23 nt, Pseudomonas aeruginosa PA01
uugaucuuguccgggaaguccgg

SEQ ID NO: 1397980 - RNA, 20 nt, Pseudomonas aeruginosa PA01
uugauccgcuccagcgccuc

SEQ ID NO: 1397981 - RNA, 23 nt, Pseudomonas aeruginosa PA01
uugaucagguucggcagcgccuc

SEQ ID NO: 1397982 - RNA, 19 nt, Pseudomonas aeruginosa PA01
uugaucaccaccggcuggc

SEQ ID NO: 1397983 - RNA, 12 nt, Pseudomonas aeruginosa PA01
uugaucgagaaa

SEQ ID NO: 1397984 - RNA, 21 nt, Pseudomonas aeruginosa PA01
uugaucgagcccuugcgcggc

SEQ ID NO: 1397985 - RNA, 22 nt, Pseudomonas aeruginosa PA01
uugacgaacaguucgaugggcc

SEQ ID NO: 1397986 - RNA, 18 nt, Pseudomonas aeruginosa PA01
uugacgaaggcggcagcg

SEQ ID NO: 1397987 - RNA, 16 nt, Pseudomonas aeruginosa PA01
uugaccucgacgccga

SEQ ID NO: 1397988 - RNA, 17 nt, Pseudomonas aeruginosa PA01
uugaccugcagcgccuc

SEQ ID NO: 1397989 - RNA, 21 nt, Pseudomonas aeruginosa PA01
uugacgaugcggcccgccggc

SEQ ID NO: 1397990 - RNA, 21 nt, Pseudomonas aeruginosa PA01
uugacgcggaugcccuggucg

SEQ ID NO: 1397991 - RNA, 20 nt, Pseudomonas aeruginosa PA01
uugacuuuuuuaucgauggc

SEQ ID NO: 1397992 - RNA, 15 nt, Pseudomonas aeruginosa PA01
uugagcacccgggcg

SEQ ID NO: 1397993 - RNA, 19 nt, Pseudomonas aeruginosa PA01
uugagcagccaggcgaagc

SEQ ID NO: 1397994 - RNA, 17 nt, Pseudomonas aeruginosa PA01
uugagcaggcggccguc

SEQ ID NO: 1397995 - RNA, 20 nt, Pseudomonas aeruginosa PA01
uugagcagggcgucgcccuc

SEQ ID NO: 1397996 - RNA, 15 nt, Pseudomonas aeruginosa PA01
uugagauccuggccg

SEQ ID NO: 1397997 - RNA, 16 nt, Pseudomonas aeruginosa PA01
uugagauccuggccgg

SEQ ID NO: 1397998 - RNA, 18 nt, Pseudomonas aeruginosa PA01
uugagggucagaccagcc

SEQ ID NO: 1397999 - RNA, 19 nt, Pseudomonas aeruginosa PA01
uugagguagagcacgccgu

SEQ ID NO: 1398000 - RNA, 20 nt, Pseudomonas aeruginosa PA01
uugagguagagcacgccguc

SEQ ID NO: 1398001 - RNA, 13 nt, Pseudomonas aeruginosa PA01
uugagcuggccga

SEQ ID NO: 1398002 - RNA, 13 nt, Pseudomonas aeruginosa PA01
uugagcggcgccc

SEQ ID NO: 1398003 - RNA, 18 nt, Pseudomonas aeruginosa PA01
uugagcggcgcccuggcu

SEQ ID NO: 1398004 - RNA, 15 nt, Pseudomonas aeruginosa PA01
uugaacgcgcgccug

SEQ ID NO: 1398005 - RNA, 19 nt, Pseudomonas aeruginosa PA01
uugaacacaucgaccaggu

SEQ ID NO: 1398006 - RNA, 17 nt, Pseudomonas aeruginosa PA01
uuccguucaaagcccgc

SEQ ID NO: 1398007 - RNA, 20 nt, Pseudomonas aeruginosa PA01
uuccgucucaggcgccaggc

SEQ ID NO: 1398008 - RNA, 23 nt, Pseudomonas aeruginosa PA01
uuccgugcggaaaccgcggccgg

SEQ ID NO: 1398009 - RNA, 15 nt, Pseudomonas aeruginosa PA01
uugaccagcgcgucg

SEQ ID NO: 1398010 - RNA, 21 nt, Pseudomonas aeruginosa PA01
uugacccgccccugcuccucg

SEQ ID NO: 1398011 - RNA, 21 nt, Pseudomonas aeruginosa PA01
uugaccaccaugugcuggcgg

SEQ ID NO: 1398012 - RNA, 13 nt, Pseudomonas aeruginosa PA01
ugggcguuggcca

SEQ ID NO: 1398013 - RNA, 19 nt, Pseudomonas aeruginosa PA01
uggggcuauagcucagcug

SEQ ID NO: 1398014 - RNA, 15 nt, Pseudomonas aeruginosa PA01
uggggcucggcuucc

SEQ ID NO: 1398015 - RNA, 21 nt, Pseudomonas aeruginosa PA01
uggggcucggcuuccaucacc

SEQ ID NO: 1398016 - RNA, 17 nt, Pseudomonas aeruginosa PA01
ugggggauuuccucguc

SEQ ID NO: 1398017 - RNA, 20 nt, Pseudomonas aeruginosa PA01
ugggggauuuccucgucgcc

SEQ ID NO: 1398018 - RNA, 23 nt, Pseudomonas aeruginosa PA01
ugggggaggggagguaagugauu

SEQ ID NO: 1398019 - RNA, 13 nt, Pseudomonas aeruginosa PA01
uggggcggccuca

SEQ ID NO: 1398020 - RNA, 16 nt, Pseudomonas aeruginosa PA01
uggggcugaucucggc

SEQ ID NO: 1398021 - RNA, 17 nt, Pseudomonas aeruginosa PA01
uggggcugcccaccacc

SEQ ID NO: 1398022 - RNA, 21 nt, Pseudomonas aeruginosa PA01
uggggcugcccaccaccagga

SEQ ID NO: 1398023 - RNA, 19 nt, Pseudomonas aeruginosa PA01
ugggcguacaggccccagg

SEQ ID NO: 1398024 - RNA, 21 nt, Pseudomonas aeruginosa PA01
ugggcguacaggccccaggcg

SEQ ID NO: 1398025 - RNA, 22 nt, Pseudomonas aeruginosa PA01
ugggcgucgcuguagcggcucg

SEQ ID NO: 1398026 - RNA, 20 nt, Pseudomonas aeruginosa PA01
ugggcguagaguucgcugcg

SEQ ID NO: 1398027 - RNA, 15 nt, Pseudomonas aeruginosa PA01
ugggcguccgguagg

SEQ ID NO: 1398028 - RNA, 14 nt, Pseudomonas aeruginosa PA01
ugggcggucggcga

SEQ ID NO: 1398029 - RNA, 15 nt, Pseudomonas aeruginosa PA01
ugggcggucggcgag

SEQ ID NO: 1398030 - RNA, 16 nt, Pseudomonas aeruginosa PA01
ugggcggucggcucag

SEQ ID NO: 1398031 - RNA, 15 nt, Pseudomonas aeruginosa PA01
ugggcguggcggccg

SEQ ID NO: 1398032 - RNA, 20 nt, Pseudomonas aeruginosa PA01
ugggcguggcggccgccggc

SEQ ID NO: 1398033 - RNA, 16 nt, Pseudomonas aeruginosa PA01
ugggugucggcgauca

SEQ ID NO: 1398034 - RNA, 16 nt, Pseudomonas aeruginosa PA01
uggguucccagcagca

SEQ ID NO: 1398035 - RNA, 15 nt, Pseudomonas aeruginosa PA01
ugggugccgcgcagg

SEQ ID NO: 1398036 - RNA, 16 nt, Pseudomonas aeruginosa PA01
ugggugcuuuccugcu

SEQ ID NO: 1398037 - RNA, 19 nt, Pseudomonas aeruginosa PA01
uggggucaguucguugagg

SEQ ID NO: 1398038 - RNA, 16 nt, Pseudomonas aeruginosa PA01
ugggguagccggccga

SEQ ID NO: 1398039 - RNA, 13 nt, Pseudomonas aeruginosa PA01
ugggugaccagca

SEQ ID NO: 1398040 - RNA, 14 nt, Pseudomonas aeruginosa PA01
ugggagccgccgga

SEQ ID NO: 1398041 - RNA, 19 nt, Pseudomonas aeruginosa PA01
ugggacgaagccgauugcc

SEQ ID NO: 1398042 - RNA, 13 nt, Pseudomonas aeruginosa PA01
ugggacgaccuca

SEQ ID NO: 1398043 - RNA, 19 nt, Pseudomonas aeruginosa PA01
ugggacauggagaccuggc

SEQ ID NO: 1398044 - RNA, 20 nt, Pseudomonas aeruginosa PA01
ugggacggaacgucggccug

SEQ ID NO: 1398045 - RNA, 19 nt, Pseudomonas aeruginosa PA01
ugggcagcgccgccgggcg

SEQ ID NO: 1398046 - RNA, 18 nt, Pseudomonas aeruginosa PA01
ugggcagcggucgccggu

SEQ ID NO: 1398047 - RNA, 19 nt, Pseudomonas aeruginosa PA01
ugggcagcgucgccgggcg

SEQ ID NO: 1398048 - RNA, 18 nt, Pseudomonas aeruginosa PA01
ugggcagcgugcaccagc

SEQ ID NO: 1398049 - RNA, 19 nt, Pseudomonas aeruginosa PA01
ugggcauaggaauacggcg

SEQ ID NO: 1398050 - RNA, 17 nt, Pseudomonas aeruginosa PA01
ugggcaggcgcaugucc

SEQ ID NO: 1398051 - RNA, 23 nt, Pseudomonas aeruginosa PA01
ugggccaacgguagcggaucagc

SEQ ID NO: 1398052 - RNA, 17 nt, Pseudomonas aeruginosa PA01
ugggcaugcucggccag

SEQ ID NO: 1398053 - RNA, 21 nt, Pseudomonas aeruginosa PA01
ugggcgagaccggggaucagc

SEQ ID NO: 1398054 - RNA, 18 nt, Pseudomonas aeruginosa PA01
ugggcgacgacgaacgcc

SEQ ID NO: 1398055 - RNA, 14 nt, Pseudomonas aeruginosa PA01
ugggccagcccaga

SEQ ID NO: 1398056 - RNA, 20 nt, Pseudomonas aeruginosa PA01
ugggccuucagguaaggcac

SEQ ID NO: 1398057 - RNA, 21 nt, Pseudomonas aeruginosa PA01
ugggcgaacagcacccaggau

SEQ ID NO: 1398058 - RNA, 17 nt, Pseudomonas aeruginosa PA01
ugggccugcuccucggc

SEQ ID NO: 1398059 - RNA, 19 nt, Pseudomonas aeruginosa PA01
ugggccugcuccucggcag

SEQ ID NO: 1398060 - RNA, 16 nt, Pseudomonas aeruginosa PA01
ugggcggcuuccugcu

SEQ ID NO: 1398061 - RNA, 17 nt, Pseudomonas aeruginosa PA01
ugggcggcgaggccgac

SEQ ID NO: 1398062 - RNA, 13 nt, Pseudomonas aeruginosa PA01
ugggcgaucacgc

SEQ ID NO: 1398063 - RNA, 12 nt, Pseudomonas aeruginosa PA01
ugggcgaugcgc

SEQ ID NO: 1398064 - RNA, 16 nt, Pseudomonas aeruginosa PA01
ugggcgagcugccccu

SEQ ID NO: 1398065 - RNA, 18 nt, Pseudomonas aeruginosa PA01
ugggcgaggcgcucgacg

SEQ ID NO: 1398066 - RNA, 18 nt, Pseudomonas aeruginosa PA01
ugggaacccuugcgcagg

SEQ ID NO: 1398067 - RNA, 14 nt, Pseudomonas aeruginosa PA01
uggcuuuucucgcc

SEQ ID NO: 1398068 - RNA, 20 nt, Pseudomonas aeruginosa PA01
uggcuggccucagggcgcga

SEQ ID NO: 1398069 - RNA, 14 nt, Pseudomonas aeruginosa PA01
uggcugcgcgccac

SEQ ID NO: 1398070 - RNA, 16 nt, Pseudomonas aeruginosa PA01
uggcugcucgccucgg

SEQ ID NO: 1398071 - RNA, 12 nt, Pseudomonas aeruginosa PA01
ugggaauggcgg

SEQ ID NO: 1398072 - RNA, 17 nt, Pseudomonas aeruginosa PA01
ugggaauggcggauagc

SEQ ID NO: 1398073 - RNA, 18 nt, Pseudomonas aeruginosa PA01
ugggacaggaagagcagg

SEQ ID NO: 1398074 - RNA, 22 nt, Pseudomonas aeruginosa PA01
ugggacaggaagagcaggcgga

SEQ ID NO: 1398075 - RNA, 22 nt, Pseudomonas aeruginosa PA01
uggcugcagguaggcgguggcg

SEQ ID NO: 1398076 - RNA, 17 nt, Pseudomonas aeruginosa PA01
uggcuggauccuggaag

SEQ ID NO: 1398077 - RNA, 12 nt, Pseudomonas aeruginosa PA01
uggcuggccagc

SEQ ID NO: 1398078 - RNA, 23 nt, Pseudomonas aeruginosa PA01
uggcugccggagucucgggaagg

SEQ ID NO: 1398079 - RNA, 19 nt, Pseudomonas aeruginosa PA01
uggcgugaaguagccgccg

SEQ ID NO: 1398080 - RNA, 14 nt, Pseudomonas aeruginosa PA01
uggcgugcaucacc

SEQ ID NO: 1398081 - RNA, 12 nt, Pseudomonas aeruginosa PA01
uggcgugccgcc

SEQ ID NO: 1398082 - RNA, 12 nt, Pseudomonas aeruginosa PA01
uggcguggccgg

SEQ ID NO: 1398083 - RNA, 13 nt, Pseudomonas aeruginosa PA01
uggcguggccggc

SEQ ID NO: 1398084 - RNA, 15 nt, Pseudomonas aeruginosa PA01
uggcguggccggcga

SEQ ID NO: 1398085 - RNA, 14 nt, Pseudomonas aeruginosa PA01
uggcgugcucggcg

SEQ ID NO: 1398086 - RNA, 15 nt, Pseudomonas aeruginosa PA01
uggcgugcucggcga

SEQ ID NO: 1398087 - RNA, 16 nt, Pseudomonas aeruginosa PA01
uggcguuauucgcccu

SEQ ID NO: 1398088 - RNA, 17 nt, Pseudomonas aeruginosa PA01
uggcguguucgucgauc

SEQ ID NO: 1398089 - RNA, 20 nt, Pseudomonas aeruginosa PA01
uggcguucucgaucaucgcc

SEQ ID NO: 1398090 - RNA, 17 nt, Pseudomonas aeruginosa PA01
uggcguucucggccagg

SEQ ID NO: 1398091 - RNA, 17 nt, Pseudomonas aeruginosa PA01
uggcguucugcgacauc

SEQ ID NO: 1398092 - RNA, 16 nt, Pseudomonas aeruginosa PA01
uggcguuccaggcggc

SEQ ID NO: 1398093 - RNA, 22 nt, Pseudomonas aeruginosa PA01
uggcugaauaccacguggccgg

SEQ ID NO: 1398094 - RNA, 23 nt, Pseudomonas aeruginosa PA01
uggcugaauaccacguggccggc

SEQ ID NO: 1398095 - RNA, 16 nt, Pseudomonas aeruginosa PA01
uggcgucgaccgccug

SEQ ID NO: 1398096 - RNA, 16 nt, Pseudomonas aeruginosa PA01
uggcgucgaucaggcg

SEQ ID NO: 1398097 - RNA, 19 nt, Pseudomonas aeruginosa PA01
uggcgucgaucaggcgggc

SEQ ID NO: 1398098 - RNA, 21 nt, Pseudomonas aeruginosa PA01
uggcgucgaucaggcgggcgu

SEQ ID NO: 1398099 - RNA, 23 nt, Pseudomonas aeruginosa PA01
uggcgucgaaugcggcguggaag

SEQ ID NO: 1398100 - RNA, 18 nt, Pseudomonas aeruginosa PA01
uggcguaucagcgcucca

SEQ ID NO: 1398101 - RNA, 19 nt, Pseudomonas aeruginosa PA01
uggcguccccaugcccggc

SEQ ID NO: 1398102 - RNA, 21 nt, Pseudomonas aeruginosa PA01
uggcguccccaugcccggccu

SEQ ID NO: 1398103 - RNA, 13 nt, Pseudomonas aeruginosa PA01
uggcgucggcgau

SEQ ID NO: 1398104 - RNA, 21 nt, Pseudomonas aeruginosa PA01
uggcgucgccuuccaccacca

SEQ ID NO: 1398105 - RNA, 14 nt, Pseudomonas aeruginosa PA01
uggcgucgaugccg

SEQ ID NO: 1398106 - RNA, 15 nt, Pseudomonas aeruginosa PA01
uggcgucgaugccga

SEQ ID NO: 1398107 - RNA, 13 nt, Pseudomonas aeruginosa PA01
uggcgucgaugcg

SEQ ID NO: 1398108 - RNA, 13 nt, Pseudomonas aeruginosa PA01
uggcggccgacgg

SEQ ID NO: 1398109 - RNA, 21 nt, Pseudomonas aeruginosa PA01
uggcggccgaguucgcgcagg

SEQ ID NO: 1398110 - RNA, 15 nt, Pseudomonas aeruginosa PA01
uggcggccaucaggc

SEQ ID NO: 1398111 - RNA, 16 nt, Pseudomonas aeruginosa PA01
uggcggccaucaggcg

SEQ ID NO: 1398112 - RNA, 14 nt, Pseudomonas aeruginosa PA01
uggcggccagggca

SEQ ID NO: 1398113 - RNA, 13 nt, Pseudomonas aeruginosa PA01
uggcggcaucgcg

SEQ ID NO: 1398114 - RNA, 17 nt, Pseudomonas aeruginosa PA01
uggcggcaucgcguagg

SEQ ID NO: 1398115 - RNA, 23 nt, Pseudomonas aeruginosa PA01
uggcggcauugagcgccagcagg

SEQ ID NO: 1398116 - RNA, 17 nt, Pseudomonas aeruginosa PA01
uggcggcauugagggcg

SEQ ID NO: 1398117 - RNA, 23 nt, Pseudomonas aeruginosa PA01
uggcguagcguugcgcgagcacc

SEQ ID NO: 1398118 - RNA, 17 nt, Pseudomonas aeruginosa PA01
uggcguacuugggcauc

SEQ ID NO: 1398119 - RNA, 19 nt, Pseudomonas aeruginosa PA01
uggcguagaggcucggcgg

SEQ ID NO: 1398120 - RNA, 19 nt, Pseudomonas aeruginosa PA01
uggcgguugaugccgacgu

SEQ ID NO: 1398121 - RNA, 22 nt, Pseudomonas aeruginosa PA01
uggcgguugaugccgacgucga

SEQ ID NO: 1398122 - RNA, 12 nt, Pseudomonas aeruginosa PA01
uggcgccagcca

SEQ ID NO: 1398123 - RNA, 13 nt, Pseudomonas aeruginosa PA01
uggcgccagccag

SEQ ID NO: 1398124 - RNA, 19 nt, Pseudomonas aeruginosa PA01
uggcgcccaugccgcccgg

SEQ ID NO: 1398125 - RNA, 20 nt, Pseudomonas aeruginosa PA01
uggcgcccaugccgcccggc

SEQ ID NO: 1398126 - RNA, 21 nt, Pseudomonas aeruginosa PA01
uggcgccccagaucgccagcg

SEQ ID NO: 1398127 - RNA, 18 nt, Pseudomonas aeruginosa PA01
uggcgccccaggcgggca

SEQ ID NO: 1398128 - RNA, 17 nt, Pseudomonas aeruginosa PA01
uggcgccauccuccagc

SEQ ID NO: 1398129 - RNA, 18 nt, Pseudomonas aeruginosa PA01
uggcgccauccuccagcg

SEQ ID NO: 1398130 - RNA, 21 nt, Pseudomonas aeruginosa PA01
uggcgccauccuccagcgccg

SEQ ID NO: 1398131 - RNA, 22 nt, Pseudomonas aeruginosa PA01
uggcgccauccuccagcgccgc

SEQ ID NO: 1398132 - RNA, 23 nt, Pseudomonas aeruginosa PA01
uggcgccauugugcgcgcgcaga

SEQ ID NO: 1398133 - RNA, 14 nt, Pseudomonas aeruginosa PA01
uggcgcccgccuug

SEQ ID NO: 1398134 - RNA, 22 nt, Pseudomonas aeruginosa PA01
uggcgcccgccuuguucgccag

SEQ ID NO: 1398135 - RNA, 15 nt, Pseudomonas aeruginosa PA01
uggcgcagccgucca

SEQ ID NO: 1398136 - RNA, 21 nt, Pseudomonas aeruginosa PA01
uggcgcagccaggcgauggug

SEQ ID NO: 1398137 - RNA, 19 nt, Pseudomonas aeruginosa PA01
uggcgcagccgcugggcca

SEQ ID NO: 1398138 - RNA, 17 nt, Pseudomonas aeruginosa PA01
uggcgcagcggcagcgc

SEQ ID NO: 1398139 - RNA, 21 nt, Pseudomonas aeruginosa PA01
uggcgcaggaccgccauggcg

SEQ ID NO: 1398140 - RNA, 15 nt, Pseudomonas aeruginosa PA01
uggcgcaggccgggc

SEQ ID NO: 1398141 - RNA, 19 nt, Pseudomonas aeruginosa PA01
uggcgcaggccgggcggac

SEQ ID NO: 1398142 - RNA, 21 nt, Pseudomonas aeruginosa PA01
uggcgcaggccgggcggacgc

SEQ ID NO: 1398143 - RNA, 14 nt, Pseudomonas aeruginosa PA01
uggcgaaggcgcuc

SEQ ID NO: 1398144 - RNA, 15 nt, Pseudomonas aeruginosa PA01
uggcgaagcuggggc

SEQ ID NO: 1398145 - RNA, 16 nt, Pseudomonas aeruginosa PA01
uggcgaagcuggggcu

SEQ ID NO: 1398146 - RNA, 18 nt, Pseudomonas aeruginosa PA01
uggcgaaggcaaugccgc

SEQ ID NO: 1398147 - RNA, 16 nt, Pseudomonas aeruginosa PA01
uggcgaaguucccgcc

SEQ ID NO: 1398148 - RNA, 16 nt, Pseudomonas aeruginosa PA01
uggcgcacgccgcgga

SEQ ID NO: 1398149 - RNA, 14 nt, Pseudomonas aeruginosa PA01
uggcgcacggccug

SEQ ID NO: 1398150 - RNA, 19 nt, Pseudomonas aeruginosa PA01
uggcgcacugccaggagca

SEQ ID NO: 1398151 - RNA, 15 nt, Pseudomonas aeruginosa PA01
uggcgcagcagcagg

SEQ ID NO: 1398152 - RNA, 23 nt, Pseudomonas aeruginosa PA01
uggcgcagacaggccuccagcaa

SEQ ID NO: 1398153 - RNA, 18 nt, Pseudomonas aeruginosa PA01
uggcgaacuucaggccgg

SEQ ID NO: 1398154 - RNA, 19 nt, Pseudomonas aeruginosa PA01
uggcgaacuucaggccggc

SEQ ID NO: 1398155 - RNA, 21 nt, Pseudomonas aeruginosa PA01
uggcgaacuucaggccggcgc

SEQ ID NO: 1398156 - RNA, 16 nt, Pseudomonas aeruginosa PA01
uggcgaaaucgagcug

SEQ ID NO: 1398157 - RNA, 22 nt, Pseudomonas aeruginosa PA01
uggcgaaauugccuccgcucug

SEQ ID NO: 1398158 - RNA, 20 nt, Pseudomonas aeruginosa PA01
uggcgaacaugaagccgcgc

SEQ ID NO: 1398159 - RNA, 22 nt, Pseudomonas aeruginosa PA01
uggcgaacaugaagccgcgcgc

SEQ ID NO: 1398160 - RNA, 17 nt, Pseudomonas aeruginosa PA01
uggcgaaccaguccagc

SEQ ID NO: 1398161 - RNA, 19 nt, Pseudomonas aeruginosa PA01
uggcgaaccaguccagcac

SEQ ID NO: 1398162 - RNA, 18 nt, Pseudomonas aeruginosa PA01
uggcggauguaguccagc

SEQ ID NO: 1398163 - RNA, 19 nt, Pseudomonas aeruginosa PA01
uggcggauguaguccagcg

SEQ ID NO: 1398164 - RNA, 21 nt, Pseudomonas aeruginosa PA01
uggcggauguaguccagcgcc

SEQ ID NO: 1398165 - RNA, 17 nt, Pseudomonas aeruginosa PA01
uggcggcaaggcacacg

SEQ ID NO: 1398166 - RNA, 18 nt, Pseudomonas aeruginosa PA01
uggcggauaaccgcaagc

SEQ ID NO: 1398167 - RNA, 20 nt, Pseudomonas aeruginosa PA01
uggcggauaaccgcaagcgg

SEQ ID NO: 1398168 - RNA, 18 nt, Pseudomonas aeruginosa PA01
uggcggauagccgcaagc

SEQ ID NO: 1398169 - RNA, 17 nt, Pseudomonas aeruginosa PA01
uggcggaucaccggcug

SEQ ID NO: 1398170 - RNA, 19 nt, Pseudomonas aeruginosa PA01
uggcggaagaaucgcagcc

SEQ ID NO: 1398171 - RNA, 17 nt, Pseudomonas aeruginosa PA01
uggcggaaaagcccgcu

SEQ ID NO: 1398172 - RNA, 20 nt, Pseudomonas aeruginosa PA01
uggcgcuugagcagccaggc

SEQ ID NO: 1398173 - RNA, 21 nt, Pseudomonas aeruginosa PA01
uggcgcuugagcagccaggcg

SEQ ID NO: 1398174 - RNA, 15 nt, Pseudomonas aeruginosa PA01
uggcgcuugccgcgc

SEQ ID NO: 1398175 - RNA, 19 nt, Pseudomonas aeruginosa PA01
uggcgcuugccgcgcccgg

SEQ ID NO: 1398176 - RNA, 20 nt, Pseudomonas aeruginosa PA01
uggcgcuugccgcgcccggc

SEQ ID NO: 1398177 - RNA, 16 nt, Pseudomonas aeruginosa PA01
uggcgcuugcgcagca

SEQ ID NO: 1398178 - RNA, 12 nt, Pseudomonas aeruginosa PA01
uggcgcuggcca

SEQ ID NO: 1398179 - RNA, 17 nt, Pseudomonas aeruginosa PA01
uggcgcuguaggcgagc

SEQ ID NO: 1398180 - RNA, 20 nt, Pseudomonas aeruginosa PA01
uggcgcuguaggcgagcagc

SEQ ID NO: 1398181 - RNA, 23 nt, Pseudomonas aeruginosa PA01
uggcgcuguaggcgagcagcggc

SEQ ID NO: 1398182 - RNA, 12 nt, Pseudomonas aeruginosa PA01
uggcgcgaccgc

SEQ ID NO: 1398183 - RNA, 13 nt, Pseudomonas aeruginosa PA01
uggcgcgaccgcc

SEQ ID NO: 1398184 - RNA, 17 nt, Pseudomonas aeruginosa PA01
uggcgcgagaagccagc

SEQ ID NO: 1398185 - RNA, 20 nt, Pseudomonas aeruginosa PA01
uggcgcgagaagccagccag

SEQ ID NO: 1398186 - RNA, 21 nt, Pseudomonas aeruginosa PA01
uggcgcgagaagccagccagg

SEQ ID NO: 1398187 - RNA, 13 nt, Pseudomonas aeruginosa PA01
uggcgcgauccgc

SEQ ID NO: 1398188 - RNA, 18 nt, Pseudomonas aeruginosa PA01
uggcgcgauccgcgcggc

SEQ ID NO: 1398189 - RNA, 15 nt, Pseudomonas aeruginosa PA01
uggcgcgaucggggc

SEQ ID NO: 1398190 - RNA, 16 nt, Pseudomonas aeruginosa PA01
uggcgcgcaccaccug

SEQ ID NO: 1398191 - RNA, 14 nt, Pseudomonas aeruginosa PA01
uggcgcgaugcucc

SEQ ID NO: 1398192 - RNA, 19 nt, Pseudomonas aeruginosa PA01
uggcgcgaugcucccgagc

SEQ ID NO: 1398193 - RNA, 23 nt, Pseudomonas aeruginosa PA01
uggcgcgaugcucccgagcaaga

SEQ ID NO: 1398194 - RNA, 21 nt, Pseudomonas aeruginosa PA01
uggcgcgcaucggugccggca

SEQ ID NO: 1398195 - RNA, 19 nt, Pseudomonas aeruginosa PA01
uggcgcggacgggccgcgc

SEQ ID NO: 1398196 - RNA, 16 nt, Pseudomonas aeruginosa PA01
uggcgcgcuuuccggc

SEQ ID NO: 1398197 - RNA, 17 nt, Pseudomonas aeruginosa PA01
uggcgcgcuuuccggcg

SEQ ID NO: 1398198 - RNA, 14 nt, Pseudomonas aeruginosa PA01
uggcgcgcgcccuu

SEQ ID NO: 1398199 - RNA, 17 nt, Pseudomonas aeruginosa PA01
uggcgcgcgcgccaggu

SEQ ID NO: 1398200 - RNA, 16 nt, Pseudomonas aeruginosa PA01
uggcgcgcggccgcgu

SEQ ID NO: 1398201 - RNA, 12 nt, Pseudomonas aeruginosa PA01
uggcgcgcugcg

SEQ ID NO: 1398202 - RNA, 14 nt, Pseudomonas aeruginosa PA01
uggcgcgcugcggc

SEQ ID NO: 1398203 - RNA, 17 nt, Pseudomonas aeruginosa PA01
uggcgcgcugcggcagg

SEQ ID NO: 1398204 - RNA, 13 nt, Pseudomonas aeruginosa PA01
uggcgcgcuggca

SEQ ID NO: 1398205 - RNA, 13 nt, Pseudomonas aeruginosa PA01
uggccggcagcag

SEQ ID NO: 1398206 - RNA, 15 nt, Pseudomonas aeruginosa PA01
uggccggcaccagca

SEQ ID NO: 1398207 - RNA, 22 nt, Pseudomonas aeruginosa PA01
uggccggcacccugaccgcgag

SEQ ID NO: 1398208 - RNA, 23 nt, Pseudomonas aeruginosa PA01
uggccggcacccugaccgcgagc

SEQ ID NO: 1398209 - RNA, 24 nt, Pseudomonas aeruginosa PA01
uggccggcacccugaccgcgagcg

SEQ ID NO: 1398210 - RNA, 18 nt, Pseudomonas aeruginosa PA01
uggccgccuggccggcca

SEQ ID NO: 1398211 - RNA, 20 nt, Pseudomonas aeruginosa PA01
uggccgccucgcgccgcgcc

SEQ ID NO: 1398212 - RNA, 19 nt, Pseudomonas aeruginosa PA01
uggccgccugcucggccug

SEQ ID NO: 1398213 - RNA, 20 nt, Pseudomonas aeruginosa PA01
uggccgccugcucggccugc

SEQ ID NO: 1398214 - RNA, 17 nt, Pseudomonas aeruginosa PA01
uggccggccagccaggc

SEQ ID NO: 1398215 - RNA, 15 nt, Pseudomonas aeruginosa PA01
uggccggcgauggcc

SEQ ID NO: 1398216 - RNA, 17 nt, Pseudomonas aeruginosa PA01
uggccggcgauggccgc

SEQ ID NO: 1398217 - RNA, 18 nt, Pseudomonas aeruginosa PA01
uggccggcgauggccgcc

SEQ ID NO: 1398218 - RNA, 21 nt, Pseudomonas aeruginosa PA01
uggccggcgauggccgccugc

SEQ ID NO: 1398219 - RNA, 15 nt, Pseudomonas aeruginosa PA01
uggccgggccgaugc

SEQ ID NO: 1398220 - RNA, 16 nt, Pseudomonas aeruginosa PA01
uggccgggccgaugcg

SEQ ID NO: 1398221 - RNA, 16 nt, Pseudomonas aeruginosa PA01
uggccggccucggcgg

SEQ ID NO: 1398222 - RNA, 17 nt, Pseudomonas aeruginosa PA01
uggccggccucggcggc

SEQ ID NO: 1398223 - RNA, 19 nt, Pseudomonas aeruginosa PA01
uggccggccucggcggcgc

SEQ ID NO: 1398224 - RNA, 20 nt, Pseudomonas aeruginosa PA01
uggccggccucggcggcgcg

SEQ ID NO: 1398225 - RNA, 21 nt, Pseudomonas aeruginosa PA01
uggccggccucggcggcgcga

SEQ ID NO: 1398226 - RNA, 22 nt, Pseudomonas aeruginosa PA01
uggccggcguacuucggcgcgg

SEQ ID NO: 1398227 - RNA, 12 nt, Pseudomonas aeruginosa PA01
uggccuggcgcu

SEQ ID NO: 1398228 - RNA, 16 nt, Pseudomonas aeruginosa PA01
uggccuggcgcucagc

SEQ ID NO: 1398229 - RNA, 20 nt, Pseudomonas aeruginosa PA01
uggccuggcgcucagcgccg

SEQ ID NO: 1398230 - RNA, 15 nt, Pseudomonas aeruginosa PA01
uggccuggucggcgc

SEQ ID NO: 1398231 - RNA, 14 nt, Pseudomonas aeruginosa PA01
uggccugggcgcuc

SEQ ID NO: 1398232 - RNA, 18 nt, Pseudomonas aeruginosa PA01
uggccugggguagccggc

SEQ ID NO: 1398233 - RNA, 20 nt, Pseudomonas aeruginosa PA01
uggccugggguagccggccg

SEQ ID NO: 1398234 - RNA, 13 nt, Pseudomonas aeruginosa PA01
uggccuuggccac

SEQ ID NO: 1398235 - RNA, 18 nt, Pseudomonas aeruginosa PA01
uggcgaaacuccagcagg

SEQ ID NO: 1398236 - RNA, 13 nt, Pseudomonas aeruginosa PA01
uggccuggucggc

SEQ ID NO: 1398237 - RNA, 23 nt, Pseudomonas aeruginosa PA01
uggccuugccguccagccggcgc

SEQ ID NO: 1398238 - RNA, 15 nt, Pseudomonas aeruginosa PA01
uggccuucgucggcu

SEQ ID NO: 1398239 - RNA, 14 nt, Pseudomonas aeruginosa PA01
uggccgccagcagg

SEQ ID NO: 1398240 - RNA, 15 nt, Pseudomonas aeruginosa PA01
uggccgccagcaggc

SEQ ID NO: 1398241 - RNA, 14 nt, Pseudomonas aeruginosa PA01
uggccgccgccgcc

SEQ ID NO: 1398242 - RNA, 16 nt, Pseudomonas aeruginosa PA01
uggccgcccaguucgc

SEQ ID NO: 1398243 - RNA, 20 nt, Pseudomonas aeruginosa PA01
uggccgcccuugcggcccgc

SEQ ID NO: 1398244 - RNA, 21 nt, Pseudomonas aeruginosa PA01
uggccgcccuugcggcccgcc

SEQ ID NO: 1398245 - RNA, 12 nt, Pseudomonas aeruginosa PA01
uggccgcagcag

SEQ ID NO: 1398246 - RNA, 14 nt, Pseudomonas aeruginosa PA01
uggccgcagcagcg

SEQ ID NO: 1398247 - RNA, 17 nt, Pseudomonas aeruginosa PA01
uggccgcagcagcggca

SEQ ID NO: 1398248 - RNA, 16 nt, Pseudomonas aeruginosa PA01
uggccgaguggccgaa

SEQ ID NO: 1398249 - RNA, 19 nt, Pseudomonas aeruginosa PA01
uggccgaguggccgaaggc

SEQ ID NO: 1398250 - RNA, 21 nt, Pseudomonas aeruginosa PA01
uggccgauuucgaugacgcca

SEQ ID NO: 1398251 - RNA, 14 nt, Pseudomonas aeruginosa PA01
uggccgaugccgac

SEQ ID NO: 1398252 - RNA, 20 nt, Pseudomonas aeruginosa PA01
uggccgaacucaugcccagc

SEQ ID NO: 1398253 - RNA, 19 nt, Pseudomonas aeruginosa PA01
uggccgaccaguaccaggc

SEQ ID NO: 1398254 - RNA, 20 nt, Pseudomonas aeruginosa PA01
uggccgaccaguaccaggcg

SEQ ID NO: 1398255 - RNA, 16 nt, Pseudomonas aeruginosa PA01
uggccgacccgcagcg

SEQ ID NO: 1398256 - RNA, 18 nt, Pseudomonas aeruginosa PA01
uggccgacccgcagcggc

SEQ ID NO: 1398257 - RNA, 19 nt, Pseudomonas aeruginosa PA01
uggccgacccgcagcggcg

SEQ ID NO: 1398258 - RNA, 12 nt, Pseudomonas aeruginosa PA01
uggccgacccgu

SEQ ID NO: 1398259 - RNA, 15 nt, Pseudomonas aeruginosa PA01
uggccgacccgugcg

SEQ ID NO: 1398260 - RNA, 14 nt, Pseudomonas aeruginosa PA01
uggccgaccgccag

SEQ ID NO: 1398261 - RNA, 16 nt, Pseudomonas aeruginosa PA01
uggccgaccgccaggc

SEQ ID NO: 1398262 - RNA, 17 nt, Pseudomonas aeruginosa PA01
uggccgaccgccaggcc

SEQ ID NO: 1398263 - RNA, 20 nt, Pseudomonas aeruginosa PA01
uggccgaccgccaggccgac

SEQ ID NO: 1398264 - RNA, 15 nt, Pseudomonas aeruginosa PA01
uggccgaaagcacug

SEQ ID NO: 1398265 - RNA, 19 nt, Pseudomonas aeruginosa PA01
uggccgaaagcacugcggc

SEQ ID NO: 1398266 - RNA, 13 nt, Pseudomonas aeruginosa PA01
uggcccuggcgca

SEQ ID NO: 1398267 - RNA, 15 nt, Pseudomonas aeruginosa PA01
uggcccuggcgcagg

SEQ ID NO: 1398268 - RNA, 19 nt, Pseudomonas aeruginosa PA01
uggcccugcaucgcgacag

SEQ ID NO: 1398269 - RNA, 20 nt, Pseudomonas aeruginosa PA01
uggcccugcaucgcgacagg

SEQ ID NO: 1398270 - RNA, 16 nt, Pseudomonas aeruginosa PA01
uggcccuucgcccugc

SEQ ID NO: 1398271 - RNA, 22 nt, Pseudomonas aeruginosa PA01
uggccgagguggagaucagcgg

SEQ ID NO: 1398272 - RNA, 18 nt, Pseudomonas aeruginosa PA01
uggccgagcugccgcacc

SEQ ID NO: 1398273 - RNA, 20 nt, Pseudomonas aeruginosa PA01
uggccgagcugccgcaccgc

SEQ ID NO: 1398274 - RNA, 16 nt, Pseudomonas aeruginosa PA01
uggccgaggacccggc

SEQ ID NO: 1398275 - RNA, 17 nt, Pseudomonas aeruginosa PA01
uggccgaggaggccagc

SEQ ID NO: 1398276 - RNA, 17 nt, Pseudomonas aeruginosa PA01
uggccgagggcgcgcag

SEQ ID NO: 1398277 - RNA, 22 nt, Pseudomonas aeruginosa PA01
uggccgagcgcgagugcagcga

SEQ ID NO: 1398278 - RNA, 21 nt, Pseudomonas aeruginosa PA01
uggccgagcccagcggcaggg

SEQ ID NO: 1398279 - RNA, 16 nt, Pseudomonas aeruginosa PA01
uggccgagcaucagca

SEQ ID NO: 1398280 - RNA, 13 nt, Pseudomonas aeruginosa PA01
uggaaggccgcgc

SEQ ID NO: 1398281 - RNA, 14 nt, Pseudomonas aeruginosa PA01
uggaagucgcccug

SEQ ID NO: 1398282 - RNA, 15 nt, Pseudomonas aeruginosa PA01
uggaagucgcccugc

SEQ ID NO: 1398283 - RNA, 17 nt, Pseudomonas aeruginosa PA01
uggaaguugccgccagc

SEQ ID NO: 1398284 - RNA, 22 nt, Pseudomonas aeruginosa PA01
uggaaguugcgcacccgcucgg

SEQ ID NO: 1398285 - RNA, 15 nt, Pseudomonas aeruginosa PA01
uggaauucgccgcgc

SEQ ID NO: 1398286 - RNA, 18 nt, Pseudomonas aeruginosa PA01
uggaauguccugccgcag

SEQ ID NO: 1398287 - RNA, 21 nt, Pseudomonas aeruginosa PA01
uggaauguccugccgcaggcg

SEQ ID NO: 1398288 - RNA, 22 nt, Pseudomonas aeruginosa PA01
uggaacuggucggggcgcaagg

SEQ ID NO: 1398289 - RNA, 20 nt, Pseudomonas aeruginosa PA01
uggaacgcaggggcaccggc

SEQ ID NO: 1398290 - RNA, 13 nt, Pseudomonas aeruginosa PA01
uggaacggccagg

SEQ ID NO: 1398291 - RNA, 18 nt, Pseudomonas aeruginosa PA01
uggaagccgaucggcaug

SEQ ID NO: 1398292 - RNA, 17 nt, Pseudomonas aeruginosa PA01
uggaagccgcgcucgcg

SEQ ID NO: 1398293 - RNA, 21 nt, Pseudomonas aeruginosa PA01
uggaagaaggcgaucaucgcc

SEQ ID NO: 1398294 - RNA, 15 nt, Pseudomonas aeruginosa PA01
uggaagaauggcgug

SEQ ID NO: 1398295 - RNA, 16 nt, Pseudomonas aeruginosa PA01
uggaagaggaucgcga

SEQ ID NO: 1398296 - RNA, 16 nt, Pseudomonas aeruginosa PA01
uggaacaccaggccgc

SEQ ID NO: 1398297 - RNA, 16 nt, Pseudomonas aeruginosa PA01
uggaacagcagccagg

SEQ ID NO: 1398298 - RNA, 17 nt, Pseudomonas aeruginosa PA01
uggaacagcagccaggc

SEQ ID NO: 1398299 - RNA, 18 nt, Pseudomonas aeruginosa PA01
uggaacagcagccaggcg

SEQ ID NO: 1398300 - RNA, 18 nt, Pseudomonas aeruginosa PA01
uggaacagccgcagcggc

SEQ ID NO: 1398301 - RNA, 22 nt, Pseudomonas aeruginosa PA01
uggaacagccgcagcggcaugc

SEQ ID NO: 1398302 - RNA, 18 nt, Pseudomonas aeruginosa PA01
ugcggggugcgcuggaac

SEQ ID NO: 1398303 - RNA, 18 nt, Pseudomonas aeruginosa PA01
uggaacgaggcgacccgg

SEQ ID NO: 1398304 - RNA, 14 nt, Pseudomonas aeruginosa PA01
uggaaccggccggc

SEQ ID NO: 1398305 - RNA, 20 nt, Pseudomonas aeruginosa PA01
uggaacccauggcgcgaugc

SEQ ID NO: 1398306 - RNA, 23 nt, Pseudomonas aeruginosa PA01
uggaacccgcuucgucggucgcg

SEQ ID NO: 1398307 - RNA, 12 nt, Pseudomonas aeruginosa PA01
uggaaccgaggg

SEQ ID NO: 1398308 - RNA, 13 nt, Pseudomonas aeruginosa PA01
uggaaccgcggcg

SEQ ID NO: 1398309 - RNA, 13 nt, Pseudomonas aeruginosa PA01
ugcgggcgccgcc

SEQ ID NO: 1398310 - RNA, 12 nt, Pseudomonas aeruginosa PA01
ugcgggcgcugc

SEQ ID NO: 1398311 - RNA, 22 nt, Pseudomonas aeruginosa PA01
ugcgggcggguaaagcgcccgc

SEQ ID NO: 1398312 - RNA, 14 nt, Pseudomonas aeruginosa PA01
ugcgggcgggugcg

SEQ ID NO: 1398313 - RNA, 17 nt, Pseudomonas aeruginosa PA01
ugcgggcguagcgcggc

SEQ ID NO: 1398314 - RNA, 13 nt, Pseudomonas aeruginosa PA01
ugcggggcgacca

SEQ ID NO: 1398315 - RNA, 18 nt, Pseudomonas aeruginosa PA01
ugcggggcgaccagcauc

SEQ ID NO: 1398316 - RNA, 16 nt, Pseudomonas aeruginosa PA01
uggaccggcucgucgg

SEQ ID NO: 1398317 - RNA, 18 nt, Pseudomonas aeruginosa PA01
uggaccggcucgucggcg

SEQ ID NO: 1398318 - RNA, 22 nt, Pseudomonas aeruginosa PA01
uggacgaaacgguagcccgcgg

SEQ ID NO: 1398319 - RNA, 14 nt, Pseudomonas aeruginosa PA01
uggacugcgaggcg

SEQ ID NO: 1398320 - RNA, 17 nt, Pseudomonas aeruginosa PA01
uggacuucggucucguc

SEQ ID NO: 1398321 - RNA, 16 nt, Pseudomonas aeruginosa PA01
uggacgugggaaauca

SEQ ID NO: 1398322 - RNA, 21 nt, Pseudomonas aeruginosa PA01
uggacgugggaaaucaccgcc

SEQ ID NO: 1398323 - RNA, 21 nt, Pseudomonas aeruginosa PA01
uggacggucucgccgccgagc

SEQ ID NO: 1398324 - RNA, 12 nt, Pseudomonas aeruginosa PA01
uggacgucggcg

SEQ ID NO: 1398325 - RNA, 13 nt, Pseudomonas aeruginosa PA01
uggacgugcagga

SEQ ID NO: 1398326 - RNA, 23 nt, Pseudomonas aeruginosa PA01
uggacgcggccugggccgaaggc

SEQ ID NO: 1398327 - RNA, 23 nt, Pseudomonas aeruginosa PA01
uggacgcgcuuguccuccagcug

SEQ ID NO: 1398328 - RNA, 23 nt, Pseudomonas aeruginosa PA01
uggacggcggacugcucgccgcc

SEQ ID NO: 1398329 - RNA, 16 nt, Pseudomonas aeruginosa PA01
uggacaccucccgggc

SEQ ID NO: 1398330 - RNA, 15 nt, Pseudomonas aeruginosa PA01
uggaauugcugacgg

SEQ ID NO: 1398331 - RNA, 20 nt, Pseudomonas aeruginosa PA01
uggacagcuuggccagcagg

SEQ ID NO: 1398332 - RNA, 21 nt, Pseudomonas aeruginosa PA01
uggacaggcgcaggggcgaga

SEQ ID NO: 1398333 - RNA, 15 nt, Pseudomonas aeruginosa PA01
uggacaggucgacgg

SEQ ID NO: 1398334 - RNA, 16 nt, Pseudomonas aeruginosa PA01
uggacaggucgacggc

SEQ ID NO: 1398335 - RNA, 19 nt, Pseudomonas aeruginosa PA01
uggaccaacagccggcggg

SEQ ID NO: 1398336 - RNA, 13 nt, Pseudomonas aeruginosa PA01
uggaccagcgccg

SEQ ID NO: 1398337 - RNA, 14 nt, Pseudomonas aeruginosa PA01
uggaccagcgccgc

SEQ ID NO: 1398338 - RNA, 23 nt, Pseudomonas aeruginosa PA01
uggaccaguucagcgcgcucgcu

SEQ ID NO: 1398339 - RNA, 15 nt, Pseudomonas aeruginosa PA01
uggaccauggccggc

SEQ ID NO: 1398340 - RNA, 16 nt, Pseudomonas aeruginosa PA01
uggacccguugccgac

SEQ ID NO: 1398341 - RNA, 15 nt, Pseudomonas aeruginosa PA01
uggaccaggcggccg

SEQ ID NO: 1398342 - RNA, 16 nt, Pseudomonas aeruginosa PA01
uggaccaggcggccgg

SEQ ID NO: 1398343 - RNA, 20 nt, Pseudomonas aeruginosa PA01
uggauagaguacucggcuac

SEQ ID NO: 1398344 - RNA, 14 nt, Pseudomonas aeruginosa PA01
uggauacgcucggc

SEQ ID NO: 1398345 - RNA, 17 nt, Pseudomonas aeruginosa PA01
uggauacgggcgccagg

SEQ ID NO: 1398346 - RNA, 14 nt, Pseudomonas aeruginosa PA01
uggauaucgucggg

SEQ ID NO: 1398347 - RNA, 15 nt, Pseudomonas aeruginosa PA01
uggauaucugggcca

SEQ ID NO: 1398348 - RNA, 16 nt, Pseudomonas aeruginosa PA01
uggaucaccgccaagg

SEQ ID NO: 1398349 - RNA, 22 nt, Pseudomonas aeruginosa PA01
uggaucaccgcggcgcugaagg

SEQ ID NO: 1398350 - RNA, 16 nt, Pseudomonas aeruginosa PA01
uggaguuuccgcgagg

SEQ ID NO: 1398351 - RNA, 16 nt, Pseudomonas aeruginosa PA01
uggaguaucgcccugg

SEQ ID NO: 1398352 - RNA, 15 nt, Pseudomonas aeruginosa PA01
uggagucaggcgccg

SEQ ID NO: 1398353 - RNA, 17 nt, Pseudomonas aeruginosa PA01
uggagucaggcgccggc

SEQ ID NO: 1398354 - RNA, 19 nt, Pseudomonas aeruginosa PA01
uggagguagcugcgccgcc

SEQ ID NO: 1398355 - RNA, 14 nt, Pseudomonas aeruginosa PA01
uggagguucggcag

SEQ ID NO: 1398356 - RNA, 13 nt, Pseudomonas aeruginosa PA01
uggagccgcccuc

SEQ ID NO: 1398357 - RNA, 15 nt, Pseudomonas aeruginosa PA01
uggaggcggcgguca

SEQ ID NO: 1398358 - RNA, 14 nt, Pseudomonas aeruginosa PA01
uggaggcgggcuca

SEQ ID NO: 1398359 - RNA, 13 nt, Pseudomonas aeruginosa PA01
uggaggcgucggc

SEQ ID NO: 1398360 - RNA, 14 nt, Pseudomonas aeruginosa PA01
uggaggacgcgggc

SEQ ID NO: 1398361 - RNA, 19 nt, Pseudomonas aeruginosa PA01
uggagcagaaccgccagca

SEQ ID NO: 1398362 - RNA, 23 nt, Pseudomonas aeruginosa PA01
uggagcaguuucggaucgacgcc

SEQ ID NO: 1398363 - RNA, 18 nt, Pseudomonas aeruginosa PA01
uggagcagcagcgccgcg

SEQ ID NO: 1398364 - RNA, 20 nt, Pseudomonas aeruginosa PA01
uggagaacguugcccaccga

SEQ ID NO: 1398365 - RNA, 15 nt, Pseudomonas aeruginosa PA01
uggagaagaucgccg

SEQ ID NO: 1398366 - RNA, 12 nt, Pseudomonas aeruginosa PA01
uggauucgaagg

SEQ ID NO: 1398367 - RNA, 14 nt, Pseudomonas aeruginosa PA01
uggauucggccugc

SEQ ID NO: 1398368 - RNA, 17 nt, Pseudomonas aeruginosa PA01
uggauguugccgccgcc

SEQ ID NO: 1398369 - RNA, 23 nt, Pseudomonas aeruginosa PA01
uggaugucguagacgcccggacc

SEQ ID NO: 1398370 - RNA, 13 nt, Pseudomonas aeruginosa PA01
uggaugugcuggu

SEQ ID NO: 1398371 - RNA, 23 nt, Pseudomonas aeruginosa PA01
uggcaaccgucgaacagguggcu

SEQ ID NO: 1398372 - RNA, 15 nt, Pseudomonas aeruginosa PA01
uggaucagcgccucg

SEQ ID NO: 1398373 - RNA, 13 nt, Pseudomonas aeruginosa PA01
uggaucgcccggc

SEQ ID NO: 1398374 - RNA, 13 nt, Pseudomonas aeruginosa PA01
uggaucgcggcgu

SEQ ID NO: 1398375 - RNA, 21 nt, Pseudomonas aeruginosa PA01
uggauccgugccaggcgcucg

SEQ ID NO: 1398376 - RNA, 17 nt, Pseudomonas aeruginosa PA01
uggauccucgccucgcg

SEQ ID NO: 1398377 - RNA, 13 nt, Pseudomonas aeruginosa PA01
uggaucggcagcu

SEQ ID NO: 1398378 - RNA, 21 nt, Pseudomonas aeruginosa PA01
uggaucggccccaccuggcga

SEQ ID NO: 1398379 - RNA, 19 nt, Pseudomonas aeruginosa PA01
uggaucggccucgcggcgc

SEQ ID NO: 1398380 - RNA, 22 nt, Pseudomonas aeruginosa PA01
uggaucggccucgcggcgcucg

SEQ ID NO: 1398381 - RNA, 20 nt, Pseudomonas aeruginosa PA01
uggaucucccguaccagcgc

SEQ ID NO: 1398382 - RNA, 19 nt, Pseudomonas aeruginosa PA01
uggaugccgguggcgccca

SEQ ID NO: 1398383 - RNA, 12 nt, Pseudomonas aeruginosa PA01
uggaugcgcggc

SEQ ID NO: 1398384 - RNA, 13 nt, Pseudomonas aeruginosa PA01
uggaugcgcggca

SEQ ID NO: 1398385 - RNA, 15 nt, Pseudomonas aeruginosa PA01
uggaugcgcggcagc

SEQ ID NO: 1398386 - RNA, 18 nt, Pseudomonas aeruginosa PA01
uggaugaccacgucgcga

SEQ ID NO: 1398387 - RNA, 19 nt, Pseudomonas aeruginosa PA01
uggaugcagccgauggcga

SEQ ID NO: 1398388 - RNA, 19 nt, Pseudomonas aeruginosa PA01
uggaugaaacgggcgaucu

SEQ ID NO: 1398389 - RNA, 15 nt, Pseudomonas aeruginosa PA01
uggcagacgcugcuc

SEQ ID NO: 1398390 - RNA, 23 nt, Pseudomonas aeruginosa PA01
uggcagagcuggaagucguccag

SEQ ID NO: 1398391 - RNA, 19 nt, Pseudomonas aeruginosa PA01
uggcaggcgcugcagccac

SEQ ID NO: 1398392 - RNA, 18 nt, Pseudomonas aeruginosa PA01
uggcaggccuggaauacc

SEQ ID NO: 1398393 - RNA, 19 nt, Pseudomonas aeruginosa PA01
uggcagccuuggccacggc

SEQ ID NO: 1398394 - RNA, 12 nt, Pseudomonas aeruginosa PA01
uggcagcgccgu

SEQ ID NO: 1398395 - RNA, 16 nt, Pseudomonas aeruginosa PA01
uggcaacugccgcccg

SEQ ID NO: 1398396 - RNA, 17 nt, Pseudomonas aeruginosa PA01
uggcaacugccgcccgc

SEQ ID NO: 1398397 - RNA, 20 nt, Pseudomonas aeruginosa PA01
uggcaacugcguccgauguc

SEQ ID NO: 1398398 - RNA, 14 nt, Pseudomonas aeruginosa PA01
uggcaaccgacgag

SEQ ID NO: 1398399 - RNA, 16 nt, Pseudomonas aeruginosa PA01
uggcacgaacccaggc

SEQ ID NO: 1398400 - RNA, 19 nt, Pseudomonas aeruginosa PA01
uggcacgaacccaggcgcu

SEQ ID NO: 1398401 - RNA, 14 nt, Pseudomonas aeruginosa PA01
uggcaccgcuucug

SEQ ID NO: 1398402 - RNA, 21 nt, Pseudomonas aeruginosa PA01
uggcacccuggacccgggccu

SEQ ID NO: 1398403 - RNA, 16 nt, Pseudomonas aeruginosa PA01
uggcagguugcacggc

SEQ ID NO: 1398404 - RNA, 15 nt, Pseudomonas aeruginosa PA01
uggcagugcgccggc

SEQ ID NO: 1398405 - RNA, 23 nt, Pseudomonas aeruginosa PA01
uggcagguaucgcugggcgccuc

SEQ ID NO: 1398406 - RNA, 20 nt, Pseudomonas aeruginosa PA01
uggcaggugacgcagggcgg

SEQ ID NO: 1398407 - RNA, 20 nt, Pseudomonas aeruginosa PA01
uggccaccgaaucggacagg

SEQ ID NO: 1398408 - RNA, 14 nt, Pseudomonas aeruginosa PA01
uggccaccgccagg

SEQ ID NO: 1398409 - RNA, 15 nt, Pseudomonas aeruginosa PA01
uggccaccgccagga

SEQ ID NO: 1398410 - RNA, 21 nt, Pseudomonas aeruginosa PA01
uggccaccgccaggaccucga

SEQ ID NO: 1398411 - RNA, 14 nt, Pseudomonas aeruginosa PA01
uggccaccgcggcg

SEQ ID NO: 1398412 - RNA, 22 nt, Pseudomonas aeruginosa PA01
uggccaccgucggauggccguc

SEQ ID NO: 1398413 - RNA, 22 nt, Pseudomonas aeruginosa PA01
uggccacccuuggagccgcccu

SEQ ID NO: 1398414 - RNA, 14 nt, Pseudomonas aeruginosa PA01
uggccaccagcacc

SEQ ID NO: 1398415 - RNA, 18 nt, Pseudomonas aeruginosa PA01
uggcaugguguccggcgg

SEQ ID NO: 1398416 - RNA, 23 nt, Pseudomonas aeruginosa PA01
uggcaugguguccggcggcgaug

SEQ ID NO: 1398417 - RNA, 14 nt, Pseudomonas aeruginosa PA01
uggcauucgucgcc

SEQ ID NO: 1398418 - RNA, 16 nt, Pseudomonas aeruginosa PA01
uggcauucgucgccgc

SEQ ID NO: 1398419 - RNA, 17 nt, Pseudomonas aeruginosa PA01
uggcauucgucgccgcu

SEQ ID NO: 1398420 - RNA, 18 nt, Pseudomonas aeruginosa PA01
uggccagcgcggugcgcg

SEQ ID NO: 1398421 - RNA, 19 nt, Pseudomonas aeruginosa PA01
uggccagcgcggugcgcgc

SEQ ID NO: 1398422 - RNA, 18 nt, Pseudomonas aeruginosa PA01
uggccagcgcuuccaccg

SEQ ID NO: 1398423 - RNA, 19 nt, Pseudomonas aeruginosa PA01
uggccagcgcuuccaccgc

SEQ ID NO: 1398424 - RNA, 16 nt, Pseudomonas aeruginosa PA01
uggccagcgcggcgcg

SEQ ID NO: 1398425 - RNA, 17 nt, Pseudomonas aeruginosa PA01
uggccagcgucgccugc

SEQ ID NO: 1398426 - RNA, 15 nt, Pseudomonas aeruginosa PA01
uggccagcucgaccu

SEQ ID NO: 1398427 - RNA, 18 nt, Pseudomonas aeruginosa PA01
uggccaggcgcaccagca

SEQ ID NO: 1398428 - RNA, 16 nt, Pseudomonas aeruginosa PA01
uggccaggcgcgacag

SEQ ID NO: 1398429 - RNA, 13 nt, Pseudomonas aeruginosa PA01
uggccaggcgcuc

SEQ ID NO: 1398430 - RNA, 13 nt, Pseudomonas aeruginosa PA01
uggccaggcgcuu

SEQ ID NO: 1398431 - RNA, 15 nt, Pseudomonas aeruginosa PA01
uggccaggaagcggg

SEQ ID NO: 1398432 - RNA, 19 nt, Pseudomonas aeruginosa PA01
uggccaggaccaucggcac

SEQ ID NO: 1398433 - RNA, 17 nt, Pseudomonas aeruginosa PA01
uggccaggacgcuggcg

SEQ ID NO: 1398434 - RNA, 16 nt, Pseudomonas aeruginosa PA01
uggccagggggccugg

SEQ ID NO: 1398435 - RNA, 19 nt, Pseudomonas aeruginosa PA01
uggccaggucgcgcagggc

SEQ ID NO: 1398436 - RNA, 16 nt, Pseudomonas aeruginosa PA01
uggccaucagcgccgc

SEQ ID NO: 1398437 - RNA, 20 nt, Pseudomonas aeruginosa PA01
uggccaucagcgccgccucg

SEQ ID NO: 1398438 - RNA, 22 nt, Pseudomonas aeruginosa PA01
uggccaguuccaugucgcuggc

SEQ ID NO: 1398439 - RNA, 15 nt, Pseudomonas aeruginosa PA01
uggccaguugcaccg

SEQ ID NO: 1398440 - RNA, 17 nt, Pseudomonas aeruginosa PA01
uggccaguugcaccgca

SEQ ID NO: 1398441 - RNA, 21 nt, Pseudomonas aeruginosa PA01
uggccagcagcaucggaccgg

SEQ ID NO: 1398442 - RNA, 15 nt, Pseudomonas aeruginosa PA01
uggccagcagccagg

SEQ ID NO: 1398443 - RNA, 16 nt, Pseudomonas aeruginosa PA01
uggccagcagccaggc

SEQ ID NO: 1398444 - RNA, 13 nt, Pseudomonas aeruginosa PA01
uggccacgccuuc

SEQ ID NO: 1398445 - RNA, 22 nt, Pseudomonas aeruginosa PA01
uggccacgccuucgggcgaugc

SEQ ID NO: 1398446 - RNA, 13 nt, Pseudomonas aeruginosa PA01
uggccacgcugcg

SEQ ID NO: 1398447 - RNA, 22 nt, Pseudomonas aeruginosa PA01
uggccagaauuccagcaggucg

SEQ ID NO: 1398448 - RNA, 18 nt, Pseudomonas aeruginosa PA01
uggccacguagggcgugg

SEQ ID NO: 1398449 - RNA, 15 nt, Pseudomonas aeruginosa PA01
uggccacguccagcg

SEQ ID NO: 1398450 - RNA, 18 nt, Pseudomonas aeruginosa PA01
uggccacguccagcggca

SEQ ID NO: 1398451 - RNA, 17 nt, Pseudomonas aeruginosa PA01
uggccacgucgccccag

SEQ ID NO: 1398452 - RNA, 18 nt, Pseudomonas aeruginosa PA01
uggccacgucgccccagg

SEQ ID NO: 1398453 - RNA, 14 nt, Pseudomonas aeruginosa PA01
uggccacuccgggc

SEQ ID NO: 1398454 - RNA, 16 nt, Pseudomonas aeruginosa PA01
uggccagcaggcgccg

SEQ ID NO: 1398455 - RNA, 20 nt, Pseudomonas aeruginosa PA01
uggccagcaggcgccgcgca

SEQ ID NO: 1398456 - RNA, 15 nt, Pseudomonas aeruginosa PA01
uggccagcaccaugc

SEQ ID NO: 1398457 - RNA, 15 nt, Pseudomonas aeruginosa PA01
uggccagcaggccga

SEQ ID NO: 1398458 - RNA, 13 nt, Pseudomonas aeruginosa PA01
uggccagcgccac

SEQ ID NO: 1398459 - RNA, 19 nt, Pseudomonas aeruginosa PA01
uggccagcgcccaggccgg

SEQ ID NO: 1398460 - RNA, 19 nt, Pseudomonas aeruginosa PA01
uggccagccgcgcggcaua

SEQ ID NO: 1398461 - RNA, 18 nt, Pseudomonas aeruginosa PA01
uggcccagaugaucaggc

SEQ ID NO: 1398462 - RNA, 20 nt, Pseudomonas aeruginosa PA01
uggcccagaccuuggagcca

SEQ ID NO: 1398463 - RNA, 23 nt, Pseudomonas aeruginosa PA01
uggcccagauauccagggccagg

SEQ ID NO: 1398464 - RNA, 14 nt, Pseudomonas aeruginosa PA01
uggccccgccgagg

SEQ ID NO: 1398465 - RNA, 16 nt, Pseudomonas aeruginosa PA01
uggccccagcgcgagc

SEQ ID NO: 1398466 - RNA, 17 nt, Pseudomonas aeruginosa PA01
uggcccaguugcccggc

SEQ ID NO: 1398467 - RNA, 20 nt, Pseudomonas aeruginosa PA01
uggcccaauccgcgccggug

SEQ ID NO: 1398468 - RNA, 18 nt, Pseudomonas aeruginosa PA01
uggccauucgcuucggcc

SEQ ID NO: 1398469 - RNA, 23 nt, Pseudomonas aeruginosa PA01
uggccauguacguaucccagcgc

SEQ ID NO: 1398470 - RNA, 12 nt, Pseudomonas aeruginosa PA01
uggccauggcgc

SEQ ID NO: 1398471 - RNA, 16 nt, Pseudomonas aeruginosa PA01
uggccauggcgcuugc

SEQ ID NO: 1398472 - RNA, 19 nt, Pseudomonas aeruginosa PA01
uggccaugggcacgccggu

SEQ ID NO: 1398473 - RNA, 21 nt, Pseudomonas aeruginosa PA01
uggccaucuucucgaagcgcg

SEQ ID NO: 1398474 - RNA, 23 nt, Pseudomonas aeruginosa PA01
uggccaugaugugcgcaggcugg

SEQ ID NO: 1398475 - RNA, 14 nt, Pseudomonas aeruginosa PA01
uggccccggcgauc

SEQ ID NO: 1398476 - RNA, 15 nt, Pseudomonas aeruginosa PA01
uggccccggcgaucc

SEQ ID NO: 1398477 - RNA, 19 nt, Pseudomonas aeruginosa PA01
uggccccggcgauccgcgc

SEQ ID NO: 1398478 - RNA, 20 nt, Pseudomonas aeruginosa PA01
uggcccggcguuucgccggg

SEQ ID NO: 1398479 - RNA, 22 nt, Pseudomonas aeruginosa PA01
uggcccucucucgccucggcgg

SEQ ID NO: 1398480 - RNA, 15 nt, Pseudomonas aeruginosa PA01
uggcccuccauccag

SEQ ID NO: 1398481 - RNA, 21 nt, Pseudomonas aeruginosa PA01
uggcccgguggaauaccgcug

SEQ ID NO: 1398482 - RNA, 22 nt, Pseudomonas aeruginosa PA01
ugucgcuggccugcagguccgg

SEQ ID NO: 1398483 - RNA, 16 nt, Pseudomonas aeruginosa PA01
ugugacggccggggcg

SEQ ID NO: 1398484 - RNA, 16 nt, Pseudomonas aeruginosa PA01
ugugaggugggcgcgc

SEQ ID NO: 1398485 - RNA, 19 nt, Pseudomonas aeruginosa PA01
ugugaggugggcgcgccgc

SEQ ID NO: 1398486 - RNA, 23 nt, Pseudomonas aeruginosa PA01
ugugaucaggcuguccacgccga

SEQ ID NO: 1398487 - RNA, 23 nt, Pseudomonas aeruginosa PA01
ugucgcggcugaaggccgaacgg

SEQ ID NO: 1398488 - RNA, 14 nt, Pseudomonas aeruginosa PA01
ugucgcggacccgc

SEQ ID NO: 1398489 - RNA, 19 nt, Pseudomonas aeruginosa PA01
ugucgcggacccgcgccgg

SEQ ID NO: 1398490 - RNA, 21 nt, Pseudomonas aeruginosa PA01
ugucgcggacccgcgccggca

SEQ ID NO: 1398491 - RNA, 23 nt, Pseudomonas aeruginosa PA01
ugucgcucagcgggccgauccgc

SEQ ID NO: 1398492 - RNA, 13 nt, Pseudomonas aeruginosa PA01
ugucgcucccuac

SEQ ID NO: 1398493 - RNA, 18 nt, Pseudomonas aeruginosa PA01
ugucgcgguugccgaagc

SEQ ID NO: 1398494 - RNA, 14 nt, Pseudomonas aeruginosa PA01
ugucgcguccggcc

SEQ ID NO: 1398495 - RNA, 17 nt, Pseudomonas aeruginosa PA01
ugucgcguccggccagc

SEQ ID NO: 1398496 - RNA, 16 nt, Pseudomonas aeruginosa PA01
ugucgcgauccaccgc

SEQ ID NO: 1398497 - RNA, 21 nt, Pseudomonas aeruginosa PA01
ugucgaucaggaacgcgccac

SEQ ID NO: 1398498 - RNA, 21 nt, Pseudomonas aeruginosa PA01
uguccggcaccaccagcgcgc

SEQ ID NO: 1398499 - RNA, 20 nt, Pseudomonas aeruginosa PA01
ugucgauaccagcgccgcuc

SEQ ID NO: 1398500 - RNA, 12 nt, Pseudomonas aeruginosa PA01
ugucgagguagg

SEQ ID NO: 1398501 - RNA, 17 nt, Pseudomonas aeruginosa PA01
ugucgaggaaggccagc

SEQ ID NO: 1398502 - RNA, 18 nt, Pseudomonas aeruginosa PA01
ugucgaggaaggccagca

SEQ ID NO: 1398503 - RNA, 18 nt, Pseudomonas aeruginosa PA01
ugucgagguugcgcucca

SEQ ID NO: 1398504 - RNA, 15 nt, Pseudomonas aeruginosa PA01
uguggucguggcgga

SEQ ID NO: 1398505 - RNA, 15 nt, Pseudomonas aeruginosa PA01
ugugguugggcaggc

SEQ ID NO: 1398506 - RNA, 15 nt, Pseudomonas aeruginosa PA01
uguggcguuauucgc

SEQ ID NO: 1398507 - RNA, 21 nt, Pseudomonas aeruginosa PA01
uguggcuggugaugccgcgga

SEQ ID NO: 1398508 - RNA, 22 nt, Pseudomonas aeruginosa PA01
ugugcagggucagucgagcagu

SEQ ID NO: 1398509 - RNA, 22 nt, Pseudomonas aeruginosa PA01
ugugcagguacggcgccgcugc

SEQ ID NO: 1398510 - RNA, 19 nt, Pseudomonas aeruginosa PA01
ugugcagggcagcggcccu

SEQ ID NO: 1398511 - RNA, 17 nt, Pseudomonas aeruginosa PA01
ugugcagggccgcggcg

SEQ ID NO: 1398512 - RNA, 14 nt, Pseudomonas aeruginosa PA01
ugugcaggaaggcg

SEQ ID NO: 1398513 - RNA, 23 nt, Pseudomonas aeruginosa PA01
ugugcacccagaccuuccagccg

SEQ ID NO: 1398514 - RNA, 14 nt, Pseudomonas aeruginosa PA01
ugugcacgaacagg

SEQ ID NO: 1398515 - RNA, 22 nt, Pseudomonas aeruginosa PA01
ugugcacgaacaggugcuggug

SEQ ID NO: 1398516 - RNA, 20 nt, Pseudomonas aeruginosa PA01
uguuccggguugguggccgc

SEQ ID NO: 1398517 - RNA, 16 nt, Pseudomonas aeruginosa PA01
uguuccucggcggcgg

SEQ ID NO: 1398518 - RNA, 21 nt, Pseudomonas aeruginosa PA01
uguuccacgucgagcgggcgg

SEQ ID NO: 1398519 - RNA, 16 nt, Pseudomonas aeruginosa PA01
uguuccaggcccgccg

SEQ ID NO: 1398520 - RNA, 14 nt, Pseudomonas aeruginosa PA01
uguucagcggcgcg

SEQ ID NO: 1398521 - RNA, 15 nt, Pseudomonas aeruginosa PA01
uguucagcggcgcgu

SEQ ID NO: 1398522 - RNA, 19 nt, Pseudomonas aeruginosa PA01
uguucaggguggcgaccgc

SEQ ID NO: 1398523 - RNA, 20 nt, Pseudomonas aeruginosa PA01
uguucagcgggugccgaaga

SEQ ID NO: 1398524 - RNA, 15 nt, Pseudomonas aeruginosa PA01
uguucaguucggcgg

SEQ ID NO: 1398525 - RNA, 13 nt, Pseudomonas aeruginosa PA01
uguuauggccgac

SEQ ID NO: 1398526 - RNA, 22 nt, Pseudomonas aeruginosa PA01
uguuacugagcgugacccgcgc

SEQ ID NO: 1398527 - RNA, 16 nt, Pseudomonas aeruginosa PA01
uguugaacagcgccgg

SEQ ID NO: 1398528 - RNA, 20 nt, Pseudomonas aeruginosa PA01
uguugaacgucucggcgaac

SEQ ID NO: 1398529 - RNA, 17 nt, Pseudomonas aeruginosa PA01
uguucgucuggcgccug

SEQ ID NO: 1398530 - RNA, 14 nt, Pseudomonas aeruginosa PA01
uguucgcggcgaug

SEQ ID NO: 1398531 - RNA, 15 nt, Pseudomonas aeruginosa PA01
uguucgcggcgaugc

SEQ ID NO: 1398532 - RNA, 15 nt, Pseudomonas aeruginosa PA01
uguucgggucgcggc

SEQ ID NO: 1398533 - RNA, 14 nt, Pseudomonas aeruginosa PA01
uguucggccagccg

SEQ ID NO: 1398534 - RNA, 21 nt, Pseudomonas aeruginosa PA01
uguucggccagccggcgccgc

SEQ ID NO: 1398535 - RNA, 13 nt, Pseudomonas aeruginosa PA01
uguucggcgcuga

SEQ ID NO: 1398536 - RNA, 12 nt, Pseudomonas aeruginosa PA01
uguucggcggcg

SEQ ID NO: 1398537 - RNA, 19 nt, Pseudomonas aeruginosa PA01
uguucgggguggcgaaggc

SEQ ID NO: 1398538 - RNA, 20 nt, Pseudomonas aeruginosa PA01
uguucgccgaggggcgggau

SEQ ID NO: 1398539 - RNA, 15 nt, Pseudomonas aeruginosa PA01
uguucgccgccacca

SEQ ID NO: 1398540 - RNA, 13 nt, Pseudomonas aeruginosa PA01
uguucgaggcgcc

SEQ ID NO: 1398541 - RNA, 18 nt, Pseudomonas aeruginosa PA01
uguucgaggcgccgacca

SEQ ID NO: 1398542 - RNA, 21 nt, Pseudomonas aeruginosa PA01
uguucgaggcgccgaccacga

SEQ ID NO: 1398543 - RNA, 22 nt, Pseudomonas aeruginosa PA01
uguucgcaaagcucgcgcaagc

SEQ ID NO: 1398544 - RNA, 23 nt, Pseudomonas aeruginosa PA01
uguucgcagucgcuuccgcgcgg

SEQ ID NO: 1398545 - RNA, 19 nt, Pseudomonas aeruginosa PA01
uguucgaaguucuccagca

SEQ ID NO: 1398546 - RNA, 21 nt, Pseudomonas aeruginosa PA01
uguugcccugggccggcgcca

SEQ ID NO: 1398547 - RNA, 23 nt, Pseudomonas aeruginosa PA01
uguugccguucugugcggcgaug

SEQ ID NO: 1398548 - RNA, 23 nt, Pseudomonas aeruginosa PA01
uguugccguugaugucgaccacg

SEQ ID NO: 1398549 - RNA, 22 nt, Pseudomonas aeruginosa PA01
uguugcgauggaaguugcgcac

SEQ ID NO: 1398550 - RNA, 16 nt, Pseudomonas aeruginosa PA01
uguugcagggucgccg

SEQ ID NO: 1398551 - RNA, 14 nt, Pseudomonas aeruginosa PA01
uguugcccaccagc

SEQ ID NO: 1398552 - RNA, 14 nt, Pseudomonas aeruginosa PA01
uguugacgauggcg

SEQ ID NO: 1398553 - RNA, 18 nt, Pseudomonas aeruginosa PA01
uguugaucgccgcgccgc

SEQ ID NO: 1398554 - RNA, 19 nt, Pseudomonas aeruginosa PA01
uguugaucgccgcgccgcc

SEQ ID NO: 1398555 - RNA, 21 nt, Pseudomonas aeruginosa PA01
uguccacgccauaggcggcgc

SEQ ID NO: 1398556 - RNA, 15 nt, Pseudomonas aeruginosa PA01
uguccacgccgaagu

SEQ ID NO: 1398557 - RNA, 21 nt, Pseudomonas aeruginosa PA01
uguccacgucguaggccgagc

SEQ ID NO: 1398558 - RNA, 17 nt, Pseudomonas aeruginosa PA01
uguccaccacgcggaua

SEQ ID NO: 1398559 - RNA, 15 nt, Pseudomonas aeruginosa PA01
uguccaccgccgcca

SEQ ID NO: 1398560 - RNA, 18 nt, Pseudomonas aeruginosa PA01
uguccaccgccgccagca

SEQ ID NO: 1398561 - RNA, 15 nt, Pseudomonas aeruginosa PA01
uguccaccgguggcg

SEQ ID NO: 1398562 - RNA, 19 nt, Pseudomonas aeruginosa PA01
uguccaccgguggcgacgc

SEQ ID NO: 1398563 - RNA, 21 nt, Pseudomonas aeruginosa PA01
uguccgccgccgcggcgcgga

SEQ ID NO: 1398564 - RNA, 16 nt, Pseudomonas aeruginosa PA01
uguccgccggccucga

SEQ ID NO: 1398565 - RNA, 14 nt, Pseudomonas aeruginosa PA01
uguccggcccggag

SEQ ID NO: 1398566 - RNA, 18 nt, Pseudomonas aeruginosa PA01
uguccggcccggagcgcg

SEQ ID NO: 1398567 - RNA, 18 nt, Pseudomonas aeruginosa PA01
uguccgcgccgcgucgcc

SEQ ID NO: 1398568 - RNA, 22 nt, Pseudomonas aeruginosa PA01
uguccgcgccgcgucgccgcca

SEQ ID NO: 1398569 - RNA, 23 nt, Pseudomonas aeruginosa PA01
uguccgcgccgcgucgccgccag

SEQ ID NO: 1398570 - RNA, 17 nt, Pseudomonas aeruginosa PA01
uguccgcggugccgcca

SEQ ID NO: 1398571 - RNA, 14 nt, Pseudomonas aeruginosa PA01
uguccgagaccggc

SEQ ID NO: 1398572 - RNA, 23 nt, Pseudomonas aeruginosa PA01
uguccgcccuuuuucgucgccag

SEQ ID NO: 1398573 - RNA, 20 nt, Pseudomonas aeruginosa PA01
ugucgagcagggucgcgagc

SEQ ID NO: 1398574 - RNA, 21 nt, Pseudomonas aeruginosa PA01
ugucgagcagggucgcgagca

SEQ ID NO: 1398575 - RNA, 18 nt, Pseudomonas aeruginosa PA01
ugucgagcacggcgcugg

SEQ ID NO: 1398576 - RNA, 17 nt, Pseudomonas aeruginosa PA01
ugucgacguugucgcaa

SEQ ID NO: 1398577 - RNA, 13 nt, Pseudomonas aeruginosa PA01
uguccggcgcuga

SEQ ID NO: 1398578 - RNA, 12 nt, Pseudomonas aeruginosa PA01
ugucgaccagcg

SEQ ID NO: 1398579 - RNA, 14 nt, Pseudomonas aeruginosa PA01
uguccggcggcugc

SEQ ID NO: 1398580 - RNA, 22 nt, Pseudomonas aeruginosa PA01
uguccgggaaguccgggcgcgg

SEQ ID NO: 1398581 - RNA, 22 nt, Pseudomonas aeruginosa PA01
ugucgacgacgaaaggccgcgc

SEQ ID NO: 1398582 - RNA, 12 nt, Pseudomonas aeruginosa PA01
ugucaccggcag

SEQ ID NO: 1398583 - RNA, 18 nt, Pseudomonas aeruginosa PA01
uguagcugcagcgcccca

SEQ ID NO: 1398584 - RNA, 18 nt, Pseudomonas aeruginosa PA01
uguaggccaugaucaucg

SEQ ID NO: 1398585 - RNA, 12 nt, Pseudomonas aeruginosa PA01
uguagaccacca

SEQ ID NO: 1398586 - RNA, 13 nt, Pseudomonas aeruginosa PA01
uguagaccaccag

SEQ ID NO: 1398587 - RNA, 15 nt, Pseudomonas aeruginosa PA01
uguagaccaccagca

SEQ ID NO: 1398588 - RNA, 16 nt, Pseudomonas aeruginosa PA01
uguagcggcucgccga

SEQ ID NO: 1398589 - RNA, 13 nt, Pseudomonas aeruginosa PA01
uguagcgcgccga

SEQ ID NO: 1398590 - RNA, 22 nt, Pseudomonas aeruginosa PA01
uguagaugaucuccaggucgcc

SEQ ID NO: 1398591 - RNA, 21 nt, Pseudomonas aeruginosa PA01
uguagccucccgccgcggcgu

SEQ ID NO: 1398592 - RNA, 20 nt, Pseudomonas aeruginosa PA01
uguagccggcgaugugcggc

SEQ ID NO: 1398593 - RNA, 22 nt, Pseudomonas aeruginosa PA01
uguagccggcgaugugcggcgu

SEQ ID NO: 1398594 - RNA, 17 nt, Pseudomonas aeruginosa PA01
uguacucgccggugcgg

SEQ ID NO: 1398595 - RNA, 11 nt, Pseudomonas aeruginosa PA01
uguacagcagg

SEQ ID NO: 1398596 - RNA, 16 nt, Pseudomonas aeruginosa PA01
uguacagcaggagcgc

SEQ ID NO: 1398597 - RNA, 19 nt, Pseudomonas aeruginosa PA01
uguacagcuucaggcgcac

SEQ ID NO: 1398598 - RNA, 23 nt, Pseudomonas aeruginosa PA01
uguacauagcgggucaugagguu

SEQ ID NO: 1398599 - RNA, 16 nt, Pseudomonas aeruginosa PA01
uguaccucuggcugaa

SEQ ID NO: 1398600 - RNA, 23 nt, Pseudomonas aeruginosa PA01
ugguguagccgagcacgcacugg

SEQ ID NO: 1398601 - RNA, 18 nt, Pseudomonas aeruginosa PA01
ugguguagcgauccugac

SEQ ID NO: 1398602 - RNA, 23 nt, Pseudomonas aeruginosa PA01
ugguguagcgcagguugcgcugg

SEQ ID NO: 1398603 - RNA, 18 nt, Pseudomonas aeruginosa PA01
ugguucugguccaccagc

SEQ ID NO: 1398604 - RNA, 17 nt, Pseudomonas aeruginosa PA01
ugguugaccugcagcgc

SEQ ID NO: 1398605 - RNA, 17 nt, Pseudomonas aeruginosa PA01
ugguugggcaggcgcau

SEQ ID NO: 1398606 - RNA, 18 nt, Pseudomonas aeruginosa PA01
ugguuggaaaagccccgc

SEQ ID NO: 1398607 - RNA, 21 nt, Pseudomonas aeruginosa PA01
ugguugccugcuguguccggc

SEQ ID NO: 1398608 - RNA, 15 nt, Pseudomonas aeruginosa PA01
ugguuuagcucggcg

SEQ ID NO: 1398609 - RNA, 16 nt, Pseudomonas aeruginosa PA01
uggguugccgcgccga

SEQ ID NO: 1398610 - RNA, 17 nt, Pseudomonas aeruginosa PA01
uggguugccgcgccgau

SEQ ID NO: 1398611 - RNA, 13 nt, Pseudomonas aeruginosa PA01
uggguuggcgcga

SEQ ID NO: 1398612 - RNA, 20 nt, Pseudomonas aeruginosa PA01
ugguaccgcugcgugccagg

SEQ ID NO: 1398613 - RNA, 16 nt, Pseudomonas aeruginosa PA01
uggugcgguggcuggc

SEQ ID NO: 1398614 - RNA, 12 nt, Pseudomonas aeruginosa PA01
ugguacagcacc

SEQ ID NO: 1398615 - RNA, 20 nt, Pseudomonas aeruginosa PA01
ugguggaacagccgcagcgg

SEQ ID NO: 1398616 - RNA, 19 nt, Pseudomonas aeruginosa PA01
uggugcugcaugugggcga

SEQ ID NO: 1398617 - RNA, 13 nt, Pseudomonas aeruginosa PA01
uggugcugcgcgc

SEQ ID NO: 1398618 - RNA, 19 nt, Pseudomonas aeruginosa PA01
uggugcugcgcgcggccca

SEQ ID NO: 1398619 - RNA, 15 nt, Pseudomonas aeruginosa PA01
ugguggccgcgccgc

SEQ ID NO: 1398620 - RNA, 13 nt, Pseudomonas aeruginosa PA01
ugguggccguggc

SEQ ID NO: 1398621 - RNA, 14 nt, Pseudomonas aeruginosa PA01
ugguggccguggcg

SEQ ID NO: 1398622 - RNA, 23 nt, Pseudomonas aeruginosa PA01
ugguggccguugagcaccucgac

SEQ ID NO: 1398623 - RNA, 22 nt, Pseudomonas aeruginosa PA01
ugguggacggucucgccgccga

SEQ ID NO: 1398624 - RNA, 14 nt, Pseudomonas aeruginosa PA01
ugguggcgccggcu

SEQ ID NO: 1398625 - RNA, 16 nt, Pseudomonas aeruginosa PA01
ugguggcgaacagcac

SEQ ID NO: 1398626 - RNA, 21 nt, Pseudomonas aeruginosa PA01
ugguggcccugggcggcgacc

SEQ ID NO: 1398627 - RNA, 17 nt, Pseudomonas aeruginosa PA01
uggugguaugggugccc

SEQ ID NO: 1398628 - RNA, 17 nt, Pseudomonas aeruginosa PA01
ugguggucaccgccagc

SEQ ID NO: 1398629 - RNA, 13 nt, Pseudomonas aeruginosa PA01
uggugggcggcgg

SEQ ID NO: 1398630 - RNA, 12 nt, Pseudomonas aeruginosa PA01
ugguggggcgcc

SEQ ID NO: 1398631 - RNA, 16 nt, Pseudomonas aeruginosa PA01
ugguggggcgccggcu

SEQ ID NO: 1398632 - RNA, 13 nt, Pseudomonas aeruginosa PA01
uguuugcgcaggg

SEQ ID NO: 1398633 - RNA, 21 nt, Pseudomonas aeruginosa PA01
uguuucgaugagcuucgccgg

SEQ ID NO: 1398634 - RNA, 17 nt, Pseudomonas aeruginosa PA01
uguugcgggcgagcagg

SEQ ID NO: 1398635 - RNA, 12 nt, Pseudomonas aeruginosa PA01
uguugcgcaggc

SEQ ID NO: 1398636 - RNA, 17 nt, Pseudomonas aeruginosa PA01
uguugcgcagggugccc

SEQ ID NO: 1398637 - RNA, 19 nt, Pseudomonas aeruginosa PA01
uguugcgccgcaccacgua

SEQ ID NO: 1398638 - RNA, 18 nt, Pseudomonas aeruginosa PA01
uguugcggcgggucacgc

SEQ ID NO: 1398639 - RNA, 16 nt, Pseudomonas aeruginosa PA01
uucccgcccgcucaug

SEQ ID NO: 1398640 - RNA, 17 nt, Pseudomonas aeruginosa PA01
uucccgcuucggcccgc

SEQ ID NO: 1398641 - RNA, 12 nt, Pseudomonas aeruginosa PA01
uucccggcgcgg

SEQ ID NO: 1398642 - RNA, 16 nt, Pseudomonas aeruginosa PA01
uucccgcaccggcgcg

SEQ ID NO: 1398643 - RNA, 21 nt, Pseudomonas aeruginosa PA01
uucccgcaccggcgcgccgga

SEQ ID NO: 1398644 - RNA, 15 nt, Pseudomonas aeruginosa PA01
uuccaggagggcugc

SEQ ID NO: 1398645 - RNA, 22 nt, Pseudomonas aeruginosa PA01
uuccaggcgaaagucggcgcga

SEQ ID NO: 1398646 - RNA, 12 nt, Pseudomonas aeruginosa PA01
uuccaggcgcgc

SEQ ID NO: 1398647 - RNA, 19 nt, Pseudomonas aeruginosa PA01
uuccaggcguccgcuggcc

SEQ ID NO: 1398648 - RNA, 12 nt, Pseudomonas aeruginosa PA01
uuccccguggcg

SEQ ID NO: 1398649 - RNA, 21 nt, Pseudomonas aeruginosa PA01
uuccagcccuucgacgucgau

SEQ ID NO: 1398650 - RNA, 20 nt, Pseudomonas aeruginosa PA01
uuccggcucagccgcuggcg

SEQ ID NO: 1398651 - RNA, 19 nt, Pseudomonas aeruginosa PA01
uuccggcuggacgugcagg

SEQ ID NO: 1398652 - RNA, 12 nt, Pseudomonas aeruginosa PA01
uuccggcgcgga

SEQ ID NO: 1398653 - RNA, 16 nt, Pseudomonas aeruginosa PA01
uuccggcgcggccugc

SEQ ID NO: 1398654 - RNA, 14 nt, Pseudomonas aeruginosa PA01
uuccggccaggcgc

SEQ ID NO: 1398655 - RNA, 16 nt, Pseudomonas aeruginosa PA01
uuccggccaggcgcgg

SEQ ID NO: 1398656 - RNA, 13 nt, Pseudomonas aeruginosa PA01
uuccggcccacgc

SEQ ID NO: 1398657 - RNA, 17 nt, Pseudomonas aeruginosa PA01
uucccggcucggcacgc

SEQ ID NO: 1398658 - RNA, 19 nt, Pseudomonas aeruginosa PA01
uucccggucgacggcgugc

SEQ ID NO: 1398659 - RNA, 21 nt, Pseudomonas aeruginosa PA01
uuccgcgcccggcuggccauc

SEQ ID NO: 1398660 - RNA, 23 nt, Pseudomonas aeruginosa PA01
uuccgcgcccggcuggccaucca

SEQ ID NO: 1398661 - RNA, 15 nt, Pseudomonas aeruginosa PA01
uuccgcggcgacggc

SEQ ID NO: 1398662 - RNA, 22 nt, Pseudomonas aeruginosa PA01
uuccgcggcguaaucgcgccag

SEQ ID NO: 1398663 - RNA, 16 nt, Pseudomonas aeruginosa PA01
uuccgccggcgccgcc

SEQ ID NO: 1398664 - RNA, 19 nt, Pseudomonas aeruginosa PA01
uuccgcucaccaggcccgc

SEQ ID NO: 1398665 - RNA, 17 nt, Pseudomonas aeruginosa PA01
uuccggacugcccagcg

SEQ ID NO: 1398666 - RNA, 21 nt, Pseudomonas aeruginosa PA01
uuccggacugcccagcgccgc

SEQ ID NO: 1398667 - RNA, 20 nt, Pseudomonas aeruginosa PA01
uuccagaaacggcugccggu

SEQ ID NO: 1398668 - RNA, 22 nt, Pseudomonas aeruginosa PA01
uuccagaacgccgcgcaccucg

SEQ ID NO: 1398669 - RNA, 23 nt, Pseudomonas aeruginosa PA01
uuccagaacgccgcgcaccucga

SEQ ID NO: 1398670 - RNA, 12 nt, Pseudomonas aeruginosa PA01
uuccagcaggca

SEQ ID NO: 1398671 - RNA, 19 nt, Pseudomonas aeruginosa PA01
uuccagcaggcaggcgcgg

SEQ ID NO: 1398672 - RNA, 15 nt, Pseudomonas aeruginosa PA01
uuccagcaggcgcuc

SEQ ID NO: 1398673 - RNA, 20 nt, Pseudomonas aeruginosa PA01
uuccagcaccucccccagcg

SEQ ID NO: 1398674 - RNA, 16 nt, Pseudomonas aeruginosa PA01
uuccaccuguuccgcg

SEQ ID NO: 1398675 - RNA, 19 nt, Pseudomonas aeruginosa PA01
uuccacgaaaaagcccggc

SEQ ID NO: 1398676 - RNA, 17 nt, Pseudomonas aeruginosa PA01
uuccaccgccuggacca

SEQ ID NO: 1398677 - RNA, 22 nt, Pseudomonas aeruginosa PA01
uuccaaggugcugccgaucagg

SEQ ID NO: 1398678 - RNA, 20 nt, Pseudomonas aeruginosa PA01
uucaguucugggcggccagg

SEQ ID NO: 1398679 - RNA, 15 nt, Pseudomonas aeruginosa PA01
uucaaccgcuggucg

SEQ ID NO: 1398680 - RNA, 17 nt, Pseudomonas aeruginosa PA01
uucacaaaggcgucgau

SEQ ID NO: 1398681 - RNA, 19 nt, Pseudomonas aeruginosa PA01
uucacgucgagcacgccgu

SEQ ID NO: 1398682 - RNA, 13 nt, Pseudomonas aeruginosa PA01
uucacccgcagcg

SEQ ID NO: 1398683 - RNA, 18 nt, Pseudomonas aeruginosa PA01
uucaccagcgcugccucg

SEQ ID NO: 1398684 - RNA, 14 nt, Pseudomonas aeruginosa PA01
uucagucggccagg

SEQ ID NO: 1398685 - RNA, 20 nt, Pseudomonas aeruginosa PA01
uucagguaaggcaccaccgc

SEQ ID NO: 1398686 - RNA, 21 nt, Pseudomonas aeruginosa PA01
uucagggcguagcggaagccg

SEQ ID NO: 1398687 - RNA, 15 nt, Pseudomonas aeruginosa PA01
uucaggucgugcugg

SEQ ID NO: 1398688 - RNA, 21 nt, Pseudomonas aeruginosa PA01
uucaggcgcacuacgccguuc

SEQ ID NO: 1398689 - RNA, 23 nt, Pseudomonas aeruginosa PA01
uucaggcgcuccuggagguucgg

SEQ ID NO: 1398690 - RNA, 16 nt, Pseudomonas aeruginosa PA01
ucgggaaaggccgcca

SEQ ID NO: 1398691 - RNA, 21 nt, Pseudomonas aeruginosa PA01
ucgggaaaggccgccacggcg

SEQ ID NO: 1398692 - RNA, 13 nt, Pseudomonas aeruginosa PA01
ucggcuugccggc

SEQ ID NO: 1398693 - RNA, 17 nt, Pseudomonas aeruginosa PA01
ucggcuucguccugcug

SEQ ID NO: 1398694 - RNA, 13 nt, Pseudomonas aeruginosa PA01
ucggcugccgcca

SEQ ID NO: 1398695 - RNA, 14 nt, Pseudomonas aeruginosa PA01
ucggcugccgccag

SEQ ID NO: 1398696 - RNA, 17 nt, Pseudomonas aeruginosa PA01
ucggcugcugcugcggc

SEQ ID NO: 1398697 - RNA, 14 nt, Pseudomonas aeruginosa PA01
ucggcugggccagg

SEQ ID NO: 1398698 - RNA, 12 nt, Pseudomonas aeruginosa PA01
ucggcuggccga

SEQ ID NO: 1398699 - RNA, 21 nt, Pseudomonas aeruginosa PA01
ucggcuggccgagggcgcgca

SEQ ID NO: 1398700 - RNA, 14 nt, Pseudomonas aeruginosa PA01
ucggcuccucugcc

SEQ ID NO: 1398701 - RNA, 17 nt, Pseudomonas aeruginosa PA01
ucggcuucaacgcgacg

SEQ ID NO: 1398702 - RNA, 17 nt, Pseudomonas aeruginosa PA01
ucgggaucuuguagaac

SEQ ID NO: 1398703 - RNA, 15 nt, Pseudomonas aeruginosa PA01
ucgggaucguaggcg

SEQ ID NO: 1398704 - RNA, 17 nt, Pseudomonas aeruginosa PA01
ucggcgcucuucagcac

SEQ ID NO: 1398705 - RNA, 12 nt, Pseudomonas aeruginosa PA01
ucggcgcugacc

SEQ ID NO: 1398706 - RNA, 12 nt, Pseudomonas aeruginosa PA01
ucggcgcuccgc

SEQ ID NO: 1398707 - RNA, 20 nt, Pseudomonas aeruginosa PA01
ucggcgcuccgccgaacgcc

SEQ ID NO: 1398708 - RNA, 18 nt, Pseudomonas aeruginosa PA01
ucggcggccagcggaugc

SEQ ID NO: 1398709 - RNA, 12 nt, Pseudomonas aeruginosa PA01
ucggcggccagg

SEQ ID NO: 1398710 - RNA, 14 nt, Pseudomonas aeruginosa PA01
ucggcggccaggcg

SEQ ID NO: 1398711 - RNA, 16 nt, Pseudomonas aeruginosa PA01
ucggcggccaggcgcu

SEQ ID NO: 1398712 - RNA, 15 nt, Pseudomonas aeruginosa PA01
ucggcggccgggucg

SEQ ID NO: 1398713 - RNA, 15 nt, Pseudomonas aeruginosa PA01
ucggcggccucggcc

SEQ ID NO: 1398714 - RNA, 23 nt, Pseudomonas aeruginosa PA01
ucggcggccuuuucggcggccag

SEQ ID NO: 1398715 - RNA, 15 nt, Pseudomonas aeruginosa PA01
ucggcgucggcaugg

SEQ ID NO: 1398716 - RNA, 19 nt, Pseudomonas aeruginosa PA01
ucggcugcaacgccggccc

SEQ ID NO: 1398717 - RNA, 18 nt, Pseudomonas aeruginosa PA01
ucggcucgguuccagcuc

SEQ ID NO: 1398718 - RNA, 17 nt, Pseudomonas aeruginosa PA01
ucggcugaccggcaucg

SEQ ID NO: 1398719 - RNA, 19 nt, Pseudomonas aeruginosa PA01
ucggcugaccggcaucgac

SEQ ID NO: 1398720 - RNA, 22 nt, Pseudomonas aeruginosa PA01
ucggcugaccggcaucgaccag

SEQ ID NO: 1398721 - RNA, 23 nt, Pseudomonas aeruginosa PA01
ucggcugaccggcaucgaccagc

SEQ ID NO: 1398722 - RNA, 16 nt, Pseudomonas aeruginosa PA01
ucggcuccagcaccag

SEQ ID NO: 1398723 - RNA, 14 nt, Pseudomonas aeruginosa PA01
ucggcuccagccag

SEQ ID NO: 1398724 - RNA, 19 nt, Pseudomonas aeruginosa PA01
ucggcuccaggaccggcag

SEQ ID NO: 1398725 - RNA, 14 nt, Pseudomonas aeruginosa PA01
ucggcucggcaagc

SEQ ID NO: 1398726 - RNA, 14 nt, Pseudomonas aeruginosa PA01
ucggcgucgggcag

SEQ ID NO: 1398727 - RNA, 16 nt, Pseudomonas aeruginosa PA01
ucggcgucuuccggcu

SEQ ID NO: 1398728 - RNA, 21 nt, Pseudomonas aeruginosa PA01
ucggcgucuuccggcucgccg

SEQ ID NO: 1398729 - RNA, 21 nt, Pseudomonas aeruginosa PA01
ucggcgucuucggcggcgccg

SEQ ID NO: 1398730 - RNA, 18 nt, Pseudomonas aeruginosa PA01
ucggcgucuugucgaagc

SEQ ID NO: 1398731 - RNA, 20 nt, Pseudomonas aeruginosa PA01
ucggcgugccgggccggcca

SEQ ID NO: 1398732 - RNA, 22 nt, Pseudomonas aeruginosa PA01
ucggcgugccgggccggccagg

SEQ ID NO: 1398733 - RNA, 12 nt, Pseudomonas aeruginosa PA01
ucggcgauggcg

SEQ ID NO: 1398734 - RNA, 13 nt, Pseudomonas aeruginosa PA01
ucggcgauggcgc

SEQ ID NO: 1398735 - RNA, 17 nt, Pseudomonas aeruginosa PA01
ucggcgauucgcggcga

SEQ ID NO: 1398736 - RNA, 23 nt, Pseudomonas aeruginosa PA01
ucggcgauucguucgagcagcuc

SEQ ID NO: 1398737 - RNA, 23 nt, Pseudomonas aeruginosa PA01
ucggcgauggccaucagggucgg

SEQ ID NO: 1398738 - RNA, 14 nt, Pseudomonas aeruginosa PA01
ucggcgcccagcac

SEQ ID NO: 1398739 - RNA, 12 nt, Pseudomonas aeruginosa PA01
ucggcgcccagg

SEQ ID NO: 1398740 - RNA, 19 nt, Pseudomonas aeruginosa PA01
ucggcgccggccuccagcg

SEQ ID NO: 1398741 - RNA, 20 nt, Pseudomonas aeruginosa PA01
ucggcgccggccuccagcgc

SEQ ID NO: 1398742 - RNA, 15 nt, Pseudomonas aeruginosa PA01
ucggcgcaggcaugg

SEQ ID NO: 1398743 - RNA, 18 nt, Pseudomonas aeruginosa PA01
ucggcgccauaggccagc

SEQ ID NO: 1398744 - RNA, 20 nt, Pseudomonas aeruginosa PA01
ucggcgccauaggccagcac

SEQ ID NO: 1398745 - RNA, 12 nt, Pseudomonas aeruginosa PA01
ucggcgcgcagg

SEQ ID NO: 1398746 - RNA, 13 nt, Pseudomonas aeruginosa PA01
ucggcgcgccaga

SEQ ID NO: 1398747 - RNA, 13 nt, Pseudomonas aeruginosa PA01
ucggcgcgcaccu

SEQ ID NO: 1398748 - RNA, 13 nt, Pseudomonas aeruginosa PA01
ucggcgcgacggc

SEQ ID NO: 1398749 - RNA, 21 nt, Pseudomonas aeruginosa PA01
ucggcgcgacggcccacggcg

SEQ ID NO: 1398750 - RNA, 20 nt, Pseudomonas aeruginosa PA01
ucggcgcgauccuccgccag

SEQ ID NO: 1398751 - RNA, 21 nt, Pseudomonas aeruginosa PA01
ucggcgcgauccuccgccagc

SEQ ID NO: 1398752 - RNA, 14 nt, Pseudomonas aeruginosa PA01
ucggcgccgucgau

SEQ ID NO: 1398753 - RNA, 21 nt, Pseudomonas aeruginosa PA01
ucggcgccggugcuggcgagc

SEQ ID NO: 1398754 - RNA, 16 nt, Pseudomonas aeruginosa PA01
ucggcgcgccggugau

SEQ ID NO: 1398755 - RNA, 12 nt, Pseudomonas aeruginosa PA01
ucggcgcgcggc

SEQ ID NO: 1398756 - RNA, 22 nt, Pseudomonas aeruginosa PA01
ucggcgcgcgacacauggucgg

SEQ ID NO: 1398757 - RNA, 16 nt, Pseudomonas aeruginosa PA01
ucggcgcgcgcccccu

SEQ ID NO: 1398758 - RNA, 22 nt, Pseudomonas aeruginosa PA01
ucggcgcgcgcccccuggccgu

SEQ ID NO: 1398759 - RNA, 14 nt, Pseudomonas aeruginosa PA01
ucggcgcgccggcc

SEQ ID NO: 1398760 - RNA, 16 nt, Pseudomonas aeruginosa PA01
ucggcgcgccggcccg

SEQ ID NO: 1398761 - RNA, 17 nt, Pseudomonas aeruginosa PA01
ucggcgcgccgaaggcg

SEQ ID NO: 1398762 - RNA, 13 nt, Pseudomonas aeruginosa PA01
ucggcgcggccgg

SEQ ID NO: 1398763 - RNA, 23 nt, Pseudomonas aeruginosa PA01
ucggcgcgcggggucuggccggc

SEQ ID NO: 1398764 - RNA, 20 nt, Pseudomonas aeruginosa PA01
ucggcgcggguucgugccag

SEQ ID NO: 1398765 - RNA, 20 nt, Pseudomonas aeruginosa PA01
ucggcgcgggcgccgaugcc

SEQ ID NO: 1398766 - RNA, 22 nt, Pseudomonas aeruginosa PA01
ucggccuggcaguugcaguacc

SEQ ID NO: 1398767 - RNA, 14 nt, Pseudomonas aeruginosa PA01
ucggccuggcgcag

SEQ ID NO: 1398768 - RNA, 15 nt, Pseudomonas aeruginosa PA01
ucggccuggcgcagc

SEQ ID NO: 1398769 - RNA, 13 nt, Pseudomonas aeruginosa PA01
ucggccuggcggu

SEQ ID NO: 1398770 - RNA, 22 nt, Pseudomonas aeruginosa PA01
ucggccuggcgguugaugccga

SEQ ID NO: 1398771 - RNA, 19 nt, Pseudomonas aeruginosa PA01
ucggccuggcugccgagca

SEQ ID NO: 1398772 - RNA, 19 nt, Pseudomonas aeruginosa PA01
ucggccugggcgcaggccg

SEQ ID NO: 1398773 - RNA, 18 nt, Pseudomonas aeruginosa PA01
ucggccuggggcucggcu

SEQ ID NO: 1398774 - RNA, 22 nt, Pseudomonas aeruginosa PA01
ucggccuggguacgcaccggcu

SEQ ID NO: 1398775 - RNA, 17 nt, Pseudomonas aeruginosa PA01
ucggccugguccggcac

SEQ ID NO: 1398776 - RNA, 19 nt, Pseudomonas aeruginosa PA01
ucggccuggugcaccuggc

SEQ ID NO: 1398777 - RNA, 15 nt, Pseudomonas aeruginosa PA01
ucggccuggaucgcc

SEQ ID NO: 1398778 - RNA, 19 nt, Pseudomonas aeruginosa PA01
ucggccuggaucgccuugc

SEQ ID NO: 1398779 - RNA, 18 nt, Pseudomonas aeruginosa PA01
ucggccugcugcgccggc

SEQ ID NO: 1398780 - RNA, 19 nt, Pseudomonas aeruginosa PA01
ucggccugcugcucgaccg

SEQ ID NO: 1398781 - RNA, 21 nt, Pseudomonas aeruginosa PA01
ucggccugcugcucgaccgcc

SEQ ID NO: 1398782 - RNA, 23 nt, Pseudomonas aeruginosa PA01
ucggccugcugcucgaccgccug

SEQ ID NO: 1398783 - RNA, 17 nt, Pseudomonas aeruginosa PA01
ucggccgcccagcggau

SEQ ID NO: 1398784 - RNA, 16 nt, Pseudomonas aeruginosa PA01
ucggccgccaggcgcg

SEQ ID NO: 1398785 - RNA, 16 nt, Pseudomonas aeruginosa PA01
ucggccgccaggcugg

SEQ ID NO: 1398786 - RNA, 21 nt, Pseudomonas aeruginosa PA01
ucggccuguuuccagaaggcu

SEQ ID NO: 1398787 - RNA, 17 nt, Pseudomonas aeruginosa PA01
ucggccuugagcgccga

SEQ ID NO: 1398788 - RNA, 21 nt, Pseudomonas aeruginosa PA01
ucggccuugagcgccgaaggc

SEQ ID NO: 1398789 - RNA, 20 nt, Pseudomonas aeruginosa PA01
ucggcgaaauccucgcgcac

SEQ ID NO: 1398790 - RNA, 18 nt, Pseudomonas aeruginosa PA01
ucggcgaaaugcaggccg

SEQ ID NO: 1398791 - RNA, 17 nt, Pseudomonas aeruginosa PA01
ucggcgaacaggguggu

SEQ ID NO: 1398792 - RNA, 20 nt, Pseudomonas aeruginosa PA01
ucggccuuggcgauguucac

SEQ ID NO: 1398793 - RNA, 18 nt, Pseudomonas aeruginosa PA01
ucggcgaacgacagcacc

SEQ ID NO: 1398794 - RNA, 21 nt, Pseudomonas aeruginosa PA01
ucggcgaacgacagcaccaug

SEQ ID NO: 1398795 - RNA, 22 nt, Pseudomonas aeruginosa PA01
ucggcgaacgacagcaccaugc

SEQ ID NO: 1398796 - RNA, 23 nt, Pseudomonas aeruginosa PA01
ucggcgaacgacagcaccaugcc

SEQ ID NO: 1398797 - RNA, 22 nt, Pseudomonas aeruginosa PA01
ucggcgaccuugcgcaccaggg

SEQ ID NO: 1398798 - RNA, 15 nt, Pseudomonas aeruginosa PA01
ucggcgagaggucgg

SEQ ID NO: 1398799 - RNA, 23 nt, Pseudomonas aeruginosa PA01
ucggcgagaggucggcgcgcccg

SEQ ID NO: 1398800 - RNA, 23 nt, Pseudomonas aeruginosa PA01
ucggcgacgcugaugaugccgcg

SEQ ID NO: 1398801 - RNA, 14 nt, Pseudomonas aeruginosa PA01
ucggcgacgaugcc

SEQ ID NO: 1398802 - RNA, 16 nt, Pseudomonas aeruginosa PA01
ucggcgacgaugccgc

SEQ ID NO: 1398803 - RNA, 17 nt, Pseudomonas aeruginosa PA01
ucggcgacgggaagcga

SEQ ID NO: 1398804 - RNA, 19 nt, Pseudomonas aeruginosa PA01
ucggcgacgggaagcgaac

SEQ ID NO: 1398805 - RNA, 23 nt, Pseudomonas aeruginosa PA01
ucggcgacgggaagcgaaccagg

SEQ ID NO: 1398806 - RNA, 14 nt, Pseudomonas aeruginosa PA01
ucggcgaucucgcc

SEQ ID NO: 1398807 - RNA, 17 nt, Pseudomonas aeruginosa PA01
ucggcgaugccgcgcca

SEQ ID NO: 1398808 - RNA, 18 nt, Pseudomonas aeruginosa PA01
ucggcgaugccgcgccag

SEQ ID NO: 1398809 - RNA, 19 nt, Pseudomonas aeruginosa PA01
ucggcgaugccgcgccagg

SEQ ID NO: 1398810 - RNA, 21 nt, Pseudomonas aeruginosa PA01
ucggcgaugccgcgccaggcg

SEQ ID NO: 1398811 - RNA, 12 nt, Pseudomonas aeruginosa PA01
ucggcgaugacc

SEQ ID NO: 1398812 - RNA, 21 nt, Pseudomonas aeruginosa PA01
ucggcgaugaccagcucggcg

SEQ ID NO: 1398813 - RNA, 17 nt, Pseudomonas aeruginosa PA01
ucggcgaucacccggcg

SEQ ID NO: 1398814 - RNA, 15 nt, Pseudomonas aeruginosa PA01
ucggcgaucagcggg

SEQ ID NO: 1398815 - RNA, 16 nt, Pseudomonas aeruginosa PA01
ucggcgaucagcgggc

SEQ ID NO: 1398816 - RNA, 14 nt, Pseudomonas aeruginosa PA01
ucggcgauccgcgc

SEQ ID NO: 1398817 - RNA, 12 nt, Pseudomonas aeruginosa PA01
ucggcgaucgcc

SEQ ID NO: 1398818 - RNA, 19 nt, Pseudomonas aeruginosa PA01
ucggcgaucaggccgaugc

SEQ ID NO: 1398819 - RNA, 17 nt, Pseudomonas aeruginosa PA01
ucggcgaucgccaggug

SEQ ID NO: 1398820 - RNA, 16 nt, Pseudomonas aeruginosa PA01
ucggacggcucgcgca

SEQ ID NO: 1398821 - RNA, 13 nt, Pseudomonas aeruginosa PA01
ucggacgaucgac

SEQ ID NO: 1398822 - RNA, 15 nt, Pseudomonas aeruginosa PA01
ucggacuugaugacc

SEQ ID NO: 1398823 - RNA, 18 nt, Pseudomonas aeruginosa PA01
ucggagaacagcagcggc

SEQ ID NO: 1398824 - RNA, 19 nt, Pseudomonas aeruginosa PA01
ucggacagguuggcgccgg

SEQ ID NO: 1398825 - RNA, 13 nt, Pseudomonas aeruginosa PA01
ucgcuggcgcagc

SEQ ID NO: 1398826 - RNA, 11 nt, Pseudomonas aeruginosa PA01
ucgcuggcgga

SEQ ID NO: 1398827 - RNA, 20 nt, Pseudomonas aeruginosa PA01
ucggacaagggccagagcac

SEQ ID NO: 1398828 - RNA, 13 nt, Pseudomonas aeruginosa PA01
ucgcugccggcgc

SEQ ID NO: 1398829 - RNA, 19 nt, Pseudomonas aeruginosa PA01
ucgcugcgcagugucgcga

SEQ ID NO: 1398830 - RNA, 22 nt, Pseudomonas aeruginosa PA01
ucgcugcgcgccaucuccucgc

SEQ ID NO: 1398831 - RNA, 11 nt, Pseudomonas aeruginosa PA01
ucgcugccgag

SEQ ID NO: 1398832 - RNA, 17 nt, Pseudomonas aeruginosa PA01
ucgcugcccaucgccuc

SEQ ID NO: 1398833 - RNA, 21 nt, Pseudomonas aeruginosa PA01
ucgcugccgccgcgcccggcg

SEQ ID NO: 1398834 - RNA, 14 nt, Pseudomonas aeruginosa PA01
ucgcugccgccgca

SEQ ID NO: 1398835 - RNA, 20 nt, Pseudomonas aeruginosa PA01
ucgcuggccugggguagccg

SEQ ID NO: 1398836 - RNA, 22 nt, Pseudomonas aeruginosa PA01
ucgcuggcgaagaaccacugga

SEQ ID NO: 1398837 - RNA, 14 nt, Pseudomonas aeruginosa PA01
ucgcuggaccaggc

SEQ ID NO: 1398838 - RNA, 15 nt, Pseudomonas aeruginosa PA01
ucgcuggaccaggcg

SEQ ID NO: 1398839 - RNA, 17 nt, Pseudomonas aeruginosa PA01
ucgcuggcaccggccag

SEQ ID NO: 1398840 - RNA, 23 nt, Pseudomonas aeruginosa PA01
ucgcuggcaccggccaggcgcug

SEQ ID NO: 1398841 - RNA, 14 nt, Pseudomonas aeruginosa PA01
ucgcugcuggcgcc

SEQ ID NO: 1398842 - RNA, 18 nt, Pseudomonas aeruginosa PA01
ucgcugcgggcguagcgc

SEQ ID NO: 1398843 - RNA, 20 nt, Pseudomonas aeruginosa PA01
ucgcugcacgcacgcgccug

SEQ ID NO: 1398844 - RNA, 18 nt, Pseudomonas aeruginosa PA01
ucgcugaugugccgcacg

SEQ ID NO: 1398845 - RNA, 19 nt, Pseudomonas aeruginosa PA01
ucgcugaguuugcccagcg

SEQ ID NO: 1398846 - RNA, 23 nt, Pseudomonas aeruginosa PA01
ucgcugaguuugcccagcgccgc

SEQ ID NO: 1398847 - RNA, 15 nt, Pseudomonas aeruginosa PA01
ucgcugagcaccggg

SEQ ID NO: 1398848 - RNA, 16 nt, Pseudomonas aeruginosa PA01
ucgcugagcaccggga

SEQ ID NO: 1398849 - RNA, 20 nt, Pseudomonas aeruginosa PA01
ucgcugacgccauucaggcg

SEQ ID NO: 1398850 - RNA, 22 nt, Pseudomonas aeruginosa PA01
ucgcugacgccauucaggcgga

SEQ ID NO: 1398851 - RNA, 18 nt, Pseudomonas aeruginosa PA01
ucgcucauggcgccgcca

SEQ ID NO: 1398852 - RNA, 19 nt, Pseudomonas aeruginosa PA01
ucgcuccaacgcaggcgca

SEQ ID NO: 1398853 - RNA, 18 nt, Pseudomonas aeruginosa PA01
ucgcucaacggcgugccg

SEQ ID NO: 1398854 - RNA, 17 nt, Pseudomonas aeruginosa PA01
ucgcgcuguugccgcgc

SEQ ID NO: 1398855 - RNA, 13 nt, Pseudomonas aeruginosa PA01
ucgcgcuuggaca

SEQ ID NO: 1398856 - RNA, 23 nt, Pseudomonas aeruginosa PA01
ucgcggaaggcgucgaaggccuc

SEQ ID NO: 1398857 - RNA, 17 nt, Pseudomonas aeruginosa PA01
ucgcgcuggacccgcac

SEQ ID NO: 1398858 - RNA, 20 nt, Pseudomonas aeruginosa PA01
ucgcgcuggaccuggccggc

SEQ ID NO: 1398859 - RNA, 18 nt, Pseudomonas aeruginosa PA01
ucgcgcugggcgcagccc

SEQ ID NO: 1398860 - RNA, 20 nt, Pseudomonas aeruginosa PA01
ucgcggacuccggaggcgca

SEQ ID NO: 1398861 - RNA, 15 nt, Pseudomonas aeruginosa PA01
ucgcuagucuuccug

SEQ ID NO: 1398862 - RNA, 22 nt, Pseudomonas aeruginosa PA01
ucgcuagucuuccugcacgcug

SEQ ID NO: 1398863 - RNA, 17 nt, Pseudomonas aeruginosa PA01
ucgcggaccucgggcag

SEQ ID NO: 1398864 - RNA, 23 nt, Pseudomonas aeruginosa PA01
ucgcggaccucugcguucugcug

SEQ ID NO: 1398865 - RNA, 22 nt, Pseudomonas aeruginosa PA01
ucgcggacgaggauggucaggc

SEQ ID NO: 1398866 - RNA, 15 nt, Pseudomonas aeruginosa PA01
ucgcggacgcuggcg

SEQ ID NO: 1398867 - RNA, 21 nt, Pseudomonas aeruginosa PA01
ucgcggaccuccagccggcca

SEQ ID NO: 1398868 - RNA, 19 nt, Pseudomonas aeruginosa PA01
ucgcggaaguaggcggcgg

SEQ ID NO: 1398869 - RNA, 14 nt, Pseudomonas aeruginosa PA01
ucgcgcuuccggcu

SEQ ID NO: 1398870 - RNA, 17 nt, Pseudomonas aeruginosa PA01
ucgcggacccgcgccgg

SEQ ID NO: 1398871 - RNA, 23 nt, Pseudomonas aeruginosa PA01
ucgcggacccgcgccggcagcuc

SEQ ID NO: 1398872 - RNA, 20 nt, Pseudomonas aeruginosa PA01
ucgcggaccagcuccgaagg

SEQ ID NO: 1398873 - RNA, 18 nt, Pseudomonas aeruginosa PA01
ucggagagacccgccagc

SEQ ID NO: 1398874 - RNA, 21 nt, Pseudomonas aeruginosa PA01
ucggagagauagucgccguuc

SEQ ID NO: 1398875 - RNA, 23 nt, Pseudomonas aeruginosa PA01
ucggagagcagccaagccaccag

SEQ ID NO: 1398876 - RNA, 16 nt, Pseudomonas aeruginosa PA01
ucggaggucgagcaga

SEQ ID NO: 1398877 - RNA, 17 nt, Pseudomonas aeruginosa PA01
ucggagugaggccgagc

SEQ ID NO: 1398878 - RNA, 16 nt, Pseudomonas aeruginosa PA01
ucggcacucagccagc

SEQ ID NO: 1398879 - RNA, 22 nt, Pseudomonas aeruginosa PA01
ucggcacucagccagcggcgcu

SEQ ID NO: 1398880 - RNA, 14 nt, Pseudomonas aeruginosa PA01
ucggcacucaggaa

SEQ ID NO: 1398881 - RNA, 18 nt, Pseudomonas aeruginosa PA01
ucggcacgcagcagcuuc

SEQ ID NO: 1398882 - RNA, 17 nt, Pseudomonas aeruginosa PA01
ucggcaccgaucgcccg

SEQ ID NO: 1398883 - RNA, 13 nt, Pseudomonas aeruginosa PA01
ucggcaccugcag

SEQ ID NO: 1398884 - RNA, 17 nt, Pseudomonas aeruginosa PA01
ucggcaucaaucgcugg

SEQ ID NO: 1398885 - RNA, 22 nt, Pseudomonas aeruginosa PA01
ucggcagcagcuugccggcaua

SEQ ID NO: 1398886 - RNA, 17 nt, Pseudomonas aeruginosa PA01
ucggcagcaucagccgc

SEQ ID NO: 1398887 - RNA, 18 nt, Pseudomonas aeruginosa PA01
ucggcagcacgcugacgc

SEQ ID NO: 1398888 - RNA, 22 nt, Pseudomonas aeruginosa PA01
ucggcagcacgcugacgccggc

SEQ ID NO: 1398889 - RNA, 12 nt, Pseudomonas aeruginosa PA01
ucggcauccggc

SEQ ID NO: 1398890 - RNA, 13 nt, Pseudomonas aeruginosa PA01
ucggcauccucgc

SEQ ID NO: 1398891 - RNA, 18 nt, Pseudomonas aeruginosa PA01
ucggcauccucgccccgc

SEQ ID NO: 1398892 - RNA, 19 nt, Pseudomonas aeruginosa PA01
ucggcauccucgccccgcc

SEQ ID NO: 1398893 - RNA, 11 nt, Pseudomonas aeruginosa PA01
ucggcaucgac

SEQ ID NO: 1398894 - RNA, 14 nt, Pseudomonas aeruginosa PA01
ucggcaucgaccag

SEQ ID NO: 1398895 - RNA, 15 nt, Pseudomonas aeruginosa PA01
ucggcaucgaccagg

SEQ ID NO: 1398896 - RNA, 16 nt, Pseudomonas aeruginosa PA01
ucggcaucgaccaggg

SEQ ID NO: 1398897 - RNA, 21 nt, Pseudomonas aeruginosa PA01
ucggcauucgacccgccgacc

SEQ ID NO: 1398898 - RNA, 21 nt, Pseudomonas aeruginosa PA01
ucggcaucgucgaagcugagg

SEQ ID NO: 1398899 - RNA, 22 nt, Pseudomonas aeruginosa PA01
ucggcauggcuguagggacagg

SEQ ID NO: 1398900 - RNA, 19 nt, Pseudomonas aeruginosa PA01
ucggccagcagcaugggau

SEQ ID NO: 1398901 - RNA, 21 nt, Pseudomonas aeruginosa PA01
ucggccaucagcgccagggca

SEQ ID NO: 1398902 - RNA, 14 nt, Pseudomonas aeruginosa PA01
ucggccagcgcggc

SEQ ID NO: 1398903 - RNA, 14 nt, Pseudomonas aeruginosa PA01
ucggccaucagcac

SEQ ID NO: 1398904 - RNA, 16 nt, Pseudomonas aeruginosa PA01
ucggccagcgcggcgc

SEQ ID NO: 1398905 - RNA, 13 nt, Pseudomonas aeruginosa PA01
ucggccagcgccg

SEQ ID NO: 1398906 - RNA, 20 nt, Pseudomonas aeruginosa PA01
ucggccacuaucgccaacgc

SEQ ID NO: 1398907 - RNA, 19 nt, Pseudomonas aeruginosa PA01
ucggccacuccagccccgc

SEQ ID NO: 1398908 - RNA, 15 nt, Pseudomonas aeruginosa PA01
ucggccagcgccacg

SEQ ID NO: 1398909 - RNA, 22 nt, Pseudomonas aeruginosa PA01
ucggccagcgccacggcgcgga

SEQ ID NO: 1398910 - RNA, 15 nt, Pseudomonas aeruginosa PA01
ucggccagccccugc

SEQ ID NO: 1398911 - RNA, 14 nt, Pseudomonas aeruginosa PA01
ucggccagccggcg

SEQ ID NO: 1398912 - RNA, 23 nt, Pseudomonas aeruginosa PA01
ucggcccgcaugaacgccucgcc

SEQ ID NO: 1398913 - RNA, 23 nt, Pseudomonas aeruginosa PA01
ucggcccgacccacuugaacacc

SEQ ID NO: 1398914 - RNA, 16 nt, Pseudomonas aeruginosa PA01
ucggcccgacgccgcc

SEQ ID NO: 1398915 - RNA, 17 nt, Pseudomonas aeruginosa PA01
ucggcccgggcgccacc

SEQ ID NO: 1398916 - RNA, 21 nt, Pseudomonas aeruginosa PA01
ucggcccggagaccgugccgc

SEQ ID NO: 1398917 - RNA, 18 nt, Pseudomonas aeruginosa PA01
ucggcccggagccaacgc

SEQ ID NO: 1398918 - RNA, 19 nt, Pseudomonas aeruginosa PA01
ucggcccuccccuggcccu

SEQ ID NO: 1398919 - RNA, 12 nt, Pseudomonas aeruginosa PA01
ucggcccuggcg

SEQ ID NO: 1398920 - RNA, 14 nt, Pseudomonas aeruginosa PA01
ucggcccuggcggc

SEQ ID NO: 1398921 - RNA, 16 nt, Pseudomonas aeruginosa PA01
ucggcccuggcggcga

SEQ ID NO: 1398922 - RNA, 20 nt, Pseudomonas aeruginosa PA01
ucggccgacagagcggccgg

SEQ ID NO: 1398923 - RNA, 21 nt, Pseudomonas aeruginosa PA01
ucggccgacagagcggccggc

SEQ ID NO: 1398924 - RNA, 22 nt, Pseudomonas aeruginosa PA01
ucggccgacagagcggccggcg

SEQ ID NO: 1398925 - RNA, 23 nt, Pseudomonas aeruginosa PA01
ucggccgacagagcggccggcgc

SEQ ID NO: 1398926 - RNA, 13 nt, Pseudomonas aeruginosa PA01
ucggccgcaccag

SEQ ID NO: 1398927 - RNA, 21 nt, Pseudomonas aeruginosa PA01
ucggccauggucucgcugacc

SEQ ID NO: 1398928 - RNA, 16 nt, Pseudomonas aeruginosa PA01
ucggccauggccgagc

SEQ ID NO: 1398929 - RNA, 14 nt, Pseudomonas aeruginosa PA01
ucggccaugccggc

SEQ ID NO: 1398930 - RNA, 18 nt, Pseudomonas aeruginosa PA01
ucggccaugccggccagg

SEQ ID NO: 1398931 - RNA, 22 nt, Pseudomonas aeruginosa PA01
ucggccaugccggccaggaagg

SEQ ID NO: 1398932 - RNA, 22 nt, Pseudomonas aeruginosa PA01
ucggcccaugaaaaagcccggc

SEQ ID NO: 1398933 - RNA, 20 nt, Pseudomonas aeruginosa PA01
ucggccccaccuggcgacag

SEQ ID NO: 1398934 - RNA, 15 nt, Pseudomonas aeruginosa PA01
ucggccccaggaagg

SEQ ID NO: 1398935 - RNA, 14 nt, Pseudomonas aeruginosa PA01
ucggcccagcagcg

SEQ ID NO: 1398936 - RNA, 15 nt, Pseudomonas aeruginosa PA01
ucggcccagcagcgc

SEQ ID NO: 1398937 - RNA, 13 nt, Pseudomonas aeruginosa PA01
ucggccccggcca

SEQ ID NO: 1398938 - RNA, 17 nt, Pseudomonas aeruginosa PA01
ucguaguugccucucga

SEQ ID NO: 1398939 - RNA, 20 nt, Pseudomonas aeruginosa PA01
ucguaguugccucucgacuu

SEQ ID NO: 1398940 - RNA, 14 nt, Pseudomonas aeruginosa PA01
ucgucacggcgugc

SEQ ID NO: 1398941 - RNA, 16 nt, Pseudomonas aeruginosa PA01
ucgucacggcgugccg

SEQ ID NO: 1398942 - RNA, 13 nt, Pseudomonas aeruginosa PA01
ucgguugcggccu

SEQ ID NO: 1398943 - RNA, 23 nt, Pseudomonas aeruginosa PA01
ucguagaggcugucgucgagggu

SEQ ID NO: 1398944 - RNA, 22 nt, Pseudomonas aeruginosa PA01
ucguagagauauucccgcgaca

SEQ ID NO: 1398945 - RNA, 20 nt, Pseudomonas aeruginosa PA01
ucguagcccuucuccgccag

SEQ ID NO: 1398946 - RNA, 19 nt, Pseudomonas aeruginosa PA01
ucgguugccaggccggcgc

SEQ ID NO: 1398947 - RNA, 15 nt, Pseudomonas aeruginosa PA01
ucgguucgucgagga

SEQ ID NO: 1398948 - RNA, 13 nt, Pseudomonas aeruginosa PA01
ucgguuuccaccu

SEQ ID NO: 1398949 - RNA, 16 nt, Pseudomonas aeruginosa PA01
ucguaggcguccuggc

SEQ ID NO: 1398950 - RNA, 18 nt, Pseudomonas aeruginosa PA01
ucguaguccugggccggu

SEQ ID NO: 1398951 - RNA, 13 nt, Pseudomonas aeruginosa PA01
ucguaggccgacu

SEQ ID NO: 1398952 - RNA, 14 nt, Pseudomonas aeruginosa PA01
ucguaggccgacuc

SEQ ID NO: 1398953 - RNA, 13 nt, Pseudomonas aeruginosa PA01
ucguaggccgagc

SEQ ID NO: 1398954 - RNA, 17 nt, Pseudomonas aeruginosa PA01
ucguaggcaggcgcggc

SEQ ID NO: 1398955 - RNA, 19 nt, Pseudomonas aeruginosa PA01
ucguaggcaggcgcggcau

SEQ ID NO: 1398956 - RNA, 18 nt, Pseudomonas aeruginosa PA01
ucguagccggcgcggcgc

SEQ ID NO: 1398957 - RNA, 21 nt, Pseudomonas aeruginosa PA01
ucguagccggcgcggcgcagc

SEQ ID NO: 1398958 - RNA, 14 nt, Pseudomonas aeruginosa PA01
ucggugcgcuccug

SEQ ID NO: 1398959 - RNA, 16 nt, Pseudomonas aeruginosa PA01
ucggugcgcacgcaau

SEQ ID NO: 1398960 - RNA, 14 nt, Pseudomonas aeruginosa PA01
ucggucgcgccccc

SEQ ID NO: 1398961 - RNA, 12 nt, Pseudomonas aeruginosa PA01
ucggucggccag

SEQ ID NO: 1398962 - RNA, 15 nt, Pseudomonas aeruginosa PA01
ucggucggccaggac

SEQ ID NO: 1398963 - RNA, 15 nt, Pseudomonas aeruginosa PA01
ucggucggcggcggu

SEQ ID NO: 1398964 - RNA, 15 nt, Pseudomonas aeruginosa PA01
ucggucgccgccagc

SEQ ID NO: 1398965 - RNA, 22 nt, Pseudomonas aeruginosa PA01
ucggucauguccggggcgaucu

SEQ ID NO: 1398966 - RNA, 19 nt, Pseudomonas aeruginosa PA01
ucggucagguauucgccgg

SEQ ID NO: 1398967 - RNA, 20 nt, Pseudomonas aeruginosa PA01
ucggucagguauucgccggc

SEQ ID NO: 1398968 - RNA, 21 nt, Pseudomonas aeruginosa PA01
ucgguauccaccggacccggc

SEQ ID NO: 1398969 - RNA, 14 nt, Pseudomonas aeruginosa PA01
ucggugcguagcga

SEQ ID NO: 1398970 - RNA, 14 nt, Pseudomonas aeruginosa PA01
ucggugucggccaa

SEQ ID NO: 1398971 - RNA, 15 nt, Pseudomonas aeruginosa PA01
ucggugucggccaac

SEQ ID NO: 1398972 - RNA, 19 nt, Pseudomonas aeruginosa PA01
ucggugucguauuccaggg

SEQ ID NO: 1398973 - RNA, 20 nt, Pseudomonas aeruginosa PA01
ucgguggcaugguguccggc

SEQ ID NO: 1398974 - RNA, 20 nt, Pseudomonas aeruginosa PA01
ucggugugaucaccagccac

SEQ ID NO: 1398975 - RNA, 15 nt, Pseudomonas aeruginosa PA01
ucgggcggcaagggc

SEQ ID NO: 1398976 - RNA, 21 nt, Pseudomonas aeruginosa PA01
ucgggcgucuccugccgccga

SEQ ID NO: 1398977 - RNA, 15 nt, Pseudomonas aeruginosa PA01
ucgggcgccgcgccu

SEQ ID NO: 1398978 - RNA, 16 nt, Pseudomonas aeruginosa PA01
ucgggccgcgcucggu

SEQ ID NO: 1398979 - RNA, 20 nt, Pseudomonas aeruginosa PA01
ucgggccgcgcucgguccag

SEQ ID NO: 1398980 - RNA, 15 nt, Pseudomonas aeruginosa PA01
ucgggccggagcagg

SEQ ID NO: 1398981 - RNA, 18 nt, Pseudomonas aeruginosa PA01
ucgggcgaaacggcaggc

SEQ ID NO: 1398982 - RNA, 20 nt, Pseudomonas aeruginosa PA01
ucgggcgaaacggcaggcca

SEQ ID NO: 1398983 - RNA, 21 nt, Pseudomonas aeruginosa PA01
ucgggcgagaaucgccgaggc

SEQ ID NO: 1398984 - RNA, 22 nt, Pseudomonas aeruginosa PA01
ucgggcgagaaucgccgaggcg

SEQ ID NO: 1398985 - RNA, 20 nt, Pseudomonas aeruginosa PA01
ucgggcagauguccaggcag

SEQ ID NO: 1398986 - RNA, 21 nt, Pseudomonas aeruginosa PA01
ucgggcagauguccaggcagg

SEQ ID NO: 1398987 - RNA, 15 nt, Pseudomonas aeruginosa PA01
ucgggcaccagcacg

SEQ ID NO: 1398988 - RNA, 12 nt, Pseudomonas aeruginosa PA01
ucgggcaccagc

SEQ ID NO: 1398989 - RNA, 13 nt, Pseudomonas aeruginosa PA01
ucgggcaccagca

SEQ ID NO: 1398990 - RNA, 14 nt, Pseudomonas aeruginosa PA01
ucgggcaguuccgc

SEQ ID NO: 1398991 - RNA, 22 nt, Pseudomonas aeruginosa PA01
ucgggccgaucgagcggcccgc

SEQ ID NO: 1398992 - RNA, 16 nt, Pseudomonas aeruginosa PA01
ucgggccaugagcagg

SEQ ID NO: 1398993 - RNA, 18 nt, Pseudomonas aeruginosa PA01
ucgggccaugagcagggc

SEQ ID NO: 1398994 - RNA, 20 nt, Pseudomonas aeruginosa PA01
ucgggcagggcagccgccgc

SEQ ID NO: 1398995 - RNA, 24 nt, Pseudomonas aeruginosa PA01
ucgggcagggcagccgccgcggca

SEQ ID NO: 1398996 - RNA, 18 nt, Pseudomonas aeruginosa PA01
ucggggccgugagcacga

SEQ ID NO: 1398997 - RNA, 21 nt, Pseudomonas aeruginosa PA01
ucggggcgcaaggccagcggc

SEQ ID NO: 1398998 - RNA, 14 nt, Pseudomonas aeruginosa PA01
ucggggcgccucca

SEQ ID NO: 1398999 - RNA, 15 nt, Pseudomonas aeruginosa PA01
ucggggccggcgaug

SEQ ID NO: 1399000 - RNA, 13 nt, Pseudomonas aeruginosa PA01
ucggggccguagu

SEQ ID NO: 1399001 - RNA, 19 nt, Pseudomonas aeruginosa PA01
ucggggccguccgccaggu

SEQ ID NO: 1399002 - RNA, 20 nt, Pseudomonas aeruginosa PA01
ucggggccgaggucgaccag

SEQ ID NO: 1399003 - RNA, 21 nt, Pseudomonas aeruginosa PA01
ucggggccgaggucgaccagc

SEQ ID NO: 1399004 - RNA, 18 nt, Pseudomonas aeruginosa PA01
ucggggauguccgccgcc

SEQ ID NO: 1399005 - RNA, 20 nt, Pseudomonas aeruginosa PA01
ucggggauguccgccgccca

SEQ ID NO: 1399006 - RNA, 17 nt, Pseudomonas aeruginosa PA01
ucggggcauucguccag

SEQ ID NO: 1399007 - RNA, 19 nt, Pseudomonas aeruginosa PA01
ucggggcauucguccagcc

SEQ ID NO: 1399008 - RNA, 18 nt, Pseudomonas aeruginosa PA01
ucgggcuucuucaccagg

SEQ ID NO: 1399009 - RNA, 22 nt, Pseudomonas aeruginosa PA01
ucggggaaacccucaggucggc

SEQ ID NO: 1399010 - RNA, 16 nt, Pseudomonas aeruginosa PA01
ucgggcuucggcagca

SEQ ID NO: 1399011 - RNA, 17 nt, Pseudomonas aeruginosa PA01
ucgggcuucagcgccgg

SEQ ID NO: 1399012 - RNA, 14 nt, Pseudomonas aeruginosa PA01
ucggggugccgcca

SEQ ID NO: 1399013 - RNA, 15 nt, Pseudomonas aeruginosa PA01
ucgggugggacaugg

SEQ ID NO: 1399014 - RNA, 20 nt, Pseudomonas aeruginosa PA01
ucggguugaucgacgccagc

SEQ ID NO: 1399015 - RNA, 14 nt, Pseudomonas aeruginosa PA01
ucgguagccggcca

SEQ ID NO: 1399016 - RNA, 19 nt, Pseudomonas aeruginosa PA01
ucguccagccgccgcugca

SEQ ID NO: 1399017 - RNA, 22 nt, Pseudomonas aeruginosa PA01
ucguccagcgaggcguggaagg

SEQ ID NO: 1399018 - RNA, 23 nt, Pseudomonas aeruginosa PA01
ucguccagcggguagaugccacu

SEQ ID NO: 1399019 - RNA, 19 nt, Pseudomonas aeruginosa PA01
ucguccagcucggccauca

SEQ ID NO: 1399020 - RNA, 20 nt, Pseudomonas aeruginosa PA01
ucguccagcucggccaucag

SEQ ID NO: 1399021 - RNA, 16 nt, Pseudomonas aeruginosa PA01
ucguccaggccgcagg

SEQ ID NO: 1399022 - RNA, 22 nt, Pseudomonas aeruginosa PA01
ucguccugcggauucaucggcg

SEQ ID NO: 1399023 - RNA, 17 nt, Pseudomonas aeruginosa PA01
ucguccuuuccuccguc

SEQ ID NO: 1399024 - RNA, 22 nt, Pseudomonas aeruginosa PA01
ucgucgaaacgcuggcggccga

SEQ ID NO: 1399025 - RNA, 18 nt, Pseudomonas aeruginosa PA01
ucgucgaacgacucuucg

SEQ ID NO: 1399026 - RNA, 16 nt, Pseudomonas aeruginosa PA01
ucgucgaagcgcagca

SEQ ID NO: 1399027 - RNA, 22 nt, Pseudomonas aeruginosa PA01
ucgucgaagcgcaguacccggc

SEQ ID NO: 1399028 - RNA, 20 nt, Pseudomonas aeruginosa PA01
ucgucgaaguuuuccacgaa

SEQ ID NO: 1399029 - RNA, 20 nt, Pseudomonas aeruginosa PA01
ucgucggcgaacgaggcgag

SEQ ID NO: 1399030 - RNA, 15 nt, Pseudomonas aeruginosa PA01
ucgucgacgcccugg

SEQ ID NO: 1399031 - RNA, 21 nt, Pseudomonas aeruginosa PA01
ucgucgaccucgauggcgaua

SEQ ID NO: 1399032 - RNA, 15 nt, Pseudomonas aeruginosa PA01
ucgucgucggagaua

SEQ ID NO: 1399033 - RNA, 23 nt, Pseudomonas aeruginosa PA01
ucgucgggcagaguggcgcggcu

SEQ ID NO: 1399034 - RNA, 15 nt, Pseudomonas aeruginosa PA01
ucgugcccgagcgac

SEQ ID NO: 1399035 - RNA, 17 nt, Pseudomonas aeruginosa PA01
ucgugccaggcggcagc

SEQ ID NO: 1399036 - RNA, 20 nt, Pseudomonas aeruginosa PA01
ucgugccaucaggccgcggc

SEQ ID NO: 1399037 - RNA, 18 nt, Pseudomonas aeruginosa PA01
ucgugcagcaagccgcag

SEQ ID NO: 1399038 - RNA, 21 nt, Pseudomonas aeruginosa PA01
ucgugcagcaagccgcagcgc

SEQ ID NO: 1399039 - RNA, 16 nt, Pseudomonas aeruginosa PA01
ucgugccacaggcccu

SEQ ID NO: 1399040 - RNA, 19 nt, Pseudomonas aeruginosa PA01
ucgugccacaggcccugga

SEQ ID NO: 1399041 - RNA, 15 nt, Pseudomonas aeruginosa PA01
ucgucuuucaggugg

SEQ ID NO: 1399042 - RNA, 16 nt, Pseudomonas aeruginosa PA01
ucgucuuccagcggcc

SEQ ID NO: 1399043 - RNA, 22 nt, Pseudomonas aeruginosa PA01
ucgugaccauaggcuugcgccg

SEQ ID NO: 1399044 - RNA, 16 nt, Pseudomonas aeruginosa PA01
ucgucguucagcccac

SEQ ID NO: 1399045 - RNA, 22 nt, Pseudomonas aeruginosa PA01
ucgucuggcgccuggccuggaa

SEQ ID NO: 1399046 - RNA, 16 nt, Pseudomonas aeruginosa PA01
ucgucguggccauaga

SEQ ID NO: 1399047 - RNA, 15 nt, Pseudomonas aeruginosa PA01
ucgucguggcgaacc

SEQ ID NO: 1399048 - RNA, 19 nt, Pseudomonas aeruginosa PA01
ucuagcgccccggccgcgc

SEQ ID NO: 1399049 - RNA, 19 nt, Pseudomonas aeruginosa PA01
ucuaaggggcggcucggcu

SEQ ID NO: 1399050 - RNA, 20 nt, Pseudomonas aeruginosa PA01
ucuaaggaaaaacccggccc

SEQ ID NO: 1399051 - RNA, 21 nt, Pseudomonas aeruginosa PA01
ucucaggggccgacgcgcugc

SEQ ID NO: 1399052 - RNA, 14 nt, Pseudomonas aeruginosa PA01
ucucaggcgccagg

SEQ ID NO: 1399053 - RNA, 13 nt, Pseudomonas aeruginosa PA01
ucuccagcaggcu

SEQ ID NO: 1399054 - RNA, 16 nt, Pseudomonas aeruginosa PA01
ucuccacgucguccgg

SEQ ID NO: 1399055 - RNA, 21 nt, Pseudomonas aeruginosa PA01
ucuccacgucguccggcgcca

SEQ ID NO: 1399056 - RNA, 20 nt, Pseudomonas aeruginosa PA01
ucuccaggcccauccuggcg

SEQ ID NO: 1399057 - RNA, 15 nt, Pseudomonas aeruginosa PA01
ucuccaggccgcuca

SEQ ID NO: 1399058 - RNA, 22 nt, Pseudomonas aeruginosa PA01
ucuccaggcgcgccgugcggcg

SEQ ID NO: 1399059 - RNA, 23 nt, Pseudomonas aeruginosa PA01
ucuccaggcgcgccgugcggcgu

SEQ ID NO: 1399060 - RNA, 14 nt, Pseudomonas aeruginosa PA01
ucuccagggaaacc

SEQ ID NO: 1399061 - RNA, 19 nt, Pseudomonas aeruginosa PA01
ucuccagggaaaccaccug

SEQ ID NO: 1399062 - RNA, 20 nt, Pseudomonas aeruginosa PA01
ucuccaggucgaacagcggc

SEQ ID NO: 1399063 - RNA, 23 nt, Pseudomonas aeruginosa PA01
ucuccaccggaucgcccuggcgc

SEQ ID NO: 1399064 - RNA, 20 nt, Pseudomonas aeruginosa PA01
ucuccaacuggcggcugggc

SEQ ID NO: 1399065 - RNA, 21 nt, Pseudomonas aeruginosa PA01
ucguugggccggaacggcuug

SEQ ID NO: 1399066 - RNA, 19 nt, Pseudomonas aeruginosa PA01
ucguuggcaaagcccgcuu

SEQ ID NO: 1399067 - RNA, 13 nt, Pseudomonas aeruginosa PA01
ucguuggcgcgac

SEQ ID NO: 1399068 - RNA, 15 nt, Pseudomonas aeruginosa PA01
ucguuguugccgcgc

SEQ ID NO: 1399069 - RNA, 14 nt, Pseudomonas aeruginosa PA01
ucguuucagcgcca

SEQ ID NO: 1399070 - RNA, 13 nt, Pseudomonas aeruginosa PA01
ucguuucccggcg

SEQ ID NO: 1399071 - RNA, 19 nt, Pseudomonas aeruginosa PA01
ucguugcggaaagcgacgc

SEQ ID NO: 1399072 - RNA, 12 nt, Pseudomonas aeruginosa PA01
ucguuggcccag

SEQ ID NO: 1399073 - RNA, 13 nt, Pseudomonas aeruginosa PA01
ucguuggcccaga

SEQ ID NO: 1399074 - RNA, 15 nt, Pseudomonas aeruginosa PA01
ucguugcgccccggg

SEQ ID NO: 1399075 - RNA, 14 nt, Pseudomonas aeruginosa PA01
ucguggcgcgccgc

SEQ ID NO: 1399076 - RNA, 18 nt, Pseudomonas aeruginosa PA01
ucguggauaggcggcgga

SEQ ID NO: 1399077 - RNA, 23 nt, Pseudomonas aeruginosa PA01
ucguggaugcugauaagcucggc

SEQ ID NO: 1399078 - RNA, 19 nt, Pseudomonas aeruginosa PA01
ucgugcuuggugucggccg

SEQ ID NO: 1399079 - RNA, 13 nt, Pseudomonas aeruginosa PA01
ucguggaaaaaga

SEQ ID NO: 1399080 - RNA, 21 nt, Pseudomonas aeruginosa PA01
ucguggaaguauugcuccacc

SEQ ID NO: 1399081 - RNA, 19 nt, Pseudomonas aeruginosa PA01
ucguggacauacaggcgcg

SEQ ID NO: 1399082 - RNA, 19 nt, Pseudomonas aeruginosa PA01
ucgcgaaaacucccggccu

SEQ ID NO: 1399083 - RNA, 21 nt, Pseudomonas aeruginosa PA01
ucgcgaaaacucccggccugg

SEQ ID NO: 1399084 - RNA, 17 nt, Pseudomonas aeruginosa PA01
ucgcgaagaacacgccc

SEQ ID NO: 1399085 - RNA, 16 nt, Pseudomonas aeruginosa PA01
ucgccuucguccaugc

SEQ ID NO: 1399086 - RNA, 18 nt, Pseudomonas aeruginosa PA01
ucgccuugaccagcggcc

SEQ ID NO: 1399087 - RNA, 15 nt, Pseudomonas aeruginosa PA01
ucgccuugcccuggc

SEQ ID NO: 1399088 - RNA, 19 nt, Pseudomonas aeruginosa PA01
ucgccuugcccuggccggc

SEQ ID NO: 1399089 - RNA, 23 nt, Pseudomonas aeruginosa PA01
ucgccuucccagacguccagcgc

SEQ ID NO: 1399090 - RNA, 17 nt, Pseudomonas aeruginosa PA01
ucgccuuccucggcgaa

SEQ ID NO: 1399091 - RNA, 19 nt, Pseudomonas aeruginosa PA01
ucgccuuccucggcgauca

SEQ ID NO: 1399092 - RNA, 23 nt, Pseudomonas aeruginosa PA01
ucgccuucggcgugcauggccgg

SEQ ID NO: 1399093 - RNA, 16 nt, Pseudomonas aeruginosa PA01
ucgccugcuuggcggc

SEQ ID NO: 1399094 - RNA, 15 nt, Pseudomonas aeruginosa PA01
ucgccugccaggcgg

SEQ ID NO: 1399095 - RNA, 16 nt, Pseudomonas aeruginosa PA01
ucgccugguaggcggc

SEQ ID NO: 1399096 - RNA, 18 nt, Pseudomonas aeruginosa PA01
ucgccugguaggcggcga

SEQ ID NO: 1399097 - RNA, 20 nt, Pseudomonas aeruginosa PA01
ucgccuggcgcgacgaggcg

SEQ ID NO: 1399098 - RNA, 21 nt, Pseudomonas aeruginosa PA01
ucgccuggcgcgacgaggcgc

SEQ ID NO: 1399099 - RNA, 15 nt, Pseudomonas aeruginosa PA01
ucgccugggccggcg

SEQ ID NO: 1399100 - RNA, 17 nt, Pseudomonas aeruginosa PA01
ucgccugggccggcgua

SEQ ID NO: 1399101 - RNA, 15 nt, Pseudomonas aeruginosa PA01
ucgccuuccaccacc

SEQ ID NO: 1399102 - RNA, 17 nt, Pseudomonas aeruginosa PA01
ucgccuuccaccaccag

SEQ ID NO: 1399103 - RNA, 14 nt, Pseudomonas aeruginosa PA01
ucgcgcacggcgaa

SEQ ID NO: 1399104 - RNA, 16 nt, Pseudomonas aeruginosa PA01
ucgcgcacggcgaaga

SEQ ID NO: 1399105 - RNA, 15 nt, Pseudomonas aeruginosa PA01
ucgcgcaccgcggcc

SEQ ID NO: 1399106 - RNA, 20 nt, Pseudomonas aeruginosa PA01
ucgcgcaccgcggccaguug

SEQ ID NO: 1399107 - RNA, 16 nt, Pseudomonas aeruginosa PA01
ucgcgcaccgcggcga

SEQ ID NO: 1399108 - RNA, 18 nt, Pseudomonas aeruginosa PA01
ucgcgcaccgcggcgagc

SEQ ID NO: 1399109 - RNA, 20 nt, Pseudomonas aeruginosa PA01
ucgcgauuggagaugcucag

SEQ ID NO: 1399110 - RNA, 16 nt, Pseudomonas aeruginosa PA01
ucgcgcaagcgcccgg

SEQ ID NO: 1399111 - RNA, 18 nt, Pseudomonas aeruginosa PA01
ucgcgcaagcgcccggcg

SEQ ID NO: 1399112 - RNA, 19 nt, Pseudomonas aeruginosa PA01
ucgcgcaagcgcccggcga

SEQ ID NO: 1399113 - RNA, 16 nt, Pseudomonas aeruginosa PA01
ucgcgcaaugccgcgu

SEQ ID NO: 1399114 - RNA, 20 nt, Pseudomonas aeruginosa PA01
ucgcgaaccacauccuugcc

SEQ ID NO: 1399115 - RNA, 20 nt, Pseudomonas aeruginosa PA01
ucgcgaagaccggccggcuc

SEQ ID NO: 1399116 - RNA, 14 nt, Pseudomonas aeruginosa PA01
ucgcgaagcgcagc

SEQ ID NO: 1399117 - RNA, 17 nt, Pseudomonas aeruginosa PA01
ucgcgcaacgccgacgg

SEQ ID NO: 1399118 - RNA, 15 nt, Pseudomonas aeruginosa PA01
ucgcgcaacggcagc

SEQ ID NO: 1399119 - RNA, 16 nt, Pseudomonas aeruginosa PA01
ucgcgcaacggcagcg

SEQ ID NO: 1399120 - RNA, 21 nt, Pseudomonas aeruginosa PA01
ucgcgcaacggcagcgcuucg

SEQ ID NO: 1399121 - RNA, 18 nt, Pseudomonas aeruginosa PA01
ucgcgcaacugcggggcg

SEQ ID NO: 1399122 - RNA, 24 nt, Pseudomonas aeruginosa PA01
ucgcgcaacugcggggcgcucagg

SEQ ID NO: 1399123 - RNA, 14 nt, Pseudomonas aeruginosa PA01
ucgcgcaacugcuc

SEQ ID NO: 1399124 - RNA, 16 nt, Pseudomonas aeruginosa PA01
ucgcgcagggcagcgc

SEQ ID NO: 1399125 - RNA, 15 nt, Pseudomonas aeruginosa PA01
ucgcgccgccgaagc

SEQ ID NO: 1399126 - RNA, 15 nt, Pseudomonas aeruginosa PA01
ucgcgccgcgccagc

SEQ ID NO: 1399127 - RNA, 16 nt, Pseudomonas aeruginosa PA01
ucgcgccgcgccagca

SEQ ID NO: 1399128 - RNA, 16 nt, Pseudomonas aeruginosa PA01
ucgcgcaggcgcuggc

SEQ ID NO: 1399129 - RNA, 20 nt, Pseudomonas aeruginosa PA01
ucgcgcaggcgcuggcgggc

SEQ ID NO: 1399130 - RNA, 15 nt, Pseudomonas aeruginosa PA01
ucgcgcaggcgggcg

SEQ ID NO: 1399131 - RNA, 14 nt, Pseudomonas aeruginosa PA01
ucgcgcaggcggug

SEQ ID NO: 1399132 - RNA, 19 nt, Pseudomonas aeruginosa PA01
ucgcgcagggccagggcgg

SEQ ID NO: 1399133 - RNA, 13 nt, Pseudomonas aeruginosa PA01
ucgcgcagcggcg

SEQ ID NO: 1399134 - RNA, 18 nt, Pseudomonas aeruginosa PA01
ucgcgcagcuccucggcg

SEQ ID NO: 1399135 - RNA, 17 nt, Pseudomonas aeruginosa PA01
ucgcgcagcucggccaa

SEQ ID NO: 1399136 - RNA, 18 nt, Pseudomonas aeruginosa PA01
ucgcgcagcucggccaac

SEQ ID NO: 1399137 - RNA, 16 nt, Pseudomonas aeruginosa PA01
ucgcgcugcccggcgc

SEQ ID NO: 1399138 - RNA, 18 nt, Pseudomonas aeruginosa PA01
ucgcgcugcccggcgcga

SEQ ID NO: 1399139 - RNA, 21 nt, Pseudomonas aeruginosa PA01
ucgcgcugcccggcgcgacgc

SEQ ID NO: 1399140 - RNA, 19 nt, Pseudomonas aeruginosa PA01
ucgcgcucggcgaggccgg

SEQ ID NO: 1399141 - RNA, 14 nt, Pseudomonas aeruginosa PA01
ucgcgcucggcggc

SEQ ID NO: 1399142 - RNA, 13 nt, Pseudomonas aeruginosa PA01
ucgcgcuccaggc

SEQ ID NO: 1399143 - RNA, 19 nt, Pseudomonas aeruginosa PA01
ucgcgcuccaggcccggca

SEQ ID NO: 1399144 - RNA, 21 nt, Pseudomonas aeruginosa PA01
ucgcgcuccaggcccggcagg

SEQ ID NO: 1399145 - RNA, 18 nt, Pseudomonas aeruginosa PA01
ucgcgcucgacgaugcug

SEQ ID NO: 1399146 - RNA, 13 nt, Pseudomonas aeruginosa PA01
ucgcgccgucgcu

SEQ ID NO: 1399147 - RNA, 16 nt, Pseudomonas aeruginosa PA01
ucgcgcgaggcgcucu

SEQ ID NO: 1399148 - RNA, 18 nt, Pseudomonas aeruginosa PA01
ucgcgcucaggcgcagcg

SEQ ID NO: 1399149 - RNA, 17 nt, Pseudomonas aeruginosa PA01
ucgcgcguggccgccag

SEQ ID NO: 1399150 - RNA, 13 nt, Pseudomonas aeruginosa PA01
ucgccgccgggcg

SEQ ID NO: 1399151 - RNA, 21 nt, Pseudomonas aeruginosa PA01
ucgccgccgggcgcgcgccuc

SEQ ID NO: 1399152 - RNA, 14 nt, Pseudomonas aeruginosa PA01
ucgccgccgccagu

SEQ ID NO: 1399153 - RNA, 12 nt, Pseudomonas aeruginosa PA01
ucgccgccggcc

SEQ ID NO: 1399154 - RNA, 15 nt, Pseudomonas aeruginosa PA01
ucgccgccggccagc

SEQ ID NO: 1399155 - RNA, 18 nt, Pseudomonas aeruginosa PA01
ucgccgccggccagccgc

SEQ ID NO: 1399156 - RNA, 14 nt, Pseudomonas aeruginosa PA01
ucgccgccggcgag

SEQ ID NO: 1399157 - RNA, 15 nt, Pseudomonas aeruginosa PA01
ucgccgccggcgagg

SEQ ID NO: 1399158 - RNA, 18 nt, Pseudomonas aeruginosa PA01
ucgccgccggcgaggauc

SEQ ID NO: 1399159 - RNA, 12 nt, Pseudomonas aeruginosa PA01
ucgccgccgaca

SEQ ID NO: 1399160 - RNA, 16 nt, Pseudomonas aeruginosa PA01
ucgccgccgacacccg

SEQ ID NO: 1399161 - RNA, 18 nt, Pseudomonas aeruginosa PA01
ucgccgccgacacccgcg

SEQ ID NO: 1399162 - RNA, 14 nt, Pseudomonas aeruginosa PA01
ucgccgccgaccgg

SEQ ID NO: 1399163 - RNA, 15 nt, Pseudomonas aeruginosa PA01
ucgccgccgaccggg

SEQ ID NO: 1399164 - RNA, 21 nt, Pseudomonas aeruginosa PA01
ucgccgcccgcgccuccaggc

SEQ ID NO: 1399165 - RNA, 22 nt, Pseudomonas aeruginosa PA01
ucgccgcccgcgccuccaggcg

SEQ ID NO: 1399166 - RNA, 13 nt, Pseudomonas aeruginosa PA01
ucgccgccagcag

SEQ ID NO: 1399167 - RNA, 19 nt, Pseudomonas aeruginosa PA01
ucgccgccagcauggcgaa

SEQ ID NO: 1399168 - RNA, 13 nt, Pseudomonas aeruginosa PA01
ucgccgcccggca

SEQ ID NO: 1399169 - RNA, 16 nt, Pseudomonas aeruginosa PA01
ucgccgcccggcagcg

SEQ ID NO: 1399170 - RNA, 13 nt, Pseudomonas aeruginosa PA01
ucgccgccgagca

SEQ ID NO: 1399171 - RNA, 15 nt, Pseudomonas aeruginosa PA01
ucgccgccgagcgcc

SEQ ID NO: 1399172 - RNA, 17 nt, Pseudomonas aeruginosa PA01
ucgccgccgagcgccug

SEQ ID NO: 1399173 - RNA, 19 nt, Pseudomonas aeruginosa PA01
ucgccgccgaggcgcgcca

SEQ ID NO: 1399174 - RNA, 12 nt, Pseudomonas aeruginosa PA01
ucgccgccgcca

SEQ ID NO: 1399175 - RNA, 14 nt, Pseudomonas aeruginosa PA01
ucgccgccgcagcc

SEQ ID NO: 1399176 - RNA, 17 nt, Pseudomonas aeruginosa PA01
ucgccgccgcagccgug

SEQ ID NO: 1399177 - RNA, 19 nt, Pseudomonas aeruginosa PA01
ucgccgccgcagccguggc

SEQ ID NO: 1399178 - RNA, 14 nt, Pseudomonas aeruginosa PA01
ucgccggccaguug

SEQ ID NO: 1399179 - RNA, 22 nt, Pseudomonas aeruginosa PA01
ucgccggccaguuggugcacgc

SEQ ID NO: 1399180 - RNA, 14 nt, Pseudomonas aeruginosa PA01
ucgccggcagcgcc

SEQ ID NO: 1399181 - RNA, 16 nt, Pseudomonas aeruginosa PA01
ucgccggcagcgccgc

SEQ ID NO: 1399182 - RNA, 18 nt, Pseudomonas aeruginosa PA01
ucgccggcagcgccgcgc

SEQ ID NO: 1399183 - RNA, 14 nt, Pseudomonas aeruginosa PA01
ucgccggccaccag

SEQ ID NO: 1399184 - RNA, 15 nt, Pseudomonas aeruginosa PA01
ucgccggccaccagg

SEQ ID NO: 1399185 - RNA, 16 nt, Pseudomonas aeruginosa PA01
ucgccggccaccaggc

SEQ ID NO: 1399186 - RNA, 16 nt, Pseudomonas aeruginosa PA01
ucgccggccugcgcgc

SEQ ID NO: 1399187 - RNA, 23 nt, Pseudomonas aeruginosa PA01
ucgccggccugcgcgcaccaggc

SEQ ID NO: 1399188 - RNA, 14 nt, Pseudomonas aeruginosa PA01
ucgccggcccgcgc

SEQ ID NO: 1399189 - RNA, 20 nt, Pseudomonas aeruginosa PA01
ucgccggcccgcgcggcaac

SEQ ID NO: 1399190 - RNA, 15 nt, Pseudomonas aeruginosa PA01
ucgccggccagcacc

SEQ ID NO: 1399191 - RNA, 20 nt, Pseudomonas aeruginosa PA01
ucgccgggcuuuucaaggcg

SEQ ID NO: 1399192 - RNA, 22 nt, Pseudomonas aeruginosa PA01
ucgccggccuggaucucggcgg

SEQ ID NO: 1399193 - RNA, 19 nt, Pseudomonas aeruginosa PA01
ucgccggggccuacugcug

SEQ ID NO: 1399194 - RNA, 22 nt, Pseudomonas aeruginosa PA01
ucgccggguggaacgaggcgac

SEQ ID NO: 1399195 - RNA, 22 nt, Pseudomonas aeruginosa PA01
ucgccggguguuuuuccucgga

SEQ ID NO: 1399196 - RNA, 19 nt, Pseudomonas aeruginosa PA01
ucgccggguugccgcuggc

SEQ ID NO: 1399197 - RNA, 19 nt, Pseudomonas aeruginosa PA01
ucgccggguuguccaggcg

SEQ ID NO: 1399198 - RNA, 14 nt, Pseudomonas aeruginosa PA01
ucgccgucggcggu

SEQ ID NO: 1399199 - RNA, 20 nt, Pseudomonas aeruginosa PA01
ucgccggucaggcugcggcg

SEQ ID NO: 1399200 - RNA, 15 nt, Pseudomonas aeruginosa PA01
ucgccgguccucgac

SEQ ID NO: 1399201 - RNA, 19 nt, Pseudomonas aeruginosa PA01
ucgccggucgcgcucaggc

SEQ ID NO: 1399202 - RNA, 16 nt, Pseudomonas aeruginosa PA01
ucgccgucucguagac

SEQ ID NO: 1399203 - RNA, 18 nt, Pseudomonas aeruginosa PA01
ucgccgucuuccaccaga

SEQ ID NO: 1399204 - RNA, 20 nt, Pseudomonas aeruginosa PA01
ucgccgugguggccguggcg

SEQ ID NO: 1399205 - RNA, 20 nt, Pseudomonas aeruginosa PA01
ucgccguucagcucccaggc

SEQ ID NO: 1399206 - RNA, 21 nt, Pseudomonas aeruginosa PA01
ucgccguucagcucccaggcg

SEQ ID NO: 1399207 - RNA, 15 nt, Pseudomonas aeruginosa PA01
ucgccucgggccaug

SEQ ID NO: 1399208 - RNA, 20 nt, Pseudomonas aeruginosa PA01
ucgccucgggcgagcgcaga

SEQ ID NO: 1399209 - RNA, 23 nt, Pseudomonas aeruginosa PA01
ucgccucggcgggagagggcggc

SEQ ID NO: 1399210 - RNA, 11 nt, Pseudomonas aeruginosa PA01
ucgccucggcc

SEQ ID NO: 1399211 - RNA, 21 nt, Pseudomonas aeruginosa PA01
ucgccucgucgagcgcagcga

SEQ ID NO: 1399212 - RNA, 17 nt, Pseudomonas aeruginosa PA01
ucgccucguucagcagc

SEQ ID NO: 1399213 - RNA, 18 nt, Pseudomonas aeruginosa PA01
ucgccucguucagcagca

SEQ ID NO: 1399214 - RNA, 18 nt, Pseudomonas aeruginosa PA01
ucgccguuggcgaggacu

SEQ ID NO: 1399215 - RNA, 13 nt, Pseudomonas aeruginosa PA01
ucgccuaccagac

SEQ ID NO: 1399216 - RNA, 18 nt, Pseudomonas aeruginosa PA01
ucgccuaccagaccgcag

SEQ ID NO: 1399217 - RNA, 20 nt, Pseudomonas aeruginosa PA01
ucgccuaccagaccgcagcc

SEQ ID NO: 1399218 - RNA, 23 nt, Pseudomonas aeruginosa PA01
ucgccuccaccagcgccggcggc

SEQ ID NO: 1399219 - RNA, 14 nt, Pseudomonas aeruginosa PA01
ucgccucgccggcc

SEQ ID NO: 1399220 - RNA, 15 nt, Pseudomonas aeruginosa PA01
ucgccucgccggcca

SEQ ID NO: 1399221 - RNA, 16 nt, Pseudomonas aeruginosa PA01
ucgccucggcgcgcgc

SEQ ID NO: 1399222 - RNA, 12 nt, Pseudomonas aeruginosa PA01
ucgccucccggc

SEQ ID NO: 1399223 - RNA, 19 nt, Pseudomonas aeruginosa PA01
ucgccucccggcucgccga

SEQ ID NO: 1399224 - RNA, 20 nt, Pseudomonas aeruginosa PA01
ucgcccauggcacgcagggc

SEQ ID NO: 1399225 - RNA, 19 nt, Pseudomonas aeruginosa PA01
ucgcccaugugcuugaccg

SEQ ID NO: 1399226 - RNA, 16 nt, Pseudomonas aeruginosa PA01
ucgcccaucgccaggg

SEQ ID NO: 1399227 - RNA, 21 nt, Pseudomonas aeruginosa PA01
ucgcccaugaaaaagccccgc

SEQ ID NO: 1399228 - RNA, 16 nt, Pseudomonas aeruginosa PA01
ucgcccaugcgcggcg

SEQ ID NO: 1399229 - RNA, 19 nt, Pseudomonas aeruginosa PA01
ucgcccaugcgcggcgaga

SEQ ID NO: 1399230 - RNA, 22 nt, Pseudomonas aeruginosa PA01
ucgccaguuccgugucgagggc

SEQ ID NO: 1399231 - RNA, 23 nt, Pseudomonas aeruginosa PA01
ucgccaguuccgugucgagggcg

SEQ ID NO: 1399232 - RNA, 20 nt, Pseudomonas aeruginosa PA01
ucgccaguucucgcagcagg

SEQ ID NO: 1399233 - RNA, 21 nt, Pseudomonas aeruginosa PA01
ucgccaguucucgcagcaggc

SEQ ID NO: 1399234 - RNA, 19 nt, Pseudomonas aeruginosa PA01
ucgccaguugcagggauuc

SEQ ID NO: 1399235 - RNA, 22 nt, Pseudomonas aeruginosa PA01
ucgccaguugcagggauuccgg

SEQ ID NO: 1399236 - RNA, 16 nt, Pseudomonas aeruginosa PA01
ucgccccagccuugcu

SEQ ID NO: 1399237 - RNA, 17 nt, Pseudomonas aeruginosa PA01
ucgcccgaacgccgacc

SEQ ID NO: 1399238 - RNA, 13 nt, Pseudomonas aeruginosa PA01
ucgccccggcggc

SEQ ID NO: 1399239 - RNA, 14 nt, Pseudomonas aeruginosa PA01
ucgccccggcggcg

SEQ ID NO: 1399240 - RNA, 19 nt, Pseudomonas aeruginosa PA01
ucgccccgccgggagcggc

SEQ ID NO: 1399241 - RNA, 20 nt, Pseudomonas aeruginosa PA01
ucgccccgccgggagcggcc

SEQ ID NO: 1399242 - RNA, 22 nt, Pseudomonas aeruginosa PA01
ucgccagcgguacccgccggcc

SEQ ID NO: 1399243 - RNA, 14 nt, Pseudomonas aeruginosa PA01
ucgccaggacgcuc

SEQ ID NO: 1399244 - RNA, 18 nt, Pseudomonas aeruginosa PA01
ucgccagcucgccgcgcu

SEQ ID NO: 1399245 - RNA, 14 nt, Pseudomonas aeruginosa PA01
ucgccaggccauug

SEQ ID NO: 1399246 - RNA, 19 nt, Pseudomonas aeruginosa PA01
ucgccagggucuugccgac

SEQ ID NO: 1399247 - RNA, 20 nt, Pseudomonas aeruginosa PA01
ucgccagggucuugccgacc

SEQ ID NO: 1399248 - RNA, 18 nt, Pseudomonas aeruginosa PA01
ucgccagguggaagcgcg

SEQ ID NO: 1399249 - RNA, 15 nt, Pseudomonas aeruginosa PA01
ucgccaggccguaga

SEQ ID NO: 1399250 - RNA, 22 nt, Pseudomonas aeruginosa PA01
ucgccaggccguagaccaccag

SEQ ID NO: 1399251 - RNA, 15 nt, Pseudomonas aeruginosa PA01
ucgccaggcugaucc

SEQ ID NO: 1399252 - RNA, 20 nt, Pseudomonas aeruginosa PA01
ucgccaggcugauccgcgac

SEQ ID NO: 1399253 - RNA, 22 nt, Pseudomonas aeruginosa PA01
ucgccaggcugauccgcgacag

SEQ ID NO: 1399254 - RNA, 13 nt, Pseudomonas aeruginosa PA01
ucgccaggcuggc

SEQ ID NO: 1399255 - RNA, 14 nt, Pseudomonas aeruginosa PA01
ucgccagcgccagc

SEQ ID NO: 1399256 - RNA, 15 nt, Pseudomonas aeruginosa PA01
ucgccagcgccuucg

SEQ ID NO: 1399257 - RNA, 19 nt, Pseudomonas aeruginosa PA01
ucgccagcgccuucgugac

SEQ ID NO: 1399258 - RNA, 14 nt, Pseudomonas aeruginosa PA01
ucgccagcgcgcgc

SEQ ID NO: 1399259 - RNA, 15 nt, Pseudomonas aeruginosa PA01
ucgccagcgcgcgcc

SEQ ID NO: 1399260 - RNA, 18 nt, Pseudomonas aeruginosa PA01
ucgccagcgcgcgccgac

SEQ ID NO: 1399261 - RNA, 21 nt, Pseudomonas aeruginosa PA01
ucgccagcgcgcgccgacagg

SEQ ID NO: 1399262 - RNA, 22 nt, Pseudomonas aeruginosa PA01
ucgccagcaggcucaugcccag

SEQ ID NO: 1399263 - RNA, 13 nt, Pseudomonas aeruginosa PA01
ucgccagcccggc

SEQ ID NO: 1399264 - RNA, 14 nt, Pseudomonas aeruginosa PA01
ucgccagcccggca

SEQ ID NO: 1399265 - RNA, 13 nt, Pseudomonas aeruginosa PA01
ucgccagcccggu

SEQ ID NO: 1399266 - RNA, 21 nt, Pseudomonas aeruginosa PA01
ucgccagcccgguucagcggg

SEQ ID NO: 1399267 - RNA, 21 nt, Pseudomonas aeruginosa PA01
ucgccgcacaccgcgcgcgcc

SEQ ID NO: 1399268 - RNA, 24 nt, Pseudomonas aeruginosa PA01
ucgccgcacaccgcgcgcgccugc

SEQ ID NO: 1399269 - RNA, 14 nt, Pseudomonas aeruginosa PA01
ucgccgagcgccgc

SEQ ID NO: 1399270 - RNA, 18 nt, Pseudomonas aeruginosa PA01
ucgccgaggcccagcgac

SEQ ID NO: 1399271 - RNA, 18 nt, Pseudomonas aeruginosa PA01
ucgccgaggcggcgcagc

SEQ ID NO: 1399272 - RNA, 19 nt, Pseudomonas aeruginosa PA01
ucgccgaggcggcgcagca

SEQ ID NO: 1399273 - RNA, 14 nt, Pseudomonas aeruginosa PA01
ucgccgagggcaag

SEQ ID NO: 1399274 - RNA, 16 nt, Pseudomonas aeruginosa PA01
ucgccgagggcgaaga

SEQ ID NO: 1399275 - RNA, 13 nt, Pseudomonas aeruginosa PA01
ucgccgccaccac

SEQ ID NO: 1399276 - RNA, 20 nt, Pseudomonas aeruginosa PA01
ucgccgccaccacgaucagg

SEQ ID NO: 1399277 - RNA, 14 nt, Pseudomonas aeruginosa PA01
ucgccgcaccggcg

SEQ ID NO: 1399278 - RNA, 16 nt, Pseudomonas aeruginosa PA01
ucgccgcagcccuagg

SEQ ID NO: 1399279 - RNA, 20 nt, Pseudomonas aeruginosa PA01
ucgccgcagcccuaggcgac

SEQ ID NO: 1399280 - RNA, 15 nt, Pseudomonas aeruginosa PA01
ucgccgccagcgccg

SEQ ID NO: 1399281 - RNA, 18 nt, Pseudomonas aeruginosa PA01
ucgccgccagcgccggcc

SEQ ID NO: 1399282 - RNA, 16 nt, Pseudomonas aeruginosa PA01
ucgccgccagcuaccg

SEQ ID NO: 1399283 - RNA, 14 nt, Pseudomonas aeruginosa PA01
ucgccgccaggcag

SEQ ID NO: 1399284 - RNA, 22 nt, Pseudomonas aeruginosa PA01
ucgccgccaggcagaccugcag

SEQ ID NO: 1399285 - RNA, 16 nt, Pseudomonas aeruginosa PA01
ucgccgccaguucggc

SEQ ID NO: 1399286 - RNA, 23 nt, Pseudomonas aeruginosa PA01
ucgccgcccacgccuugcagcac

SEQ ID NO: 1399287 - RNA, 19 nt, Pseudomonas aeruginosa PA01
ucgcccuacggccccaggc

SEQ ID NO: 1399288 - RNA, 15 nt, Pseudomonas aeruginosa PA01
ucgcccuacgggggc

SEQ ID NO: 1399289 - RNA, 16 nt, Pseudomonas aeruginosa PA01
ucgcccuacccgacag

SEQ ID NO: 1399290 - RNA, 17 nt, Pseudomonas aeruginosa PA01
ucgcccuacccgacagg

SEQ ID NO: 1399291 - RNA, 15 nt, Pseudomonas aeruginosa PA01
ucgcccuacgaaagc

SEQ ID NO: 1399292 - RNA, 16 nt, Pseudomonas aeruginosa PA01
ucgcccgugccucggc

SEQ ID NO: 1399293 - RNA, 17 nt, Pseudomonas aeruginosa PA01
ucgcccgugccucggcg

SEQ ID NO: 1399294 - RNA, 18 nt, Pseudomonas aeruginosa PA01
ucgcccgugccucggcgg

SEQ ID NO: 1399295 - RNA, 19 nt, Pseudomonas aeruginosa PA01
ucgcccgugccucggcgga

SEQ ID NO: 1399296 - RNA, 19 nt, Pseudomonas aeruginosa PA01
ucgcccgaccccacgccgg

SEQ ID NO: 1399297 - RNA, 14 nt, Pseudomonas aeruginosa PA01
ucgcccggcucggc

SEQ ID NO: 1399298 - RNA, 16 nt, Pseudomonas aeruginosa PA01
ucgccgacuucggcaa

SEQ ID NO: 1399299 - RNA, 16 nt, Pseudomonas aeruginosa PA01
ucgccgacguccucca

SEQ ID NO: 1399300 - RNA, 18 nt, Pseudomonas aeruginosa PA01
ucgcccucgaagcccugc

SEQ ID NO: 1399301 - RNA, 15 nt, Pseudomonas aeruginosa PA01
ucgcccucagcagcg

SEQ ID NO: 1399302 - RNA, 23 nt, Pseudomonas aeruginosa PA01
ucgcccucgcuccaacgcaggcg

SEQ ID NO: 1399303 - RNA, 17 nt, Pseudomonas aeruginosa PA01
ucgcccucggcgcuggc

SEQ ID NO: 1399304 - RNA, 14 nt, Pseudomonas aeruginosa PA01
ucgcagccggcggc

SEQ ID NO: 1399305 - RNA, 21 nt, Pseudomonas aeruginosa PA01
ucgcagccgguggucuucagc

SEQ ID NO: 1399306 - RNA, 21 nt, Pseudomonas aeruginosa PA01
ucgcagcaggccgcuggcgac

SEQ ID NO: 1399307 - RNA, 21 nt, Pseudomonas aeruginosa PA01
ucgcagcaggcguucggcgau

SEQ ID NO: 1399308 - RNA, 13 nt, Pseudomonas aeruginosa PA01
ucgcagacggggc

SEQ ID NO: 1399309 - RNA, 14 nt, Pseudomonas aeruginosa PA01
ucgcagagaucggc

SEQ ID NO: 1399310 - RNA, 13 nt, Pseudomonas aeruginosa PA01
ucgcagaugucgg

SEQ ID NO: 1399311 - RNA, 17 nt, Pseudomonas aeruginosa PA01
ucgcagccgagccccca

SEQ ID NO: 1399312 - RNA, 14 nt, Pseudomonas aeruginosa PA01
ucgcagcggccccg

SEQ ID NO: 1399313 - RNA, 16 nt, Pseudomonas aeruginosa PA01
ucgcagcggccguagc

SEQ ID NO: 1399314 - RNA, 12 nt, Pseudomonas aeruginosa PA01
ucgcaggccagg

SEQ ID NO: 1399315 - RNA, 16 nt, Pseudomonas aeruginosa PA01
ucgcaggccaggcccc

SEQ ID NO: 1399316 - RNA, 24 nt, Pseudomonas aeruginosa PA01
ucgcaggccaggccccagggccgg

SEQ ID NO: 1399317 - RNA, 14 nt, Pseudomonas aeruginosa PA01
ucgcaggccaggcg

SEQ ID NO: 1399318 - RNA, 18 nt, Pseudomonas aeruginosa PA01
ucgcaggccaggcgcagu

SEQ ID NO: 1399319 - RNA, 13 nt, Pseudomonas aeruginosa PA01
ucgcaggcgaugc

SEQ ID NO: 1399320 - RNA, 14 nt, Pseudomonas aeruginosa PA01
ucgcaggcgaugcc

SEQ ID NO: 1399321 - RNA, 16 nt, Pseudomonas aeruginosa PA01
ucgcagguaacccgcg

SEQ ID NO: 1399322 - RNA, 19 nt, Pseudomonas aeruginosa PA01
ucgcagguaacccgcggcg

SEQ ID NO: 1399323 - RNA, 20 nt, Pseudomonas aeruginosa PA01
ucgcagguaacccgcggcga

SEQ ID NO: 1399324 - RNA, 22 nt, Pseudomonas aeruginosa PA01
ucgcagguaacccgcggcgagg

SEQ ID NO: 1399325 - RNA, 18 nt, Pseudomonas aeruginosa PA01
ucgcaguacagcucggcg

SEQ ID NO: 1399326 - RNA, 22 nt, Pseudomonas aeruginosa PA01
ucgcaguacagcucggcgcccu

SEQ ID NO: 1399327 - RNA, 14 nt, Pseudomonas aeruginosa PA01
ucgcauagccggcg

SEQ ID NO: 1399328 - RNA, 15 nt, Pseudomonas aeruginosa PA01
ucgcauagccggcgc

SEQ ID NO: 1399329 - RNA, 16 nt, Pseudomonas aeruginosa PA01
ucgcauagccggcgcg

SEQ ID NO: 1399330 - RNA, 16 nt, Pseudomonas aeruginosa PA01
ucgcauaggcggccag

SEQ ID NO: 1399331 - RNA, 21 nt, Pseudomonas aeruginosa PA01
ucgcagucgcuuccgcgcggc

SEQ ID NO: 1399332 - RNA, 13 nt, Pseudomonas aeruginosa PA01
ucgcauccaccag

SEQ ID NO: 1399333 - RNA, 14 nt, Pseudomonas aeruginosa PA01
ucgcauccaccagc

SEQ ID NO: 1399334 - RNA, 15 nt, Pseudomonas aeruginosa PA01
ucgccaccccgccgc

SEQ ID NO: 1399335 - RNA, 17 nt, Pseudomonas aeruginosa PA01
ucgccaccccgccgcug

SEQ ID NO: 1399336 - RNA, 21 nt, Pseudomonas aeruginosa PA01
ucgccaccccgcuccgcucag

SEQ ID NO: 1399337 - RNA, 14 nt, Pseudomonas aeruginosa PA01
ucgccaagcccggc

SEQ ID NO: 1399338 - RNA, 16 nt, Pseudomonas aeruginosa PA01
ucgccaagcccggcga

SEQ ID NO: 1399339 - RNA, 18 nt, Pseudomonas aeruginosa PA01
ucgccaagcccggcgaga

SEQ ID NO: 1399340 - RNA, 23 nt, Pseudomonas aeruginosa PA01
ucgccaacgcgccgucgcgaccu

SEQ ID NO: 1399341 - RNA, 19 nt, Pseudomonas aeruginosa PA01
ucgccaacgccaccgcgcg

SEQ ID NO: 1399342 - RNA, 20 nt, Pseudomonas aeruginosa PA01
ucgccaacgccaccgcgcgc

SEQ ID NO: 1399343 - RNA, 21 nt, Pseudomonas aeruginosa PA01
ucgccacugauaccgcuggcc

SEQ ID NO: 1399344 - RNA, 23 nt, Pseudomonas aeruginosa PA01
ucgccacugauaccgcuggccag

SEQ ID NO: 1399345 - RNA, 21 nt, Pseudomonas aeruginosa PA01
ucgccagaugacgauggccgc

SEQ ID NO: 1399346 - RNA, 22 nt, Pseudomonas aeruginosa PA01
ucgccagaugacgauggccgcc

SEQ ID NO: 1399347 - RNA, 17 nt, Pseudomonas aeruginosa PA01
ucgccacgccggcgcuc

SEQ ID NO: 1399348 - RNA, 14 nt, Pseudomonas aeruginosa PA01
ucgccacgcugcug

SEQ ID NO: 1399349 - RNA, 19 nt, Pseudomonas aeruginosa PA01
ucgccaccgggugcagguu

SEQ ID NO: 1399350 - RNA, 18 nt, Pseudomonas aeruginosa PA01
ucgccacgaucaugguga

SEQ ID NO: 1399351 - RNA, 20 nt, Pseudomonas aeruginosa PA01
ucgccacgcaguucgcgggc

SEQ ID NO: 1399352 - RNA, 21 nt, Pseudomonas aeruginosa PA01
ucgccacgcaguucgcgggcc

SEQ ID NO: 1399353 - RNA, 13 nt, Pseudomonas aeruginosa PA01
ucgccacgcccgc

SEQ ID NO: 1399354 - RNA, 14 nt, Pseudomonas aeruginosa PA01
ucgccaccgcggau

SEQ ID NO: 1399355 - RNA, 15 nt, Pseudomonas aeruginosa PA01
ucgagacgccaucaa

SEQ ID NO: 1399356 - RNA, 22 nt, Pseudomonas aeruginosa PA01
ucgagacgccguagcgcaguuc

SEQ ID NO: 1399357 - RNA, 23 nt, Pseudomonas aeruginosa PA01
ucgagcaccccgagcccggccgg

SEQ ID NO: 1399358 - RNA, 15 nt, Pseudomonas aeruginosa PA01
ucgagcaacagcagg

SEQ ID NO: 1399359 - RNA, 15 nt, Pseudomonas aeruginosa PA01
ucgagcaccagcagg

SEQ ID NO: 1399360 - RNA, 19 nt, Pseudomonas aeruginosa PA01
ucgagcaccagcaggucgg

SEQ ID NO: 1399361 - RNA, 15 nt, Pseudomonas aeruginosa PA01
ucgagacccgcaaca

SEQ ID NO: 1399362 - RNA, 17 nt, Pseudomonas aeruginosa PA01
ucgagacccgcaacacc

SEQ ID NO: 1399363 - RNA, 15 nt, Pseudomonas aeruginosa PA01
ucgagaaagcgcagg

SEQ ID NO: 1399364 - RNA, 17 nt, Pseudomonas aeruginosa PA01
ucgagaaauaggcgcug

SEQ ID NO: 1399365 - RNA, 14 nt, Pseudomonas aeruginosa PA01
ucgacuucgucgaa

SEQ ID NO: 1399366 - RNA, 21 nt, Pseudomonas aeruginosa PA01
ucgacuucgucgaagaccagg

SEQ ID NO: 1399367 - RNA, 13 nt, Pseudomonas aeruginosa PA01
ucgacuucgacga

SEQ ID NO: 1399368 - RNA, 16 nt, Pseudomonas aeruginosa PA01
ucgacuucgcaccagc

SEQ ID NO: 1399369 - RNA, 17 nt, Pseudomonas aeruginosa PA01
ucgacuuccgccuuguc

SEQ ID NO: 1399370 - RNA, 14 nt, Pseudomonas aeruginosa PA01
ucgacgucgaucuu

SEQ ID NO: 1399371 - RNA, 22 nt, Pseudomonas aeruginosa PA01
ucgacgucauaggccuuggcga

SEQ ID NO: 1399372 - RNA, 18 nt, Pseudomonas aeruginosa PA01
ucgacucggugcguagcg

SEQ ID NO: 1399373 - RNA, 15 nt, Pseudomonas aeruginosa PA01
uccgggugccccagg

SEQ ID NO: 1399374 - RNA, 17 nt, Pseudomonas aeruginosa PA01
uccgggugccccaggcg

SEQ ID NO: 1399375 - RNA, 18 nt, Pseudomonas aeruginosa PA01
uccggguggagaggcgug

SEQ ID NO: 1399376 - RNA, 23 nt, Pseudomonas aeruginosa PA01
uccgggucggucacgaaggcgau

SEQ ID NO: 1399377 - RNA, 15 nt, Pseudomonas aeruginosa PA01
uccgggugaugcccg

SEQ ID NO: 1399378 - RNA, 23 nt, Pseudomonas aeruginosa PA01
uccggguuggcgcaggccgggcg

SEQ ID NO: 1399379 - RNA, 22 nt, Pseudomonas aeruginosa PA01
uccggguugacccagagccgcu

SEQ ID NO: 1399380 - RNA, 13 nt, Pseudomonas aeruginosa PA01
ucgacgcgcggcu

SEQ ID NO: 1399381 - RNA, 14 nt, Pseudomonas aeruginosa PA01
ucgacgcgcggcug

SEQ ID NO: 1399382 - RNA, 21 nt, Pseudomonas aeruginosa PA01
uccgguacccguacgcugcca

SEQ ID NO: 1399383 - RNA, 12 nt, Pseudomonas aeruginosa PA01
ucgacgcgccag

SEQ ID NO: 1399384 - RNA, 14 nt, Pseudomonas aeruginosa PA01
uccggcucagccgc

SEQ ID NO: 1399385 - RNA, 13 nt, Pseudomonas aeruginosa PA01
uccgggcguaggg

SEQ ID NO: 1399386 - RNA, 21 nt, Pseudomonas aeruginosa PA01
uccgggcggaggcgaggucgc

SEQ ID NO: 1399387 - RNA, 17 nt, Pseudomonas aeruginosa PA01
uccgggucauuggcgaa

SEQ ID NO: 1399388 - RNA, 14 nt, Pseudomonas aeruginosa PA01
uccggggcccggca

SEQ ID NO: 1399389 - RNA, 21 nt, Pseudomonas aeruginosa PA01
uccggggacgcugucccggcc

SEQ ID NO: 1399390 - RNA, 22 nt, Pseudomonas aeruginosa PA01
uccggggacgcugucccggcca

SEQ ID NO: 1399391 - RNA, 17 nt, Pseudomonas aeruginosa PA01
uccgggcuggccaccag

SEQ ID NO: 1399392 - RNA, 14 nt, Pseudomonas aeruginosa PA01
ucgacggcaccagc

SEQ ID NO: 1399393 - RNA, 13 nt, Pseudomonas aeruginosa PA01
ucgacggcgaucu

SEQ ID NO: 1399394 - RNA, 15 nt, Pseudomonas aeruginosa PA01
ucgacgcucagcacc

SEQ ID NO: 1399395 - RNA, 17 nt, Pseudomonas aeruginosa PA01
ucgacggauacgccagg

SEQ ID NO: 1399396 - RNA, 21 nt, Pseudomonas aeruginosa PA01
ucgacgcugcccagcccgccu

SEQ ID NO: 1399397 - RNA, 20 nt, Pseudomonas aeruginosa PA01
ucgacgcugcuaggcuggaa

SEQ ID NO: 1399398 - RNA, 14 nt, Pseudomonas aeruginosa PA01
ucgacguaggcggc

SEQ ID NO: 1399399 - RNA, 17 nt, Pseudomonas aeruginosa PA01
ucgacguaggcggcgaa

SEQ ID NO: 1399400 - RNA, 20 nt, Pseudomonas aeruginosa PA01
ucgacguaggcggcgaaggc

SEQ ID NO: 1399401 - RNA, 18 nt, Pseudomonas aeruginosa PA01
ucgacguaggcggcgagg

SEQ ID NO: 1399402 - RNA, 16 nt, Pseudomonas aeruginosa PA01
ucgacguaccgccugc

SEQ ID NO: 1399403 - RNA, 17 nt, Pseudomonas aeruginosa PA01
ucgacguaccgccugcc

SEQ ID NO: 1399404 - RNA, 15 nt, Pseudomonas aeruginosa PA01
ucgacgguucgcgaa

SEQ ID NO: 1399405 - RNA, 16 nt, Pseudomonas aeruginosa PA01
ucgacggcuuccaggg

SEQ ID NO: 1399406 - RNA, 15 nt, Pseudomonas aeruginosa PA01
ucgacggcgugcagg

SEQ ID NO: 1399407 - RNA, 22 nt, Pseudomonas aeruginosa PA01
ucgacgguauguuucuggccgu

SEQ ID NO: 1399408 - RNA, 20 nt, Pseudomonas aeruginosa PA01
ucgagcaguucccccagcac

SEQ ID NO: 1399409 - RNA, 17 nt, Pseudomonas aeruginosa PA01
ucgagcaguuccggcac

SEQ ID NO: 1399410 - RNA, 14 nt, Pseudomonas aeruginosa PA01
ucgagcaguuccag

SEQ ID NO: 1399411 - RNA, 20 nt, Pseudomonas aeruginosa PA01
ucgagccaggcguauucggc

SEQ ID NO: 1399412 - RNA, 18 nt, Pseudomonas aeruginosa PA01
ucgagccagcccagcggc

SEQ ID NO: 1399413 - RNA, 19 nt, Pseudomonas aeruginosa PA01
ucgagccagcccagcggcg

SEQ ID NO: 1399414 - RNA, 14 nt, Pseudomonas aeruginosa PA01
ucgagcgcagcgac

SEQ ID NO: 1399415 - RNA, 12 nt, Pseudomonas aeruginosa PA01
ucgagcgccagg

SEQ ID NO: 1399416 - RNA, 20 nt, Pseudomonas aeruginosa PA01
ucgagcgccaggaacgccuc

SEQ ID NO: 1399417 - RNA, 16 nt, Pseudomonas aeruginosa PA01
ucgagccuugcggcgc

SEQ ID NO: 1399418 - RNA, 13 nt, Pseudomonas aeruginosa PA01
ucgagcgcgccca

SEQ ID NO: 1399419 - RNA, 21 nt, Pseudomonas aeruginosa PA01
ucgagcaccgcggucuucccg

SEQ ID NO: 1399420 - RNA, 13 nt, Pseudomonas aeruginosa PA01
ucgagcacggcgc

SEQ ID NO: 1399421 - RNA, 22 nt, Pseudomonas aeruginosa PA01
ucgagcagggagaaccaggcgg

SEQ ID NO: 1399422 - RNA, 20 nt, Pseudomonas aeruginosa PA01
ucgagcagaguuuagccgcc

SEQ ID NO: 1399423 - RNA, 21 nt, Pseudomonas aeruginosa PA01
ucgagcagaguuuagccgcca

SEQ ID NO: 1399424 - RNA, 22 nt, Pseudomonas aeruginosa PA01
ucgagcagaguuuagccgccag

SEQ ID NO: 1399425 - RNA, 13 nt, Pseudomonas aeruginosa PA01
ucgagcagcgccg

SEQ ID NO: 1399426 - RNA, 15 nt, Pseudomonas aeruginosa PA01
ucgagcagcgccgcg

SEQ ID NO: 1399427 - RNA, 16 nt, Pseudomonas aeruginosa PA01
ucgagcagcggcgcca

SEQ ID NO: 1399428 - RNA, 21 nt, Pseudomonas aeruginosa PA01
ucgagcagcucguucgcccag

SEQ ID NO: 1399429 - RNA, 16 nt, Pseudomonas aeruginosa PA01
ucgagguagguccagg

SEQ ID NO: 1399430 - RNA, 18 nt, Pseudomonas aeruginosa PA01
ucgagguagguccaggcg

SEQ ID NO: 1399431 - RNA, 21 nt, Pseudomonas aeruginosa PA01
ucgagguagguccaggcgacg

SEQ ID NO: 1399432 - RNA, 23 nt, Pseudomonas aeruginosa PA01
ucgagggcguccuugcccggcgc

SEQ ID NO: 1399433 - RNA, 21 nt, Pseudomonas aeruginosa PA01
ucgagguauugcgcguggcgu

SEQ ID NO: 1399434 - RNA, 23 nt, Pseudomonas aeruginosa PA01
ucgaguagguccaggcgucggcg

SEQ ID NO: 1399435 - RNA, 15 nt, Pseudomonas aeruginosa PA01
ucgagguugcgcggc

SEQ ID NO: 1399436 - RNA, 14 nt, Pseudomonas aeruginosa PA01
ucgaggucgacggc

SEQ ID NO: 1399437 - RNA, 19 nt, Pseudomonas aeruginosa PA01
ucgaggucgagguccacgu

SEQ ID NO: 1399438 - RNA, 21 nt, Pseudomonas aeruginosa PA01
ucgagguucuccacuuccacu

SEQ ID NO: 1399439 - RNA, 21 nt, Pseudomonas aeruginosa PA01
ucgagggcgaacagcagcggu

SEQ ID NO: 1399440 - RNA, 18 nt, Pseudomonas aeruginosa PA01
ucgagggcgaccgccagg

SEQ ID NO: 1399441 - RNA, 21 nt, Pseudomonas aeruginosa PA01
ucgaggguggcgccgagcagc

SEQ ID NO: 1399442 - RNA, 20 nt, Pseudomonas aeruginosa PA01
ucgagggugguuuccaggcu

SEQ ID NO: 1399443 - RNA, 22 nt, Pseudomonas aeruginosa PA01
ucgagggugguuuccaggcuca

SEQ ID NO: 1399444 - RNA, 17 nt, Pseudomonas aeruginosa PA01
ucgaggguugucaccgg

SEQ ID NO: 1399445 - RNA, 21 nt, Pseudomonas aeruginosa PA01
ucgaggguugucaccggcagg

SEQ ID NO: 1399446 - RNA, 14 nt, Pseudomonas aeruginosa PA01
ucgaggcgccgacc

SEQ ID NO: 1399447 - RNA, 16 nt, Pseudomonas aeruginosa PA01
ucgaggcgccgaccac

SEQ ID NO: 1399448 - RNA, 15 nt, Pseudomonas aeruginosa PA01
ucgaggccgagccgg

SEQ ID NO: 1399449 - RNA, 13 nt, Pseudomonas aeruginosa PA01
ucgaggccgccca

SEQ ID NO: 1399450 - RNA, 18 nt, Pseudomonas aeruginosa PA01
ucgaggcccucggcggcg

SEQ ID NO: 1399451 - RNA, 12 nt, Pseudomonas aeruginosa PA01
ucgagcucggcc

SEQ ID NO: 1399452 - RNA, 14 nt, Pseudomonas aeruginosa PA01
ucgagcucggccag

SEQ ID NO: 1399453 - RNA, 17 nt, Pseudomonas aeruginosa PA01
ucgagcucggccaggca

SEQ ID NO: 1399454 - RNA, 18 nt, Pseudomonas aeruginosa PA01
ucgagcucggccaggcac

SEQ ID NO: 1399455 - RNA, 17 nt, Pseudomonas aeruginosa PA01
ucgagcuggacgcgcuu

SEQ ID NO: 1399456 - RNA, 20 nt, Pseudomonas aeruginosa PA01
ucgagcgggcggucgucgcc

SEQ ID NO: 1399457 - RNA, 15 nt, Pseudomonas aeruginosa PA01
ucgaggaccgacggc

SEQ ID NO: 1399458 - RNA, 20 nt, Pseudomonas aeruginosa PA01
ucgaggaacaggucgacgcc

SEQ ID NO: 1399459 - RNA, 20 nt, Pseudomonas aeruginosa PA01
ucgaggaacaggucgacggc

SEQ ID NO: 1399460 - RNA, 19 nt, Pseudomonas aeruginosa PA01
ucgagcuguccaucucgcc

SEQ ID NO: 1399461 - RNA, 23 nt, Pseudomonas aeruginosa PA01
ucgagcuguccaucucgccgcgc

SEQ ID NO: 1399462 - RNA, 19 nt, Pseudomonas aeruginosa PA01
ucgaggaucuugcgcccgg

SEQ ID NO: 1399463 - RNA, 20 nt, Pseudomonas aeruginosa PA01
ucgaggaucuugcgcccggc

SEQ ID NO: 1399464 - RNA, 21 nt, Pseudomonas aeruginosa PA01
ucgaggaucuugcgcccggcg

SEQ ID NO: 1399465 - RNA, 22 nt, Pseudomonas aeruginosa PA01
ucgaggauguacagggucuugc

SEQ ID NO: 1399466 - RNA, 20 nt, Pseudomonas aeruginosa PA01
ucgaggauguaguagacguc

SEQ ID NO: 1399467 - RNA, 19 nt, Pseudomonas aeruginosa PA01
ucgaggcaaucugcccggc

SEQ ID NO: 1399468 - RNA, 15 nt, Pseudomonas aeruginosa PA01
ucgaucagccggcgc

SEQ ID NO: 1399469 - RNA, 17 nt, Pseudomonas aeruginosa PA01
ucgaucagcagcgccac

SEQ ID NO: 1399470 - RNA, 17 nt, Pseudomonas aeruginosa PA01
ucgaucagccguugaag

SEQ ID NO: 1399471 - RNA, 15 nt, Pseudomonas aeruginosa PA01
ucgaucagcgcggcc

SEQ ID NO: 1399472 - RNA, 20 nt, Pseudomonas aeruginosa PA01
ucgaucagcgagcuucgccg

SEQ ID NO: 1399473 - RNA, 21 nt, Pseudomonas aeruginosa PA01
ucgaucagcgagcuucgccgc

SEQ ID NO: 1399474 - RNA, 14 nt, Pseudomonas aeruginosa PA01
ucgaucaccgcgga

SEQ ID NO: 1399475 - RNA, 20 nt, Pseudomonas aeruginosa PA01
ucgauauccagcggcagccc

SEQ ID NO: 1399476 - RNA, 21 nt, Pseudomonas aeruginosa PA01
ucgaucaauugccgguagccg

SEQ ID NO: 1399477 - RNA, 18 nt, Pseudomonas aeruginosa PA01
ucgaggcugucgcggacc

SEQ ID NO: 1399478 - RNA, 20 nt, Pseudomonas aeruginosa PA01
ucgaguaccgcugcggccgg

SEQ ID NO: 1399479 - RNA, 13 nt, Pseudomonas aeruginosa PA01
ucgagucgccggc

SEQ ID NO: 1399480 - RNA, 16 nt, Pseudomonas aeruginosa PA01
ucgagucgccggcgaa

SEQ ID NO: 1399481 - RNA, 13 nt, Pseudomonas aeruginosa PA01
ucgagucgcgcag

SEQ ID NO: 1399482 - RNA, 14 nt, Pseudomonas aeruginosa PA01
ucgauaccagcgcc

SEQ ID NO: 1399483 - RNA, 20 nt, Pseudomonas aeruginosa PA01
ucgauaacaccaggagcgcc

SEQ ID NO: 1399484 - RNA, 17 nt, Pseudomonas aeruginosa PA01
ucgaucuggcugcccag

SEQ ID NO: 1399485 - RNA, 22 nt, Pseudomonas aeruginosa PA01
ucgaucuucgaguagguccagg

SEQ ID NO: 1399486 - RNA, 17 nt, Pseudomonas aeruginosa PA01
ucgaugaaacgcagggc

SEQ ID NO: 1399487 - RNA, 21 nt, Pseudomonas aeruginosa PA01
ucgaugaaauagcucugccga

SEQ ID NO: 1399488 - RNA, 14 nt, Pseudomonas aeruginosa PA01
ucgaucucguagcg

SEQ ID NO: 1399489 - RNA, 15 nt, Pseudomonas aeruginosa PA01
ucgaucucgucggcg

SEQ ID NO: 1399490 - RNA, 18 nt, Pseudomonas aeruginosa PA01
ucgaucuccuccucggcg

SEQ ID NO: 1399491 - RNA, 14 nt, Pseudomonas aeruginosa PA01
ucgaucuccucgcg

SEQ ID NO: 1399492 - RNA, 16 nt, Pseudomonas aeruginosa PA01
ucgaucuccucgcgca

SEQ ID NO: 1399493 - RNA, 20 nt, Pseudomonas aeruginosa PA01
ucgaugacgaggcccgccca

SEQ ID NO: 1399494 - RNA, 22 nt, Pseudomonas aeruginosa PA01
ucgaugacgccauccuucggcg

SEQ ID NO: 1399495 - RNA, 17 nt, Pseudomonas aeruginosa PA01
ucgaugaccuugccgcg

SEQ ID NO: 1399496 - RNA, 18 nt, Pseudomonas aeruginosa PA01
ucgaugaccuugccgcga

SEQ ID NO: 1399497 - RNA, 14 nt, Pseudomonas aeruginosa PA01
ucgaugaucgacug

SEQ ID NO: 1399498 - RNA, 13 nt, Pseudomonas aeruginosa PA01
ucgaugaucccga

SEQ ID NO: 1399499 - RNA, 20 nt, Pseudomonas aeruginosa PA01
ucgaugauccgcucgauccc

SEQ ID NO: 1399500 - RNA, 17 nt, Pseudomonas aeruginosa PA01
ucgaugagcaugccgca

SEQ ID NO: 1399501 - RNA, 19 nt, Pseudomonas aeruginosa PA01
ucgaugagcaugccgcaga

SEQ ID NO: 1399502 - RNA, 17 nt, Pseudomonas aeruginosa PA01
ucgaugaguugcagggc

SEQ ID NO: 1399503 - RNA, 14 nt, Pseudomonas aeruginosa PA01
ucgauccgcgccug

SEQ ID NO: 1399504 - RNA, 15 nt, Pseudomonas aeruginosa PA01
ucgauccgcugggcc

SEQ ID NO: 1399505 - RNA, 14 nt, Pseudomonas aeruginosa PA01
ucgauccagccggc

SEQ ID NO: 1399506 - RNA, 17 nt, Pseudomonas aeruginosa PA01
ucgauccccaacccggc

SEQ ID NO: 1399507 - RNA, 18 nt, Pseudomonas aeruginosa PA01
ucgauccccaacccggcc

SEQ ID NO: 1399508 - RNA, 21 nt, Pseudomonas aeruginosa PA01
ucgauccccaacccggccagc

SEQ ID NO: 1399509 - RNA, 19 nt, Pseudomonas aeruginosa PA01
ucgaucacccgcgaggccg

SEQ ID NO: 1399510 - RNA, 21 nt, Pseudomonas aeruginosa PA01
ucgaucagugcaucggccgcc

SEQ ID NO: 1399511 - RNA, 21 nt, Pseudomonas aeruginosa PA01
ucgaucaggaacacccggucc

SEQ ID NO: 1399512 - RNA, 20 nt, Pseudomonas aeruginosa PA01
ucgaucaggcgcaugcccag

SEQ ID NO: 1399513 - RNA, 23 nt, Pseudomonas aeruginosa PA01
ucgaucaggcgcaugcccagggc

SEQ ID NO: 1399514 - RNA, 14 nt, Pseudomonas aeruginosa PA01
ucgaucaggucgcc

SEQ ID NO: 1399515 - RNA, 16 nt, Pseudomonas aeruginosa PA01
ucgaucaggucgccgc

SEQ ID NO: 1399516 - RNA, 16 nt, Pseudomonas aeruginosa PA01
ucgaucggcccgggcg

SEQ ID NO: 1399517 - RNA, 14 nt, Pseudomonas aeruginosa PA01
ucgaucggcagggc

SEQ ID NO: 1399518 - RNA, 18 nt, Pseudomonas aeruginosa PA01
ucgauccugaccccggcc

SEQ ID NO: 1399519 - RNA, 16 nt, Pseudomonas aeruginosa PA01
ucgaucgagucgccga

SEQ ID NO: 1399520 - RNA, 13 nt, Pseudomonas aeruginosa PA01
ucgcaaccggccu

SEQ ID NO: 1399521 - RNA, 15 nt, Pseudomonas aeruginosa PA01
ucgcaaaggucggcg

SEQ ID NO: 1399522 - RNA, 17 nt, Pseudomonas aeruginosa PA01
ucgcaaaggucggcgaa

SEQ ID NO: 1399523 - RNA, 16 nt, Pseudomonas aeruginosa PA01
ucgcaaagcucgcgca

SEQ ID NO: 1399524 - RNA, 13 nt, Pseudomonas aeruginosa PA01
ucgcaccgccagc

SEQ ID NO: 1399525 - RNA, 14 nt, Pseudomonas aeruginosa PA01
ucgcaccgccagca

SEQ ID NO: 1399526 - RNA, 15 nt, Pseudomonas aeruginosa PA01
ucgcaccgccagcag

SEQ ID NO: 1399527 - RNA, 20 nt, Pseudomonas aeruginosa PA01
ucgcaccagccuuccggcac

SEQ ID NO: 1399528 - RNA, 14 nt, Pseudomonas aeruginosa PA01
ucgcaccaggccag

SEQ ID NO: 1399529 - RNA, 23 nt, Pseudomonas aeruginosa PA01
ucgcaccugggacucccgcagau

SEQ ID NO: 1399530 - RNA, 21 nt, Pseudomonas aeruginosa PA01
ucgcacccggcccauggcgac

SEQ ID NO: 1399531 - RNA, 17 nt, Pseudomonas aeruginosa PA01
ucgcacggucguccugc

SEQ ID NO: 1399532 - RNA, 14 nt, Pseudomonas aeruginosa PA01
ucgcacgcagcgcc

SEQ ID NO: 1399533 - RNA, 17 nt, Pseudomonas aeruginosa PA01
ucgcacgcagcgccgcg

SEQ ID NO: 1399534 - RNA, 21 nt, Pseudomonas aeruginosa PA01
ucgaugggcgagcgacgguga

SEQ ID NO: 1399535 - RNA, 12 nt, Pseudomonas aeruginosa PA01
ucgauggcugga

SEQ ID NO: 1399536 - RNA, 22 nt, Pseudomonas aeruginosa PA01
ucgaugggcaggauaucgccca

SEQ ID NO: 1399537 - RNA, 18 nt, Pseudomonas aeruginosa PA01
ucgauggucuugauccca

SEQ ID NO: 1399538 - RNA, 22 nt, Pseudomonas aeruginosa PA01
ucgauggugacguugcgccgca

SEQ ID NO: 1399539 - RNA, 22 nt, Pseudomonas aeruginosa PA01
ucgauggcgaagcgcuugccca

SEQ ID NO: 1399540 - RNA, 15 nt, Pseudomonas aeruginosa PA01
ucgauggcggccgcc

SEQ ID NO: 1399541 - RNA, 19 nt, Pseudomonas aeruginosa PA01
ucgauguccugggccaccu

SEQ ID NO: 1399542 - RNA, 24 nt, Pseudomonas aeruginosa PA01
ucgaugucgaacaacccgccagca

SEQ ID NO: 1399543 - RNA, 14 nt, Pseudomonas aeruginosa PA01
ucgaugucgcggcc

SEQ ID NO: 1399544 - RNA, 15 nt, Pseudomonas aeruginosa PA01
ucgaugucgcggcgc

SEQ ID NO: 1399545 - RNA, 19 nt, Pseudomonas aeruginosa PA01
ucgauguuuccgacccgga

SEQ ID NO: 1399546 - RNA, 18 nt, Pseudomonas aeruginosa PA01
ucgaugcccgccagcagg

SEQ ID NO: 1399547 - RNA, 17 nt, Pseudomonas aeruginosa PA01
ucgaugcccgccucgcg

SEQ ID NO: 1399548 - RNA, 14 nt, Pseudomonas aeruginosa PA01
ucgaugccgcgcgc

SEQ ID NO: 1399549 - RNA, 17 nt, Pseudomonas aeruginosa PA01
ucgaugcccucgcggcg

SEQ ID NO: 1399550 - RNA, 18 nt, Pseudomonas aeruginosa PA01
ucgaugcccucgcggcgg

SEQ ID NO: 1399551 - RNA, 20 nt, Pseudomonas aeruginosa PA01
ucgaugccuucggcggccgg

SEQ ID NO: 1399552 - RNA, 15 nt, Pseudomonas aeruginosa PA01
ucgaugcugccguag

SEQ ID NO: 1399553 - RNA, 20 nt, Pseudomonas aeruginosa PA01
ucgaugcuccaaugcaccug

SEQ ID NO: 1399554 - RNA, 20 nt, Pseudomonas aeruginosa PA01
ucgaugccuugcggccccca

SEQ ID NO: 1399555 - RNA, 13 nt, Pseudomonas aeruginosa PA01
ucgaugcgcgcgg

SEQ ID NO: 1399556 - RNA, 19 nt, Pseudomonas aeruginosa PA01
ugccggacaacaggccggg

SEQ ID NO: 1399557 - RNA, 21 nt, Pseudomonas aeruginosa PA01
ugccggacaacaggccgggcg

SEQ ID NO: 1399558 - RNA, 16 nt, Pseudomonas aeruginosa PA01
ugccggagaacgccgc

SEQ ID NO: 1399559 - RNA, 15 nt, Pseudomonas aeruginosa PA01
ugccggagagcagca

SEQ ID NO: 1399560 - RNA, 18 nt, Pseudomonas aeruginosa PA01
ugccggagacgauggcga

SEQ ID NO: 1399561 - RNA, 15 nt, Pseudomonas aeruginosa PA01
ugccgcuggccgacc

SEQ ID NO: 1399562 - RNA, 13 nt, Pseudomonas aeruginosa PA01
ugccgcuggcggc

SEQ ID NO: 1399563 - RNA, 21 nt, Pseudomonas aeruginosa PA01
ugccgcuggcggccuucggcg

SEQ ID NO: 1399564 - RNA, 18 nt, Pseudomonas aeruginosa PA01
ugccgcuucggcugcugc

SEQ ID NO: 1399565 - RNA, 17 nt, Pseudomonas aeruginosa PA01
ugccgcuggugaucgac

SEQ ID NO: 1399566 - RNA, 21 nt, Pseudomonas aeruginosa PA01
ugccgcuggugaucgaccaca

SEQ ID NO: 1399567 - RNA, 17 nt, Pseudomonas aeruginosa PA01
ugccgcuguuggcguga

SEQ ID NO: 1399568 - RNA, 17 nt, Pseudomonas aeruginosa PA01
ugccggaaagccuggcc

SEQ ID NO: 1399569 - RNA, 20 nt, Pseudomonas aeruginosa PA01
ugccggaaagccuggccggc

SEQ ID NO: 1399570 - RNA, 21 nt, Pseudomonas aeruginosa PA01
ugccggaaagccuggccggcg

SEQ ID NO: 1399571 - RNA, 14 nt, Pseudomonas aeruginosa PA01
ugccgcugcacgcc

SEQ ID NO: 1399572 - RNA, 17 nt, Pseudomonas aeruginosa PA01
ugccgcugcaggccacc

SEQ ID NO: 1399573 - RNA, 19 nt, Pseudomonas aeruginosa PA01
ugccgcugcaggccaccgg

SEQ ID NO: 1399574 - RNA, 13 nt, Pseudomonas aeruginosa PA01
ugccgcucuggcu

SEQ ID NO: 1399575 - RNA, 20 nt, Pseudomonas aeruginosa PA01
ugccgcucuggcugcuggcg

SEQ ID NO: 1399576 - RNA, 21 nt, Pseudomonas aeruginosa PA01
ugccgcucuggcugcuggcga

SEQ ID NO: 1399577 - RNA, 13 nt, Pseudomonas aeruginosa PA01
ugccgccucagcg

SEQ ID NO: 1399578 - RNA, 17 nt, Pseudomonas aeruginosa PA01
ugccgcuaucgcuggcg

SEQ ID NO: 1399579 - RNA, 20 nt, Pseudomonas aeruginosa PA01
ugccgcuaucgcuggcgcag

SEQ ID NO: 1399580 - RNA, 15 nt, Pseudomonas aeruginosa PA01
ugccgcuagcccugc

SEQ ID NO: 1399581 - RNA, 12 nt, Pseudomonas aeruginosa PA01
ugccgccggggg

SEQ ID NO: 1399582 - RNA, 22 nt, Pseudomonas aeruginosa PA01
ugccgccgggcaucaugccgag

SEQ ID NO: 1399583 - RNA, 22 nt, Pseudomonas aeruginosa PA01
ugccgccgguucgcaggccagg

SEQ ID NO: 1399584 - RNA, 15 nt, Pseudomonas aeruginosa PA01
ugccgccgucgcggc

SEQ ID NO: 1399585 - RNA, 19 nt, Pseudomonas aeruginosa PA01
ugccgccgucgcggccauc

SEQ ID NO: 1399586 - RNA, 12 nt, Pseudomonas aeruginosa PA01
ugccggcgcaga

SEQ ID NO: 1399587 - RNA, 21 nt, Pseudomonas aeruginosa PA01
ugccggcgcagaucgcggcgc

SEQ ID NO: 1399588 - RNA, 11 nt, Pseudomonas aeruginosa PA01
ugccggcgcca

SEQ ID NO: 1399589 - RNA, 21 nt, Pseudomonas aeruginosa PA01
ugccggcgccaucgaucagca

SEQ ID NO: 1399590 - RNA, 13 nt, Pseudomonas aeruginosa PA01
ugccggcgaugau

SEQ ID NO: 1399591 - RNA, 12 nt, Pseudomonas aeruginosa PA01
ugccggcgcugu

SEQ ID NO: 1399592 - RNA, 22 nt, Pseudomonas aeruginosa PA01
ugccggcgcugucucgccagcc

SEQ ID NO: 1399593 - RNA, 23 nt, Pseudomonas aeruginosa PA01
ugccggcgcgcacggaggcgcuc

SEQ ID NO: 1399594 - RNA, 17 nt, Pseudomonas aeruginosa PA01
ugccggcgcgucgcugc

SEQ ID NO: 1399595 - RNA, 20 nt, Pseudomonas aeruginosa PA01
ugccggcgcgucgcugcgca

SEQ ID NO: 1399596 - RNA, 12 nt, Pseudomonas aeruginosa PA01
ugccggccggca

SEQ ID NO: 1399597 - RNA, 15 nt, Pseudomonas aeruginosa PA01
ugccggccggcagcg

SEQ ID NO: 1399598 - RNA, 17 nt, Pseudomonas aeruginosa PA01
ugccggccggcagcgag

SEQ ID NO: 1399599 - RNA, 17 nt, Pseudomonas aeruginosa PA01
ugccggccgucgcgcac

SEQ ID NO: 1399600 - RNA, 21 nt, Pseudomonas aeruginosa PA01
ugccggccgucgcgcaccacc

SEQ ID NO: 1399601 - RNA, 15 nt, Pseudomonas aeruginosa PA01
ugccggccucgagga

SEQ ID NO: 1399602 - RNA, 22 nt, Pseudomonas aeruginosa PA01
ugccggccggggccggcacccg

SEQ ID NO: 1399603 - RNA, 14 nt, Pseudomonas aeruginosa PA01
ugccggccgccagc

SEQ ID NO: 1399604 - RNA, 22 nt, Pseudomonas aeruginosa PA01
ugccggccgccagcagguagac

SEQ ID NO: 1399605 - RNA, 19 nt, Pseudomonas aeruginosa PA01
ugccggccagggucgccag

SEQ ID NO: 1399606 - RNA, 22 nt, Pseudomonas aeruginosa PA01
ugccggccaugcaggccagggc

SEQ ID NO: 1399607 - RNA, 14 nt, Pseudomonas aeruginosa PA01
ugccggccaccauc

SEQ ID NO: 1399608 - RNA, 18 nt, Pseudomonas aeruginosa PA01
ugccggcacgcucaggcg

SEQ ID NO: 1399609 - RNA, 14 nt, Pseudomonas aeruginosa PA01
ugccggcagcgacc

SEQ ID NO: 1399610 - RNA, 17 nt, Pseudomonas aeruginosa PA01
ugccggagucucgggaa

SEQ ID NO: 1399611 - RNA, 17 nt, Pseudomonas aeruginosa PA01
ugccggagugccgcgga

SEQ ID NO: 1399612 - RNA, 21 nt, Pseudomonas aeruginosa PA01
ugccgcagcgccucccgggcc

SEQ ID NO: 1399613 - RNA, 15 nt, Pseudomonas aeruginosa PA01
ugccgcccuccauca

SEQ ID NO: 1399614 - RNA, 21 nt, Pseudomonas aeruginosa PA01
ugccgcccuccaucagcgccu

SEQ ID NO: 1399615 - RNA, 22 nt, Pseudomonas aeruginosa PA01
ugccgcccggucuagcgccccg

SEQ ID NO: 1399616 - RNA, 16 nt, Pseudomonas aeruginosa PA01
ugccgcccggccaggc

SEQ ID NO: 1399617 - RNA, 13 nt, Pseudomonas aeruginosa PA01
ugccgcccugggg

SEQ ID NO: 1399618 - RNA, 18 nt, Pseudomonas aeruginosa PA01
ugccgcccuugccauccu

SEQ ID NO: 1399619 - RNA, 19 nt, Pseudomonas aeruginosa PA01
ugccgccgaccucggccgc

SEQ ID NO: 1399620 - RNA, 19 nt, Pseudomonas aeruginosa PA01
ugccgcaagcuccccgccg

SEQ ID NO: 1399621 - RNA, 19 nt, Pseudomonas aeruginosa PA01
ugccgcaccccauccucgc

SEQ ID NO: 1399622 - RNA, 22 nt, Pseudomonas aeruginosa PA01
ugccgcaccccauccucgccgg

SEQ ID NO: 1399623 - RNA, 12 nt, Pseudomonas aeruginosa PA01
ugccgcaccgcc

SEQ ID NO: 1399624 - RNA, 18 nt, Pseudomonas aeruginosa PA01
ugccgcacaggcuggcca

SEQ ID NO: 1399625 - RNA, 21 nt, Pseudomonas aeruginosa PA01
ugccgcacaguugcgcgccgg

SEQ ID NO: 1399626 - RNA, 14 nt, Pseudomonas aeruginosa PA01
ugccgcagagcauc

SEQ ID NO: 1399627 - RNA, 16 nt, Pseudomonas aeruginosa PA01
ugccgcagcagcggcg

SEQ ID NO: 1399628 - RNA, 18 nt, Pseudomonas aeruginosa PA01
ugccgcagacaucgccga

SEQ ID NO: 1399629 - RNA, 20 nt, Pseudomonas aeruginosa PA01
ugccgcagacaucgccgagg

SEQ ID NO: 1399630 - RNA, 22 nt, Pseudomonas aeruginosa PA01
ugccgcagacaucgccgagggc

SEQ ID NO: 1399631 - RNA, 15 nt, Pseudomonas aeruginosa PA01
ugccgcacggugcgc

SEQ ID NO: 1399632 - RNA, 15 nt, Pseudomonas aeruginosa PA01
ugccgcaaacccccu

SEQ ID NO: 1399633 - RNA, 17 nt, Pseudomonas aeruginosa PA01
ugccgcaaacccccugc

SEQ ID NO: 1399634 - RNA, 22 nt, Pseudomonas aeruginosa PA01
ugccgcaaacccccugcgcgga

SEQ ID NO: 1399635 - RNA, 18 nt, Pseudomonas aeruginosa PA01
ugccgaucaccgccacua

SEQ ID NO: 1399636 - RNA, 16 nt, Pseudomonas aeruginosa PA01
ugccgaugucgccggc

SEQ ID NO: 1399637 - RNA, 20 nt, Pseudomonas aeruginosa PA01
ugccgaugucgccggcaugg

SEQ ID NO: 1399638 - RNA, 12 nt, Pseudomonas aeruginosa PA01
ugccgaggcggc

SEQ ID NO: 1399639 - RNA, 23 nt, Pseudomonas aeruginosa PA01
ugccgaggcggccguagccgucg

SEQ ID NO: 1399640 - RNA, 16 nt, Pseudomonas aeruginosa PA01
ugccgagguguagaaa

SEQ ID NO: 1399641 - RNA, 19 nt, Pseudomonas aeruginosa PA01
ugccgagcgaaaucggcag

SEQ ID NO: 1399642 - RNA, 20 nt, Pseudomonas aeruginosa PA01
ugccgagcgaaaucggcagg

SEQ ID NO: 1399643 - RNA, 15 nt, Pseudomonas aeruginosa PA01
ugccgaggaacucgc

SEQ ID NO: 1399644 - RNA, 19 nt, Pseudomonas aeruginosa PA01
ugccgaggaagucggcggc

SEQ ID NO: 1399645 - RNA, 21 nt, Pseudomonas aeruginosa PA01
ugccgaggaagucggcggccg

SEQ ID NO: 1399646 - RNA, 20 nt, Pseudomonas aeruginosa PA01
ugccgagcgcgaucagccgc

SEQ ID NO: 1399647 - RNA, 22 nt, Pseudomonas aeruginosa PA01
ugccgagcgcgaucagccgcuc

SEQ ID NO: 1399648 - RNA, 18 nt, Pseudomonas aeruginosa PA01
ugccgagcugggcguugc

SEQ ID NO: 1399649 - RNA, 14 nt, Pseudomonas aeruginosa PA01
ugccgaggccgagg

SEQ ID NO: 1399650 - RNA, 13 nt, Pseudomonas aeruginosa PA01
ugccgaggccgcc

SEQ ID NO: 1399651 - RNA, 16 nt, Pseudomonas aeruginosa PA01
ugccgaggccgccgcg

SEQ ID NO: 1399652 - RNA, 19 nt, Pseudomonas aeruginosa PA01
ugccgaggccgccgcgggc

SEQ ID NO: 1399653 - RNA, 18 nt, Pseudomonas aeruginosa PA01
ugccgacgccgcggccgg

SEQ ID NO: 1399654 - RNA, 24 nt, Pseudomonas aeruginosa PA01
ugccgacgccgcggccggcgaccu

SEQ ID NO: 1399655 - RNA, 20 nt, Pseudomonas aeruginosa PA01
ugccgacgcugaucaucgag

SEQ ID NO: 1399656 - RNA, 16 nt, Pseudomonas aeruginosa PA01
ugccgacggcggcggc

SEQ ID NO: 1399657 - RNA, 19 nt, Pseudomonas aeruginosa PA01
ugccgacggcggcggcgga

SEQ ID NO: 1399658 - RNA, 17 nt, Pseudomonas aeruginosa PA01
ugccgacgucgaugacg

SEQ ID NO: 1399659 - RNA, 20 nt, Pseudomonas aeruginosa PA01
ugccgacgucgaugacgaug

SEQ ID NO: 1399660 - RNA, 21 nt, Pseudomonas aeruginosa PA01
ugcccggcgccaguucgccgg

SEQ ID NO: 1399661 - RNA, 14 nt, Pseudomonas aeruginosa PA01
ugcccggccuggcg

SEQ ID NO: 1399662 - RNA, 17 nt, Pseudomonas aeruginosa PA01
ugcccggcuugccgucg

SEQ ID NO: 1399663 - RNA, 18 nt, Pseudomonas aeruginosa PA01
ugcccggcuugccgucgg

SEQ ID NO: 1399664 - RNA, 21 nt, Pseudomonas aeruginosa PA01
ugccgacgagcagcucgccgg

SEQ ID NO: 1399665 - RNA, 12 nt, Pseudomonas aeruginosa PA01
ugccgaccuuca

SEQ ID NO: 1399666 - RNA, 18 nt, Pseudomonas aeruginosa PA01
ugccgaccuucaccacca

SEQ ID NO: 1399667 - RNA, 18 nt, Pseudomonas aeruginosa PA01
ugccgaccuucaucaggc

SEQ ID NO: 1399668 - RNA, 20 nt, Pseudomonas aeruginosa PA01
ugccgaccuucaucaggcgg

SEQ ID NO: 1399669 - RNA, 22 nt, Pseudomonas aeruginosa PA01
ugcccggagcggcugccgaggc

SEQ ID NO: 1399670 - RNA, 16 nt, Pseudomonas aeruginosa PA01
ugcccggcgaggucgg

SEQ ID NO: 1399671 - RNA, 12 nt, Pseudomonas aeruginosa PA01
ugcccggccgca

SEQ ID NO: 1399672 - RNA, 21 nt, Pseudomonas aeruginosa PA01
ugcccggccgcaggcagcaca

SEQ ID NO: 1399673 - RNA, 17 nt, Pseudomonas aeruginosa PA01
ugcccggcauaggcgcc

SEQ ID NO: 1399674 - RNA, 21 nt, Pseudomonas aeruginosa PA01
ugcccggcauaggcgccagcc

SEQ ID NO: 1399675 - RNA, 18 nt, Pseudomonas aeruginosa PA01
ugcccggccaugccgccg

SEQ ID NO: 1399676 - RNA, 19 nt, Pseudomonas aeruginosa PA01
ugcccggccaugccgccga

SEQ ID NO: 1399677 - RNA, 11 nt, Pseudomonas aeruginosa PA01
ugccacccggc

SEQ ID NO: 1399678 - RNA, 16 nt, Pseudomonas aeruginosa PA01
ugccacccggcgcccg

SEQ ID NO: 1399679 - RNA, 17 nt, Pseudomonas aeruginosa PA01
ugccacccggcgcccgg

SEQ ID NO: 1399680 - RNA, 18 nt, Pseudomonas aeruginosa PA01
ugccacccggcgcccggc

SEQ ID NO: 1399681 - RNA, 15 nt, Pseudomonas aeruginosa PA01
ugccacccggcucgg

SEQ ID NO: 1399682 - RNA, 13 nt, Pseudomonas aeruginosa PA01
ugcaugccgggga

SEQ ID NO: 1399683 - RNA, 23 nt, Pseudomonas aeruginosa PA01
ugcaugcuuuugaacaccagcga

SEQ ID NO: 1399684 - RNA, 18 nt, Pseudomonas aeruginosa PA01
ugcaugaaggcgcugagc

SEQ ID NO: 1399685 - RNA, 19 nt, Pseudomonas aeruginosa PA01
ugcaugagugucgccauca

SEQ ID NO: 1399686 - RNA, 22 nt, Pseudomonas aeruginosa PA01
ugcaugauuucguuggcccaga

SEQ ID NO: 1399687 - RNA, 16 nt, Pseudomonas aeruginosa PA01
ugcaugccggccgucg

SEQ ID NO: 1399688 - RNA, 18 nt, Pseudomonas aeruginosa PA01
ugcaugccggccgucgcg

SEQ ID NO: 1399689 - RNA, 22 nt, Pseudomonas aeruginosa PA01
ugcaugccggccgucgcgcacc

SEQ ID NO: 1399690 - RNA, 17 nt, Pseudomonas aeruginosa PA01
ugcauccgccgcagacc

SEQ ID NO: 1399691 - RNA, 21 nt, Pseudomonas aeruginosa PA01
ugcaucaccaggcugccgccg

SEQ ID NO: 1399692 - RNA, 13 nt, Pseudomonas aeruginosa PA01
ugcaucaccggca

SEQ ID NO: 1399693 - RNA, 16 nt, Pseudomonas aeruginosa PA01
ugcaucaccggcagca

SEQ ID NO: 1399694 - RNA, 18 nt, Pseudomonas aeruginosa PA01
ugcaucaccggcagcagc

SEQ ID NO: 1399695 - RNA, 19 nt, Pseudomonas aeruginosa PA01
ugcaucacguacggcgccu

SEQ ID NO: 1399696 - RNA, 14 nt, Pseudomonas aeruginosa PA01
ugcaucggccggga

SEQ ID NO: 1399697 - RNA, 17 nt, Pseudomonas aeruginosa PA01
ugcaucggcgcgccgaa

SEQ ID NO: 1399698 - RNA, 19 nt, Pseudomonas aeruginosa PA01
ugcaucggcgcgccgaagg

SEQ ID NO: 1399699 - RNA, 20 nt, Pseudomonas aeruginosa PA01
ugcauccuuuuuccgaccuu

SEQ ID NO: 1399700 - RNA, 15 nt, Pseudomonas aeruginosa PA01
ugcaguaccugcuca

SEQ ID NO: 1399701 - RNA, 18 nt, Pseudomonas aeruginosa PA01
ugcaguacuuggccagca

SEQ ID NO: 1399702 - RNA, 20 nt, Pseudomonas aeruginosa PA01
ugcaguacuuggccagcagc

SEQ ID NO: 1399703 - RNA, 19 nt, Pseudomonas aeruginosa PA01
ugcagucgcggaagcggca

SEQ ID NO: 1399704 - RNA, 17 nt, Pseudomonas aeruginosa PA01
ugcagguguucggcggc

SEQ ID NO: 1399705 - RNA, 19 nt, Pseudomonas aeruginosa PA01
ugcagguaguccagccagu

SEQ ID NO: 1399706 - RNA, 22 nt, Pseudomonas aeruginosa PA01
ugcaggucgaggcgcuccaccg

SEQ ID NO: 1399707 - RNA, 21 nt, Pseudomonas aeruginosa PA01
ugcaggucgcgcggcgccugc

SEQ ID NO: 1399708 - RNA, 15 nt, Pseudomonas aeruginosa PA01
ugcagugcgccgcag

SEQ ID NO: 1399709 - RNA, 16 nt, Pseudomonas aeruginosa PA01
ugcagugcgccgcagc

SEQ ID NO: 1399710 - RNA, 20 nt, Pseudomonas aeruginosa PA01
ugcaguugagucgcgcgcgc

SEQ ID NO: 1399711 - RNA, 16 nt, Pseudomonas aeruginosa PA01
ugcacgcacgcgccug

SEQ ID NO: 1399712 - RNA, 14 nt, Pseudomonas aeruginosa PA01
ugcacgcaggccgc

SEQ ID NO: 1399713 - RNA, 16 nt, Pseudomonas aeruginosa PA01
ugcacgcaggccgcug

SEQ ID NO: 1399714 - RNA, 14 nt, Pseudomonas aeruginosa PA01
ugcacgcccaggcg

SEQ ID NO: 1399715 - RNA, 18 nt, Pseudomonas aeruginosa PA01
ugcacgcccaggcgcucg

SEQ ID NO: 1399716 - RNA, 15 nt, Pseudomonas aeruginosa PA01
ugcacgccgauggcg

SEQ ID NO: 1399717 - RNA, 17 nt, Pseudomonas aeruginosa PA01
ugcacgcgccgggucgg

SEQ ID NO: 1399718 - RNA, 16 nt, Pseudomonas aeruginosa PA01
ugcacgccgugcauca

SEQ ID NO: 1399719 - RNA, 20 nt, Pseudomonas aeruginosa PA01
ugcaccugcucggggccgua

SEQ ID NO: 1399720 - RNA, 19 nt, Pseudomonas aeruginosa PA01
ugcaccuggcgaugcccug

SEQ ID NO: 1399721 - RNA, 19 nt, Pseudomonas aeruginosa PA01
ugcaccucaugcugcgcgg

SEQ ID NO: 1399722 - RNA, 20 nt, Pseudomonas aeruginosa PA01
ugcaccggccacucgcagcc

SEQ ID NO: 1399723 - RNA, 22 nt, Pseudomonas aeruginosa PA01
ugcaccggccacucgcagccgc

SEQ ID NO: 1399724 - RNA, 16 nt, Pseudomonas aeruginosa PA01
ugccccgggcgccggg

SEQ ID NO: 1399725 - RNA, 19 nt, Pseudomonas aeruginosa PA01
ugccccgugcaccgaggcg

SEQ ID NO: 1399726 - RNA, 22 nt, Pseudomonas aeruginosa PA01
ugccccucacaccaccagcauc

SEQ ID NO: 1399727 - RNA, 20 nt, Pseudomonas aeruginosa PA01
ugccccgcuggcccaacagc

SEQ ID NO: 1399728 - RNA, 13 nt, Pseudomonas aeruginosa PA01
ugccccuucggcu

SEQ ID NO: 1399729 - RNA, 18 nt, Pseudomonas aeruginosa PA01
ugcccccggcaacacccu

SEQ ID NO: 1399730 - RNA, 19 nt, Pseudomonas aeruginosa PA01
ugccccauccgacgccggc

SEQ ID NO: 1399731 - RNA, 20 nt, Pseudomonas aeruginosa PA01
ugccccauccgacgccggcu

SEQ ID NO: 1399732 - RNA, 20 nt, Pseudomonas aeruginosa PA01
ugccccacuuccggcccggc

SEQ ID NO: 1399733 - RNA, 18 nt, Pseudomonas aeruginosa PA01
ugccccagcaucgccggc

SEQ ID NO: 1399734 - RNA, 19 nt, Pseudomonas aeruginosa PA01
ugccccagcaucgccggca

SEQ ID NO: 1399735 - RNA, 19 nt, Pseudomonas aeruginosa PA01
ugcccagggccagcagcgg

SEQ ID NO: 1399736 - RNA, 14 nt, Pseudomonas aeruginosa PA01
ugcccaggcgcugg

SEQ ID NO: 1399737 - RNA, 16 nt, Pseudomonas aeruginosa PA01
ugcccaggcgcuggcg

SEQ ID NO: 1399738 - RNA, 14 nt, Pseudomonas aeruginosa PA01
ugcccaggccgccg

SEQ ID NO: 1399739 - RNA, 15 nt, Pseudomonas aeruginosa PA01
ugcccaggccgccga

SEQ ID NO: 1399740 - RNA, 15 nt, Pseudomonas aeruginosa PA01
ugcccagcguggcca

SEQ ID NO: 1399741 - RNA, 12 nt, Pseudomonas aeruginosa PA01
ugcccagcggcg

SEQ ID NO: 1399742 - RNA, 15 nt, Pseudomonas aeruginosa PA01
ugcccagcggcgcca

SEQ ID NO: 1399743 - RNA, 16 nt, Pseudomonas aeruginosa PA01
ugcccauccgcucggc

SEQ ID NO: 1399744 - RNA, 17 nt, Pseudomonas aeruginosa PA01
ugcccagguagccggcg

SEQ ID NO: 1399745 - RNA, 20 nt, Pseudomonas aeruginosa PA01
ugcccagguagccggcgagc

SEQ ID NO: 1399746 - RNA, 18 nt, Pseudomonas aeruginosa PA01
ugcccagugggccaccgg

SEQ ID NO: 1399747 - RNA, 16 nt, Pseudomonas aeruginosa PA01
ugcccaguugcgcggc

SEQ ID NO: 1399748 - RNA, 17 nt, Pseudomonas aeruginosa PA01
ugcccaguugcgcggcg

SEQ ID NO: 1399749 - RNA, 19 nt, Pseudomonas aeruginosa PA01
ugcccaguugcgcggcgag

SEQ ID NO: 1399750 - RNA, 20 nt, Pseudomonas aeruginosa PA01
ugccagccgcuuccggcgcu

SEQ ID NO: 1399751 - RNA, 21 nt, Pseudomonas aeruginosa PA01
ugccagcgcgucggcacgccg

SEQ ID NO: 1399752 - RNA, 17 nt, Pseudomonas aeruginosa PA01
ugccagcgccacgccgc

SEQ ID NO: 1399753 - RNA, 20 nt, Pseudomonas aeruginosa PA01
ugccagcgccacgccgcugu

SEQ ID NO: 1399754 - RNA, 22 nt, Pseudomonas aeruginosa PA01
ugccagcgggcgccgccgccga

SEQ ID NO: 1399755 - RNA, 22 nt, Pseudomonas aeruginosa PA01
ugccagcaccuucaucaccagg

SEQ ID NO: 1399756 - RNA, 23 nt, Pseudomonas aeruginosa PA01
ugccagcaccuucaucaccaggu

SEQ ID NO: 1399757 - RNA, 12 nt, Pseudomonas aeruginosa PA01
ugccagcagcgc

SEQ ID NO: 1399758 - RNA, 23 nt, Pseudomonas aeruginosa PA01
ugccagcaguaucgacgauggug

SEQ ID NO: 1399759 - RNA, 16 nt, Pseudomonas aeruginosa PA01
ugccacgcaccaccag

SEQ ID NO: 1399760 - RNA, 18 nt, Pseudomonas aeruginosa PA01
ugccacgcaccaccaggu

SEQ ID NO: 1399761 - RNA, 14 nt, Pseudomonas aeruginosa PA01
ugcccacggccagg

SEQ ID NO: 1399762 - RNA, 13 nt, Pseudomonas aeruginosa PA01
ugcccagacgccg

SEQ ID NO: 1399763 - RNA, 12 nt, Pseudomonas aeruginosa PA01
ugcccagcgcag

SEQ ID NO: 1399764 - RNA, 14 nt, Pseudomonas aeruginosa PA01
ugcccagcgcaggc

SEQ ID NO: 1399765 - RNA, 17 nt, Pseudomonas aeruginosa PA01
ugcccagcgcaggccga

SEQ ID NO: 1399766 - RNA, 16 nt, Pseudomonas aeruginosa PA01
ugcccagcgccgccag

SEQ ID NO: 1399767 - RNA, 18 nt, Pseudomonas aeruginosa PA01
ugcccagcaggcugcugc

SEQ ID NO: 1399768 - RNA, 16 nt, Pseudomonas aeruginosa PA01
ugcccagccagggccg

SEQ ID NO: 1399769 - RNA, 18 nt, Pseudomonas aeruginosa PA01
ugcccagccagggccgcg

SEQ ID NO: 1399770 - RNA, 21 nt, Pseudomonas aeruginosa PA01
ugcccagccccaccgccaggu

SEQ ID NO: 1399771 - RNA, 16 nt, Pseudomonas aeruginosa PA01
ugcccagcccgccuuc

SEQ ID NO: 1399772 - RNA, 17 nt, Pseudomonas aeruginosa PA01
ugcccacgcagaaggcg

SEQ ID NO: 1399773 - RNA, 21 nt, Pseudomonas aeruginosa PA01
ugcccaccgggaucugccggu

SEQ ID NO: 1399774 - RNA, 21 nt, Pseudomonas aeruginosa PA01
ugcccaccugaacgcgcccgg

SEQ ID NO: 1399775 - RNA, 21 nt, Pseudomonas aeruginosa PA01
ugcccaccccggacugcccga

SEQ ID NO: 1399776 - RNA, 22 nt, Pseudomonas aeruginosa PA01
ugcccaccccggacugcccgac

SEQ ID NO: 1399777 - RNA, 22 nt, Pseudomonas aeruginosa PA01
ugcccaagggccugggcgccgc

SEQ ID NO: 1399778 - RNA, 16 nt, Pseudomonas aeruginosa PA01
ugcccaauacccacag

SEQ ID NO: 1399779 - RNA, 15 nt, Pseudomonas aeruginosa PA01
ugcccaauacggcgg

SEQ ID NO: 1399780 - RNA, 15 nt, Pseudomonas aeruginosa PA01
ugcggcaacgacggc

SEQ ID NO: 1399781 - RNA, 15 nt, Pseudomonas aeruginosa PA01
ugcggcaaggcgauc

SEQ ID NO: 1399782 - RNA, 20 nt, Pseudomonas aeruginosa PA01
ugcggcaaggcgaucccggc

SEQ ID NO: 1399783 - RNA, 12 nt, Pseudomonas aeruginosa PA01
ugcggcaccagc

SEQ ID NO: 1399784 - RNA, 13 nt, Pseudomonas aeruginosa PA01
ugcggcaccagcc

SEQ ID NO: 1399785 - RNA, 13 nt, Pseudomonas aeruginosa PA01
ugcggcacgcugc

SEQ ID NO: 1399786 - RNA, 19 nt, Pseudomonas aeruginosa PA01
ugcggauggcaauggcggu

SEQ ID NO: 1399787 - RNA, 15 nt, Pseudomonas aeruginosa PA01
ugcggauggcgcggg

SEQ ID NO: 1399788 - RNA, 17 nt, Pseudomonas aeruginosa PA01
ugcggauggcgcggggc

SEQ ID NO: 1399789 - RNA, 15 nt, Pseudomonas aeruginosa PA01
ugcggauucaucggc

SEQ ID NO: 1399790 - RNA, 15 nt, Pseudomonas aeruginosa PA01
ugcgcguugcagcgc

SEQ ID NO: 1399791 - RNA, 23 nt, Pseudomonas aeruginosa PA01
ugcgcguugcagcgccuguucca

SEQ ID NO: 1399792 - RNA, 22 nt, Pseudomonas aeruginosa PA01
ugcgcguguacccccaccgggc

SEQ ID NO: 1399793 - RNA, 17 nt, Pseudomonas aeruginosa PA01
ugcgcguguugcgccgc

SEQ ID NO: 1399794 - RNA, 16 nt, Pseudomonas aeruginosa PA01
ugcgcguacaucccgc

SEQ ID NO: 1399795 - RNA, 16 nt, Pseudomonas aeruginosa PA01
ugcgcgugcuggugcc

SEQ ID NO: 1399796 - RNA, 15 nt, Pseudomonas aeruginosa PA01
ugcgcuacggcauca

SEQ ID NO: 1399797 - RNA, 15 nt, Pseudomonas aeruginosa PA01
ugcgcucgagccggc

SEQ ID NO: 1399798 - RNA, 18 nt, Pseudomonas aeruginosa PA01
ugcgcucgagccggcuga

SEQ ID NO: 1399799 - RNA, 23 nt, Pseudomonas aeruginosa PA01
ugcgcucgagccggcugaugccc

SEQ ID NO: 1399800 - RNA, 19 nt, Pseudomonas aeruginosa PA01
ugcgcuccacccaggcgcc

SEQ ID NO: 1399801 - RNA, 13 nt, Pseudomonas aeruginosa PA01
ugcgcuccaggcg

SEQ ID NO: 1399802 - RNA, 14 nt, Pseudomonas aeruginosa PA01
ugcgcuccgccagg

SEQ ID NO: 1399803 - RNA, 15 nt, Pseudomonas aeruginosa PA01
ugcgcuccgguggcg

SEQ ID NO: 1399804 - RNA, 16 nt, Pseudomonas aeruginosa PA01
ugcgcuaucggcccgg

SEQ ID NO: 1399805 - RNA, 20 nt, Pseudomonas aeruginosa PA01
ugcgcuccuguugcuggccg

SEQ ID NO: 1399806 - RNA, 22 nt, Pseudomonas aeruginosa PA01
ugcgcuccuguugcuggccggu

SEQ ID NO: 1399807 - RNA, 17 nt, Pseudomonas aeruginosa PA01
ugcgcuccuuggcuggc

SEQ ID NO: 1399808 - RNA, 17 nt, Pseudomonas aeruginosa PA01
ugcggcccagcggcagg

SEQ ID NO: 1399809 - RNA, 15 nt, Pseudomonas aeruginosa PA01
ugcggcguucgccgc

SEQ ID NO: 1399810 - RNA, 19 nt, Pseudomonas aeruginosa PA01
ugcggcguucgccgcgggc

SEQ ID NO: 1399811 - RNA, 13 nt, Pseudomonas aeruginosa PA01
ugcggcucgccga

SEQ ID NO: 1399812 - RNA, 14 nt, Pseudomonas aeruginosa PA01
ugcggcucgccgau

SEQ ID NO: 1399813 - RNA, 17 nt, Pseudomonas aeruginosa PA01
ugcgggccuugaccacc

SEQ ID NO: 1399814 - RNA, 12 nt, Pseudomonas aeruginosa PA01
ugcgggcgaucu

SEQ ID NO: 1399815 - RNA, 21 nt, Pseudomonas aeruginosa PA01
ugcggcaggccuuccacgccu

SEQ ID NO: 1399816 - RNA, 23 nt, Pseudomonas aeruginosa PA01
ugcggcaggccuuccacgccuuc

SEQ ID NO: 1399817 - RNA, 23 nt, Pseudomonas aeruginosa PA01
ugcggcaguccucgccguuggcg

SEQ ID NO: 1399818 - RNA, 22 nt, Pseudomonas aeruginosa PA01
ugcggcagucgguagaaauccu

SEQ ID NO: 1399819 - RNA, 21 nt, Pseudomonas aeruginosa PA01
ugcggcagcauccguaccagg

SEQ ID NO: 1399820 - RNA, 15 nt, Pseudomonas aeruginosa PA01
ugcggcagacgugcu

SEQ ID NO: 1399821 - RNA, 16 nt, Pseudomonas aeruginosa PA01
ugcggcauuccgggcg

SEQ ID NO: 1399822 - RNA, 13 nt, Pseudomonas aeruginosa PA01
ugcggccagcgcc

SEQ ID NO: 1399823 - RNA, 16 nt, Pseudomonas aeruginosa PA01
ugcggccagcgccagg

SEQ ID NO: 1399824 - RNA, 20 nt, Pseudomonas aeruginosa PA01
ugcgccgcgggucaccagcg

SEQ ID NO: 1399825 - RNA, 22 nt, Pseudomonas aeruginosa PA01
ugcgccgcgggucaccagcgcc

SEQ ID NO: 1399826 - RNA, 23 nt, Pseudomonas aeruginosa PA01
ugcgccgcgggucaccagcgccg

SEQ ID NO: 1399827 - RNA, 16 nt, Pseudomonas aeruginosa PA01
ugcgccgcucgcgcac

SEQ ID NO: 1399828 - RNA, 19 nt, Pseudomonas aeruginosa PA01
ugcgccgcucgcgcacggc

SEQ ID NO: 1399829 - RNA, 23 nt, Pseudomonas aeruginosa PA01
ugcgccgccgucuugccgcugcg

SEQ ID NO: 1399830 - RNA, 11 nt, Pseudomonas aeruginosa PA01
ugcgccggcac

SEQ ID NO: 1399831 - RNA, 14 nt, Pseudomonas aeruginosa PA01
ugcgccggcacggc

SEQ ID NO: 1399832 - RNA, 21 nt, Pseudomonas aeruginosa PA01
ugcgccggcaucgccauggcg

SEQ ID NO: 1399833 - RNA, 14 nt, Pseudomonas aeruginosa PA01
ugcgccgcugcggc

SEQ ID NO: 1399834 - RNA, 23 nt, Pseudomonas aeruginosa PA01
ugcgccggaucggcugaccggca

SEQ ID NO: 1399835 - RNA, 19 nt, Pseudomonas aeruginosa PA01
ugcgccggcggccggcgca

SEQ ID NO: 1399836 - RNA, 21 nt, Pseudomonas aeruginosa PA01
ugcgccgggaugcucaccgcg

SEQ ID NO: 1399837 - RNA, 12 nt, Pseudomonas aeruginosa PA01
ugcgccgggccu

SEQ ID NO: 1399838 - RNA, 18 nt, Pseudomonas aeruginosa PA01
ugcgccgggccucggcaa

SEQ ID NO: 1399839 - RNA, 14 nt, Pseudomonas aeruginosa PA01
ugcgccgggugccg

SEQ ID NO: 1399840 - RNA, 17 nt, Pseudomonas aeruginosa PA01
ugcgccgggugccggug

SEQ ID NO: 1399841 - RNA, 15 nt, Pseudomonas aeruginosa PA01
ugcgccggcccagca

SEQ ID NO: 1399842 - RNA, 14 nt, Pseudomonas aeruginosa PA01
ugcgccagcucggc

SEQ ID NO: 1399843 - RNA, 23 nt, Pseudomonas aeruginosa PA01
ugcgccagguguucguccagaug

SEQ ID NO: 1399844 - RNA, 17 nt, Pseudomonas aeruginosa PA01
ugcgccgagcgcucgcc

SEQ ID NO: 1399845 - RNA, 18 nt, Pseudomonas aeruginosa PA01
ugcgccaggcccggcgcu

SEQ ID NO: 1399846 - RNA, 13 nt, Pseudomonas aeruginosa PA01
ugcgccaggccgu

SEQ ID NO: 1399847 - RNA, 13 nt, Pseudomonas aeruginosa PA01
ugcgccgcagcgc

SEQ ID NO: 1399848 - RNA, 14 nt, Pseudomonas aeruginosa PA01
ugcgccgcaccacg

SEQ ID NO: 1399849 - RNA, 15 nt, Pseudomonas aeruginosa PA01
ugcgccgcagcggcc

SEQ ID NO: 1399850 - RNA, 21 nt, Pseudomonas aeruginosa PA01
ugcgccgccacgugcacgccg

SEQ ID NO: 1399851 - RNA, 22 nt, Pseudomonas aeruginosa PA01
ugcgcgaagccaggaagcggcg

SEQ ID NO: 1399852 - RNA, 17 nt, Pseudomonas aeruginosa PA01
ugcgcgccucgccccag

SEQ ID NO: 1399853 - RNA, 20 nt, Pseudomonas aeruginosa PA01
ugcgcgccucgccccagacc

SEQ ID NO: 1399854 - RNA, 22 nt, Pseudomonas aeruginosa PA01
ugcgccgguugcugcuugcgcg

SEQ ID NO: 1399855 - RNA, 12 nt, Pseudomonas aeruginosa PA01
ugcgccguggca

SEQ ID NO: 1399856 - RNA, 17 nt, Pseudomonas aeruginosa PA01
ugcgccguggcaccagg

SEQ ID NO: 1399857 - RNA, 16 nt, Pseudomonas aeruginosa PA01
ugcgccucgccgcccg

SEQ ID NO: 1399858 - RNA, 12 nt, Pseudomonas aeruginosa PA01
ugcgccucggcc

SEQ ID NO: 1399859 - RNA, 21 nt, Pseudomonas aeruginosa PA01
ugcgccucgaccuggccacgc

SEQ ID NO: 1399860 - RNA, 20 nt, Pseudomonas aeruginosa PA01
ugcgccugcuucagcccggc

SEQ ID NO: 1399861 - RNA, 13 nt, Pseudomonas aeruginosa PA01
ugcgccuggccgc

SEQ ID NO: 1399862 - RNA, 14 nt, Pseudomonas aeruginosa PA01
ugcgccuggccgcg

SEQ ID NO: 1399863 - RNA, 14 nt, Pseudomonas aeruginosa PA01
ugcgcggcagcagg

SEQ ID NO: 1399864 - RNA, 19 nt, Pseudomonas aeruginosa PA01
ugcgcggcagcaggcgggc

SEQ ID NO: 1399865 - RNA, 14 nt, Pseudomonas aeruginosa PA01
ugcgcggcaggacc

SEQ ID NO: 1399866 - RNA, 16 nt, Pseudomonas aeruginosa PA01
ugcgcggcagguggcu

SEQ ID NO: 1399867 - RNA, 21 nt, Pseudomonas aeruginosa PA01
ugcgcgcggcgucgaccacgg

SEQ ID NO: 1399868 - RNA, 22 nt, Pseudomonas aeruginosa PA01
ugcgcgcggcgucgaccacggc

SEQ ID NO: 1399869 - RNA, 19 nt, Pseudomonas aeruginosa PA01
ugcgcgcggguuuccgugc

SEQ ID NO: 1399870 - RNA, 13 nt, Pseudomonas aeruginosa PA01
ugcgcgcggccca

SEQ ID NO: 1399871 - RNA, 16 nt, Pseudomonas aeruginosa PA01
ugcgcgcggcccacca

SEQ ID NO: 1399872 - RNA, 22 nt, Pseudomonas aeruginosa PA01
ugcgcggucaccagggucacgc

SEQ ID NO: 1399873 - RNA, 23 nt, Pseudomonas aeruginosa PA01
ugcgcggucaccagggucacgcc

SEQ ID NO: 1399874 - RNA, 17 nt, Pseudomonas aeruginosa PA01
ugcgcgucgccgaacgg

SEQ ID NO: 1399875 - RNA, 19 nt, Pseudomonas aeruginosa PA01
ugccuccgcucugcuggcc

SEQ ID NO: 1399876 - RNA, 12 nt, Pseudomonas aeruginosa PA01
ugccucgccgag

SEQ ID NO: 1399877 - RNA, 14 nt, Pseudomonas aeruginosa PA01
ugccucgccgaggc

SEQ ID NO: 1399878 - RNA, 17 nt, Pseudomonas aeruginosa PA01
ugccucggcggcggccu

SEQ ID NO: 1399879 - RNA, 21 nt, Pseudomonas aeruginosa PA01
ugccucgguuuccggccaggc

SEQ ID NO: 1399880 - RNA, 22 nt, Pseudomonas aeruginosa PA01
ugccucgguuuccggccaggcg

SEQ ID NO: 1399881 - RNA, 18 nt, Pseudomonas aeruginosa PA01
ugccugcagguagcgcug

SEQ ID NO: 1399882 - RNA, 22 nt, Pseudomonas aeruginosa PA01
ugccugcggccccaaggggccg

SEQ ID NO: 1399883 - RNA, 16 nt, Pseudomonas aeruginosa PA01
ugccugcguuucgccg

SEQ ID NO: 1399884 - RNA, 14 nt, Pseudomonas aeruginosa PA01
ugccugcgcagggc

SEQ ID NO: 1399885 - RNA, 13 nt, Pseudomonas aeruginosa PA01
ugccugcgcccuc

SEQ ID NO: 1399886 - RNA, 16 nt, Pseudomonas aeruginosa PA01
ugccgucgagcaccag

SEQ ID NO: 1399887 - RNA, 18 nt, Pseudomonas aeruginosa PA01
ugccgucgagcaccagca

SEQ ID NO: 1399888 - RNA, 15 nt, Pseudomonas aeruginosa PA01
ugccgucggcgcggg

SEQ ID NO: 1399889 - RNA, 16 nt, Pseudomonas aeruginosa PA01
ugccgguucccgcagc

SEQ ID NO: 1399890 - RNA, 17 nt, Pseudomonas aeruginosa PA01
ugccgguucccgcagcg

SEQ ID NO: 1399891 - RNA, 21 nt, Pseudomonas aeruginosa PA01
ugccgucccggaguuccagcg

SEQ ID NO: 1399892 - RNA, 20 nt, Pseudomonas aeruginosa PA01
ugccggcgucggcgagcagg

SEQ ID NO: 1399893 - RNA, 18 nt, Pseudomonas aeruginosa PA01
ugccggcgucguccugcg

SEQ ID NO: 1399894 - RNA, 20 nt, Pseudomonas aeruginosa PA01
ugccggcgugaacgcggcga

SEQ ID NO: 1399895 - RNA, 23 nt, Pseudomonas aeruginosa PA01
ugccggcgggacgcgcaugcagg

SEQ ID NO: 1399896 - RNA, 21 nt, Pseudomonas aeruginosa PA01
ugccggcgguggacgucggcg

SEQ ID NO: 1399897 - RNA, 14 nt, Pseudomonas aeruginosa PA01
ugccgggaagcgca

SEQ ID NO: 1399898 - RNA, 17 nt, Pseudomonas aeruginosa PA01
ugccgggaauacgcggu

SEQ ID NO: 1399899 - RNA, 17 nt, Pseudomonas aeruginosa PA01
ugccggcugcgccgcgu

SEQ ID NO: 1399900 - RNA, 20 nt, Pseudomonas aeruginosa PA01
ugccgggcaacgcgcagagg

SEQ ID NO: 1399901 - RNA, 22 nt, Pseudomonas aeruginosa PA01
ugccgggcucugguagccgcag

SEQ ID NO: 1399902 - RNA, 12 nt, Pseudomonas aeruginosa PA01
ugccgggccggc

SEQ ID NO: 1399903 - RNA, 14 nt, Pseudomonas aeruginosa PA01
ugccgggccggcca

SEQ ID NO: 1399904 - RNA, 18 nt, Pseudomonas aeruginosa PA01
ugccgggccggccagggc

SEQ ID NO: 1399905 - RNA, 16 nt, Pseudomonas aeruginosa PA01
ugccgggggcggcgaa

SEQ ID NO: 1399906 - RNA, 15 nt, Pseudomonas aeruginosa PA01
ugccgggguccgccg

SEQ ID NO: 1399907 - RNA, 22 nt, Pseudomonas aeruginosa PA01
ugccggguauccagcacccgca

SEQ ID NO: 1399908 - RNA, 20 nt, Pseudomonas aeruginosa PA01
ugccgggguggaguaccagg

SEQ ID NO: 1399909 - RNA, 16 nt, Pseudomonas aeruginosa PA01
ugccgguagcuggcca

SEQ ID NO: 1399910 - RNA, 18 nt, Pseudomonas aeruginosa PA01
ugccgguaggucaccagg

SEQ ID NO: 1399911 - RNA, 19 nt, Pseudomonas aeruginosa PA01
ugccgguaggucaccaggu

SEQ ID NO: 1399912 - RNA, 16 nt, Pseudomonas aeruginosa PA01
ugccgguacgcaccag

SEQ ID NO: 1399913 - RNA, 21 nt, Pseudomonas aeruginosa PA01
ugccggucaggcuggugccgc

SEQ ID NO: 1399914 - RNA, 17 nt, Pseudomonas aeruginosa PA01
ugccggugcucggccug

SEQ ID NO: 1399915 - RNA, 23 nt, Pseudomonas aeruginosa PA01
ugccggugcucggccugaucauc

SEQ ID NO: 1399916 - RNA, 18 nt, Pseudomonas aeruginosa PA01
ugccggugcuggugcggc

SEQ ID NO: 1399917 - RNA, 15 nt, Pseudomonas aeruginosa PA01
ugccgguggcgccca

SEQ ID NO: 1399918 - RNA, 13 nt, Pseudomonas aeruginosa PA01
ugccggugugccg

SEQ ID NO: 1399919 - RNA, 17 nt, Pseudomonas aeruginosa PA01
ugccggucggaacgacc

SEQ ID NO: 1399920 - RNA, 22 nt, Pseudomonas aeruginosa PA01
ugccggucugcugcgcgcacca

SEQ ID NO: 1399921 - RNA, 21 nt, Pseudomonas aeruginosa PA01
ugccggugaugucggcgcugu

SEQ ID NO: 1399922 - RNA, 13 nt, Pseudomonas aeruginosa PA01
ugcgccagcggcc

SEQ ID NO: 1399923 - RNA, 17 nt, Pseudomonas aeruginosa PA01
ugcgccagcggcccggc

SEQ ID NO: 1399924 - RNA, 14 nt, Pseudomonas aeruginosa PA01
ugcgcaugcccgcg

SEQ ID NO: 1399925 - RNA, 16 nt, Pseudomonas aeruginosa PA01
ugcgcaugcgcagcgc

SEQ ID NO: 1399926 - RNA, 13 nt, Pseudomonas aeruginosa PA01
ugcgcaucgccug

SEQ ID NO: 1399927 - RNA, 18 nt, Pseudomonas aeruginosa PA01
ugcgcaucgccugggccg

SEQ ID NO: 1399928 - RNA, 22 nt, Pseudomonas aeruginosa PA01
ugcgcaucgccugggccggcgu

SEQ ID NO: 1399929 - RNA, 16 nt, Pseudomonas aeruginosa PA01
ugcgcaggcgguaggu

SEQ ID NO: 1399930 - RNA, 15 nt, Pseudomonas aeruginosa PA01
ugcgcaggcuggccg

SEQ ID NO: 1399931 - RNA, 19 nt, Pseudomonas aeruginosa PA01
ugcgcagguacucgccggc

SEQ ID NO: 1399932 - RNA, 13 nt, Pseudomonas aeruginosa PA01
ugcgcaggucgcg

SEQ ID NO: 1399933 - RNA, 14 nt, Pseudomonas aeruginosa PA01
ugcgcaggucgcga

SEQ ID NO: 1399934 - RNA, 19 nt, Pseudomonas aeruginosa PA01
ugcgaucgaggaugaucgg

SEQ ID NO: 1399935 - RNA, 17 nt, Pseudomonas aeruginosa PA01
ugcgaugggugccgcgc

SEQ ID NO: 1399936 - RNA, 23 nt, Pseudomonas aeruginosa PA01
ugcgauggaaguugcgcacccgc

SEQ ID NO: 1399937 - RNA, 17 nt, Pseudomonas aeruginosa PA01
ugcgauggaugcgcggc

SEQ ID NO: 1399938 - RNA, 12 nt, Pseudomonas aeruginosa PA01
ugcgcaggcgcu

SEQ ID NO: 1399939 - RNA, 14 nt, Pseudomonas aeruginosa PA01
ugcgcaggccgaga

SEQ ID NO: 1399940 - RNA, 15 nt, Pseudomonas aeruginosa PA01
ugcgcagggcggcga

SEQ ID NO: 1399941 - RNA, 16 nt, Pseudomonas aeruginosa PA01
ugcgcagggcggcgag

SEQ ID NO: 1399942 - RNA, 20 nt, Pseudomonas aeruginosa PA01
ugcgcagggcgucgaaggcg

SEQ ID NO: 1399943 - RNA, 16 nt, Pseudomonas aeruginosa PA01
ugcgcaggggcgcggc

SEQ ID NO: 1399944 - RNA, 17 nt, Pseudomonas aeruginosa PA01
ugcgcaggggcgcggcg

SEQ ID NO: 1399945 - RNA, 17 nt, Pseudomonas aeruginosa PA01
ugcgagacgggcgacgc

SEQ ID NO: 1399946 - RNA, 18 nt, Pseudomonas aeruginosa PA01
ugcgagacgggcgacgcc

SEQ ID NO: 1399947 - RNA, 20 nt, Pseudomonas aeruginosa PA01
ugcgacucguugcacgcagg

SEQ ID NO: 1399948 - RNA, 21 nt, Pseudomonas aeruginosa PA01
ugcgacuggaugcagccgaug

SEQ ID NO: 1399949 - RNA, 21 nt, Pseudomonas aeruginosa PA01
ugcgacuggggcaucucggcc

SEQ ID NO: 1399950 - RNA, 17 nt, Pseudomonas aeruginosa PA01
ugcgaccgugaggcgca

SEQ ID NO: 1399951 - RNA, 19 nt, Pseudomonas aeruginosa PA01
ugcgaccgugaggcgcagg

SEQ ID NO: 1399952 - RNA, 16 nt, Pseudomonas aeruginosa PA01
ugcgaccuggcgccga

SEQ ID NO: 1399953 - RNA, 21 nt, Pseudomonas aeruginosa PA01
ugccuggaaguauucggcggg

SEQ ID NO: 1399954 - RNA, 16 nt, Pseudomonas aeruginosa PA01
ugcgacacgaugucgc

SEQ ID NO: 1399955 - RNA, 15 nt, Pseudomonas aeruginosa PA01
ugcgaauguccggcg

SEQ ID NO: 1399956 - RNA, 17 nt, Pseudomonas aeruginosa PA01
ugcgaauugcgcuggaa

SEQ ID NO: 1399957 - RNA, 18 nt, Pseudomonas aeruginosa PA01
ugcgaauugcgcuggaag

SEQ ID NO: 1399958 - RNA, 17 nt, Pseudomonas aeruginosa PA01
ugagcuguuucagccca

SEQ ID NO: 1399959 - RNA, 15 nt, Pseudomonas aeruginosa PA01
ugagcuucgccgggu

SEQ ID NO: 1399960 - RNA, 12 nt, Pseudomonas aeruginosa PA01
ugagcuggccca

SEQ ID NO: 1399961 - RNA, 21 nt, Pseudomonas aeruginosa PA01
ugagcuggcccaguugcccgg

SEQ ID NO: 1399962 - RNA, 13 nt, Pseudomonas aeruginosa PA01
ugaggcuggccag

SEQ ID NO: 1399963 - RNA, 17 nt, Pseudomonas aeruginosa PA01
ugaggcuguccagcagg

SEQ ID NO: 1399964 - RNA, 14 nt, Pseudomonas aeruginosa PA01
ugaggcgggccagc

SEQ ID NO: 1399965 - RNA, 16 nt, Pseudomonas aeruginosa PA01
ugaggcguucgagggu

SEQ ID NO: 1399966 - RNA, 17 nt, Pseudomonas aeruginosa PA01
ugagggucgcgccgacg

SEQ ID NO: 1399967 - RNA, 13 nt, Pseudomonas aeruginosa PA01
ugagguaggccag

SEQ ID NO: 1399968 - RNA, 23 nt, Pseudomonas aeruginosa PA01
ugagcggaacgggacgccuggcg

SEQ ID NO: 1399969 - RNA, 14 nt, Pseudomonas aeruginosa PA01
ugagcgcgcccagg

SEQ ID NO: 1399970 - RNA, 17 nt, Pseudomonas aeruginosa PA01
ugagcgcgcccaggcag

SEQ ID NO: 1399971 - RNA, 14 nt, Pseudomonas aeruginosa PA01
ugagcgccagcagg

SEQ ID NO: 1399972 - RNA, 18 nt, Pseudomonas aeruginosa PA01
ugagcgcauugacacgga

SEQ ID NO: 1399973 - RNA, 17 nt, Pseudomonas aeruginosa PA01
ugagcgccaggcgcaag

SEQ ID NO: 1399974 - RNA, 18 nt, Pseudomonas aeruginosa PA01
ugagcgcccggcaaucag

SEQ ID NO: 1399975 - RNA, 16 nt, Pseudomonas aeruginosa PA01
ugagcgugacccgcgc

SEQ ID NO: 1399976 - RNA, 13 nt, Pseudomonas aeruginosa PA01
ugagcggcggcac

SEQ ID NO: 1399977 - RNA, 16 nt, Pseudomonas aeruginosa PA01
ugagcggaucgucgcg

SEQ ID NO: 1399978 - RNA, 19 nt, Pseudomonas aeruginosa PA01
ugagcggaucgucgcggcg

SEQ ID NO: 1399979 - RNA, 13 nt, Pseudomonas aeruginosa PA01
ugagcaugccgca

SEQ ID NO: 1399980 - RNA, 18 nt, Pseudomonas aeruginosa PA01
ugagcagucgccuggccc

SEQ ID NO: 1399981 - RNA, 21 nt, Pseudomonas aeruginosa PA01
ugagcaggaacucgaucagcg

SEQ ID NO: 1399982 - RNA, 15 nt, Pseudomonas aeruginosa PA01
ugagcaggccgacgg

SEQ ID NO: 1399983 - RNA, 21 nt, Pseudomonas aeruginosa PA01
ugagcagccaggcgaagcggc

SEQ ID NO: 1399984 - RNA, 13 nt, Pseudomonas aeruginosa PA01
ugagcagggccga

SEQ ID NO: 1399985 - RNA, 22 nt, Pseudomonas aeruginosa PA01
ugagcagggccgagcgcagcgc

SEQ ID NO: 1399986 - RNA, 23 nt, Pseudomonas aeruginosa PA01
ugagcagggugacggugaucgcc

SEQ ID NO: 1399987 - RNA, 14 nt, Pseudomonas aeruginosa PA01
ugacuuccaucagc

SEQ ID NO: 1399988 - RNA, 14 nt, Pseudomonas aeruginosa PA01
ugagcacgucgccu

SEQ ID NO: 1399989 - RNA, 13 nt, Pseudomonas aeruginosa PA01
ugacggcgccgau

SEQ ID NO: 1399990 - RNA, 15 nt, Pseudomonas aeruginosa PA01
ugacgcuggcugaca

SEQ ID NO: 1399991 - RNA, 20 nt, Pseudomonas aeruginosa PA01
ugacggcaaggaccugcugc

SEQ ID NO: 1399992 - RNA, 17 nt, Pseudomonas aeruginosa PA01
ugacgcugcucaccagg

SEQ ID NO: 1399993 - RNA, 21 nt, Pseudomonas aeruginosa PA01
ugacgcggaugcccuggucgg

SEQ ID NO: 1399994 - RNA, 18 nt, Pseudomonas aeruginosa PA01
ugacgcucuucaccucga

SEQ ID NO: 1399995 - RNA, 20 nt, Pseudomonas aeruginosa PA01
ugacgcucuucaccucgaug

SEQ ID NO: 1399996 - RNA, 21 nt, Pseudomonas aeruginosa PA01
ugacggggaucacucgccgcc

SEQ ID NO: 1399997 - RNA, 15 nt, Pseudomonas aeruginosa PA01
ugacggcguggcgga

SEQ ID NO: 1399998 - RNA, 17 nt, Pseudomonas aeruginosa PA01
ugacggugaucgccgcg

SEQ ID NO: 1399999 - RNA, 20 nt, Pseudomonas aeruginosa PA01
ugacggugauucguccggag

SEQ ID NO: 1400000 - RNA, 15 nt, Pseudomonas aeruginosa PA01
ugacggugcagccac

SEQ ID NO: 1400001 - RNA, 21 nt, Pseudomonas aeruginosa PA01
ugacgguggaggcgggcucac

SEQ ID NO: 1400002 - RNA, 22 nt, Pseudomonas aeruginosa PA01
ugacgaucuucugcaccccguc

SEQ ID NO: 1400003 - RNA, 22 nt, Pseudomonas aeruginosa PA01
ugacgaugccguucaggcgcgg

SEQ ID NO: 1400004 - RNA, 15 nt, Pseudomonas aeruginosa PA01
ugacgaugcggcccg

SEQ ID NO: 1400005 - RNA, 20 nt, Pseudomonas aeruginosa PA01
ugacgaugcggcccgccggc

SEQ ID NO: 1400006 - RNA, 16 nt, Pseudomonas aeruginosa PA01
ugacgauaucggcgcc

SEQ ID NO: 1400007 - RNA, 17 nt, Pseudomonas aeruginosa PA01
ugacgauaucggcgccg

SEQ ID NO: 1400008 - RNA, 18 nt, Pseudomonas aeruginosa PA01
ugacgauaucggcgccgg

SEQ ID NO: 1400009 - RNA, 13 nt, Pseudomonas aeruginosa PA01
ugacgaucgcccc

SEQ ID NO: 1400010 - RNA, 15 nt, Pseudomonas aeruginosa PA01
ugacgaucgccccgc

SEQ ID NO: 1400011 - RNA, 14 nt, Pseudomonas aeruginosa PA01
ugacgauggcgccu

SEQ ID NO: 1400012 - RNA, 13 nt, Pseudomonas aeruginosa PA01
ugacgauggccag

SEQ ID NO: 1400013 - RNA, 14 nt, Pseudomonas aeruginosa PA01
ugacgauggcccag

SEQ ID NO: 1400014 - RNA, 16 nt, Pseudomonas aeruginosa PA01
ugacgauggcccagau

SEQ ID NO: 1400015 - RNA, 14 nt, Pseudomonas aeruginosa PA01
ugacgauggccgcc

SEQ ID NO: 1400016 - RNA, 17 nt, Pseudomonas aeruginosa PA01
ugacgauggccgccgcc

SEQ ID NO: 1400017 - RNA, 17 nt, Pseudomonas aeruginosa PA01
ugacgcaagcgcucggc

SEQ ID NO: 1400018 - RNA, 20 nt, Pseudomonas aeruginosa PA01
ugacgcaagcgcucggccug

SEQ ID NO: 1400019 - RNA, 21 nt, Pseudomonas aeruginosa PA01
ugacgcgcagcgccgccgcgu

SEQ ID NO: 1400020 - RNA, 22 nt, Pseudomonas aeruginosa PA01
ugacgcgcagcgccgccgcguc

SEQ ID NO: 1400021 - RNA, 22 nt, Pseudomonas aeruginosa PA01
ugacgcggcggcuccggcgcca

SEQ ID NO: 1400022 - RNA, 15 nt, Pseudomonas aeruginosa PA01
ugacgcaguuccgcg

SEQ ID NO: 1400023 - RNA, 18 nt, Pseudomonas aeruginosa PA01
ugacgccauccuucggcg

SEQ ID NO: 1400024 - RNA, 13 nt, Pseudomonas aeruginosa PA01
ugaugcgucgcac

SEQ ID NO: 1400025 - RNA, 20 nt, Pseudomonas aeruginosa PA01
ugcaauggauguugccgccg

SEQ ID NO: 1400026 - RNA, 20 nt, Pseudomonas aeruginosa PA01
ugcaauggggcggccggcgc

SEQ ID NO: 1400027 - RNA, 19 nt, Pseudomonas aeruginosa PA01
ugcaauuccaccggcuggc

SEQ ID NO: 1400028 - RNA, 21 nt, Pseudomonas aeruginosa PA01
ugcaauuccaccggcuggccg

SEQ ID NO: 1400029 - RNA, 22 nt, Pseudomonas aeruginosa PA01
ugcaauugcaggcccggccgcc

SEQ ID NO: 1400030 - RNA, 11 nt, Pseudomonas aeruginosa PA01
ugcaacuggaa

SEQ ID NO: 1400031 - RNA, 16 nt, Pseudomonas aeruginosa PA01
ugcaagaggucgacgg

SEQ ID NO: 1400032 - RNA, 23 nt, Pseudomonas aeruginosa PA01
ugcaagggcacuucguccaggcc

SEQ ID NO: 1400033 - RNA, 13 nt, Pseudomonas aeruginosa PA01
ugcacagcgccca

SEQ ID NO: 1400034 - RNA, 21 nt, Pseudomonas aeruginosa PA01
ugcacagccauagcgccggca

SEQ ID NO: 1400035 - RNA, 18 nt, Pseudomonas aeruginosa PA01
ugcacaccagcuccccgu

SEQ ID NO: 1400036 - RNA, 13 nt, Pseudomonas aeruginosa PA01
ugcaccgccgggu

SEQ ID NO: 1400037 - RNA, 20 nt, Pseudomonas aeruginosa PA01
ugcaccgccggguacagcgc

SEQ ID NO: 1400038 - RNA, 12 nt, Pseudomonas aeruginosa PA01
ugcaccgaggcg

SEQ ID NO: 1400039 - RNA, 15 nt, Pseudomonas aeruginosa PA01
ugcaccgaggcgcgc

SEQ ID NO: 1400040 - RNA, 20 nt, Pseudomonas aeruginosa PA01
ugaggucgcgggcgauggcc

SEQ ID NO: 1400041 - RNA, 15 nt, Pseudomonas aeruginosa PA01
ugaggucggccucga

SEQ ID NO: 1400042 - RNA, 16 nt, Pseudomonas aeruginosa PA01
ugaggucggcgcgcgg

SEQ ID NO: 1400043 - RNA, 21 nt, Pseudomonas aeruginosa PA01
ugaggucgcagcguuccagcg

SEQ ID NO: 1400044 - RNA, 16 nt, Pseudomonas aeruginosa PA01
ugaggucguuggccag

SEQ ID NO: 1400045 - RNA, 22 nt, Pseudomonas aeruginosa PA01
ugaguucgaagcgccaggcgug

SEQ ID NO: 1400046 - RNA, 21 nt, Pseudomonas aeruginosa PA01
ugaguucccagaccuggccgc

SEQ ID NO: 1400047 - RNA, 17 nt, Pseudomonas aeruginosa PA01
ugaguugcaggccggcg

SEQ ID NO: 1400048 - RNA, 18 nt, Pseudomonas aeruginosa PA01
ugaguugcaggccggcga

SEQ ID NO: 1400049 - RNA, 16 nt, Pseudomonas aeruginosa PA01
ugaguugcagggcuug

SEQ ID NO: 1400050 - RNA, 14 nt, Pseudomonas aeruginosa PA01
ugauccagcuggcg

SEQ ID NO: 1400051 - RNA, 19 nt, Pseudomonas aeruginosa PA01
ugaucaucggcuggccgag

SEQ ID NO: 1400052 - RNA, 21 nt, Pseudomonas aeruginosa PA01
ugaucagguucggcagcgccu

SEQ ID NO: 1400053 - RNA, 17 nt, Pseudomonas aeruginosa PA01
ugaucagguugccggcg

SEQ ID NO: 1400054 - RNA, 20 nt, Pseudomonas aeruginosa PA01
ugaucagguugccggcgugc

SEQ ID NO: 1400055 - RNA, 17 nt, Pseudomonas aeruginosa PA01
ugauccgcguggcgugc

SEQ ID NO: 1400056 - RNA, 23 nt, Pseudomonas aeruginosa PA01
ugauccgcucgaucccggcgcgg

SEQ ID NO: 1400057 - RNA, 18 nt, Pseudomonas aeruginosa PA01
ugauccugggcgccagcc

SEQ ID NO: 1400058 - RNA, 16 nt, Pseudomonas aeruginosa PA01
ugaucgacucgauggc

SEQ ID NO: 1400059 - RNA, 21 nt, Pseudomonas aeruginosa PA01
ugaucgacucgauggcgcggu

SEQ ID NO: 1400060 - RNA, 21 nt, Pseudomonas aeruginosa PA01
ugaucgacugcaugaccucca

SEQ ID NO: 1400061 - RNA, 20 nt, Pseudomonas aeruginosa PA01
ugaucgagcccuugcgcggc

SEQ ID NO: 1400062 - RNA, 17 nt, Pseudomonas aeruginosa PA01
ugaucgaccucgcgggc

SEQ ID NO: 1400063 - RNA, 16 nt, Pseudomonas aeruginosa PA01
ugaucgaagcccaucg

SEQ ID NO: 1400064 - RNA, 17 nt, Pseudomonas aeruginosa PA01
ugauccgcacccgcgac

SEQ ID NO: 1400065 - RNA, 15 nt, Pseudomonas aeruginosa PA01
ugaucuccgcgccgg

SEQ ID NO: 1400066 - RNA, 23 nt, Pseudomonas aeruginosa PA01
ugaucucgaacucgaaggccagc

SEQ ID NO: 1400067 - RNA, 14 nt, Pseudomonas aeruginosa PA01
ugaucucgcggcgc

SEQ ID NO: 1400068 - RNA, 16 nt, Pseudomonas aeruginosa PA01
ugaucucgcggcgcgg

SEQ ID NO: 1400069 - RNA, 14 nt, Pseudomonas aeruginosa PA01
ugaucugcauggcg

SEQ ID NO: 1400070 - RNA, 18 nt, Pseudomonas aeruginosa PA01
ugaucuccaggucgcccu

SEQ ID NO: 1400071 - RNA, 22 nt, Pseudomonas aeruginosa PA01
ugaucgagggaggucgcacgca

SEQ ID NO: 1400072 - RNA, 16 nt, Pseudomonas aeruginosa PA01
ugaucgagggccacga

SEQ ID NO: 1400073 - RNA, 15 nt, Pseudomonas aeruginosa PA01
ugaucgagucgccgg

SEQ ID NO: 1400074 - RNA, 13 nt, Pseudomonas aeruginosa PA01
ugaucgccgcgcc

SEQ ID NO: 1400075 - RNA, 15 nt, Pseudomonas aeruginosa PA01
ugaucgccgcgccgc

SEQ ID NO: 1400076 - RNA, 21 nt, Pseudomonas aeruginosa PA01
ugaucgggugggacauggaga

SEQ ID NO: 1400077 - RNA, 15 nt, Pseudomonas aeruginosa PA01
ugaucgguucccgcc

SEQ ID NO: 1400078 - RNA, 12 nt, Pseudomonas aeruginosa PA01
ugaucggcgcgc

SEQ ID NO: 1400079 - RNA, 12 nt, Pseudomonas aeruginosa PA01
ugaucgcgccgg

SEQ ID NO: 1400080 - RNA, 22 nt, Pseudomonas aeruginosa PA01
ugaucgcgugggccaccaucag

SEQ ID NO: 1400081 - RNA, 23 nt, Pseudomonas aeruginosa PA01
ugacgaacaguucgaugggccgg

SEQ ID NO: 1400082 - RNA, 14 nt, Pseudomonas aeruginosa PA01
ugacgaacaucgcc

SEQ ID NO: 1400083 - RNA, 16 nt, Pseudomonas aeruginosa PA01
ugacgaacaucgccag

SEQ ID NO: 1400084 - RNA, 18 nt, Pseudomonas aeruginosa PA01
ugacgaacaucgccagcg

SEQ ID NO: 1400085 - RNA, 20 nt, Pseudomonas aeruginosa PA01
ugacgaacaucgccagcgcc

SEQ ID NO: 1400086 - RNA, 23 nt, Pseudomonas aeruginosa PA01
ugacgaacaucgccagcgccacg

SEQ ID NO: 1400087 - RNA, 16 nt, Pseudomonas aeruginosa PA01
ugacgaacgaagcgcc

SEQ ID NO: 1400088 - RNA, 16 nt, Pseudomonas aeruginosa PA01
ugacgaagcgcaccgg

SEQ ID NO: 1400089 - RNA, 16 nt, Pseudomonas aeruginosa PA01
ugacgaacugcacgcc

SEQ ID NO: 1400090 - RNA, 17 nt, Pseudomonas aeruginosa PA01
ugaccuugucggccgac

SEQ ID NO: 1400091 - RNA, 14 nt, Pseudomonas aeruginosa PA01
ugaccuugccgccg

SEQ ID NO: 1400092 - RNA, 18 nt, Pseudomonas aeruginosa PA01
ugacgaaaccggcguccu

SEQ ID NO: 1400093 - RNA, 22 nt, Pseudomonas aeruginosa PA01
ugacgaaauacucgucgacggc

SEQ ID NO: 1400094 - RNA, 18 nt, Pseudomonas aeruginosa PA01
ugacgaaggcggcagcgg

SEQ ID NO: 1400095 - RNA, 15 nt, Pseudomonas aeruginosa PA01
ugacgaaggcuggag

SEQ ID NO: 1400096 - RNA, 20 nt, Pseudomonas aeruginosa PA01
ugaccugcugggccagcgcc

SEQ ID NO: 1400097 - RNA, 14 nt, Pseudomonas aeruginosa PA01
ugaccuucacuucg

SEQ ID NO: 1400098 - RNA, 23 nt, Pseudomonas aeruginosa PA01
ugaccuucagcaccugcgccgaa

SEQ ID NO: 1400099 - RNA, 19 nt, Pseudomonas aeruginosa PA01
ugaccugggauggggcugc

SEQ ID NO: 1400100 - RNA, 22 nt, Pseudomonas aeruginosa PA01
ugaccuucugcaccgugcgcgc

SEQ ID NO: 1400101 - RNA, 17 nt, Pseudomonas aeruginosa PA01
ugaccucccgcgccagc

SEQ ID NO: 1400102 - RNA, 22 nt, Pseudomonas aeruginosa PA01
ugaccgugaugcccagcggcgc

SEQ ID NO: 1400103 - RNA, 18 nt, Pseudomonas aeruginosa PA01
ugaccguccuggcccugc

SEQ ID NO: 1400104 - RNA, 18 nt, Pseudomonas aeruginosa PA01
ugaccguccacggcgcgu

SEQ ID NO: 1400105 - RNA, 14 nt, Pseudomonas aeruginosa PA01
ugaccguccacacc

SEQ ID NO: 1400106 - RNA, 18 nt, Pseudomonas aeruginosa PA01
ugaccgucagccaggcug

SEQ ID NO: 1400107 - RNA, 20 nt, Pseudomonas aeruginosa PA01
ugaccgcgaauggcagcagg

SEQ ID NO: 1400108 - RNA, 17 nt, Pseudomonas aeruginosa PA01
ugaccggcaucgaccag

SEQ ID NO: 1400109 - RNA, 21 nt, Pseudomonas aeruginosa PA01
ugaccggcaucgaccagcagc

SEQ ID NO: 1400110 - RNA, 16 nt, Pseudomonas aeruginosa PA01
ugaccgauggcgccgc

SEQ ID NO: 1400111 - RNA, 12 nt, Pseudomonas aeruginosa PA01
ugaccgccccgg

SEQ ID NO: 1400112 - RNA, 15 nt, Pseudomonas aeruginosa PA01
ugaccgccgccgccu

SEQ ID NO: 1400113 - RNA, 14 nt, Pseudomonas aeruginosa PA01
ugaccacgcucagc

SEQ ID NO: 1400114 - RNA, 16 nt, Pseudomonas aeruginosa PA01
ugaccaccaggcgguc

SEQ ID NO: 1400115 - RNA, 18 nt, Pseudomonas aeruginosa PA01
ugaccaccagggcgaugg

SEQ ID NO: 1400116 - RNA, 15 nt, Pseudomonas aeruginosa PA01
ugacacccugccgcg

SEQ ID NO: 1400117 - RNA, 19 nt, Pseudomonas aeruginosa PA01
ugacacccugccgcgccgg

SEQ ID NO: 1400118 - RNA, 19 nt, Pseudomonas aeruginosa PA01
ugacagcgaauuugaacgc

SEQ ID NO: 1400119 - RNA, 18 nt, Pseudomonas aeruginosa PA01
ugacccgacugcagcggu

SEQ ID NO: 1400120 - RNA, 13 nt, Pseudomonas aeruginosa PA01
ugacccgcacggc

SEQ ID NO: 1400121 - RNA, 21 nt, Pseudomonas aeruginosa PA01
ugaccccggccuggcuggccu

SEQ ID NO: 1400122 - RNA, 19 nt, Pseudomonas aeruginosa PA01
ugacccagagccgcucggc

SEQ ID NO: 1400123 - RNA, 21 nt, Pseudomonas aeruginosa PA01
ugacccagagccgcucggcgg

SEQ ID NO: 1400124 - RNA, 22 nt, Pseudomonas aeruginosa PA01
ugacccagagccgcucggcggg

SEQ ID NO: 1400125 - RNA, 17 nt, Pseudomonas aeruginosa PA01
ugacccaggcuucggcg

SEQ ID NO: 1400126 - RNA, 13 nt, Pseudomonas aeruginosa PA01
ugacccgcucgcc

SEQ ID NO: 1400127 - RNA, 14 nt, Pseudomonas aeruginosa PA01
ugacccgcugcacc

SEQ ID NO: 1400128 - RNA, 17 nt, Pseudomonas aeruginosa PA01
ugacccgcugcaccagc

SEQ ID NO: 1400129 - RNA, 13 nt, Pseudomonas aeruginosa PA01
ugacccgcugcug

SEQ ID NO: 1400130 - RNA, 18 nt, Pseudomonas aeruginosa PA01
ugacccgcuguccgccgg

SEQ ID NO: 1400131 - RNA, 22 nt, Pseudomonas aeruginosa PA01
ugacccgcuguccgccggccuc

SEQ ID NO: 1400132 - RNA, 14 nt, Pseudomonas aeruginosa PA01
ugacccgccccugc

SEQ ID NO: 1400133 - RNA, 16 nt, Pseudomonas aeruginosa PA01
ugacccguugcgccuc

SEQ ID NO: 1400134 - RNA, 16 nt, Pseudomonas aeruginosa PA01
ugacccgguacagcgc

SEQ ID NO: 1400135 - RNA, 19 nt, Pseudomonas aeruginosa PA01
ugacccgguacagcgccug

SEQ ID NO: 1400136 - RNA, 20 nt, Pseudomonas aeruginosa PA01
ugaccagcgcgucgaccacc

SEQ ID NO: 1400137 - RNA, 17 nt, Pseudomonas aeruginosa PA01
ugaccagcggcaccgag

SEQ ID NO: 1400138 - RNA, 20 nt, Pseudomonas aeruginosa PA01
ugaccagcggcaccgagagc

SEQ ID NO: 1400139 - RNA, 16 nt, Pseudomonas aeruginosa PA01
ugaccagcccggcggc

SEQ ID NO: 1400140 - RNA, 20 nt, Pseudomonas aeruginosa PA01
ugaccagcgcaucggcgccu

SEQ ID NO: 1400141 - RNA, 23 nt, Pseudomonas aeruginosa PA01
ugaccagcagggugcggauggcg

SEQ ID NO: 1400142 - RNA, 18 nt, Pseudomonas aeruginosa PA01
ugaccaggcugaucagcc

SEQ ID NO: 1400143 - RNA, 16 nt, Pseudomonas aeruginosa PA01
ugaccaggguggcggc

SEQ ID NO: 1400144 - RNA, 17 nt, Pseudomonas aeruginosa PA01
ugaccagcucggcggga

SEQ ID NO: 1400145 - RNA, 23 nt, Pseudomonas aeruginosa PA01
ugaccagucccggcuugccggca

SEQ ID NO: 1400146 - RNA, 13 nt, Pseudomonas aeruginosa PA01
ugaaccggggcgg

SEQ ID NO: 1400147 - RNA, 16 nt, Pseudomonas aeruginosa PA01
ugaacgacucgucgcc

SEQ ID NO: 1400148 - RNA, 23 nt, Pseudomonas aeruginosa PA01
ugaacugcgguccggcgaagucc

SEQ ID NO: 1400149 - RNA, 22 nt, Pseudomonas aeruginosa PA01
ugaacuggaugucgcuggccag

SEQ ID NO: 1400150 - RNA, 12 nt, Pseudomonas aeruginosa PA01
ugaacuggccgu

SEQ ID NO: 1400151 - RNA, 13 nt, Pseudomonas aeruginosa PA01
ucuuugccuggaa

SEQ ID NO: 1400152 - RNA, 19 nt, Pseudomonas aeruginosa PA01
ucucccuguccuacccgag

SEQ ID NO: 1400153 - RNA, 13 nt, Pseudomonas aeruginosa PA01
ucuccccgcuccc

SEQ ID NO: 1400154 - RNA, 14 nt, Pseudomonas aeruginosa PA01
ucucccggcugguc

SEQ ID NO: 1400155 - RNA, 18 nt, Pseudomonas aeruginosa PA01
ucucccgcuccgauggcg

SEQ ID NO: 1400156 - RNA, 13 nt, Pseudomonas aeruginosa PA01
ucuccagcucggc

SEQ ID NO: 1400157 - RNA, 13 nt, Pseudomonas aeruginosa PA01
ucuccaguucggc

SEQ ID NO: 1400158 - RNA, 18 nt, Pseudomonas aeruginosa PA01
ucuccaguucggcgauga

SEQ ID NO: 1400159 - RNA, 15 nt, Pseudomonas aeruginosa PA01
ugaaggcgcggggcg

SEQ ID NO: 1400160 - RNA, 22 nt, Pseudomonas aeruginosa PA01
ugaaggcgcggggcgaggucgg

SEQ ID NO: 1400161 - RNA, 23 nt, Pseudomonas aeruginosa PA01
ugaaggcgcggggcgaggucggc

SEQ ID NO: 1400162 - RNA, 22 nt, Pseudomonas aeruginosa PA01
ugaaggucagcacgccuuccag

SEQ ID NO: 1400163 - RNA, 15 nt, Pseudomonas aeruginosa PA01
ugaaguccuggccga

SEQ ID NO: 1400164 - RNA, 18 nt, Pseudomonas aeruginosa PA01
ugaagugauccaggucga

SEQ ID NO: 1400165 - RNA, 16 nt, Pseudomonas aeruginosa PA01
ugaagaagcugccggc

SEQ ID NO: 1400166 - RNA, 18 nt, Pseudomonas aeruginosa PA01
ugaagaagccauugccga

SEQ ID NO: 1400167 - RNA, 22 nt, Pseudomonas aeruginosa PA01
ugaagagcucccugccgcccuu

SEQ ID NO: 1400168 - RNA, 23 nt, Pseudomonas aeruginosa PA01
ugaagaguucgcugaaggucgcc

SEQ ID NO: 1400169 - RNA, 11 nt, Pseudomonas aeruginosa PA01
ugaaggccgac

SEQ ID NO: 1400170 - RNA, 16 nt, Pseudomonas aeruginosa PA01
ugaaggaaaccggcca

SEQ ID NO: 1400171 - RNA, 14 nt, Pseudomonas aeruginosa PA01
ugaagcugccgucg

SEQ ID NO: 1400172 - RNA, 18 nt, Pseudomonas aeruginosa PA01
ugaagcuggagcagcagc

SEQ ID NO: 1400173 - RNA, 19 nt, Pseudomonas aeruginosa PA01
ugaagcuggagcagcagcg

SEQ ID NO: 1400174 - RNA, 13 nt, Pseudomonas aeruginosa PA01
uaugccucggcgg

SEQ ID NO: 1400175 - RNA, 15 nt, Pseudomonas aeruginosa PA01
uaugccucggcggcg

SEQ ID NO: 1400176 - RNA, 17 nt, Pseudomonas aeruginosa PA01
uaucgcuggcgcagccg

SEQ ID NO: 1400177 - RNA, 13 nt, Pseudomonas aeruginosa PA01
uaucgcggcgcga

SEQ ID NO: 1400178 - RNA, 13 nt, Pseudomonas aeruginosa PA01
uaucgcgugguga

SEQ ID NO: 1400179 - RNA, 17 nt, Pseudomonas aeruginosa PA01
uaucgccaacgccaccg

SEQ ID NO: 1400180 - RNA, 15 nt, Pseudomonas aeruginosa PA01
uaucgccgccgcagc

SEQ ID NO: 1400181 - RNA, 13 nt, Pseudomonas aeruginosa PA01
uaucgaugcgcgc

SEQ ID NO: 1400182 - RNA, 14 nt, Pseudomonas aeruginosa PA01
uaucgaugcgcgcg

SEQ ID NO: 1400183 - RNA, 19 nt, Pseudomonas aeruginosa PA01
uaucgaugcgcgcggcgag

SEQ ID NO: 1400184 - RNA, 21 nt, Pseudomonas aeruginosa PA01
uagcggguggcaacugccgcc

SEQ ID NO: 1400185 - RNA, 20 nt, Pseudomonas aeruginosa PA01
uagcgggcauccagcggacg

SEQ ID NO: 1400186 - RNA, 13 nt, Pseudomonas aeruginosa PA01
uagcgggccagca

SEQ ID NO: 1400187 - RNA, 15 nt, Pseudomonas aeruginosa PA01
uagcgggccagcagc

SEQ ID NO: 1400188 - RNA, 21 nt, Pseudomonas aeruginosa PA01
uagcgguagccgucaagcaac

SEQ ID NO: 1400189 - RNA, 16 nt, Pseudomonas aeruginosa PA01
uaugcgcggucaccag

SEQ ID NO: 1400190 - RNA, 23 nt, Pseudomonas aeruginosa PA01
ucaacgaccgcccaggcugccgc

SEQ ID NO: 1400191 - RNA, 14 nt, Pseudomonas aeruginosa PA01
ucaacgagccgagc

SEQ ID NO: 1400192 - RNA, 19 nt, Pseudomonas aeruginosa PA01
ucaacgagccgagcaggcc

SEQ ID NO: 1400193 - RNA, 13 nt, Pseudomonas aeruginosa PA01
ucaaccgcgggcg

SEQ ID NO: 1400194 - RNA, 19 nt, Pseudomonas aeruginosa PA01
ucaaccccuggaucuccug

SEQ ID NO: 1400195 - RNA, 22 nt, Pseudomonas aeruginosa PA01
ucaacccuugcucccgccgcuc

SEQ ID NO: 1400196 - RNA, 19 nt, Pseudomonas aeruginosa PA01
ucaacagcgaagcuggcgc

SEQ ID NO: 1400197 - RNA, 17 nt, Pseudomonas aeruginosa PA01
ucaacaccagcgccgcc

SEQ ID NO: 1400198 - RNA, 15 nt, Pseudomonas aeruginosa PA01
ucaaagggcagcggc

SEQ ID NO: 1400199 - RNA, 18 nt, Pseudomonas aeruginosa PA01
ucaacggcgugccgggca

SEQ ID NO: 1400200 - RNA, 19 nt, Pseudomonas aeruginosa PA01
ucaacggcgaccgcuggac

SEQ ID NO: 1400201 - RNA, 18 nt, Pseudomonas aeruginosa PA01
ucaacuggucgcagccgc

SEQ ID NO: 1400202 - RNA, 19 nt, Pseudomonas aeruginosa PA01
ucaacugguuggccgccug

SEQ ID NO: 1400203 - RNA, 15 nt, Pseudomonas aeruginosa PA01
ucaagacgaaaaagc

SEQ ID NO: 1400204 - RNA, 22 nt, Pseudomonas aeruginosa PA01
ucaagggccaggaaaucgagcg

SEQ ID NO: 1400205 - RNA, 16 nt, Pseudomonas aeruginosa PA01
ucaaucgcgcaacggc

SEQ ID NO: 1400206 - RNA, 14 nt, Pseudomonas aeruginosa PA01
ucagcacccuggcc

SEQ ID NO: 1400207 - RNA, 16 nt, Pseudomonas aeruginosa PA01
ucagauacuccagcag

SEQ ID NO: 1400208 - RNA, 18 nt, Pseudomonas aeruginosa PA01
ucagaggcgaccagccgg

SEQ ID NO: 1400209 - RNA, 23 nt, Pseudomonas aeruginosa PA01
ucagagcagggugaagcugcggc

SEQ ID NO: 1400210 - RNA, 14 nt, Pseudomonas aeruginosa PA01
ucagagcuggacga

SEQ ID NO: 1400211 - RNA, 17 nt, Pseudomonas aeruginosa PA01
ucagagcuggacgacgc

SEQ ID NO: 1400212 - RNA, 18 nt, Pseudomonas aeruginosa PA01
ucagcacgucguccagcg

SEQ ID NO: 1400213 - RNA, 11 nt, Pseudomonas aeruginosa PA01
ucagcagcacc

SEQ ID NO: 1400214 - RNA, 14 nt, Pseudomonas aeruginosa PA01
ucagcacuucggcg

SEQ ID NO: 1400215 - RNA, 20 nt, Pseudomonas aeruginosa PA01
ucagcacuucggcgcgcggc

SEQ ID NO: 1400216 - RNA, 22 nt, Pseudomonas aeruginosa PA01
ucagcacuucggcgcgcggcag

SEQ ID NO: 1400217 - RNA, 13 nt, Pseudomonas aeruginosa PA01
ucagcagcaggcg

SEQ ID NO: 1400218 - RNA, 19 nt, Pseudomonas aeruginosa PA01
ucagcagcaggcgcucggg

SEQ ID NO: 1400219 - RNA, 23 nt, Pseudomonas aeruginosa PA01
ucagcagcaugccgcucugccag

SEQ ID NO: 1400220 - RNA, 18 nt, Pseudomonas aeruginosa PA01
ucagcagcaugucgccgg

SEQ ID NO: 1400221 - RNA, 21 nt, Pseudomonas aeruginosa PA01
ucagcaggcccgagccggacg

SEQ ID NO: 1400222 - RNA, 23 nt, Pseudomonas aeruginosa PA01
ucagcaggcccgagccggacgag

SEQ ID NO: 1400223 - RNA, 20 nt, Pseudomonas aeruginosa PA01
ucagcaggucgcggccccag

SEQ ID NO: 1400224 - RNA, 18 nt, Pseudomonas aeruginosa PA01
ucagcagcggcacccggc

SEQ ID NO: 1400225 - RNA, 13 nt, Pseudomonas aeruginosa PA01
ucagcagcgccac

SEQ ID NO: 1400226 - RNA, 14 nt, Pseudomonas aeruginosa PA01
ucagcagcgccagc

SEQ ID NO: 1400227 - RNA, 22 nt, Pseudomonas aeruginosa PA01
ucagcagcgccagcaggucgcg

SEQ ID NO: 1400228 - RNA, 15 nt, Pseudomonas aeruginosa PA01
ucagcagcgccagua

SEQ ID NO: 1400229 - RNA, 16 nt, Pseudomonas aeruginosa PA01
ucagcagcgccgcccu

SEQ ID NO: 1400230 - RNA, 15 nt, Pseudomonas aeruginosa PA01
ucagcagugcggggc

SEQ ID NO: 1400231 - RNA, 20 nt, Pseudomonas aeruginosa PA01
ucagcagugcggggcgcucg

SEQ ID NO: 1400232 - RNA, 22 nt, Pseudomonas aeruginosa PA01
ucagcagugcggggcgcucgcc

SEQ ID NO: 1400233 - RNA, 21 nt, Pseudomonas aeruginosa PA01
ucagcccgccgugcgcuccgc

SEQ ID NO: 1400234 - RNA, 16 nt, Pseudomonas aeruginosa PA01
ucagcccggcaccagg

SEQ ID NO: 1400235 - RNA, 12 nt, Pseudomonas aeruginosa PA01
ucagcccgcuga

SEQ ID NO: 1400236 - RNA, 16 nt, Pseudomonas aeruginosa PA01
ucagcccgcugaccgg

SEQ ID NO: 1400237 - RNA, 19 nt, Pseudomonas aeruginosa PA01
ucagcccgcugaccgggcg

SEQ ID NO: 1400238 - RNA, 21 nt, Pseudomonas aeruginosa PA01
ucagccucacccugcugggcg

SEQ ID NO: 1400239 - RNA, 18 nt, Pseudomonas aeruginosa PA01
ucagcccaggcgccgcuc

SEQ ID NO: 1400240 - RNA, 23 nt, Pseudomonas aeruginosa PA01
ucagccccagcacgccgagcaac

SEQ ID NO: 1400241 - RNA, 20 nt, Pseudomonas aeruginosa PA01
ucagcccauacaccaggccg

SEQ ID NO: 1400242 - RNA, 22 nt, Pseudomonas aeruginosa PA01
ucagcccauacaccaggccggc

SEQ ID NO: 1400243 - RNA, 23 nt, Pseudomonas aeruginosa PA01
ucagcccauacaccaggccggcg

SEQ ID NO: 1400244 - RNA, 15 nt, Pseudomonas aeruginosa PA01
ucagccccgaucgcc

SEQ ID NO: 1400245 - RNA, 16 nt, Pseudomonas aeruginosa PA01
ucagccccucggccag

SEQ ID NO: 1400246 - RNA, 17 nt, Pseudomonas aeruginosa PA01
ucagccccucggccagg

SEQ ID NO: 1400247 - RNA, 17 nt, Pseudomonas aeruginosa PA01
ucagccauagaguugcu

SEQ ID NO: 1400248 - RNA, 23 nt, Pseudomonas aeruginosa PA01
ucagccauuggccgacgccgcug

SEQ ID NO: 1400249 - RNA, 22 nt, Pseudomonas aeruginosa PA01
ucagcccacccccagcccggcc

SEQ ID NO: 1400250 - RNA, 23 nt, Pseudomonas aeruginosa PA01
ucagcccacccccagcccggcca

SEQ ID NO: 1400251 - RNA, 19 nt, Pseudomonas aeruginosa PA01
ucagcccacgcgccuggcc

SEQ ID NO: 1400252 - RNA, 20 nt, Pseudomonas aeruginosa PA01
ucagcccacgcgccuggccg

SEQ ID NO: 1400253 - RNA, 22 nt, Pseudomonas aeruginosa PA01
ucagcccacgcgccuggccguc

SEQ ID NO: 1400254 - RNA, 21 nt, Pseudomonas aeruginosa PA01
ucacggugaugguaucgccgu

SEQ ID NO: 1400255 - RNA, 15 nt, Pseudomonas aeruginosa PA01
ucacggucagcucgg

SEQ ID NO: 1400256 - RNA, 22 nt, Pseudomonas aeruginosa PA01
ucacggguguuucggccgcugc

SEQ ID NO: 1400257 - RNA, 14 nt, Pseudomonas aeruginosa PA01
ucacggugacggug

SEQ ID NO: 1400258 - RNA, 22 nt, Pseudomonas aeruginosa PA01
ucacggcggauaaccgcgagcg

SEQ ID NO: 1400259 - RNA, 15 nt, Pseudomonas aeruginosa PA01
ucagaacugcucggc

SEQ ID NO: 1400260 - RNA, 17 nt, Pseudomonas aeruginosa PA01
ucagaacugcucggcgu

SEQ ID NO: 1400261 - RNA, 15 nt, Pseudomonas aeruginosa PA01
ucagaacagcggcag

SEQ ID NO: 1400262 - RNA, 14 nt, Pseudomonas aeruginosa PA01
ucacucgccgccgu

SEQ ID NO: 1400263 - RNA, 15 nt, Pseudomonas aeruginosa PA01
ucacucgccgccguc

SEQ ID NO: 1400264 - RNA, 14 nt, Pseudomonas aeruginosa PA01
ucacuacaggaccu

SEQ ID NO: 1400265 - RNA, 21 nt, Pseudomonas aeruginosa PA01
ucacuccugcguacagggaac

SEQ ID NO: 1400266 - RNA, 18 nt, Pseudomonas aeruginosa PA01
ucacucauccucgccgcu

SEQ ID NO: 1400267 - RNA, 15 nt, Pseudomonas aeruginosa PA01
ucaccguggcgcugg

SEQ ID NO: 1400268 - RNA, 20 nt, Pseudomonas aeruginosa PA01
ucaccguggcgcuggccgaa

SEQ ID NO: 1400269 - RNA, 21 nt, Pseudomonas aeruginosa PA01
ucaccguggucauggcgcaga

SEQ ID NO: 1400270 - RNA, 17 nt, Pseudomonas aeruginosa PA01
ucaccgugaucccgcgc

SEQ ID NO: 1400271 - RNA, 16 nt, Pseudomonas aeruginosa PA01
ucaccguccuucggcc

SEQ ID NO: 1400272 - RNA, 19 nt, Pseudomonas aeruginosa PA01
ucaccguccuucggccgca

SEQ ID NO: 1400273 - RNA, 21 nt, Pseudomonas aeruginosa PA01
ucaccguccuucggccgcacc

SEQ ID NO: 1400274 - RNA, 21 nt, Pseudomonas aeruginosa PA01
ucaccguggagaggucgccga

SEQ ID NO: 1400275 - RNA, 19 nt, Pseudomonas aeruginosa PA01
ucaccguucccagcagcgc

SEQ ID NO: 1400276 - RNA, 20 nt, Pseudomonas aeruginosa PA01
ucacgcggacccaguugggc

SEQ ID NO: 1400277 - RNA, 23 nt, Pseudomonas aeruginosa PA01
ucacgcggacccaguugggccag

SEQ ID NO: 1400278 - RNA, 14 nt, Pseudomonas aeruginosa PA01
ucacgccuggcggc

SEQ ID NO: 1400279 - RNA, 18 nt, Pseudomonas aeruginosa PA01
ucacggccuccgguggcg

SEQ ID NO: 1400280 - RNA, 15 nt, Pseudomonas aeruginosa PA01
ucacggcgaagcggc

SEQ ID NO: 1400281 - RNA, 14 nt, Pseudomonas aeruginosa PA01
ucacggcgccccgg

SEQ ID NO: 1400282 - RNA, 19 nt, Pseudomonas aeruginosa PA01
ucacggcgccccgggucgg

SEQ ID NO: 1400283 - RNA, 17 nt, Pseudomonas aeruginosa PA01
ucacgccgcgcaccagc

SEQ ID NO: 1400284 - RNA, 22 nt, Pseudomonas aeruginosa PA01
ucacgccgagggcgcggcgcca

SEQ ID NO: 1400285 - RNA, 11 nt, Pseudomonas aeruginosa PA01
ucacgccgauc

SEQ ID NO: 1400286 - RNA, 17 nt, Pseudomonas aeruginosa PA01
ucacgccgaucccggcg

SEQ ID NO: 1400287 - RNA, 19 nt, Pseudomonas aeruginosa PA01
ucacgccgaucccggcggc

SEQ ID NO: 1400288 - RNA, 12 nt, Pseudomonas aeruginosa PA01
ucacaucgcccg

SEQ ID NO: 1400289 - RNA, 14 nt, Pseudomonas aeruginosa PA01
ucacaucgcccggc

SEQ ID NO: 1400290 - RNA, 22 nt, Pseudomonas aeruginosa PA01
ucacaucgcccggcagcaggcc

SEQ ID NO: 1400291 - RNA, 20 nt, Pseudomonas aeruginosa PA01
ucacaugcaccaggcccugc

SEQ ID NO: 1400292 - RNA, 15 nt, Pseudomonas aeruginosa PA01
ucaccaccucgugcu

SEQ ID NO: 1400293 - RNA, 18 nt, Pseudomonas aeruginosa PA01
ucaccaccggcuggcggc

SEQ ID NO: 1400294 - RNA, 20 nt, Pseudomonas aeruginosa PA01
ucaccaccggcuggcggcuc

SEQ ID NO: 1400295 - RNA, 21 nt, Pseudomonas aeruginosa PA01
ucaccaccggcuggcggcucg

SEQ ID NO: 1400296 - RNA, 22 nt, Pseudomonas aeruginosa PA01
ucaccaccggcuggcggcucgg

SEQ ID NO: 1400297 - RNA, 23 nt, Pseudomonas aeruginosa PA01
ucaccaccggcuggcggcucggc

SEQ ID NO: 1400298 - RNA, 18 nt, Pseudomonas aeruginosa PA01
ucaccaccaccgcgccga

SEQ ID NO: 1400299 - RNA, 14 nt, Pseudomonas aeruginosa PA01
ucaccaccaccguc

SEQ ID NO: 1400300 - RNA, 18 nt, Pseudomonas aeruginosa PA01
ucaccaccagcgccgcca

SEQ ID NO: 1400301 - RNA, 18 nt, Pseudomonas aeruginosa PA01
ucaccacccagccgcggc

SEQ ID NO: 1400302 - RNA, 20 nt, Pseudomonas aeruginosa PA01
ucacauuggcuuccgagcag

SEQ ID NO: 1400303 - RNA, 16 nt, Pseudomonas aeruginosa PA01
ucaaugcguuccuguc

SEQ ID NO: 1400304 - RNA, 20 nt, Pseudomonas aeruginosa PA01
ucaauugccgguagccggcg

SEQ ID NO: 1400305 - RNA, 22 nt, Pseudomonas aeruginosa PA01
ucaccacgcgauauccgccagg

SEQ ID NO: 1400306 - RNA, 24 nt, Pseudomonas aeruginosa PA01
ucaccacgcgauauccgccaggcg

SEQ ID NO: 1400307 - RNA, 13 nt, Pseudomonas aeruginosa PA01
ucaccagccacug

SEQ ID NO: 1400308 - RNA, 22 nt, Pseudomonas aeruginosa PA01
ucaccagccacugcuuggcgaa

SEQ ID NO: 1400309 - RNA, 22 nt, Pseudomonas aeruginosa PA01
ucaccagcaauugccggcguga

SEQ ID NO: 1400310 - RNA, 19 nt, Pseudomonas aeruginosa PA01
ucaccaggaucgccgggcu

SEQ ID NO: 1400311 - RNA, 22 nt, Pseudomonas aeruginosa PA01
ucaccagcggguaguagaucag

SEQ ID NO: 1400312 - RNA, 18 nt, Pseudomonas aeruginosa PA01
ucaccagcggcgagcagg

SEQ ID NO: 1400313 - RNA, 12 nt, Pseudomonas aeruginosa PA01
ucaccagcgcug

SEQ ID NO: 1400314 - RNA, 14 nt, Pseudomonas aeruginosa PA01
ucaccagcgccagg

SEQ ID NO: 1400315 - RNA, 21 nt, Pseudomonas aeruginosa PA01
ucaccagcgccgucaccagca

SEQ ID NO: 1400316 - RNA, 16 nt, Pseudomonas aeruginosa PA01
ucaccaggcugccgcc

SEQ ID NO: 1400317 - RNA, 19 nt, Pseudomonas aeruginosa PA01
ucaccaggcugccgccgua

SEQ ID NO: 1400318 - RNA, 15 nt, Pseudomonas aeruginosa PA01
ucaccagggucacgc

SEQ ID NO: 1400319 - RNA, 13 nt, Pseudomonas aeruginosa PA01
ucaccccgaccag

SEQ ID NO: 1400320 - RNA, 14 nt, Pseudomonas aeruginosa PA01
ucaccccgaccagc

SEQ ID NO: 1400321 - RNA, 21 nt, Pseudomonas aeruginosa PA01
ucacccacauggcgguccagg

SEQ ID NO: 1400322 - RNA, 12 nt, Pseudomonas aeruginosa PA01
ucaccgcgccgc

SEQ ID NO: 1400323 - RNA, 15 nt, Pseudomonas aeruginosa PA01
ucaccgcggcgcuga

SEQ ID NO: 1400324 - RNA, 20 nt, Pseudomonas aeruginosa PA01
ucaccgcggcgcugaaggcg

SEQ ID NO: 1400325 - RNA, 20 nt, Pseudomonas aeruginosa PA01
ucaccgcguccauccccgcc

SEQ ID NO: 1400326 - RNA, 23 nt, Pseudomonas aeruginosa PA01
ucaccgcguccauccccgccucg

SEQ ID NO: 1400327 - RNA, 23 nt, Pseudomonas aeruginosa PA01
ucaccgcgcuugacgacugcacg

SEQ ID NO: 1400328 - RNA, 16 nt, Pseudomonas aeruginosa PA01
ucacccgcgaggccgg

SEQ ID NO: 1400329 - RNA, 14 nt, Pseudomonas aeruginosa PA01
ucacccgcgccugc

SEQ ID NO: 1400330 - RNA, 17 nt, Pseudomonas aeruginosa PA01
ucacccgcgccugcagg

SEQ ID NO: 1400331 - RNA, 20 nt, Pseudomonas aeruginosa PA01
ucacccggcgaagcuccucg

SEQ ID NO: 1400332 - RNA, 20 nt, Pseudomonas aeruginosa PA01
ucacccgguucucgccccag

SEQ ID NO: 1400333 - RNA, 18 nt, Pseudomonas aeruginosa PA01
ucaccgacagucccaggc

SEQ ID NO: 1400334 - RNA, 21 nt, Pseudomonas aeruginosa PA01
ucauacgaaaaaaaggcgcug

SEQ ID NO: 1400335 - RNA, 17 nt, Pseudomonas aeruginosa PA01
ucaggguggcgaucacg

SEQ ID NO: 1400336 - RNA, 22 nt, Pseudomonas aeruginosa PA01
ucagggugaucuguucgaccag

SEQ ID NO: 1400337 - RNA, 22 nt, Pseudomonas aeruginosa PA01
ucaggugcguacuuggcccggc

SEQ ID NO: 1400338 - RNA, 20 nt, Pseudomonas aeruginosa PA01
ucaggugcuggacucgcgcc

SEQ ID NO: 1400339 - RNA, 17 nt, Pseudomonas aeruginosa PA01
ucagguugccggcgugc

SEQ ID NO: 1400340 - RNA, 14 nt, Pseudomonas aeruginosa PA01
ucagguuggacagg

SEQ ID NO: 1400341 - RNA, 14 nt, Pseudomonas aeruginosa PA01
ucagucccgcggcg

SEQ ID NO: 1400342 - RNA, 18 nt, Pseudomonas aeruginosa PA01
ucagcgacagcauggccu

SEQ ID NO: 1400343 - RNA, 20 nt, Pseudomonas aeruginosa PA01
ucagcgagcuucgccgcgca

SEQ ID NO: 1400344 - RNA, 17 nt, Pseudomonas aeruginosa PA01
ucagcgacugguggucg

SEQ ID NO: 1400345 - RNA, 21 nt, Pseudomonas aeruginosa PA01
ucagcgacugguggucgaggg

SEQ ID NO: 1400346 - RNA, 19 nt, Pseudomonas aeruginosa PA01
ucaggcgggcuccgccgcc

SEQ ID NO: 1400347 - RNA, 19 nt, Pseudomonas aeruginosa PA01
ucaggcggcacucggcgac

SEQ ID NO: 1400348 - RNA, 16 nt, Pseudomonas aeruginosa PA01
ucaggcgcugcgcggc

SEQ ID NO: 1400349 - RNA, 11 nt, Pseudomonas aeruginosa PA01
ucaggcgcugg

SEQ ID NO: 1400350 - RNA, 15 nt, Pseudomonas aeruginosa PA01
ucaggcgcuugucca

SEQ ID NO: 1400351 - RNA, 21 nt, Pseudomonas aeruginosa PA01
ucaggcgcuccgggcuccacc

SEQ ID NO: 1400352 - RNA, 23 nt, Pseudomonas aeruginosa PA01
ucaggcgcuccuugagcagcucg

SEQ ID NO: 1400353 - RNA, 11 nt, Pseudomonas aeruginosa PA01
ucaggcgccgu

SEQ ID NO: 1400354 - RNA, 14 nt, Pseudomonas aeruginosa PA01
ucaggcgcgcggcc

SEQ ID NO: 1400355 - RNA, 23 nt, Pseudomonas aeruginosa PA01
ucaggcgcgcggucuucaucacc

SEQ ID NO: 1400356 - RNA, 21 nt, Pseudomonas aeruginosa PA01
ucaggcgcgcucgggaucgcc

SEQ ID NO: 1400357 - RNA, 20 nt, Pseudomonas aeruginosa PA01
ucagcgagagcuguccggcg

SEQ ID NO: 1400358 - RNA, 14 nt, Pseudomonas aeruginosa PA01
ucaggcgcagcguc

SEQ ID NO: 1400359 - RNA, 17 nt, Pseudomonas aeruginosa PA01
ucaggcgcaugcccagg

SEQ ID NO: 1400360 - RNA, 13 nt, Pseudomonas aeruginosa PA01
ucaggcgccggcc

SEQ ID NO: 1400361 - RNA, 16 nt, Pseudomonas aeruginosa PA01
ucagggucucgcgggc

SEQ ID NO: 1400362 - RNA, 20 nt, Pseudomonas aeruginosa PA01
ucagggucggcccggagacc

SEQ ID NO: 1400363 - RNA, 19 nt, Pseudomonas aeruginosa PA01
ucagggcuugcgcgccacc

SEQ ID NO: 1400364 - RNA, 18 nt, Pseudomonas aeruginosa PA01
ucaggggccgacgcgcug

SEQ ID NO: 1400365 - RNA, 13 nt, Pseudomonas aeruginosa PA01
ucagggcugggcg

SEQ ID NO: 1400366 - RNA, 19 nt, Pseudomonas aeruginosa PA01
ucagggcgcgaaguagcgg

SEQ ID NO: 1400367 - RNA, 17 nt, Pseudomonas aeruginosa PA01
ucagggcguagcggaag

SEQ ID NO: 1400368 - RNA, 14 nt, Pseudomonas aeruginosa PA01
ucagggcgagcagg

SEQ ID NO: 1400369 - RNA, 17 nt, Pseudomonas aeruginosa PA01
ucagggcgagcagggca

SEQ ID NO: 1400370 - RNA, 17 nt, Pseudomonas aeruginosa PA01
ucagggccucgccacgc

SEQ ID NO: 1400371 - RNA, 18 nt, Pseudomonas aeruginosa PA01
ucagggacaugucgaggg

SEQ ID NO: 1400372 - RNA, 16 nt, Pseudomonas aeruginosa PA01
ucaggcuguccacgcc

SEQ ID NO: 1400373 - RNA, 20 nt, Pseudomonas aeruginosa PA01
ucaggcugguggucaccgcc

SEQ ID NO: 1400374 - RNA, 21 nt, Pseudomonas aeruginosa PA01
ucaggcugaucggcgcgccgg

SEQ ID NO: 1400375 - RNA, 14 nt, Pseudomonas aeruginosa PA01
ucaggcugccgagc

SEQ ID NO: 1400376 - RNA, 15 nt, Pseudomonas aeruginosa PA01
ucaggcugcgcaccu

SEQ ID NO: 1400377 - RNA, 16 nt, Pseudomonas aeruginosa PA01
ucaggcugcgcaccuc

SEQ ID NO: 1400378 - RNA, 16 nt, Pseudomonas aeruginosa PA01
ucaggcuggccccggu

SEQ ID NO: 1400379 - RNA, 15 nt, Pseudomonas aeruginosa PA01
ucaggcgugggccag

SEQ ID NO: 1400380 - RNA, 20 nt, Pseudomonas aeruginosa PA01
ucaggcguucgucguggcca

SEQ ID NO: 1400381 - RNA, 13 nt, Pseudomonas aeruginosa PA01
ucauguuguucgc

SEQ ID NO: 1400382 - RNA, 19 nt, Pseudomonas aeruginosa PA01
ucauggccagcucgaccuu

SEQ ID NO: 1400383 - RNA, 13 nt, Pseudomonas aeruginosa PA01
ucauggcguccgg

SEQ ID NO: 1400384 - RNA, 19 nt, Pseudomonas aeruginosa PA01
ucauggcgcacgccgcgga

SEQ ID NO: 1400385 - RNA, 13 nt, Pseudomonas aeruginosa PA01
ucauggcgccacu

SEQ ID NO: 1400386 - RNA, 19 nt, Pseudomonas aeruginosa PA01
ucauggcgccacucggcgu

SEQ ID NO: 1400387 - RNA, 20 nt, Pseudomonas aeruginosa PA01
ucauggcgccacucggcgug

SEQ ID NO: 1400388 - RNA, 17 nt, Pseudomonas aeruginosa PA01
ucaucucuucguugaug

SEQ ID NO: 1400389 - RNA, 20 nt, Pseudomonas aeruginosa PA01
ucaucugaccuuucaccggu

SEQ ID NO: 1400390 - RNA, 14 nt, Pseudomonas aeruginosa PA01
ucaugccgagcauc

SEQ ID NO: 1400391 - RNA, 19 nt, Pseudomonas aeruginosa PA01
ucaugccgccgucgcggcc

SEQ ID NO: 1400392 - RNA, 21 nt, Pseudomonas aeruginosa PA01
ucaugccgccgucgcggccau

SEQ ID NO: 1400393 - RNA, 11 nt, Pseudomonas aeruginosa PA01
ucaugcgcggg

SEQ ID NO: 1400394 - RNA, 12 nt, Pseudomonas aeruginosa PA01
ucaugcgcgggc

SEQ ID NO: 1400395 - RNA, 13 nt, Pseudomonas aeruginosa PA01
ucaucgccagcgg

SEQ ID NO: 1400396 - RNA, 12 nt, Pseudomonas aeruginosa PA01
ucaucgccggcg

SEQ ID NO: 1400397 - RNA, 20 nt, Pseudomonas aeruginosa PA01
ucaucgcccgcccucgucgc

SEQ ID NO: 1400398 - RNA, 17 nt, Pseudomonas aeruginosa PA01
ucaucgagcggcggccg

SEQ ID NO: 1400399 - RNA, 15 nt, Pseudomonas aeruginosa PA01
ucaucgaaaugccgc

SEQ ID NO: 1400400 - RNA, 14 nt, Pseudomonas aeruginosa PA01
ucauccuggcccug

SEQ ID NO: 1400401 - RNA, 18 nt, Pseudomonas aeruginosa PA01
ucauccucgccgcuggcg

SEQ ID NO: 1400402 - RNA, 13 nt, Pseudomonas aeruginosa PA01
ucauccugcgcgc

SEQ ID NO: 1400403 - RNA, 16 nt, Pseudomonas aeruginosa PA01
ucauccugcgcgccuc

SEQ ID NO: 1400404 - RNA, 21 nt, Pseudomonas aeruginosa PA01
uccagagccaugggccggccg

SEQ ID NO: 1400405 - RNA, 15 nt, Pseudomonas aeruginosa PA01
uccagcacgccgauc

SEQ ID NO: 1400406 - RNA, 13 nt, Pseudomonas aeruginosa PA01
uccagcacgcugg

SEQ ID NO: 1400407 - RNA, 14 nt, Pseudomonas aeruginosa PA01
uccagcacgcuggc

SEQ ID NO: 1400408 - RNA, 18 nt, Pseudomonas aeruginosa PA01
uccacgccgaagucggcg

SEQ ID NO: 1400409 - RNA, 16 nt, Pseudomonas aeruginosa PA01
uccagaccucgagcag

SEQ ID NO: 1400410 - RNA, 17 nt, Pseudomonas aeruginosa PA01
uccagaccucgagcagg

SEQ ID NO: 1400411 - RNA, 16 nt, Pseudomonas aeruginosa PA01
uccagaaucucccgca

SEQ ID NO: 1400412 - RNA, 18 nt, Pseudomonas aeruginosa PA01
uccacccccgcaaccgcu

SEQ ID NO: 1400413 - RNA, 13 nt, Pseudomonas aeruginosa PA01
uccacccgcagcc

SEQ ID NO: 1400414 - RNA, 15 nt, Pseudomonas aeruginosa PA01
uccacccgcagccgc

SEQ ID NO: 1400415 - RNA, 17 nt, Pseudomonas aeruginosa PA01
uccacccguucgccggc

SEQ ID NO: 1400416 - RNA, 21 nt, Pseudomonas aeruginosa PA01
uccaccuugcgguagcgcucg

SEQ ID NO: 1400417 - RNA, 19 nt, Pseudomonas aeruginosa PA01
uccacgaaaaagcccggca

SEQ ID NO: 1400418 - RNA, 12 nt, Pseudomonas aeruginosa PA01
uccaccuggcgc

SEQ ID NO: 1400419 - RNA, 13 nt, Pseudomonas aeruginosa PA01
uccaccuggcgca

SEQ ID NO: 1400420 - RNA, 14 nt, Pseudomonas aeruginosa PA01
uccaccuggcgcag

SEQ ID NO: 1400421 - RNA, 15 nt, Pseudomonas aeruginosa PA01
uccaccuggcgcagg

SEQ ID NO: 1400422 - RNA, 22 nt, Pseudomonas aeruginosa PA01
uccaccuggcgcagguagaagg

SEQ ID NO: 1400423 - RNA, 19 nt, Pseudomonas aeruginosa PA01
uccacgacucacccgcugc

SEQ ID NO: 1400424 - RNA, 17 nt, Pseudomonas aeruginosa PA01
uccacgccauaggcggc

SEQ ID NO: 1400425 - RNA, 20 nt, Pseudomonas aeruginosa PA01
uccacgccauaggcggcgca

SEQ ID NO: 1400426 - RNA, 22 nt, Pseudomonas aeruginosa PA01
ucauuucuacuucccugccggc

SEQ ID NO: 1400427 - RNA, 19 nt, Pseudomonas aeruginosa PA01
ucauugugcguguucggcg

SEQ ID NO: 1400428 - RNA, 16 nt, Pseudomonas aeruginosa PA01
uccacccaggcgccga

SEQ ID NO: 1400429 - RNA, 19 nt, Pseudomonas aeruginosa PA01
uccaccauaaagcccacac

SEQ ID NO: 1400430 - RNA, 15 nt, Pseudomonas aeruginosa PA01
uccaccagccagcuc

SEQ ID NO: 1400431 - RNA, 14 nt, Pseudomonas aeruginosa PA01
uccaccagcgcccg

SEQ ID NO: 1400432 - RNA, 15 nt, Pseudomonas aeruginosa PA01
uccaccagcgccggc

SEQ ID NO: 1400433 - RNA, 23 nt, Pseudomonas aeruginosa PA01
uccaccaggcgccgggucgaugg

SEQ ID NO: 1400434 - RNA, 19 nt, Pseudomonas aeruginosa PA01
uccaccagggccucggggc

SEQ ID NO: 1400435 - RNA, 20 nt, Pseudomonas aeruginosa PA01
uccaggaauccuccgccagc

SEQ ID NO: 1400436 - RNA, 16 nt, Pseudomonas aeruginosa PA01
uccagcuugcgccaga

SEQ ID NO: 1400437 - RNA, 21 nt, Pseudomonas aeruginosa PA01
uccagcuugcgccagagcagg

SEQ ID NO: 1400438 - RNA, 21 nt, Pseudomonas aeruginosa PA01
uccagcuuggcacggccggcg

SEQ ID NO: 1400439 - RNA, 22 nt, Pseudomonas aeruginosa PA01
uccaggaaccaggggucgacgc

SEQ ID NO: 1400440 - RNA, 15 nt, Pseudomonas aeruginosa PA01
uccaggaaccggcca

SEQ ID NO: 1400441 - RNA, 19 nt, Pseudomonas aeruginosa PA01
uccaggaugcaaccgcccu

SEQ ID NO: 1400442 - RNA, 21 nt, Pseudomonas aeruginosa PA01
uccaggaugcaaccgcccugg

SEQ ID NO: 1400443 - RNA, 14 nt, Pseudomonas aeruginosa PA01
uccaggaucgccuc

SEQ ID NO: 1400444 - RNA, 15 nt, Pseudomonas aeruginosa PA01
uccagcucggucagc

SEQ ID NO: 1400445 - RNA, 19 nt, Pseudomonas aeruginosa PA01
uccagcucggucagcggcg

SEQ ID NO: 1400446 - RNA, 23 nt, Pseudomonas aeruginosa PA01
uccagcucgucgagcugcucggc

SEQ ID NO: 1400447 - RNA, 17 nt, Pseudomonas aeruginosa PA01
uccagcucgucgaugau

SEQ ID NO: 1400448 - RNA, 14 nt, Pseudomonas aeruginosa PA01
uccagcucucgcug

SEQ ID NO: 1400449 - RNA, 14 nt, Pseudomonas aeruginosa PA01
uccagcucggccau

SEQ ID NO: 1400450 - RNA, 13 nt, Pseudomonas aeruginosa PA01
uccagcucggcga

SEQ ID NO: 1400451 - RNA, 14 nt, Pseudomonas aeruginosa PA01
uccagcucggcgag

SEQ ID NO: 1400452 - RNA, 15 nt, Pseudomonas aeruginosa PA01
uccagcucggcgauc

SEQ ID NO: 1400453 - RNA, 16 nt, Pseudomonas aeruginosa PA01
uccagcucggcgaucc

SEQ ID NO: 1400454 - RNA, 14 nt, Pseudomonas aeruginosa PA01
uccagcggcagcuc

SEQ ID NO: 1400455 - RNA, 17 nt, Pseudomonas aeruginosa PA01
uccagcggcagcucggc

SEQ ID NO: 1400456 - RNA, 19 nt, Pseudomonas aeruginosa PA01
uccagcggcagcucggcga

SEQ ID NO: 1400457 - RNA, 17 nt, Pseudomonas aeruginosa PA01
uccagcucgacccgccc

SEQ ID NO: 1400458 - RNA, 18 nt, Pseudomonas aeruginosa PA01
uccagcucgacccgcccg

SEQ ID NO: 1400459 - RNA, 20 nt, Pseudomonas aeruginosa PA01
uccagcggaaucgcgcccuu

SEQ ID NO: 1400460 - RNA, 18 nt, Pseudomonas aeruginosa PA01
uccagcggcaugccguag

SEQ ID NO: 1400461 - RNA, 14 nt, Pseudomonas aeruginosa PA01
uccaguagcgccug

SEQ ID NO: 1400462 - RNA, 21 nt, Pseudomonas aeruginosa PA01
uccagucggggcaggcgcagg

SEQ ID NO: 1400463 - RNA, 20 nt, Pseudomonas aeruginosa PA01
uccagucuucgccggccugc

SEQ ID NO: 1400464 - RNA, 14 nt, Pseudomonas aeruginosa PA01
uccagugcggcagu

SEQ ID NO: 1400465 - RNA, 15 nt, Pseudomonas aeruginosa PA01
uccagugcggcaguc

SEQ ID NO: 1400466 - RNA, 15 nt, Pseudomonas aeruginosa PA01
uccaguugcagcacc

SEQ ID NO: 1400467 - RNA, 15 nt, Pseudomonas aeruginosa PA01
uccaguucguugacc

SEQ ID NO: 1400468 - RNA, 20 nt, Pseudomonas aeruginosa PA01
uccaguucguugaccacgcu

SEQ ID NO: 1400469 - RNA, 14 nt, Pseudomonas aeruginosa PA01
uccaguucaucgag

SEQ ID NO: 1400470 - RNA, 18 nt, Pseudomonas aeruginosa PA01
uccaguucaucgagcagg

SEQ ID NO: 1400471 - RNA, 17 nt, Pseudomonas aeruginosa PA01
uccaguucggccgcggc

SEQ ID NO: 1400472 - RNA, 23 nt, Pseudomonas aeruginosa PA01
uccaguucggccgcggcuggcag

SEQ ID NO: 1400473 - RNA, 15 nt, Pseudomonas aeruginosa PA01
uccaguucggcgaug

SEQ ID NO: 1400474 - RNA, 14 nt, Pseudomonas aeruginosa PA01
uccagcgcaccgcc

SEQ ID NO: 1400475 - RNA, 23 nt, Pseudomonas aeruginosa PA01
uccagcgagcgggcgagggcggc

SEQ ID NO: 1400476 - RNA, 22 nt, Pseudomonas aeruginosa PA01
uccagcgagaacuugccggcgc

SEQ ID NO: 1400477 - RNA, 13 nt, Pseudomonas aeruginosa PA01
uccagcgccguuc

SEQ ID NO: 1400478 - RNA, 23 nt, Pseudomonas aeruginosa PA01
uccagcgccguucacgccuggcg

SEQ ID NO: 1400479 - RNA, 14 nt, Pseudomonas aeruginosa PA01
uccagcgccucgac

SEQ ID NO: 1400480 - RNA, 18 nt, Pseudomonas aeruginosa PA01
uccagcgccucgaccaga

SEQ ID NO: 1400481 - RNA, 17 nt, Pseudomonas aeruginosa PA01
uccagcgccucgccgag

SEQ ID NO: 1400482 - RNA, 18 nt, Pseudomonas aeruginosa PA01
uccagcgccucgccgagc

SEQ ID NO: 1400483 - RNA, 19 nt, Pseudomonas aeruginosa PA01
uccagcgccucgccgagca

SEQ ID NO: 1400484 - RNA, 18 nt, Pseudomonas aeruginosa PA01
uccagcgccucgggccgg

SEQ ID NO: 1400485 - RNA, 23 nt, Pseudomonas aeruginosa PA01
uccagcgccgccucgaaggccgg

SEQ ID NO: 1400486 - RNA, 14 nt, Pseudomonas aeruginosa PA01
uccagcgccgcauu

SEQ ID NO: 1400487 - RNA, 17 nt, Pseudomonas aeruginosa PA01
uccagcgccgccaggcg

SEQ ID NO: 1400488 - RNA, 18 nt, Pseudomonas aeruginosa PA01
uccagcgcuugaacgcgc

SEQ ID NO: 1400489 - RNA, 19 nt, Pseudomonas aeruginosa PA01
uccagcgcuccuugcgcca

SEQ ID NO: 1400490 - RNA, 13 nt, Pseudomonas aeruginosa PA01
uccagcgcuggca

SEQ ID NO: 1400491 - RNA, 17 nt, Pseudomonas aeruginosa PA01
uccagcgccuggaugau

SEQ ID NO: 1400492 - RNA, 14 nt, Pseudomonas aeruginosa PA01
uccagcgccuggcg

SEQ ID NO: 1400493 - RNA, 16 nt, Pseudomonas aeruginosa PA01
uccagcgcgcccggcg

SEQ ID NO: 1400494 - RNA, 17 nt, Pseudomonas aeruginosa PA01
uccagcgcgcccggcgc

SEQ ID NO: 1400495 - RNA, 12 nt, Pseudomonas aeruginosa PA01
uccagcgcgccg

SEQ ID NO: 1400496 - RNA, 15 nt, Pseudomonas aeruginosa PA01
uccagcgcgccgcgc

SEQ ID NO: 1400497 - RNA, 16 nt, Pseudomonas aeruginosa PA01
uccagcgcgccgcgca

SEQ ID NO: 1400498 - RNA, 18 nt, Pseudomonas aeruginosa PA01
uccagcacuacgcccaug

SEQ ID NO: 1400499 - RNA, 17 nt, Pseudomonas aeruginosa PA01
uccagcacucgcuccuc

SEQ ID NO: 1400500 - RNA, 23 nt, Pseudomonas aeruginosa PA01
uccagcacucgcuccuccgggcg

SEQ ID NO: 1400501 - RNA, 16 nt, Pseudomonas aeruginosa PA01
uccagcaggcccagcc

SEQ ID NO: 1400502 - RNA, 11 nt, Pseudomonas aeruginosa PA01
uccagcaggcg

SEQ ID NO: 1400503 - RNA, 12 nt, Pseudomonas aeruginosa PA01
uccagccgggcu

SEQ ID NO: 1400504 - RNA, 20 nt, Pseudomonas aeruginosa PA01
uccagccgggcuccgccgcg

SEQ ID NO: 1400505 - RNA, 23 nt, Pseudomonas aeruginosa PA01
uccagccgggcuccgccgcgagc

SEQ ID NO: 1400506 - RNA, 17 nt, Pseudomonas aeruginosa PA01
uccagccgcugcagggc

SEQ ID NO: 1400507 - RNA, 21 nt, Pseudomonas aeruginosa PA01
uccagccggccauccagccag

SEQ ID NO: 1400508 - RNA, 19 nt, Pseudomonas aeruginosa PA01
uccgauuucagcuucaucg

SEQ ID NO: 1400509 - RNA, 17 nt, Pseudomonas aeruginosa PA01
uccgaugaagcaggcgg

SEQ ID NO: 1400510 - RNA, 13 nt, Pseudomonas aeruginosa PA01
uccgaugcgacgc

SEQ ID NO: 1400511 - RNA, 16 nt, Pseudomonas aeruginosa PA01
uccgacaaggagcgcg

SEQ ID NO: 1400512 - RNA, 14 nt, Pseudomonas aeruginosa PA01
uccgacaaucagcg

SEQ ID NO: 1400513 - RNA, 21 nt, Pseudomonas aeruginosa PA01
uccgacgaucucaucgcccau

SEQ ID NO: 1400514 - RNA, 17 nt, Pseudomonas aeruginosa PA01
uccgaaucgccuaccag

SEQ ID NO: 1400515 - RNA, 14 nt, Pseudomonas aeruginosa PA01
ucccguagaccggc

SEQ ID NO: 1400516 - RNA, 21 nt, Pseudomonas aeruginosa PA01
ucccggucgagguugcgcggc

SEQ ID NO: 1400517 - RNA, 17 nt, Pseudomonas aeruginosa PA01
ucccgguuuccgcagcg

SEQ ID NO: 1400518 - RNA, 20 nt, Pseudomonas aeruginosa PA01
ucccguaaggccaggcucgg

SEQ ID NO: 1400519 - RNA, 14 nt, Pseudomonas aeruginosa PA01
ucccguaccagcgc

SEQ ID NO: 1400520 - RNA, 20 nt, Pseudomonas aeruginosa PA01
ucccggguucugcucgaaca

SEQ ID NO: 1400521 - RNA, 13 nt, Pseudomonas aeruginosa PA01
ucccgggcuccgg

SEQ ID NO: 1400522 - RNA, 18 nt, Pseudomonas aeruginosa PA01
ucccgggaaaccaccagg

SEQ ID NO: 1400523 - RNA, 19 nt, Pseudomonas aeruginosa PA01
ucccgggccagcuccgccu

SEQ ID NO: 1400524 - RNA, 20 nt, Pseudomonas aeruginosa PA01
ucccgggccagcuccgccug

SEQ ID NO: 1400525 - RNA, 16 nt, Pseudomonas aeruginosa PA01
ucccggcuugccggca

SEQ ID NO: 1400526 - RNA, 21 nt, Pseudomonas aeruginosa PA01
ucccggcuugccggcagcgac

SEQ ID NO: 1400527 - RNA, 17 nt, Pseudomonas aeruginosa PA01
ucccggcuugcugacga

SEQ ID NO: 1400528 - RNA, 12 nt, Pseudomonas aeruginosa PA01
uccgccgcggca

SEQ ID NO: 1400529 - RNA, 14 nt, Pseudomonas aeruginosa PA01
uccgccgcggcaau

SEQ ID NO: 1400530 - RNA, 23 nt, Pseudomonas aeruginosa PA01
uccgccgcggcaaugcggcgaug

SEQ ID NO: 1400531 - RNA, 18 nt, Pseudomonas aeruginosa PA01
uccgccgcgugcgcgccc

SEQ ID NO: 1400532 - RNA, 21 nt, Pseudomonas aeruginosa PA01
uccgccgcuacugcgcgggca

SEQ ID NO: 1400533 - RNA, 19 nt, Pseudomonas aeruginosa PA01
uccgccgcuaucgccgccg

SEQ ID NO: 1400534 - RNA, 23 nt, Pseudomonas aeruginosa PA01
uccgccgcuggggaccgcaccug

SEQ ID NO: 1400535 - RNA, 18 nt, Pseudomonas aeruginosa PA01
uccgccgcuuccgccggc

SEQ ID NO: 1400536 - RNA, 13 nt, Pseudomonas aeruginosa PA01
uccgccaggcggc

SEQ ID NO: 1400537 - RNA, 15 nt, Pseudomonas aeruginosa PA01
uccgccaggcggccg

SEQ ID NO: 1400538 - RNA, 12 nt, Pseudomonas aeruginosa PA01
uccgccagccgg

SEQ ID NO: 1400539 - RNA, 13 nt, Pseudomonas aeruginosa PA01
uccgccagccggc

SEQ ID NO: 1400540 - RNA, 17 nt, Pseudomonas aeruginosa PA01
uccgccaggaccuccug

SEQ ID NO: 1400541 - RNA, 20 nt, Pseudomonas aeruginosa PA01
uccgccaggaccuccugcac

SEQ ID NO: 1400542 - RNA, 12 nt, Pseudomonas aeruginosa PA01
uccgccaggccg

SEQ ID NO: 1400543 - RNA, 20 nt, Pseudomonas aeruginosa PA01
uccgccagaugcgcgucgcc

SEQ ID NO: 1400544 - RNA, 23 nt, Pseudomonas aeruginosa PA01
uccgccagaugcgcgucgccgaa

SEQ ID NO: 1400545 - RNA, 12 nt, Pseudomonas aeruginosa PA01
uccgccagcagg

SEQ ID NO: 1400546 - RNA, 21 nt, Pseudomonas aeruginosa PA01
uccgccagccagccgcgcgcc

SEQ ID NO: 1400547 - RNA, 22 nt, Pseudomonas aeruginosa PA01
uccgccacccguuccuugcgcg

SEQ ID NO: 1400548 - RNA, 15 nt, Pseudomonas aeruginosa PA01
uccgccaccagccag

SEQ ID NO: 1400549 - RNA, 19 nt, Pseudomonas aeruginosa PA01
uccgacccggccgaccagg

SEQ ID NO: 1400550 - RNA, 13 nt, Pseudomonas aeruginosa PA01
uccgccgugaggc

SEQ ID NO: 1400551 - RNA, 23 nt, Pseudomonas aeruginosa PA01
uccgccguuccuccucgccgccg

SEQ ID NO: 1400552 - RNA, 18 nt, Pseudomonas aeruginosa PA01
uccgccggguccaccgcg

SEQ ID NO: 1400553 - RNA, 18 nt, Pseudomonas aeruginosa PA01
uccgccggucaccacugg

SEQ ID NO: 1400554 - RNA, 13 nt, Pseudomonas aeruginosa PA01
uccgccggcgaug

SEQ ID NO: 1400555 - RNA, 14 nt, Pseudomonas aeruginosa PA01
uccgccggcgaugc

SEQ ID NO: 1400556 - RNA, 24 nt, Pseudomonas aeruginosa PA01
uccgccggcgcgucccugggcgca

SEQ ID NO: 1400557 - RNA, 18 nt, Pseudomonas aeruginosa PA01
uccgccugaccgcugaug

SEQ ID NO: 1400558 - RNA, 15 nt, Pseudomonas aeruginosa PA01
uccgccucgcgccgu

SEQ ID NO: 1400559 - RNA, 16 nt, Pseudomonas aeruginosa PA01
uccgccucgcugagca

SEQ ID NO: 1400560 - RNA, 21 nt, Pseudomonas aeruginosa PA01
uccgccucgcugagcaccggg

SEQ ID NO: 1400561 - RNA, 18 nt, Pseudomonas aeruginosa PA01
uccgcgccaugccggcgc

SEQ ID NO: 1400562 - RNA, 20 nt, Pseudomonas aeruginosa PA01
uccgcgcccaggcgcaccuc

SEQ ID NO: 1400563 - RNA, 20 nt, Pseudomonas aeruginosa PA01
uccgcgcccaggcugccggc

SEQ ID NO: 1400564 - RNA, 22 nt, Pseudomonas aeruginosa PA01
uccgcgcaggaccacgcugguc

SEQ ID NO: 1400565 - RNA, 23 nt, Pseudomonas aeruginosa PA01
uccgcgcaggaccacgcugguca

SEQ ID NO: 1400566 - RNA, 13 nt, Pseudomonas aeruginosa PA01
uccgcgcaggcgg

SEQ ID NO: 1400567 - RNA, 18 nt, Pseudomonas aeruginosa PA01
uccgcgcaggcggucgcc

SEQ ID NO: 1400568 - RNA, 12 nt, Pseudomonas aeruginosa PA01
uccgcgccacgc

SEQ ID NO: 1400569 - RNA, 21 nt, Pseudomonas aeruginosa PA01
uccggcggcgaugaagcugau

SEQ ID NO: 1400570 - RNA, 12 nt, Pseudomonas aeruginosa PA01
uccggcgcagcc

SEQ ID NO: 1400571 - RNA, 16 nt, Pseudomonas aeruginosa PA01
uccggcgcagcccagc

SEQ ID NO: 1400572 - RNA, 15 nt, Pseudomonas aeruginosa PA01
uccggcgaccaccac

SEQ ID NO: 1400573 - RNA, 15 nt, Pseudomonas aeruginosa PA01
uccggcgugguggcg

SEQ ID NO: 1400574 - RNA, 17 nt, Pseudomonas aeruginosa PA01
uccggaguucgcccgcc

SEQ ID NO: 1400575 - RNA, 21 nt, Pseudomonas aeruginosa PA01
uccggacugcccagcgccgcc

SEQ ID NO: 1400576 - RNA, 19 nt, Pseudomonas aeruginosa PA01
uccggaugcagauccagcg

SEQ ID NO: 1400577 - RNA, 21 nt, Pseudomonas aeruginosa PA01
uccggauugguggucaccagc

SEQ ID NO: 1400578 - RNA, 14 nt, Pseudomonas aeruginosa PA01
uccgcucaccaggc

SEQ ID NO: 1400579 - RNA, 20 nt, Pseudomonas aeruginosa PA01
uccgcucaccaggcccgccg

SEQ ID NO: 1400580 - RNA, 21 nt, Pseudomonas aeruginosa PA01
uccgcugaggauguagccggc

SEQ ID NO: 1400581 - RNA, 22 nt, Pseudomonas aeruginosa PA01
uccgcugaggauguagccggcu

SEQ ID NO: 1400582 - RNA, 13 nt, Pseudomonas aeruginosa PA01
uccggagccgggc

SEQ ID NO: 1400583 - RNA, 14 nt, Pseudomonas aeruginosa PA01
uccggagccgggca

SEQ ID NO: 1400584 - RNA, 16 nt, Pseudomonas aeruginosa PA01
uccggaggcgcacagg

SEQ ID NO: 1400585 - RNA, 17 nt, Pseudomonas aeruginosa PA01
uccggacgccgaacgcc

SEQ ID NO: 1400586 - RNA, 21 nt, Pseudomonas aeruginosa PA01
uccggacgccgaacgccccag

SEQ ID NO: 1400587 - RNA, 22 nt, Pseudomonas aeruginosa PA01
uccggacgccgaacgccccagu

SEQ ID NO: 1400588 - RNA, 15 nt, Pseudomonas aeruginosa PA01
uccgcucugcuggcc

SEQ ID NO: 1400589 - RNA, 16 nt, Pseudomonas aeruginosa PA01
uccgcucugcuggcca

SEQ ID NO: 1400590 - RNA, 22 nt, Pseudomonas aeruginosa PA01
uccgcucuggaucacguaggac

SEQ ID NO: 1400591 - RNA, 13 nt, Pseudomonas aeruginosa PA01
uccgcuccagcag

SEQ ID NO: 1400592 - RNA, 12 nt, Pseudomonas aeruginosa PA01
uccgcuccagcg

SEQ ID NO: 1400593 - RNA, 17 nt, Pseudomonas aeruginosa PA01
uccgcucgaucccggcg

SEQ ID NO: 1400594 - RNA, 18 nt, Pseudomonas aeruginosa PA01
uccgcucgaucccggcgc

SEQ ID NO: 1400595 - RNA, 12 nt, Pseudomonas aeruginosa PA01
uccgcucggcga

SEQ ID NO: 1400596 - RNA, 14 nt, Pseudomonas aeruginosa PA01
uccgcgucacggac

SEQ ID NO: 1400597 - RNA, 23 nt, Pseudomonas aeruginosa PA01
uccgcgucacggacccgcucggc

SEQ ID NO: 1400598 - RNA, 20 nt, Pseudomonas aeruginosa PA01
uccgcgucgccuucggagaa

SEQ ID NO: 1400599 - RNA, 12 nt, Pseudomonas aeruginosa PA01
uccgcguggcga

SEQ ID NO: 1400600 - RNA, 14 nt, Pseudomonas aeruginosa PA01
uccgcguggcgaug

SEQ ID NO: 1400601 - RNA, 16 nt, Pseudomonas aeruginosa PA01
uccgcguggcgaugcc

SEQ ID NO: 1400602 - RNA, 21 nt, Pseudomonas aeruginosa PA01
uccgcguggcgaugcccuggc

SEQ ID NO: 1400603 - RNA, 12 nt, Pseudomonas aeruginosa PA01
uccgcguggcgu

SEQ ID NO: 1400604 - RNA, 21 nt, Pseudomonas aeruginosa PA01
uccgcguggcgugcucggcga

SEQ ID NO: 1400605 - RNA, 23 nt, Pseudomonas aeruginosa PA01
uccgcguggcgugcucggcgauc

SEQ ID NO: 1400606 - RNA, 18 nt, Pseudomonas aeruginosa PA01
uccgcguguucgcggcuc

SEQ ID NO: 1400607 - RNA, 19 nt, Pseudomonas aeruginosa PA01
uccgcguuaccguccgcgc

SEQ ID NO: 1400608 - RNA, 20 nt, Pseudomonas aeruginosa PA01
uccgcguuaccguccgcgcc

SEQ ID NO: 1400609 - RNA, 14 nt, Pseudomonas aeruginosa PA01
uccgcggccccggc

SEQ ID NO: 1400610 - RNA, 21 nt, Pseudomonas aeruginosa PA01
uccgcggcccugcucgccggc

SEQ ID NO: 1400611 - RNA, 22 nt, Pseudomonas aeruginosa PA01
uccgcggcccugcucgccggcg

SEQ ID NO: 1400612 - RNA, 13 nt, Pseudomonas aeruginosa PA01
uccgcggagagga

SEQ ID NO: 1400613 - RNA, 21 nt, Pseudomonas aeruginosa PA01
uccgcggagaggaucagcgaa

SEQ ID NO: 1400614 - RNA, 19 nt, Pseudomonas aeruginosa PA01
uccgcggaucguccgggcg

SEQ ID NO: 1400615 - RNA, 21 nt, Pseudomonas aeruginosa PA01
uccgcggccggcaggccgaug

SEQ ID NO: 1400616 - RNA, 15 nt, Pseudomonas aeruginosa PA01
uccgcggccggcuuc

SEQ ID NO: 1400617 - RNA, 15 nt, Pseudomonas aeruginosa PA01
uccgcgggacgcggc

SEQ ID NO: 1400618 - RNA, 14 nt, Pseudomonas aeruginosa PA01
uccgcgccgguggc

SEQ ID NO: 1400619 - RNA, 15 nt, Pseudomonas aeruginosa PA01
uccgcgcgcgcgcuc

SEQ ID NO: 1400620 - RNA, 23 nt, Pseudomonas aeruginosa PA01
uccgcgcggcgcccugccgggcu

SEQ ID NO: 1400621 - RNA, 17 nt, Pseudomonas aeruginosa PA01
uccgcgcccggcuggcc

SEQ ID NO: 1400622 - RNA, 18 nt, Pseudomonas aeruginosa PA01
uccgcgcccggcuggcca

SEQ ID NO: 1400623 - RNA, 12 nt, Pseudomonas aeruginosa PA01
uccgcgccgacc

SEQ ID NO: 1400624 - RNA, 15 nt, Pseudomonas aeruginosa PA01
uccgcgccgaccagc

SEQ ID NO: 1400625 - RNA, 16 nt, Pseudomonas aeruginosa PA01
uccgcgccgaccagcc

SEQ ID NO: 1400626 - RNA, 18 nt, Pseudomonas aeruginosa PA01
uccgcgccgaccagccgc

SEQ ID NO: 1400627 - RNA, 13 nt, Pseudomonas aeruginosa PA01
uccgcgccgggcu

SEQ ID NO: 1400628 - RNA, 13 nt, Pseudomonas aeruginosa PA01
uccgcgccgcggc

SEQ ID NO: 1400629 - RNA, 14 nt, Pseudomonas aeruginosa PA01
uccgcgccgcggcg

SEQ ID NO: 1400630 - RNA, 16 nt, Pseudomonas aeruginosa PA01
uccgcgccgcgucgcc

SEQ ID NO: 1400631 - RNA, 15 nt, Pseudomonas aeruginosa PA01
uccccagcaggcagg

SEQ ID NO: 1400632 - RNA, 22 nt, Pseudomonas aeruginosa PA01
uccccaacccggccagcccggc

SEQ ID NO: 1400633 - RNA, 20 nt, Pseudomonas aeruginosa PA01
ucccauucgcugucgucggc

SEQ ID NO: 1400634 - RNA, 20 nt, Pseudomonas aeruginosa PA01
ucccaugaccgucagccagg

SEQ ID NO: 1400635 - RNA, 16 nt, Pseudomonas aeruginosa PA01
ucccaggccagcgggc

SEQ ID NO: 1400636 - RNA, 19 nt, Pseudomonas aeruginosa PA01
ucccagcguuguccucggc

SEQ ID NO: 1400637 - RNA, 20 nt, Pseudomonas aeruginosa PA01
ucccaggucggcgggcaccg

SEQ ID NO: 1400638 - RNA, 15 nt, Pseudomonas aeruginosa PA01
ucccagguuggcgaa

SEQ ID NO: 1400639 - RNA, 15 nt, Pseudomonas aeruginosa PA01
ucccaggcuggcggc

SEQ ID NO: 1400640 - RNA, 16 nt, Pseudomonas aeruginosa PA01
ucccaggcuggcggca

SEQ ID NO: 1400641 - RNA, 17 nt, Pseudomonas aeruginosa PA01
ucccaggcgucgccgac

SEQ ID NO: 1400642 - RNA, 20 nt, Pseudomonas aeruginosa PA01
ucccaacagucgucgcgcag

SEQ ID NO: 1400643 - RNA, 23 nt, Pseudomonas aeruginosa PA01
uccauaguagagaugcaccggcc

SEQ ID NO: 1400644 - RNA, 15 nt, Pseudomonas aeruginosa PA01
uccauagggcggcgc

SEQ ID NO: 1400645 - RNA, 18 nt, Pseudomonas aeruginosa PA01
uccauagggcggcgcggc

SEQ ID NO: 1400646 - RNA, 14 nt, Pseudomonas aeruginosa PA01
ucccaccgcgcggc

SEQ ID NO: 1400647 - RNA, 20 nt, Pseudomonas aeruginosa PA01
ucccaccgcuuucagcgccg

SEQ ID NO: 1400648 - RNA, 23 nt, Pseudomonas aeruginosa PA01
ucccaccgcuuucagcgccgcuc

SEQ ID NO: 1400649 - RNA, 21 nt, Pseudomonas aeruginosa PA01
ucccacaggccggcuaaccgc

SEQ ID NO: 1400650 - RNA, 18 nt, Pseudomonas aeruginosa PA01
ucccacuuccucggugau

SEQ ID NO: 1400651 - RNA, 17 nt, Pseudomonas aeruginosa PA01
ucccagaagucgcuggc

SEQ ID NO: 1400652 - RNA, 19 nt, Pseudomonas aeruginosa PA01
ucccagaagucgcuggccu

SEQ ID NO: 1400653 - RNA, 17 nt, Pseudomonas aeruginosa PA01
ucccacuccguccagug

SEQ ID NO: 1400654 - RNA, 13 nt, Pseudomonas aeruginosa PA01
ucccagccgaggc

SEQ ID NO: 1400655 - RNA, 21 nt, Pseudomonas aeruginosa PA01
ucccagccgaggcagccgucg

SEQ ID NO: 1400656 - RNA, 16 nt, Pseudomonas aeruginosa PA01
ucccagcagcgccucg

SEQ ID NO: 1400657 - RNA, 18 nt, Pseudomonas aeruginosa PA01
ucccagcagcgccucggc

SEQ ID NO: 1400658 - RNA, 14 nt, Pseudomonas aeruginosa PA01
ucccagaccacccg

SEQ ID NO: 1400659 - RNA, 13 nt, Pseudomonas aeruginosa PA01
ucccagaccagca

SEQ ID NO: 1400660 - RNA, 18 nt, Pseudomonas aeruginosa PA01
ucccagaccagcagcggc

SEQ ID NO: 1400661 - RNA, 14 nt, Pseudomonas aeruginosa PA01
uccccguccuggcg

SEQ ID NO: 1400662 - RNA, 15 nt, Pseudomonas aeruginosa PA01
uccccguccuggcgg

SEQ ID NO: 1400663 - RNA, 20 nt, Pseudomonas aeruginosa PA01
uccccggccagcagcgccuc

SEQ ID NO: 1400664 - RNA, 20 nt, Pseudomonas aeruginosa PA01
uccccggcccgcgccgccuc

SEQ ID NO: 1400665 - RNA, 14 nt, Pseudomonas aeruginosa PA01
uccccgccgccagg

SEQ ID NO: 1400666 - RNA, 16 nt, Pseudomonas aeruginosa PA01
uccccccuacgaaagc

SEQ ID NO: 1400667 - RNA, 21 nt, Pseudomonas aeruginosa PA01
uccccccgcgaagcgacggcg

SEQ ID NO: 1400668 - RNA, 14 nt, Pseudomonas aeruginosa PA01
ucccccagcaccug

SEQ ID NO: 1400669 - RNA, 16 nt, Pseudomonas aeruginosa PA01
ucccccagcaccugga

SEQ ID NO: 1400670 - RNA, 21 nt, Pseudomonas aeruginosa PA01
ucccccguggcgacgcagcac

SEQ ID NO: 1400671 - RNA, 20 nt, Pseudomonas aeruginosa PA01
ucccccacguacuccagcaa

SEQ ID NO: 1400672 - RNA, 16 nt, Pseudomonas aeruginosa PA01
uccccgaggcgacgcc

SEQ ID NO: 1400673 - RNA, 18 nt, Pseudomonas aeruginosa PA01
uccccgcaccugccguca

SEQ ID NO: 1400674 - RNA, 17 nt, Pseudomonas aeruginosa PA01
ucccgcggcuccagccg

SEQ ID NO: 1400675 - RNA, 17 nt, Pseudomonas aeruginosa PA01
ucccgcgcgcugugcac

SEQ ID NO: 1400676 - RNA, 13 nt, Pseudomonas aeruginosa PA01
ucccgaucggcaa

SEQ ID NO: 1400677 - RNA, 17 nt, Pseudomonas aeruginosa PA01
ucccgaucguuggcgaa

SEQ ID NO: 1400678 - RNA, 18 nt, Pseudomonas aeruginosa PA01
ucccgcuccgauggcgcu

SEQ ID NO: 1400679 - RNA, 13 nt, Pseudomonas aeruginosa PA01
ucccgcuccagcc

SEQ ID NO: 1400680 - RNA, 15 nt, Pseudomonas aeruginosa PA01
ucccgcuccagccgg

SEQ ID NO: 1400681 - RNA, 16 nt, Pseudomonas aeruginosa PA01
ucccggauucgccgag

SEQ ID NO: 1400682 - RNA, 17 nt, Pseudomonas aeruginosa PA01
ucccgcuucggcccgcu

SEQ ID NO: 1400683 - RNA, 16 nt, Pseudomonas aeruginosa PA01
uccccuggagcccccg

SEQ ID NO: 1400684 - RNA, 23 nt, Pseudomonas aeruginosa PA01
uccccuguggucaggcgccagga

SEQ ID NO: 1400685 - RNA, 20 nt, Pseudomonas aeruginosa PA01
uccccuuccuccucgccgcu

SEQ ID NO: 1400686 - RNA, 15 nt, Pseudomonas aeruginosa PA01
uccccucacggcgcg

SEQ ID NO: 1400687 - RNA, 14 nt, Pseudomonas aeruginosa PA01
uccccucaggcgcc

SEQ ID NO: 1400688 - RNA, 18 nt, Pseudomonas aeruginosa PA01
uccccguggcgccgcagg

SEQ ID NO: 1400689 - RNA, 15 nt, Pseudomonas aeruginosa PA01
ucccgaggcgaucgc

SEQ ID NO: 1400690 - RNA, 21 nt, Pseudomonas aeruginosa PA01
ucccgaggcgaucgccgcggc

SEQ ID NO: 1400691 - RNA, 18 nt, Pseudomonas aeruginosa PA01
ucccgaggguggcgcugg

SEQ ID NO: 1400692 - RNA, 16 nt, Pseudomonas aeruginosa PA01
guugcucgcaccaggc

SEQ ID NO: 1400693 - RNA, 18 nt, Pseudomonas aeruginosa PA01
guugcucgcaccaggcca

SEQ ID NO: 1400694 - RNA, 20 nt, Pseudomonas aeruginosa PA01
guugcucgcaccaggccagg

SEQ ID NO: 1400695 - RNA, 20 nt, Pseudomonas aeruginosa PA01
guugcuccugcggcuggcga

SEQ ID NO: 1400696 - RNA, 15 nt, Pseudomonas aeruginosa PA01
guuggccgccuggcg

SEQ ID NO: 1400697 - RNA, 17 nt, Pseudomonas aeruginosa PA01
guuggccgccuggcgca

SEQ ID NO: 1400698 - RNA, 23 nt, Pseudomonas aeruginosa PA01
guugcucgagccguuccaggcgg

SEQ ID NO: 1400699 - RNA, 18 nt, Pseudomonas aeruginosa PA01
guuggccggcugcuccgg

SEQ ID NO: 1400700 - RNA, 20 nt, Pseudomonas aeruginosa PA01
guuggcgaacaaucggucgc

SEQ ID NO: 1400701 - RNA, 20 nt, Pseudomonas aeruginosa PA01
guuggcgaacuucaggccgg

SEQ ID NO: 1400702 - RNA, 23 nt, Pseudomonas aeruginosa PA01
guuggcgaacuucaggccggcgc

SEQ ID NO: 1400703 - RNA, 19 nt, Pseudomonas aeruginosa PA01
guuggcgccccagaucgcc

SEQ ID NO: 1400704 - RNA, 21 nt, Pseudomonas aeruginosa PA01
guuggcgccccagaucgccag

SEQ ID NO: 1400705 - RNA, 14 nt, Pseudomonas aeruginosa PA01
guugggccagggcc

SEQ ID NO: 1400706 - RNA, 12 nt, Pseudomonas aeruginosa PA01
guugggccggaa

SEQ ID NO: 1400707 - RNA, 13 nt, Pseudomonas aeruginosa PA01
guugggcaggcgc

SEQ ID NO: 1400708 - RNA, 16 nt, Pseudomonas aeruginosa PA01
guuggcgucgcugccg

SEQ ID NO: 1400709 - RNA, 14 nt, Pseudomonas aeruginosa PA01
guuggcuccgggcc

SEQ ID NO: 1400710 - RNA, 16 nt, Pseudomonas aeruginosa PA01
guuggcuccgggccga

SEQ ID NO: 1400711 - RNA, 13 nt, Pseudomonas aeruginosa PA01
guuggcggccagc

SEQ ID NO: 1400712 - RNA, 12 nt, Pseudomonas aeruginosa PA01
guuggcggccga

SEQ ID NO: 1400713 - RNA, 15 nt, Pseudomonas aeruginosa PA01
guuggcggccgacgg

SEQ ID NO: 1400714 - RNA, 14 nt, Pseudomonas aeruginosa PA01
guuggcggugccgc

SEQ ID NO: 1400715 - RNA, 14 nt, Pseudomonas aeruginosa PA01
guuggcgcgaccgc

SEQ ID NO: 1400716 - RNA, 20 nt, Pseudomonas aeruginosa PA01
guuggcgcgaccgcccgccu

SEQ ID NO: 1400717 - RNA, 20 nt, Pseudomonas aeruginosa PA01
guuggcgcgagaaggcguag

SEQ ID NO: 1400718 - RNA, 14 nt, Pseudomonas aeruginosa PA01
guuggcgcgggcga

SEQ ID NO: 1400719 - RNA, 12 nt, Pseudomonas aeruginosa PA01
guuggcgcaggc

SEQ ID NO: 1400720 - RNA, 16 nt, Pseudomonas aeruginosa PA01
guugggccucgcugcg

SEQ ID NO: 1400721 - RNA, 22 nt, Pseudomonas aeruginosa PA01
guugggcgaccugcucgaaccg

SEQ ID NO: 1400722 - RNA, 15 nt, Pseudomonas aeruginosa PA01
guugguacagcucgc

SEQ ID NO: 1400723 - RNA, 21 nt, Pseudomonas aeruginosa PA01
guugguauggcagcucugcga

SEQ ID NO: 1400724 - RNA, 17 nt, Pseudomonas aeruginosa PA01
guuggucugcucggcga

SEQ ID NO: 1400725 - RNA, 17 nt, Pseudomonas aeruginosa PA01
guugucggccagcagca

SEQ ID NO: 1400726 - RNA, 14 nt, Pseudomonas aeruginosa PA01
guuggucggcacca

SEQ ID NO: 1400727 - RNA, 15 nt, Pseudomonas aeruginosa PA01
guuggucggcaccag

SEQ ID NO: 1400728 - RNA, 17 nt, Pseudomonas aeruginosa PA01
guuguugcccaccagcg

SEQ ID NO: 1400729 - RNA, 19 nt, Pseudomonas aeruginosa PA01
guuguugaacgucucggcg

SEQ ID NO: 1400730 - RNA, 20 nt, Pseudomonas aeruginosa PA01
guuguugaacgucucggcga

SEQ ID NO: 1400731 - RNA, 13 nt, Pseudomonas aeruginosa PA01
guuguggcggcgc

SEQ ID NO: 1400732 - RNA, 14 nt, Pseudomonas aeruginosa PA01
guuguggcuggccu

SEQ ID NO: 1400733 - RNA, 14 nt, Pseudomonas aeruginosa PA01
guuguucggcgagu

SEQ ID NO: 1400734 - RNA, 15 nt, Pseudomonas aeruginosa PA01
guuguugaccgcagg

SEQ ID NO: 1400735 - RNA, 12 nt, Pseudomonas aeruginosa PA01
guugccgcgcac

SEQ ID NO: 1400736 - RNA, 17 nt, Pseudomonas aeruginosa PA01
guugccgccgcuggccu

SEQ ID NO: 1400737 - RNA, 24 nt, Pseudomonas aeruginosa PA01
guugccgccgcuggccuggccacc

SEQ ID NO: 1400738 - RNA, 17 nt, Pseudomonas aeruginosa PA01
guugccuucgccgucga

SEQ ID NO: 1400739 - RNA, 13 nt, Pseudomonas aeruginosa PA01
guugccgcgccga

SEQ ID NO: 1400740 - RNA, 18 nt, Pseudomonas aeruginosa PA01
guugccgcgcgggccggc

SEQ ID NO: 1400741 - RNA, 23 nt, Pseudomonas aeruginosa PA01
guugccgcgcgggccggcgaugg

SEQ ID NO: 1400742 - RNA, 17 nt, Pseudomonas aeruginosa PA01
guugccgcgcuugccgu

SEQ ID NO: 1400743 - RNA, 14 nt, Pseudomonas aeruginosa PA01
guugccgaugccgg

SEQ ID NO: 1400744 - RNA, 19 nt, Pseudomonas aeruginosa PA01
guugccgcagcagcggcga

SEQ ID NO: 1400745 - RNA, 14 nt, Pseudomonas aeruginosa PA01
guugccgccgauca

SEQ ID NO: 1400746 - RNA, 19 nt, Pseudomonas aeruginosa PA01
guugccgccgaucagcgcg

SEQ ID NO: 1400747 - RNA, 13 nt, Pseudomonas aeruginosa PA01
guugccgccgccg

SEQ ID NO: 1400748 - RNA, 14 nt, Pseudomonas aeruginosa PA01
guugccgccgccga

SEQ ID NO: 1400749 - RNA, 18 nt, Pseudomonas aeruginosa PA01
guugccgccgccgaggag

SEQ ID NO: 1400750 - RNA, 12 nt, Pseudomonas aeruginosa PA01
guugccgccagc

SEQ ID NO: 1400751 - RNA, 14 nt, Pseudomonas aeruginosa PA01
guugccgaucaggc

SEQ ID NO: 1400752 - RNA, 23 nt, Pseudomonas aeruginosa PA01
guugcggucgauguccugggcca

SEQ ID NO: 1400753 - RNA, 15 nt, Pseudomonas aeruginosa PA01
guugcgcgagcaccg

SEQ ID NO: 1400754 - RNA, 19 nt, Pseudomonas aeruginosa PA01
guugcgcgagcaccgcgca

SEQ ID NO: 1400755 - RNA, 16 nt, Pseudomonas aeruginosa PA01
guugcguuccaacugg

SEQ ID NO: 1400756 - RNA, 21 nt, Pseudomonas aeruginosa PA01
guugcgacacgaugucgcggg

SEQ ID NO: 1400757 - RNA, 20 nt, Pseudomonas aeruginosa PA01
guugcgauagaccaggaagg

SEQ ID NO: 1400758 - RNA, 20 nt, Pseudomonas aeruginosa PA01
guugcgaugggugccgcgca

SEQ ID NO: 1400759 - RNA, 22 nt, Pseudomonas aeruginosa PA01
guugcgaugggugccgcgcagg

SEQ ID NO: 1400760 - RNA, 17 nt, Pseudomonas aeruginosa PA01
guugcgauuguccaccg

SEQ ID NO: 1400761 - RNA, 19 nt, Pseudomonas aeruginosa PA01
guugcgauuguccaccggc

SEQ ID NO: 1400762 - RNA, 14 nt, Pseudomonas aeruginosa PA01
guugcgcacccgcu

SEQ ID NO: 1400763 - RNA, 15 nt, Pseudomonas aeruginosa PA01
guugcgcacccgcuc

SEQ ID NO: 1400764 - RNA, 20 nt, Pseudomonas aeruginosa PA01
guugcgcacccgcucggccu

SEQ ID NO: 1400765 - RNA, 21 nt, Pseudomonas aeruginosa PA01
guugcgcagcaacuggucgcc

SEQ ID NO: 1400766 - RNA, 23 nt, Pseudomonas aeruginosa PA01
guugcgcagcuucugcagggcgg

SEQ ID NO: 1400767 - RNA, 15 nt, Pseudomonas aeruginosa PA01
guugcgcagggugcc

SEQ ID NO: 1400768 - RNA, 17 nt, Pseudomonas aeruginosa PA01
guugcgccccgggucgc

SEQ ID NO: 1400769 - RNA, 21 nt, Pseudomonas aeruginosa PA01
guugcgcauuugcacgucggu

SEQ ID NO: 1400770 - RNA, 14 nt, Pseudomonas aeruginosa PA01
guugcgccgcagca

SEQ ID NO: 1400771 - RNA, 17 nt, Pseudomonas aeruginosa PA01
guugcgccgccugcggc

SEQ ID NO: 1400772 - RNA, 22 nt, Pseudomonas aeruginosa PA01
guugcgccggcccagcaggccg

SEQ ID NO: 1400773 - RNA, 23 nt, Pseudomonas aeruginosa PA01
guugcgccggcccagcaggccgg

SEQ ID NO: 1400774 - RNA, 19 nt, Pseudomonas aeruginosa PA01
guugaucgccgcgccgccg

SEQ ID NO: 1400775 - RNA, 21 nt, Pseudomonas aeruginosa PA01
guugaucggcguggcggucag

SEQ ID NO: 1400776 - RNA, 23 nt, Pseudomonas aeruginosa PA01
guugaucagguucggcagcgccu

SEQ ID NO: 1400777 - RNA, 15 nt, Pseudomonas aeruginosa PA01
guugauccugggcgc

SEQ ID NO: 1400778 - RNA, 17 nt, Pseudomonas aeruginosa PA01
guugacgaucugcgagc

SEQ ID NO: 1400779 - RNA, 18 nt, Pseudomonas aeruginosa PA01
guugacgaugcggcccgc

SEQ ID NO: 1400780 - RNA, 23 nt, Pseudomonas aeruginosa PA01
guugacgaugcggcccgccggcg

SEQ ID NO: 1400781 - RNA, 16 nt, Pseudomonas aeruginosa PA01
guugaccugcgaggcg

SEQ ID NO: 1400782 - RNA, 18 nt, Pseudomonas aeruginosa PA01
guugaccugcgaggcguc

SEQ ID NO: 1400783 - RNA, 19 nt, Pseudomonas aeruginosa PA01
guugaccccgaggucggcg

SEQ ID NO: 1400784 - RNA, 20 nt, Pseudomonas aeruginosa PA01
guugaccccgaggucggcga

SEQ ID NO: 1400785 - RNA, 17 nt, Pseudomonas aeruginosa PA01
guugaccccgcggccga

SEQ ID NO: 1400786 - RNA, 18 nt, Pseudomonas aeruginosa PA01
guugcccugggccggcgc

SEQ ID NO: 1400787 - RNA, 22 nt, Pseudomonas aeruginosa PA01
guugcccugggccggcgccagc

SEQ ID NO: 1400788 - RNA, 20 nt, Pseudomonas aeruginosa PA01
guugcccucgcagccggcgg

SEQ ID NO: 1400789 - RNA, 14 nt, Pseudomonas aeruginosa PA01
guugcccucgcgcu

SEQ ID NO: 1400790 - RNA, 16 nt, Pseudomonas aeruginosa PA01
guugcccgagugccgg

SEQ ID NO: 1400791 - RNA, 17 nt, Pseudomonas aeruginosa PA01
guugcccggcuugccgu

SEQ ID NO: 1400792 - RNA, 16 nt, Pseudomonas aeruginosa PA01
guugaugaagccgcga

SEQ ID NO: 1400793 - RNA, 15 nt, Pseudomonas aeruginosa PA01
guugauggucaggcu

SEQ ID NO: 1400794 - RNA, 16 nt, Pseudomonas aeruginosa PA01
guugaugucgaccacg

SEQ ID NO: 1400795 - RNA, 14 nt, Pseudomonas aeruginosa PA01
guugaugccgauca

SEQ ID NO: 1400796 - RNA, 14 nt, Pseudomonas aeruginosa PA01
guugccauccagcg

SEQ ID NO: 1400797 - RNA, 17 nt, Pseudomonas aeruginosa PA01
guucggaucggcccggc

SEQ ID NO: 1400798 - RNA, 14 nt, Pseudomonas aeruginosa PA01
guucggcagcgccu

SEQ ID NO: 1400799 - RNA, 14 nt, Pseudomonas aeruginosa PA01
guucgcugaggacu

SEQ ID NO: 1400800 - RNA, 20 nt, Pseudomonas aeruginosa PA01
guucgcugaggacugccagg

SEQ ID NO: 1400801 - RNA, 21 nt, Pseudomonas aeruginosa PA01
guucgcugaccgcgaauggca

SEQ ID NO: 1400802 - RNA, 19 nt, Pseudomonas aeruginosa PA01
guucgcugacccagcgcac

SEQ ID NO: 1400803 - RNA, 20 nt, Pseudomonas aeruginosa PA01
guucgcguagccccucgcgc

SEQ ID NO: 1400804 - RNA, 12 nt, Pseudomonas aeruginosa PA01
guucgcugccgc

SEQ ID NO: 1400805 - RNA, 17 nt, Pseudomonas aeruginosa PA01
guucggccagccggcgc

SEQ ID NO: 1400806 - RNA, 22 nt, Pseudomonas aeruginosa PA01
guucggcaugguccguucggcg

SEQ ID NO: 1400807 - RNA, 20 nt, Pseudomonas aeruginosa PA01
guucggcauuggugcugccg

SEQ ID NO: 1400808 - RNA, 19 nt, Pseudomonas aeruginosa PA01
guucggcgaugccgcgcca

SEQ ID NO: 1400809 - RNA, 14 nt, Pseudomonas aeruginosa PA01
guucggcccagcag

SEQ ID NO: 1400810 - RNA, 18 nt, Pseudomonas aeruginosa PA01
guucggcccagcagcgcu

SEQ ID NO: 1400811 - RNA, 15 nt, Pseudomonas aeruginosa PA01
guucggccccggcca

SEQ ID NO: 1400812 - RNA, 17 nt, Pseudomonas aeruginosa PA01
guucggccccggccagg

SEQ ID NO: 1400813 - RNA, 16 nt, Pseudomonas aeruginosa PA01
guucggccgcggcugg

SEQ ID NO: 1400814 - RNA, 19 nt, Pseudomonas aeruginosa PA01
guucggccgcggcuggcag

SEQ ID NO: 1400815 - RNA, 14 nt, Pseudomonas aeruginosa PA01
guucgcgcgggucg

SEQ ID NO: 1400816 - RNA, 19 nt, Pseudomonas aeruginosa PA01
guucgcgcgccucgcggcg

SEQ ID NO: 1400817 - RNA, 17 nt, Pseudomonas aeruginosa PA01
guucgcggucggugagc

SEQ ID NO: 1400818 - RNA, 17 nt, Pseudomonas aeruginosa PA01
guucgcggcucuggcgc

SEQ ID NO: 1400819 - RNA, 15 nt, Pseudomonas aeruginosa PA01
guucgcgggccgcgg

SEQ ID NO: 1400820 - RNA, 17 nt, Pseudomonas aeruginosa PA01
guucgcgggccgcggcg

SEQ ID NO: 1400821 - RNA, 20 nt, Pseudomonas aeruginosa PA01
guucgcgggccgcggcgacc

SEQ ID NO: 1400822 - RNA, 17 nt, Pseudomonas aeruginosa PA01
guucgcccugcggaugg

SEQ ID NO: 1400823 - RNA, 22 nt, Pseudomonas aeruginosa PA01
guucgcgcccgucgucguggcg

SEQ ID NO: 1400824 - RNA, 23 nt, Pseudomonas aeruginosa PA01
guucgcgcaggaccuggcugagg

SEQ ID NO: 1400825 - RNA, 19 nt, Pseudomonas aeruginosa PA01
guucgcgcaggcgcuggcg

SEQ ID NO: 1400826 - RNA, 12 nt, Pseudomonas aeruginosa PA01
guucgccggccu

SEQ ID NO: 1400827 - RNA, 19 nt, Pseudomonas aeruginosa PA01
guucgccggccuccagcac

SEQ ID NO: 1400828 - RNA, 21 nt, Pseudomonas aeruginosa PA01
guucgccuugcggggcggcgc

SEQ ID NO: 1400829 - RNA, 23 nt, Pseudomonas aeruginosa PA01
guucugcgacaucuccaggccgc

SEQ ID NO: 1400830 - RNA, 17 nt, Pseudomonas aeruginosa PA01
guucugcucgcugcccg

SEQ ID NO: 1400831 - RNA, 15 nt, Pseudomonas aeruginosa PA01
guucuggucgccgac

SEQ ID NO: 1400832 - RNA, 14 nt, Pseudomonas aeruginosa PA01
guucugugcggcga

SEQ ID NO: 1400833 - RNA, 20 nt, Pseudomonas aeruginosa PA01
guucuuguugagcuggccga

SEQ ID NO: 1400834 - RNA, 22 nt, Pseudomonas aeruginosa PA01
guugaccagcgcgucgaccacc

SEQ ID NO: 1400835 - RNA, 19 nt, Pseudomonas aeruginosa PA01
guucuugaagaagcugccg

SEQ ID NO: 1400836 - RNA, 23 nt, Pseudomonas aeruginosa PA01
guucuugauccgcuccagcgccu

SEQ ID NO: 1400837 - RNA, 15 nt, Pseudomonas aeruginosa PA01
guucuucgccgcccg

SEQ ID NO: 1400838 - RNA, 22 nt, Pseudomonas aeruginosa PA01
guucggggcccuccaggcgaag

SEQ ID NO: 1400839 - RNA, 19 nt, Pseudomonas aeruginosa PA01
guucggggaacagcgccag

SEQ ID NO: 1400840 - RNA, 17 nt, Pseudomonas aeruginosa PA01
guucgggucgcggcuga

SEQ ID NO: 1400841 - RNA, 19 nt, Pseudomonas aeruginosa PA01
guucggcgggaucgacgcc

SEQ ID NO: 1400842 - RNA, 16 nt, Pseudomonas aeruginosa PA01
guucggcugggccagg

SEQ ID NO: 1400843 - RNA, 14 nt, Pseudomonas aeruginosa PA01
guucggcgcuggcg

SEQ ID NO: 1400844 - RNA, 18 nt, Pseudomonas aeruginosa PA01
guucggcgcuggcgcgga

SEQ ID NO: 1400845 - RNA, 23 nt, Pseudomonas aeruginosa PA01
guucggcgaggaucgccagcaau

SEQ ID NO: 1400846 - RNA, 23 nt, Pseudomonas aeruginosa PA01
guucggcgcugaccucgauggcg

SEQ ID NO: 1400847 - RNA, 14 nt, Pseudomonas aeruginosa PA01
guucggcgccagcu

SEQ ID NO: 1400848 - RNA, 15 nt, Pseudomonas aeruginosa PA01
guucggcgcccaggu

SEQ ID NO: 1400849 - RNA, 20 nt, Pseudomonas aeruginosa PA01
guucgaccuccaggccgaag

SEQ ID NO: 1400850 - RNA, 16 nt, Pseudomonas aeruginosa PA01
guucgacacgcucagc

SEQ ID NO: 1400851 - RNA, 16 nt, Pseudomonas aeruginosa PA01
guucgaagcgccaggc

SEQ ID NO: 1400852 - RNA, 17 nt, Pseudomonas aeruginosa PA01
guucgaagcgccaggcg

SEQ ID NO: 1400853 - RNA, 17 nt, Pseudomonas aeruginosa PA01
guucgaaugcugcccgg

SEQ ID NO: 1400854 - RNA, 16 nt, Pseudomonas aeruginosa PA01
guucgaggcgccgacc

SEQ ID NO: 1400855 - RNA, 19 nt, Pseudomonas aeruginosa PA01
guucgaggcgccgaccacg

SEQ ID NO: 1400856 - RNA, 20 nt, Pseudomonas aeruginosa PA01
guucgaggcgccgaccacga

SEQ ID NO: 1400857 - RNA, 22 nt, Pseudomonas aeruginosa PA01
guucgagcagcucguucgccca

SEQ ID NO: 1400858 - RNA, 16 nt, Pseudomonas aeruginosa PA01
guucgacgcugcuagg

SEQ ID NO: 1400859 - RNA, 12 nt, Pseudomonas aeruginosa PA01
guucgccggcca

SEQ ID NO: 1400860 - RNA, 18 nt, Pseudomonas aeruginosa PA01
guucgccggccagcaccu

SEQ ID NO: 1400861 - RNA, 23 nt, Pseudomonas aeruginosa PA01
guucgccgccaccacgaucaggc

SEQ ID NO: 1400862 - RNA, 20 nt, Pseudomonas aeruginosa PA01
guucgccgccgagcgccugg

SEQ ID NO: 1400863 - RNA, 22 nt, Pseudomonas aeruginosa PA01
guucgccgccgagcgccuggca

SEQ ID NO: 1400864 - RNA, 21 nt, Pseudomonas aeruginosa PA01
guucgccgaaauagcgcgccc

SEQ ID NO: 1400865 - RNA, 12 nt, Pseudomonas aeruginosa PA01
guucgccgagcg

SEQ ID NO: 1400866 - RNA, 16 nt, Pseudomonas aeruginosa PA01
guucgccgagcgccgc

SEQ ID NO: 1400867 - RNA, 13 nt, Pseudomonas aeruginosa PA01
guucgcccagacc

SEQ ID NO: 1400868 - RNA, 14 nt, Pseudomonas aeruginosa PA01
guucgcccgcggcg

SEQ ID NO: 1400869 - RNA, 18 nt, Pseudomonas aeruginosa PA01
guucgcccgcggcggcga

SEQ ID NO: 1400870 - RNA, 13 nt, Pseudomonas aeruginosa PA01
guucgcccgcggg

SEQ ID NO: 1400871 - RNA, 19 nt, Pseudomonas aeruginosa PA01
guucgcaggccaggcgcag

SEQ ID NO: 1400872 - RNA, 13 nt, Pseudomonas aeruginosa PA01
guucgaucuugua

SEQ ID NO: 1400873 - RNA, 15 nt, Pseudomonas aeruginosa PA01
guucccggccuggcg

SEQ ID NO: 1400874 - RNA, 22 nt, Pseudomonas aeruginosa PA01
guucccccuuuuucggcgcgga

SEQ ID NO: 1400875 - RNA, 17 nt, Pseudomonas aeruginosa PA01
guucccgccgcucugcu

SEQ ID NO: 1400876 - RNA, 20 nt, Pseudomonas aeruginosa PA01
guucccgccgcucugcuggc

SEQ ID NO: 1400877 - RNA, 21 nt, Pseudomonas aeruginosa PA01
guucccgccgcucugcuggcc

SEQ ID NO: 1400878 - RNA, 22 nt, Pseudomonas aeruginosa PA01
guucccgccgcucugcuggccg

SEQ ID NO: 1400879 - RNA, 15 nt, Pseudomonas aeruginosa PA01
guuccgaaucgccua

SEQ ID NO: 1400880 - RNA, 17 nt, Pseudomonas aeruginosa PA01
guuccgaaucgccuacc

SEQ ID NO: 1400881 - RNA, 19 nt, Pseudomonas aeruginosa PA01
guucccagaaaaucggcag

SEQ ID NO: 1400882 - RNA, 19 nt, Pseudomonas aeruginosa PA01
guucccagaccuggccgcu

SEQ ID NO: 1400883 - RNA, 16 nt, Pseudomonas aeruginosa PA01
guucccagcagcgccu

SEQ ID NO: 1400884 - RNA, 14 nt, Pseudomonas aeruginosa PA01
guucccccagcacc

SEQ ID NO: 1400885 - RNA, 17 nt, Pseudomonas aeruginosa PA01
guucccccguggcgacg

SEQ ID NO: 1400886 - RNA, 23 nt, Pseudomonas aeruginosa PA01
guuccaugcgaaaacggcgaccc

SEQ ID NO: 1400887 - RNA, 17 nt, Pseudomonas aeruginosa PA01
guuccaugucgcuggcc

SEQ ID NO: 1400888 - RNA, 21 nt, Pseudomonas aeruginosa PA01
guuccugcuccuccgacgccc

SEQ ID NO: 1400889 - RNA, 21 nt, Pseudomonas aeruginosa PA01
guuccucgcggcucaccgaga

SEQ ID NO: 1400890 - RNA, 20 nt, Pseudomonas aeruginosa PA01
guuccucggcggcggucgcg

SEQ ID NO: 1400891 - RNA, 12 nt, Pseudomonas aeruginosa PA01
guuccuccagag

SEQ ID NO: 1400892 - RNA, 15 nt, Pseudomonas aeruginosa PA01
guuccgggcagcggc

SEQ ID NO: 1400893 - RNA, 16 nt, Pseudomonas aeruginosa PA01
guuccucacggcgcag

SEQ ID NO: 1400894 - RNA, 13 nt, Pseudomonas aeruginosa PA01
guuccuccgccag

SEQ ID NO: 1400895 - RNA, 14 nt, Pseudomonas aeruginosa PA01
guuccuccgccagg

SEQ ID NO: 1400896 - RNA, 15 nt, Pseudomonas aeruginosa PA01
guuccuccucgccgc

SEQ ID NO: 1400897 - RNA, 16 nt, Pseudomonas aeruginosa PA01
guuccuccucgccgcc

SEQ ID NO: 1400898 - RNA, 14 nt, Pseudomonas aeruginosa PA01
guuccgcgaucaac

SEQ ID NO: 1400899 - RNA, 15 nt, Pseudomonas aeruginosa PA01
guuccggcaggaccu

SEQ ID NO: 1400900 - RNA, 18 nt, Pseudomonas aeruginosa PA01
guuccggguugguggccg

SEQ ID NO: 1400901 - RNA, 18 nt, Pseudomonas aeruginosa PA01
guuccggucgggaugccg

SEQ ID NO: 1400902 - RNA, 20 nt, Pseudomonas aeruginosa PA01
guuccggucgggaugccgug

SEQ ID NO: 1400903 - RNA, 22 nt, Pseudomonas aeruginosa PA01
guuccggucgggaugccgugcc

SEQ ID NO: 1400904 - RNA, 19 nt, Pseudomonas aeruginosa PA01
guuccggcucagccgcugg

SEQ ID NO: 1400905 - RNA, 15 nt, Pseudomonas aeruginosa PA01
guuauucgcccuacc

SEQ ID NO: 1400906 - RNA, 14 nt, Pseudomonas aeruginosa PA01
guuauggccgaccc

SEQ ID NO: 1400907 - RNA, 16 nt, Pseudomonas aeruginosa PA01
guuauccgccgccgac

SEQ ID NO: 1400908 - RNA, 17 nt, Pseudomonas aeruginosa PA01
guuauccgccgccgacg

SEQ ID NO: 1400909 - RNA, 15 nt, Pseudomonas aeruginosa PA01
guuauccgccgccgg

SEQ ID NO: 1400910 - RNA, 16 nt, Pseudomonas aeruginosa PA01
guuaccggcgaccacc

SEQ ID NO: 1400911 - RNA, 17 nt, Pseudomonas aeruginosa PA01
guuacgacaucgacgcc

SEQ ID NO: 1400912 - RNA, 12 nt, Pseudomonas aeruginosa PA01
guuagccggcga

SEQ ID NO: 1400913 - RNA, 20 nt, Pseudomonas aeruginosa PA01
guuagccggcgaucauccag

SEQ ID NO: 1400914 - RNA, 20 nt, Pseudomonas aeruginosa PA01
guucacguaggagccggcca

SEQ ID NO: 1400915 - RNA, 15 nt, Pseudomonas aeruginosa PA01
guucacuccacgagg

SEQ ID NO: 1400916 - RNA, 16 nt, Pseudomonas aeruginosa PA01
guucagcagcaugccg

SEQ ID NO: 1400917 - RNA, 20 nt, Pseudomonas aeruginosa PA01
guucagcagcaugccgcucu

SEQ ID NO: 1400918 - RNA, 19 nt, Pseudomonas aeruginosa PA01
guucagcagcggcacccgg

SEQ ID NO: 1400919 - RNA, 21 nt, Pseudomonas aeruginosa PA01
guucagcagcggcacccggcu

SEQ ID NO: 1400920 - RNA, 22 nt, Pseudomonas aeruginosa PA01
guucagcaggagcagcuugcgc

SEQ ID NO: 1400921 - RNA, 14 nt, Pseudomonas aeruginosa PA01
guucagcaggucgc

SEQ ID NO: 1400922 - RNA, 20 nt, Pseudomonas aeruginosa PA01
guucagagggugaggcgcau

SEQ ID NO: 1400923 - RNA, 13 nt, Pseudomonas aeruginosa PA01
guucaccgcgcaa

SEQ ID NO: 1400924 - RNA, 21 nt, Pseudomonas aeruginosa PA01
guucacgccuggcggcuggcg

SEQ ID NO: 1400925 - RNA, 20 nt, Pseudomonas aeruginosa PA01
guucaccccgcccuuggcgg

SEQ ID NO: 1400926 - RNA, 19 nt, Pseudomonas aeruginosa PA01
guucagcggcgcgucgacc

SEQ ID NO: 1400927 - RNA, 23 nt, Pseudomonas aeruginosa PA01
guucagcggcgcgucgaccacga

SEQ ID NO: 1400928 - RNA, 17 nt, Pseudomonas aeruginosa PA01
guucagcgggcgcuuga

SEQ ID NO: 1400929 - RNA, 20 nt, Pseudomonas aeruginosa PA01
guucagccgguacugcgcca

SEQ ID NO: 1400930 - RNA, 20 nt, Pseudomonas aeruginosa PA01
guucagcgcgcucgcugucg

SEQ ID NO: 1400931 - RNA, 23 nt, Pseudomonas aeruginosa PA01
guucagcgcggagcguccaccag

SEQ ID NO: 1400932 - RNA, 15 nt, Pseudomonas aeruginosa PA01
guucaguucagccgg

SEQ ID NO: 1400933 - RNA, 15 nt, Pseudomonas aeruginosa PA01
guucagugccagcag

SEQ ID NO: 1400934 - RNA, 17 nt, Pseudomonas aeruginosa PA01
guucagucccgcggcgc

SEQ ID NO: 1400935 - RNA, 15 nt, Pseudomonas aeruginosa PA01
guucagucggccagg

SEQ ID NO: 1400936 - RNA, 17 nt, Pseudomonas aeruginosa PA01
guucagguucagggugg

SEQ ID NO: 1400937 - RNA, 22 nt, Pseudomonas aeruginosa PA01
guucaggcuccaauucgacgcc

SEQ ID NO: 1400938 - RNA, 13 nt, Pseudomonas aeruginosa PA01
guucaggcgcgga

SEQ ID NO: 1400939 - RNA, 16 nt, Pseudomonas aeruginosa PA01
guucaggccggcgccg

SEQ ID NO: 1400940 - RNA, 17 nt, Pseudomonas aeruginosa PA01
guucaggccggcgccgc

SEQ ID NO: 1400941 - RNA, 20 nt, Pseudomonas aeruginosa PA01
guucaggccgggcaggccga

SEQ ID NO: 1400942 - RNA, 23 nt, Pseudomonas aeruginosa PA01
guucagggucagguugccgguga

SEQ ID NO: 1400943 - RNA, 17 nt, Pseudomonas aeruginosa PA01
guuccagcaccucgcgg

SEQ ID NO: 1400944 - RNA, 22 nt, Pseudomonas aeruginosa PA01
guuccacgggucgcagccgagc

SEQ ID NO: 1400945 - RNA, 16 nt, Pseudomonas aeruginosa PA01
guuccagcgccucggg

SEQ ID NO: 1400946 - RNA, 21 nt, Pseudomonas aeruginosa PA01
guuccagcgccucgggccgga

SEQ ID NO: 1400947 - RNA, 17 nt, Pseudomonas aeruginosa PA01
guuccagcggccgcgag

SEQ ID NO: 1400948 - RNA, 14 nt, Pseudomonas aeruginosa PA01
guuccaggcccgcc

SEQ ID NO: 1400949 - RNA, 18 nt, Pseudomonas aeruginosa PA01
guuccaggcccgccgcgg

SEQ ID NO: 1400950 - RNA, 19 nt, Pseudomonas aeruginosa PA01
guuccaggcccgccgcggc

SEQ ID NO: 1400951 - RNA, 22 nt, Pseudomonas aeruginosa PA01
guuccagggucagcuggcgcgc

SEQ ID NO: 1400952 - RNA, 20 nt, Pseudomonas aeruginosa PA01
guuccagggccugcuccagc

SEQ ID NO: 1400953 - RNA, 12 nt, Pseudomonas aeruginosa PA01
guuccaggucgc

SEQ ID NO: 1400954 - RNA, 16 nt, Pseudomonas aeruginosa PA01
guuccaguucggccgc

SEQ ID NO: 1400955 - RNA, 20 nt, Pseudomonas aeruginosa PA01
guuccaguucggccgcggcu

SEQ ID NO: 1400956 - RNA, 14 nt, Pseudomonas aeruginosa PA01
guucaggucgaugc

SEQ ID NO: 1400957 - RNA, 17 nt, Pseudomonas aeruginosa PA01
guucaguucugggcggc

SEQ ID NO: 1400958 - RNA, 18 nt, Pseudomonas aeruginosa PA01
guucaguucugggcggcc

SEQ ID NO: 1400959 - RNA, 19 nt, Pseudomonas aeruginosa PA01
guucaguucugggcggcca

SEQ ID NO: 1400960 - RNA, 21 nt, Pseudomonas aeruginosa PA01
guucaguucugggcggccagg

SEQ ID NO: 1400961 - RNA, 18 nt, Pseudomonas aeruginosa PA01
guucaucgccgccaggca

SEQ ID NO: 1400962 - RNA, 13 nt, Pseudomonas aeruginosa PA01
guucaucgagcag

SEQ ID NO: 1400963 - RNA, 16 nt, Pseudomonas aeruginosa PA01
guucaucgagcggcgg

SEQ ID NO: 1400964 - RNA, 18 nt, Pseudomonas aeruginosa PA01
guucaucgagcggcggcc

SEQ ID NO: 1400965 - RNA, 21 nt, Pseudomonas aeruginosa PA01
guucaucgagcggcggccguc

SEQ ID NO: 1400966 - RNA, 22 nt, Pseudomonas aeruginosa PA01
guucaucgagcggcggccgucg

SEQ ID NO: 1400967 - RNA, 23 nt, Pseudomonas aeruginosa PA01
guucaucgagcggcggccgucgc

SEQ ID NO: 1400968 - RNA, 16 nt, Pseudomonas aeruginosa PA01
guucaucuugcggcaa

SEQ ID NO: 1400969 - RNA, 21 nt, Pseudomonas aeruginosa PA01
guucaugccgcgagccuucag

SEQ ID NO: 1400970 - RNA, 14 nt, Pseudomonas aeruginosa PA01
guucaucuucgcgc

SEQ ID NO: 1400971 - RNA, 14 nt, Pseudomonas aeruginosa PA01
gugcguugcgcggc

SEQ ID NO: 1400972 - RNA, 21 nt, Pseudomonas aeruginosa PA01
gugcguggugcauccgccgca

SEQ ID NO: 1400973 - RNA, 17 nt, Pseudomonas aeruginosa PA01
gugcguguucggcggcu

SEQ ID NO: 1400974 - RNA, 23 nt, Pseudomonas aeruginosa PA01
gugguggccguggcgccccaggc

SEQ ID NO: 1400975 - RNA, 16 nt, Pseudomonas aeruginosa PA01
guguagcccgcauccc

SEQ ID NO: 1400976 - RNA, 19 nt, Pseudomonas aeruginosa PA01
guguagccgagcacgcacu

SEQ ID NO: 1400977 - RNA, 18 nt, Pseudomonas aeruginosa PA01
guguagcgcagguugcgc

SEQ ID NO: 1400978 - RNA, 23 nt, Pseudomonas aeruginosa PA01
guguaccuggguugccgcgccga

SEQ ID NO: 1400979 - RNA, 20 nt, Pseudomonas aeruginosa PA01
guguacccagggugcgccgg

SEQ ID NO: 1400980 - RNA, 13 nt, Pseudomonas aeruginosa PA01
guguccaccacca

SEQ ID NO: 1400981 - RNA, 20 nt, Pseudomonas aeruginosa PA01
gugucccgaguaggcgcugc

SEQ ID NO: 1400982 - RNA, 16 nt, Pseudomonas aeruginosa PA01
guguagguauccgccg

SEQ ID NO: 1400983 - RNA, 19 nt, Pseudomonas aeruginosa PA01
guguagguauccgccggcc

SEQ ID NO: 1400984 - RNA, 12 nt, Pseudomonas aeruginosa PA01
gugucaggccga

SEQ ID NO: 1400985 - RNA, 16 nt, Pseudomonas aeruginosa PA01
gugucgguauggaaga

SEQ ID NO: 1400986 - RNA, 22 nt, Pseudomonas aeruginosa PA01
gugucggugaugcgucgcacca

SEQ ID NO: 1400987 - RNA, 14 nt, Pseudomonas aeruginosa PA01
gugucggcgaucag

SEQ ID NO: 1400988 - RNA, 20 nt, Pseudomonas aeruginosa PA01
gugucggcgaucaggccgau

SEQ ID NO: 1400989 - RNA, 16 nt, Pseudomonas aeruginosa PA01
gugucggccgccaggg

SEQ ID NO: 1400990 - RNA, 11 nt, Pseudomonas aeruginosa PA01
gugucggccaa

SEQ ID NO: 1400991 - RNA, 14 nt, Pseudomonas aeruginosa PA01
gugucggccaacug

SEQ ID NO: 1400992 - RNA, 21 nt, Pseudomonas aeruginosa PA01
gugucgccaucagugacaucc

SEQ ID NO: 1400993 - RNA, 19 nt, Pseudomonas aeruginosa PA01
gugucgccuuccggcaggu

SEQ ID NO: 1400994 - RNA, 18 nt, Pseudomonas aeruginosa PA01
gugucgcgaacucggcgc

SEQ ID NO: 1400995 - RNA, 19 nt, Pseudomonas aeruginosa PA01
gugucgcgaacucggcgcc

SEQ ID NO: 1400996 - RNA, 20 nt, Pseudomonas aeruginosa PA01
gugucgcgaacucggcgccg

SEQ ID NO: 1400997 - RNA, 23 nt, Pseudomonas aeruginosa PA01
gugucgacucagcgggcgcggua

SEQ ID NO: 1400998 - RNA, 17 nt, Pseudomonas aeruginosa PA01
gugucgacaccuggcaa

SEQ ID NO: 1400999 - RNA, 19 nt, Pseudomonas aeruginosa PA01
gugucguuguugccgcgca

SEQ ID NO: 1401000 - RNA, 21 nt, Pseudomonas aeruginosa PA01
gugugccggccaugcaggcca

SEQ ID NO: 1401001 - RNA, 14 nt, Pseudomonas aeruginosa PA01
gugugcucaggcga

SEQ ID NO: 1401002 - RNA, 20 nt, Pseudomonas aeruginosa PA01
guguggcgaaacuccagcag

SEQ ID NO: 1401003 - RNA, 17 nt, Pseudomonas aeruginosa PA01
guguuucggccgcugcc

SEQ ID NO: 1401004 - RNA, 16 nt, Pseudomonas aeruginosa PA01
guguuggaaccgaggg

SEQ ID NO: 1401005 - RNA, 12 nt, Pseudomonas aeruginosa PA01
guguugcgccgc

SEQ ID NO: 1401006 - RNA, 17 nt, Pseudomonas aeruginosa PA01
guguugaucgccgcgcc

SEQ ID NO: 1401007 - RNA, 22 nt, Pseudomonas aeruginosa PA01
guguugaucgccgcgccgccga

SEQ ID NO: 1401008 - RNA, 18 nt, Pseudomonas aeruginosa PA01
guguucggccagccggcg

SEQ ID NO: 1401009 - RNA, 17 nt, Pseudomonas aeruginosa PA01
uaccaguagcgacagca

SEQ ID NO: 1401010 - RNA, 21 nt, Pseudomonas aeruginosa PA01
uaccagucgcccgcuucgcca

SEQ ID NO: 1401011 - RNA, 18 nt, Pseudomonas aeruginosa PA01
uacccagggugcgccggg

SEQ ID NO: 1401012 - RNA, 20 nt, Pseudomonas aeruginosa PA01
uacccagggugcgccgggga

SEQ ID NO: 1401013 - RNA, 17 nt, Pseudomonas aeruginosa PA01
uacccagguaagcggcg

SEQ ID NO: 1401014 - RNA, 13 nt, Pseudomonas aeruginosa PA01
uacccgccgcugg

SEQ ID NO: 1401015 - RNA, 15 nt, Pseudomonas aeruginosa PA01
uacccgccgcuggca

SEQ ID NO: 1401016 - RNA, 16 nt, Pseudomonas aeruginosa PA01
uacccgcgaccacagg

SEQ ID NO: 1401017 - RNA, 23 nt, Pseudomonas aeruginosa PA01
uacccgcgaccacaggcggcgga

SEQ ID NO: 1401018 - RNA, 15 nt, Pseudomonas aeruginosa PA01
uacccccucgaccuu

SEQ ID NO: 1401019 - RNA, 18 nt, Pseudomonas aeruginosa PA01
uacccccuugcccgucgg

SEQ ID NO: 1401020 - RNA, 20 nt, Pseudomonas aeruginosa PA01
uaccccgaccaggucgcugg

SEQ ID NO: 1401021 - RNA, 22 nt, Pseudomonas aeruginosa PA01
uaccccgggucgcgcagcggcu

SEQ ID NO: 1401022 - RNA, 17 nt, Pseudomonas aeruginosa PA01
uaccccguagcgcucgg

SEQ ID NO: 1401023 - RNA, 17 nt, Pseudomonas aeruginosa PA01
uacccugggagccgccg

SEQ ID NO: 1401024 - RNA, 17 nt, Pseudomonas aeruginosa PA01
uaccaccgggccgucgg

SEQ ID NO: 1401025 - RNA, 19 nt, Pseudomonas aeruginosa PA01
uaccaccgugcccgccggc

SEQ ID NO: 1401026 - RNA, 20 nt, Pseudomonas aeruginosa PA01
uaccagcaaugcccagcgca

SEQ ID NO: 1401027 - RNA, 20 nt, Pseudomonas aeruginosa PA01
uaccagcaauuccacgcgac

SEQ ID NO: 1401028 - RNA, 12 nt, Pseudomonas aeruginosa PA01
uaccagcagcgc

SEQ ID NO: 1401029 - RNA, 18 nt, Pseudomonas aeruginosa PA01
uaccaggaccagcgccug

SEQ ID NO: 1401030 - RNA, 20 nt, Pseudomonas aeruginosa PA01
uaccaggaagcucggcagca

SEQ ID NO: 1401031 - RNA, 11 nt, Pseudomonas aeruginosa PA01
uaccagcggcu

SEQ ID NO: 1401032 - RNA, 15 nt, Pseudomonas aeruginosa PA01
uacaguucaggcugg

SEQ ID NO: 1401033 - RNA, 19 nt, Pseudomonas aeruginosa PA01
uacagcgccacggccagca

SEQ ID NO: 1401034 - RNA, 14 nt, Pseudomonas aeruginosa PA01
uacagguuguucgg

SEQ ID NO: 1401035 - RNA, 18 nt, Pseudomonas aeruginosa PA01
uacagcgccuggucggcg

SEQ ID NO: 1401036 - RNA, 22 nt, Pseudomonas aeruginosa PA01
uacagcgccuggucggcggccu

SEQ ID NO: 1401037 - RNA, 19 nt, Pseudomonas aeruginosa PA01
uacagcgcgacaucggcga

SEQ ID NO: 1401038 - RNA, 17 nt, Pseudomonas aeruginosa PA01
uaccgcgcauggcggcg

SEQ ID NO: 1401039 - RNA, 18 nt, Pseudomonas aeruginosa PA01
uaccgcuccccacucggc

SEQ ID NO: 1401040 - RNA, 20 nt, Pseudomonas aeruginosa PA01
uaccgcugcggccggcgcgu

SEQ ID NO: 1401041 - RNA, 15 nt, Pseudomonas aeruginosa PA01
uaccgcuggcgcugg

SEQ ID NO: 1401042 - RNA, 15 nt, Pseudomonas aeruginosa PA01
uaccgcgggcucagg

SEQ ID NO: 1401043 - RNA, 16 nt, Pseudomonas aeruginosa PA01
uaccgcgcgcgcaagg

SEQ ID NO: 1401044 - RNA, 15 nt, Pseudomonas aeruginosa PA01
uaccgcuuccugggc

SEQ ID NO: 1401045 - RNA, 17 nt, Pseudomonas aeruginosa PA01
uaccggcaaggcggccu

SEQ ID NO: 1401046 - RNA, 17 nt, Pseudomonas aeruginosa PA01
uaccggagcgaacgaca

SEQ ID NO: 1401047 - RNA, 19 nt, Pseudomonas aeruginosa PA01
uaccggcguugaacugccc

SEQ ID NO: 1401048 - RNA, 19 nt, Pseudomonas aeruginosa PA01
uaccggccaucagcaccag

SEQ ID NO: 1401049 - RNA, 17 nt, Pseudomonas aeruginosa PA01
uaccgcccacccugcgc

SEQ ID NO: 1401050 - RNA, 13 nt, Pseudomonas aeruginosa PA01
uaccgccagcgca

SEQ ID NO: 1401051 - RNA, 13 nt, Pseudomonas aeruginosa PA01
uaccgccggcggc

SEQ ID NO: 1401052 - RNA, 19 nt, Pseudomonas aeruginosa PA01
uaccgccgagggcgccagg

SEQ ID NO: 1401053 - RNA, 22 nt, Pseudomonas aeruginosa PA01
uaccgacaagcauucagcgcgc

SEQ ID NO: 1401054 - RNA, 19 nt, Pseudomonas aeruginosa PA01
uaccgacaugccccgccga

SEQ ID NO: 1401055 - RNA, 14 nt, Pseudomonas aeruginosa PA01
uacgaucagccagg

SEQ ID NO: 1401056 - RNA, 15 nt, Pseudomonas aeruginosa PA01
uaccguccgcgccgc

SEQ ID NO: 1401057 - RNA, 15 nt, Pseudomonas aeruginosa PA01
uacgcccgcagccac

SEQ ID NO: 1401058 - RNA, 22 nt, Pseudomonas aeruginosa PA01
uacgcccccuccccugugguca

SEQ ID NO: 1401059 - RNA, 14 nt, Pseudomonas aeruginosa PA01
uacgcccagcagcg

SEQ ID NO: 1401060 - RNA, 16 nt, Pseudomonas aeruginosa PA01
uacgcaacccgcccgg

SEQ ID NO: 1401061 - RNA, 17 nt, Pseudomonas aeruginosa PA01
uacgcaacccgcccggc

SEQ ID NO: 1401062 - RNA, 21 nt, Pseudomonas aeruginosa PA01
uacgccggauuucacggcgga

SEQ ID NO: 1401063 - RNA, 21 nt, Pseudomonas aeruginosa PA01
uacgccccguuugccgucggc

SEQ ID NO: 1401064 - RNA, 17 nt, Pseudomonas aeruginosa PA01
uacgccggguuucacgg

SEQ ID NO: 1401065 - RNA, 19 nt, Pseudomonas aeruginosa PA01
uacgccggguuucacggcg

SEQ ID NO: 1401066 - RNA, 17 nt, Pseudomonas aeruginosa PA01
uacuaucccggucgggu

SEQ ID NO: 1401067 - RNA, 20 nt, Pseudomonas aeruginosa PA01
uacuggucgcgcgcggccag

SEQ ID NO: 1401068 - RNA, 21 nt, Pseudomonas aeruginosa PA01
uacuggccgaaauugaccagg

SEQ ID NO: 1401069 - RNA, 14 nt, Pseudomonas aeruginosa PA01
uacugggcggcgac

SEQ ID NO: 1401070 - RNA, 18 nt, Pseudomonas aeruginosa PA01
uacuggcgcugcgcggcg

SEQ ID NO: 1401071 - RNA, 18 nt, Pseudomonas aeruginosa PA01
uacuggcggaucaccggc

SEQ ID NO: 1401072 - RNA, 17 nt, Pseudomonas aeruginosa PA01
uacugcuggacggcgga

SEQ ID NO: 1401073 - RNA, 17 nt, Pseudomonas aeruginosa PA01
uacugcgcgggcaugca

SEQ ID NO: 1401074 - RNA, 15 nt, Pseudomonas aeruginosa PA01
uacugagcgugaccc

SEQ ID NO: 1401075 - RNA, 23 nt, Pseudomonas aeruginosa PA01
uacugagcgugacccgcgcuucc

SEQ ID NO: 1401076 - RNA, 17 nt, Pseudomonas aeruginosa PA01
uagaccaggaaggccgg

SEQ ID NO: 1401077 - RNA, 16 nt, Pseudomonas aeruginosa PA01
uagaccagcagcgagc

SEQ ID NO: 1401078 - RNA, 19 nt, Pseudomonas aeruginosa PA01
uagaccagcagcgagcagg

SEQ ID NO: 1401079 - RNA, 19 nt, Pseudomonas aeruginosa PA01
uagaccaccagcagcagcg

SEQ ID NO: 1401080 - RNA, 18 nt, Pseudomonas aeruginosa PA01
uagaccaccucgacggcg

SEQ ID NO: 1401081 - RNA, 17 nt, Pseudomonas aeruginosa PA01
uagaccuugcggccguu

SEQ ID NO: 1401082 - RNA, 16 nt, Pseudomonas aeruginosa PA01
uagacugucgcggggc

SEQ ID NO: 1401083 - RNA, 13 nt, Pseudomonas aeruginosa PA01
uagagcgugcggc

SEQ ID NO: 1401084 - RNA, 19 nt, Pseudomonas aeruginosa PA01
uagaguacucggcuacgaa

SEQ ID NO: 1401085 - RNA, 20 nt, Pseudomonas aeruginosa PA01
uagagcacgccgucgcgcuc

SEQ ID NO: 1401086 - RNA, 16 nt, Pseudomonas aeruginosa PA01
uagagcagcccgggca

SEQ ID NO: 1401087 - RNA, 19 nt, Pseudomonas aeruginosa PA01
uagcagagggucgccagcg

SEQ ID NO: 1401088 - RNA, 21 nt, Pseudomonas aeruginosa PA01
uagcaggccuggagcgccucg

SEQ ID NO: 1401089 - RNA, 13 nt, Pseudomonas aeruginosa PA01
uagcaauacaacc

SEQ ID NO: 1401090 - RNA, 15 nt, Pseudomonas aeruginosa PA01
uagagugcccaggcg

SEQ ID NO: 1401091 - RNA, 19 nt, Pseudomonas aeruginosa PA01
uagaggaugccggccucga

SEQ ID NO: 1401092 - RNA, 15 nt, Pseudomonas aeruginosa PA01
uagauaaaugcccgg

SEQ ID NO: 1401093 - RNA, 17 nt, Pseudomonas aeruginosa PA01
uagcagcgccgcgccug

SEQ ID NO: 1401094 - RNA, 19 nt, Pseudomonas aeruginosa PA01
uagccaggggucaggccga

SEQ ID NO: 1401095 - RNA, 12 nt, Pseudomonas aeruginosa PA01
uagcccgcggcg

SEQ ID NO: 1401096 - RNA, 15 nt, Pseudomonas aeruginosa PA01
uagcccgcggcgagc

SEQ ID NO: 1401097 - RNA, 18 nt, Pseudomonas aeruginosa PA01
uagcccgcggcgagcagc

SEQ ID NO: 1401098 - RNA, 22 nt, Pseudomonas aeruginosa PA01
uagcccgcggcgagcagcggcg

SEQ ID NO: 1401099 - RNA, 18 nt, Pseudomonas aeruginosa PA01
uagcccgggaucgaugcg

SEQ ID NO: 1401100 - RNA, 17 nt, Pseudomonas aeruginosa PA01
uagccgaucaacgcggc

SEQ ID NO: 1401101 - RNA, 22 nt, Pseudomonas aeruginosa PA01
uagccgaucaacgcggccagca

SEQ ID NO: 1401102 - RNA, 14 nt, Pseudomonas aeruginosa PA01
uagcccucgaccug

SEQ ID NO: 1401103 - RNA, 16 nt, Pseudomonas aeruginosa PA01
uagcccugggcgaugc

SEQ ID NO: 1401104 - RNA, 16 nt, Pseudomonas aeruginosa PA01
uagcccaggccgaagg

SEQ ID NO: 1401105 - RNA, 17 nt, Pseudomonas aeruginosa PA01
uagcccaggccgaaggc

SEQ ID NO: 1401106 - RNA, 11 nt, Pseudomonas aeruginosa PA01
uagcccagggg

SEQ ID NO: 1401107 - RNA, 22 nt, Pseudomonas aeruginosa PA01
uagcccauggucagcgguaggu

SEQ ID NO: 1401108 - RNA, 13 nt, Pseudomonas aeruginosa PA01
uagcccccgccgc

SEQ ID NO: 1401109 - RNA, 15 nt, Pseudomonas aeruginosa PA01
uagcccccgccgcug

SEQ ID NO: 1401110 - RNA, 12 nt, Pseudomonas aeruginosa PA01
uagccccggccc

SEQ ID NO: 1401111 - RNA, 16 nt, Pseudomonas aeruginosa PA01
uagcgcaguccgguag

SEQ ID NO: 1401112 - RNA, 23 nt, Pseudomonas aeruginosa PA01
uagcgcaguccgguagcgcgccu

SEQ ID NO: 1401113 - RNA, 18 nt, Pseudomonas aeruginosa PA01
uagcgcaguucgccgccg

SEQ ID NO: 1401114 - RNA, 23 nt, Pseudomonas aeruginosa PA01
uagcgcaguucgccgccgagcgc

SEQ ID NO: 1401115 - RNA, 16 nt, Pseudomonas aeruginosa PA01
uagcgcaugccguugg

SEQ ID NO: 1401116 - RNA, 14 nt, Pseudomonas aeruginosa PA01
uagcgcagcggcag

SEQ ID NO: 1401117 - RNA, 15 nt, Pseudomonas aeruginosa PA01
uagcgcagcggcagg

SEQ ID NO: 1401118 - RNA, 22 nt, Pseudomonas aeruginosa PA01
uagcgcagguugcgcuggcgca

SEQ ID NO: 1401119 - RNA, 22 nt, Pseudomonas aeruginosa PA01
uagcgcagccgcucggccgcca

SEQ ID NO: 1401120 - RNA, 15 nt, Pseudomonas aeruginosa PA01
uagcgcagcaccggc

SEQ ID NO: 1401121 - RNA, 16 nt, Pseudomonas aeruginosa PA01
uagccgcaguccaggg

SEQ ID NO: 1401122 - RNA, 17 nt, Pseudomonas aeruginosa PA01
uagccgcaguccagggc

SEQ ID NO: 1401123 - RNA, 14 nt, Pseudomonas aeruginosa PA01
uagccgcccaccgc

SEQ ID NO: 1401124 - RNA, 18 nt, Pseudomonas aeruginosa PA01
uaaucgcucaacggcgug

SEQ ID NO: 1401125 - RNA, 20 nt, Pseudomonas aeruginosa PA01
uaagccgcgccaucggucgc

SEQ ID NO: 1401126 - RNA, 21 nt, Pseudomonas aeruginosa PA01
uacacaaugaucgcgccggau

SEQ ID NO: 1401127 - RNA, 16 nt, Pseudomonas aeruginosa PA01
uacaaugauggcccuu

SEQ ID NO: 1401128 - RNA, 20 nt, Pseudomonas aeruginosa PA01
uacagcgacucgcugccggc

SEQ ID NO: 1401129 - RNA, 17 nt, Pseudomonas aeruginosa PA01
uacaccgagcgcaguuc

SEQ ID NO: 1401130 - RNA, 19 nt, Pseudomonas aeruginosa PA01
uacaccgcugcgccgccgu

SEQ ID NO: 1401131 - RNA, 20 nt, Pseudomonas aeruginosa PA01
uacaccgcugcgccgccguc

SEQ ID NO: 1401132 - RNA, 20 nt, Pseudomonas aeruginosa PA01
uaacgccccucuuccacgcg

SEQ ID NO: 1401133 - RNA, 18 nt, Pseudomonas aeruginosa PA01
uaacgccugucgcuccgg

SEQ ID NO: 1401134 - RNA, 19 nt, Pseudomonas aeruginosa PA01
uaacaccaggagcgccagc

SEQ ID NO: 1401135 - RNA, 22 nt, Pseudomonas aeruginosa PA01
uaaccaauuucuuccaucgugg

SEQ ID NO: 1401136 - RNA, 20 nt, Pseudomonas aeruginosa PA01
uaaaaagccccgcuucggcg

SEQ ID NO: 1401137 - RNA, 17 nt, Pseudomonas aeruginosa PA01
guuucagaacgucggcg

SEQ ID NO: 1401138 - RNA, 22 nt, Pseudomonas aeruginosa PA01
guuucagcccacgcgccuggcc

SEQ ID NO: 1401139 - RNA, 16 nt, Pseudomonas aeruginosa PA01
guuucagcgccagcag

SEQ ID NO: 1401140 - RNA, 17 nt, Pseudomonas aeruginosa PA01
uaaagaaaaggccgcgu

SEQ ID NO: 1401141 - RNA, 16 nt, Pseudomonas aeruginosa PA01
gggauugucgccgccg

SEQ ID NO: 1401142 - RNA, 21 nt, Pseudomonas aeruginosa PA01
gggauguuccaggcccgccgc

SEQ ID NO: 1401143 - RNA, 22 nt, Pseudomonas aeruginosa PA01
gggauguuccaggcccgccgcg

SEQ ID NO: 1401144 - RNA, 15 nt, Pseudomonas aeruginosa PA01
gggauuccuugguca

SEQ ID NO: 1401145 - RNA, 23 nt, Pseudomonas aeruginosa PA01
gggauuccuuggucaggucgacg

SEQ ID NO: 1401146 - RNA, 17 nt, Pseudomonas aeruginosa PA01
gggaucgcgcggcuggc

SEQ ID NO: 1401147 - RNA, 20 nt, Pseudomonas aeruginosa PA01
gggaucgcgcggcuggcugc

SEQ ID NO: 1401148 - RNA, 12 nt, Pseudomonas aeruginosa PA01
gggaucgaccgg

SEQ ID NO: 1401149 - RNA, 14 nt, Pseudomonas aeruginosa PA01
gggaucgacgccgc

SEQ ID NO: 1401150 - RNA, 21 nt, Pseudomonas aeruginosa PA01
gggaucgacgccgcuggcggc

SEQ ID NO: 1401151 - RNA, 21 nt, Pseudomonas aeruginosa PA01
gggauggucgagggcgcguug

SEQ ID NO: 1401152 - RNA, 15 nt, Pseudomonas aeruginosa PA01
gggaucggcgaucag

SEQ ID NO: 1401153 - RNA, 17 nt, Pseudomonas aeruginosa PA01
gggaucggcgaucagcg

SEQ ID NO: 1401154 - RNA, 16 nt, Pseudomonas aeruginosa PA01
gggaucacucgccgcc

SEQ ID NO: 1401155 - RNA, 13 nt, Pseudomonas aeruginosa PA01
gggaucagcgaga

SEQ ID NO: 1401156 - RNA, 13 nt, Pseudomonas aeruginosa PA01
gggaucagcggcg

SEQ ID NO: 1401157 - RNA, 20 nt, Pseudomonas aeruginosa PA01
gggaucaggucgccagcgcc

SEQ ID NO: 1401158 - RNA, 12 nt, Pseudomonas aeruginosa PA01
gggacgcgccgg

SEQ ID NO: 1401159 - RNA, 23 nt, Pseudomonas aeruginosa PA01
gggacgcugucccggccauuccu

SEQ ID NO: 1401160 - RNA, 17 nt, Pseudomonas aeruginosa PA01
gggacggaagcauggcc

SEQ ID NO: 1401161 - RNA, 20 nt, Pseudomonas aeruginosa PA01
gggacggcugcccaacuggc

SEQ ID NO: 1401162 - RNA, 15 nt, Pseudomonas aeruginosa PA01
gggacggugcaggcc

SEQ ID NO: 1401163 - RNA, 22 nt, Pseudomonas aeruginosa PA01
gggacgaugccgaucucgccca

SEQ ID NO: 1401164 - RNA, 13 nt, Pseudomonas aeruginosa PA01
gggacgccaggcg

SEQ ID NO: 1401165 - RNA, 19 nt, Pseudomonas aeruginosa PA01
gggacgcgcaugcagggcg

SEQ ID NO: 1401166 - RNA, 15 nt, Pseudomonas aeruginosa PA01
gggcacggaaucgga

SEQ ID NO: 1401167 - RNA, 21 nt, Pseudomonas aeruginosa PA01
gggcacggccagucgcguugg

SEQ ID NO: 1401168 - RNA, 14 nt, Pseudomonas aeruginosa PA01
gggcacgcuggcga

SEQ ID NO: 1401169 - RNA, 16 nt, Pseudomonas aeruginosa PA01
gggcacgcuggcgaga

SEQ ID NO: 1401170 - RNA, 19 nt, Pseudomonas aeruginosa PA01
gggcacgcauagcgcgcug

SEQ ID NO: 1401171 - RNA, 21 nt, Pseudomonas aeruginosa PA01
gggcaccgacgaugggcacga

SEQ ID NO: 1401172 - RNA, 17 nt, Pseudomonas aeruginosa PA01
gggcaccgagucggcaa

SEQ ID NO: 1401173 - RNA, 14 nt, Pseudomonas aeruginosa PA01
gggcaccgccgagg

SEQ ID NO: 1401174 - RNA, 13 nt, Pseudomonas aeruginosa PA01
gggcaccggcgga

SEQ ID NO: 1401175 - RNA, 23 nt, Pseudomonas aeruginosa PA01
gggcaccgcgccggcggugcgga

SEQ ID NO: 1401176 - RNA, 17 nt, Pseudomonas aeruginosa PA01
gggcacguugggaucgc

SEQ ID NO: 1401177 - RNA, 23 nt, Pseudomonas aeruginosa PA01
gggcacuucucgaacagcuccuc

SEQ ID NO: 1401178 - RNA, 21 nt, Pseudomonas aeruginosa PA01
gggcagaguggcgcggcugau

SEQ ID NO: 1401179 - RNA, 17 nt, Pseudomonas aeruginosa PA01
gggcagcagccggacca

SEQ ID NO: 1401180 - RNA, 12 nt, Pseudomonas aeruginosa PA01
gggcagcagcga

SEQ ID NO: 1401181 - RNA, 16 nt, Pseudomonas aeruginosa PA01
gggcagcacgcuggcg

SEQ ID NO: 1401182 - RNA, 22 nt, Pseudomonas aeruginosa PA01
gggcagcacgcuggcgucgggc

SEQ ID NO: 1401183 - RNA, 14 nt, Pseudomonas aeruginosa PA01
gggcagcggcgagu

SEQ ID NO: 1401184 - RNA, 13 nt, Pseudomonas aeruginosa PA01
gggcagcggcgca

SEQ ID NO: 1401185 - RNA, 11 nt, Pseudomonas aeruginosa PA01
gggcagcggcg

SEQ ID NO: 1401186 - RNA, 20 nt, Pseudomonas aeruginosa PA01
gggcagccgccgcggcaccg

SEQ ID NO: 1401187 - RNA, 22 nt, Pseudomonas aeruginosa PA01
ggcuugugcagagaggcuggcg

SEQ ID NO: 1401188 - RNA, 20 nt, Pseudomonas aeruginosa PA01
ggcuuucguaggcaggcgcg

SEQ ID NO: 1401189 - RNA, 16 nt, Pseudomonas aeruginosa PA01
ggcuuuuucucgucgc

SEQ ID NO: 1401190 - RNA, 17 nt, Pseudomonas aeruginosa PA01
ggcuuuuucucgucgcg

SEQ ID NO: 1401191 - RNA, 18 nt, Pseudomonas aeruginosa PA01
ggcuuuccagggccuggc

SEQ ID NO: 1401192 - RNA, 19 nt, Pseudomonas aeruginosa PA01
ggcuuuccagggccuggcg

SEQ ID NO: 1401193 - RNA, 20 nt, Pseudomonas aeruginosa PA01
ggcuuuccgucucaggcgcc

SEQ ID NO: 1401194 - RNA, 15 nt, Pseudomonas aeruginosa PA01
ggcuuuccucggcca

SEQ ID NO: 1401195 - RNA, 18 nt, Pseudomonas aeruginosa PA01
ggcuuuccucggccaugc

SEQ ID NO: 1401196 - RNA, 22 nt, Pseudomonas aeruginosa PA01
ggcuugugcgaauguccggcga

SEQ ID NO: 1401197 - RNA, 19 nt, Pseudomonas aeruginosa PA01
ggcuuguucagcucggcgu

SEQ ID NO: 1401198 - RNA, 21 nt, Pseudomonas aeruginosa PA01
gggaagcugccuuccagcagg

SEQ ID NO: 1401199 - RNA, 13 nt, Pseudomonas aeruginosa PA01
gggaagggccgga

SEQ ID NO: 1401200 - RNA, 19 nt, Pseudomonas aeruginosa PA01
gggaaguaggccuggccgc

SEQ ID NO: 1401201 - RNA, 17 nt, Pseudomonas aeruginosa PA01
gggaaacaccaggccga

SEQ ID NO: 1401202 - RNA, 23 nt, Pseudomonas aeruginosa PA01
gggaaaagcccagguggcaggcc

SEQ ID NO: 1401203 - RNA, 19 nt, Pseudomonas aeruginosa PA01
ggcuuuuucaugggcgcgc

SEQ ID NO: 1401204 - RNA, 23 nt, Pseudomonas aeruginosa PA01
ggcuuuuucguuuccggcaggcu

SEQ ID NO: 1401205 - RNA, 13 nt, Pseudomonas aeruginosa PA01
gggaauggcggau

SEQ ID NO: 1401206 - RNA, 19 nt, Pseudomonas aeruginosa PA01
gggaaucgucacggcgugc

SEQ ID NO: 1401207 - RNA, 15 nt, Pseudomonas aeruginosa PA01
gggaaucuggccgau

SEQ ID NO: 1401208 - RNA, 23 nt, Pseudomonas aeruginosa PA01
gggaaugacuaucgggccgaucg

SEQ ID NO: 1401209 - RNA, 19 nt, Pseudomonas aeruginosa PA01
gggaaugcucagcacggcg

SEQ ID NO: 1401210 - RNA, 23 nt, Pseudomonas aeruginosa PA01
gggaaugcucagcacggcgacgg

SEQ ID NO: 1401211 - RNA, 20 nt, Pseudomonas aeruginosa PA01
gggaauggaugcgcggcagc

SEQ ID NO: 1401212 - RNA, 18 nt, Pseudomonas aeruginosa PA01
gggaauuucacgccgaag

SEQ ID NO: 1401213 - RNA, 19 nt, Pseudomonas aeruginosa PA01
ggcuugaucgagucgccgg

SEQ ID NO: 1401214 - RNA, 21 nt, Pseudomonas aeruginosa PA01
ggcuugaucgagucgccggcg

SEQ ID NO: 1401215 - RNA, 19 nt, Pseudomonas aeruginosa PA01
ggcuuggucgggcgccgcg

SEQ ID NO: 1401216 - RNA, 15 nt, Pseudomonas aeruginosa PA01
ggcuucguccgccug

SEQ ID NO: 1401217 - RNA, 22 nt, Pseudomonas aeruginosa PA01
ggcuucgggaucguaggcgcgc

SEQ ID NO: 1401218 - RNA, 18 nt, Pseudomonas aeruginosa PA01
ggcuucuuccuggccggg

SEQ ID NO: 1401219 - RNA, 14 nt, Pseudomonas aeruginosa PA01
ggcuugaccgccgc

SEQ ID NO: 1401220 - RNA, 16 nt, Pseudomonas aeruginosa PA01
ggcuugaccgccgccg

SEQ ID NO: 1401221 - RNA, 19 nt, Pseudomonas aeruginosa PA01
ggcuugaccgccgccgccu

SEQ ID NO: 1401222 - RNA, 18 nt, Pseudomonas aeruginosa PA01
ggcugggguugcggcgcc

SEQ ID NO: 1401223 - RNA, 12 nt, Pseudomonas aeruginosa PA01
ggcugggugucg

SEQ ID NO: 1401224 - RNA, 14 nt, Pseudomonas aeruginosa PA01
ggcugggucggcug

SEQ ID NO: 1401225 - RNA, 15 nt, Pseudomonas aeruginosa PA01
ggcugggucggcugg

SEQ ID NO: 1401226 - RNA, 23 nt, Pseudomonas aeruginosa PA01
ggcugggcgcccuucagcgccuc

SEQ ID NO: 1401227 - RNA, 15 nt, Pseudomonas aeruginosa PA01
ggcuggucagaacca

SEQ ID NO: 1401228 - RNA, 15 nt, Pseudomonas aeruginosa PA01
ggcuggucaggcuga

SEQ ID NO: 1401229 - RNA, 19 nt, Pseudomonas aeruginosa PA01
ggcuggucaguucggccca

SEQ ID NO: 1401230 - RNA, 20 nt, Pseudomonas aeruginosa PA01
ggcuggucaguucggcccag

SEQ ID NO: 1401231 - RNA, 15 nt, Pseudomonas aeruginosa PA01
ggcuguaaucgccgc

SEQ ID NO: 1401232 - RNA, 15 nt, Pseudomonas aeruginosa PA01
ggcuguacagcagga

SEQ ID NO: 1401233 - RNA, 19 nt, Pseudomonas aeruginosa PA01
ggcuguacagcaggagcgc

SEQ ID NO: 1401234 - RNA, 16 nt, Pseudomonas aeruginosa PA01
ggcugguucagcgggu

SEQ ID NO: 1401235 - RNA, 16 nt, Pseudomonas aeruginosa PA01
ggcuggguucggcgag

SEQ ID NO: 1401236 - RNA, 16 nt, Pseudomonas aeruginosa PA01
ggcuggucggcuuccg

SEQ ID NO: 1401237 - RNA, 18 nt, Pseudomonas aeruginosa PA01
ggcuggucguagcagcgg

SEQ ID NO: 1401238 - RNA, 22 nt, Pseudomonas aeruginosa PA01
ggcugguggccguugagcaccu

SEQ ID NO: 1401239 - RNA, 18 nt, Pseudomonas aeruginosa PA01
ggcugguggucaccgcca

SEQ ID NO: 1401240 - RNA, 11 nt, Pseudomonas aeruginosa PA01
ggcugguggcc

SEQ ID NO: 1401241 - RNA, 22 nt, Pseudomonas aeruginosa PA01
gggcggaucgagcagcggcgcc

SEQ ID NO: 1401242 - RNA, 12 nt, Pseudomonas aeruginosa PA01
gggcggccaggu

SEQ ID NO: 1401243 - RNA, 13 nt, Pseudomonas aeruginosa PA01
gggcggccgccga

SEQ ID NO: 1401244 - RNA, 12 nt, Pseudomonas aeruginosa PA01
gggcggccggcg

SEQ ID NO: 1401245 - RNA, 16 nt, Pseudomonas aeruginosa PA01
gggcggccggcgcgga

SEQ ID NO: 1401246 - RNA, 12 nt, Pseudomonas aeruginosa PA01
gggcggcggcga

SEQ ID NO: 1401247 - RNA, 13 nt, Pseudomonas aeruginosa PA01
gggcggcggcgcg

SEQ ID NO: 1401248 - RNA, 13 nt, Pseudomonas aeruginosa PA01
gggcggcggcgcu

SEQ ID NO: 1401249 - RNA, 19 nt, Pseudomonas aeruginosa PA01
gggcggccucaggccuggc

SEQ ID NO: 1401250 - RNA, 13 nt, Pseudomonas aeruginosa PA01
gggcggcgaacgg

SEQ ID NO: 1401251 - RNA, 12 nt, Pseudomonas aeruginosa PA01
gggcggcgaccg

SEQ ID NO: 1401252 - RNA, 14 nt, Pseudomonas aeruginosa PA01
gggcggcgagcugg

SEQ ID NO: 1401253 - RNA, 13 nt, Pseudomonas aeruginosa PA01
gggcggcgccugg

SEQ ID NO: 1401254 - RNA, 13 nt, Pseudomonas aeruginosa PA01
gggcgggcggucg

SEQ ID NO: 1401255 - RNA, 13 nt, Pseudomonas aeruginosa PA01
gggcgggcguccg

SEQ ID NO: 1401256 - RNA, 22 nt, Pseudomonas aeruginosa PA01
gggcgguacaggcgcaccuggc

SEQ ID NO: 1401257 - RNA, 13 nt, Pseudomonas aeruginosa PA01
gggcgguacgccg

SEQ ID NO: 1401258 - RNA, 14 nt, Pseudomonas aeruginosa PA01
gggcgguacgccgc

SEQ ID NO: 1401259 - RNA, 18 nt, Pseudomonas aeruginosa PA01
gggcgguacgccgcgcug

SEQ ID NO: 1401260 - RNA, 15 nt, Pseudomonas aeruginosa PA01
gggcggucggcucag

SEQ ID NO: 1401261 - RNA, 14 nt, Pseudomonas aeruginosa PA01
gggcgggucuggcg

SEQ ID NO: 1401262 - RNA, 17 nt, Pseudomonas aeruginosa PA01
gggcgguagcgggccag

SEQ ID NO: 1401263 - RNA, 18 nt, Pseudomonas aeruginosa PA01
gggcgguagcgggccagc

SEQ ID NO: 1401264 - RNA, 14 nt, Pseudomonas aeruginosa PA01
gggcgguaugccgg

SEQ ID NO: 1401265 - RNA, 15 nt, Pseudomonas aeruginosa PA01
gggcgguaugccgga

SEQ ID NO: 1401266 - RNA, 14 nt, Pseudomonas aeruginosa PA01
gggcggucggccag

SEQ ID NO: 1401267 - RNA, 20 nt, Pseudomonas aeruginosa PA01
gggcggcggcucaggccgcc

SEQ ID NO: 1401268 - RNA, 14 nt, Pseudomonas aeruginosa PA01
gggcggcgucgcgg

SEQ ID NO: 1401269 - RNA, 15 nt, Pseudomonas aeruginosa PA01
gggcggcgucgcgga

SEQ ID NO: 1401270 - RNA, 20 nt, Pseudomonas aeruginosa PA01
gggcggcgucccggcgccgc

SEQ ID NO: 1401271 - RNA, 15 nt, Pseudomonas aeruginosa PA01
gggcggcuggccgag

SEQ ID NO: 1401272 - RNA, 22 nt, Pseudomonas aeruginosa PA01
gggcggcuguagcggaucaggc

SEQ ID NO: 1401273 - RNA, 21 nt, Pseudomonas aeruginosa PA01
gggcgggaucaggucgccagc

SEQ ID NO: 1401274 - RNA, 21 nt, Pseudomonas aeruginosa PA01
gggcgggauugucgccgccga

SEQ ID NO: 1401275 - RNA, 18 nt, Pseudomonas aeruginosa PA01
gggcgcucaccgaggcga

SEQ ID NO: 1401276 - RNA, 13 nt, Pseudomonas aeruginosa PA01
gggcgcucgcccu

SEQ ID NO: 1401277 - RNA, 20 nt, Pseudomonas aeruginosa PA01
gggcgcguugcccagcccca

SEQ ID NO: 1401278 - RNA, 12 nt, Pseudomonas aeruginosa PA01
gggcgcugccga

SEQ ID NO: 1401279 - RNA, 17 nt, Pseudomonas aeruginosa PA01
gggcgcuugaagccggc

SEQ ID NO: 1401280 - RNA, 22 nt, Pseudomonas aeruginosa PA01
gggcggacgcugggcugggucg

SEQ ID NO: 1401281 - RNA, 13 nt, Pseudomonas aeruginosa PA01
gggcgcgcgccgg

SEQ ID NO: 1401282 - RNA, 14 nt, Pseudomonas aeruginosa PA01
gggcgcgcuggucg

SEQ ID NO: 1401283 - RNA, 20 nt, Pseudomonas aeruginosa PA01
gggcgcgcgccaccgccugg

SEQ ID NO: 1401284 - RNA, 13 nt, Pseudomonas aeruginosa PA01
gggcgcgccgcag

SEQ ID NO: 1401285 - RNA, 15 nt, Pseudomonas aeruginosa PA01
gggcgaucucgcggg

SEQ ID NO: 1401286 - RNA, 21 nt, Pseudomonas aeruginosa PA01
gggcgaucucgcgggcuacca

SEQ ID NO: 1401287 - RNA, 12 nt, Pseudomonas aeruginosa PA01
gggcgcggcgcc

SEQ ID NO: 1401288 - RNA, 13 nt, Pseudomonas aeruginosa PA01
gggcgcggcgcca

SEQ ID NO: 1401289 - RNA, 19 nt, Pseudomonas aeruginosa PA01
gggcgcgguagggaucguc

SEQ ID NO: 1401290 - RNA, 17 nt, Pseudomonas aeruginosa PA01
gggcgaguucggcgagc

SEQ ID NO: 1401291 - RNA, 18 nt, Pseudomonas aeruginosa PA01
gggcgaguucggcgagca

SEQ ID NO: 1401292 - RNA, 18 nt, Pseudomonas aeruginosa PA01
gggcgaggccgcucuucu

SEQ ID NO: 1401293 - RNA, 15 nt, Pseudomonas aeruginosa PA01
gggcgagggcgcgca

SEQ ID NO: 1401294 - RNA, 16 nt, Pseudomonas aeruginosa PA01
gggcgagggcggcgcg

SEQ ID NO: 1401295 - RNA, 15 nt, Pseudomonas aeruginosa PA01
gggcgaucacgccgc

SEQ ID NO: 1401296 - RNA, 18 nt, Pseudomonas aeruginosa PA01
gggcgaucacgccgcgca

SEQ ID NO: 1401297 - RNA, 22 nt, Pseudomonas aeruginosa PA01
gggcgaucuccucgauccgcug

SEQ ID NO: 1401298 - RNA, 17 nt, Pseudomonas aeruginosa PA01
gggcgauccgcccgcau

SEQ ID NO: 1401299 - RNA, 15 nt, Pseudomonas aeruginosa PA01
gggcgauccagaaga

SEQ ID NO: 1401300 - RNA, 16 nt, Pseudomonas aeruginosa PA01
gggcgacgcccgaggc

SEQ ID NO: 1401301 - RNA, 23 nt, Pseudomonas aeruginosa PA01
gggcgacgcccgaggcguuaucc

SEQ ID NO: 1401302 - RNA, 14 nt, Pseudomonas aeruginosa PA01
gggcgacgccgaug

SEQ ID NO: 1401303 - RNA, 19 nt, Pseudomonas aeruginosa PA01
gggcgacgccgaugcucgg

SEQ ID NO: 1401304 - RNA, 15 nt, Pseudomonas aeruginosa PA01
gggcgacgcguccgg

SEQ ID NO: 1401305 - RNA, 13 nt, Pseudomonas aeruginosa PA01
gggcgacuaccag

SEQ ID NO: 1401306 - RNA, 13 nt, Pseudomonas aeruginosa PA01
gggcgagcugcac

SEQ ID NO: 1401307 - RNA, 23 nt, Pseudomonas aeruginosa PA01
gggcgagcgcagacgggugcuga

SEQ ID NO: 1401308 - RNA, 15 nt, Pseudomonas aeruginosa PA01
gggcgagaaucgccg

SEQ ID NO: 1401309 - RNA, 21 nt, Pseudomonas aeruginosa PA01
gggcccggcuccagccgggcu

SEQ ID NO: 1401310 - RNA, 19 nt, Pseudomonas aeruginosa PA01
gggcccguggcaggugacg

SEQ ID NO: 1401311 - RNA, 13 nt, Pseudomonas aeruginosa PA01
gggcccuccaggc

SEQ ID NO: 1401312 - RNA, 15 nt, Pseudomonas aeruginosa PA01
gggcccugccagagg

SEQ ID NO: 1401313 - RNA, 21 nt, Pseudomonas aeruginosa PA01
gggcccugccagaggaucggc

SEQ ID NO: 1401314 - RNA, 14 nt, Pseudomonas aeruginosa PA01
gggccgaaggccag

SEQ ID NO: 1401315 - RNA, 17 nt, Pseudomonas aeruginosa PA01
gggccgaaggccaggcc

SEQ ID NO: 1401316 - RNA, 14 nt, Pseudomonas aeruginosa PA01
gggccgcgccgagc

SEQ ID NO: 1401317 - RNA, 18 nt, Pseudomonas aeruginosa PA01
gggccgcgagguccggcu

SEQ ID NO: 1401318 - RNA, 13 nt, Pseudomonas aeruginosa PA01
gggccgcgcagau

SEQ ID NO: 1401319 - RNA, 10 nt, Pseudomonas aeruginosa PA01
gggccgccuc

SEQ ID NO: 1401320 - RNA, 13 nt, Pseudomonas aeruginosa PA01
gggccgccggcga

SEQ ID NO: 1401321 - RNA, 16 nt, Pseudomonas aeruginosa PA01
gggccgccggcgacga

SEQ ID NO: 1401322 - RNA, 14 nt, Pseudomonas aeruginosa PA01
gggcaucagccccu

SEQ ID NO: 1401323 - RNA, 21 nt, Pseudomonas aeruginosa PA01
gggcaucagccccucggccag

SEQ ID NO: 1401324 - RNA, 17 nt, Pseudomonas aeruginosa PA01
gggcaucaugccgagca

SEQ ID NO: 1401325 - RNA, 21 nt, Pseudomonas aeruginosa PA01
gggcauaggaauacggcgcga

SEQ ID NO: 1401326 - RNA, 22 nt, Pseudomonas aeruginosa PA01
gggcaguacucaugaccgccgc

SEQ ID NO: 1401327 - RNA, 16 nt, Pseudomonas aeruginosa PA01
gggcaggccgaucauc

SEQ ID NO: 1401328 - RNA, 13 nt, Pseudomonas aeruginosa PA01
gggcagggugucg

SEQ ID NO: 1401329 - RNA, 17 nt, Pseudomonas aeruginosa PA01
gggcagcuuggcgguca

SEQ ID NO: 1401330 - RNA, 23 nt, Pseudomonas aeruginosa PA01
gggcagcucguugcacagcgccc

SEQ ID NO: 1401331 - RNA, 21 nt, Pseudomonas aeruginosa PA01
gggccguuuuuuaugccgagg

SEQ ID NO: 1401332 - RNA, 15 nt, Pseudomonas aeruginosa PA01
gggccucgccacgcu

SEQ ID NO: 1401333 - RNA, 16 nt, Pseudomonas aeruginosa PA01
gggccuccuggcggcg

SEQ ID NO: 1401334 - RNA, 12 nt, Pseudomonas aeruginosa PA01
gggccucgcugu

SEQ ID NO: 1401335 - RNA, 18 nt, Pseudomonas aeruginosa PA01
gggccucggccagcgccg

SEQ ID NO: 1401336 - RNA, 18 nt, Pseudomonas aeruginosa PA01
gggccugcucagcguccu

SEQ ID NO: 1401337 - RNA, 18 nt, Pseudomonas aeruginosa PA01
gggccugcuccucggcag

SEQ ID NO: 1401338 - RNA, 20 nt, Pseudomonas aeruginosa PA01
gggccuggcucgaucggcag

SEQ ID NO: 1401339 - RNA, 16 nt, Pseudomonas aeruginosa PA01
gggcgacccaggccga

SEQ ID NO: 1401340 - RNA, 18 nt, Pseudomonas aeruginosa PA01
gggcgacccaggccgaca

SEQ ID NO: 1401341 - RNA, 14 nt, Pseudomonas aeruginosa PA01
gggcgaccgccagg

SEQ ID NO: 1401342 - RNA, 20 nt, Pseudomonas aeruginosa PA01
gggcgaccgccaggcggccg

SEQ ID NO: 1401343 - RNA, 21 nt, Pseudomonas aeruginosa PA01
gggcgaccggaugcuccaggu

SEQ ID NO: 1401344 - RNA, 16 nt, Pseudomonas aeruginosa PA01
gggcgaccuucagcgg

SEQ ID NO: 1401345 - RNA, 18 nt, Pseudomonas aeruginosa PA01
gggccggaucggccuugg

SEQ ID NO: 1401346 - RNA, 15 nt, Pseudomonas aeruginosa PA01
gggccgcggcgacca

SEQ ID NO: 1401347 - RNA, 12 nt, Pseudomonas aeruginosa PA01
gggccgcgcugc

SEQ ID NO: 1401348 - RNA, 23 nt, Pseudomonas aeruginosa PA01
gggccgcggcguugucggccagc

SEQ ID NO: 1401349 - RNA, 13 nt, Pseudomonas aeruginosa PA01
gggccgcggcgga

SEQ ID NO: 1401350 - RNA, 22 nt, Pseudomonas aeruginosa PA01
gggccggacguuuccagcggcu

SEQ ID NO: 1401351 - RNA, 23 nt, Pseudomonas aeruginosa PA01
gggccggcaugcucagccgcgcc

SEQ ID NO: 1401352 - RNA, 22 nt, Pseudomonas aeruginosa PA01
ggcguuuuuucuuuccagcgcc

SEQ ID NO: 1401353 - RNA, 22 nt, Pseudomonas aeruginosa PA01
ggcguuuuucauuccgguccca

SEQ ID NO: 1401354 - RNA, 16 nt, Pseudomonas aeruginosa PA01
ggcguugucggcaacc

SEQ ID NO: 1401355 - RNA, 19 nt, Pseudomonas aeruginosa PA01
ggcguugucggccagcagc

SEQ ID NO: 1401356 - RNA, 20 nt, Pseudomonas aeruginosa PA01
ggcguugucggccagcagca

SEQ ID NO: 1401357 - RNA, 16 nt, Pseudomonas aeruginosa PA01
ggcguuguugccgccg

SEQ ID NO: 1401358 - RNA, 12 nt, Pseudomonas aeruginosa PA01
ggcguuucgccg

SEQ ID NO: 1401359 - RNA, 17 nt, Pseudomonas aeruginosa PA01
ggcguuguccaggcugu

SEQ ID NO: 1401360 - RNA, 19 nt, Pseudomonas aeruginosa PA01
ggcguuugcgucauccgcc

SEQ ID NO: 1401361 - RNA, 15 nt, Pseudomonas aeruginosa PA01
ggcucaauccggcug

SEQ ID NO: 1401362 - RNA, 15 nt, Pseudomonas aeruginosa PA01
ggcucacacgccgug

SEQ ID NO: 1401363 - RNA, 18 nt, Pseudomonas aeruginosa PA01
ggcucaacugguccugag

SEQ ID NO: 1401364 - RNA, 22 nt, Pseudomonas aeruginosa PA01
ggcucaacugguuggccgccug

SEQ ID NO: 1401365 - RNA, 17 nt, Pseudomonas aeruginosa PA01
ggcucaccgagaaccag

SEQ ID NO: 1401366 - RNA, 15 nt, Pseudomonas aeruginosa PA01
ggcuagucgcgcagc

SEQ ID NO: 1401367 - RNA, 16 nt, Pseudomonas aeruginosa PA01
ggcuagucgcgcagcg

SEQ ID NO: 1401368 - RNA, 15 nt, Pseudomonas aeruginosa PA01
ggcuaucgcuuucag

SEQ ID NO: 1401369 - RNA, 19 nt, Pseudomonas aeruginosa PA01
ggcuaucaggugagggcga

SEQ ID NO: 1401370 - RNA, 15 nt, Pseudomonas aeruginosa PA01
ggcuauccuccaggc

SEQ ID NO: 1401371 - RNA, 18 nt, Pseudomonas aeruginosa PA01
ggcuauccuccaggccgc

SEQ ID NO: 1401372 - RNA, 19 nt, Pseudomonas aeruginosa PA01
ggcuauccuccaggccgcc

SEQ ID NO: 1401373 - RNA, 18 nt, Pseudomonas aeruginosa PA01
ggcuauucccgccgcucc

SEQ ID NO: 1401374 - RNA, 23 nt, Pseudomonas aeruginosa PA01
ggcgugacugcaaucgaccauca

SEQ ID NO: 1401375 - RNA, 13 nt, Pseudomonas aeruginosa PA01
ggcgugccgcagg

SEQ ID NO: 1401376 - RNA, 18 nt, Pseudomonas aeruginosa PA01
ggcgugccgcaggccgcg

SEQ ID NO: 1401377 - RNA, 22 nt, Pseudomonas aeruginosa PA01
ggcgugccgcaggccgcggccg

SEQ ID NO: 1401378 - RNA, 18 nt, Pseudomonas aeruginosa PA01
ggcgugccgccaggccuu

SEQ ID NO: 1401379 - RNA, 19 nt, Pseudomonas aeruginosa PA01
ggcgugccgcuggccgacc

SEQ ID NO: 1401380 - RNA, 20 nt, Pseudomonas aeruginosa PA01
ggcgugccgcuggccgacca

SEQ ID NO: 1401381 - RNA, 14 nt, Pseudomonas aeruginosa PA01
ggcgugcuccagca

SEQ ID NO: 1401382 - RNA, 18 nt, Pseudomonas aeruginosa PA01
ggcgugccguggcucggc

SEQ ID NO: 1401383 - RNA, 20 nt, Pseudomonas aeruginosa PA01
ggcgugccguggcucggcgg

SEQ ID NO: 1401384 - RNA, 19 nt, Pseudomonas aeruginosa PA01
ggcgugccuguuccuccgc

SEQ ID NO: 1401385 - RNA, 15 nt, Pseudomonas aeruginosa PA01
ggcgugccgggcagu

SEQ ID NO: 1401386 - RNA, 18 nt, Pseudomonas aeruginosa PA01
ggcgugccgggccggcca

SEQ ID NO: 1401387 - RNA, 20 nt, Pseudomonas aeruginosa PA01
ggcgugccgggccggccagg

SEQ ID NO: 1401388 - RNA, 20 nt, Pseudomonas aeruginosa PA01
ggcguucggaccugucccga

SEQ ID NO: 1401389 - RNA, 21 nt, Pseudomonas aeruginosa PA01
ggcguucggaccugucccgau

SEQ ID NO: 1401390 - RNA, 13 nt, Pseudomonas aeruginosa PA01
ggcguucucgauc

SEQ ID NO: 1401391 - RNA, 22 nt, Pseudomonas aeruginosa PA01
ggcguucucgaucaucgccagc

SEQ ID NO: 1401392 - RNA, 14 nt, Pseudomonas aeruginosa PA01
ggcguucucggcca

SEQ ID NO: 1401393 - RNA, 16 nt, Pseudomonas aeruginosa PA01
ggcguucucguccucg

SEQ ID NO: 1401394 - RNA, 20 nt, Pseudomonas aeruginosa PA01
ggcguucucguccucggcgu

SEQ ID NO: 1401395 - RNA, 21 nt, Pseudomonas aeruginosa PA01
ggcguugguacagcucgcgca

SEQ ID NO: 1401396 - RNA, 22 nt, Pseudomonas aeruginosa PA01
ggcguuguagaucugcaccgcc

SEQ ID NO: 1401397 - RNA, 22 nt, Pseudomonas aeruginosa PA01
ggcguuguaggaauagaucgca

SEQ ID NO: 1401398 - RNA, 13 nt, Pseudomonas aeruginosa PA01
ggcguucgccgag

SEQ ID NO: 1401399 - RNA, 20 nt, Pseudomonas aeruginosa PA01
ggcguucugcuucucggcua

SEQ ID NO: 1401400 - RNA, 18 nt, Pseudomonas aeruginosa PA01
ggcguucuucacccgcag

SEQ ID NO: 1401401 - RNA, 23 nt, Pseudomonas aeruginosa PA01
ggcguucuucacccgcagcggca

SEQ ID NO: 1401402 - RNA, 19 nt, Pseudomonas aeruginosa PA01
ggcguuggcuccgggccga

SEQ ID NO: 1401403 - RNA, 20 nt, Pseudomonas aeruginosa PA01
ggcguuggcuccgggccgag

SEQ ID NO: 1401404 - RNA, 20 nt, Pseudomonas aeruginosa PA01
ggcguuccagcucggcgagg

SEQ ID NO: 1401405 - RNA, 15 nt, Pseudomonas aeruginosa PA01
ggcguuccaggcggc

SEQ ID NO: 1401406 - RNA, 16 nt, Pseudomonas aeruginosa PA01
ggcguuccaggcggcg

SEQ ID NO: 1401407 - RNA, 20 nt, Pseudomonas aeruginosa PA01
ggcguuccaguucggccgcg

SEQ ID NO: 1401408 - RNA, 15 nt, Pseudomonas aeruginosa PA01
ggcgugcucggcgau

SEQ ID NO: 1401409 - RNA, 16 nt, Pseudomonas aeruginosa PA01
ggcgugcucggcgauc

SEQ ID NO: 1401410 - RNA, 15 nt, Pseudomonas aeruginosa PA01
ggcguuccucgacga

SEQ ID NO: 1401411 - RNA, 18 nt, Pseudomonas aeruginosa PA01
ggcguuccuucaacagcg

SEQ ID NO: 1401412 - RNA, 20 nt, Pseudomonas aeruginosa PA01
ggcguuccuuuuccucgauc

SEQ ID NO: 1401413 - RNA, 20 nt, Pseudomonas aeruginosa PA01
ggcgucguagagguugccgu

SEQ ID NO: 1401414 - RNA, 23 nt, Pseudomonas aeruginosa PA01
ggcgucguccucgaaagccgccg

SEQ ID NO: 1401415 - RNA, 19 nt, Pseudomonas aeruginosa PA01
ggcgucguccugcgcggcg

SEQ ID NO: 1401416 - RNA, 20 nt, Pseudomonas aeruginosa PA01
ggcgucguccugcgcggcga

SEQ ID NO: 1401417 - RNA, 16 nt, Pseudomonas aeruginosa PA01
ggcgucgucgaccucg

SEQ ID NO: 1401418 - RNA, 20 nt, Pseudomonas aeruginosa PA01
ggcgucgucgaggcugucgc

SEQ ID NO: 1401419 - RNA, 12 nt, Pseudomonas aeruginosa PA01
ggcgucggcgcc

SEQ ID NO: 1401420 - RNA, 14 nt, Pseudomonas aeruginosa PA01
ggcgucggcgcggg

SEQ ID NO: 1401421 - RNA, 21 nt, Pseudomonas aeruginosa PA01
ggcgucggcgcgggcgccgau

SEQ ID NO: 1401422 - RNA, 13 nt, Pseudomonas aeruginosa PA01
ggcgucggcgauc

SEQ ID NO: 1401423 - RNA, 21 nt, Pseudomonas aeruginosa PA01
ggcgucggcugcgcugggcgc

SEQ ID NO: 1401424 - RNA, 15 nt, Pseudomonas aeruginosa PA01
ggcgucggcuggucg

SEQ ID NO: 1401425 - RNA, 16 nt, Pseudomonas aeruginosa PA01
ggcgucggcuggucga

SEQ ID NO: 1401426 - RNA, 22 nt, Pseudomonas aeruginosa PA01
ggcgucuggggugaggccgagc

SEQ ID NO: 1401427 - RNA, 19 nt, Pseudomonas aeruginosa PA01
ggcgucuugucgaagcccg

SEQ ID NO: 1401428 - RNA, 13 nt, Pseudomonas aeruginosa PA01
ggcgucuucggcg

SEQ ID NO: 1401429 - RNA, 17 nt, Pseudomonas aeruginosa PA01
ggcgucuucggcggcgc

SEQ ID NO: 1401430 - RNA, 18 nt, Pseudomonas aeruginosa PA01
ggcgucuucggcggcgcc

SEQ ID NO: 1401431 - RNA, 19 nt, Pseudomonas aeruginosa PA01
ggcgucuucggcggcgccg

SEQ ID NO: 1401432 - RNA, 20 nt, Pseudomonas aeruginosa PA01
ggcgucuuccggcucgccgc

SEQ ID NO: 1401433 - RNA, 14 nt, Pseudomonas aeruginosa PA01
ggcgugaagccgcc

SEQ ID NO: 1401434 - RNA, 15 nt, Pseudomonas aeruginosa PA01
ggcgugaagccgccg

SEQ ID NO: 1401435 - RNA, 22 nt, Pseudomonas aeruginosa PA01
ggcgugaagccgccgcccagca

SEQ ID NO: 1401436 - RNA, 19 nt, Pseudomonas aeruginosa PA01
ggcgugaaguagccgccgg

SEQ ID NO: 1401437 - RNA, 14 nt, Pseudomonas aeruginosa PA01
ggcgucgucgcugc

SEQ ID NO: 1401438 - RNA, 23 nt, Pseudomonas aeruginosa PA01
ggcgucguuguugcgggcgagca

SEQ ID NO: 1401439 - RNA, 15 nt, Pseudomonas aeruginosa PA01
ggcgucugcccgguc

SEQ ID NO: 1401440 - RNA, 20 nt, Pseudomonas aeruginosa PA01
ggcgucugcccgguccaacc

SEQ ID NO: 1401441 - RNA, 22 nt, Pseudomonas aeruginosa PA01
ggcgucucggagugaggccgag

SEQ ID NO: 1401442 - RNA, 20 nt, Pseudomonas aeruginosa PA01
ggcgucucauggaacagcag

SEQ ID NO: 1401443 - RNA, 14 nt, Pseudomonas aeruginosa PA01
ggcgucuccugccg

SEQ ID NO: 1401444 - RNA, 20 nt, Pseudomonas aeruginosa PA01
ggcgucuccugccgccgaua

SEQ ID NO: 1401445 - RNA, 13 nt, Pseudomonas aeruginosa PA01
ggcggucgcgauc

SEQ ID NO: 1401446 - RNA, 16 nt, Pseudomonas aeruginosa PA01
ggcggucgcgaucugc

SEQ ID NO: 1401447 - RNA, 14 nt, Pseudomonas aeruginosa PA01
ggcggucgccgaac

SEQ ID NO: 1401448 - RNA, 15 nt, Pseudomonas aeruginosa PA01
ggcggucgccgaaca

SEQ ID NO: 1401449 - RNA, 20 nt, Pseudomonas aeruginosa PA01
ggcggucgccgaacagccgc

SEQ ID NO: 1401450 - RNA, 14 nt, Pseudomonas aeruginosa PA01
ggcggucgccgccg

SEQ ID NO: 1401451 - RNA, 15 nt, Pseudomonas aeruginosa PA01
ggcggucgccgccgg

SEQ ID NO: 1401452 - RNA, 18 nt, Pseudomonas aeruginosa PA01
ggcggucgccgccggcga

SEQ ID NO: 1401453 - RNA, 12 nt, Pseudomonas aeruginosa PA01
ggcggucgaggc

SEQ ID NO: 1401454 - RNA, 13 nt, Pseudomonas aeruginosa PA01
ggcggucgaggcc

SEQ ID NO: 1401455 - RNA, 18 nt, Pseudomonas aeruginosa PA01
ggcgguccgccgcgggac

SEQ ID NO: 1401456 - RNA, 16 nt, Pseudomonas aeruginosa PA01
ggcggucaugcgcccu

SEQ ID NO: 1401457 - RNA, 13 nt, Pseudomonas aeruginosa PA01
ggcggucgcggac

SEQ ID NO: 1401458 - RNA, 14 nt, Pseudomonas aeruginosa PA01
ggcggucgcggacc

SEQ ID NO: 1401459 - RNA, 16 nt, Pseudomonas aeruginosa PA01
ggcggucggccaggcg

SEQ ID NO: 1401460 - RNA, 18 nt, Pseudomonas aeruginosa PA01
ggcggucggccaggcggc

SEQ ID NO: 1401461 - RNA, 20 nt, Pseudomonas aeruginosa PA01
ggcggucggccaggcggccg

SEQ ID NO: 1401462 - RNA, 17 nt, Pseudomonas aeruginosa PA01
ggcggucucgaacgcca

SEQ ID NO: 1401463 - RNA, 19 nt, Pseudomonas aeruginosa PA01
ggcggucgucgccaucgcu

SEQ ID NO: 1401464 - RNA, 22 nt, Pseudomonas aeruginosa PA01
ggcggucgucgccaucgcucac

SEQ ID NO: 1401465 - RNA, 19 nt, Pseudomonas aeruginosa PA01
ggcgucgccuuccaccacc

SEQ ID NO: 1401466 - RNA, 19 nt, Pseudomonas aeruginosa PA01
ggcgucgcugccgcugacg

SEQ ID NO: 1401467 - RNA, 13 nt, Pseudomonas aeruginosa PA01
ggcgucgcgcagg

SEQ ID NO: 1401468 - RNA, 13 nt, Pseudomonas aeruginosa PA01
ggcgucgcgccag

SEQ ID NO: 1401469 - RNA, 14 nt, Pseudomonas aeruginosa PA01
ggcgucgcgccagc

SEQ ID NO: 1401470 - RNA, 20 nt, Pseudomonas aeruginosa PA01
ggcgucgcuguagcggcucg

SEQ ID NO: 1401471 - RNA, 21 nt, Pseudomonas aeruginosa PA01
ggcgucgcuguagcggcucgc

SEQ ID NO: 1401472 - RNA, 13 nt, Pseudomonas aeruginosa PA01
ggcggugaccagc

SEQ ID NO: 1401473 - RNA, 16 nt, Pseudomonas aeruginosa PA01
ggcggugaccagcggc

SEQ ID NO: 1401474 - RNA, 19 nt, Pseudomonas aeruginosa PA01
ggcggugaccagcggcacc

SEQ ID NO: 1401475 - RNA, 22 nt, Pseudomonas aeruginosa PA01
ggcggugcagcggaagcccugc

SEQ ID NO: 1401476 - RNA, 14 nt, Pseudomonas aeruginosa PA01
ggcggugagggcga

SEQ ID NO: 1401477 - RNA, 16 nt, Pseudomonas aeruginosa PA01
ggcggugagguugccg

SEQ ID NO: 1401478 - RNA, 18 nt, Pseudomonas aeruginosa PA01
ggcggugagguugccgcc

SEQ ID NO: 1401479 - RNA, 19 nt, Pseudomonas aeruginosa PA01
ggcggugagguugccgccg

SEQ ID NO: 1401480 - RNA, 22 nt, Pseudomonas aeruginosa PA01
ggcggugagguugccgccgauc

SEQ ID NO: 1401481 - RNA, 21 nt, Pseudomonas aeruginosa PA01
ggcucuguuccucggcggcgg

SEQ ID NO: 1401482 - RNA, 13 nt, Pseudomonas aeruginosa PA01
ggcucuuggucgc

SEQ ID NO: 1401483 - RNA, 19 nt, Pseudomonas aeruginosa PA01
ggcucuuuccgggucauug

SEQ ID NO: 1401484 - RNA, 20 nt, Pseudomonas aeruginosa PA01
ggcucuuuccgggucauugg

SEQ ID NO: 1401485 - RNA, 22 nt, Pseudomonas aeruginosa PA01
ggcucuuuucuauuccggggac

SEQ ID NO: 1401486 - RNA, 17 nt, Pseudomonas aeruginosa PA01
ggcugaacagcgccacc

SEQ ID NO: 1401487 - RNA, 16 nt, Pseudomonas aeruginosa PA01
ggcugacccgcugucc

SEQ ID NO: 1401488 - RNA, 18 nt, Pseudomonas aeruginosa PA01
ggcugacccgcuguccgc

SEQ ID NO: 1401489 - RNA, 21 nt, Pseudomonas aeruginosa PA01
ggcugacccgcuguccgccgg

SEQ ID NO: 1401490 - RNA, 17 nt, Pseudomonas aeruginosa PA01
ggcugacccggucgcug

SEQ ID NO: 1401491 - RNA, 20 nt, Pseudomonas aeruginosa PA01
ggcugaccgcgugggccggc

SEQ ID NO: 1401492 - RNA, 21 nt, Pseudomonas aeruginosa PA01
ggcugaccgcgugggccggca

SEQ ID NO: 1401493 - RNA, 18 nt, Pseudomonas aeruginosa PA01
ggcugaagaagcugcccc

SEQ ID NO: 1401494 - RNA, 16 nt, Pseudomonas aeruginosa PA01
ggcugaagacccugca

SEQ ID NO: 1401495 - RNA, 15 nt, Pseudomonas aeruginosa PA01
ggcugaagcggccgc

SEQ ID NO: 1401496 - RNA, 16 nt, Pseudomonas aeruginosa PA01
ggcugaagcggccgcc

SEQ ID NO: 1401497 - RNA, 17 nt, Pseudomonas aeruginosa PA01
ggcugaauaccacgugg

SEQ ID NO: 1401498 - RNA, 22 nt, Pseudomonas aeruginosa PA01
ggcugaauaccacguggccggc

SEQ ID NO: 1401499 - RNA, 23 nt, Pseudomonas aeruginosa PA01
ggcugaauaccacguggccggcg

SEQ ID NO: 1401500 - RNA, 15 nt, Pseudomonas aeruginosa PA01
ggcuccgcugcucag

SEQ ID NO: 1401501 - RNA, 13 nt, Pseudomonas aeruginosa PA01
ggcuccggauggc

SEQ ID NO: 1401502 - RNA, 15 nt, Pseudomonas aeruginosa PA01
ggcuccgcgcacgga

SEQ ID NO: 1401503 - RNA, 12 nt, Pseudomonas aeruginosa PA01
ggcuccgccgcg

SEQ ID NO: 1401504 - RNA, 15 nt, Pseudomonas aeruginosa PA01
ggcucguugaugaua

SEQ ID NO: 1401505 - RNA, 18 nt, Pseudomonas aeruginosa PA01
ggcucucgcgcagcagga

SEQ ID NO: 1401506 - RNA, 16 nt, Pseudomonas aeruginosa PA01
ggcucucuucggccga

SEQ ID NO: 1401507 - RNA, 13 nt, Pseudomonas aeruginosa PA01
ggcuccggcgcca

SEQ ID NO: 1401508 - RNA, 19 nt, Pseudomonas aeruginosa PA01
ggcucacgccccagcgcau

SEQ ID NO: 1401509 - RNA, 21 nt, Pseudomonas aeruginosa PA01
ggcucaccgcguaauaggcga

SEQ ID NO: 1401510 - RNA, 14 nt, Pseudomonas aeruginosa PA01
ggcuccaguugcag

SEQ ID NO: 1401511 - RNA, 22 nt, Pseudomonas aeruginosa PA01
ggcuccgaugaagcaggcggag

SEQ ID NO: 1401512 - RNA, 16 nt, Pseudomonas aeruginosa PA01
ggcugagacgcugccg

SEQ ID NO: 1401513 - RNA, 13 nt, Pseudomonas aeruginosa PA01
ggcugacgucgac

SEQ ID NO: 1401514 - RNA, 22 nt, Pseudomonas aeruginosa PA01
ggcugacgucgacgcagcgcgc

SEQ ID NO: 1401515 - RNA, 13 nt, Pseudomonas aeruginosa PA01
ggcugacgcuggc

SEQ ID NO: 1401516 - RNA, 15 nt, Pseudomonas aeruginosa PA01
ggcugacgcuggcga

SEQ ID NO: 1401517 - RNA, 22 nt, Pseudomonas aeruginosa PA01
ggcugacgcuggcgaaggcgcu

SEQ ID NO: 1401518 - RNA, 19 nt, Pseudomonas aeruginosa PA01
ggcugagcuguuucagccc

SEQ ID NO: 1401519 - RNA, 20 nt, Pseudomonas aeruginosa PA01
ggcugagcuguuucagccca

SEQ ID NO: 1401520 - RNA, 16 nt, Pseudomonas aeruginosa PA01
ggcugaggcuggcgac

SEQ ID NO: 1401521 - RNA, 17 nt, Pseudomonas aeruginosa PA01
ggcugaggcuggcgacc

SEQ ID NO: 1401522 - RNA, 22 nt, Pseudomonas aeruginosa PA01
ggcugaggccgacgaacagcca

SEQ ID NO: 1401523 - RNA, 14 nt, Pseudomonas aeruginosa PA01
ggcugaucggccgc

SEQ ID NO: 1401524 - RNA, 18 nt, Pseudomonas aeruginosa PA01
ggcugaucggcgcgccgg

SEQ ID NO: 1401525 - RNA, 20 nt, Pseudomonas aeruginosa PA01
ggcugaguucgucgagcaug

SEQ ID NO: 1401526 - RNA, 24 nt, Pseudomonas aeruginosa PA01
ggcugccaccgagggcaggaacca

SEQ ID NO: 1401527 - RNA, 15 nt, Pseudomonas aeruginosa PA01
ggcugcccaccacca

SEQ ID NO: 1401528 - RNA, 12 nt, Pseudomonas aeruginosa PA01
ggcugcccacca

SEQ ID NO: 1401529 - RNA, 17 nt, Pseudomonas aeruginosa PA01
ggcugcauguccgccag

SEQ ID NO: 1401530 - RNA, 16 nt, Pseudomonas aeruginosa PA01
ggcugcaucggcucgg

SEQ ID NO: 1401531 - RNA, 22 nt, Pseudomonas aeruginosa PA01
ggcugcaugccgggguccgccg

SEQ ID NO: 1401532 - RNA, 23 nt, Pseudomonas aeruginosa PA01
ggcugcagggccagggaggcgcu

SEQ ID NO: 1401533 - RNA, 13 nt, Pseudomonas aeruginosa PA01
ggcugcagguagg

SEQ ID NO: 1401534 - RNA, 18 nt, Pseudomonas aeruginosa PA01
ggcugaucucggccaugg

SEQ ID NO: 1401535 - RNA, 13 nt, Pseudomonas aeruginosa PA01
ggcugaucagccc

SEQ ID NO: 1401536 - RNA, 15 nt, Pseudomonas aeruginosa PA01
ggcugaucagcccgc

SEQ ID NO: 1401537 - RNA, 14 nt, Pseudomonas aeruginosa PA01
ggcugaucugccgg

SEQ ID NO: 1401538 - RNA, 13 nt, Pseudomonas aeruginosa PA01
ggcugaugccgcg

SEQ ID NO: 1401539 - RNA, 16 nt, Pseudomonas aeruginosa PA01
ggcugaugccgcggua

SEQ ID NO: 1401540 - RNA, 14 nt, Pseudomonas aeruginosa PA01
ggcugcaacgccgc

SEQ ID NO: 1401541 - RNA, 15 nt, Pseudomonas aeruginosa PA01
ggcugcaacgccgcg

SEQ ID NO: 1401542 - RNA, 18 nt, Pseudomonas aeruginosa PA01
ggcugcaacgccgcgggu

SEQ ID NO: 1401543 - RNA, 17 nt, Pseudomonas aeruginosa PA01
ggcugccguccaggcgc

SEQ ID NO: 1401544 - RNA, 17 nt, Pseudomonas aeruginosa PA01
ggcugccggacgcgauc

SEQ ID NO: 1401545 - RNA, 19 nt, Pseudomonas aeruginosa PA01
ggcugccggagucucggga

SEQ ID NO: 1401546 - RNA, 13 nt, Pseudomonas aeruginosa PA01
ggcugccgcccgg

SEQ ID NO: 1401547 - RNA, 15 nt, Pseudomonas aeruginosa PA01
ggcugccgccgccgu

SEQ ID NO: 1401548 - RNA, 16 nt, Pseudomonas aeruginosa PA01
ggcugccgccgccguc

SEQ ID NO: 1401549 - RNA, 22 nt, Pseudomonas aeruginosa PA01
ggcugccgccgccgucgacacc

SEQ ID NO: 1401550 - RNA, 13 nt, Pseudomonas aeruginosa PA01
ggcugccgccagc

SEQ ID NO: 1401551 - RNA, 20 nt, Pseudomonas aeruginosa PA01
ggcugccccucacaccacca

SEQ ID NO: 1401552 - RNA, 20 nt, Pseudomonas aeruginosa PA01
ggcugcccaguugcgcggcg

SEQ ID NO: 1401553 - RNA, 21 nt, Pseudomonas aeruginosa PA01
ggcugcccaguugcgcggcga

SEQ ID NO: 1401554 - RNA, 23 nt, Pseudomonas aeruginosa PA01
ggcugcccaguugcgcggcgagu

SEQ ID NO: 1401555 - RNA, 13 nt, Pseudomonas aeruginosa PA01
ggcugcccaggcu

SEQ ID NO: 1401556 - RNA, 20 nt, Pseudomonas aeruginosa PA01
ggcugcccagguagccggcg

SEQ ID NO: 1401557 - RNA, 24 nt, Pseudomonas aeruginosa PA01
ggcugcccagguagccggcgagcg

SEQ ID NO: 1401558 - RNA, 21 nt, Pseudomonas aeruginosa PA01
ggcugccgaagccuucgucga

SEQ ID NO: 1401559 - RNA, 11 nt, Pseudomonas aeruginosa PA01
ggcugccgagc

SEQ ID NO: 1401560 - RNA, 18 nt, Pseudomonas aeruginosa PA01
ggcugccgagcaggguca

SEQ ID NO: 1401561 - RNA, 21 nt, Pseudomonas aeruginosa PA01
ggcugccgaggguguagagga

SEQ ID NO: 1401562 - RNA, 17 nt, Pseudomonas aeruginosa PA01
ggcugccgaacaggcgu

SEQ ID NO: 1401563 - RNA, 18 nt, Pseudomonas aeruginosa PA01
ggcugccgaacaggcguc

SEQ ID NO: 1401564 - RNA, 15 nt, Pseudomonas aeruginosa PA01
ggcugcccucgacga

SEQ ID NO: 1401565 - RNA, 19 nt, Pseudomonas aeruginosa PA01
ggcugcggcggaaggcggc

SEQ ID NO: 1401566 - RNA, 20 nt, Pseudomonas aeruginosa PA01
ggcugcggcggaaggcggcg

SEQ ID NO: 1401567 - RNA, 18 nt, Pseudomonas aeruginosa PA01
ggcugcgucguuggccgg

SEQ ID NO: 1401568 - RNA, 20 nt, Pseudomonas aeruginosa PA01
ggcugcgucguuggccggcu

SEQ ID NO: 1401569 - RNA, 14 nt, Pseudomonas aeruginosa PA01
ggcugcgcgccacc

SEQ ID NO: 1401570 - RNA, 13 nt, Pseudomonas aeruginosa PA01
ggcugcgcgccgg

SEQ ID NO: 1401571 - RNA, 19 nt, Pseudomonas aeruginosa PA01
ggcugcgauauggccgauc

SEQ ID NO: 1401572 - RNA, 22 nt, Pseudomonas aeruginosa PA01
ggcugcggagcgucggaagcgu

SEQ ID NO: 1401573 - RNA, 16 nt, Pseudomonas aeruginosa PA01
ggcugcgcucggcgcu

SEQ ID NO: 1401574 - RNA, 19 nt, Pseudomonas aeruginosa PA01
ggcugcgcucggcgcucgg

SEQ ID NO: 1401575 - RNA, 13 nt, Pseudomonas aeruginosa PA01
ggcugcgcugggc

SEQ ID NO: 1401576 - RNA, 12 nt, Pseudomonas aeruginosa PA01
ggcugcgcucac

SEQ ID NO: 1401577 - RNA, 12 nt, Pseudomonas aeruginosa PA01
ggcugcgcucca

SEQ ID NO: 1401578 - RNA, 18 nt, Pseudomonas aeruginosa PA01
ggcugcgcaccucggcca

SEQ ID NO: 1401579 - RNA, 19 nt, Pseudomonas aeruginosa PA01
ggcugcgcaccucggccag

SEQ ID NO: 1401580 - RNA, 20 nt, Pseudomonas aeruginosa PA01
ggcugcgcaucgccugggcc

SEQ ID NO: 1401581 - RNA, 13 nt, Pseudomonas aeruginosa PA01
ggcugcgccgcgu

SEQ ID NO: 1401582 - RNA, 13 nt, Pseudomonas aeruginosa PA01
ggcugcgccgcug

SEQ ID NO: 1401583 - RNA, 17 nt, Pseudomonas aeruginosa PA01
ggcugcgccgcugcggc

SEQ ID NO: 1401584 - RNA, 20 nt, Pseudomonas aeruginosa PA01
ggcugcgccgcugcggcugc

SEQ ID NO: 1401585 - RNA, 21 nt, Pseudomonas aeruginosa PA01
ggcugcgccgcugcggcugca

SEQ ID NO: 1401586 - RNA, 19 nt, Pseudomonas aeruginosa PA01
ggcuggcccucggcguuca

SEQ ID NO: 1401587 - RNA, 17 nt, Pseudomonas aeruginosa PA01
ggcuggccgagcgccgc

SEQ ID NO: 1401588 - RNA, 20 nt, Pseudomonas aeruginosa PA01
ggcuggccgagcgccgccug

SEQ ID NO: 1401589 - RNA, 22 nt, Pseudomonas aeruginosa PA01
ggcuggccauccgcccugcggg

SEQ ID NO: 1401590 - RNA, 21 nt, Pseudomonas aeruginosa PA01
ggcuggccagcaggcuggcgg

SEQ ID NO: 1401591 - RNA, 23 nt, Pseudomonas aeruginosa PA01
ggcuggccagcaggcuggcggca

SEQ ID NO: 1401592 - RNA, 16 nt, Pseudomonas aeruginosa PA01
ggcuggccagcccugg

SEQ ID NO: 1401593 - RNA, 20 nt, Pseudomonas aeruginosa PA01
ggcuggccagcccugguagg

SEQ ID NO: 1401594 - RNA, 19 nt, Pseudomonas aeruginosa PA01
ggcuggccgagggcgcgca

SEQ ID NO: 1401595 - RNA, 13 nt, Pseudomonas aeruginosa PA01
ggcuggccgccuc

SEQ ID NO: 1401596 - RNA, 20 nt, Pseudomonas aeruginosa PA01
ggcuggccgccucgcgccgc

SEQ ID NO: 1401597 - RNA, 13 nt, Pseudomonas aeruginosa PA01
ggcuggccgcggu

SEQ ID NO: 1401598 - RNA, 15 nt, Pseudomonas aeruginosa PA01
ggcuggccucggcga

SEQ ID NO: 1401599 - RNA, 15 nt, Pseudomonas aeruginosa PA01
ggcuggccucguuga

SEQ ID NO: 1401600 - RNA, 15 nt, Pseudomonas aeruginosa PA01
ggcuggccuuggcca

SEQ ID NO: 1401601 - RNA, 18 nt, Pseudomonas aeruginosa PA01
ggcuggccuuggccaugc

SEQ ID NO: 1401602 - RNA, 13 nt, Pseudomonas aeruginosa PA01
ggcuggccgucga

SEQ ID NO: 1401603 - RNA, 19 nt, Pseudomonas aeruginosa PA01
ggcuggccgucgacccgcc

SEQ ID NO: 1401604 - RNA, 15 nt, Pseudomonas aeruginosa PA01
ggcugggcagcgccg

SEQ ID NO: 1401605 - RNA, 18 nt, Pseudomonas aeruginosa PA01
ggcugggcagcgccgccg

SEQ ID NO: 1401606 - RNA, 15 nt, Pseudomonas aeruginosa PA01
ggcuggcggcucggc

SEQ ID NO: 1401607 - RNA, 14 nt, Pseudomonas aeruginosa PA01
ggcuggcggggucg

SEQ ID NO: 1401608 - RNA, 24 nt, Pseudomonas aeruginosa PA01
ggcuggcgccgcgggucugcucgg

SEQ ID NO: 1401609 - RNA, 16 nt, Pseudomonas aeruginosa PA01
ggcuggcgccggugca

SEQ ID NO: 1401610 - RNA, 14 nt, Pseudomonas aeruginosa PA01
ggcuggcgcaggac

SEQ ID NO: 1401611 - RNA, 16 nt, Pseudomonas aeruginosa PA01
ggcuggcgcaggaccg

SEQ ID NO: 1401612 - RNA, 17 nt, Pseudomonas aeruginosa PA01
ggcuggcgcaggaccgc

SEQ ID NO: 1401613 - RNA, 22 nt, Pseudomonas aeruginosa PA01
ggcuggcggcauaggcccggcg

SEQ ID NO: 1401614 - RNA, 20 nt, Pseudomonas aeruginosa PA01
ggcuggcggcaucggcgccg

SEQ ID NO: 1401615 - RNA, 21 nt, Pseudomonas aeruginosa PA01
ggcuggcggcaucggcgccgc

SEQ ID NO: 1401616 - RNA, 12 nt, Pseudomonas aeruginosa PA01
ggcuggcggcca

SEQ ID NO: 1401617 - RNA, 13 nt, Pseudomonas aeruginosa PA01
ggcuggcggccag

SEQ ID NO: 1401618 - RNA, 19 nt, Pseudomonas aeruginosa PA01
ggcuggcgcuugccgcgcc

SEQ ID NO: 1401619 - RNA, 12 nt, Pseudomonas aeruginosa PA01
ggcuggcgcgau

SEQ ID NO: 1401620 - RNA, 16 nt, Pseudomonas aeruginosa PA01
ggcugcuugccgcuca

SEQ ID NO: 1401621 - RNA, 13 nt, Pseudomonas aeruginosa PA01
ggcugcuugccgg

SEQ ID NO: 1401622 - RNA, 13 nt, Pseudomonas aeruginosa PA01
ggcugcuuggcca

SEQ ID NO: 1401623 - RNA, 15 nt, Pseudomonas aeruginosa PA01
ggcugcuuggccagg

SEQ ID NO: 1401624 - RNA, 21 nt, Pseudomonas aeruginosa PA01
ggcugcuuggccaggucgcgc

SEQ ID NO: 1401625 - RNA, 15 nt, Pseudomonas aeruginosa PA01
ggcugcuucggcagc

SEQ ID NO: 1401626 - RNA, 14 nt, Pseudomonas aeruginosa PA01
ggcugcugcgccug

SEQ ID NO: 1401627 - RNA, 18 nt, Pseudomonas aeruginosa PA01
ggcugcugcgccuggccg

SEQ ID NO: 1401628 - RNA, 16 nt, Pseudomonas aeruginosa PA01
ggcugcugcugcggcg

SEQ ID NO: 1401629 - RNA, 12 nt, Pseudomonas aeruginosa PA01
ggcugcugucga

SEQ ID NO: 1401630 - RNA, 18 nt, Pseudomonas aeruginosa PA01
ggcugcuccggaucgcgc

SEQ ID NO: 1401631 - RNA, 16 nt, Pseudomonas aeruginosa PA01
ggcugcgugccagcac

SEQ ID NO: 1401632 - RNA, 17 nt, Pseudomonas aeruginosa PA01
ggcugcgugccagcacc

SEQ ID NO: 1401633 - RNA, 18 nt, Pseudomonas aeruginosa PA01
ggcugcgugccagcaccu

SEQ ID NO: 1401634 - RNA, 16 nt, Pseudomonas aeruginosa PA01
ggcuggaagccgcgcu

SEQ ID NO: 1401635 - RNA, 15 nt, Pseudomonas aeruginosa PA01
ggcuggaguagcuga

SEQ ID NO: 1401636 - RNA, 20 nt, Pseudomonas aeruginosa PA01
ggcuggcaggugccgcucgu

SEQ ID NO: 1401637 - RNA, 19 nt, Pseudomonas aeruginosa PA01
ggcuggaucgaucucgucg

SEQ ID NO: 1401638 - RNA, 14 nt, Pseudomonas aeruginosa PA01
ggcuggagcgcugc

SEQ ID NO: 1401639 - RNA, 15 nt, Pseudomonas aeruginosa PA01
ggcuggccaccagca

SEQ ID NO: 1401640 - RNA, 17 nt, Pseudomonas aeruginosa PA01
ggcuggccaccagcacc

SEQ ID NO: 1401641 - RNA, 18 nt, Pseudomonas aeruginosa PA01
ggcuggccaccagcaccu

SEQ ID NO: 1401642 - RNA, 17 nt, Pseudomonas aeruginosa PA01
ggcuggccaccgccagg

SEQ ID NO: 1401643 - RNA, 20 nt, Pseudomonas aeruginosa PA01
ggcuggccaccgccaggacc

SEQ ID NO: 1401644 - RNA, 18 nt, Pseudomonas aeruginosa PA01
ggcgccgccuggccggug

SEQ ID NO: 1401645 - RNA, 12 nt, Pseudomonas aeruginosa PA01
ggcgccgcgcca

SEQ ID NO: 1401646 - RNA, 20 nt, Pseudomonas aeruginosa PA01
ggcgccgcgggucugcucgg

SEQ ID NO: 1401647 - RNA, 21 nt, Pseudomonas aeruginosa PA01
ggcgccgcgggucugcucggc

SEQ ID NO: 1401648 - RNA, 13 nt, Pseudomonas aeruginosa PA01
ggcgccgcgccuu

SEQ ID NO: 1401649 - RNA, 20 nt, Pseudomonas aeruginosa PA01
ggcgccgcuagggcgcccuc

SEQ ID NO: 1401650 - RNA, 15 nt, Pseudomonas aeruginosa PA01
ggcgccgcucgaugc

SEQ ID NO: 1401651 - RNA, 19 nt, Pseudomonas aeruginosa PA01
ggcgccgcucgaugcccgc

SEQ ID NO: 1401652 - RNA, 11 nt, Pseudomonas aeruginosa PA01
ggcgccgcugu

SEQ ID NO: 1401653 - RNA, 22 nt, Pseudomonas aeruginosa PA01
ggcgccgcggucgaugucgcgg

SEQ ID NO: 1401654 - RNA, 16 nt, Pseudomonas aeruginosa PA01
ggcgccggccagagcu

SEQ ID NO: 1401655 - RNA, 16 nt, Pseudomonas aeruginosa PA01
ggcgccggcauugccg

SEQ ID NO: 1401656 - RNA, 18 nt, Pseudomonas aeruginosa PA01
ggcgccggcauugccgac

SEQ ID NO: 1401657 - RNA, 21 nt, Pseudomonas aeruginosa PA01
ggcgccggcaggaacgcccgc

SEQ ID NO: 1401658 - RNA, 15 nt, Pseudomonas aeruginosa PA01
ggcgccggcaggccu

SEQ ID NO: 1401659 - RNA, 17 nt, Pseudomonas aeruginosa PA01
ggcgccggcaggccuuc

SEQ ID NO: 1401660 - RNA, 19 nt, Pseudomonas aeruginosa PA01
ggcgccggcagguagaccu

SEQ ID NO: 1401661 - RNA, 20 nt, Pseudomonas aeruginosa PA01
ggcgccggccuccagcgccu

SEQ ID NO: 1401662 - RNA, 13 nt, Pseudomonas aeruginosa PA01
ggcgccggccggg

SEQ ID NO: 1401663 - RNA, 20 nt, Pseudomonas aeruginosa PA01
ggcgccggcgcgcaggguga

SEQ ID NO: 1401664 - RNA, 13 nt, Pseudomonas aeruginosa PA01
ggcgccgggucga

SEQ ID NO: 1401665 - RNA, 21 nt, Pseudomonas aeruginosa PA01
ggcgccggcggaucagcccgc

SEQ ID NO: 1401666 - RNA, 14 nt, Pseudomonas aeruginosa PA01
ggcgccggcucgcc

SEQ ID NO: 1401667 - RNA, 20 nt, Pseudomonas aeruginosa PA01
ggcgccggcugacgcuggcg

SEQ ID NO: 1401668 - RNA, 23 nt, Pseudomonas aeruginosa PA01
ggcgccgggcgcgaugccgaugc

SEQ ID NO: 1401669 - RNA, 15 nt, Pseudomonas aeruginosa PA01
ggcgccgggcugccg

SEQ ID NO: 1401670 - RNA, 18 nt, Pseudomonas aeruginosa PA01
ggcgccgggcugccgaac

SEQ ID NO: 1401671 - RNA, 13 nt, Pseudomonas aeruginosa PA01
ggcgccucgaagc

SEQ ID NO: 1401672 - RNA, 13 nt, Pseudomonas aeruginosa PA01
ggcgccucgauga

SEQ ID NO: 1401673 - RNA, 15 nt, Pseudomonas aeruginosa PA01
ggcgccuccagcggg

SEQ ID NO: 1401674 - RNA, 17 nt, Pseudomonas aeruginosa PA01
ggcgccucccagggucg

SEQ ID NO: 1401675 - RNA, 17 nt, Pseudomonas aeruginosa PA01
ggcgccugagcagcgcu

SEQ ID NO: 1401676 - RNA, 12 nt, Pseudomonas aeruginosa PA01
ggcgccucgccg

SEQ ID NO: 1401677 - RNA, 14 nt, Pseudomonas aeruginosa PA01
ggcgccuggccugg

SEQ ID NO: 1401678 - RNA, 15 nt, Pseudomonas aeruginosa PA01
ggcgccuggccugga

SEQ ID NO: 1401679 - RNA, 12 nt, Pseudomonas aeruginosa PA01
ggcgccuggcgu

SEQ ID NO: 1401680 - RNA, 16 nt, Pseudomonas aeruginosa PA01
ggcgccuggcguagcg

SEQ ID NO: 1401681 - RNA, 16 nt, Pseudomonas aeruginosa PA01
ggcgccuucggcgaca

SEQ ID NO: 1401682 - RNA, 18 nt, Pseudomonas aeruginosa PA01
ggcgccuuccaggcgugc

SEQ ID NO: 1401683 - RNA, 19 nt, Pseudomonas aeruginosa PA01
ggcgccuuccaggcgugcc

SEQ ID NO: 1401684 - RNA, 20 nt, Pseudomonas aeruginosa PA01
ggcgccuuccaggcgugccu

SEQ ID NO: 1401685 - RNA, 22 nt, Pseudomonas aeruginosa PA01
ggcgccuucccagauaccggcg

SEQ ID NO: 1401686 - RNA, 16 nt, Pseudomonas aeruginosa PA01
ggcgccuucagcgccg

SEQ ID NO: 1401687 - RNA, 18 nt, Pseudomonas aeruginosa PA01
ggcgccuucagcgccgcc

SEQ ID NO: 1401688 - RNA, 21 nt, Pseudomonas aeruginosa PA01
ggcgccuucagcgccgccagg

SEQ ID NO: 1401689 - RNA, 16 nt, Pseudomonas aeruginosa PA01
ggcgccggugaggcgc

SEQ ID NO: 1401690 - RNA, 19 nt, Pseudomonas aeruginosa PA01
ggcgccggugcuggcgagc

SEQ ID NO: 1401691 - RNA, 20 nt, Pseudomonas aeruginosa PA01
ggcgccggugcuggcgagca

SEQ ID NO: 1401692 - RNA, 20 nt, Pseudomonas aeruginosa PA01
ggcgccguggaucgcccggc

SEQ ID NO: 1401693 - RNA, 22 nt, Pseudomonas aeruginosa PA01
ggcgccguuguucaggcgcgcg

SEQ ID NO: 1401694 - RNA, 18 nt, Pseudomonas aeruginosa PA01
ggcgccgaacagggcgag

SEQ ID NO: 1401695 - RNA, 20 nt, Pseudomonas aeruginosa PA01
ggcgccgaacagggcgagca

SEQ ID NO: 1401696 - RNA, 22 nt, Pseudomonas aeruginosa PA01
ggcgccgaacagggcgagcagg

SEQ ID NO: 1401697 - RNA, 12 nt, Pseudomonas aeruginosa PA01
ggcgccgaccac

SEQ ID NO: 1401698 - RNA, 18 nt, Pseudomonas aeruginosa PA01
ggcgccgaccacgaccgc

SEQ ID NO: 1401699 - RNA, 12 nt, Pseudomonas aeruginosa PA01
ggcgccgaggcc

SEQ ID NO: 1401700 - RNA, 14 nt, Pseudomonas aeruginosa PA01
ggcgccgaucaggc

SEQ ID NO: 1401701 - RNA, 16 nt, Pseudomonas aeruginosa PA01
ggcgccgaugcccagg

SEQ ID NO: 1401702 - RNA, 15 nt, Pseudomonas aeruginosa PA01
ggcgccgaugccggc

SEQ ID NO: 1401703 - RNA, 20 nt, Pseudomonas aeruginosa PA01
ggcgccgaugccggccggca

SEQ ID NO: 1401704 - RNA, 13 nt, Pseudomonas aeruginosa PA01
ggcgccgccgaac

SEQ ID NO: 1401705 - RNA, 19 nt, Pseudomonas aeruginosa PA01
ggcgccgccgaacaugccg

SEQ ID NO: 1401706 - RNA, 22 nt, Pseudomonas aeruginosa PA01
ggcgccgccagccagagcagcg

SEQ ID NO: 1401707 - RNA, 23 nt, Pseudomonas aeruginosa PA01
ggcgccgaccgcaccgccagcgu

SEQ ID NO: 1401708 - RNA, 19 nt, Pseudomonas aeruginosa PA01
ggcgccgccgacgccaugg

SEQ ID NO: 1401709 - RNA, 18 nt, Pseudomonas aeruginosa PA01
ggcgccgccccguuggcg

SEQ ID NO: 1401710 - RNA, 13 nt, Pseudomonas aeruginosa PA01
ggcgccgccgcug

SEQ ID NO: 1401711 - RNA, 19 nt, Pseudomonas aeruginosa PA01
ggcgccgccgcuggcgagg

SEQ ID NO: 1401712 - RNA, 12 nt, Pseudomonas aeruginosa PA01
ggcgccgccggc

SEQ ID NO: 1401713 - RNA, 22 nt, Pseudomonas aeruginosa PA01
ggcgccgccgagguugcgcagg

SEQ ID NO: 1401714 - RNA, 20 nt, Pseudomonas aeruginosa PA01
ggcgccgccggggaucagcg

SEQ ID NO: 1401715 - RNA, 21 nt, Pseudomonas aeruginosa PA01
ggcgccgccggggaucagcga

SEQ ID NO: 1401716 - RNA, 16 nt, Pseudomonas aeruginosa PA01
ggcgccgccggcgaac

SEQ ID NO: 1401717 - RNA, 18 nt, Pseudomonas aeruginosa PA01
ggcgcccgccuuguucgc

SEQ ID NO: 1401718 - RNA, 22 nt, Pseudomonas aeruginosa PA01
ggcgcccgccuuguucgccagc

SEQ ID NO: 1401719 - RNA, 14 nt, Pseudomonas aeruginosa PA01
ggcgcccgcgggcg

SEQ ID NO: 1401720 - RNA, 13 nt, Pseudomonas aeruginosa PA01
ggcgcccggccgg

SEQ ID NO: 1401721 - RNA, 14 nt, Pseudomonas aeruginosa PA01
ggcgcccggccgga

SEQ ID NO: 1401722 - RNA, 15 nt, Pseudomonas aeruginosa PA01
ggcgcccggucaggu

SEQ ID NO: 1401723 - RNA, 20 nt, Pseudomonas aeruginosa PA01
ggcgcccgguggaggucugc

SEQ ID NO: 1401724 - RNA, 17 nt, Pseudomonas aeruginosa PA01
ggcgcccucgggcgccg

SEQ ID NO: 1401725 - RNA, 18 nt, Pseudomonas aeruginosa PA01
ggcgcccucugccggucg

SEQ ID NO: 1401726 - RNA, 20 nt, Pseudomonas aeruginosa PA01
ggcgcccucugccggucgga

SEQ ID NO: 1401727 - RNA, 16 nt, Pseudomonas aeruginosa PA01
ggcgcccucgccaauc

SEQ ID NO: 1401728 - RNA, 14 nt, Pseudomonas aeruginosa PA01
ggcgcccugcucug

SEQ ID NO: 1401729 - RNA, 21 nt, Pseudomonas aeruginosa PA01
ggcgcccugcucugguucggc

SEQ ID NO: 1401730 - RNA, 15 nt, Pseudomonas aeruginosa PA01
ggcgcccuggccgcc

SEQ ID NO: 1401731 - RNA, 16 nt, Pseudomonas aeruginosa PA01
ggcgcccuggccgucg

SEQ ID NO: 1401732 - RNA, 21 nt, Pseudomonas aeruginosa PA01
ggcgcccuggccgucggccug

SEQ ID NO: 1401733 - RNA, 19 nt, Pseudomonas aeruginosa PA01
ggcgccccaggcgcccagg

SEQ ID NO: 1401734 - RNA, 15 nt, Pseudomonas aeruginosa PA01
ggcgccccaggcggg

SEQ ID NO: 1401735 - RNA, 16 nt, Pseudomonas aeruginosa PA01
ggcgccccaggcgggc

SEQ ID NO: 1401736 - RNA, 15 nt, Pseudomonas aeruginosa PA01
ggcgccccgggucgg

SEQ ID NO: 1401737 - RNA, 16 nt, Pseudomonas aeruginosa PA01
ggcgccccgggucggc

SEQ ID NO: 1401738 - RNA, 17 nt, Pseudomonas aeruginosa PA01
ggcgccccugcggcgcc

SEQ ID NO: 1401739 - RNA, 19 nt, Pseudomonas aeruginosa PA01
ggcgccccugcggcgccgg

SEQ ID NO: 1401740 - RNA, 21 nt, Pseudomonas aeruginosa PA01
ggcgccccugcggcgccgguu

SEQ ID NO: 1401741 - RNA, 21 nt, Pseudomonas aeruginosa PA01
ggcgcccgcccggcaccaccg

SEQ ID NO: 1401742 - RNA, 22 nt, Pseudomonas aeruginosa PA01
ggcgcccgccaaggcccugcug

SEQ ID NO: 1401743 - RNA, 20 nt, Pseudomonas aeruginosa PA01
ggcgcccagggcuucgcggu

SEQ ID NO: 1401744 - RNA, 23 nt, Pseudomonas aeruginosa PA01
ggcgccccagaucgccagcgcca

SEQ ID NO: 1401745 - RNA, 17 nt, Pseudomonas aeruginosa PA01
ggcgauguagcugccgg

SEQ ID NO: 1401746 - RNA, 19 nt, Pseudomonas aeruginosa PA01
ggcgauguagcugccggcg

SEQ ID NO: 1401747 - RNA, 20 nt, Pseudomonas aeruginosa PA01
ggcgauguagcugccggcgu

SEQ ID NO: 1401748 - RNA, 16 nt, Pseudomonas aeruginosa PA01
ggcgauggcguccacc

SEQ ID NO: 1401749 - RNA, 19 nt, Pseudomonas aeruginosa PA01
ggcgauggccuggucggcg

SEQ ID NO: 1401750 - RNA, 23 nt, Pseudomonas aeruginosa PA01
ggcgauggccuggucggcgcggc

SEQ ID NO: 1401751 - RNA, 14 nt, Pseudomonas aeruginosa PA01
ggcgcaacccugcc

SEQ ID NO: 1401752 - RNA, 21 nt, Pseudomonas aeruginosa PA01
ggcgauguaggucaccgcgcc

SEQ ID NO: 1401753 - RNA, 22 nt, Pseudomonas aeruginosa PA01
ggcgauguaggucaccgcgccg

SEQ ID NO: 1401754 - RNA, 22 nt, Pseudomonas aeruginosa PA01
ggcgauguccuggaucggcagc

SEQ ID NO: 1401755 - RNA, 20 nt, Pseudomonas aeruginosa PA01
ggcgauguucaccgcggccu

SEQ ID NO: 1401756 - RNA, 16 nt, Pseudomonas aeruginosa PA01
ggcgaugucgcgggca

SEQ ID NO: 1401757 - RNA, 15 nt, Pseudomonas aeruginosa PA01
ggcgaugucggccug

SEQ ID NO: 1401758 - RNA, 16 nt, Pseudomonas aeruginosa PA01
ggcgauggacucgauc

SEQ ID NO: 1401759 - RNA, 17 nt, Pseudomonas aeruginosa PA01
ggcgauggaugacccgc

SEQ ID NO: 1401760 - RNA, 12 nt, Pseudomonas aeruginosa PA01
ggcgaugcgguc

SEQ ID NO: 1401761 - RNA, 20 nt, Pseudomonas aeruginosa PA01
ggcgaugcguuugucgaccu

SEQ ID NO: 1401762 - RNA, 21 nt, Pseudomonas aeruginosa PA01
ggcgaugcguuugucgaccug

SEQ ID NO: 1401763 - RNA, 13 nt, Pseudomonas aeruginosa PA01
ggcgaugcgcugg

SEQ ID NO: 1401764 - RNA, 14 nt, Pseudomonas aeruginosa PA01
ggcgauggccagcg

SEQ ID NO: 1401765 - RNA, 16 nt, Pseudomonas aeruginosa PA01
ggcgauggccagcgcg

SEQ ID NO: 1401766 - RNA, 13 nt, Pseudomonas aeruginosa PA01
ggcgauggcccag

SEQ ID NO: 1401767 - RNA, 16 nt, Pseudomonas aeruginosa PA01
ggcgaugcucagcgcc

SEQ ID NO: 1401768 - RNA, 17 nt, Pseudomonas aeruginosa PA01
ggcgaugcucagcgccg

SEQ ID NO: 1401769 - RNA, 15 nt, Pseudomonas aeruginosa PA01
ggcgauggccgccag

SEQ ID NO: 1401770 - RNA, 22 nt, Pseudomonas aeruginosa PA01
ggcgauggccgccagcaggccg

SEQ ID NO: 1401771 - RNA, 22 nt, Pseudomonas aeruginosa PA01
ggcgauggccgccugcagggcg

SEQ ID NO: 1401772 - RNA, 12 nt, Pseudomonas aeruginosa PA01
ggcgauggccgc

SEQ ID NO: 1401773 - RNA, 13 nt, Pseudomonas aeruginosa PA01
ggcgauggccgcc

SEQ ID NO: 1401774 - RNA, 15 nt, Pseudomonas aeruginosa PA01
ggcgacaaaucggca

SEQ ID NO: 1401775 - RNA, 13 nt, Pseudomonas aeruginosa PA01
ggcgaugcgccgg

SEQ ID NO: 1401776 - RNA, 20 nt, Pseudomonas aeruginosa PA01
ggcgaugcgccggaucggcu

SEQ ID NO: 1401777 - RNA, 22 nt, Pseudomonas aeruginosa PA01
ggcgaugcgccggaucggcuga

SEQ ID NO: 1401778 - RNA, 23 nt, Pseudomonas aeruginosa PA01
ggcgaugcgccggaucggcugac

SEQ ID NO: 1401779 - RNA, 22 nt, Pseudomonas aeruginosa PA01
ggcgacaaggcugaggccgacg

SEQ ID NO: 1401780 - RNA, 14 nt, Pseudomonas aeruginosa PA01
ggcgaauucgucgc

SEQ ID NO: 1401781 - RNA, 21 nt, Pseudomonas aeruginosa PA01
ggcgaauggagggaucgcgcg

SEQ ID NO: 1401782 - RNA, 22 nt, Pseudomonas aeruginosa PA01
ggcgaauggagggaucgcgcgg

SEQ ID NO: 1401783 - RNA, 23 nt, Pseudomonas aeruginosa PA01
ggcgaauggagggaucgcgcggc

SEQ ID NO: 1401784 - RNA, 13 nt, Pseudomonas aeruginosa PA01
ggcgcacggccug

SEQ ID NO: 1401785 - RNA, 14 nt, Pseudomonas aeruginosa PA01
ggcgcacgccggcc

SEQ ID NO: 1401786 - RNA, 15 nt, Pseudomonas aeruginosa PA01
ggcgcacgccggccu

SEQ ID NO: 1401787 - RNA, 17 nt, Pseudomonas aeruginosa PA01
ggcgcaauugcaccgcu

SEQ ID NO: 1401788 - RNA, 15 nt, Pseudomonas aeruginosa PA01
ggcgcaccuccucgg

SEQ ID NO: 1401789 - RNA, 14 nt, Pseudomonas aeruginosa PA01
ggcgcaacugcgcc

SEQ ID NO: 1401790 - RNA, 16 nt, Pseudomonas aeruginosa PA01
ggcgcaagggcgccgc

SEQ ID NO: 1401791 - RNA, 17 nt, Pseudomonas aeruginosa PA01
ggcgcaaggugccgagg

SEQ ID NO: 1401792 - RNA, 22 nt, Pseudomonas aeruginosa PA01
ggcgcaauacaccgcugcgccg

SEQ ID NO: 1401793 - RNA, 23 nt, Pseudomonas aeruginosa PA01
ggcgcaacaccuugcgcaccgcc

SEQ ID NO: 1401794 - RNA, 13 nt, Pseudomonas aeruginosa PA01
ggcgcaacaggcg

SEQ ID NO: 1401795 - RNA, 16 nt, Pseudomonas aeruginosa PA01
ggcgcaaccugguuca

SEQ ID NO: 1401796 - RNA, 14 nt, Pseudomonas aeruginosa PA01
ggcgcagcgcccga

SEQ ID NO: 1401797 - RNA, 17 nt, Pseudomonas aeruginosa PA01
ggcgcagcccagccgcu

SEQ ID NO: 1401798 - RNA, 19 nt, Pseudomonas aeruginosa PA01
ggcgcagcccagccgcucg

SEQ ID NO: 1401799 - RNA, 21 nt, Pseudomonas aeruginosa PA01
ggcgcagcccagccgcucgcg

SEQ ID NO: 1401800 - RNA, 14 nt, Pseudomonas aeruginosa PA01
ggcgcagccagcac

SEQ ID NO: 1401801 - RNA, 20 nt, Pseudomonas aeruginosa PA01
ggcgcagccgcaaggccagg

SEQ ID NO: 1401802 - RNA, 15 nt, Pseudomonas aeruginosa PA01
ggcgcagccgcugcu

SEQ ID NO: 1401803 - RNA, 12 nt, Pseudomonas aeruginosa PA01
ggcgcagcagga

SEQ ID NO: 1401804 - RNA, 15 nt, Pseudomonas aeruginosa PA01
ggcgcagcaggaucu

SEQ ID NO: 1401805 - RNA, 15 nt, Pseudomonas aeruginosa PA01
ggcgcagaacugccg

SEQ ID NO: 1401806 - RNA, 17 nt, Pseudomonas aeruginosa PA01
ggcgcacuacgccguuc

SEQ ID NO: 1401807 - RNA, 16 nt, Pseudomonas aeruginosa PA01
ggcgcagaucgcggcg

SEQ ID NO: 1401808 - RNA, 17 nt, Pseudomonas aeruginosa PA01
ggcgcagacgaucuccu

SEQ ID NO: 1401809 - RNA, 14 nt, Pseudomonas aeruginosa PA01
ggcgcagacaggcc

SEQ ID NO: 1401810 - RNA, 14 nt, Pseudomonas aeruginosa PA01
ggcgcagcagggcg

SEQ ID NO: 1401811 - RNA, 19 nt, Pseudomonas aeruginosa PA01
ggcgcagcagggcgucggc

SEQ ID NO: 1401812 - RNA, 15 nt, Pseudomonas aeruginosa PA01
ggcgcagcaucaucu

SEQ ID NO: 1401813 - RNA, 12 nt, Pseudomonas aeruginosa PA01
ggcgcagcagca

SEQ ID NO: 1401814 - RNA, 22 nt, Pseudomonas aeruginosa PA01
ggcgcagcagcagguugacccc

SEQ ID NO: 1401815 - RNA, 12 nt, Pseudomonas aeruginosa PA01
ggcgcagcagcg

SEQ ID NO: 1401816 - RNA, 22 nt, Pseudomonas aeruginosa PA01
ggcgcagcagcgacucgcuggg

SEQ ID NO: 1401817 - RNA, 15 nt, Pseudomonas aeruginosa PA01
ggcgcagcagcgcca

SEQ ID NO: 1401818 - RNA, 16 nt, Pseudomonas aeruginosa PA01
ggcgcagcagcgccag

SEQ ID NO: 1401819 - RNA, 18 nt, Pseudomonas aeruginosa PA01
ggcgcagcagcgccaguu

SEQ ID NO: 1401820 - RNA, 15 nt, Pseudomonas aeruginosa PA01
ggcgcagcguccugc

SEQ ID NO: 1401821 - RNA, 19 nt, Pseudomonas aeruginosa PA01
ggcgcagcguccugcccuc

SEQ ID NO: 1401822 - RNA, 13 nt, Pseudomonas aeruginosa PA01
ggcgcagcggcag

SEQ ID NO: 1401823 - RNA, 18 nt, Pseudomonas aeruginosa PA01
ggcgcagcggcagcgcca

SEQ ID NO: 1401824 - RNA, 21 nt, Pseudomonas aeruginosa PA01
ggcgcagcggcagcgccaggu

SEQ ID NO: 1401825 - RNA, 14 nt, Pseudomonas aeruginosa PA01
ggcgcaggaccgcc

SEQ ID NO: 1401826 - RNA, 18 nt, Pseudomonas aeruginosa PA01
ggcgcaggaccgccaugg

SEQ ID NO: 1401827 - RNA, 15 nt, Pseudomonas aeruginosa PA01
ggcgcaggccgaggu

SEQ ID NO: 1401828 - RNA, 15 nt, Pseudomonas aeruginosa PA01
ggcgcaggcauggau

SEQ ID NO: 1401829 - RNA, 13 nt, Pseudomonas aeruginosa PA01
ggcgcaggccuuc

SEQ ID NO: 1401830 - RNA, 15 nt, Pseudomonas aeruginosa PA01
ggcgcaggcgaacug

SEQ ID NO: 1401831 - RNA, 16 nt, Pseudomonas aeruginosa PA01
ggcgcaggcgaacugc

SEQ ID NO: 1401832 - RNA, 20 nt, Pseudomonas aeruginosa PA01
ggcgcaggcgaggauggccg

SEQ ID NO: 1401833 - RNA, 12 nt, Pseudomonas aeruginosa PA01
ggcgcaggcgau

SEQ ID NO: 1401834 - RNA, 20 nt, Pseudomonas aeruginosa PA01
ggcgcaggcgaugaucagcc

SEQ ID NO: 1401835 - RNA, 16 nt, Pseudomonas aeruginosa PA01
ggcgcaguaggccugg

SEQ ID NO: 1401836 - RNA, 18 nt, Pseudomonas aeruginosa PA01
ggcgcaguagucgaccgg

SEQ ID NO: 1401837 - RNA, 20 nt, Pseudomonas aeruginosa PA01
ggcgcaguaacgccugucgc

SEQ ID NO: 1401838 - RNA, 20 nt, Pseudomonas aeruginosa PA01
ggcgcagguugagggccgcg

SEQ ID NO: 1401839 - RNA, 22 nt, Pseudomonas aeruginosa PA01
ggcgcagguugagggccgcgcu

SEQ ID NO: 1401840 - RNA, 17 nt, Pseudomonas aeruginosa PA01
ggcgcaggucgcuggcg

SEQ ID NO: 1401841 - RNA, 23 nt, Pseudomonas aeruginosa PA01
ggcgcaggucgcuggcgucgacc

SEQ ID NO: 1401842 - RNA, 13 nt, Pseudomonas aeruginosa PA01
ggcgcaggggcgc

SEQ ID NO: 1401843 - RNA, 14 nt, Pseudomonas aeruginosa PA01
ggcgcaggggcgcg

SEQ ID NO: 1401844 - RNA, 12 nt, Pseudomonas aeruginosa PA01
ggcgcagguaga

SEQ ID NO: 1401845 - RNA, 18 nt, Pseudomonas aeruginosa PA01
ggcgcagguagucgcuca

SEQ ID NO: 1401846 - RNA, 15 nt, Pseudomonas aeruginosa PA01
ggcgcaggcugucgg

SEQ ID NO: 1401847 - RNA, 19 nt, Pseudomonas aeruginosa PA01
ggcgcaggcugucggccag

SEQ ID NO: 1401848 - RNA, 16 nt, Pseudomonas aeruginosa PA01
ggcgcaggcggaucgc

SEQ ID NO: 1401849 - RNA, 16 nt, Pseudomonas aeruginosa PA01
ggcgcauagccaccgc

SEQ ID NO: 1401850 - RNA, 20 nt, Pseudomonas aeruginosa PA01
ggcgcauagccaccgccgac

SEQ ID NO: 1401851 - RNA, 16 nt, Pseudomonas aeruginosa PA01
ggcgcauagcggccau

SEQ ID NO: 1401852 - RNA, 18 nt, Pseudomonas aeruginosa PA01
ggcgcauaaccgcuugcg

SEQ ID NO: 1401853 - RNA, 23 nt, Pseudomonas aeruginosa PA01
ggcgcauaacgccccucuuccac

SEQ ID NO: 1401854 - RNA, 23 nt, Pseudomonas aeruginosa PA01
ggcgcauauccaccaugaaacag

SEQ ID NO: 1401855 - RNA, 15 nt, Pseudomonas aeruginosa PA01
ggcgcaguucgucga

SEQ ID NO: 1401856 - RNA, 15 nt, Pseudomonas aeruginosa PA01
ggcgcaguucaucga

SEQ ID NO: 1401857 - RNA, 23 nt, Pseudomonas aeruginosa PA01
ggcgcauggacaggucgacggcc

SEQ ID NO: 1401858 - RNA, 17 nt, Pseudomonas aeruginosa PA01
ggcgcauguccagccag

SEQ ID NO: 1401859 - RNA, 14 nt, Pseudomonas aeruginosa PA01
ggcgcaugcccagg

SEQ ID NO: 1401860 - RNA, 15 nt, Pseudomonas aeruginosa PA01
ggcgcaugcccaggg

SEQ ID NO: 1401861 - RNA, 18 nt, Pseudomonas aeruginosa PA01
ggcgcaugcccagggcca

SEQ ID NO: 1401862 - RNA, 15 nt, Pseudomonas aeruginosa PA01
ggcgcaugccgcagg

SEQ ID NO: 1401863 - RNA, 14 nt, Pseudomonas aeruginosa PA01
ggcgcaugcgccgg

SEQ ID NO: 1401864 - RNA, 11 nt, Pseudomonas aeruginosa PA01
ggcgccaacca

SEQ ID NO: 1401865 - RNA, 12 nt, Pseudomonas aeruginosa PA01
ggcgcaucagcg

SEQ ID NO: 1401866 - RNA, 12 nt, Pseudomonas aeruginosa PA01
ggcgcaucaggc

SEQ ID NO: 1401867 - RNA, 16 nt, Pseudomonas aeruginosa PA01
ggcgcaucaggccaaa

SEQ ID NO: 1401868 - RNA, 19 nt, Pseudomonas aeruginosa PA01
ggcgcauccgcccgaucgc

SEQ ID NO: 1401869 - RNA, 20 nt, Pseudomonas aeruginosa PA01
ggcgcauccgcccgaucgcc

SEQ ID NO: 1401870 - RNA, 18 nt, Pseudomonas aeruginosa PA01
ggcgccaacucggccugg

SEQ ID NO: 1401871 - RNA, 21 nt, Pseudomonas aeruginosa PA01
ggcgccaacugcuugccgagc

SEQ ID NO: 1401872 - RNA, 19 nt, Pseudomonas aeruginosa PA01
ggcgccaccgauagcggcg

SEQ ID NO: 1401873 - RNA, 19 nt, Pseudomonas aeruginosa PA01
ggcgccaccgauucgccgg

SEQ ID NO: 1401874 - RNA, 15 nt, Pseudomonas aeruginosa PA01
ggcgccagagcgcgc

SEQ ID NO: 1401875 - RNA, 12 nt, Pseudomonas aeruginosa PA01
ggcgccagcagg

SEQ ID NO: 1401876 - RNA, 15 nt, Pseudomonas aeruginosa PA01
ggcgccagccgccau

SEQ ID NO: 1401877 - RNA, 21 nt, Pseudomonas aeruginosa PA01
ggcgccagccgccaucaccag

SEQ ID NO: 1401878 - RNA, 18 nt, Pseudomonas aeruginosa PA01
ggcgccagccagcccggc

SEQ ID NO: 1401879 - RNA, 19 nt, Pseudomonas aeruginosa PA01
ggcgccagccagcccggcg

SEQ ID NO: 1401880 - RNA, 14 nt, Pseudomonas aeruginosa PA01
ggcgccagcgcccc

SEQ ID NO: 1401881 - RNA, 20 nt, Pseudomonas aeruginosa PA01
ggcgccagcgccccaccagg

SEQ ID NO: 1401882 - RNA, 18 nt, Pseudomonas aeruginosa PA01
ggcgccaggccggagccg

SEQ ID NO: 1401883 - RNA, 21 nt, Pseudomonas aeruginosa PA01
ggcgccagggacgcgcagcgg

SEQ ID NO: 1401884 - RNA, 23 nt, Pseudomonas aeruginosa PA01
ggcgccagggacgcgcagcggcg

SEQ ID NO: 1401885 - RNA, 13 nt, Pseudomonas aeruginosa PA01
ggcgccagggccg

SEQ ID NO: 1401886 - RNA, 20 nt, Pseudomonas aeruginosa PA01
ggcgccaggggugccuugcc

SEQ ID NO: 1401887 - RNA, 19 nt, Pseudomonas aeruginosa PA01
ggcgccagguagugccgcc

SEQ ID NO: 1401888 - RNA, 15 nt, Pseudomonas aeruginosa PA01
ggcgccagcuccagc

SEQ ID NO: 1401889 - RNA, 18 nt, Pseudomonas aeruginosa PA01
ggcgccagcuccagcgcc

SEQ ID NO: 1401890 - RNA, 21 nt, Pseudomonas aeruginosa PA01
ggcgccaggacucgccaucgg

SEQ ID NO: 1401891 - RNA, 22 nt, Pseudomonas aeruginosa PA01
ggcgccaggcccucggcgacca

SEQ ID NO: 1401892 - RNA, 14 nt, Pseudomonas aeruginosa PA01
ggcgccaggccgcg

SEQ ID NO: 1401893 - RNA, 17 nt, Pseudomonas aeruginosa PA01
ggcgccaggccgcgucg

SEQ ID NO: 1401894 - RNA, 23 nt, Pseudomonas aeruginosa PA01
ggcgccagucauugcgcuccgac

SEQ ID NO: 1401895 - RNA, 15 nt, Pseudomonas aeruginosa PA01
ggcgccaguucgccg

SEQ ID NO: 1401896 - RNA, 18 nt, Pseudomonas aeruginosa PA01
ggcgccaguucgccggug

SEQ ID NO: 1401897 - RNA, 16 nt, Pseudomonas aeruginosa PA01
ggcgccauaggccagc

SEQ ID NO: 1401898 - RNA, 20 nt, Pseudomonas aeruginosa PA01
ggcgccauagggcacccggu

SEQ ID NO: 1401899 - RNA, 19 nt, Pseudomonas aeruginosa PA01
ggcgccauccuccagcgcc

SEQ ID NO: 1401900 - RNA, 20 nt, Pseudomonas aeruginosa PA01
ggcgccauccuccagcgccg

SEQ ID NO: 1401901 - RNA, 21 nt, Pseudomonas aeruginosa PA01
ggcgccauccuccagcgccgc

SEQ ID NO: 1401902 - RNA, 20 nt, Pseudomonas aeruginosa PA01
ggcgccaucgaucagcagcg

SEQ ID NO: 1401903 - RNA, 23 nt, Pseudomonas aeruginosa PA01
ggcgccaucgaucagcagcgcca

SEQ ID NO: 1401904 - RNA, 22 nt, Pseudomonas aeruginosa PA01
ggcgcccacaaccugccgaucg

SEQ ID NO: 1401905 - RNA, 20 nt, Pseudomonas aeruginosa PA01
ggcgccauugugcgcgcgca

SEQ ID NO: 1401906 - RNA, 19 nt, Pseudomonas aeruginosa PA01
ggcgcccaaugcaucggcc

SEQ ID NO: 1401907 - RNA, 20 nt, Pseudomonas aeruginosa PA01
ggcgcccaaugcaucggccg

SEQ ID NO: 1401908 - RNA, 22 nt, Pseudomonas aeruginosa PA01
ggcgcccaaugcaucggccggg

SEQ ID NO: 1401909 - RNA, 23 nt, Pseudomonas aeruginosa PA01
ggcgcccaaugcaucggccggga

SEQ ID NO: 1401910 - RNA, 13 nt, Pseudomonas aeruginosa PA01
ggcgcccagccag

SEQ ID NO: 1401911 - RNA, 22 nt, Pseudomonas aeruginosa PA01
ggcgccaucgcuuuccuggccg

SEQ ID NO: 1401912 - RNA, 23 nt, Pseudomonas aeruginosa PA01
ggcgccaucgcuuuccuggccga

SEQ ID NO: 1401913 - RNA, 14 nt, Pseudomonas aeruginosa PA01
ggcgggccagcagg

SEQ ID NO: 1401914 - RNA, 15 nt, Pseudomonas aeruginosa PA01
ggcgggccagcaggc

SEQ ID NO: 1401915 - RNA, 18 nt, Pseudomonas aeruginosa PA01
ggcgggccagcaggcgcu

SEQ ID NO: 1401916 - RNA, 20 nt, Pseudomonas aeruginosa PA01
ggcgggccagcaggcgcucg

SEQ ID NO: 1401917 - RNA, 22 nt, Pseudomonas aeruginosa PA01
ggcgggccagcaggguggccag

SEQ ID NO: 1401918 - RNA, 22 nt, Pseudomonas aeruginosa PA01
ggcgggccgcucgcgcggcacc

SEQ ID NO: 1401919 - RNA, 17 nt, Pseudomonas aeruginosa PA01
ggcgggccaugcgcucg

SEQ ID NO: 1401920 - RNA, 15 nt, Pseudomonas aeruginosa PA01
ggcgggccauugcag

SEQ ID NO: 1401921 - RNA, 16 nt, Pseudomonas aeruginosa PA01
ggcgggccagcuggcg

SEQ ID NO: 1401922 - RNA, 15 nt, Pseudomonas aeruginosa PA01
ggcgggccggcgucc

SEQ ID NO: 1401923 - RNA, 16 nt, Pseudomonas aeruginosa PA01
ggcgggccggcgucca

SEQ ID NO: 1401924 - RNA, 21 nt, Pseudomonas aeruginosa PA01
ggcggggccaucagugccugc

SEQ ID NO: 1401925 - RNA, 16 nt, Pseudomonas aeruginosa PA01
ggcgggcgaccggaug

SEQ ID NO: 1401926 - RNA, 22 nt, Pseudomonas aeruginosa PA01
ggcgggguauuaccccgcccac

SEQ ID NO: 1401927 - RNA, 18 nt, Pseudomonas aeruginosa PA01
ggcggcuggccgaggacc

SEQ ID NO: 1401928 - RNA, 16 nt, Pseudomonas aeruginosa PA01
ggcggcugggcugcgg

SEQ ID NO: 1401929 - RNA, 18 nt, Pseudomonas aeruginosa PA01
ggcggcugcugcgccugg

SEQ ID NO: 1401930 - RNA, 16 nt, Pseudomonas aeruginosa PA01
ggcggcuggcgcgauc

SEQ ID NO: 1401931 - RNA, 14 nt, Pseudomonas aeruginosa PA01
ggcggcuggcgugg

SEQ ID NO: 1401932 - RNA, 15 nt, Pseudomonas aeruginosa PA01
ggcggcuguugccgu

SEQ ID NO: 1401933 - RNA, 17 nt, Pseudomonas aeruginosa PA01
ggcggcuucagccagac

SEQ ID NO: 1401934 - RNA, 22 nt, Pseudomonas aeruginosa PA01
ggcggcuucagccagaccggca

SEQ ID NO: 1401935 - RNA, 21 nt, Pseudomonas aeruginosa PA01
ggcggcuguagcggaucaggc

SEQ ID NO: 1401936 - RNA, 13 nt, Pseudomonas aeruginosa PA01
ggcggcuucgcgc

SEQ ID NO: 1401937 - RNA, 20 nt, Pseudomonas aeruginosa PA01
ggcggcuuccuccaucgccu

SEQ ID NO: 1401938 - RNA, 18 nt, Pseudomonas aeruginosa PA01
ggcggcgcucagucgagc

SEQ ID NO: 1401939 - RNA, 21 nt, Pseudomonas aeruginosa PA01
ggcggcgcuauccgccgcuac

SEQ ID NO: 1401940 - RNA, 11 nt, Pseudomonas aeruginosa PA01
ggcggcgcuca

SEQ ID NO: 1401941 - RNA, 22 nt, Pseudomonas aeruginosa PA01
ggcggcgcuguuugcggcgcag

SEQ ID NO: 1401942 - RNA, 19 nt, Pseudomonas aeruginosa PA01
ggcggcucuuuccggguca

SEQ ID NO: 1401943 - RNA, 13 nt, Pseudomonas aeruginosa PA01
ggcggcggaagaa

SEQ ID NO: 1401944 - RNA, 14 nt, Pseudomonas aeruginosa PA01
ggcggcggacgcag

SEQ ID NO: 1401945 - RNA, 13 nt, Pseudomonas aeruginosa PA01
ggcggcggagucg

SEQ ID NO: 1401946 - RNA, 15 nt, Pseudomonas aeruginosa PA01
ggcggcggauaaccg

SEQ ID NO: 1401947 - RNA, 20 nt, Pseudomonas aeruginosa PA01
ggcggcggauaaccgcgagc

SEQ ID NO: 1401948 - RNA, 17 nt, Pseudomonas aeruginosa PA01
ggcggcggauaacgccu

SEQ ID NO: 1401949 - RNA, 14 nt, Pseudomonas aeruginosa PA01
ggcggucaggccaa

SEQ ID NO: 1401950 - RNA, 16 nt, Pseudomonas aeruginosa PA01
ggcggucaggccaagc

SEQ ID NO: 1401951 - RNA, 18 nt, Pseudomonas aeruginosa PA01
ggcggucagcaguugccg

SEQ ID NO: 1401952 - RNA, 18 nt, Pseudomonas aeruginosa PA01
ggcggucccagaccagca

SEQ ID NO: 1401953 - RNA, 20 nt, Pseudomonas aeruginosa PA01
ggcggucccagaccagcagc

SEQ ID NO: 1401954 - RNA, 14 nt, Pseudomonas aeruginosa PA01
ggcgguccagguca

SEQ ID NO: 1401955 - RNA, 17 nt, Pseudomonas aeruginosa PA01
ggcggucaggcucagcu

SEQ ID NO: 1401956 - RNA, 23 nt, Pseudomonas aeruginosa PA01
ggcggucaggcucagcucggcga

SEQ ID NO: 1401957 - RNA, 15 nt, Pseudomonas aeruginosa PA01
ggcggucagcgacug

SEQ ID NO: 1401958 - RNA, 18 nt, Pseudomonas aeruginosa PA01
ggcggucaucgcgccgcc

SEQ ID NO: 1401959 - RNA, 23 nt, Pseudomonas aeruginosa PA01
ggcgguaguaggguucgccgacg

SEQ ID NO: 1401960 - RNA, 19 nt, Pseudomonas aeruginosa PA01
ggcgguacgcccuccagca

SEQ ID NO: 1401961 - RNA, 16 nt, Pseudomonas aeruginosa PA01
ggcgguacgccgcgcu

SEQ ID NO: 1401962 - RNA, 22 nt, Pseudomonas aeruginosa PA01
ggcgguacgccgcgcugcgcca

SEQ ID NO: 1401963 - RNA, 21 nt, Pseudomonas aeruginosa PA01
ggcgguagccgaggcggccga

SEQ ID NO: 1401964 - RNA, 14 nt, Pseudomonas aeruginosa PA01
ggcgguagcgccgc

SEQ ID NO: 1401965 - RNA, 21 nt, Pseudomonas aeruginosa PA01
ggcgguagcgggccagcagcu

SEQ ID NO: 1401966 - RNA, 19 nt, Pseudomonas aeruginosa PA01
ggcgguagcuccaggccga

SEQ ID NO: 1401967 - RNA, 23 nt, Pseudomonas aeruginosa PA01
ggcgguagcuccaggccgaagaa

SEQ ID NO: 1401968 - RNA, 20 nt, Pseudomonas aeruginosa PA01
ggcgguaggugagcgacccg

SEQ ID NO: 1401969 - RNA, 23 nt, Pseudomonas aeruginosa PA01
ggcgggugaacucaugcaggccg

SEQ ID NO: 1401970 - RNA, 16 nt, Pseudomonas aeruginosa PA01
ggcgggugauacggcu

SEQ ID NO: 1401971 - RNA, 12 nt, Pseudomonas aeruginosa PA01
ggcgggugaucu

SEQ ID NO: 1401972 - RNA, 13 nt, Pseudomonas aeruginosa PA01
ggcgggucggcgg

SEQ ID NO: 1401973 - RNA, 21 nt, Pseudomonas aeruginosa PA01
ggcgggccuggugagcggaac

SEQ ID NO: 1401974 - RNA, 21 nt, Pseudomonas aeruginosa PA01
ggcggguaaagcgcccgcgca

SEQ ID NO: 1401975 - RNA, 21 nt, Pseudomonas aeruginosa PA01
ggcggguaguguuugcgcagg

SEQ ID NO: 1401976 - RNA, 16 nt, Pseudomonas aeruginosa PA01
ggcggguauccgccgg

SEQ ID NO: 1401977 - RNA, 21 nt, Pseudomonas aeruginosa PA01
ggcggguauccgccgggccgc

SEQ ID NO: 1401978 - RNA, 15 nt, Pseudomonas aeruginosa PA01
ggcgguacaccgcca

SEQ ID NO: 1401979 - RNA, 17 nt, Pseudomonas aeruginosa PA01
ggcgguacagcccccag

SEQ ID NO: 1401980 - RNA, 15 nt, Pseudomonas aeruginosa PA01
ggcgguacaggcgca

SEQ ID NO: 1401981 - RNA, 16 nt, Pseudomonas aeruginosa PA01
ggcgguacaggcgcac

SEQ ID NO: 1401982 - RNA, 14 nt, Pseudomonas aeruginosa PA01
ggcggguucggcgu

SEQ ID NO: 1401983 - RNA, 22 nt, Pseudomonas aeruginosa PA01
ggcgggugcguggugcauccgc

SEQ ID NO: 1401984 - RNA, 14 nt, Pseudomonas aeruginosa PA01
ggcggccaucaggc

SEQ ID NO: 1401985 - RNA, 17 nt, Pseudomonas aeruginosa PA01
ggcggccaucaggcgcu

SEQ ID NO: 1401986 - RNA, 16 nt, Pseudomonas aeruginosa PA01
ggcggccauugccgcg

SEQ ID NO: 1401987 - RNA, 18 nt, Pseudomonas aeruginosa PA01
ggcggccauugccgcggg

SEQ ID NO: 1401988 - RNA, 19 nt, Pseudomonas aeruginosa PA01
ggcggcccaugcggaucgc

SEQ ID NO: 1401989 - RNA, 22 nt, Pseudomonas aeruginosa PA01
ggcggcccaugcggaucgccuc

SEQ ID NO: 1401990 - RNA, 12 nt, Pseudomonas aeruginosa PA01
ggcggccgccuc

SEQ ID NO: 1401991 - RNA, 15 nt, Pseudomonas aeruginosa PA01
ggcggccgcuggcga

SEQ ID NO: 1401992 - RNA, 19 nt, Pseudomonas aeruginosa PA01
ggcggccccuucagcucca

SEQ ID NO: 1401993 - RNA, 19 nt, Pseudomonas aeruginosa PA01
ggcggccgccuugaccugc

SEQ ID NO: 1401994 - RNA, 14 nt, Pseudomonas aeruginosa PA01
ggcggccggauggc

SEQ ID NO: 1401995 - RNA, 16 nt, Pseudomonas aeruginosa PA01
ggcggccggauggccg

SEQ ID NO: 1401996 - RNA, 19 nt, Pseudomonas aeruginosa PA01
ggcggauguaguccagcgc

SEQ ID NO: 1401997 - RNA, 20 nt, Pseudomonas aeruginosa PA01
ggcggauguaguccagcgcc

SEQ ID NO: 1401998 - RNA, 21 nt, Pseudomonas aeruginosa PA01
ggcggauguaguccagcgccg

SEQ ID NO: 1401999 - RNA, 19 nt, Pseudomonas aeruginosa PA01
ggcggaugagccgcugguc

SEQ ID NO: 1402000 - RNA, 13 nt, Pseudomonas aeruginosa PA01
ggcggaucgccgc

SEQ ID NO: 1402001 - RNA, 19 nt, Pseudomonas aeruginosa PA01
ggcggaucagcccgcugac

SEQ ID NO: 1402002 - RNA, 14 nt, Pseudomonas aeruginosa PA01
ggcggaucagcucg

SEQ ID NO: 1402003 - RNA, 20 nt, Pseudomonas aeruginosa PA01
ggcggaucagcucgaucagc

SEQ ID NO: 1402004 - RNA, 22 nt, Pseudomonas aeruginosa PA01
ggcggaucagcucgaucagccc

SEQ ID NO: 1402005 - RNA, 15 nt, Pseudomonas aeruginosa PA01
ggcggaucugcucga

SEQ ID NO: 1402006 - RNA, 18 nt, Pseudomonas aeruginosa PA01
ggcggaucugcucgacgu

SEQ ID NO: 1402007 - RNA, 21 nt, Pseudomonas aeruginosa PA01
ggcggauugacgauggccagc

SEQ ID NO: 1402008 - RNA, 15 nt, Pseudomonas aeruginosa PA01
ggcggauugccagca

SEQ ID NO: 1402009 - RNA, 20 nt, Pseudomonas aeruginosa PA01
ggcggauuuccugcggcacg

SEQ ID NO: 1402010 - RNA, 16 nt, Pseudomonas aeruginosa PA01
ggcggauuugccgccg

SEQ ID NO: 1402011 - RNA, 19 nt, Pseudomonas aeruginosa PA01
ggcggauuugccgccgagg

SEQ ID NO: 1402012 - RNA, 14 nt, Pseudomonas aeruginosa PA01
ggcggcgagcgccg

SEQ ID NO: 1402013 - RNA, 18 nt, Pseudomonas aeruginosa PA01
ggcggcgagcgccgcggc

SEQ ID NO: 1402014 - RNA, 23 nt, Pseudomonas aeruginosa PA01
ggcggcgagcguucggaucggcc

SEQ ID NO: 1402015 - RNA, 16 nt, Pseudomonas aeruginosa PA01
ggcggcgaggccgacc

SEQ ID NO: 1402016 - RNA, 18 nt, Pseudomonas aeruginosa PA01
ggcggcgagcuggaucgg

SEQ ID NO: 1402017 - RNA, 12 nt, Pseudomonas aeruginosa PA01
ggcggcgaucgc

SEQ ID NO: 1402018 - RNA, 14 nt, Pseudomonas aeruginosa PA01
ggcggcgcgcagcg

SEQ ID NO: 1402019 - RNA, 15 nt, Pseudomonas aeruginosa PA01
ggcggcgauggacuc

SEQ ID NO: 1402020 - RNA, 13 nt, Pseudomonas aeruginosa PA01
ggcggcgaugacc

SEQ ID NO: 1402021 - RNA, 14 nt, Pseudomonas aeruginosa PA01
ggcggcgcgcugcg

SEQ ID NO: 1402022 - RNA, 14 nt, Pseudomonas aeruginosa PA01
ggcggcgcggcgca

SEQ ID NO: 1402023 - RNA, 13 nt, Pseudomonas aeruginosa PA01
ggcggcgcggcgg

SEQ ID NO: 1402024 - RNA, 16 nt, Pseudomonas aeruginosa PA01
ggcggcgcggcguacu

SEQ ID NO: 1402025 - RNA, 15 nt, Pseudomonas aeruginosa PA01
ggcggcgcggcgugg

SEQ ID NO: 1402026 - RNA, 16 nt, Pseudomonas aeruginosa PA01
ggcggcgcgggcgcgc

SEQ ID NO: 1402027 - RNA, 20 nt, Pseudomonas aeruginosa PA01
ggcggcgcgggucugcucgc

SEQ ID NO: 1402028 - RNA, 13 nt, Pseudomonas aeruginosa PA01
ggcggcgcgggcg

SEQ ID NO: 1402029 - RNA, 20 nt, Pseudomonas aeruginosa PA01
ggcggccucggccucgucga

SEQ ID NO: 1402030 - RNA, 18 nt, Pseudomonas aeruginosa PA01
ggcggccugagccggccg

SEQ ID NO: 1402031 - RNA, 17 nt, Pseudomonas aeruginosa PA01
ggcggccugcucgcgca

SEQ ID NO: 1402032 - RNA, 22 nt, Pseudomonas aeruginosa PA01
ggcggccugcucgcgcagccag

SEQ ID NO: 1402033 - RNA, 23 nt, Pseudomonas aeruginosa PA01
ggcggccugcucgcgcagccagg

SEQ ID NO: 1402034 - RNA, 15 nt, Pseudomonas aeruginosa PA01
ggcggccucaggccu

SEQ ID NO: 1402035 - RNA, 17 nt, Pseudomonas aeruginosa PA01
ggcggccucaggccugg

SEQ ID NO: 1402036 - RNA, 21 nt, Pseudomonas aeruginosa PA01
ggcggccucaggccuggcgca

SEQ ID NO: 1402037 - RNA, 14 nt, Pseudomonas aeruginosa PA01
ggcggccucgcggg

SEQ ID NO: 1402038 - RNA, 18 nt, Pseudomonas aeruginosa PA01
ggcggccucgaggucggc

SEQ ID NO: 1402039 - RNA, 16 nt, Pseudomonas aeruginosa PA01
ggcggccucgauggcg

SEQ ID NO: 1402040 - RNA, 15 nt, Pseudomonas aeruginosa PA01
ggcggccggccaggu

SEQ ID NO: 1402041 - RNA, 20 nt, Pseudomonas aeruginosa PA01
ggcggccggugccuucggcg

SEQ ID NO: 1402042 - RNA, 17 nt, Pseudomonas aeruginosa PA01
ggcggccguagccgucg

SEQ ID NO: 1402043 - RNA, 13 nt, Pseudomonas aeruginosa PA01
ggcggccguccuc

SEQ ID NO: 1402044 - RNA, 17 nt, Pseudomonas aeruginosa PA01
ggcggccgucgcuggcu

SEQ ID NO: 1402045 - RNA, 17 nt, Pseudomonas aeruginosa PA01
ggcggccgucggccugg

SEQ ID NO: 1402046 - RNA, 16 nt, Pseudomonas aeruginosa PA01
ggcgcuccaacagcag

SEQ ID NO: 1402047 - RNA, 17 nt, Pseudomonas aeruginosa PA01
ggcgcuccaacagcagg

SEQ ID NO: 1402048 - RNA, 13 nt, Pseudomonas aeruginosa PA01
ggcgcuccacagc

SEQ ID NO: 1402049 - RNA, 17 nt, Pseudomonas aeruginosa PA01
ggcgcuccacagcugcc

SEQ ID NO: 1402050 - RNA, 13 nt, Pseudomonas aeruginosa PA01
ggcgcuccaccag

SEQ ID NO: 1402051 - RNA, 19 nt, Pseudomonas aeruginosa PA01
ggcgcuccaccagggccuc

SEQ ID NO: 1402052 - RNA, 13 nt, Pseudomonas aeruginosa PA01
ggcgcuccaccgc

SEQ ID NO: 1402053 - RNA, 21 nt, Pseudomonas aeruginosa PA01
ggcgcuccgggcuccaccagu

SEQ ID NO: 1402054 - RNA, 15 nt, Pseudomonas aeruginosa PA01
ggcgcuccuccagcg

SEQ ID NO: 1402055 - RNA, 16 nt, Pseudomonas aeruginosa PA01
ggcgcuccuccagcgc

SEQ ID NO: 1402056 - RNA, 18 nt, Pseudomonas aeruginosa PA01
ggcgcuccuccagcgccg

SEQ ID NO: 1402057 - RNA, 19 nt, Pseudomonas aeruginosa PA01
ggcgcuccuccagcgccgc

SEQ ID NO: 1402058 - RNA, 23 nt, Pseudomonas aeruginosa PA01
ggcgcuccuccagcgccgccagg

SEQ ID NO: 1402059 - RNA, 14 nt, Pseudomonas aeruginosa PA01
ggcgcucacccaca

SEQ ID NO: 1402060 - RNA, 15 nt, Pseudomonas aeruginosa PA01
ggcgcucaccgaggc

SEQ ID NO: 1402061 - RNA, 17 nt, Pseudomonas aeruginosa PA01
ggcgcucaccgaggcga

SEQ ID NO: 1402062 - RNA, 17 nt, Pseudomonas aeruginosa PA01
ggcgcgucggugccgcc

SEQ ID NO: 1402063 - RNA, 15 nt, Pseudomonas aeruginosa PA01
ggcgcgucgaccacg

SEQ ID NO: 1402064 - RNA, 19 nt, Pseudomonas aeruginosa PA01
ggcgcgucggcggugucgg

SEQ ID NO: 1402065 - RNA, 12 nt, Pseudomonas aeruginosa PA01
ggcgcgucucca

SEQ ID NO: 1402066 - RNA, 17 nt, Pseudomonas aeruginosa PA01
ggcgcgucuccaugcgg

SEQ ID NO: 1402067 - RNA, 18 nt, Pseudomonas aeruginosa PA01
ggcgcugcgcggccugcg

SEQ ID NO: 1402068 - RNA, 18 nt, Pseudomonas aeruginosa PA01
ggcgcugcgcggcgucgg

SEQ ID NO: 1402069 - RNA, 16 nt, Pseudomonas aeruginosa PA01
ggcgcuccuggugcgg

SEQ ID NO: 1402070 - RNA, 19 nt, Pseudomonas aeruginosa PA01
ggcgcuccuggugcggcac

SEQ ID NO: 1402071 - RNA, 17 nt, Pseudomonas aeruginosa PA01
ggcgcugcucgauggcc

SEQ ID NO: 1402072 - RNA, 19 nt, Pseudomonas aeruginosa PA01
ggcgcugcgguaccagcgc

SEQ ID NO: 1402073 - RNA, 13 nt, Pseudomonas aeruginosa PA01
ggcgcuggccgaa

SEQ ID NO: 1402074 - RNA, 16 nt, Pseudomonas aeruginosa PA01
ggcgcuggccagcgcu

SEQ ID NO: 1402075 - RNA, 18 nt, Pseudomonas aeruginosa PA01
ggcgcugcuucuugucga

SEQ ID NO: 1402076 - RNA, 15 nt, Pseudomonas aeruginosa PA01
ggcgcuggaacagcg

SEQ ID NO: 1402077 - RNA, 14 nt, Pseudomonas aeruginosa PA01
ggcgcugcuggugg

SEQ ID NO: 1402078 - RNA, 20 nt, Pseudomonas aeruginosa PA01
ggcgcugcugguggacgucg

SEQ ID NO: 1402079 - RNA, 15 nt, Pseudomonas aeruginosa PA01
ggcgcuggccgcgcg

SEQ ID NO: 1402080 - RNA, 17 nt, Pseudomonas aeruginosa PA01
ggcgcuggccgcgcgac

SEQ ID NO: 1402081 - RNA, 18 nt, Pseudomonas aeruginosa PA01
ggcgcuggccgcgcgacc

SEQ ID NO: 1402082 - RNA, 21 nt, Pseudomonas aeruginosa PA01
ggcgcuggccgcgcgaccgcg

SEQ ID NO: 1402083 - RNA, 13 nt, Pseudomonas aeruginosa PA01
ggcgcuggccgcg

SEQ ID NO: 1402084 - RNA, 13 nt, Pseudomonas aeruginosa PA01
ggcgcuugccgcg

SEQ ID NO: 1402085 - RNA, 14 nt, Pseudomonas aeruginosa PA01
ggcgcuugccgcgc

SEQ ID NO: 1402086 - RNA, 20 nt, Pseudomonas aeruginosa PA01
ggcgcuugccgcgcccggcc

SEQ ID NO: 1402087 - RNA, 21 nt, Pseudomonas aeruginosa PA01
ggcgcuugccgcgcccggcca

SEQ ID NO: 1402088 - RNA, 15 nt, Pseudomonas aeruginosa PA01
ggcgcuucgcgcagg

SEQ ID NO: 1402089 - RNA, 16 nt, Pseudomonas aeruginosa PA01
ggcgcuucggcggaua

SEQ ID NO: 1402090 - RNA, 21 nt, Pseudomonas aeruginosa PA01
ggcgcuucugcgagccgcgcg

SEQ ID NO: 1402091 - RNA, 18 nt, Pseudomonas aeruginosa PA01
ggcgcuguuugcggcgca

SEQ ID NO: 1402092 - RNA, 18 nt, Pseudomonas aeruginosa PA01
ggcgcuucaucuccugcu

SEQ ID NO: 1402093 - RNA, 21 nt, Pseudomonas aeruginosa PA01
ggcgcuucaacugcuucaggu

SEQ ID NO: 1402094 - RNA, 13 nt, Pseudomonas aeruginosa PA01
ggcgcuucagcgc

SEQ ID NO: 1402095 - RNA, 22 nt, Pseudomonas aeruginosa PA01
ggcgcuucagcgccucgaccug

SEQ ID NO: 1402096 - RNA, 16 nt, Pseudomonas aeruginosa PA01
ggcgcuugggcgcgga

SEQ ID NO: 1402097 - RNA, 21 nt, Pseudomonas aeruginosa PA01
ggcgcuuguagcccaggggca

SEQ ID NO: 1402098 - RNA, 22 nt, Pseudomonas aeruginosa PA01
ggcgcuuguagcccaggggcac

SEQ ID NO: 1402099 - RNA, 22 nt, Pseudomonas aeruginosa PA01
ggcgcuuguccgagaccggcag

SEQ ID NO: 1402100 - RNA, 17 nt, Pseudomonas aeruginosa PA01
ggcgcuugcgggcgcgc

SEQ ID NO: 1402101 - RNA, 17 nt, Pseudomonas aeruginosa PA01
ggcgcuugcucuccacu

SEQ ID NO: 1402102 - RNA, 24 nt, Pseudomonas aeruginosa PA01
ggcgcuugcucuccacuaccgccg

SEQ ID NO: 1402103 - RNA, 16 nt, Pseudomonas aeruginosa PA01
ggcgcuuucaucaggc

SEQ ID NO: 1402104 - RNA, 23 nt, Pseudomonas aeruginosa PA01
ggcggacagcccgcgcucggccg

SEQ ID NO: 1402105 - RNA, 17 nt, Pseudomonas aeruginosa PA01
ggcggacagcggaaacg

SEQ ID NO: 1402106 - RNA, 14 nt, Pseudomonas aeruginosa PA01
ggcggacaggcagc

SEQ ID NO: 1402107 - RNA, 21 nt, Pseudomonas aeruginosa PA01
ggcggacauguugcagggucg

SEQ ID NO: 1402108 - RNA, 13 nt, Pseudomonas aeruginosa PA01
ggcggauaacgcc

SEQ ID NO: 1402109 - RNA, 17 nt, Pseudomonas aeruginosa PA01
ggcggauaacgccacag

SEQ ID NO: 1402110 - RNA, 19 nt, Pseudomonas aeruginosa PA01
ggcggauaacgcccgcggc

SEQ ID NO: 1402111 - RNA, 20 nt, Pseudomonas aeruginosa PA01
ggcggauaacgcccgcggcg

SEQ ID NO: 1402112 - RNA, 14 nt, Pseudomonas aeruginosa PA01
ggcggauaacgccg

SEQ ID NO: 1402113 - RNA, 17 nt, Pseudomonas aeruginosa PA01
ggcggauaacgccgaug

SEQ ID NO: 1402114 - RNA, 22 nt, Pseudomonas aeruginosa PA01
ggcggauaacgccgauggcguu

SEQ ID NO: 1402115 - RNA, 17 nt, Pseudomonas aeruginosa PA01
ggcggauaacgccgcug

SEQ ID NO: 1402116 - RNA, 20 nt, Pseudomonas aeruginosa PA01
ggcggauaacgccgcuggcg

SEQ ID NO: 1402117 - RNA, 17 nt, Pseudomonas aeruginosa PA01
ggcggauaaucgcagcg

SEQ ID NO: 1402118 - RNA, 18 nt, Pseudomonas aeruginosa PA01
ggcggauacaggcgcagc

SEQ ID NO: 1402119 - RNA, 20 nt, Pseudomonas aeruginosa PA01
ggcggauacaggcgcagcag

SEQ ID NO: 1402120 - RNA, 22 nt, Pseudomonas aeruginosa PA01
ggcggauacaggcgcagcagca

SEQ ID NO: 1402121 - RNA, 16 nt, Pseudomonas aeruginosa PA01
ggcggauaucgcgccg

SEQ ID NO: 1402122 - RNA, 15 nt, Pseudomonas aeruginosa PA01
ggcggauaucgcgug

SEQ ID NO: 1402123 - RNA, 19 nt, Pseudomonas aeruginosa PA01
ggcggauaucgcgugguga

SEQ ID NO: 1402124 - RNA, 16 nt, Pseudomonas aeruginosa PA01
ggcggauaaccgcgag

SEQ ID NO: 1402125 - RNA, 19 nt, Pseudomonas aeruginosa PA01
ggcggauaaccgcgagcgg

SEQ ID NO: 1402126 - RNA, 20 nt, Pseudomonas aeruginosa PA01
ggcggaucgagcagcggcgc

SEQ ID NO: 1402127 - RNA, 21 nt, Pseudomonas aeruginosa PA01
ggcggaucgagcagcggcgcc

SEQ ID NO: 1402128 - RNA, 15 nt, Pseudomonas aeruginosa PA01
ggcggaucgaucagc

SEQ ID NO: 1402129 - RNA, 20 nt, Pseudomonas aeruginosa PA01
ggcggaucgaucagcagcac

SEQ ID NO: 1402130 - RNA, 20 nt, Pseudomonas aeruginosa PA01
ggcggauagcgcgcaggcgc

SEQ ID NO: 1402131 - RNA, 15 nt, Pseudomonas aeruginosa PA01
ggcggaucaccggcu

SEQ ID NO: 1402132 - RNA, 21 nt, Pseudomonas aeruginosa PA01
ggcggaucaccggcuggcccu

SEQ ID NO: 1402133 - RNA, 13 nt, Pseudomonas aeruginosa PA01
ggcggacgcuggg

SEQ ID NO: 1402134 - RNA, 14 nt, Pseudomonas aeruginosa PA01
ggcggacgcugggc

SEQ ID NO: 1402135 - RNA, 23 nt, Pseudomonas aeruginosa PA01
ggcggacgcugggcugggucggc

SEQ ID NO: 1402136 - RNA, 13 nt, Pseudomonas aeruginosa PA01
ggcggaccuccgc

SEQ ID NO: 1402137 - RNA, 16 nt, Pseudomonas aeruginosa PA01
ggcggaccuccgccag

SEQ ID NO: 1402138 - RNA, 19 nt, Pseudomonas aeruginosa PA01
ggcggaccuccgccagguc

SEQ ID NO: 1402139 - RNA, 23 nt, Pseudomonas aeruginosa PA01
ggcggaccuccgccaggucgauc

SEQ ID NO: 1402140 - RNA, 18 nt, Pseudomonas aeruginosa PA01
ggcggacugcucgccgcc

SEQ ID NO: 1402141 - RNA, 15 nt, Pseudomonas aeruginosa PA01
ggcggagccgucggc

SEQ ID NO: 1402142 - RNA, 14 nt, Pseudomonas aeruginosa PA01
ggcggagaagccgc

SEQ ID NO: 1402143 - RNA, 12 nt, Pseudomonas aeruginosa PA01
ggcggaggcgag

SEQ ID NO: 1402144 - RNA, 15 nt, Pseudomonas aeruginosa PA01
ggcgcgcgucgaugc

SEQ ID NO: 1402145 - RNA, 20 nt, Pseudomonas aeruginosa PA01
ggcgcgcgguuucuucgccu

SEQ ID NO: 1402146 - RNA, 20 nt, Pseudomonas aeruginosa PA01
ggcgcgcggggucuggccgg

SEQ ID NO: 1402147 - RNA, 14 nt, Pseudomonas aeruginosa PA01
ggcgcgcgggccuu

SEQ ID NO: 1402148 - RNA, 16 nt, Pseudomonas aeruginosa PA01
ggcgcgcggcagcacc

SEQ ID NO: 1402149 - RNA, 19 nt, Pseudomonas aeruginosa PA01
ggcgcgcggccagcgcggc

SEQ ID NO: 1402150 - RNA, 13 nt, Pseudomonas aeruginosa PA01
ggcgcgcggccgc

SEQ ID NO: 1402151 - RNA, 15 nt, Pseudomonas aeruginosa PA01
ggcgcgcgcgcugcc

SEQ ID NO: 1402152 - RNA, 21 nt, Pseudomonas aeruginosa PA01
ggcgcggauacgggaucuuca

SEQ ID NO: 1402153 - RNA, 14 nt, Pseudomonas aeruginosa PA01
ggcgcggaugaccu

SEQ ID NO: 1402154 - RNA, 20 nt, Pseudomonas aeruginosa PA01
ggcgcggcagugcucgauca

SEQ ID NO: 1402155 - RNA, 19 nt, Pseudomonas aeruginosa PA01
ggcgcggccagcuucucca

SEQ ID NO: 1402156 - RNA, 14 nt, Pseudomonas aeruginosa PA01
ggcgcgacugucga

SEQ ID NO: 1402157 - RNA, 15 nt, Pseudomonas aeruginosa PA01
ggcgcgacuguucuc

SEQ ID NO: 1402158 - RNA, 19 nt, Pseudomonas aeruginosa PA01
ggcgcgagaugaagcgccg

SEQ ID NO: 1402159 - RNA, 20 nt, Pseudomonas aeruginosa PA01
ggcgcgagaugaagcgccgc

SEQ ID NO: 1402160 - RNA, 12 nt, Pseudomonas aeruginosa PA01
ggcgcgcgcccu

SEQ ID NO: 1402161 - RNA, 13 nt, Pseudomonas aeruginosa PA01
ggcgcgcgccgaa

SEQ ID NO: 1402162 - RNA, 14 nt, Pseudomonas aeruginosa PA01
ggcgcgcgccgaac

SEQ ID NO: 1402163 - RNA, 22 nt, Pseudomonas aeruginosa PA01
ggcgcgcgccucagcggcuggc

SEQ ID NO: 1402164 - RNA, 21 nt, Pseudomonas aeruginosa PA01
ggcgcgaaucuucggcgcgcc

SEQ ID NO: 1402165 - RNA, 22 nt, Pseudomonas aeruginosa PA01
ggcgcgaaucuucggcgcgccg

SEQ ID NO: 1402166 - RNA, 16 nt, Pseudomonas aeruginosa PA01
ggcgcgaauggcauuc

SEQ ID NO: 1402167 - RNA, 19 nt, Pseudomonas aeruginosa PA01
ggcgccuuuuucauggccu

SEQ ID NO: 1402168 - RNA, 23 nt, Pseudomonas aeruginosa PA01
ggcgccuuuuuucauccugcgga

SEQ ID NO: 1402169 - RNA, 15 nt, Pseudomonas aeruginosa PA01
ggcgcgaccgucggc

SEQ ID NO: 1402170 - RNA, 18 nt, Pseudomonas aeruginosa PA01
ggcgcgaccgucggccgg

SEQ ID NO: 1402171 - RNA, 14 nt, Pseudomonas aeruginosa PA01
ggcgcgacgcucca

SEQ ID NO: 1402172 - RNA, 14 nt, Pseudomonas aeruginosa PA01
ggcgcgacagcucg

SEQ ID NO: 1402173 - RNA, 18 nt, Pseudomonas aeruginosa PA01
ggcgcgggccuucaggcu

SEQ ID NO: 1402174 - RNA, 15 nt, Pseudomonas aeruginosa PA01
ggcgcgggcgaaggc

SEQ ID NO: 1402175 - RNA, 23 nt, Pseudomonas aeruginosa PA01
ggcgcgggcgaaggccucgucga

SEQ ID NO: 1402176 - RNA, 13 nt, Pseudomonas aeruginosa PA01
ggcgcggccggcg

SEQ ID NO: 1402177 - RNA, 22 nt, Pseudomonas aeruginosa PA01
ggcgcggcccguccgcgccacg

SEQ ID NO: 1402178 - RNA, 11 nt, Pseudomonas aeruginosa PA01
ggcgcggccga

SEQ ID NO: 1402179 - RNA, 20 nt, Pseudomonas aeruginosa PA01
ggcgcgggcauggaucuccc

SEQ ID NO: 1402180 - RNA, 14 nt, Pseudomonas aeruginosa PA01
ggcgcgggcgcgcg

SEQ ID NO: 1402181 - RNA, 23 nt, Pseudomonas aeruginosa PA01
ggcgcgggcgccgaugccggccg

SEQ ID NO: 1402182 - RNA, 18 nt, Pseudomonas aeruginosa PA01
ggcgcgggcggccucgau

SEQ ID NO: 1402183 - RNA, 13 nt, Pseudomonas aeruginosa PA01
ggcgcgggcggcg

SEQ ID NO: 1402184 - RNA, 18 nt, Pseudomonas aeruginosa PA01
ggcgcggggcccggcucc

SEQ ID NO: 1402185 - RNA, 15 nt, Pseudomonas aeruginosa PA01
ggcgcgggcuggcca

SEQ ID NO: 1402186 - RNA, 17 nt, Pseudomonas aeruginosa PA01
ggcgcgggucugcucgc

SEQ ID NO: 1402187 - RNA, 20 nt, Pseudomonas aeruginosa PA01
ggcgcgggucugcucgcgcu

SEQ ID NO: 1402188 - RNA, 19 nt, Pseudomonas aeruginosa PA01
ggcgcgggucuucaggccg

SEQ ID NO: 1402189 - RNA, 22 nt, Pseudomonas aeruginosa PA01
ggcgcggggcgaggucggccug

SEQ ID NO: 1402190 - RNA, 12 nt, Pseudomonas aeruginosa PA01
ggcgcggguggc

SEQ ID NO: 1402191 - RNA, 18 nt, Pseudomonas aeruginosa PA01
ggcgcgguagggaucguc

SEQ ID NO: 1402192 - RNA, 23 nt, Pseudomonas aeruginosa PA01
ggcgcgguagggaucgucgccaa

SEQ ID NO: 1402193 - RNA, 19 nt, Pseudomonas aeruginosa PA01
ggcgcggguucgugccagg

SEQ ID NO: 1402194 - RNA, 17 nt, Pseudomonas aeruginosa PA01
ggcgcggugggccuuga

SEQ ID NO: 1402195 - RNA, 16 nt, Pseudomonas aeruginosa PA01
ggcgcgguugccgcug

SEQ ID NO: 1402196 - RNA, 19 nt, Pseudomonas aeruginosa PA01
ggcgcggucguaggaacgu

SEQ ID NO: 1402197 - RNA, 19 nt, Pseudomonas aeruginosa PA01
ggcgcggugagggcgacgu

SEQ ID NO: 1402198 - RNA, 13 nt, Pseudomonas aeruginosa PA01
ggcgcguaggcga

SEQ ID NO: 1402199 - RNA, 14 nt, Pseudomonas aeruginosa PA01
ggcgcguccaccug

SEQ ID NO: 1402200 - RNA, 15 nt, Pseudomonas aeruginosa PA01
ggcgcguacgcccgc

SEQ ID NO: 1402201 - RNA, 16 nt, Pseudomonas aeruginosa PA01
ggcgcguacgcccgca

SEQ ID NO: 1402202 - RNA, 21 nt, Pseudomonas aeruginosa PA01
ggcgcguacuugccagggcag

SEQ ID NO: 1402203 - RNA, 18 nt, Pseudomonas aeruginosa PA01
ggcgcguagaggaugccg

SEQ ID NO: 1402204 - RNA, 22 nt, Pseudomonas aeruginosa PA01
ggcgcguagaggaugccggccu

SEQ ID NO: 1402205 - RNA, 14 nt, Pseudomonas aeruginosa PA01
ggcgcgucaugccg

SEQ ID NO: 1402206 - RNA, 19 nt, Pseudomonas aeruginosa PA01
ggcgcgucaugccgccguc

SEQ ID NO: 1402207 - RNA, 23 nt, Pseudomonas aeruginosa PA01
ggcgcgucaugccgccgucgcgg

SEQ ID NO: 1402208 - RNA, 17 nt, Pseudomonas aeruginosa PA01
ggcgcgucgcugccgcc

SEQ ID NO: 1402209 - RNA, 18 nt, Pseudomonas aeruginosa PA01
ggcgcgucgcugccgccg

SEQ ID NO: 1402210 - RNA, 19 nt, Pseudomonas aeruginosa PA01
ggcgcgucgcugccgccgc

SEQ ID NO: 1402211 - RNA, 22 nt, Pseudomonas aeruginosa PA01
ggcgcgucgcugccgccgcgcc

SEQ ID NO: 1402212 - RNA, 14 nt, Pseudomonas aeruginosa PA01
ggcgcgucgcugcg

SEQ ID NO: 1402213 - RNA, 16 nt, Pseudomonas aeruginosa PA01
ggcgcgucgcugcgca

SEQ ID NO: 1402214 - RNA, 21 nt, Pseudomonas aeruginosa PA01
ggcgcguccagcuccaccagg

SEQ ID NO: 1402215 - RNA, 21 nt, Pseudomonas aeruginosa PA01
ggcauuuccugggugccgcga

SEQ ID NO: 1402216 - RNA, 15 nt, Pseudomonas aeruginosa PA01
ggccacccuugcgcc

SEQ ID NO: 1402217 - RNA, 18 nt, Pseudomonas aeruginosa PA01
ggccacccuugcgcccgg

SEQ ID NO: 1402218 - RNA, 17 nt, Pseudomonas aeruginosa PA01
ggccaccgaaucgaugc

SEQ ID NO: 1402219 - RNA, 21 nt, Pseudomonas aeruginosa PA01
ggccaccgaaucgaugcugua

SEQ ID NO: 1402220 - RNA, 23 nt, Pseudomonas aeruginosa PA01
ggccaccgaaucggacagguugg

SEQ ID NO: 1402221 - RNA, 20 nt, Pseudomonas aeruginosa PA01
ggccaccgggaucagcggcg

SEQ ID NO: 1402222 - RNA, 14 nt, Pseudomonas aeruginosa PA01
ggccaccgcggcgu

SEQ ID NO: 1402223 - RNA, 20 nt, Pseudomonas aeruginosa PA01
ggccaccgcggcguccgcgu

SEQ ID NO: 1402224 - RNA, 21 nt, Pseudomonas aeruginosa PA01
ggccacggccgcugcgcaggc

SEQ ID NO: 1402225 - RNA, 13 nt, Pseudomonas aeruginosa PA01
ggccacggccggc

SEQ ID NO: 1402226 - RNA, 17 nt, Pseudomonas aeruginosa PA01
ggccacggccggcgagg

SEQ ID NO: 1402227 - RNA, 19 nt, Pseudomonas aeruginosa PA01
ggccacgcugcggaucaac

SEQ ID NO: 1402228 - RNA, 16 nt, Pseudomonas aeruginosa PA01
ggccacgcgaccagcg

SEQ ID NO: 1402229 - RNA, 17 nt, Pseudomonas aeruginosa PA01
ggccacgcgaccagcgc

SEQ ID NO: 1402230 - RNA, 19 nt, Pseudomonas aeruginosa PA01
ggccacgcgaccagcgcca

SEQ ID NO: 1402231 - RNA, 20 nt, Pseudomonas aeruginosa PA01
ggccacgcgaccagcgccag

SEQ ID NO: 1402232 - RNA, 22 nt, Pseudomonas aeruginosa PA01
ggccaccuucgcccgcugcgcu

SEQ ID NO: 1402233 - RNA, 23 nt, Pseudomonas aeruginosa PA01
ggccacgcucucgaacagcagca

SEQ ID NO: 1402234 - RNA, 17 nt, Pseudomonas aeruginosa PA01
ggccagcaaugcccgcg

SEQ ID NO: 1402235 - RNA, 17 nt, Pseudomonas aeruginosa PA01
ggccacuccagccccgc

SEQ ID NO: 1402236 - RNA, 12 nt, Pseudomonas aeruginosa PA01
ggccacggcgga

SEQ ID NO: 1402237 - RNA, 17 nt, Pseudomonas aeruginosa PA01
ggccacggcggaagucg

SEQ ID NO: 1402238 - RNA, 15 nt, Pseudomonas aeruginosa PA01
ggccacguagggcgu

SEQ ID NO: 1402239 - RNA, 17 nt, Pseudomonas aeruginosa PA01
ggccacguagggcgugg

SEQ ID NO: 1402240 - RNA, 17 nt, Pseudomonas aeruginosa PA01
ggccagcaccucgacgc

SEQ ID NO: 1402241 - RNA, 20 nt, Pseudomonas aeruginosa PA01
ggccagcaccucgacgcccg

SEQ ID NO: 1402242 - RNA, 21 nt, Pseudomonas aeruginosa PA01
ggccagcaccucgacgcccgc

SEQ ID NO: 1402243 - RNA, 22 nt, Pseudomonas aeruginosa PA01
ggccagcaccucgacgcccgcu

SEQ ID NO: 1402244 - RNA, 21 nt, Pseudomonas aeruginosa PA01
ggccagcaccagucccuggcc

SEQ ID NO: 1402245 - RNA, 22 nt, Pseudomonas aeruginosa PA01
ggccagcaccagucccuggccg

SEQ ID NO: 1402246 - RNA, 23 nt, Pseudomonas aeruginosa PA01
ggccagcaccagucccuggccgg

SEQ ID NO: 1402247 - RNA, 11 nt, Pseudomonas aeruginosa PA01
ggccagcaccu

SEQ ID NO: 1402248 - RNA, 16 nt, Pseudomonas aeruginosa PA01
ggccagcgcggccgcc

SEQ ID NO: 1402249 - RNA, 17 nt, Pseudomonas aeruginosa PA01
ggccagcgcggccgccg

SEQ ID NO: 1402250 - RNA, 13 nt, Pseudomonas aeruginosa PA01
ggccagcgcggug

SEQ ID NO: 1402251 - RNA, 18 nt, Pseudomonas aeruginosa PA01
ggccagcgcggugcgcgc

SEQ ID NO: 1402252 - RNA, 22 nt, Pseudomonas aeruginosa PA01
ggccagcgcggugcgcgccauc

SEQ ID NO: 1402253 - RNA, 20 nt, Pseudomonas aeruginosa PA01
ggccagcgcuuccaccgccu

SEQ ID NO: 1402254 - RNA, 21 nt, Pseudomonas aeruginosa PA01
ggccagcgcuuccaccgccug

SEQ ID NO: 1402255 - RNA, 22 nt, Pseudomonas aeruginosa PA01
ggccagcgcuucgcgaucggcg

SEQ ID NO: 1402256 - RNA, 18 nt, Pseudomonas aeruginosa PA01
ggccagcggcauccgccg

SEQ ID NO: 1402257 - RNA, 19 nt, Pseudomonas aeruginosa PA01
ggccagcagcacggcgacg

SEQ ID NO: 1402258 - RNA, 24 nt, Pseudomonas aeruginosa PA01
ggccagcagcacggcgacgaaggc

SEQ ID NO: 1402259 - RNA, 20 nt, Pseudomonas aeruginosa PA01
ggccagcagguagccugcgg

SEQ ID NO: 1402260 - RNA, 22 nt, Pseudomonas aeruginosa PA01
ggccagccaacugcuucaggcg

SEQ ID NO: 1402261 - RNA, 16 nt, Pseudomonas aeruginosa PA01
ggccagcgccguacgc

SEQ ID NO: 1402262 - RNA, 17 nt, Pseudomonas aeruginosa PA01
ggccagcgccuggcgca

SEQ ID NO: 1402263 - RNA, 18 nt, Pseudomonas aeruginosa PA01
ggccagcccagaacagca

SEQ ID NO: 1402264 - RNA, 18 nt, Pseudomonas aeruginosa PA01
ggccagccagagccaguc

SEQ ID NO: 1402265 - RNA, 22 nt, Pseudomonas aeruginosa PA01
ggccagcuuccaggcgcgcugg

SEQ ID NO: 1402266 - RNA, 22 nt, Pseudomonas aeruginosa PA01
ggccagcuuguaguagcgcccg

SEQ ID NO: 1402267 - RNA, 23 nt, Pseudomonas aeruginosa PA01
ggccagcucgccggucaacagcg

SEQ ID NO: 1402268 - RNA, 15 nt, Pseudomonas aeruginosa PA01
ggccagcucgcccgc

SEQ ID NO: 1402269 - RNA, 16 nt, Pseudomonas aeruginosa PA01
ggccagcucgcccgcc

SEQ ID NO: 1402270 - RNA, 16 nt, Pseudomonas aeruginosa PA01
ggccagcucgccgaac

SEQ ID NO: 1402271 - RNA, 17 nt, Pseudomonas aeruginosa PA01
ggccagcucgccgaaca

SEQ ID NO: 1402272 - RNA, 13 nt, Pseudomonas aeruginosa PA01
ggccaggaugacc

SEQ ID NO: 1402273 - RNA, 19 nt, Pseudomonas aeruginosa PA01
ggccaggaugaccaggcug

SEQ ID NO: 1402274 - RNA, 21 nt, Pseudomonas aeruginosa PA01
ggccaggaugaccaggcugau

SEQ ID NO: 1402275 - RNA, 21 nt, Pseudomonas aeruginosa PA01
ggccaggagcaucggcgcggc

SEQ ID NO: 1402276 - RNA, 22 nt, Pseudomonas aeruginosa PA01
ggccaggagcaucggcgcggcc

SEQ ID NO: 1402277 - RNA, 16 nt, Pseudomonas aeruginosa PA01
ggccaggaccgcgaug

SEQ ID NO: 1402278 - RNA, 19 nt, Pseudomonas aeruginosa PA01
ggccaggaccagggcgggc

SEQ ID NO: 1402279 - RNA, 23 nt, Pseudomonas aeruginosa PA01
ggccaggaagcgggccucggcgg

SEQ ID NO: 1402280 - RNA, 15 nt, Pseudomonas aeruginosa PA01
ggccaggaaggccgc

SEQ ID NO: 1402281 - RNA, 20 nt, Pseudomonas aeruginosa PA01
ggccaggaaaucgagcgcca

SEQ ID NO: 1402282 - RNA, 17 nt, Pseudomonas aeruginosa PA01
ggccagcuucuccagca

SEQ ID NO: 1402283 - RNA, 14 nt, Pseudomonas aeruginosa PA01
ggccagcuccgccu

SEQ ID NO: 1402284 - RNA, 13 nt, Pseudomonas aeruginosa PA01
ggccagcuccgcc

SEQ ID NO: 1402285 - RNA, 16 nt, Pseudomonas aeruginosa PA01
ggccagcucgaccuug

SEQ ID NO: 1402286 - RNA, 17 nt, Pseudomonas aeruginosa PA01
ggccagcucgaccuugc

SEQ ID NO: 1402287 - RNA, 18 nt, Pseudomonas aeruginosa PA01
ggccagcucgaccuugcc

SEQ ID NO: 1402288 - RNA, 20 nt, Pseudomonas aeruginosa PA01
ggccagcguccuucggcgcu

SEQ ID NO: 1402289 - RNA, 14 nt, Pseudomonas aeruginosa PA01
ggccagcuccagca

SEQ ID NO: 1402290 - RNA, 17 nt, Pseudomonas aeruginosa PA01
ggccagcuccagcaccg

SEQ ID NO: 1402291 - RNA, 19 nt, Pseudomonas aeruginosa PA01
ggccagcuccagcaccggc

SEQ ID NO: 1402292 - RNA, 20 nt, Pseudomonas aeruginosa PA01
ggccagcuccagcaccggcg

SEQ ID NO: 1402293 - RNA, 24 nt, Pseudomonas aeruginosa PA01
ggccagcgugaagaccugguccaa

SEQ ID NO: 1402294 - RNA, 21 nt, Pseudomonas aeruginosa PA01
ggcaguacucaugaccgccgc

SEQ ID NO: 1402295 - RNA, 17 nt, Pseudomonas aeruginosa PA01
ggcagggugucgacgac

SEQ ID NO: 1402296 - RNA, 12 nt, Pseudomonas aeruginosa PA01
ggcagguagugg

SEQ ID NO: 1402297 - RNA, 18 nt, Pseudomonas aeruginosa PA01
ggcagguaguggcccucg

SEQ ID NO: 1402298 - RNA, 20 nt, Pseudomonas aeruginosa PA01
ggcagucccugccaggggcu

SEQ ID NO: 1402299 - RNA, 12 nt, Pseudomonas aeruginosa PA01
ggcagucgccgc

SEQ ID NO: 1402300 - RNA, 17 nt, Pseudomonas aeruginosa PA01
ggcagucgccgcaccgg

SEQ ID NO: 1402301 - RNA, 20 nt, Pseudomonas aeruginosa PA01
ggcagucgccgcaccggcga

SEQ ID NO: 1402302 - RNA, 14 nt, Pseudomonas aeruginosa PA01
ggcaguccucgccg

SEQ ID NO: 1402303 - RNA, 20 nt, Pseudomonas aeruginosa PA01
ggcaguccuugagcgccagc

SEQ ID NO: 1402304 - RNA, 15 nt, Pseudomonas aeruginosa PA01
ggcagucgucgcagc

SEQ ID NO: 1402305 - RNA, 22 nt, Pseudomonas aeruginosa PA01
ggcaucgacgauguacugcucg

SEQ ID NO: 1402306 - RNA, 15 nt, Pseudomonas aeruginosa PA01
ggcaucgacgccagc

SEQ ID NO: 1402307 - RNA, 19 nt, Pseudomonas aeruginosa PA01
ggcaucgacgccagcggcg

SEQ ID NO: 1402308 - RNA, 20 nt, Pseudomonas aeruginosa PA01
ggcaucgacgccagcggcga

SEQ ID NO: 1402309 - RNA, 20 nt, Pseudomonas aeruginosa PA01
ggcaucgaccagcagcggcu

SEQ ID NO: 1402310 - RNA, 21 nt, Pseudomonas aeruginosa PA01
ggcaucgaccagcagcggcuc

SEQ ID NO: 1402311 - RNA, 17 nt, Pseudomonas aeruginosa PA01
ggcaucgaucuugccca

SEQ ID NO: 1402312 - RNA, 15 nt, Pseudomonas aeruginosa PA01
ggcaucgccauggcg

SEQ ID NO: 1402313 - RNA, 17 nt, Pseudomonas aeruginosa PA01
ggcaucgccauggcgcu

SEQ ID NO: 1402314 - RNA, 16 nt, Pseudomonas aeruginosa PA01
ggcauccugccgccug

SEQ ID NO: 1402315 - RNA, 24 nt, Pseudomonas aeruginosa PA01
ggcaucccgcccggucucagccgg

SEQ ID NO: 1402316 - RNA, 18 nt, Pseudomonas aeruginosa PA01
ggcauccucgccccgccg

SEQ ID NO: 1402317 - RNA, 21 nt, Pseudomonas aeruginosa PA01
ggcauccucgccccgccggga

SEQ ID NO: 1402318 - RNA, 14 nt, Pseudomonas aeruginosa PA01
ggcauccgccgcug

SEQ ID NO: 1402319 - RNA, 15 nt, Pseudomonas aeruginosa PA01
ggcauccccggacca

SEQ ID NO: 1402320 - RNA, 21 nt, Pseudomonas aeruginosa PA01
ggcauccccuuuuuucagccu

SEQ ID NO: 1402321 - RNA, 14 nt, Pseudomonas aeruginosa PA01
ggcauccagcaccg

SEQ ID NO: 1402322 - RNA, 14 nt, Pseudomonas aeruginosa PA01
ggcauccaguucgu

SEQ ID NO: 1402323 - RNA, 13 nt, Pseudomonas aeruginosa PA01
ggcaucucggcca

SEQ ID NO: 1402324 - RNA, 14 nt, Pseudomonas aeruginosa PA01
ggcaucucggccac

SEQ ID NO: 1402325 - RNA, 13 nt, Pseudomonas aeruginosa PA01
ggcaucguggcca

SEQ ID NO: 1402326 - RNA, 15 nt, Pseudomonas aeruginosa PA01
ggcaucguggccaug

SEQ ID NO: 1402327 - RNA, 13 nt, Pseudomonas aeruginosa PA01
ggcaucggcgccg

SEQ ID NO: 1402328 - RNA, 14 nt, Pseudomonas aeruginosa PA01
ggcaucggcgccgc

SEQ ID NO: 1402329 - RNA, 15 nt, Pseudomonas aeruginosa PA01
ggcaucggcgccgcg

SEQ ID NO: 1402330 - RNA, 17 nt, Pseudomonas aeruginosa PA01
ggcaucggcgccgcgca

SEQ ID NO: 1402331 - RNA, 12 nt, Pseudomonas aeruginosa PA01
ggcaucgcgaaa

SEQ ID NO: 1402332 - RNA, 12 nt, Pseudomonas aeruginosa PA01
ggcaucgccgac

SEQ ID NO: 1402333 - RNA, 14 nt, Pseudomonas aeruginosa PA01
ggcaucgccgccca

SEQ ID NO: 1402334 - RNA, 13 nt, Pseudomonas aeruginosa PA01
ggcaucggccugg

SEQ ID NO: 1402335 - RNA, 22 nt, Pseudomonas aeruginosa PA01
ggcaugaagcuuuuccagcgca

SEQ ID NO: 1402336 - RNA, 17 nt, Pseudomonas aeruginosa PA01
ggcaucuucaaucgcgc

SEQ ID NO: 1402337 - RNA, 16 nt, Pseudomonas aeruginosa PA01
ggcaugaccgauggcg

SEQ ID NO: 1402338 - RNA, 18 nt, Pseudomonas aeruginosa PA01
ggcaugaccgauggcgcc

SEQ ID NO: 1402339 - RNA, 20 nt, Pseudomonas aeruginosa PA01
ggcaugaccgauggcgccgc

SEQ ID NO: 1402340 - RNA, 21 nt, Pseudomonas aeruginosa PA01
ggcaugaccgauggcgccgcg

SEQ ID NO: 1402341 - RNA, 22 nt, Pseudomonas aeruginosa PA01
ggcaugaccgauggcgccgcga

SEQ ID NO: 1402342 - RNA, 19 nt, Pseudomonas aeruginosa PA01
ggcaucuuguguaccacca

SEQ ID NO: 1402343 - RNA, 21 nt, Pseudomonas aeruginosa PA01
ggcaucuuucagcugagucgc

SEQ ID NO: 1402344 - RNA, 16 nt, Pseudomonas aeruginosa PA01
ggcaugcaagaggucg

SEQ ID NO: 1402345 - RNA, 15 nt, Pseudomonas aeruginosa PA01
ggcaugcacgcccug

SEQ ID NO: 1402346 - RNA, 20 nt, Pseudomonas aeruginosa PA01
ggcaugaggggaaucgccgu

SEQ ID NO: 1402347 - RNA, 18 nt, Pseudomonas aeruginosa PA01
ggcaugcccugccggcgc

SEQ ID NO: 1402348 - RNA, 12 nt, Pseudomonas aeruginosa PA01
ggcaugcggccc

SEQ ID NO: 1402349 - RNA, 14 nt, Pseudomonas aeruginosa PA01
ggcaugcggccccg

SEQ ID NO: 1402350 - RNA, 17 nt, Pseudomonas aeruginosa PA01
ggcauuggugcugcgcg

SEQ ID NO: 1402351 - RNA, 23 nt, Pseudomonas aeruginosa PA01
ggcauuggugcugcgcgcggccc

SEQ ID NO: 1402352 - RNA, 13 nt, Pseudomonas aeruginosa PA01
ggcaugcccaggc

SEQ ID NO: 1402353 - RNA, 14 nt, Pseudomonas aeruginosa PA01
ggcaugcccaggcu

SEQ ID NO: 1402354 - RNA, 16 nt, Pseudomonas aeruginosa PA01
ggcaugcccaggcucg

SEQ ID NO: 1402355 - RNA, 19 nt, Pseudomonas aeruginosa PA01
ggcaugccgugggcgccgc

SEQ ID NO: 1402356 - RNA, 22 nt, Pseudomonas aeruginosa PA01
ggcaugccgugggcgccgccgg

SEQ ID NO: 1402357 - RNA, 24 nt, Pseudomonas aeruginosa PA01
ggcaugccguugggccagggccuu

SEQ ID NO: 1402358 - RNA, 14 nt, Pseudomonas aeruginosa PA01
ggcaggcggucagc

SEQ ID NO: 1402359 - RNA, 12 nt, Pseudomonas aeruginosa PA01
ggcaggcuggcg

SEQ ID NO: 1402360 - RNA, 17 nt, Pseudomonas aeruginosa PA01
ggcaggcucagcgcaug

SEQ ID NO: 1402361 - RNA, 17 nt, Pseudomonas aeruginosa PA01
ggcaggcugcaucggcu

SEQ ID NO: 1402362 - RNA, 16 nt, Pseudomonas aeruginosa PA01
ggcaggcugcgccgcu

SEQ ID NO: 1402363 - RNA, 11 nt, Pseudomonas aeruginosa PA01
ggcaggcgcgg

SEQ ID NO: 1402364 - RNA, 12 nt, Pseudomonas aeruginosa PA01
ggcaggcgcggc

SEQ ID NO: 1402365 - RNA, 19 nt, Pseudomonas aeruginosa PA01
ggcaggcgcgggucaucgg

SEQ ID NO: 1402366 - RNA, 16 nt, Pseudomonas aeruginosa PA01
ggcaggcgcaggcgaa

SEQ ID NO: 1402367 - RNA, 22 nt, Pseudomonas aeruginosa PA01
ggcaggcgccaaccgggcagca

SEQ ID NO: 1402368 - RNA, 19 nt, Pseudomonas aeruginosa PA01
ggcaggcgcccggucaggu

SEQ ID NO: 1402369 - RNA, 12 nt, Pseudomonas aeruginosa PA01
ggcaggccugga

SEQ ID NO: 1402370 - RNA, 18 nt, Pseudomonas aeruginosa PA01
ggcaggccuuccacgccu

SEQ ID NO: 1402371 - RNA, 20 nt, Pseudomonas aeruginosa PA01
ggcaggccuucggcgccgga

SEQ ID NO: 1402372 - RNA, 21 nt, Pseudomonas aeruginosa PA01
ggcaggccuucggcgccggag

SEQ ID NO: 1402373 - RNA, 19 nt, Pseudomonas aeruginosa PA01
ggcagggaguccgccagcc

SEQ ID NO: 1402374 - RNA, 21 nt, Pseudomonas aeruginosa PA01
ggcagggaguccgccagccgg

SEQ ID NO: 1402375 - RNA, 21 nt, Pseudomonas aeruginosa PA01
ggcaggggcuuucuucgccug

SEQ ID NO: 1402376 - RNA, 15 nt, Pseudomonas aeruginosa PA01
ggcagggggucuucg

SEQ ID NO: 1402377 - RNA, 19 nt, Pseudomonas aeruginosa PA01
ggcaggguagccacgccgg

SEQ ID NO: 1402378 - RNA, 16 nt, Pseudomonas aeruginosa PA01
ggcagggcgcguccag

SEQ ID NO: 1402379 - RNA, 14 nt, Pseudomonas aeruginosa PA01
ggcagggccucggg

SEQ ID NO: 1402380 - RNA, 14 nt, Pseudomonas aeruginosa PA01
ggcagggcgcccgc

SEQ ID NO: 1402381 - RNA, 13 nt, Pseudomonas aeruginosa PA01
ggcagggcgccga

SEQ ID NO: 1402382 - RNA, 15 nt, Pseudomonas aeruginosa PA01
ggcagggcgccgacc

SEQ ID NO: 1402383 - RNA, 13 nt, Pseudomonas aeruginosa PA01
ggcagcgggccag

SEQ ID NO: 1402384 - RNA, 17 nt, Pseudomonas aeruginosa PA01
ggcagcgggccaggcgg

SEQ ID NO: 1402385 - RNA, 12 nt, Pseudomonas aeruginosa PA01
ggcagcggcugg

SEQ ID NO: 1402386 - RNA, 15 nt, Pseudomonas aeruginosa PA01
ggcagcggcuggccg

SEQ ID NO: 1402387 - RNA, 16 nt, Pseudomonas aeruginosa PA01
ggcagcggcuggccgu

SEQ ID NO: 1402388 - RNA, 18 nt, Pseudomonas aeruginosa PA01
ggcagcggcuggccgucg

SEQ ID NO: 1402389 - RNA, 21 nt, Pseudomonas aeruginosa PA01
ggcagcggcuggccgucgacc

SEQ ID NO: 1402390 - RNA, 13 nt, Pseudomonas aeruginosa PA01
ggcagcggucgcc

SEQ ID NO: 1402391 - RNA, 17 nt, Pseudomonas aeruginosa PA01
ggcagcggucgccgguc

SEQ ID NO: 1402392 - RNA, 22 nt, Pseudomonas aeruginosa PA01
ggcagcgguucgcccgcgggca

SEQ ID NO: 1402393 - RNA, 19 nt, Pseudomonas aeruginosa PA01
ggcaggccgggcuggccac

SEQ ID NO: 1402394 - RNA, 18 nt, Pseudomonas aeruginosa PA01
ggcagcguccgaacgcgc

SEQ ID NO: 1402395 - RNA, 22 nt, Pseudomonas aeruginosa PA01
ggcagcgucgagcuggcgcagg

SEQ ID NO: 1402396 - RNA, 19 nt, Pseudomonas aeruginosa PA01
ggcagcgucucagcccucg

SEQ ID NO: 1402397 - RNA, 18 nt, Pseudomonas aeruginosa PA01
ggcaggccgaggccggcg

SEQ ID NO: 1402398 - RNA, 14 nt, Pseudomonas aeruginosa PA01
ggcaggccgauggc

SEQ ID NO: 1402399 - RNA, 16 nt, Pseudomonas aeruginosa PA01
ggcaggccgauggccc

SEQ ID NO: 1402400 - RNA, 20 nt, Pseudomonas aeruginosa PA01
ggcaggccgauggccccggc

SEQ ID NO: 1402401 - RNA, 13 nt, Pseudomonas aeruginosa PA01
ggcaggccgaugu

SEQ ID NO: 1402402 - RNA, 15 nt, Pseudomonas aeruginosa PA01
ggcaggccgccgauc

SEQ ID NO: 1402403 - RNA, 16 nt, Pseudomonas aeruginosa PA01
ggcagaccugcagcag

SEQ ID NO: 1402404 - RNA, 22 nt, Pseudomonas aeruginosa PA01
ggcagcgcuucguugcuccugc

SEQ ID NO: 1402405 - RNA, 14 nt, Pseudomonas aeruginosa PA01
ggcagcgcuggcga

SEQ ID NO: 1402406 - RNA, 15 nt, Pseudomonas aeruginosa PA01
ggcagcgcuggcgau

SEQ ID NO: 1402407 - RNA, 20 nt, Pseudomonas aeruginosa PA01
ggcagcgcuggcgaucacca

SEQ ID NO: 1402408 - RNA, 17 nt, Pseudomonas aeruginosa PA01
ggcagaccagcagcgca

SEQ ID NO: 1402409 - RNA, 18 nt, Pseudomonas aeruginosa PA01
ggcagaccagcagcgcac

SEQ ID NO: 1402410 - RNA, 20 nt, Pseudomonas aeruginosa PA01
ggcagaccagcagcgcacca

SEQ ID NO: 1402411 - RNA, 23 nt, Pseudomonas aeruginosa PA01
ggcagaccagcagcgcaccaucc

SEQ ID NO: 1402412 - RNA, 14 nt, Pseudomonas aeruginosa PA01
ggcagaccagcgca

SEQ ID NO: 1402413 - RNA, 21 nt, Pseudomonas aeruginosa PA01
ggcagaccagcgcaagcggcg

SEQ ID NO: 1402414 - RNA, 14 nt, Pseudomonas aeruginosa PA01
ggcagacaccacca

SEQ ID NO: 1402415 - RNA, 16 nt, Pseudomonas aeruginosa PA01
ggcagaacaucgccca

SEQ ID NO: 1402416 - RNA, 12 nt, Pseudomonas aeruginosa PA01
ggcacuucucga

SEQ ID NO: 1402417 - RNA, 21 nt, Pseudomonas aeruginosa PA01
ggcacuucucgaacagcuccu

SEQ ID NO: 1402418 - RNA, 13 nt, Pseudomonas aeruginosa PA01
ggcacuucgucca

SEQ ID NO: 1402419 - RNA, 18 nt, Pseudomonas aeruginosa PA01
ggcacagcguggccagcg

SEQ ID NO: 1402420 - RNA, 19 nt, Pseudomonas aeruginosa PA01
ggcacagcguggccagcgc

SEQ ID NO: 1402421 - RNA, 20 nt, Pseudomonas aeruginosa PA01
ggcacagcguggccagcgcc

SEQ ID NO: 1402422 - RNA, 21 nt, Pseudomonas aeruginosa PA01
ggcacagcguggccagcgccc

SEQ ID NO: 1402423 - RNA, 12 nt, Pseudomonas aeruginosa PA01
ggcacagggcga

SEQ ID NO: 1402424 - RNA, 13 nt, Pseudomonas aeruginosa PA01
ggcacagggcgac

SEQ ID NO: 1402425 - RNA, 23 nt, Pseudomonas aeruginosa PA01
ggcacagccauagugcugggcga

SEQ ID NO: 1402426 - RNA, 18 nt, Pseudomonas aeruginosa PA01
ggcaccaccgccgccagc

SEQ ID NO: 1402427 - RNA, 11 nt, Pseudomonas aeruginosa PA01
ggcaccaccgg

SEQ ID NO: 1402428 - RNA, 22 nt, Pseudomonas aeruginosa PA01
ggcacacgucggcaucgaacuc

SEQ ID NO: 1402429 - RNA, 18 nt, Pseudomonas aeruginosa PA01
ggcaccaguggcgccgcc

SEQ ID NO: 1402430 - RNA, 23 nt, Pseudomonas aeruginosa PA01
ggcaccccgagcggcgcgaaguc

SEQ ID NO: 1402431 - RNA, 13 nt, Pseudomonas aeruginosa PA01
ggcaccgcuuucg

SEQ ID NO: 1402432 - RNA, 21 nt, Pseudomonas aeruginosa PA01
ggcaccgcuuucguagggcga

SEQ ID NO: 1402433 - RNA, 13 nt, Pseudomonas aeruginosa PA01
ggcaccggccagg

SEQ ID NO: 1402434 - RNA, 15 nt, Pseudomonas aeruginosa PA01
ggcaccggccaggcg

SEQ ID NO: 1402435 - RNA, 17 nt, Pseudomonas aeruginosa PA01
ggcaccggccaggcgcu

SEQ ID NO: 1402436 - RNA, 19 nt, Pseudomonas aeruginosa PA01
ggcaccggccaggcgcugg

SEQ ID NO: 1402437 - RNA, 22 nt, Pseudomonas aeruginosa PA01
ggcaccggccaggcgcuggucc

SEQ ID NO: 1402438 - RNA, 15 nt, Pseudomonas aeruginosa PA01
ggcaccgcgccggcg

SEQ ID NO: 1402439 - RNA, 14 nt, Pseudomonas aeruginosa PA01
ggcaccgcgccggc

SEQ ID NO: 1402440 - RNA, 17 nt, Pseudomonas aeruginosa PA01
ggcaccgcgcagcguca

SEQ ID NO: 1402441 - RNA, 16 nt, Pseudomonas aeruginosa PA01
ggcaccgaucgcccgc

SEQ ID NO: 1402442 - RNA, 15 nt, Pseudomonas aeruginosa PA01
ggcacccggcugggu

SEQ ID NO: 1402443 - RNA, 20 nt, Pseudomonas aeruginosa PA01
ggcacccggcuggguucggc

SEQ ID NO: 1402444 - RNA, 15 nt, Pseudomonas aeruginosa PA01
ggcacccugaccgcg

SEQ ID NO: 1402445 - RNA, 18 nt, Pseudomonas aeruginosa PA01
ggcacccugaccgcgagc

SEQ ID NO: 1402446 - RNA, 21 nt, Pseudomonas aeruginosa PA01
ggcacgaauuuccuggcgcgu

SEQ ID NO: 1402447 - RNA, 17 nt, Pseudomonas aeruginosa PA01
ggcacgacaccaaauga

SEQ ID NO: 1402448 - RNA, 16 nt, Pseudomonas aeruginosa PA01
ggcaccguaggccagg

SEQ ID NO: 1402449 - RNA, 19 nt, Pseudomonas aeruginosa PA01
ggcaccgucaagggccagg

SEQ ID NO: 1402450 - RNA, 19 nt, Pseudomonas aeruginosa PA01
ggcaccgucaccuguucgg

SEQ ID NO: 1402451 - RNA, 18 nt, Pseudomonas aeruginosa PA01
ggcaccucgauggcggcg

SEQ ID NO: 1402452 - RNA, 21 nt, Pseudomonas aeruginosa PA01
ggcaccucgauggcggcggcg

SEQ ID NO: 1402453 - RNA, 20 nt, Pseudomonas aeruginosa PA01
ggcacgacgccggugccagg

SEQ ID NO: 1402454 - RNA, 14 nt, Pseudomonas aeruginosa PA01
ggcacgcagcagcu

SEQ ID NO: 1402455 - RNA, 20 nt, Pseudomonas aeruginosa PA01
ggcacgcagcagcuucggcg

SEQ ID NO: 1402456 - RNA, 17 nt, Pseudomonas aeruginosa PA01
ggcacgaucugcgccgc

SEQ ID NO: 1402457 - RNA, 18 nt, Pseudomonas aeruginosa PA01
ggcacgaucugcgccgca

SEQ ID NO: 1402458 - RNA, 18 nt, Pseudomonas aeruginosa PA01
ggcacgaugucgaccugg

SEQ ID NO: 1402459 - RNA, 19 nt, Pseudomonas aeruginosa PA01
ggcacgccgcucugcccga

SEQ ID NO: 1402460 - RNA, 20 nt, Pseudomonas aeruginosa PA01
ggcacgccgguggccaggcu

SEQ ID NO: 1402461 - RNA, 12 nt, Pseudomonas aeruginosa PA01
ggcacgccccau

SEQ ID NO: 1402462 - RNA, 20 nt, Pseudomonas aeruginosa PA01
ggcacguacguccagggcac

SEQ ID NO: 1402463 - RNA, 19 nt, Pseudomonas aeruginosa PA01
ggcacguugggaucgcuga

SEQ ID NO: 1402464 - RNA, 19 nt, Pseudomonas aeruginosa PA01
ggcacgugcagcggcagcg

SEQ ID NO: 1402465 - RNA, 16 nt, Pseudomonas aeruginosa PA01
ggcacucagccagcgg

SEQ ID NO: 1402466 - RNA, 20 nt, Pseudomonas aeruginosa PA01
ggcacucagccagcggcgcu

SEQ ID NO: 1402467 - RNA, 23 nt, Pseudomonas aeruginosa PA01
ggcacucagccagcggcgcuugc

SEQ ID NO: 1402468 - RNA, 21 nt, Pseudomonas aeruginosa PA01
ggcacucaggaaaaaacgccg

SEQ ID NO: 1402469 - RNA, 13 nt, Pseudomonas aeruginosa PA01
ggcacuccggcau

SEQ ID NO: 1402470 - RNA, 23 nt, Pseudomonas aeruginosa PA01
ggcacuccggcauaccgcccguc

SEQ ID NO: 1402471 - RNA, 18 nt, Pseudomonas aeruginosa PA01
ggcacucgaugaacagcg

SEQ ID NO: 1402472 - RNA, 20 nt, Pseudomonas aeruginosa PA01
ggcacucgaugaacagcgcg

SEQ ID NO: 1402473 - RNA, 19 nt, Pseudomonas aeruginosa PA01
ggcacucggcgaccacccg

SEQ ID NO: 1402474 - RNA, 17 nt, Pseudomonas aeruginosa PA01
ggcacggaagcgcugcu

SEQ ID NO: 1402475 - RNA, 23 nt, Pseudomonas aeruginosa PA01
ggcacggccagucgcguuggccg

SEQ ID NO: 1402476 - RNA, 17 nt, Pseudomonas aeruginosa PA01
ggcacgcugcuugcgca

SEQ ID NO: 1402477 - RNA, 20 nt, Pseudomonas aeruginosa PA01
ggcacgcuggcgagaauggc

SEQ ID NO: 1402478 - RNA, 15 nt, Pseudomonas aeruginosa PA01
ggcacgcugccagca

SEQ ID NO: 1402479 - RNA, 17 nt, Pseudomonas aeruginosa PA01
ggcacgcugccagcagg

SEQ ID NO: 1402480 - RNA, 21 nt, Pseudomonas aeruginosa PA01
ggcacgcugccagcaggccga

SEQ ID NO: 1402481 - RNA, 18 nt, Pseudomonas aeruginosa PA01
ggcacgcugccgccgaug

SEQ ID NO: 1402482 - RNA, 15 nt, Pseudomonas aeruginosa PA01
ggcacgcucuggccg

SEQ ID NO: 1402483 - RNA, 16 nt, Pseudomonas aeruginosa PA01
ggcacgcggaucuggc

SEQ ID NO: 1402484 - RNA, 22 nt, Pseudomonas aeruginosa PA01
ggcacgcuccagaucgccguuc

SEQ ID NO: 1402485 - RNA, 18 nt, Pseudomonas aeruginosa PA01
ggcacgcuccagggcggc

SEQ ID NO: 1402486 - RNA, 19 nt, Pseudomonas aeruginosa PA01
ggcacgcuccagggcggcc

SEQ ID NO: 1402487 - RNA, 17 nt, Pseudomonas aeruginosa PA01
ggcacggggcgccuguc

SEQ ID NO: 1402488 - RNA, 19 nt, Pseudomonas aeruginosa PA01
ggcacggcuucagcgccag

SEQ ID NO: 1402489 - RNA, 22 nt, Pseudomonas aeruginosa PA01
ggcacgguggaccaacgggcug

SEQ ID NO: 1402490 - RNA, 23 nt, Pseudomonas aeruginosa PA01
ggcacggucaggacgagcguccg

SEQ ID NO: 1402491 - RNA, 21 nt, Pseudomonas aeruginosa PA01
ggcacggucauggccagcucg

SEQ ID NO: 1402492 - RNA, 20 nt, Pseudomonas aeruginosa PA01
ggcaaucaggcgcgaucgcg

SEQ ID NO: 1402493 - RNA, 15 nt, Pseudomonas aeruginosa PA01
ggcaaucgcggggug

SEQ ID NO: 1402494 - RNA, 19 nt, Pseudomonas aeruginosa PA01
ggcaaucaucgcgucgccg

SEQ ID NO: 1402495 - RNA, 21 nt, Pseudomonas aeruginosa PA01
ggcaaucaucgcgucgccgaa

SEQ ID NO: 1402496 - RNA, 19 nt, Pseudomonas aeruginosa PA01
ggcaaucucccccucuucg

SEQ ID NO: 1402497 - RNA, 23 nt, Pseudomonas aeruginosa PA01
ggcaaugccgcccuccaucagcg

SEQ ID NO: 1402498 - RNA, 14 nt, Pseudomonas aeruginosa PA01
ggcaauggcggugu

SEQ ID NO: 1402499 - RNA, 16 nt, Pseudomonas aeruginosa PA01
ggcaaugcggcgaugg

SEQ ID NO: 1402500 - RNA, 16 nt, Pseudomonas aeruginosa PA01
ggcaauggccggcggg

SEQ ID NO: 1402501 - RNA, 17 nt, Pseudomonas aeruginosa PA01
ggcaauggccggcgggc

SEQ ID NO: 1402502 - RNA, 19 nt, Pseudomonas aeruginosa PA01
ggcaauggccggcgggcgc

SEQ ID NO: 1402503 - RNA, 17 nt, Pseudomonas aeruginosa PA01
ggcacaaaaaaggcgga

SEQ ID NO: 1402504 - RNA, 18 nt, Pseudomonas aeruginosa PA01
ggcaaggcgaucccggcg

SEQ ID NO: 1402505 - RNA, 13 nt, Pseudomonas aeruginosa PA01
ggcaaggaccugc

SEQ ID NO: 1402506 - RNA, 22 nt, Pseudomonas aeruginosa PA01
ggcaaggaccugcugcccggca

SEQ ID NO: 1402507 - RNA, 15 nt, Pseudomonas aeruginosa PA01
ggcaagcucgacgag

SEQ ID NO: 1402508 - RNA, 17 nt, Pseudomonas aeruginosa PA01
ggcaagcugaagcgccg

SEQ ID NO: 1402509 - RNA, 21 nt, Pseudomonas aeruginosa PA01
ggcaagcugaagcgccgcggc

SEQ ID NO: 1402510 - RNA, 22 nt, Pseudomonas aeruginosa PA01
ggcaagcugcacggcgacccgc

SEQ ID NO: 1402511 - RNA, 15 nt, Pseudomonas aeruginosa PA01
ggcaagugggucacg

SEQ ID NO: 1402512 - RNA, 19 nt, Pseudomonas aeruginosa PA01
ggcaaguaaugccgaaggc

SEQ ID NO: 1402513 - RNA, 22 nt, Pseudomonas aeruginosa PA01
ggcaaguaaugccgaaggcguc

SEQ ID NO: 1402514 - RNA, 16 nt, Pseudomonas aeruginosa PA01
ggcaagggccugcuca

SEQ ID NO: 1402515 - RNA, 17 nt, Pseudomonas aeruginosa PA01
ggcaagggccugcucag

SEQ ID NO: 1402516 - RNA, 19 nt, Pseudomonas aeruginosa PA01
ggcaagggccugcucagcg

SEQ ID NO: 1402517 - RNA, 21 nt, Pseudomonas aeruginosa PA01
ggcaagguaguccaucaccgc

SEQ ID NO: 1402518 - RNA, 23 nt, Pseudomonas aeruginosa PA01
ggcaagguaguccaucaccgcgg

SEQ ID NO: 1402519 - RNA, 18 nt, Pseudomonas aeruginosa PA01
ggcaagcaggccgcggua

SEQ ID NO: 1402520 - RNA, 21 nt, Pseudomonas aeruginosa PA01
ggcaagccucgcguucgcggu

SEQ ID NO: 1402521 - RNA, 23 nt, Pseudomonas aeruginosa PA01
ggcaagccuggcgcgcugcggca

SEQ ID NO: 1402522 - RNA, 12 nt, Pseudomonas aeruginosa PA01
ggcaagcgaacc

SEQ ID NO: 1402523 - RNA, 13 nt, Pseudomonas aeruginosa PA01
ggcaacggcgggc

SEQ ID NO: 1402524 - RNA, 14 nt, Pseudomonas aeruginosa PA01
ggcaacggcugggu

SEQ ID NO: 1402525 - RNA, 15 nt, Pseudomonas aeruginosa PA01
ggcaacugaucagcc

SEQ ID NO: 1402526 - RNA, 15 nt, Pseudomonas aeruginosa PA01
ggauguucgccgcca

SEQ ID NO: 1402527 - RNA, 12 nt, Pseudomonas aeruginosa PA01
ggagagcgccgu

SEQ ID NO: 1402528 - RNA, 17 nt, Pseudomonas aeruginosa PA01
ggauguuccaggcccgc

SEQ ID NO: 1402529 - RNA, 15 nt, Pseudomonas aeruginosa PA01
ggauucggccugccg

SEQ ID NO: 1402530 - RNA, 16 nt, Pseudomonas aeruginosa PA01
ggauuccgggucgagg

SEQ ID NO: 1402531 - RNA, 20 nt, Pseudomonas aeruginosa PA01
ggauucgaaccacugcgcca

SEQ ID NO: 1402532 - RNA, 15 nt, Pseudomonas aeruginosa PA01
ggagaccgugccgcc

SEQ ID NO: 1402533 - RNA, 14 nt, Pseudomonas aeruginosa PA01
ggagacggcccgcc

SEQ ID NO: 1402534 - RNA, 15 nt, Pseudomonas aeruginosa PA01
ggagagcagcagcuc

SEQ ID NO: 1402535 - RNA, 16 nt, Pseudomonas aeruginosa PA01
ggagacucagcgcgac

SEQ ID NO: 1402536 - RNA, 19 nt, Pseudomonas aeruginosa PA01
ggagacucagcgcgacagg

SEQ ID NO: 1402537 - RNA, 15 nt, Pseudomonas aeruginosa PA01
ggagagacccgccag

SEQ ID NO: 1402538 - RNA, 17 nt, Pseudomonas aeruginosa PA01
ggagagacccgccagcg

SEQ ID NO: 1402539 - RNA, 20 nt, Pseudomonas aeruginosa PA01
ggagagacccgccagcggca

SEQ ID NO: 1402540 - RNA, 23 nt, Pseudomonas aeruginosa PA01
ggagagauagagcuucucgucgc

SEQ ID NO: 1402541 - RNA, 17 nt, Pseudomonas aeruginosa PA01
ggauuuccuucggcacc

SEQ ID NO: 1402542 - RNA, 18 nt, Pseudomonas aeruginosa PA01
ggauuuccuucggcaccc

SEQ ID NO: 1402543 - RNA, 21 nt, Pseudomonas aeruginosa PA01
ggauuuccgcgcccggcuggc

SEQ ID NO: 1402544 - RNA, 15 nt, Pseudomonas aeruginosa PA01
ggauuuccgcggccg

SEQ ID NO: 1402545 - RNA, 16 nt, Pseudomonas aeruginosa PA01
ggauuuccgcggccgg

SEQ ID NO: 1402546 - RNA, 12 nt, Pseudomonas aeruginosa PA01
ggcaaagcccgc

SEQ ID NO: 1402547 - RNA, 14 nt, Pseudomonas aeruginosa PA01
ggcaaacgccgcca

SEQ ID NO: 1402548 - RNA, 19 nt, Pseudomonas aeruginosa PA01
ggcaaaggcccggcgcggu

SEQ ID NO: 1402549 - RNA, 14 nt, Pseudomonas aeruginosa PA01
ggcaaaggcgcgca

SEQ ID NO: 1402550 - RNA, 21 nt, Pseudomonas aeruginosa PA01
ggcaaaggcgcgcagggccgc

SEQ ID NO: 1402551 - RNA, 13 nt, Pseudomonas aeruginosa PA01
ggcaacaggucga

SEQ ID NO: 1402552 - RNA, 14 nt, Pseudomonas aeruginosa PA01
ggcaacccagggcg

SEQ ID NO: 1402553 - RNA, 18 nt, Pseudomonas aeruginosa PA01
ggcaacccagggcgcugc

SEQ ID NO: 1402554 - RNA, 19 nt, Pseudomonas aeruginosa PA01
ggcaacccagggcgcugcc

SEQ ID NO: 1402555 - RNA, 13 nt, Pseudomonas aeruginosa PA01
ggcaaccgcggcg

SEQ ID NO: 1402556 - RNA, 15 nt, Pseudomonas aeruginosa PA01
ggcaaccgcggcggc

SEQ ID NO: 1402557 - RNA, 16 nt, Pseudomonas aeruginosa PA01
ggcaaccgcggcggcc

SEQ ID NO: 1402558 - RNA, 22 nt, Pseudomonas aeruginosa PA01
ggcaaccgggcgggacucgccg

SEQ ID NO: 1402559 - RNA, 19 nt, Pseudomonas aeruginosa PA01
ggcaacgaacuucagggcu

SEQ ID NO: 1402560 - RNA, 16 nt, Pseudomonas aeruginosa PA01
ggcaacgccaggccgc

SEQ ID NO: 1402561 - RNA, 17 nt, Pseudomonas aeruginosa PA01
ggcaacgccaggccgcu

SEQ ID NO: 1402562 - RNA, 17 nt, Pseudomonas aeruginosa PA01
ggcaacgcgcagaggcg

SEQ ID NO: 1402563 - RNA, 19 nt, Pseudomonas aeruginosa PA01
ggcaacgcgcagaggcgcu

SEQ ID NO: 1402564 - RNA, 20 nt, Pseudomonas aeruginosa PA01
ggcaacgauucgacgcagcg

SEQ ID NO: 1402565 - RNA, 23 nt, Pseudomonas aeruginosa PA01
ggcaacgagcaggacugcccgcg

SEQ ID NO: 1402566 - RNA, 17 nt, Pseudomonas aeruginosa PA01
ggcaacgauaccgccgc

SEQ ID NO: 1402567 - RNA, 18 nt, Pseudomonas aeruginosa PA01
ggcaacgauaccgccgcc

SEQ ID NO: 1402568 - RNA, 23 nt, Pseudomonas aeruginosa PA01
ggcaaccuugcacauccagcccu

SEQ ID NO: 1402569 - RNA, 20 nt, Pseudomonas aeruginosa PA01
ggcaacgacgaggccuggau

SEQ ID NO: 1402570 - RNA, 14 nt, Pseudomonas aeruginosa PA01
ggcaacgacggcaa

SEQ ID NO: 1402571 - RNA, 15 nt, Pseudomonas aeruginosa PA01
ggccgcauccgcggc

SEQ ID NO: 1402572 - RNA, 16 nt, Pseudomonas aeruginosa PA01
ggccgcaucgcgggcg

SEQ ID NO: 1402573 - RNA, 20 nt, Pseudomonas aeruginosa PA01
ggccgcaucgcgggcgugcu

SEQ ID NO: 1402574 - RNA, 11 nt, Pseudomonas aeruginosa PA01
ggccgccagcc

SEQ ID NO: 1402575 - RNA, 14 nt, Pseudomonas aeruginosa PA01
ggccgccagcaggc

SEQ ID NO: 1402576 - RNA, 15 nt, Pseudomonas aeruginosa PA01
ggccgccacggcggu

SEQ ID NO: 1402577 - RNA, 23 nt, Pseudomonas aeruginosa PA01
ggccgccacggcgguuucgucga

SEQ ID NO: 1402578 - RNA, 14 nt, Pseudomonas aeruginosa PA01
ggccgcagcggcug

SEQ ID NO: 1402579 - RNA, 13 nt, Pseudomonas aeruginosa PA01
ggccgcaggcagc

SEQ ID NO: 1402580 - RNA, 20 nt, Pseudomonas aeruginosa PA01
ggccgcagguuggccccgcc

SEQ ID NO: 1402581 - RNA, 16 nt, Pseudomonas aeruginosa PA01
ggccgcagcagcggca

SEQ ID NO: 1402582 - RNA, 12 nt, Pseudomonas aeruginosa PA01
ggccgcagcgca

SEQ ID NO: 1402583 - RNA, 19 nt, Pseudomonas aeruginosa PA01
ggccgcagcgcagccgauc

SEQ ID NO: 1402584 - RNA, 20 nt, Pseudomonas aeruginosa PA01
ggccgcagcgcagccgaucg

SEQ ID NO: 1402585 - RNA, 20 nt, Pseudomonas aeruginosa PA01
ggccgacgauguucgaggcg

SEQ ID NO: 1402586 - RNA, 23 nt, Pseudomonas aeruginosa PA01
ggccgacgauguucgaggcgccg

SEQ ID NO: 1402587 - RNA, 23 nt, Pseudomonas aeruginosa PA01
ggccgacgauguuguugcccacc

SEQ ID NO: 1402588 - RNA, 16 nt, Pseudomonas aeruginosa PA01
ggccgacgaagaccuu

SEQ ID NO: 1402589 - RNA, 18 nt, Pseudomonas aeruginosa PA01
ggccgacgaaggccgcgg

SEQ ID NO: 1402590 - RNA, 22 nt, Pseudomonas aeruginosa PA01
ggccgacgaaggccgcggucgg

SEQ ID NO: 1402591 - RNA, 13 nt, Pseudomonas aeruginosa PA01
ggccgacgcuucc

SEQ ID NO: 1402592 - RNA, 19 nt, Pseudomonas aeruginosa PA01
ggccgaucaucaucaggua

SEQ ID NO: 1402593 - RNA, 16 nt, Pseudomonas aeruginosa PA01
ggccgaucaucggcug

SEQ ID NO: 1402594 - RNA, 18 nt, Pseudomonas aeruginosa PA01
ggccgaucagcuuggccu

SEQ ID NO: 1402595 - RNA, 13 nt, Pseudomonas aeruginosa PA01
ggccgaucaggaa

SEQ ID NO: 1402596 - RNA, 20 nt, Pseudomonas aeruginosa PA01
ggccgaugaucuccgcgccg

SEQ ID NO: 1402597 - RNA, 14 nt, Pseudomonas aeruginosa PA01
ggccgaugccgacc

SEQ ID NO: 1402598 - RNA, 16 nt, Pseudomonas aeruginosa PA01
ggccgaugccgaccuu

SEQ ID NO: 1402599 - RNA, 15 nt, Pseudomonas aeruginosa PA01
ggccgaugcgcaacg

SEQ ID NO: 1402600 - RNA, 13 nt, Pseudomonas aeruginosa PA01
ggccgaugcgcga

SEQ ID NO: 1402601 - RNA, 14 nt, Pseudomonas aeruginosa PA01
ggccgaugaacgcc

SEQ ID NO: 1402602 - RNA, 17 nt, Pseudomonas aeruginosa PA01
ggccgaucuucagcagc

SEQ ID NO: 1402603 - RNA, 18 nt, Pseudomonas aeruginosa PA01
ggccgaucuucagcagca

SEQ ID NO: 1402604 - RNA, 15 nt, Pseudomonas aeruginosa PA01
ggccgaucuucgccg

SEQ ID NO: 1402605 - RNA, 17 nt, Pseudomonas aeruginosa PA01
ggccgaucuucgccgac

SEQ ID NO: 1402606 - RNA, 18 nt, Pseudomonas aeruginosa PA01
ggccgaucuucgccgaca

SEQ ID NO: 1402607 - RNA, 15 nt, Pseudomonas aeruginosa PA01
ggccgaucgagcggc

SEQ ID NO: 1402608 - RNA, 17 nt, Pseudomonas aeruginosa PA01
ggccgaucuccuggcgg

SEQ ID NO: 1402609 - RNA, 21 nt, Pseudomonas aeruginosa PA01
ggccgaucucgugggccagca

SEQ ID NO: 1402610 - RNA, 18 nt, Pseudomonas aeruginosa PA01
ggccgauguucaggccgg

SEQ ID NO: 1402611 - RNA, 13 nt, Pseudomonas aeruginosa PA01
ggccgcaaccagc

SEQ ID NO: 1402612 - RNA, 20 nt, Pseudomonas aeruginosa PA01
ggccgcaaccagcccuggcg

SEQ ID NO: 1402613 - RNA, 22 nt, Pseudomonas aeruginosa PA01
ggccgcaaccagcccuggcgca

SEQ ID NO: 1402614 - RNA, 23 nt, Pseudomonas aeruginosa PA01
ggccgcaaccagcccuggcgcag

SEQ ID NO: 1402615 - RNA, 15 nt, Pseudomonas aeruginosa PA01
ggccgcaagcgguau

SEQ ID NO: 1402616 - RNA, 19 nt, Pseudomonas aeruginosa PA01
ggccgcaaguaccgccggc

SEQ ID NO: 1402617 - RNA, 20 nt, Pseudomonas aeruginosa PA01
ggccgcaaguaccgccggca

SEQ ID NO: 1402618 - RNA, 17 nt, Pseudomonas aeruginosa PA01
ggccgauuucgaugacg

SEQ ID NO: 1402619 - RNA, 13 nt, Pseudomonas aeruginosa PA01
ggccgccgcgcag

SEQ ID NO: 1402620 - RNA, 14 nt, Pseudomonas aeruginosa PA01
ggccgccgcgcagc

SEQ ID NO: 1402621 - RNA, 17 nt, Pseudomonas aeruginosa PA01
ggccgccgcgcagcacc

SEQ ID NO: 1402622 - RNA, 18 nt, Pseudomonas aeruginosa PA01
ggccgccgcgcagcacca

SEQ ID NO: 1402623 - RNA, 19 nt, Pseudomonas aeruginosa PA01
ggccgccgccugcucgccg

SEQ ID NO: 1402624 - RNA, 15 nt, Pseudomonas aeruginosa PA01
ggccgccgcgugccg

SEQ ID NO: 1402625 - RNA, 16 nt, Pseudomonas aeruginosa PA01
ggccgccgcgugccgc

SEQ ID NO: 1402626 - RNA, 20 nt, Pseudomonas aeruginosa PA01
ggccgccgcgggcaaccgcg

SEQ ID NO: 1402627 - RNA, 13 nt, Pseudomonas aeruginosa PA01
ggccgccggcgac

SEQ ID NO: 1402628 - RNA, 14 nt, Pseudomonas aeruginosa PA01
ggccgccggcgacc

SEQ ID NO: 1402629 - RNA, 16 nt, Pseudomonas aeruginosa PA01
ggccgccggcgaccgc

SEQ ID NO: 1402630 - RNA, 21 nt, Pseudomonas aeruginosa PA01
ggccgccggcgaccgcgcgca

SEQ ID NO: 1402631 - RNA, 14 nt, Pseudomonas aeruginosa PA01
ggccgccggcgccc

SEQ ID NO: 1402632 - RNA, 17 nt, Pseudomonas aeruginosa PA01
ggccgccggcgcccugc

SEQ ID NO: 1402633 - RNA, 18 nt, Pseudomonas aeruginosa PA01
ggccgccucgcgccgcgc

SEQ ID NO: 1402634 - RNA, 17 nt, Pseudomonas aeruginosa PA01
ggccgccuuccucggcc

SEQ ID NO: 1402635 - RNA, 20 nt, Pseudomonas aeruginosa PA01
ggccgccuuccucggccgcc

SEQ ID NO: 1402636 - RNA, 22 nt, Pseudomonas aeruginosa PA01
ggccgccuuccucggccgccag

SEQ ID NO: 1402637 - RNA, 14 nt, Pseudomonas aeruginosa PA01
ggccgccuggccgg

SEQ ID NO: 1402638 - RNA, 15 nt, Pseudomonas aeruginosa PA01
ggccgccuggccggc

SEQ ID NO: 1402639 - RNA, 16 nt, Pseudomonas aeruginosa PA01
ggccgccuggccggcc

SEQ ID NO: 1402640 - RNA, 22 nt, Pseudomonas aeruginosa PA01
ggccgccuggccggccagccag

SEQ ID NO: 1402641 - RNA, 12 nt, Pseudomonas aeruginosa PA01
ggccgccuggcg

SEQ ID NO: 1402642 - RNA, 14 nt, Pseudomonas aeruginosa PA01
ggccgccuggcgca

SEQ ID NO: 1402643 - RNA, 13 nt, Pseudomonas aeruginosa PA01
ggccgccuggcgu

SEQ ID NO: 1402644 - RNA, 21 nt, Pseudomonas aeruginosa PA01
ggccgccuggcgugccgccag

SEQ ID NO: 1402645 - RNA, 21 nt, Pseudomonas aeruginosa PA01
ggccgccuggucggggccggc

SEQ ID NO: 1402646 - RNA, 22 nt, Pseudomonas aeruginosa PA01
ggccgccuggucggggccggcg

SEQ ID NO: 1402647 - RNA, 18 nt, Pseudomonas aeruginosa PA01
ggccgcccgagccgcugc

SEQ ID NO: 1402648 - RNA, 19 nt, Pseudomonas aeruginosa PA01
ggccgcccuugcggcccgc

SEQ ID NO: 1402649 - RNA, 20 nt, Pseudomonas aeruginosa PA01
ggccgccgaagaacucggcg

SEQ ID NO: 1402650 - RNA, 21 nt, Pseudomonas aeruginosa PA01
ggccgccgaagaacucggcgc

SEQ ID NO: 1402651 - RNA, 22 nt, Pseudomonas aeruginosa PA01
ggccgccgaagaacucggcgcu

SEQ ID NO: 1402652 - RNA, 15 nt, Pseudomonas aeruginosa PA01
ggccgccgaggucag

SEQ ID NO: 1402653 - RNA, 21 nt, Pseudomonas aeruginosa PA01
ggccgccgccgacaggucgcu

SEQ ID NO: 1402654 - RNA, 16 nt, Pseudomonas aeruginosa PA01
ggccgccgccgccguc

SEQ ID NO: 1402655 - RNA, 15 nt, Pseudomonas aeruginosa PA01
ggccgccagccgcca

SEQ ID NO: 1402656 - RNA, 19 nt, Pseudomonas aeruginosa PA01
ggccgccagccgccaggac

SEQ ID NO: 1402657 - RNA, 15 nt, Pseudomonas aeruginosa PA01
ggccgccaggcgcgu

SEQ ID NO: 1402658 - RNA, 16 nt, Pseudomonas aeruginosa PA01
ggccgccagggcgucg

SEQ ID NO: 1402659 - RNA, 14 nt, Pseudomonas aeruginosa PA01
ggccgccaggguca

SEQ ID NO: 1402660 - RNA, 23 nt, Pseudomonas aeruginosa PA01
ggccgcccaggacaacgacagcc

SEQ ID NO: 1402661 - RNA, 20 nt, Pseudomonas aeruginosa PA01
ggccgcccagcgcagccugc

SEQ ID NO: 1402662 - RNA, 19 nt, Pseudomonas aeruginosa PA01
ggccgccaugcucggccag

SEQ ID NO: 1402663 - RNA, 23 nt, Pseudomonas aeruginosa PA01
ggccgccaugcucggccagcucg

SEQ ID NO: 1402664 - RNA, 18 nt, Pseudomonas aeruginosa PA01
ggccgccauuccggaacu

SEQ ID NO: 1402665 - RNA, 15 nt, Pseudomonas aeruginosa PA01
ggccaggccggcgcc

SEQ ID NO: 1402666 - RNA, 16 nt, Pseudomonas aeruginosa PA01
ggccaggccggcgccu

SEQ ID NO: 1402667 - RNA, 20 nt, Pseudomonas aeruginosa PA01
ggccaggcgcaccagcaggc

SEQ ID NO: 1402668 - RNA, 12 nt, Pseudomonas aeruginosa PA01
ggccaggccgcc

SEQ ID NO: 1402669 - RNA, 17 nt, Pseudomonas aeruginosa PA01
ggccaggcgcagugccu

SEQ ID NO: 1402670 - RNA, 15 nt, Pseudomonas aeruginosa PA01
ggccaggcgccaggu

SEQ ID NO: 1402671 - RNA, 23 nt, Pseudomonas aeruginosa PA01
ggccaggcgccagguagugccgc

SEQ ID NO: 1402672 - RNA, 14 nt, Pseudomonas aeruginosa PA01
ggccaggcgcuccu

SEQ ID NO: 1402673 - RNA, 13 nt, Pseudomonas aeruginosa PA01
ggccaggcgcggc

SEQ ID NO: 1402674 - RNA, 16 nt, Pseudomonas aeruginosa PA01
ggccaggcgcggcgcc

SEQ ID NO: 1402675 - RNA, 15 nt, Pseudomonas aeruginosa PA01
ggccaggcgcgacag

SEQ ID NO: 1402676 - RNA, 17 nt, Pseudomonas aeruginosa PA01
ggccaggcccuugguca

SEQ ID NO: 1402677 - RNA, 18 nt, Pseudomonas aeruginosa PA01
ggccaggcccuuggucag

SEQ ID NO: 1402678 - RNA, 23 nt, Pseudomonas aeruginosa PA01
ggccaggcccuuggucaggccga

SEQ ID NO: 1402679 - RNA, 12 nt, Pseudomonas aeruginosa PA01
ggccaggccgag

SEQ ID NO: 1402680 - RNA, 14 nt, Pseudomonas aeruginosa PA01
ggccaggccgagca

SEQ ID NO: 1402681 - RNA, 14 nt, Pseudomonas aeruginosa PA01
ggccaggccgagcg

SEQ ID NO: 1402682 - RNA, 17 nt, Pseudomonas aeruginosa PA01
ggccaggccgagcgcca

SEQ ID NO: 1402683 - RNA, 16 nt, Pseudomonas aeruginosa PA01
ggccaggccgagcgcg

SEQ ID NO: 1402684 - RNA, 17 nt, Pseudomonas aeruginosa PA01
ggccaggccgagcgcgc

SEQ ID NO: 1402685 - RNA, 18 nt, Pseudomonas aeruginosa PA01
ggccaggccgagcgcgcc

SEQ ID NO: 1402686 - RNA, 20 nt, Pseudomonas aeruginosa PA01
ggccaggaucgucggcccgc

SEQ ID NO: 1402687 - RNA, 18 nt, Pseudomonas aeruginosa PA01
ggccaggccccagggccg

SEQ ID NO: 1402688 - RNA, 22 nt, Pseudomonas aeruginosa PA01
ggccaggcccucagcggcggug

SEQ ID NO: 1402689 - RNA, 18 nt, Pseudomonas aeruginosa PA01
ggccaggauguucgccga

SEQ ID NO: 1402690 - RNA, 20 nt, Pseudomonas aeruginosa PA01
ggccaggauguucgccgagg

SEQ ID NO: 1402691 - RNA, 18 nt, Pseudomonas aeruginosa PA01
ggccaggcauccagcacc

SEQ ID NO: 1402692 - RNA, 19 nt, Pseudomonas aeruginosa PA01
ggccaggcauccagcaccg

SEQ ID NO: 1402693 - RNA, 22 nt, Pseudomonas aeruginosa PA01
ggccaggcauuccuccaggguc

SEQ ID NO: 1402694 - RNA, 16 nt, Pseudomonas aeruginosa PA01
ggccaggccacggccg

SEQ ID NO: 1402695 - RNA, 17 nt, Pseudomonas aeruginosa PA01
ggccaggccacggcgga

SEQ ID NO: 1402696 - RNA, 20 nt, Pseudomonas aeruginosa PA01
ggcccagcguucggcgcugg

SEQ ID NO: 1402697 - RNA, 12 nt, Pseudomonas aeruginosa PA01
ggcccagcggca

SEQ ID NO: 1402698 - RNA, 20 nt, Pseudomonas aeruginosa PA01
ggcccagcgccccgccuacc

SEQ ID NO: 1402699 - RNA, 12 nt, Pseudomonas aeruginosa PA01
ggcccagcgccc

SEQ ID NO: 1402700 - RNA, 16 nt, Pseudomonas aeruginosa PA01
ggcccagcgacuccgc

SEQ ID NO: 1402701 - RNA, 19 nt, Pseudomonas aeruginosa PA01
ggcccagcgacuccgccag

SEQ ID NO: 1402702 - RNA, 12 nt, Pseudomonas aeruginosa PA01
ggcccaggccgg

SEQ ID NO: 1402703 - RNA, 14 nt, Pseudomonas aeruginosa PA01
ggcccaggcuggcg

SEQ ID NO: 1402704 - RNA, 20 nt, Pseudomonas aeruginosa PA01
ggcccaugccuccgacgauc

SEQ ID NO: 1402705 - RNA, 12 nt, Pseudomonas aeruginosa PA01
ggcccauggcga

SEQ ID NO: 1402706 - RNA, 12 nt, Pseudomonas aeruginosa PA01
ggccccaccagc

SEQ ID NO: 1402707 - RNA, 19 nt, Pseudomonas aeruginosa PA01
ggccccgccgaggaagccg

SEQ ID NO: 1402708 - RNA, 19 nt, Pseudomonas aeruginosa PA01
ggccccaccgcacuggugg

SEQ ID NO: 1402709 - RNA, 19 nt, Pseudomonas aeruginosa PA01
ggcccaugauggucggcac

SEQ ID NO: 1402710 - RNA, 20 nt, Pseudomonas aeruginosa PA01
ggcccaugauggucggcacg

SEQ ID NO: 1402711 - RNA, 23 nt, Pseudomonas aeruginosa PA01
ggcccaguucgcguagccccucg

SEQ ID NO: 1402712 - RNA, 19 nt, Pseudomonas aeruginosa PA01
ggcccaguucgcugccgcc

SEQ ID NO: 1402713 - RNA, 15 nt, Pseudomonas aeruginosa PA01
ggcccauccgccgca

SEQ ID NO: 1402714 - RNA, 21 nt, Pseudomonas aeruginosa PA01
ggcccgcaaucagcgggccuu

SEQ ID NO: 1402715 - RNA, 13 nt, Pseudomonas aeruginosa PA01
ggcccgcacaggu

SEQ ID NO: 1402716 - RNA, 13 nt, Pseudomonas aeruginosa PA01
ggccccggccagg

SEQ ID NO: 1402717 - RNA, 16 nt, Pseudomonas aeruginosa PA01
ggccccggccagguac

SEQ ID NO: 1402718 - RNA, 22 nt, Pseudomonas aeruginosa PA01
ggccccggccagguacuggcga

SEQ ID NO: 1402719 - RNA, 23 nt, Pseudomonas aeruginosa PA01
ggccccggccagguacuggcgau

SEQ ID NO: 1402720 - RNA, 18 nt, Pseudomonas aeruginosa PA01
ggccccggcaagggccug

SEQ ID NO: 1402721 - RNA, 23 nt, Pseudomonas aeruginosa PA01
ggccccggcaagggccugcucag

SEQ ID NO: 1402722 - RNA, 14 nt, Pseudomonas aeruginosa PA01
ggcccgagggcggc

SEQ ID NO: 1402723 - RNA, 17 nt, Pseudomonas aeruginosa PA01
ggcccgagggucgccuu

SEQ ID NO: 1402724 - RNA, 21 nt, Pseudomonas aeruginosa PA01
ggcccgagcaggcugccgaag

SEQ ID NO: 1402725 - RNA, 17 nt, Pseudomonas aeruginosa PA01
ggcccgacggugcggcc

SEQ ID NO: 1402726 - RNA, 14 nt, Pseudomonas aeruginosa PA01
ggcccgacgccgcc

SEQ ID NO: 1402727 - RNA, 14 nt, Pseudomonas aeruginosa PA01
ggccccggccggca

SEQ ID NO: 1402728 - RNA, 15 nt, Pseudomonas aeruginosa PA01
ggccccggccggcag

SEQ ID NO: 1402729 - RNA, 14 nt, Pseudomonas aeruginosa PA01
ggcccgcggaucgc

SEQ ID NO: 1402730 - RNA, 12 nt, Pseudomonas aeruginosa PA01
ggcccgcucuug

SEQ ID NO: 1402731 - RNA, 13 nt, Pseudomonas aeruginosa PA01
ggcccgggcgcca

SEQ ID NO: 1402732 - RNA, 15 nt, Pseudomonas aeruginosa PA01
ggcccgggcgccacc

SEQ ID NO: 1402733 - RNA, 18 nt, Pseudomonas aeruginosa PA01
ggcccggcguuucgccgg

SEQ ID NO: 1402734 - RNA, 13 nt, Pseudomonas aeruginosa PA01
ggcccggcgugag

SEQ ID NO: 1402735 - RNA, 14 nt, Pseudomonas aeruginosa PA01
ggcccggcgugagc

SEQ ID NO: 1402736 - RNA, 14 nt, Pseudomonas aeruginosa PA01
ggcccggcgugccg

SEQ ID NO: 1402737 - RNA, 17 nt, Pseudomonas aeruginosa PA01
ggcccgggccuggugca

SEQ ID NO: 1402738 - RNA, 21 nt, Pseudomonas aeruginosa PA01
ggcccggggcucugccggugu

SEQ ID NO: 1402739 - RNA, 13 nt, Pseudomonas aeruginosa PA01
ggcccggucagcu

SEQ ID NO: 1402740 - RNA, 19 nt, Pseudomonas aeruginosa PA01
ggcccggucagcuucgccg

SEQ ID NO: 1402741 - RNA, 21 nt, Pseudomonas aeruginosa PA01
ggcccggucagcuucgccgcc

SEQ ID NO: 1402742 - RNA, 14 nt, Pseudomonas aeruginosa PA01
ggcccuggcggcga

SEQ ID NO: 1402743 - RNA, 21 nt, Pseudomonas aeruginosa PA01
ggcccuguacauagcggguca

SEQ ID NO: 1402744 - RNA, 12 nt, Pseudomonas aeruginosa PA01
ggcccugggccc

SEQ ID NO: 1402745 - RNA, 15 nt, Pseudomonas aeruginosa PA01
ggcccugggcggcga

SEQ ID NO: 1402746 - RNA, 17 nt, Pseudomonas aeruginosa PA01
ggcccugggcggcgacc

SEQ ID NO: 1402747 - RNA, 18 nt, Pseudomonas aeruginosa PA01
ggcccugggcggcgaccu

SEQ ID NO: 1402748 - RNA, 17 nt, Pseudomonas aeruginosa PA01
ggcccugcucgccggcg

SEQ ID NO: 1402749 - RNA, 21 nt, Pseudomonas aeruginosa PA01
ggcccuggauaucugggccau

SEQ ID NO: 1402750 - RNA, 23 nt, Pseudomonas aeruginosa PA01
ggcccuggauaucugggccaucg

SEQ ID NO: 1402751 - RNA, 16 nt, Pseudomonas aeruginosa PA01
ggcccuggaucaccgc

SEQ ID NO: 1402752 - RNA, 19 nt, Pseudomonas aeruginosa PA01
ggcccuggaucaccgcggc

SEQ ID NO: 1402753 - RNA, 22 nt, Pseudomonas aeruginosa PA01
ggcccuggaucaccgcggcgcu

SEQ ID NO: 1402754 - RNA, 13 nt, Pseudomonas aeruginosa PA01
ggcccugcgccgc

SEQ ID NO: 1402755 - RNA, 22 nt, Pseudomonas aeruginosa PA01
ggcccugccacuugcgggugcg

SEQ ID NO: 1402756 - RNA, 17 nt, Pseudomonas aeruginosa PA01
ggccgaaaucgaugucg

SEQ ID NO: 1402757 - RNA, 20 nt, Pseudomonas aeruginosa PA01
ggccgaaagcacugcggcgg

SEQ ID NO: 1402758 - RNA, 16 nt, Pseudomonas aeruginosa PA01
ggccgaaauggcggug

SEQ ID NO: 1402759 - RNA, 23 nt, Pseudomonas aeruginosa PA01
ggccgaaauggcgguggccgugg

SEQ ID NO: 1402760 - RNA, 20 nt, Pseudomonas aeruginosa PA01
ggccgaaauugaccagguac

SEQ ID NO: 1402761 - RNA, 18 nt, Pseudomonas aeruginosa PA01
ggccgaagaacaccacgc

SEQ ID NO: 1402762 - RNA, 19 nt, Pseudomonas aeruginosa PA01
ggccgaacagacgcaggca

SEQ ID NO: 1402763 - RNA, 18 nt, Pseudomonas aeruginosa PA01
ggcccuuuuccaccggcc

SEQ ID NO: 1402764 - RNA, 19 nt, Pseudomonas aeruginosa PA01
ggcccuuuuccaccggccg

SEQ ID NO: 1402765 - RNA, 21 nt, Pseudomonas aeruginosa PA01
ggcccuuuuccaccggccgcg

SEQ ID NO: 1402766 - RNA, 17 nt, Pseudomonas aeruginosa PA01
ggcccugcuccuccagg

SEQ ID NO: 1402767 - RNA, 19 nt, Pseudomonas aeruginosa PA01
ggcccuucacgagaccacc

SEQ ID NO: 1402768 - RNA, 20 nt, Pseudomonas aeruginosa PA01
ggcccuugaacaggcuggcg

SEQ ID NO: 1402769 - RNA, 21 nt, Pseudomonas aeruginosa PA01
ggcccuuggucaggccgacca

SEQ ID NO: 1402770 - RNA, 17 nt, Pseudomonas aeruginosa PA01
ggcccuugucgccgcug

SEQ ID NO: 1402771 - RNA, 16 nt, Pseudomonas aeruginosa PA01
ggccgaccugcccgcu

SEQ ID NO: 1402772 - RNA, 15 nt, Pseudomonas aeruginosa PA01
ggccgaccuugucca

SEQ ID NO: 1402773 - RNA, 17 nt, Pseudomonas aeruginosa PA01
ggccgacgaacagccag

SEQ ID NO: 1402774 - RNA, 16 nt, Pseudomonas aeruginosa PA01
ggccgaccucggcggu

SEQ ID NO: 1402775 - RNA, 18 nt, Pseudomonas aeruginosa PA01
ggccgaccucggcgguca

SEQ ID NO: 1402776 - RNA, 15 nt, Pseudomonas aeruginosa PA01
ggccgaccgccaggc

SEQ ID NO: 1402777 - RNA, 18 nt, Pseudomonas aeruginosa PA01
ggccgacccgugcgccgc

SEQ ID NO: 1402778 - RNA, 19 nt, Pseudomonas aeruginosa PA01
ggccgacccgugcgccgcg

SEQ ID NO: 1402779 - RNA, 13 nt, Pseudomonas aeruginosa PA01
ggccgacccgcag

SEQ ID NO: 1402780 - RNA, 20 nt, Pseudomonas aeruginosa PA01
ggccgacccgcagcggcgcu

SEQ ID NO: 1402781 - RNA, 18 nt, Pseudomonas aeruginosa PA01
ggccgacccgcaggccgg

SEQ ID NO: 1402782 - RNA, 20 nt, Pseudomonas aeruginosa PA01
ggccgacccgcaggccggcc

SEQ ID NO: 1402783 - RNA, 22 nt, Pseudomonas aeruginosa PA01
ggccgacccgcaggccggccag

SEQ ID NO: 1402784 - RNA, 13 nt, Pseudomonas aeruginosa PA01
ggccgaaggccug

SEQ ID NO: 1402785 - RNA, 18 nt, Pseudomonas aeruginosa PA01
ggccgaaggccuggccgu

SEQ ID NO: 1402786 - RNA, 15 nt, Pseudomonas aeruginosa PA01
ggccgaauccgccgg

SEQ ID NO: 1402787 - RNA, 19 nt, Pseudomonas aeruginosa PA01
ggccgaauccgccggcgau

SEQ ID NO: 1402788 - RNA, 18 nt, Pseudomonas aeruginosa PA01
ggccgaauccuccagccg

SEQ ID NO: 1402789 - RNA, 20 nt, Pseudomonas aeruginosa PA01
ggccgaauccuccagccggc

SEQ ID NO: 1402790 - RNA, 22 nt, Pseudomonas aeruginosa PA01
ggccgaauccuccagccggcga

SEQ ID NO: 1402791 - RNA, 14 nt, Pseudomonas aeruginosa PA01
ggccgaagccgccg

SEQ ID NO: 1402792 - RNA, 17 nt, Pseudomonas aeruginosa PA01
ggccgaagccgccggga

SEQ ID NO: 1402793 - RNA, 18 nt, Pseudomonas aeruginosa PA01
ggccgaagccgccgggaa

SEQ ID NO: 1402794 - RNA, 13 nt, Pseudomonas aeruginosa PA01
ggccgaaggccag

SEQ ID NO: 1402795 - RNA, 16 nt, Pseudomonas aeruginosa PA01
ggccgaaggccaggac

SEQ ID NO: 1402796 - RNA, 17 nt, Pseudomonas aeruginosa PA01
ggccgaaggccaggacc

SEQ ID NO: 1402797 - RNA, 20 nt, Pseudomonas aeruginosa PA01
ggccgaaggccaggaccgcg

SEQ ID NO: 1402798 - RNA, 18 nt, Pseudomonas aeruginosa PA01
ggccgaaggccaggccgg

SEQ ID NO: 1402799 - RNA, 18 nt, Pseudomonas aeruginosa PA01
ggccgaagcgugggcggc

SEQ ID NO: 1402800 - RNA, 19 nt, Pseudomonas aeruginosa PA01
ggccgaagcgugggcggcc

SEQ ID NO: 1402801 - RNA, 21 nt, Pseudomonas aeruginosa PA01
ggccgaagcgugggcggccgg

SEQ ID NO: 1402802 - RNA, 23 nt, Pseudomonas aeruginosa PA01
ggccgaagcgugggcggccggcc

SEQ ID NO: 1402803 - RNA, 15 nt, Pseudomonas aeruginosa PA01
ggccgccugcucggc

SEQ ID NO: 1402804 - RNA, 16 nt, Pseudomonas aeruginosa PA01
ggccgcgagcgcggcc

SEQ ID NO: 1402805 - RNA, 19 nt, Pseudomonas aeruginosa PA01
ggccgcgagcgcggccggc

SEQ ID NO: 1402806 - RNA, 20 nt, Pseudomonas aeruginosa PA01
ggccgcgagcgcggccggcc

SEQ ID NO: 1402807 - RNA, 14 nt, Pseudomonas aeruginosa PA01
ggccgcgcagcaac

SEQ ID NO: 1402808 - RNA, 13 nt, Pseudomonas aeruginosa PA01
ggccgcgcagauc

SEQ ID NO: 1402809 - RNA, 19 nt, Pseudomonas aeruginosa PA01
ggccgcuuacgcggccuuu

SEQ ID NO: 1402810 - RNA, 16 nt, Pseudomonas aeruginosa PA01
ggccgcuucaagcggc

SEQ ID NO: 1402811 - RNA, 17 nt, Pseudomonas aeruginosa PA01
ggccgcuucaagcggcc

SEQ ID NO: 1402812 - RNA, 17 nt, Pseudomonas aeruginosa PA01
ggccgcugucgucuucg

SEQ ID NO: 1402813 - RNA, 22 nt, Pseudomonas aeruginosa PA01
ggccgcuuccggcccggccagg

SEQ ID NO: 1402814 - RNA, 15 nt, Pseudomonas aeruginosa PA01
ggccgcuucgccgcc

SEQ ID NO: 1402815 - RNA, 12 nt, Pseudomonas aeruginosa PA01
ggccgcuggcga

SEQ ID NO: 1402816 - RNA, 13 nt, Pseudomonas aeruginosa PA01
ggccgcuggcgac

SEQ ID NO: 1402817 - RNA, 13 nt, Pseudomonas aeruginosa PA01
ggccgcuggcgau

SEQ ID NO: 1402818 - RNA, 16 nt, Pseudomonas aeruginosa PA01
ggccgcuggcgaucuc

SEQ ID NO: 1402819 - RNA, 13 nt, Pseudomonas aeruginosa PA01
ggccgcuggcggc

SEQ ID NO: 1402820 - RNA, 17 nt, Pseudomonas aeruginosa PA01
ggccgcuggaugccgac

SEQ ID NO: 1402821 - RNA, 18 nt, Pseudomonas aeruginosa PA01
ggccgcuggaugccgacc

SEQ ID NO: 1402822 - RNA, 19 nt, Pseudomonas aeruginosa PA01
ggccgcuggaugccgacca

SEQ ID NO: 1402823 - RNA, 22 nt, Pseudomonas aeruginosa PA01
ggccgcgcaggaagaaggcguc

SEQ ID NO: 1402824 - RNA, 14 nt, Pseudomonas aeruginosa PA01
ggccgcugccgccg

SEQ ID NO: 1402825 - RNA, 17 nt, Pseudomonas aeruginosa PA01
ggccgcugccgccgcgc

SEQ ID NO: 1402826 - RNA, 20 nt, Pseudomonas aeruginosa PA01
ggccgcugccgccgcgcagg

SEQ ID NO: 1402827 - RNA, 18 nt, Pseudomonas aeruginosa PA01
ggccgcugccgcucuggc

SEQ ID NO: 1402828 - RNA, 14 nt, Pseudomonas aeruginosa PA01
ggccgcugccguug

SEQ ID NO: 1402829 - RNA, 21 nt, Pseudomonas aeruginosa PA01
ggccgcugccguugcaggccc

SEQ ID NO: 1402830 - RNA, 19 nt, Pseudomonas aeruginosa PA01
ggccgcugccugucgcagc

SEQ ID NO: 1402831 - RNA, 13 nt, Pseudomonas aeruginosa PA01
ggccgcugcgcag

SEQ ID NO: 1402832 - RNA, 14 nt, Pseudomonas aeruginosa PA01
ggccgcugcgcagg

SEQ ID NO: 1402833 - RNA, 12 nt, Pseudomonas aeruginosa PA01
ggccgcucuucu

SEQ ID NO: 1402834 - RNA, 20 nt, Pseudomonas aeruginosa PA01
ggccgcucuucugguaggcc

SEQ ID NO: 1402835 - RNA, 22 nt, Pseudomonas aeruginosa PA01
ggccgcucuucugguaggccag

SEQ ID NO: 1402836 - RNA, 17 nt, Pseudomonas aeruginosa PA01
ggccgcugaaauagcgc

SEQ ID NO: 1402837 - RNA, 19 nt, Pseudomonas aeruginosa PA01
ggccggcacccugaccgcg

SEQ ID NO: 1402838 - RNA, 17 nt, Pseudomonas aeruginosa PA01
ggccggcagcagcgcca

SEQ ID NO: 1402839 - RNA, 18 nt, Pseudomonas aeruginosa PA01
ggccggcagcagcgccag

SEQ ID NO: 1402840 - RNA, 20 nt, Pseudomonas aeruginosa PA01
ggccggcaggaggaucgcgg

SEQ ID NO: 1402841 - RNA, 13 nt, Pseudomonas aeruginosa PA01
ggccggcaggcug

SEQ ID NO: 1402842 - RNA, 14 nt, Pseudomonas aeruginosa PA01
ggccggcaggccga

SEQ ID NO: 1402843 - RNA, 15 nt, Pseudomonas aeruginosa PA01
ggccggcaggccgau

SEQ ID NO: 1402844 - RNA, 16 nt, Pseudomonas aeruginosa PA01
ggccggcaggccgaug

SEQ ID NO: 1402845 - RNA, 19 nt, Pseudomonas aeruginosa PA01
ggccggcaggccgauggcc

SEQ ID NO: 1402846 - RNA, 17 nt, Pseudomonas aeruginosa PA01
ggccggcaugcaggugg

SEQ ID NO: 1402847 - RNA, 15 nt, Pseudomonas aeruginosa PA01
ggccggcgcgauccu

SEQ ID NO: 1402848 - RNA, 19 nt, Pseudomonas aeruginosa PA01
ggccggcgcgauccuggcg

SEQ ID NO: 1402849 - RNA, 22 nt, Pseudomonas aeruginosa PA01
ggccggcgcgauccuggcggca

SEQ ID NO: 1402850 - RNA, 15 nt, Pseudomonas aeruginosa PA01
ggccggccaggucgu

SEQ ID NO: 1402851 - RNA, 16 nt, Pseudomonas aeruginosa PA01
ggccggccacgcgacc

SEQ ID NO: 1402852 - RNA, 19 nt, Pseudomonas aeruginosa PA01
ggccggccacgcgaccagc

SEQ ID NO: 1402853 - RNA, 22 nt, Pseudomonas aeruginosa PA01
ggccggccacgcgaccagcgcc

SEQ ID NO: 1402854 - RNA, 16 nt, Pseudomonas aeruginosa PA01
ggccggccagccaggc

SEQ ID NO: 1402855 - RNA, 14 nt, Pseudomonas aeruginosa PA01
ggccggaugccacc

SEQ ID NO: 1402856 - RNA, 15 nt, Pseudomonas aeruginosa PA01
ggccggaugccaccg

SEQ ID NO: 1402857 - RNA, 21 nt, Pseudomonas aeruginosa PA01
ggccggaacggcuugcugaca

SEQ ID NO: 1402858 - RNA, 20 nt, Pseudomonas aeruginosa PA01
ggccggaucggccuuggcga

SEQ ID NO: 1402859 - RNA, 16 nt, Pseudomonas aeruginosa PA01
ggccggauuggccgag

SEQ ID NO: 1402860 - RNA, 17 nt, Pseudomonas aeruginosa PA01
ggccggauuggccgagg

SEQ ID NO: 1402861 - RNA, 14 nt, Pseudomonas aeruginosa PA01
ggccggcaccagca

SEQ ID NO: 1402862 - RNA, 18 nt, Pseudomonas aeruginosa PA01
ggccgcuuggccauggcg

SEQ ID NO: 1402863 - RNA, 20 nt, Pseudomonas aeruginosa PA01
ggccgcuuggccauggcgcu

SEQ ID NO: 1402864 - RNA, 19 nt, Pseudomonas aeruginosa PA01
ggccgcuugaagcggccau

SEQ ID NO: 1402865 - RNA, 11 nt, Pseudomonas aeruginosa PA01
ggccggcggcc

SEQ ID NO: 1402866 - RNA, 15 nt, Pseudomonas aeruginosa PA01
ggccggcgcggcgcg

SEQ ID NO: 1402867 - RNA, 22 nt, Pseudomonas aeruginosa PA01
ggccggcguacuucggcgcggu

SEQ ID NO: 1402868 - RNA, 15 nt, Pseudomonas aeruginosa PA01
ggccggcgggcgcga

SEQ ID NO: 1402869 - RNA, 16 nt, Pseudomonas aeruginosa PA01
ggccgggcagacuucg

SEQ ID NO: 1402870 - RNA, 16 nt, Pseudomonas aeruginosa PA01
ggccgggcaggccgag

SEQ ID NO: 1402871 - RNA, 13 nt, Pseudomonas aeruginosa PA01
ggccgggcccugg

SEQ ID NO: 1402872 - RNA, 21 nt, Pseudomonas aeruginosa PA01
ggccgggcccugggccccggc

SEQ ID NO: 1402873 - RNA, 17 nt, Pseudomonas aeruginosa PA01
ggccgggcaccccgagc

SEQ ID NO: 1402874 - RNA, 20 nt, Pseudomonas aeruginosa PA01
ggccgggcaccccgagcggc

SEQ ID NO: 1402875 - RNA, 22 nt, Pseudomonas aeruginosa PA01
ggccgggcaccccgagcggcgc

SEQ ID NO: 1402876 - RNA, 12 nt, Pseudomonas aeruginosa PA01
ggccgggccgau

SEQ ID NO: 1402877 - RNA, 13 nt, Pseudomonas aeruginosa PA01
ggccgggccgauc

SEQ ID NO: 1402878 - RNA, 16 nt, Pseudomonas aeruginosa PA01
ggccgggccgaugcgc

SEQ ID NO: 1402879 - RNA, 19 nt, Pseudomonas aeruginosa PA01
ggccgggcuggccaccgcc

SEQ ID NO: 1402880 - RNA, 21 nt, Pseudomonas aeruginosa PA01
ggccggugccauacagcgccc

SEQ ID NO: 1402881 - RNA, 12 nt, Pseudomonas aeruginosa PA01
ggccggugccgc

SEQ ID NO: 1402882 - RNA, 13 nt, Pseudomonas aeruginosa PA01
ggccggugccgcc

SEQ ID NO: 1402883 - RNA, 16 nt, Pseudomonas aeruginosa PA01
ggccggugccgcccug

SEQ ID NO: 1402884 - RNA, 23 nt, Pseudomonas aeruginosa PA01
ggccggugccuucggcggcgccu

SEQ ID NO: 1402885 - RNA, 23 nt, Pseudomonas aeruginosa PA01
ggccggugaucucgcggcgcggc

SEQ ID NO: 1402886 - RNA, 13 nt, Pseudomonas aeruginosa PA01
ggccgguggucgg

SEQ ID NO: 1402887 - RNA, 21 nt, Pseudomonas aeruginosa PA01
ggccggugugcgacuggggca

SEQ ID NO: 1402888 - RNA, 14 nt, Pseudomonas aeruginosa PA01
ggccgguugcgacc

SEQ ID NO: 1402889 - RNA, 18 nt, Pseudomonas aeruginosa PA01
ggccgguugcgaccggcc

SEQ ID NO: 1402890 - RNA, 16 nt, Pseudomonas aeruginosa PA01
ggccgguugcggcgcc

SEQ ID NO: 1402891 - RNA, 13 nt, Pseudomonas aeruginosa PA01
ggccgucccaggu

SEQ ID NO: 1402892 - RNA, 16 nt, Pseudomonas aeruginosa PA01
ggccgucccagguugg

SEQ ID NO: 1402893 - RNA, 21 nt, Pseudomonas aeruginosa PA01
ggccgucccagucggcguccg

SEQ ID NO: 1402894 - RNA, 23 nt, Pseudomonas aeruginosa PA01
ggccgucccagucggcguccgcc

SEQ ID NO: 1402895 - RNA, 18 nt, Pseudomonas aeruginosa PA01
ggccgucccugaccagca

SEQ ID NO: 1402896 - RNA, 13 nt, Pseudomonas aeruginosa PA01
ggccguccgccag

SEQ ID NO: 1402897 - RNA, 14 nt, Pseudomonas aeruginosa PA01
ggccguccaggcug

SEQ ID NO: 1402898 - RNA, 18 nt, Pseudomonas aeruginosa PA01
ggccguccaggcugccgc

SEQ ID NO: 1402899 - RNA, 14 nt, Pseudomonas aeruginosa PA01
ggccguccucgucg

SEQ ID NO: 1402900 - RNA, 15 nt, Pseudomonas aeruginosa PA01
ggccguccucgucga

SEQ ID NO: 1402901 - RNA, 20 nt, Pseudomonas aeruginosa PA01
ggccguccugcggccguucg

SEQ ID NO: 1402902 - RNA, 19 nt, Pseudomonas aeruginosa PA01
ggccguccugcuugaccuu

SEQ ID NO: 1402903 - RNA, 22 nt, Pseudomonas aeruginosa PA01
ggccguccuugaguagcuggcg

SEQ ID NO: 1402904 - RNA, 13 nt, Pseudomonas aeruginosa PA01
ggccgucgaaggg

SEQ ID NO: 1402905 - RNA, 19 nt, Pseudomonas aeruginosa PA01
ggccgucgaagggcacgcc

SEQ ID NO: 1402906 - RNA, 14 nt, Pseudomonas aeruginosa PA01
ggccgucgaagugg

SEQ ID NO: 1402907 - RNA, 14 nt, Pseudomonas aeruginosa PA01
ggccguccucggga

SEQ ID NO: 1402908 - RNA, 15 nt, Pseudomonas aeruginosa PA01
ggccgucgaggucgg

SEQ ID NO: 1402909 - RNA, 12 nt, Pseudomonas aeruginosa PA01
ggccgucgcgca

SEQ ID NO: 1402910 - RNA, 23 nt, Pseudomonas aeruginosa PA01
ggccgucggccugcuugcaggag

SEQ ID NO: 1402911 - RNA, 14 nt, Pseudomonas aeruginosa PA01
ggccgucggccugg

SEQ ID NO: 1402912 - RNA, 17 nt, Pseudomonas aeruginosa PA01
ggccgucggccuggcgg

SEQ ID NO: 1402913 - RNA, 18 nt, Pseudomonas aeruginosa PA01
ggccgucggccuggcggu

SEQ ID NO: 1402914 - RNA, 14 nt, Pseudomonas aeruginosa PA01
ggccgucgcgcacc

SEQ ID NO: 1402915 - RNA, 15 nt, Pseudomonas aeruginosa PA01
ggccgucgcgcacca

SEQ ID NO: 1402916 - RNA, 17 nt, Pseudomonas aeruginosa PA01
ggccgucgcgcaccacc

SEQ ID NO: 1402917 - RNA, 16 nt, Pseudomonas aeruginosa PA01
ggccgucgcgccgcgg

SEQ ID NO: 1402918 - RNA, 22 nt, Pseudomonas aeruginosa PA01
ggccguaguucgaaccguggcg

SEQ ID NO: 1402919 - RNA, 21 nt, Pseudomonas aeruginosa PA01
ggccguaggugaccgcccagg

SEQ ID NO: 1402920 - RNA, 21 nt, Pseudomonas aeruginosa PA01
ggccgguuuuuuauugccagc

SEQ ID NO: 1402921 - RNA, 15 nt, Pseudomonas aeruginosa PA01
ggccguaggcgaugg

SEQ ID NO: 1402922 - RNA, 19 nt, Pseudomonas aeruginosa PA01
ggccguaccagucgcccgc

SEQ ID NO: 1402923 - RNA, 16 nt, Pseudomonas aeruginosa PA01
ggccguagaccaccag

SEQ ID NO: 1402924 - RNA, 17 nt, Pseudomonas aeruginosa PA01
ggccguagaccaccagc

SEQ ID NO: 1402925 - RNA, 21 nt, Pseudomonas aeruginosa PA01
ggccguagaccaccagcagca

SEQ ID NO: 1402926 - RNA, 22 nt, Pseudomonas aeruginosa PA01
ggccguagaccaccagcagcag

SEQ ID NO: 1402927 - RNA, 23 nt, Pseudomonas aeruginosa PA01
ggccguagaccaccagcagcagc

SEQ ID NO: 1402928 - RNA, 14 nt, Pseudomonas aeruginosa PA01
ggccguagccgaac

SEQ ID NO: 1402929 - RNA, 14 nt, Pseudomonas aeruginosa PA01
ggcgaagucgccgu

SEQ ID NO: 1402930 - RNA, 15 nt, Pseudomonas aeruginosa PA01
ggcgaagucgccguc

SEQ ID NO: 1402931 - RNA, 16 nt, Pseudomonas aeruginosa PA01
ggcgaagucgccgucg

SEQ ID NO: 1402932 - RNA, 16 nt, Pseudomonas aeruginosa PA01
ggcgaagucggcgcgc

SEQ ID NO: 1402933 - RNA, 17 nt, Pseudomonas aeruginosa PA01
ggcgaagucggcgcgcc

SEQ ID NO: 1402934 - RNA, 19 nt, Pseudomonas aeruginosa PA01
ggcgaagucggcgcgccag

SEQ ID NO: 1402935 - RNA, 17 nt, Pseudomonas aeruginosa PA01
ggcgaaguugccgccgc

SEQ ID NO: 1402936 - RNA, 20 nt, Pseudomonas aeruginosa PA01
ggcgaaguugccgccgcugg

SEQ ID NO: 1402937 - RNA, 16 nt, Pseudomonas aeruginosa PA01
ggcgaaguucccgccg

SEQ ID NO: 1402938 - RNA, 17 nt, Pseudomonas aeruginosa PA01
ggcgaaguucccgccgc

SEQ ID NO: 1402939 - RNA, 20 nt, Pseudomonas aeruginosa PA01
ggcgaaguucccgccgcucu

SEQ ID NO: 1402940 - RNA, 16 nt, Pseudomonas aeruginosa PA01
ggcgaaguccaccagg

SEQ ID NO: 1402941 - RNA, 18 nt, Pseudomonas aeruginosa PA01
ggcgaaguccaccaggcg

SEQ ID NO: 1402942 - RNA, 21 nt, Pseudomonas aeruginosa PA01
ggcgaaguccaccaggcgccg

SEQ ID NO: 1402943 - RNA, 22 nt, Pseudomonas aeruginosa PA01
ggcgaaguccggguugagcacc

SEQ ID NO: 1402944 - RNA, 19 nt, Pseudomonas aeruginosa PA01
ggcgaagguggcgaccugg

SEQ ID NO: 1402945 - RNA, 17 nt, Pseudomonas aeruginosa PA01
ggcgaaguagaagcgcg

SEQ ID NO: 1402946 - RNA, 18 nt, Pseudomonas aeruginosa PA01
ggcgaaguagaagcgcgc

SEQ ID NO: 1402947 - RNA, 12 nt, Pseudomonas aeruginosa PA01
ggcgaaggucug

SEQ ID NO: 1402948 - RNA, 17 nt, Pseudomonas aeruginosa PA01
ggcgaaggucugccccg

SEQ ID NO: 1402949 - RNA, 17 nt, Pseudomonas aeruginosa PA01
ggcgaagggcaggccga

SEQ ID NO: 1402950 - RNA, 16 nt, Pseudomonas aeruginosa PA01
ggcgaaggccucgucg

SEQ ID NO: 1402951 - RNA, 19 nt, Pseudomonas aeruginosa PA01
ggcgaaggccucgucgauc

SEQ ID NO: 1402952 - RNA, 14 nt, Pseudomonas aeruginosa PA01
ggcgaaggcgaacc

SEQ ID NO: 1402953 - RNA, 22 nt, Pseudomonas aeruginosa PA01
ggcgaaggcgaaccacaccagg

SEQ ID NO: 1402954 - RNA, 18 nt, Pseudomonas aeruginosa PA01
ggcgaauauccucgucga

SEQ ID NO: 1402955 - RNA, 20 nt, Pseudomonas aeruginosa PA01
ggcgaauauccucgucgauc

SEQ ID NO: 1402956 - RNA, 14 nt, Pseudomonas aeruginosa PA01
ggcgaauagcgccg

SEQ ID NO: 1402957 - RNA, 15 nt, Pseudomonas aeruginosa PA01
ggcgaauagcgccgc

SEQ ID NO: 1402958 - RNA, 20 nt, Pseudomonas aeruginosa PA01
ggcgaauagcgccgcaggcg

SEQ ID NO: 1402959 - RNA, 19 nt, Pseudomonas aeruginosa PA01
ggcgaauaccagugccgcg

SEQ ID NO: 1402960 - RNA, 17 nt, Pseudomonas aeruginosa PA01
ggcgaauaaccgcaucg

SEQ ID NO: 1402961 - RNA, 19 nt, Pseudomonas aeruginosa PA01
ggcgaauaaccgcucgcgg

SEQ ID NO: 1402962 - RNA, 17 nt, Pseudomonas aeruginosa PA01
ggcgaauaacgccacag

SEQ ID NO: 1402963 - RNA, 23 nt, Pseudomonas aeruginosa PA01
ggcgaagaucucgccauggcgga

SEQ ID NO: 1402964 - RNA, 20 nt, Pseudomonas aeruginosa PA01
ggcgaagccaaugcgugggu

SEQ ID NO: 1402965 - RNA, 15 nt, Pseudomonas aeruginosa PA01
ggcgaagccagcacg

SEQ ID NO: 1402966 - RNA, 19 nt, Pseudomonas aeruginosa PA01
ggcgaagcccagcgagccg

SEQ ID NO: 1402967 - RNA, 12 nt, Pseudomonas aeruginosa PA01
ggcgaagccgcg

SEQ ID NO: 1402968 - RNA, 14 nt, Pseudomonas aeruginosa PA01
ggcgaagccgcgcc

SEQ ID NO: 1402969 - RNA, 13 nt, Pseudomonas aeruginosa PA01
ggcgaagccggcg

SEQ ID NO: 1402970 - RNA, 14 nt, Pseudomonas aeruginosa PA01
ggcgaagccggcgg

SEQ ID NO: 1402971 - RNA, 15 nt, Pseudomonas aeruginosa PA01
ggcgaagccggcggc

SEQ ID NO: 1402972 - RNA, 20 nt, Pseudomonas aeruginosa PA01
ggcgaagccggcggcgcggc

SEQ ID NO: 1402973 - RNA, 23 nt, Pseudomonas aeruginosa PA01
ggcgaagccguuguagaucggca

SEQ ID NO: 1402974 - RNA, 15 nt, Pseudomonas aeruginosa PA01
ggcgaagcguugcag

SEQ ID NO: 1402975 - RNA, 20 nt, Pseudomonas aeruginosa PA01
ggcgaagcguugcagcgucu

SEQ ID NO: 1402976 - RNA, 12 nt, Pseudomonas aeruginosa PA01
ggcgaagcuggg

SEQ ID NO: 1402977 - RNA, 20 nt, Pseudomonas aeruginosa PA01
ggcgaaggcaaugccgcccu

SEQ ID NO: 1402978 - RNA, 21 nt, Pseudomonas aeruginosa PA01
ggcgaaggccaccaucgcggc

SEQ ID NO: 1402979 - RNA, 15 nt, Pseudomonas aeruginosa PA01
ggcgaagcgauucca

SEQ ID NO: 1402980 - RNA, 13 nt, Pseudomonas aeruginosa PA01
ggcgaagcgcagc

SEQ ID NO: 1402981 - RNA, 22 nt, Pseudomonas aeruginosa PA01
ggcgaagcgcagcuccggcagc

SEQ ID NO: 1402982 - RNA, 21 nt, Pseudomonas aeruginosa PA01
ggcgaagcggaagcgcagcca

SEQ ID NO: 1402983 - RNA, 13 nt, Pseudomonas aeruginosa PA01
ggcgaagcggccc

SEQ ID NO: 1402984 - RNA, 20 nt, Pseudomonas aeruginosa PA01
ggcgaagcggcucggccagg

SEQ ID NO: 1402985 - RNA, 18 nt, Pseudomonas aeruginosa PA01
ggcgaagcggcuggccgc

SEQ ID NO: 1402986 - RNA, 17 nt, Pseudomonas aeruginosa PA01
ggcgaacuccgccagcu

SEQ ID NO: 1402987 - RNA, 19 nt, Pseudomonas aeruginosa PA01
ggcgaacuccgccagcuug

SEQ ID NO: 1402988 - RNA, 16 nt, Pseudomonas aeruginosa PA01
ggcgaacugccgacgg

SEQ ID NO: 1402989 - RNA, 18 nt, Pseudomonas aeruginosa PA01
ggcgaacugccgacggcg

SEQ ID NO: 1402990 - RNA, 20 nt, Pseudomonas aeruginosa PA01
ggcgaacugccgacggcggc

SEQ ID NO: 1402991 - RNA, 23 nt, Pseudomonas aeruginosa PA01
ggcgaacuggccaccgucggaug

SEQ ID NO: 1402992 - RNA, 16 nt, Pseudomonas aeruginosa PA01
ggcgaacggcuggucg

SEQ ID NO: 1402993 - RNA, 23 nt, Pseudomonas aeruginosa PA01
ggcgaagacgaaguuggcggccg

SEQ ID NO: 1402994 - RNA, 17 nt, Pseudomonas aeruginosa PA01
ggcgaacuucaggccgg

SEQ ID NO: 1402995 - RNA, 19 nt, Pseudomonas aeruginosa PA01
ggcgaacuucaggccggcg

SEQ ID NO: 1402996 - RNA, 23 nt, Pseudomonas aeruginosa PA01
ggcgaacuucaggccggcgccga

SEQ ID NO: 1402997 - RNA, 20 nt, Pseudomonas aeruginosa PA01
ggccugguuguaggcgccgc

SEQ ID NO: 1402998 - RNA, 13 nt, Pseudomonas aeruginosa PA01
ggccuggugcacg

SEQ ID NO: 1402999 - RNA, 19 nt, Pseudomonas aeruginosa PA01
ggccuggugcacgccgaug

SEQ ID NO: 1403000 - RNA, 22 nt, Pseudomonas aeruginosa PA01
ggccuggugcacgccgauggcg

SEQ ID NO: 1403001 - RNA, 20 nt, Pseudomonas aeruginosa PA01
ggccugucgggggcugcgca

SEQ ID NO: 1403002 - RNA, 20 nt, Pseudomonas aeruginosa PA01
ggccuguccgaagacaggcc

SEQ ID NO: 1403003 - RNA, 22 nt, Pseudomonas aeruginosa PA01
ggccuguccgaagacaggccuu

SEQ ID NO: 1403004 - RNA, 19 nt, Pseudomonas aeruginosa PA01
ggccuguaccaaggugcug

SEQ ID NO: 1403005 - RNA, 17 nt, Pseudomonas aeruginosa PA01
ggccuguaccgcuuccu

SEQ ID NO: 1403006 - RNA, 15 nt, Pseudomonas aeruginosa PA01
ggccugucacgccgg

SEQ ID NO: 1403007 - RNA, 16 nt, Pseudomonas aeruginosa PA01
ggccugucacgccggg

SEQ ID NO: 1403008 - RNA, 23 nt, Pseudomonas aeruginosa PA01
ggccugucacgccgggggucgcg

SEQ ID NO: 1403009 - RNA, 22 nt, Pseudomonas aeruginosa PA01
ggccuuuuccguuguggcggcg

SEQ ID NO: 1403010 - RNA, 20 nt, Pseudomonas aeruginosa PA01
ggccuuguucaggguggcga

SEQ ID NO: 1403011 - RNA, 23 nt, Pseudomonas aeruginosa PA01
ggccuuguucaggguggcgaccg

SEQ ID NO: 1403012 - RNA, 15 nt, Pseudomonas aeruginosa PA01
ggccuuuuucauggg

SEQ ID NO: 1403013 - RNA, 21 nt, Pseudomonas aeruginosa PA01
ggccuuuuucaugggugcugu

SEQ ID NO: 1403014 - RNA, 20 nt, Pseudomonas aeruginosa PA01
ggccuugugacuaucgucga

SEQ ID NO: 1403015 - RNA, 19 nt, Pseudomonas aeruginosa PA01
ggccuugugcgccagcucg

SEQ ID NO: 1403016 - RNA, 17 nt, Pseudomonas aeruginosa PA01
ggccuuguacagggcgc

SEQ ID NO: 1403017 - RNA, 14 nt, Pseudomonas aeruginosa PA01
ggccuguucgccca

SEQ ID NO: 1403018 - RNA, 15 nt, Pseudomonas aeruginosa PA01
ggccuguucgcccaa

SEQ ID NO: 1403019 - RNA, 21 nt, Pseudomonas aeruginosa PA01
ggccuguucgcccaaggccag

SEQ ID NO: 1403020 - RNA, 16 nt, Pseudomonas aeruginosa PA01
ggcgaaagucggcgcg

SEQ ID NO: 1403021 - RNA, 18 nt, Pseudomonas aeruginosa PA01
ggcgaaagucggcgcgac

SEQ ID NO: 1403022 - RNA, 20 nt, Pseudomonas aeruginosa PA01
ggcgaaaccggccagcgcgg

SEQ ID NO: 1403023 - RNA, 21 nt, Pseudomonas aeruginosa PA01
ggcgaaaccggccagcgcggc

SEQ ID NO: 1403024 - RNA, 15 nt, Pseudomonas aeruginosa PA01
ggcgaaacggcggau

SEQ ID NO: 1403025 - RNA, 20 nt, Pseudomonas aeruginosa PA01
ggcgaaacguccggcguccc

SEQ ID NO: 1403026 - RNA, 17 nt, Pseudomonas aeruginosa PA01
ggcgaaccaggcggccg

SEQ ID NO: 1403027 - RNA, 18 nt, Pseudomonas aeruginosa PA01
ggcgaaccaggcggccga

SEQ ID NO: 1403028 - RNA, 19 nt, Pseudomonas aeruginosa PA01
ggcgaaccaggcggccgaa

SEQ ID NO: 1403029 - RNA, 20 nt, Pseudomonas aeruginosa PA01
ggcgaacaucauccacagcg

SEQ ID NO: 1403030 - RNA, 15 nt, Pseudomonas aeruginosa PA01
ggcgaacggcagcgu

SEQ ID NO: 1403031 - RNA, 17 nt, Pseudomonas aeruginosa PA01
ggcgaacggcagcgucu

SEQ ID NO: 1403032 - RNA, 23 nt, Pseudomonas aeruginosa PA01
ggcgaacgacagcaccaugcccu

SEQ ID NO: 1403033 - RNA, 21 nt, Pseudomonas aeruginosa PA01
ggcgaacgaugguggucggca

SEQ ID NO: 1403034 - RNA, 18 nt, Pseudomonas aeruginosa PA01
ggcgaaccaguccagcac

SEQ ID NO: 1403035 - RNA, 19 nt, Pseudomonas aeruginosa PA01
ggcgaaccaguccagcacg

SEQ ID NO: 1403036 - RNA, 19 nt, Pseudomonas aeruginosa PA01
ggcgaaccagugcaccgcc

SEQ ID NO: 1403037 - RNA, 13 nt, Pseudomonas aeruginosa PA01
ggccucgucgauc

SEQ ID NO: 1403038 - RNA, 14 nt, Pseudomonas aeruginosa PA01
ggccucgucgaucu

SEQ ID NO: 1403039 - RNA, 14 nt, Pseudomonas aeruginosa PA01
ggccucggggccgu

SEQ ID NO: 1403040 - RNA, 24 nt, Pseudomonas aeruginosa PA01
ggccucggggccguccgccagguc

SEQ ID NO: 1403041 - RNA, 14 nt, Pseudomonas aeruginosa PA01
ggccugcaccagcc

SEQ ID NO: 1403042 - RNA, 15 nt, Pseudomonas aeruginosa PA01
ggccugcaccagcca

SEQ ID NO: 1403043 - RNA, 23 nt, Pseudomonas aeruginosa PA01
ggccugcaccagccaguccggca

SEQ ID NO: 1403044 - RNA, 16 nt, Pseudomonas aeruginosa PA01
ggccugcacguggagu

SEQ ID NO: 1403045 - RNA, 15 nt, Pseudomonas aeruginosa PA01
ggccugccccgccgg

SEQ ID NO: 1403046 - RNA, 16 nt, Pseudomonas aeruginosa PA01
ggccugccccgccggc

SEQ ID NO: 1403047 - RNA, 17 nt, Pseudomonas aeruginosa PA01
ggccugccccgccggcg

SEQ ID NO: 1403048 - RNA, 19 nt, Pseudomonas aeruginosa PA01
ggccugccccgccggcgcu

SEQ ID NO: 1403049 - RNA, 21 nt, Pseudomonas aeruginosa PA01
ggccugccccgccggcgcuuu

SEQ ID NO: 1403050 - RNA, 13 nt, Pseudomonas aeruginosa PA01
ggccugcagccug

SEQ ID NO: 1403051 - RNA, 17 nt, Pseudomonas aeruginosa PA01
ggccugcagccuggcgu

SEQ ID NO: 1403052 - RNA, 17 nt, Pseudomonas aeruginosa PA01
ggccugcagcgacucca

SEQ ID NO: 1403053 - RNA, 19 nt, Pseudomonas aeruginosa PA01
ggccugguaggcgucgucg

SEQ ID NO: 1403054 - RNA, 19 nt, Pseudomonas aeruginosa PA01
ggccugguagucgccgguc

SEQ ID NO: 1403055 - RNA, 15 nt, Pseudomonas aeruginosa PA01
ggccugggugaacag

SEQ ID NO: 1403056 - RNA, 18 nt, Pseudomonas aeruginosa PA01
ggccugggugaacagcgg

SEQ ID NO: 1403057 - RNA, 18 nt, Pseudomonas aeruginosa PA01
ggccugcggguucggcga

SEQ ID NO: 1403058 - RNA, 19 nt, Pseudomonas aeruginosa PA01
ggccugcggguucggcgag

SEQ ID NO: 1403059 - RNA, 21 nt, Pseudomonas aeruginosa PA01
ggccugcggguucggcgagag

SEQ ID NO: 1403060 - RNA, 20 nt, Pseudomonas aeruginosa PA01
ggccugcgcgcaccaggccu

SEQ ID NO: 1403061 - RNA, 21 nt, Pseudomonas aeruginosa PA01
ggccugcgcgcaccaggccuc

SEQ ID NO: 1403062 - RNA, 18 nt, Pseudomonas aeruginosa PA01
ggccugcgcccuagucga

SEQ ID NO: 1403063 - RNA, 12 nt, Pseudomonas aeruginosa PA01
ggccugccguug

SEQ ID NO: 1403064 - RNA, 15 nt, Pseudomonas aeruginosa PA01
ggccucgcugccgcc

SEQ ID NO: 1403065 - RNA, 18 nt, Pseudomonas aeruginosa PA01
ggccucgcugccgccgca

SEQ ID NO: 1403066 - RNA, 19 nt, Pseudomonas aeruginosa PA01
ggccucgcugccgccgcag

SEQ ID NO: 1403067 - RNA, 14 nt, Pseudomonas aeruginosa PA01
ggccucgcugcgca

SEQ ID NO: 1403068 - RNA, 13 nt, Pseudomonas aeruginosa PA01
ggccucgccgguc

SEQ ID NO: 1403069 - RNA, 16 nt, Pseudomonas aeruginosa PA01
ggccucgcggcgcucg

SEQ ID NO: 1403070 - RNA, 18 nt, Pseudomonas aeruginosa PA01
ggccucgccugcggcgcc

SEQ ID NO: 1403071 - RNA, 16 nt, Pseudomonas aeruginosa PA01
ggccucgccgaugucg

SEQ ID NO: 1403072 - RNA, 22 nt, Pseudomonas aeruginosa PA01
ggccucgggcgggaucuccgcg

SEQ ID NO: 1403073 - RNA, 17 nt, Pseudomonas aeruginosa PA01
ggccucggcgucgcgca

SEQ ID NO: 1403074 - RNA, 18 nt, Pseudomonas aeruginosa PA01
ggccucggcgucgcgcag

SEQ ID NO: 1403075 - RNA, 12 nt, Pseudomonas aeruginosa PA01
ggccucggcgcg

SEQ ID NO: 1403076 - RNA, 18 nt, Pseudomonas aeruginosa PA01
ggccucggcgcgggccuu

SEQ ID NO: 1403077 - RNA, 13 nt, Pseudomonas aeruginosa PA01
ggccucggcggcg

SEQ ID NO: 1403078 - RNA, 14 nt, Pseudomonas aeruginosa PA01
ggccucggcgaucg

SEQ ID NO: 1403079 - RNA, 13 nt, Pseudomonas aeruginosa PA01
ggccucgcgugcg

SEQ ID NO: 1403080 - RNA, 16 nt, Pseudomonas aeruginosa PA01
ggccucggccucgucg

SEQ ID NO: 1403081 - RNA, 17 nt, Pseudomonas aeruginosa PA01
ggccucggccucgucga

SEQ ID NO: 1403082 - RNA, 13 nt, Pseudomonas aeruginosa PA01
ggccucggccugg

SEQ ID NO: 1403083 - RNA, 13 nt, Pseudomonas aeruginosa PA01
ggccucggcgaag

SEQ ID NO: 1403084 - RNA, 12 nt, Pseudomonas aeruginosa PA01
ggccucggccag

SEQ ID NO: 1403085 - RNA, 14 nt, Pseudomonas aeruginosa PA01
ggccucggccagcg

SEQ ID NO: 1403086 - RNA, 15 nt, Pseudomonas aeruginosa PA01
ggccucggccagcgc

SEQ ID NO: 1403087 - RNA, 17 nt, Pseudomonas aeruginosa PA01
ggccucggccagcgccg

SEQ ID NO: 1403088 - RNA, 13 nt, Pseudomonas aeruginosa PA01
ggccuccagcgcc

SEQ ID NO: 1403089 - RNA, 23 nt, Pseudomonas aeruginosa PA01
ggccuccagcgccucgccgagca

SEQ ID NO: 1403090 - RNA, 20 nt, Pseudomonas aeruginosa PA01
ggccuccagcgccuggcgca

SEQ ID NO: 1403091 - RNA, 21 nt, Pseudomonas aeruginosa PA01
ggccucgaugaucgccgggug

SEQ ID NO: 1403092 - RNA, 20 nt, Pseudomonas aeruginosa PA01
ggccuccagcacucgcuccu

SEQ ID NO: 1403093 - RNA, 21 nt, Pseudomonas aeruginosa PA01
ggccucgcaauugaucaucca

SEQ ID NO: 1403094 - RNA, 14 nt, Pseudomonas aeruginosa PA01
ggccuccaggcugg

SEQ ID NO: 1403095 - RNA, 17 nt, Pseudomonas aeruginosa PA01
ggccuccaggcuggccu

SEQ ID NO: 1403096 - RNA, 18 nt, Pseudomonas aeruginosa PA01
ggccuccaggcuggccuu

SEQ ID NO: 1403097 - RNA, 19 nt, Pseudomonas aeruginosa PA01
ggccuccagcaacgccgcc

SEQ ID NO: 1403098 - RNA, 15 nt, Pseudomonas aeruginosa PA01
ggccucaauacccgu

SEQ ID NO: 1403099 - RNA, 13 nt, Pseudomonas aeruginosa PA01
ggccucagggcgc

SEQ ID NO: 1403100 - RNA, 14 nt, Pseudomonas aeruginosa PA01
ggccucagggcgcg

SEQ ID NO: 1403101 - RNA, 15 nt, Pseudomonas aeruginosa PA01
ggccucaacgaccgc

SEQ ID NO: 1403102 - RNA, 16 nt, Pseudomonas aeruginosa PA01
ggccucaacgaccgcc

SEQ ID NO: 1403103 - RNA, 21 nt, Pseudomonas aeruginosa PA01
ggccucaacgaccgcccaggc

SEQ ID NO: 1403104 - RNA, 20 nt, Pseudomonas aeruginosa PA01
ggucgaauggaguuuccgcg

SEQ ID NO: 1403105 - RNA, 22 nt, Pseudomonas aeruginosa PA01
ggucgagcagaguuuagccgcc

SEQ ID NO: 1403106 - RNA, 20 nt, Pseudomonas aeruginosa PA01
ggucgagcagcgccgcggug

SEQ ID NO: 1403107 - RNA, 13 nt, Pseudomonas aeruginosa PA01
ggucgagcucggc

SEQ ID NO: 1403108 - RNA, 16 nt, Pseudomonas aeruginosa PA01
ggucgagcucggccag

SEQ ID NO: 1403109 - RNA, 18 nt, Pseudomonas aeruginosa PA01
ggucgagcucggccaggc

SEQ ID NO: 1403110 - RNA, 24 nt, Pseudomonas aeruginosa PA01
ggucgaaccagcucagcuccaggc

SEQ ID NO: 1403111 - RNA, 16 nt, Pseudomonas aeruginosa PA01
ggucgaacagcggcug

SEQ ID NO: 1403112 - RNA, 18 nt, Pseudomonas aeruginosa PA01
ggucgaacugcacccgcc

SEQ ID NO: 1403113 - RNA, 19 nt, Pseudomonas aeruginosa PA01
ggucgcagcguuccagcgc

SEQ ID NO: 1403114 - RNA, 22 nt, Pseudomonas aeruginosa PA01
ggucgcagcguuccagcgcugg

SEQ ID NO: 1403115 - RNA, 15 nt, Pseudomonas aeruginosa PA01
ggucgcagcuccagc

SEQ ID NO: 1403116 - RNA, 15 nt, Pseudomonas aeruginosa PA01
ggucgcagcaggccg

SEQ ID NO: 1403117 - RNA, 17 nt, Pseudomonas aeruginosa PA01
ggucgcagcaggccgcu

SEQ ID NO: 1403118 - RNA, 18 nt, Pseudomonas aeruginosa PA01
ggucgcagcaggccgcug

SEQ ID NO: 1403119 - RNA, 19 nt, Pseudomonas aeruginosa PA01
ggucgcagcaggccgcugg

SEQ ID NO: 1403120 - RNA, 21 nt, Pseudomonas aeruginosa PA01
ggucgcagcaggccgcuggcg

SEQ ID NO: 1403121 - RNA, 18 nt, Pseudomonas aeruginosa PA01
ggucgcacgcagcgccgc

SEQ ID NO: 1403122 - RNA, 20 nt, Pseudomonas aeruginosa PA01
ggucgagguucuccaggcuu

SEQ ID NO: 1403123 - RNA, 18 nt, Pseudomonas aeruginosa PA01
ggucgaggacgaucagcu

SEQ ID NO: 1403124 - RNA, 21 nt, Pseudomonas aeruginosa PA01
ggucgaggcaaucugcccggc

SEQ ID NO: 1403125 - RNA, 18 nt, Pseudomonas aeruginosa PA01
ggucgaggccgcggagca

SEQ ID NO: 1403126 - RNA, 12 nt, Pseudomonas aeruginosa PA01
ggucgcaccgcc

SEQ ID NO: 1403127 - RNA, 13 nt, Pseudomonas aeruginosa PA01
ggucgcaccgcca

SEQ ID NO: 1403128 - RNA, 14 nt, Pseudomonas aeruginosa PA01
ggucgcaccgccag

SEQ ID NO: 1403129 - RNA, 19 nt, Pseudomonas aeruginosa PA01
ggucgcaccgccagcaguu

SEQ ID NO: 1403130 - RNA, 21 nt, Pseudomonas aeruginosa PA01
ggucgagcuuguuggccagca

SEQ ID NO: 1403131 - RNA, 23 nt, Pseudomonas aeruginosa PA01
ggucgagcuuguuggccagcagc

SEQ ID NO: 1403132 - RNA, 23 nt, Pseudomonas aeruginosa PA01
ggucgaggcggagaagccgcuga

SEQ ID NO: 1403133 - RNA, 13 nt, Pseudomonas aeruginosa PA01
ggucgaggcugcc

SEQ ID NO: 1403134 - RNA, 23 nt, Pseudomonas aeruginosa PA01
ggucgagggcaugaccgauggcg

SEQ ID NO: 1403135 - RNA, 19 nt, Pseudomonas aeruginosa PA01
ggucgccggcgcgcacggu

SEQ ID NO: 1403136 - RNA, 13 nt, Pseudomonas aeruginosa PA01
ggucgccagcgcc

SEQ ID NO: 1403137 - RNA, 17 nt, Pseudomonas aeruginosa PA01
ggucgccgugguggccg

SEQ ID NO: 1403138 - RNA, 14 nt, Pseudomonas aeruginosa PA01
ggucgccgggcuca

SEQ ID NO: 1403139 - RNA, 19 nt, Pseudomonas aeruginosa PA01
ggucgcgacugaccacgca

SEQ ID NO: 1403140 - RNA, 18 nt, Pseudomonas aeruginosa PA01
ggucgcgagcagggcgau

SEQ ID NO: 1403141 - RNA, 23 nt, Pseudomonas aeruginosa PA01
ggucgcgacagguucaggacgcu

SEQ ID NO: 1403142 - RNA, 13 nt, Pseudomonas aeruginosa PA01
ggucgcgggcgau

SEQ ID NO: 1403143 - RNA, 12 nt, Pseudomonas aeruginosa PA01
ggucgcgaucac

SEQ ID NO: 1403144 - RNA, 19 nt, Pseudomonas aeruginosa PA01
ggucgcgauguuggcgucg

SEQ ID NO: 1403145 - RNA, 15 nt, Pseudomonas aeruginosa PA01
ggucgcggcuggccg

SEQ ID NO: 1403146 - RNA, 21 nt, Pseudomonas aeruginosa PA01
ggucgcugaccacccggugca

SEQ ID NO: 1403147 - RNA, 15 nt, Pseudomonas aeruginosa PA01
ggucgcguuccagcu

SEQ ID NO: 1403148 - RNA, 17 nt, Pseudomonas aeruginosa PA01
ggucgcguuccagcucc

SEQ ID NO: 1403149 - RNA, 15 nt, Pseudomonas aeruginosa PA01
ggucgcguucgucgg

SEQ ID NO: 1403150 - RNA, 21 nt, Pseudomonas aeruginosa PA01
ggucgcguucgucggccacca

SEQ ID NO: 1403151 - RNA, 22 nt, Pseudomonas aeruginosa PA01
ggucgcguucgucggccaccag

SEQ ID NO: 1403152 - RNA, 18 nt, Pseudomonas aeruginosa PA01
ggucgcgggccaggcccu

SEQ ID NO: 1403153 - RNA, 19 nt, Pseudomonas aeruginosa PA01
ggucgcguacagcgggccg

SEQ ID NO: 1403154 - RNA, 17 nt, Pseudomonas aeruginosa PA01
ggucgcuuccucggcac

SEQ ID NO: 1403155 - RNA, 11 nt, Pseudomonas aeruginosa PA01
ggucgcuggca

SEQ ID NO: 1403156 - RNA, 18 nt, Pseudomonas aeruginosa PA01
ggucgcuggcgucgaccg

SEQ ID NO: 1403157 - RNA, 19 nt, Pseudomonas aeruginosa PA01
ggucgcuggcgucgaccgc

SEQ ID NO: 1403158 - RNA, 19 nt, Pseudomonas aeruginosa PA01
ggucgcugcccaucgccuc

SEQ ID NO: 1403159 - RNA, 23 nt, Pseudomonas aeruginosa PA01
ggucgcugaggccgcccuggccg

SEQ ID NO: 1403160 - RNA, 24 nt, Pseudomonas aeruginosa PA01
gguccgccacuucaagcuggcgca

SEQ ID NO: 1403161 - RNA, 16 nt, Pseudomonas aeruginosa PA01
gguccgccgcgggacg

SEQ ID NO: 1403162 - RNA, 20 nt, Pseudomonas aeruginosa PA01
gguccgccgcgggacgccgc

SEQ ID NO: 1403163 - RNA, 15 nt, Pseudomonas aeruginosa PA01
ggucccuggaucugc

SEQ ID NO: 1403164 - RNA, 23 nt, Pseudomonas aeruginosa PA01
ggucccuucgugggccugcucgg

SEQ ID NO: 1403165 - RNA, 11 nt, Pseudomonas aeruginosa PA01
gguccgcaccg

SEQ ID NO: 1403166 - RNA, 19 nt, Pseudomonas aeruginosa PA01
gguccacguugcaguccag

SEQ ID NO: 1403167 - RNA, 15 nt, Pseudomonas aeruginosa PA01
gguccaccagcccgc

SEQ ID NO: 1403168 - RNA, 16 nt, Pseudomonas aeruginosa PA01
gguccaccagcccgca

SEQ ID NO: 1403169 - RNA, 22 nt, Pseudomonas aeruginosa PA01
gguccaccgcggccucgcuggc

SEQ ID NO: 1403170 - RNA, 19 nt, Pseudomonas aeruginosa PA01
gguccuuguuccugggcgg

SEQ ID NO: 1403171 - RNA, 15 nt, Pseudomonas aeruginosa PA01
ggucgaaagccugcc

SEQ ID NO: 1403172 - RNA, 18 nt, Pseudomonas aeruginosa PA01
ggucgaaagccugccggg

SEQ ID NO: 1403173 - RNA, 23 nt, Pseudomonas aeruginosa PA01
ggucgaaagcuucgucgcgcagg

SEQ ID NO: 1403174 - RNA, 21 nt, Pseudomonas aeruginosa PA01
ggucgaacacuugaccgucgg

SEQ ID NO: 1403175 - RNA, 15 nt, Pseudomonas aeruginosa PA01
gguccugcggcggca

SEQ ID NO: 1403176 - RNA, 17 nt, Pseudomonas aeruginosa PA01
gguccuggugaucaucg

SEQ ID NO: 1403177 - RNA, 21 nt, Pseudomonas aeruginosa PA01
gguccugcagauaaagcugga

SEQ ID NO: 1403178 - RNA, 17 nt, Pseudomonas aeruginosa PA01
gguccucgggcaccagc

SEQ ID NO: 1403179 - RNA, 19 nt, Pseudomonas aeruginosa PA01
gguccucgggcaccagcac

SEQ ID NO: 1403180 - RNA, 23 nt, Pseudomonas aeruginosa PA01
gguccugcaacuggaaggccgcg

SEQ ID NO: 1403181 - RNA, 19 nt, Pseudomonas aeruginosa PA01
gguccgcgaaccgcuggug

SEQ ID NO: 1403182 - RNA, 16 nt, Pseudomonas aeruginosa PA01
gguccgcgccaugccg

SEQ ID NO: 1403183 - RNA, 22 nt, Pseudomonas aeruginosa PA01
gguccaacccauguggcgcagc

SEQ ID NO: 1403184 - RNA, 22 nt, Pseudomonas aeruginosa PA01
gguccaaccgggcaucgccgac

SEQ ID NO: 1403185 - RNA, 14 nt, Pseudomonas aeruginosa PA01
ggucaucaggauca

SEQ ID NO: 1403186 - RNA, 14 nt, Pseudomonas aeruginosa PA01
ggucauccgccggc

SEQ ID NO: 1403187 - RNA, 15 nt, Pseudomonas aeruginosa PA01
ggucagguugaccuu

SEQ ID NO: 1403188 - RNA, 22 nt, Pseudomonas aeruginosa PA01
ggucaucacgcuuuccggcuug

SEQ ID NO: 1403189 - RNA, 17 nt, Pseudomonas aeruginosa PA01
ggucaguuccaggucgg

SEQ ID NO: 1403190 - RNA, 22 nt, Pseudomonas aeruginosa PA01
ggucaguucggugccgccggcg

SEQ ID NO: 1403191 - RNA, 20 nt, Pseudomonas aeruginosa PA01
ggucagcgacuggcccuggu

SEQ ID NO: 1403192 - RNA, 18 nt, Pseudomonas aeruginosa PA01
ggucagcgaguugaccuu

SEQ ID NO: 1403193 - RNA, 13 nt, Pseudomonas aeruginosa PA01
ggucagcgccagc

SEQ ID NO: 1403194 - RNA, 13 nt, Pseudomonas aeruginosa PA01
ggucagcaccagg

SEQ ID NO: 1403195 - RNA, 20 nt, Pseudomonas aeruginosa PA01
ggucagcaccagggccaggg

SEQ ID NO: 1403196 - RNA, 14 nt, Pseudomonas aeruginosa PA01
ggucagcaggcugc

SEQ ID NO: 1403197 - RNA, 19 nt, Pseudomonas aeruginosa PA01
ggucagcagcaccgcgagc

SEQ ID NO: 1403198 - RNA, 14 nt, Pseudomonas aeruginosa PA01
ggucagcagcgcca

SEQ ID NO: 1403199 - RNA, 21 nt, Pseudomonas aeruginosa PA01
ggucagcccguguucggccag

SEQ ID NO: 1403200 - RNA, 21 nt, Pseudomonas aeruginosa PA01
ggucagccaccugcucgcuga

SEQ ID NO: 1403201 - RNA, 16 nt, Pseudomonas aeruginosa PA01
ggucagcaguugccgg

SEQ ID NO: 1403202 - RNA, 23 nt, Pseudomonas aeruginosa PA01
ggugcagccacccagcagcaacu

SEQ ID NO: 1403203 - RNA, 18 nt, Pseudomonas aeruginosa PA01
ggugcagauggucgccgg

SEQ ID NO: 1403204 - RNA, 17 nt, Pseudomonas aeruginosa PA01
ggugauguaggacgccu

SEQ ID NO: 1403205 - RNA, 15 nt, Pseudomonas aeruginosa PA01
ggugauguaggccgc

SEQ ID NO: 1403206 - RNA, 14 nt, Pseudomonas aeruginosa PA01
ggugaugucgcggc

SEQ ID NO: 1403207 - RNA, 19 nt, Pseudomonas aeruginosa PA01
ggugaugucgcggcaggcg

SEQ ID NO: 1403208 - RNA, 21 nt, Pseudomonas aeruginosa PA01
ggugaugucgcggcaggcggc

SEQ ID NO: 1403209 - RNA, 14 nt, Pseudomonas aeruginosa PA01
ggugcacggccagg

SEQ ID NO: 1403210 - RNA, 18 nt, Pseudomonas aeruginosa PA01
ggugcacggcgacccgcc

SEQ ID NO: 1403211 - RNA, 18 nt, Pseudomonas aeruginosa PA01
ggugauccagcuggcgcg

SEQ ID NO: 1403212 - RNA, 14 nt, Pseudomonas aeruginosa PA01
ggugauccaggcgu

SEQ ID NO: 1403213 - RNA, 15 nt, Pseudomonas aeruginosa PA01
ggugaucgagccgcc

SEQ ID NO: 1403214 - RNA, 16 nt, Pseudomonas aeruginosa PA01
ggugaucgagccgccg

SEQ ID NO: 1403215 - RNA, 14 nt, Pseudomonas aeruginosa PA01
ggugaugccgcgga

SEQ ID NO: 1403216 - RNA, 16 nt, Pseudomonas aeruginosa PA01
ggugaugccgcggacg

SEQ ID NO: 1403217 - RNA, 17 nt, Pseudomonas aeruginosa PA01
ggugagguagaagcggc

SEQ ID NO: 1403218 - RNA, 19 nt, Pseudomonas aeruginosa PA01
ggugagguagaagcggccg

SEQ ID NO: 1403219 - RNA, 16 nt, Pseudomonas aeruginosa PA01
ggugagguugccgccg

SEQ ID NO: 1403220 - RNA, 17 nt, Pseudomonas aeruginosa PA01
ggugauaccgccggcgg

SEQ ID NO: 1403221 - RNA, 16 nt, Pseudomonas aeruginosa PA01
ggugaucagucgucgu

SEQ ID NO: 1403222 - RNA, 15 nt, Pseudomonas aeruginosa PA01
ggugaucagcuccgc

SEQ ID NO: 1403223 - RNA, 18 nt, Pseudomonas aeruginosa PA01
ggugaucagcuccgccuc

SEQ ID NO: 1403224 - RNA, 16 nt, Pseudomonas aeruginosa PA01
ggugaucacgucggcg

SEQ ID NO: 1403225 - RNA, 13 nt, Pseudomonas aeruginosa PA01
ggugaucaccgcc

SEQ ID NO: 1403226 - RNA, 15 nt, Pseudomonas aeruginosa PA01
ggugaucaccgccuu

SEQ ID NO: 1403227 - RNA, 14 nt, Pseudomonas aeruginosa PA01
ggugacgcagggcg

SEQ ID NO: 1403228 - RNA, 17 nt, Pseudomonas aeruginosa PA01
ggugacgaacgaagcgc

SEQ ID NO: 1403229 - RNA, 19 nt, Pseudomonas aeruginosa PA01
ggugacgaacgaagcgccc

SEQ ID NO: 1403230 - RNA, 21 nt, Pseudomonas aeruginosa PA01
ggugaccguuucgccgccggc

SEQ ID NO: 1403231 - RNA, 19 nt, Pseudomonas aeruginosa PA01
ggugacgguccgcgccacg

SEQ ID NO: 1403232 - RNA, 16 nt, Pseudomonas aeruginosa PA01
ggugacguugcgccgc

SEQ ID NO: 1403233 - RNA, 20 nt, Pseudomonas aeruginosa PA01
ggugacguugcgccgcagcg

SEQ ID NO: 1403234 - RNA, 12 nt, Pseudomonas aeruginosa PA01
ggugaccgugcg

SEQ ID NO: 1403235 - RNA, 14 nt, Pseudomonas aeruginosa PA01
ggugaagugaucga

SEQ ID NO: 1403236 - RNA, 22 nt, Pseudomonas aeruginosa PA01
ggugaauuccauauucaacguc

SEQ ID NO: 1403237 - RNA, 14 nt, Pseudomonas aeruginosa PA01
ggugaaggcgaagu

SEQ ID NO: 1403238 - RNA, 22 nt, Pseudomonas aeruginosa PA01
ggugaagcgcaggcggcuggcg

SEQ ID NO: 1403239 - RNA, 12 nt, Pseudomonas aeruginosa PA01
ggugaagcgcuc

SEQ ID NO: 1403240 - RNA, 16 nt, Pseudomonas aeruginosa PA01
ggugaacuggccgucg

SEQ ID NO: 1403241 - RNA, 17 nt, Pseudomonas aeruginosa PA01
ggugaagcccaggcgcu

SEQ ID NO: 1403242 - RNA, 13 nt, Pseudomonas aeruginosa PA01
ggucggcgcggcg

SEQ ID NO: 1403243 - RNA, 21 nt, Pseudomonas aeruginosa PA01
ggucggcgcggcgcuccaggc

SEQ ID NO: 1403244 - RNA, 19 nt, Pseudomonas aeruginosa PA01
ggucggcggcagcugcggc

SEQ ID NO: 1403245 - RNA, 16 nt, Pseudomonas aeruginosa PA01
ggucggguccgggccc

SEQ ID NO: 1403246 - RNA, 13 nt, Pseudomonas aeruginosa PA01
ggucggucggcgg

SEQ ID NO: 1403247 - RNA, 15 nt, Pseudomonas aeruginosa PA01
ggucggucuggcggc

SEQ ID NO: 1403248 - RNA, 20 nt, Pseudomonas aeruginosa PA01
ggucggucuggcggcccugg

SEQ ID NO: 1403249 - RNA, 16 nt, Pseudomonas aeruginosa PA01
ggucgguccgccgaug

SEQ ID NO: 1403250 - RNA, 18 nt, Pseudomonas aeruginosa PA01
ggucggugagcacgccgc

SEQ ID NO: 1403251 - RNA, 14 nt, Pseudomonas aeruginosa PA01
ggucguccugcgga

SEQ ID NO: 1403252 - RNA, 19 nt, Pseudomonas aeruginosa PA01
ggucggcgaaggcgaacca

SEQ ID NO: 1403253 - RNA, 23 nt, Pseudomonas aeruginosa PA01
ggucggccuggguacgcaccggc

SEQ ID NO: 1403254 - RNA, 12 nt, Pseudomonas aeruginosa PA01
ggucggcgcgcg

SEQ ID NO: 1403255 - RNA, 20 nt, Pseudomonas aeruginosa PA01
ggucggcgccggugcuggcg

SEQ ID NO: 1403256 - RNA, 16 nt, Pseudomonas aeruginosa PA01
ggucggcgccugcgga

SEQ ID NO: 1403257 - RNA, 13 nt, Pseudomonas aeruginosa PA01
ggucggcgcgacg

SEQ ID NO: 1403258 - RNA, 16 nt, Pseudomonas aeruginosa PA01
ggucggcgcgacggcc

SEQ ID NO: 1403259 - RNA, 13 nt, Pseudomonas aeruginosa PA01
ggucggcgcgccc

SEQ ID NO: 1403260 - RNA, 16 nt, Pseudomonas aeruginosa PA01
ggucggcgcgcccggc

SEQ ID NO: 1403261 - RNA, 15 nt, Pseudomonas aeruginosa PA01
ggucggacaggcauu

SEQ ID NO: 1403262 - RNA, 12 nt, Pseudomonas aeruginosa PA01
ggucggaucggc

SEQ ID NO: 1403263 - RNA, 15 nt, Pseudomonas aeruginosa PA01
ggucggaucggccuu

SEQ ID NO: 1403264 - RNA, 20 nt, Pseudomonas aeruginosa PA01
ggucggccggcagcuccggc

SEQ ID NO: 1403265 - RNA, 14 nt, Pseudomonas aeruginosa PA01
ggucggccucgagc

SEQ ID NO: 1403266 - RNA, 23 nt, Pseudomonas aeruginosa PA01
ggucggccucgagcaucuccggc

SEQ ID NO: 1403267 - RNA, 17 nt, Pseudomonas aeruginosa PA01
ggucuugaucacgucca

SEQ ID NO: 1403268 - RNA, 20 nt, Pseudomonas aeruginosa PA01
ggugaacucaugcaggccga

SEQ ID NO: 1403269 - RNA, 20 nt, Pseudomonas aeruginosa PA01
ggucuguugguggggcgccg

SEQ ID NO: 1403270 - RNA, 21 nt, Pseudomonas aeruginosa PA01
ggucuucaggccgaguccgcg

SEQ ID NO: 1403271 - RNA, 19 nt, Pseudomonas aeruginosa PA01
ggucuucaucaccuugccc

SEQ ID NO: 1403272 - RNA, 22 nt, Pseudomonas aeruginosa PA01
ggucugguagcgaaucugcagg

SEQ ID NO: 1403273 - RNA, 16 nt, Pseudomonas aeruginosa PA01
ggucuguggaggcgca

SEQ ID NO: 1403274 - RNA, 20 nt, Pseudomonas aeruginosa PA01
ggucugcucgcgcuucucga

SEQ ID NO: 1403275 - RNA, 15 nt, Pseudomonas aeruginosa PA01
ggucugcucggcgau

SEQ ID NO: 1403276 - RNA, 15 nt, Pseudomonas aeruginosa PA01
ggucugcugcgcgca

SEQ ID NO: 1403277 - RNA, 22 nt, Pseudomonas aeruginosa PA01
ggucugcugguagcugcugccg

SEQ ID NO: 1403278 - RNA, 18 nt, Pseudomonas aeruginosa PA01
ggucugcuugcgcuggcc

SEQ ID NO: 1403279 - RNA, 19 nt, Pseudomonas aeruginosa PA01
ggucugcuugcgcuggccg

SEQ ID NO: 1403280 - RNA, 20 nt, Pseudomonas aeruginosa PA01
ggucugcuugcgcuggccgg

SEQ ID NO: 1403281 - RNA, 15 nt, Pseudomonas aeruginosa PA01
ggucuggaugaacga

SEQ ID NO: 1403282 - RNA, 20 nt, Pseudomonas aeruginosa PA01
ggucuacgugauccguggcg

SEQ ID NO: 1403283 - RNA, 14 nt, Pseudomonas aeruginosa PA01
ggucuagccgggcc

SEQ ID NO: 1403284 - RNA, 16 nt, Pseudomonas aeruginosa PA01
ggucuagcgccccggc

SEQ ID NO: 1403285 - RNA, 19 nt, Pseudomonas aeruginosa PA01
ggucgugcagcagcgccuu

SEQ ID NO: 1403286 - RNA, 16 nt, Pseudomonas aeruginosa PA01
ggucgugcagcccggu

SEQ ID NO: 1403287 - RNA, 16 nt, Pseudomonas aeruginosa PA01
ggucgucgcccuggcc

SEQ ID NO: 1403288 - RNA, 18 nt, Pseudomonas aeruginosa PA01
ggucgucgcccuggccga

SEQ ID NO: 1403289 - RNA, 15 nt, Pseudomonas aeruginosa PA01
ggucguugccgucga

SEQ ID NO: 1403290 - RNA, 20 nt, Pseudomonas aeruginosa PA01
ggucguugccgucgagcacc

SEQ ID NO: 1403291 - RNA, 16 nt, Pseudomonas aeruginosa PA01
ggucguugcgccggcc

SEQ ID NO: 1403292 - RNA, 20 nt, Pseudomonas aeruginosa PA01
ggucguugcgcgccagcgcc

SEQ ID NO: 1403293 - RNA, 22 nt, Pseudomonas aeruginosa PA01
ggucguugcgcgccagcgccac

SEQ ID NO: 1403294 - RNA, 18 nt, Pseudomonas aeruginosa PA01
ggucguuggccaggcgcg

SEQ ID NO: 1403295 - RNA, 20 nt, Pseudomonas aeruginosa PA01
ggucguuggccaggcgcgac

SEQ ID NO: 1403296 - RNA, 21 nt, Pseudomonas aeruginosa PA01
ggucguuggccaggcgcgaca

SEQ ID NO: 1403297 - RNA, 21 nt, Pseudomonas aeruginosa PA01
ggucguucagugccagcagac

SEQ ID NO: 1403298 - RNA, 22 nt, Pseudomonas aeruginosa PA01
ggucgugguccagcucggucag

SEQ ID NO: 1403299 - RNA, 12 nt, Pseudomonas aeruginosa PA01
ggucguggucga

SEQ ID NO: 1403300 - RNA, 21 nt, Pseudomonas aeruginosa PA01
ggucgugcuugcagucgcgga

SEQ ID NO: 1403301 - RNA, 19 nt, Pseudomonas aeruginosa PA01
ggucguggcggaaggucag

SEQ ID NO: 1403302 - RNA, 13 nt, Pseudomonas aeruginosa PA01
ggucgucggucgg

SEQ ID NO: 1403303 - RNA, 17 nt, Pseudomonas aeruginosa PA01
ggucgucggucggccag

SEQ ID NO: 1403304 - RNA, 15 nt, Pseudomonas aeruginosa PA01
gguaggggucggccu

SEQ ID NO: 1403305 - RNA, 16 nt, Pseudomonas aeruginosa PA01
gguaggggucggccug

SEQ ID NO: 1403306 - RNA, 20 nt, Pseudomonas aeruginosa PA01
gguagguagcguugcgccag

SEQ ID NO: 1403307 - RNA, 20 nt, Pseudomonas aeruginosa PA01
gguaggcucccccgcgccgc

SEQ ID NO: 1403308 - RNA, 14 nt, Pseudomonas aeruginosa PA01
gguaguccagccag

SEQ ID NO: 1403309 - RNA, 17 nt, Pseudomonas aeruginosa PA01
gguagucgagccggauc

SEQ ID NO: 1403310 - RNA, 14 nt, Pseudomonas aeruginosa PA01
gguagucgcccggc

SEQ ID NO: 1403311 - RNA, 18 nt, Pseudomonas aeruginosa PA01
gguagucgccggucagag

SEQ ID NO: 1403312 - RNA, 17 nt, Pseudomonas aeruginosa PA01
gguaggugagcgacccg

SEQ ID NO: 1403313 - RNA, 20 nt, Pseudomonas aeruginosa PA01
gguaguaggguucgccgacg

SEQ ID NO: 1403314 - RNA, 23 nt, Pseudomonas aeruginosa PA01
gguaguguuugcgcagggcgucg

SEQ ID NO: 1403315 - RNA, 13 nt, Pseudomonas aeruginosa PA01
gguagucggggca

SEQ ID NO: 1403316 - RNA, 20 nt, Pseudomonas aeruginosa PA01
gguagucggugaagcgcggc

SEQ ID NO: 1403317 - RNA, 21 nt, Pseudomonas aeruginosa PA01
gguagucggugaagcgcggcg

SEQ ID NO: 1403318 - RNA, 18 nt, Pseudomonas aeruginosa PA01
gguagugcggcgggcgcc

SEQ ID NO: 1403319 - RNA, 15 nt, Pseudomonas aeruginosa PA01
gguagugcucggcca

SEQ ID NO: 1403320 - RNA, 23 nt, Pseudomonas aeruginosa PA01
gguagugggcgaggcgcucgacg

SEQ ID NO: 1403321 - RNA, 14 nt, Pseudomonas aeruginosa PA01
gguagccgucaagc

SEQ ID NO: 1403322 - RNA, 14 nt, Pseudomonas aeruginosa PA01
gguagccggcgagc

SEQ ID NO: 1403323 - RNA, 18 nt, Pseudomonas aeruginosa PA01
gguagcgcugcgccaggc

SEQ ID NO: 1403324 - RNA, 19 nt, Pseudomonas aeruginosa PA01
gguagcguugcgccagacc

SEQ ID NO: 1403325 - RNA, 16 nt, Pseudomonas aeruginosa PA01
gguagcggcaggagca

SEQ ID NO: 1403326 - RNA, 20 nt, Pseudomonas aeruginosa PA01
gguagcggcguucgccgagc

SEQ ID NO: 1403327 - RNA, 15 nt, Pseudomonas aeruginosa PA01
gguagcggaucagcc

SEQ ID NO: 1403328 - RNA, 15 nt, Pseudomonas aeruginosa PA01
gguagcuccaggccg

SEQ ID NO: 1403329 - RNA, 20 nt, Pseudomonas aeruginosa PA01
gguagcugagcaggccgacg

SEQ ID NO: 1403330 - RNA, 15 nt, Pseudomonas aeruginosa PA01
gguagcgggccagca

SEQ ID NO: 1403331 - RNA, 24 nt, Pseudomonas aeruginosa PA01
gguaggacagggccaggccgagca

SEQ ID NO: 1403332 - RNA, 22 nt, Pseudomonas aeruginosa PA01
gguagcugcgcagggcgccguc

SEQ ID NO: 1403333 - RNA, 17 nt, Pseudomonas aeruginosa PA01
gguagcugcuccagccc

SEQ ID NO: 1403334 - RNA, 19 nt, Pseudomonas aeruginosa PA01
gguagcugcuccagcccgg

SEQ ID NO: 1403335 - RNA, 20 nt, Pseudomonas aeruginosa PA01
gguaggagccgucgccggcg

SEQ ID NO: 1403336 - RNA, 13 nt, Pseudomonas aeruginosa PA01
gguaggcaucgac

SEQ ID NO: 1403337 - RNA, 21 nt, Pseudomonas aeruginosa PA01
gguagaacuccuugccguggc

SEQ ID NO: 1403338 - RNA, 14 nt, Pseudomonas aeruginosa PA01
gguagaagcggccg

SEQ ID NO: 1403339 - RNA, 15 nt, Pseudomonas aeruginosa PA01
gguagaagcggccgc

SEQ ID NO: 1403340 - RNA, 18 nt, Pseudomonas aeruginosa PA01
gguagagucgcucgcgca

SEQ ID NO: 1403341 - RNA, 23 nt, Pseudomonas aeruginosa PA01
gguagccggccaaccaccggcgc

SEQ ID NO: 1403342 - RNA, 17 nt, Pseudomonas aeruginosa PA01
gguagccgcgccggccg

SEQ ID NO: 1403343 - RNA, 12 nt, Pseudomonas aeruginosa PA01
gguagccgcagu

SEQ ID NO: 1403344 - RNA, 19 nt, Pseudomonas aeruginosa PA01
gguagccgcaguccagggc

SEQ ID NO: 1403345 - RNA, 13 nt, Pseudomonas aeruginosa PA01
gguagccgcccac

SEQ ID NO: 1403346 - RNA, 14 nt, Pseudomonas aeruginosa PA01
gguagccgcccacc

SEQ ID NO: 1403347 - RNA, 19 nt, Pseudomonas aeruginosa PA01
gguagccgcccaccgcggg

SEQ ID NO: 1403348 - RNA, 20 nt, Pseudomonas aeruginosa PA01
gguagccaggggucaggccg

SEQ ID NO: 1403349 - RNA, 21 nt, Pseudomonas aeruginosa PA01
gguagccaugcacacgcuccc

SEQ ID NO: 1403350 - RNA, 15 nt, Pseudomonas aeruginosa PA01
gguagccauggcgga

SEQ ID NO: 1403351 - RNA, 17 nt, Pseudomonas aeruginosa PA01
gguagcagccguccagc

SEQ ID NO: 1403352 - RNA, 16 nt, Pseudomonas aeruginosa PA01
gguagcccaggccgaa

SEQ ID NO: 1403353 - RNA, 17 nt, Pseudomonas aeruginosa PA01
gguagcccgcggcgagc

SEQ ID NO: 1403354 - RNA, 18 nt, Pseudomonas aeruginosa PA01
gguagcccgcggcgagca

SEQ ID NO: 1403355 - RNA, 18 nt, Pseudomonas aeruginosa PA01
gguacuaucccggucggg

SEQ ID NO: 1403356 - RNA, 21 nt, Pseudomonas aeruginosa PA01
gguacucggcccgggccuggu

SEQ ID NO: 1403357 - RNA, 24 nt, Pseudomonas aeruginosa PA01
gguacugccgcuaucgcuggcgca

SEQ ID NO: 1403358 - RNA, 20 nt, Pseudomonas aeruginosa PA01
gguacuccggguugaccgcc

SEQ ID NO: 1403359 - RNA, 17 nt, Pseudomonas aeruginosa PA01
gguacuccuggcauggc

SEQ ID NO: 1403360 - RNA, 16 nt, Pseudomonas aeruginosa PA01
gguacgcucaccacca

SEQ ID NO: 1403361 - RNA, 15 nt, Pseudomonas aeruginosa PA01
gguacggaagcggcc

SEQ ID NO: 1403362 - RNA, 13 nt, Pseudomonas aeruginosa PA01
gguacggucgagg

SEQ ID NO: 1403363 - RNA, 13 nt, Pseudomonas aeruginosa PA01
gguaccgcuggcg

SEQ ID NO: 1403364 - RNA, 14 nt, Pseudomonas aeruginosa PA01
gguaccggccaggc

SEQ ID NO: 1403365 - RNA, 14 nt, Pseudomonas aeruginosa PA01
gguacgacugacga

SEQ ID NO: 1403366 - RNA, 18 nt, Pseudomonas aeruginosa PA01
gguacgacugacgaaggc

SEQ ID NO: 1403367 - RNA, 19 nt, Pseudomonas aeruginosa PA01
gguaccguugcgcaggcgu

SEQ ID NO: 1403368 - RNA, 16 nt, Pseudomonas aeruginosa PA01
gguaccugcucgcggg

SEQ ID NO: 1403369 - RNA, 21 nt, Pseudomonas aeruginosa PA01
gguaccugcucgcgggucacc

SEQ ID NO: 1403370 - RNA, 15 nt, Pseudomonas aeruginosa PA01
gguauugcagacgcu

SEQ ID NO: 1403371 - RNA, 15 nt, Pseudomonas aeruginosa PA01
ggucaaccgcgggcg

SEQ ID NO: 1403372 - RNA, 22 nt, Pseudomonas aeruginosa PA01
gguauuguggccccagcgcgag

SEQ ID NO: 1403373 - RNA, 15 nt, Pseudomonas aeruginosa PA01
ggucaacaccagcgc

SEQ ID NO: 1403374 - RNA, 17 nt, Pseudomonas aeruginosa PA01
ggucaacaccagcgccg

SEQ ID NO: 1403375 - RNA, 18 nt, Pseudomonas aeruginosa PA01
ggucaacaccagcgccgc

SEQ ID NO: 1403376 - RNA, 19 nt, Pseudomonas aeruginosa PA01
ggucaacaccagcgccgcc

SEQ ID NO: 1403377 - RNA, 20 nt, Pseudomonas aeruginosa PA01
ggucaacaccagcgccgcca

SEQ ID NO: 1403378 - RNA, 20 nt, Pseudomonas aeruginosa PA01
gguaugggugcccuugccgg

SEQ ID NO: 1403379 - RNA, 18 nt, Pseudomonas aeruginosa PA01
gguaugccggagugccgc

SEQ ID NO: 1403380 - RNA, 18 nt, Pseudomonas aeruginosa PA01
gguauucgccggccaggu

SEQ ID NO: 1403381 - RNA, 14 nt, Pseudomonas aeruginosa PA01
gguaucaugcgccc

SEQ ID NO: 1403382 - RNA, 18 nt, Pseudomonas aeruginosa PA01
gguaucgaucucgaucga

SEQ ID NO: 1403383 - RNA, 15 nt, Pseudomonas aeruginosa PA01
gguaucgcugggcgc

SEQ ID NO: 1403384 - RNA, 14 nt, Pseudomonas aeruginosa PA01
gguaucgcugucgc

SEQ ID NO: 1403385 - RNA, 11 nt, Pseudomonas aeruginosa PA01
gguaucggcca

SEQ ID NO: 1403386 - RNA, 16 nt, Pseudomonas aeruginosa PA01
gguauccagcacccgc

SEQ ID NO: 1403387 - RNA, 15 nt, Pseudomonas aeruginosa PA01
gguauccagcggccg

SEQ ID NO: 1403388 - RNA, 17 nt, Pseudomonas aeruginosa PA01
gguauccaccucgcccu

SEQ ID NO: 1403389 - RNA, 14 nt, Pseudomonas aeruginosa PA01
gguaucccggcuga

SEQ ID NO: 1403390 - RNA, 23 nt, Pseudomonas aeruginosa PA01
gguaucccggcugagcgccaggc

SEQ ID NO: 1403391 - RNA, 15 nt, Pseudomonas aeruginosa PA01
gguaucccuggaacu

SEQ ID NO: 1403392 - RNA, 13 nt, Pseudomonas aeruginosa PA01
ggucaccgcgccg

SEQ ID NO: 1403393 - RNA, 19 nt, Pseudomonas aeruginosa PA01
ggucaccgucugcaccgcc

SEQ ID NO: 1403394 - RNA, 17 nt, Pseudomonas aeruginosa PA01
ggucaccgccagcggga

SEQ ID NO: 1403395 - RNA, 19 nt, Pseudomonas aeruginosa PA01
ggucaccagggucacgccg

SEQ ID NO: 1403396 - RNA, 23 nt, Pseudomonas aeruginosa PA01
ggucaccacguugcgccgcagca

SEQ ID NO: 1403397 - RNA, 23 nt, Pseudomonas aeruginosa PA01
ggucaccagcaccacccggcgca

SEQ ID NO: 1403398 - RNA, 14 nt, Pseudomonas aeruginosa PA01
ggucaccacccagc

SEQ ID NO: 1403399 - RNA, 20 nt, Pseudomonas aeruginosa PA01
ggucaccaugaucaucggcu

SEQ ID NO: 1403400 - RNA, 22 nt, Pseudomonas aeruginosa PA01
ggucaccaugaucaucggcugg

SEQ ID NO: 1403401 - RNA, 21 nt, Pseudomonas aeruginosa PA01
ggucacccauucgaugccgcg

SEQ ID NO: 1403402 - RNA, 13 nt, Pseudomonas aeruginosa PA01
ggucaccagguug

SEQ ID NO: 1403403 - RNA, 21 nt, Pseudomonas aeruginosa PA01
ggucacgccgagggcgcggcg

SEQ ID NO: 1403404 - RNA, 15 nt, Pseudomonas aeruginosa PA01
ggucacgaaggcgau

SEQ ID NO: 1403405 - RNA, 17 nt, Pseudomonas aeruginosa PA01
ggucacgcaggcgcugg

SEQ ID NO: 1403406 - RNA, 18 nt, Pseudomonas aeruginosa PA01
ggucacgcaggcgcuggc

SEQ ID NO: 1403407 - RNA, 23 nt, Pseudomonas aeruginosa PA01
ggucaccuugaccuugucggccg

SEQ ID NO: 1403408 - RNA, 21 nt, Pseudomonas aeruginosa PA01
ggucaccguggucauggcgca

SEQ ID NO: 1403409 - RNA, 17 nt, Pseudomonas aeruginosa PA01
ggucacggcgaagcggc

SEQ ID NO: 1403410 - RNA, 16 nt, Pseudomonas aeruginosa PA01
ggucacggugacggug

SEQ ID NO: 1403411 - RNA, 21 nt, Pseudomonas aeruginosa PA01
ggucagagggugaucagcucc

SEQ ID NO: 1403412 - RNA, 15 nt, Pseudomonas aeruginosa PA01
ggucacuuccuugcg

SEQ ID NO: 1403413 - RNA, 17 nt, Pseudomonas aeruginosa PA01
ggucagaccacgaagcg

SEQ ID NO: 1403414 - RNA, 16 nt, Pseudomonas aeruginosa PA01
ggucagaccagcccug

SEQ ID NO: 1403415 - RNA, 20 nt, Pseudomonas aeruginosa PA01
ggucagaccagcccuggcgc

SEQ ID NO: 1403416 - RNA, 13 nt, Pseudomonas aeruginosa PA01
ggucacguggccg

SEQ ID NO: 1403417 - RNA, 13 nt, Pseudomonas aeruginosa PA01
ggguucggcgaga

SEQ ID NO: 1403418 - RNA, 22 nt, Pseudomonas aeruginosa PA01
ggguucggggaacagcgccagc

SEQ ID NO: 1403419 - RNA, 22 nt, Pseudomonas aeruginosa PA01
ggguucgagucccguccgcugc

SEQ ID NO: 1403420 - RNA, 19 nt, Pseudomonas aeruginosa PA01
ggguuccucacggcgcagc

SEQ ID NO: 1403421 - RNA, 15 nt, Pseudomonas aeruginosa PA01
ggguucccagcagca

SEQ ID NO: 1403422 - RNA, 21 nt, Pseudomonas aeruginosa PA01
ggguucccaguugcugggcga

SEQ ID NO: 1403423 - RNA, 16 nt, Pseudomonas aeruginosa PA01
ggguugaugccgaggc

SEQ ID NO: 1403424 - RNA, 17 nt, Pseudomonas aeruginosa PA01
ggguugaguugcaggcc

SEQ ID NO: 1403425 - RNA, 21 nt, Pseudomonas aeruginosa PA01
ggguguugucgcggcugacga

SEQ ID NO: 1403426 - RNA, 16 nt, Pseudomonas aeruginosa PA01
ggguguucagcggcgc

SEQ ID NO: 1403427 - RNA, 18 nt, Pseudomonas aeruginosa PA01
ggguguucagcggcgcgu

SEQ ID NO: 1403428 - RNA, 17 nt, Pseudomonas aeruginosa PA01
ggguugggcagcgucgc

SEQ ID NO: 1403429 - RNA, 17 nt, Pseudomonas aeruginosa PA01
ggguuuccgugcgcugc

SEQ ID NO: 1403430 - RNA, 20 nt, Pseudomonas aeruginosa PA01
ggguugcccucgcagccggc

SEQ ID NO: 1403431 - RNA, 15 nt, Pseudomonas aeruginosa PA01
ggguugccgcgccga

SEQ ID NO: 1403432 - RNA, 17 nt, Pseudomonas aeruginosa PA01
ggguuggucggcaccag

SEQ ID NO: 1403433 - RNA, 15 nt, Pseudomonas aeruginosa PA01
ggguugguggccgcg

SEQ ID NO: 1403434 - RNA, 12 nt, Pseudomonas aeruginosa PA01
ggguuggccgca

SEQ ID NO: 1403435 - RNA, 21 nt, Pseudomonas aeruginosa PA01
ggguuuucuuuuugcgccagg

SEQ ID NO: 1403436 - RNA, 22 nt, Pseudomonas aeruginosa PA01
ggguuuucuuuuugcgccaggu

SEQ ID NO: 1403437 - RNA, 16 nt, Pseudomonas aeruginosa PA01
gguaauaucacccgca

SEQ ID NO: 1403438 - RNA, 21 nt, Pseudomonas aeruginosa PA01
gguaauccagggagaacagca

SEQ ID NO: 1403439 - RNA, 21 nt, Pseudomonas aeruginosa PA01
gguaauguucuccucccgccc

SEQ ID NO: 1403440 - RNA, 21 nt, Pseudomonas aeruginosa PA01
gguacagcgacucgcugccgg

SEQ ID NO: 1403441 - RNA, 12 nt, Pseudomonas aeruginosa PA01
gguacagcgcca

SEQ ID NO: 1403442 - RNA, 13 nt, Pseudomonas aeruginosa PA01
gguaccagcagcg

SEQ ID NO: 1403443 - RNA, 16 nt, Pseudomonas aeruginosa PA01
gguaccagcagcgccg

SEQ ID NO: 1403444 - RNA, 19 nt, Pseudomonas aeruginosa PA01
gguaccagggaagcgcgcg

SEQ ID NO: 1403445 - RNA, 14 nt, Pseudomonas aeruginosa PA01
gguacccgccggcc

SEQ ID NO: 1403446 - RNA, 15 nt, Pseudomonas aeruginosa PA01
gguacccgccggcca

SEQ ID NO: 1403447 - RNA, 18 nt, Pseudomonas aeruginosa PA01
gguacccgccggccaugc

SEQ ID NO: 1403448 - RNA, 20 nt, Pseudomonas aeruginosa PA01
gguacccggcagggccagcg

SEQ ID NO: 1403449 - RNA, 14 nt, Pseudomonas aeruginosa PA01
gguaacuggccagg

SEQ ID NO: 1403450 - RNA, 16 nt, Pseudomonas aeruginosa PA01
gguaaaggccaccaga

SEQ ID NO: 1403451 - RNA, 16 nt, Pseudomonas aeruginosa PA01
gguaaggauguccggg

SEQ ID NO: 1403452 - RNA, 21 nt, Pseudomonas aeruginosa PA01
gguaaggcaccaccgccgcca

SEQ ID NO: 1403453 - RNA, 23 nt, Pseudomonas aeruginosa PA01
gguaaggcaccaccgccgccagc

SEQ ID NO: 1403454 - RNA, 17 nt, Pseudomonas aeruginosa PA01
gggugcagcagguuccu

SEQ ID NO: 1403455 - RNA, 12 nt, Pseudomonas aeruginosa PA01
gggugccccagg

SEQ ID NO: 1403456 - RNA, 17 nt, Pseudomonas aeruginosa PA01
gggugccccaggcgagu

SEQ ID NO: 1403457 - RNA, 15 nt, Pseudomonas aeruginosa PA01
gggugcccucguuga

SEQ ID NO: 1403458 - RNA, 15 nt, Pseudomonas aeruginosa PA01
gggugccgaccaacg

SEQ ID NO: 1403459 - RNA, 14 nt, Pseudomonas aeruginosa PA01
gggugccgcgcagg

SEQ ID NO: 1403460 - RNA, 21 nt, Pseudomonas aeruginosa PA01
gggugccgggggcggcgaacg

SEQ ID NO: 1403461 - RNA, 14 nt, Pseudomonas aeruginosa PA01
gggugccggugcgg

SEQ ID NO: 1403462 - RNA, 23 nt, Pseudomonas aeruginosa PA01
gggugaucagucgucguccagcg

SEQ ID NO: 1403463 - RNA, 18 nt, Pseudomonas aeruginosa PA01
gggugaucuugaucugca

SEQ ID NO: 1403464 - RNA, 19 nt, Pseudomonas aeruginosa PA01
gggugaucuuuuccucguc

SEQ ID NO: 1403465 - RNA, 17 nt, Pseudomonas aeruginosa PA01
gggugauuucuucagcc

SEQ ID NO: 1403466 - RNA, 18 nt, Pseudomonas aeruginosa PA01
gggugaggcgcauggaca

SEQ ID NO: 1403467 - RNA, 21 nt, Pseudomonas aeruginosa PA01
gggcguccaguagcgccuggu

SEQ ID NO: 1403468 - RNA, 16 nt, Pseudomonas aeruginosa PA01
gggcgucgcccucggc

SEQ ID NO: 1403469 - RNA, 21 nt, Pseudomonas aeruginosa PA01
gggcgucgcccucggcgcugg

SEQ ID NO: 1403470 - RNA, 19 nt, Pseudomonas aeruginosa PA01
gggcguaacggcuugccgg

SEQ ID NO: 1403471 - RNA, 21 nt, Pseudomonas aeruginosa PA01
gggcgucgaacaccggcgccg

SEQ ID NO: 1403472 - RNA, 19 nt, Pseudomonas aeruginosa PA01
gggcgucgaaggcggcgcg

SEQ ID NO: 1403473 - RNA, 21 nt, Pseudomonas aeruginosa PA01
gggcgucgaaggcggcgcggc

SEQ ID NO: 1403474 - RNA, 15 nt, Pseudomonas aeruginosa PA01
gggcguccggcgagc

SEQ ID NO: 1403475 - RNA, 16 nt, Pseudomonas aeruginosa PA01
gggcguccggcgagca

SEQ ID NO: 1403476 - RNA, 20 nt, Pseudomonas aeruginosa PA01
gggcguagaccuugcggccg

SEQ ID NO: 1403477 - RNA, 16 nt, Pseudomonas aeruginosa PA01
ggguggucgccgccca

SEQ ID NO: 1403478 - RNA, 13 nt, Pseudomonas aeruginosa PA01
gggugucggcgau

SEQ ID NO: 1403479 - RNA, 14 nt, Pseudomonas aeruginosa PA01
gggugucggcgauc

SEQ ID NO: 1403480 - RNA, 17 nt, Pseudomonas aeruginosa PA01
ggguggcggcggcgagu

SEQ ID NO: 1403481 - RNA, 13 nt, Pseudomonas aeruginosa PA01
ggguggcgggcgg

SEQ ID NO: 1403482 - RNA, 17 nt, Pseudomonas aeruginosa PA01
ggguggcgggcggcccc

SEQ ID NO: 1403483 - RNA, 14 nt, Pseudomonas aeruginosa PA01
gggugggucauggc

SEQ ID NO: 1403484 - RNA, 19 nt, Pseudomonas aeruginosa PA01
ggguggcaacugccgcccg

SEQ ID NO: 1403485 - RNA, 17 nt, Pseudomonas aeruginosa PA01
ggguggagaggcgugcu

SEQ ID NO: 1403486 - RNA, 21 nt, Pseudomonas aeruginosa PA01
ggguggccaggcgcaccagca

SEQ ID NO: 1403487 - RNA, 14 nt, Pseudomonas aeruginosa PA01
ggguggcgacgccg

SEQ ID NO: 1403488 - RNA, 21 nt, Pseudomonas aeruginosa PA01
ggguggcgcccaugccgcccg

SEQ ID NO: 1403489 - RNA, 22 nt, Pseudomonas aeruginosa PA01
ggguggcgccgagcagcggcgc

SEQ ID NO: 1403490 - RNA, 19 nt, Pseudomonas aeruginosa PA01
ggguggaacgaggcgaccc

SEQ ID NO: 1403491 - RNA, 20 nt, Pseudomonas aeruginosa PA01
ggguggaacgaggcgacccg

SEQ ID NO: 1403492 - RNA, 22 nt, Pseudomonas aeruginosa PA01
gggugcucaggacguccuggcc

SEQ ID NO: 1403493 - RNA, 17 nt, Pseudomonas aeruginosa PA01
gggugcgcuggaacggc

SEQ ID NO: 1403494 - RNA, 22 nt, Pseudomonas aeruginosa PA01
guaccguuugcucucaucccug

SEQ ID NO: 1403495 - RNA, 14 nt, Pseudomonas aeruginosa PA01
guaccguugcgcag

SEQ ID NO: 1403496 - RNA, 15 nt, Pseudomonas aeruginosa PA01
guaccggccaggcgg

SEQ ID NO: 1403497 - RNA, 17 nt, Pseudomonas aeruginosa PA01
guaccggccaggcgguc

SEQ ID NO: 1403498 - RNA, 20 nt, Pseudomonas aeruginosa PA01
guaccggccaggcgguccag

SEQ ID NO: 1403499 - RNA, 21 nt, Pseudomonas aeruginosa PA01
guaccggccaggcgguccagc

SEQ ID NO: 1403500 - RNA, 19 nt, Pseudomonas aeruginosa PA01
guaccgcugcggccggcgc

SEQ ID NO: 1403501 - RNA, 20 nt, Pseudomonas aeruginosa PA01
guaccgcugcggccggcgcg

SEQ ID NO: 1403502 - RNA, 21 nt, Pseudomonas aeruginosa PA01
guaccgcugcggccggcgcgu

SEQ ID NO: 1403503 - RNA, 23 nt, Pseudomonas aeruginosa PA01
guaccgcuuccugggcuucgucc

SEQ ID NO: 1403504 - RNA, 13 nt, Pseudomonas aeruginosa PA01
guaccggcagcgc

SEQ ID NO: 1403505 - RNA, 15 nt, Pseudomonas aeruginosa PA01
guaccggcagcgccg

SEQ ID NO: 1403506 - RNA, 16 nt, Pseudomonas aeruginosa PA01
guaccggcagcgccga

SEQ ID NO: 1403507 - RNA, 19 nt, Pseudomonas aeruginosa PA01
guaccgacggucggcaggu

SEQ ID NO: 1403508 - RNA, 19 nt, Pseudomonas aeruginosa PA01
guacccggcagggccagcg

SEQ ID NO: 1403509 - RNA, 22 nt, Pseudomonas aeruginosa PA01
guacccggcagggccagcggaa

SEQ ID NO: 1403510 - RNA, 16 nt, Pseudomonas aeruginosa PA01
guaccgaaacagggcg

SEQ ID NO: 1403511 - RNA, 17 nt, Pseudomonas aeruginosa PA01
guaccagcgcaccaggg

SEQ ID NO: 1403512 - RNA, 18 nt, Pseudomonas aeruginosa PA01
guaccagcaaugcccagc

SEQ ID NO: 1403513 - RNA, 15 nt, Pseudomonas aeruginosa PA01
guaccagcagcgccg

SEQ ID NO: 1403514 - RNA, 20 nt, Pseudomonas aeruginosa PA01
guacccagcuugcuggcgua

SEQ ID NO: 1403515 - RNA, 18 nt, Pseudomonas aeruginosa PA01
guaccagggaagcgcgcg

SEQ ID NO: 1403516 - RNA, 17 nt, Pseudomonas aeruginosa PA01
guacccccaccgggcca

SEQ ID NO: 1403517 - RNA, 14 nt, Pseudomonas aeruginosa PA01
guacgcaccgcgua

SEQ ID NO: 1403518 - RNA, 14 nt, Pseudomonas aeruginosa PA01
guacgcccgcagcc

SEQ ID NO: 1403519 - RNA, 16 nt, Pseudomonas aeruginosa PA01
guacgcccuccagcac

SEQ ID NO: 1403520 - RNA, 13 nt, Pseudomonas aeruginosa PA01
guacgcccagcag

SEQ ID NO: 1403521 - RNA, 19 nt, Pseudomonas aeruginosa PA01
guacgcccagcagcggcag

SEQ ID NO: 1403522 - RNA, 23 nt, Pseudomonas aeruginosa PA01
guacgaucagccagggcaacgcc

SEQ ID NO: 1403523 - RNA, 17 nt, Pseudomonas aeruginosa PA01
guacgacugacgaaggc

SEQ ID NO: 1403524 - RNA, 21 nt, Pseudomonas aeruginosa PA01
guaccuggcgguacagccccc

SEQ ID NO: 1403525 - RNA, 21 nt, Pseudomonas aeruginosa PA01
guaccucgaagcccagcgccu

SEQ ID NO: 1403526 - RNA, 12 nt, Pseudomonas aeruginosa PA01
guaccugcucgc

SEQ ID NO: 1403527 - RNA, 15 nt, Pseudomonas aeruginosa PA01
guaccugcucgcggg

SEQ ID NO: 1403528 - RNA, 19 nt, Pseudomonas aeruginosa PA01
guacgaaaucuccuuggcc

SEQ ID NO: 1403529 - RNA, 23 nt, Pseudomonas aeruginosa PA01
guaccuuucuccccucaggcgcc

SEQ ID NO: 1403530 - RNA, 21 nt, Pseudomonas aeruginosa PA01
guacgccgcgcugcgccaggc

SEQ ID NO: 1403531 - RNA, 23 nt, Pseudomonas aeruginosa PA01
guacguaucccagcgcgugcagg

SEQ ID NO: 1403532 - RNA, 17 nt, Pseudomonas aeruginosa PA01
guacuccgagggccgcg

SEQ ID NO: 1403533 - RNA, 20 nt, Pseudomonas aeruginosa PA01
guacuccgagggccgcgccg

SEQ ID NO: 1403534 - RNA, 16 nt, Pseudomonas aeruginosa PA01
guacucaggccgggcg

SEQ ID NO: 1403535 - RNA, 11 nt, Pseudomonas aeruginosa PA01
guacgucgaga

SEQ ID NO: 1403536 - RNA, 20 nt, Pseudomonas aeruginosa PA01
guagccggcguccgccgggu

SEQ ID NO: 1403537 - RNA, 16 nt, Pseudomonas aeruginosa PA01
guagccggcgccgucg

SEQ ID NO: 1403538 - RNA, 14 nt, Pseudomonas aeruginosa PA01
guagccggcgcggc

SEQ ID NO: 1403539 - RNA, 18 nt, Pseudomonas aeruginosa PA01
guagccggcgcggcgcag

SEQ ID NO: 1403540 - RNA, 11 nt, Pseudomonas aeruginosa PA01
guagccggcgc

SEQ ID NO: 1403541 - RNA, 13 nt, Pseudomonas aeruginosa PA01
guagccggcgccg

SEQ ID NO: 1403542 - RNA, 17 nt, Pseudomonas aeruginosa PA01
guagcccccgccgcuga

SEQ ID NO: 1403543 - RNA, 13 nt, Pseudomonas aeruginosa PA01
guagccggccagg

SEQ ID NO: 1403544 - RNA, 15 nt, Pseudomonas aeruginosa PA01
guagccggccgauca

SEQ ID NO: 1403545 - RNA, 16 nt, Pseudomonas aeruginosa PA01
guagccggcgaucagc

SEQ ID NO: 1403546 - RNA, 14 nt, Pseudomonas aeruginosa PA01
guagcccaggccga

SEQ ID NO: 1403547 - RNA, 13 nt, Pseudomonas aeruginosa PA01
guagcagguccgc

SEQ ID NO: 1403548 - RNA, 20 nt, Pseudomonas aeruginosa PA01
guagccaggggucaggccga

SEQ ID NO: 1403549 - RNA, 22 nt, Pseudomonas aeruginosa PA01
guagccaggggucaggccgaug

SEQ ID NO: 1403550 - RNA, 23 nt, Pseudomonas aeruginosa PA01
guagccaggggucaggccgaugg

SEQ ID NO: 1403551 - RNA, 19 nt, Pseudomonas aeruginosa PA01
guagcagagggucgccagc

SEQ ID NO: 1403552 - RNA, 21 nt, Pseudomonas aeruginosa PA01
guagcagagggucgccagcga

SEQ ID NO: 1403553 - RNA, 20 nt, Pseudomonas aeruginosa PA01
guagaaggugcccagcggcg

SEQ ID NO: 1403554 - RNA, 14 nt, Pseudomonas aeruginosa PA01
guagaacgccagga

SEQ ID NO: 1403555 - RNA, 24 nt, Pseudomonas aeruginosa PA01
guagaacggguugaucagguucgg

SEQ ID NO: 1403556 - RNA, 14 nt, Pseudomonas aeruginosa PA01
guagaccaccagca

SEQ ID NO: 1403557 - RNA, 23 nt, Pseudomonas aeruginosa PA01
guagaccaccagcaggaucgagc

SEQ ID NO: 1403558 - RNA, 17 nt, Pseudomonas aeruginosa PA01
guagaccacgcaggcca

SEQ ID NO: 1403559 - RNA, 20 nt, Pseudomonas aeruginosa PA01
guagaccacgcaggccagcg

SEQ ID NO: 1403560 - RNA, 22 nt, Pseudomonas aeruginosa PA01
guagaccacgcaggccagcgcc

SEQ ID NO: 1403561 - RNA, 23 nt, Pseudomonas aeruginosa PA01
guagaccacgcaggccagcgcca

SEQ ID NO: 1403562 - RNA, 14 nt, Pseudomonas aeruginosa PA01
guacuucggcgcgg

SEQ ID NO: 1403563 - RNA, 16 nt, Pseudomonas aeruginosa PA01
guacuugacggcgccg

SEQ ID NO: 1403564 - RNA, 22 nt, Pseudomonas aeruginosa PA01
guagaaaugguggaccagcgcc

SEQ ID NO: 1403565 - RNA, 19 nt, Pseudomonas aeruginosa PA01
guagaacaggcugccgcag

SEQ ID NO: 1403566 - RNA, 12 nt, Pseudomonas aeruginosa PA01
guagcgccaggc

SEQ ID NO: 1403567 - RNA, 13 nt, Pseudomonas aeruginosa PA01
guagcgccaggcc

SEQ ID NO: 1403568 - RNA, 19 nt, Pseudomonas aeruginosa PA01
guagcgcaguucgccgccg

SEQ ID NO: 1403569 - RNA, 15 nt, Pseudomonas aeruginosa PA01
guagcgcagcggcag

SEQ ID NO: 1403570 - RNA, 22 nt, Pseudomonas aeruginosa PA01
guagcgcagcggcaggccacgg

SEQ ID NO: 1403571 - RNA, 13 nt, Pseudomonas aeruginosa PA01
guagccugcggcc

SEQ ID NO: 1403572 - RNA, 15 nt, Pseudomonas aeruginosa PA01
guagccugcggccag

SEQ ID NO: 1403573 - RNA, 19 nt, Pseudomonas aeruginosa PA01
guagccugcggccagcgcc

SEQ ID NO: 1403574 - RNA, 23 nt, Pseudomonas aeruginosa PA01
guagccugcggccagcgccagga

SEQ ID NO: 1403575 - RNA, 18 nt, Pseudomonas aeruginosa PA01
guagccucccgccgcggc

SEQ ID NO: 1403576 - RNA, 19 nt, Pseudomonas aeruginosa PA01
guagccuggauacgggcgc

SEQ ID NO: 1403577 - RNA, 23 nt, Pseudomonas aeruginosa PA01
guagccuggauacgggcgccagg

SEQ ID NO: 1403578 - RNA, 23 nt, Pseudomonas aeruginosa PA01
guagcgacccuucaacggcgacc

SEQ ID NO: 1403579 - RNA, 13 nt, Pseudomonas aeruginosa PA01
guagcggcugcgg

SEQ ID NO: 1403580 - RNA, 13 nt, Pseudomonas aeruginosa PA01
guagcgggccagc

SEQ ID NO: 1403581 - RNA, 17 nt, Pseudomonas aeruginosa PA01
guagcgcuucaucaggc

SEQ ID NO: 1403582 - RNA, 20 nt, Pseudomonas aeruginosa PA01
guagcgcuucaucaggcugc

SEQ ID NO: 1403583 - RNA, 16 nt, Pseudomonas aeruginosa PA01
guagcgcuucccgcgg

SEQ ID NO: 1403584 - RNA, 17 nt, Pseudomonas aeruginosa PA01
guagcgcuucccgcggc

SEQ ID NO: 1403585 - RNA, 16 nt, Pseudomonas aeruginosa PA01
guagcggaagccgucg

SEQ ID NO: 1403586 - RNA, 20 nt, Pseudomonas aeruginosa PA01
guagcggaagccgucggcga

SEQ ID NO: 1403587 - RNA, 23 nt, Pseudomonas aeruginosa PA01
guagcgccccuuggccagcacca

SEQ ID NO: 1403588 - RNA, 14 nt, Pseudomonas aeruginosa PA01
guagcgcgcggcga

SEQ ID NO: 1403589 - RNA, 17 nt, Pseudomonas aeruginosa PA01
guagcgcgcggcgagcc

SEQ ID NO: 1403590 - RNA, 16 nt, Pseudomonas aeruginosa PA01
guagcgcuccagcucc

SEQ ID NO: 1403591 - RNA, 22 nt, Pseudomonas aeruginosa PA01
guagcgcuccucgcgcugcccg

SEQ ID NO: 1403592 - RNA, 21 nt, Pseudomonas aeruginosa PA01
guagcgcuccuucuccggggc

SEQ ID NO: 1403593 - RNA, 22 nt, Pseudomonas aeruginosa PA01
guagcgcuccuucuccggggcc

SEQ ID NO: 1403594 - RNA, 15 nt, Pseudomonas aeruginosa PA01
guagcgcugcgccag

SEQ ID NO: 1403595 - RNA, 17 nt, Pseudomonas aeruginosa PA01
guagcgcugcgccaggc

SEQ ID NO: 1403596 - RNA, 19 nt, Pseudomonas aeruginosa PA01
guagcgcugcgccaggcuu

SEQ ID NO: 1403597 - RNA, 23 nt, Pseudomonas aeruginosa PA01
guagcgcucgauagcguccaggu

SEQ ID NO: 1403598 - RNA, 15 nt, Pseudomonas aeruginosa PA01
guagcuuuccgcggc

SEQ ID NO: 1403599 - RNA, 17 nt, Pseudomonas aeruginosa PA01
guagcugcuccagcccg

SEQ ID NO: 1403600 - RNA, 15 nt, Pseudomonas aeruginosa PA01
guagcugcggccgag

SEQ ID NO: 1403601 - RNA, 18 nt, Pseudomonas aeruginosa PA01
guagcugccggcgucguc

SEQ ID NO: 1403602 - RNA, 16 nt, Pseudomonas aeruginosa PA01
guagcugcgccgccuu

SEQ ID NO: 1403603 - RNA, 15 nt, Pseudomonas aeruginosa PA01
guagcugcagcgccc

SEQ ID NO: 1403604 - RNA, 14 nt, Pseudomonas aeruginosa PA01
guaggacaggccga

SEQ ID NO: 1403605 - RNA, 21 nt, Pseudomonas aeruginosa PA01
guaggacagggccaggccgag

SEQ ID NO: 1403606 - RNA, 17 nt, Pseudomonas aeruginosa PA01
guaggagccggccaggc

SEQ ID NO: 1403607 - RNA, 16 nt, Pseudomonas aeruginosa PA01
guaguccagcaggugg

SEQ ID NO: 1403608 - RNA, 13 nt, Pseudomonas aeruginosa PA01
guaguccagcgcc

SEQ ID NO: 1403609 - RNA, 20 nt, Pseudomonas aeruginosa PA01
guaguccagcgccgcgcugc

SEQ ID NO: 1403610 - RNA, 21 nt, Pseudomonas aeruginosa PA01
guaguccagcgguaccagcag

SEQ ID NO: 1403611 - RNA, 23 nt, Pseudomonas aeruginosa PA01
guaguccagcgguaccagcagcg

SEQ ID NO: 1403612 - RNA, 21 nt, Pseudomonas aeruginosa PA01
guagucccagaccacccggcu

SEQ ID NO: 1403613 - RNA, 22 nt, Pseudomonas aeruginosa PA01
guagucuucgaugcgccgcagg

SEQ ID NO: 1403614 - RNA, 23 nt, Pseudomonas aeruginosa PA01
guagucguucagcgccucgcggg

SEQ ID NO: 1403615 - RNA, 12 nt, Pseudomonas aeruginosa PA01
guagucggcgua

SEQ ID NO: 1403616 - RNA, 16 nt, Pseudomonas aeruginosa PA01
guagucgagccggauc

SEQ ID NO: 1403617 - RNA, 11 nt, Pseudomonas aeruginosa PA01
guagucgccca

SEQ ID NO: 1403618 - RNA, 16 nt, Pseudomonas aeruginosa PA01
guagucgcccagcgcc

SEQ ID NO: 1403619 - RNA, 17 nt, Pseudomonas aeruginosa PA01
guagucgcccagcgccu

SEQ ID NO: 1403620 - RNA, 12 nt, Pseudomonas aeruginosa PA01
guagucgcccgg

SEQ ID NO: 1403621 - RNA, 13 nt, Pseudomonas aeruginosa PA01
guaguaggcgcgg

SEQ ID NO: 1403622 - RNA, 16 nt, Pseudomonas aeruginosa PA01
guaguagggacggugc

SEQ ID NO: 1403623 - RNA, 19 nt, Pseudomonas aeruginosa PA01
guaguccgcugcgagcagg

SEQ ID NO: 1403624 - RNA, 14 nt, Pseudomonas aeruginosa PA01
guagugcucggcca

SEQ ID NO: 1403625 - RNA, 20 nt, Pseudomonas aeruginosa PA01
guaguggaagccguggcggg

SEQ ID NO: 1403626 - RNA, 12 nt, Pseudomonas aeruginosa PA01
guagugccgccc

SEQ ID NO: 1403627 - RNA, 13 nt, Pseudomonas aeruginosa PA01
guagugccgcccu

SEQ ID NO: 1403628 - RNA, 15 nt, Pseudomonas aeruginosa PA01
guagugcuccggggc

SEQ ID NO: 1403629 - RNA, 17 nt, Pseudomonas aeruginosa PA01
guagugcuccggggcgc

SEQ ID NO: 1403630 - RNA, 18 nt, Pseudomonas aeruginosa PA01
guagugcuccucgucgua

SEQ ID NO: 1403631 - RNA, 12 nt, Pseudomonas aeruginosa PA01
guaguucagucg

SEQ ID NO: 1403632 - RNA, 19 nt, Pseudomonas aeruginosa PA01
guaguucgaaccguggcgg

SEQ ID NO: 1403633 - RNA, 17 nt, Pseudomonas aeruginosa PA01
guaguugagccccaggu

SEQ ID NO: 1403634 - RNA, 20 nt, Pseudomonas aeruginosa PA01
guaguugagccccagguagg

SEQ ID NO: 1403635 - RNA, 19 nt, Pseudomonas aeruginosa PA01
guaguggcuuuucucgccu

SEQ ID NO: 1403636 - RNA, 16 nt, Pseudomonas aeruginosa PA01
guagugggcgaggcgc

SEQ ID NO: 1403637 - RNA, 20 nt, Pseudomonas aeruginosa PA01
guauagcucauggccagguc

SEQ ID NO: 1403638 - RNA, 15 nt, Pseudomonas aeruginosa PA01
guauaccagcggcug

SEQ ID NO: 1403639 - RNA, 19 nt, Pseudomonas aeruginosa PA01
guauccaugucagcgguga

SEQ ID NO: 1403640 - RNA, 16 nt, Pseudomonas aeruginosa PA01
guaucccggcugagcg

SEQ ID NO: 1403641 - RNA, 21 nt, Pseudomonas aeruginosa PA01
guauccaagagagcgccagcg

SEQ ID NO: 1403642 - RNA, 15 nt, Pseudomonas aeruginosa PA01
guauccagcggccgc

SEQ ID NO: 1403643 - RNA, 19 nt, Pseudomonas aeruginosa PA01
guaucgauccagccggggc

SEQ ID NO: 1403644 - RNA, 14 nt, Pseudomonas aeruginosa PA01
guaucgaugcgcgc

SEQ ID NO: 1403645 - RNA, 21 nt, Pseudomonas aeruginosa PA01
guaugcagcaacccggcccag

SEQ ID NO: 1403646 - RNA, 23 nt, Pseudomonas aeruginosa PA01
guaugccgcaggcaguggcgcca

SEQ ID NO: 1403647 - RNA, 19 nt, Pseudomonas aeruginosa PA01
guaugcgccuccagguaga

SEQ ID NO: 1403648 - RNA, 22 nt, Pseudomonas aeruginosa PA01
guaugggugcccuugccgguca

SEQ ID NO: 1403649 - RNA, 19 nt, Pseudomonas aeruginosa PA01
guauggccuucgcugaaau

SEQ ID NO: 1403650 - RNA, 17 nt, Pseudomonas aeruginosa PA01
guauggcggucggccag

SEQ ID NO: 1403651 - RNA, 24 nt, Pseudomonas aeruginosa PA01
guauggcgggccuugcgaccaggu

SEQ ID NO: 1403652 - RNA, 17 nt, Pseudomonas aeruginosa PA01
gucaaccgcgggcgagg

SEQ ID NO: 1403653 - RNA, 18 nt, Pseudomonas aeruginosa PA01
gucaacccuugcucccgc

SEQ ID NO: 1403654 - RNA, 15 nt, Pseudomonas aeruginosa PA01
gucaacaccagcgcc

SEQ ID NO: 1403655 - RNA, 16 nt, Pseudomonas aeruginosa PA01
gucaacaccagcgccg

SEQ ID NO: 1403656 - RNA, 18 nt, Pseudomonas aeruginosa PA01
gucaccacguugcgccgc

SEQ ID NO: 1403657 - RNA, 21 nt, Pseudomonas aeruginosa PA01
gucaccagcaccacccggcgc

SEQ ID NO: 1403658 - RNA, 13 nt, Pseudomonas aeruginosa PA01
gucaccacccagc

SEQ ID NO: 1403659 - RNA, 20 nt, Pseudomonas aeruginosa PA01
gucaccacccagccgcggcc

SEQ ID NO: 1403660 - RNA, 19 nt, Pseudomonas aeruginosa PA01
gucacgcaggcgcuggccg

SEQ ID NO: 1403661 - RNA, 23 nt, Pseudomonas aeruginosa PA01
gucacgcaggcuuuccagcccgg

SEQ ID NO: 1403662 - RNA, 23 nt, Pseudomonas aeruginosa PA01
gucacgccgaaguucuucagcag

SEQ ID NO: 1403663 - RNA, 18 nt, Pseudomonas aeruginosa PA01
gucacgccgaggcugcgg

SEQ ID NO: 1403664 - RNA, 16 nt, Pseudomonas aeruginosa PA01
gucacgccgagggcgc

SEQ ID NO: 1403665 - RNA, 21 nt, Pseudomonas aeruginosa PA01
gucacgccgaucaccccgccc

SEQ ID NO: 1403666 - RNA, 12 nt, Pseudomonas aeruginosa PA01
gucaccgccagc

SEQ ID NO: 1403667 - RNA, 22 nt, Pseudomonas aeruginosa PA01
gucaccggcgccacccucggcu

SEQ ID NO: 1403668 - RNA, 12 nt, Pseudomonas aeruginosa PA01
gucaccggcagg

SEQ ID NO: 1403669 - RNA, 16 nt, Pseudomonas aeruginosa PA01
gucaccggcagggcga

SEQ ID NO: 1403670 - RNA, 17 nt, Pseudomonas aeruginosa PA01
gucaccggcagggcgau

SEQ ID NO: 1403671 - RNA, 13 nt, Pseudomonas aeruginosa PA01
gucaccgcgccga

SEQ ID NO: 1403672 - RNA, 14 nt, Pseudomonas aeruginosa PA01
gucaccgcgccggu

SEQ ID NO: 1403673 - RNA, 13 nt, Pseudomonas aeruginosa PA01
gucaccagcagcc

SEQ ID NO: 1403674 - RNA, 15 nt, Pseudomonas aeruginosa PA01
gucacccgcgccugc

SEQ ID NO: 1403675 - RNA, 21 nt, Pseudomonas aeruginosa PA01
gucacccgcgccugcaggucg

SEQ ID NO: 1403676 - RNA, 17 nt, Pseudomonas aeruginosa PA01
ggugcuggacucgcgcc

SEQ ID NO: 1403677 - RNA, 16 nt, Pseudomonas aeruginosa PA01
ggugcuggcgucgccu

SEQ ID NO: 1403678 - RNA, 18 nt, Pseudomonas aeruginosa PA01
ggugcugcgcgcggccca

SEQ ID NO: 1403679 - RNA, 17 nt, Pseudomonas aeruginosa PA01
ggugcugcaccgggagu

SEQ ID NO: 1403680 - RNA, 21 nt, Pseudomonas aeruginosa PA01
gguggacggcauuggagauga

SEQ ID NO: 1403681 - RNA, 20 nt, Pseudomonas aeruginosa PA01
gguggacggucucgccgccg

SEQ ID NO: 1403682 - RNA, 16 nt, Pseudomonas aeruginosa PA01
gguggacgucgucggc

SEQ ID NO: 1403683 - RNA, 16 nt, Pseudomonas aeruginosa PA01
gguggauaucgucggg

SEQ ID NO: 1403684 - RNA, 23 nt, Pseudomonas aeruginosa PA01
gguggaugacccgcaccuugccc

SEQ ID NO: 1403685 - RNA, 17 nt, Pseudomonas aeruginosa PA01
gguggagcacgucgagc

SEQ ID NO: 1403686 - RNA, 14 nt, Pseudomonas aeruginosa PA01
gguggaggcccaga

SEQ ID NO: 1403687 - RNA, 13 nt, Pseudomonas aeruginosa PA01
ggugcaggggcgc

SEQ ID NO: 1403688 - RNA, 23 nt, Pseudomonas aeruginosa PA01
ggugcaggccgacguagccgcgu

SEQ ID NO: 1403689 - RNA, 12 nt, Pseudomonas aeruginosa PA01
ggugcaggccgc

SEQ ID NO: 1403690 - RNA, 16 nt, Pseudomonas aeruginosa PA01
ggugcaggaacagcca

SEQ ID NO: 1403691 - RNA, 20 nt, Pseudomonas aeruginosa PA01
ggugcggugggcgagggcgc

SEQ ID NO: 1403692 - RNA, 19 nt, Pseudomonas aeruginosa PA01
ggugcguacggucaugccg

SEQ ID NO: 1403693 - RNA, 23 nt, Pseudomonas aeruginosa PA01
ggugcucaggacguccuggccga

SEQ ID NO: 1403694 - RNA, 15 nt, Pseudomonas aeruginosa PA01
ggugcucaggcggcc

SEQ ID NO: 1403695 - RNA, 16 nt, Pseudomonas aeruginosa PA01
ggugcucaggcggccg

SEQ ID NO: 1403696 - RNA, 20 nt, Pseudomonas aeruginosa PA01
ggugcucaggcggccgaacu

SEQ ID NO: 1403697 - RNA, 18 nt, Pseudomonas aeruginosa PA01
ggugcucaugccuugucg

SEQ ID NO: 1403698 - RNA, 16 nt, Pseudomonas aeruginosa PA01
ggugcguucgcgggcg

SEQ ID NO: 1403699 - RNA, 18 nt, Pseudomonas aeruginosa PA01
ggugcguucgcgggcgcc

SEQ ID NO: 1403700 - RNA, 14 nt, Pseudomonas aeruginosa PA01
ggugggcagcagcg

SEQ ID NO: 1403701 - RNA, 13 nt, Pseudomonas aeruginosa PA01
gguggcgucgauc

SEQ ID NO: 1403702 - RNA, 23 nt, Pseudomonas aeruginosa PA01
gguggcguucucgaucaucgcca

SEQ ID NO: 1403703 - RNA, 21 nt, Pseudomonas aeruginosa PA01
ggugggaacgaaacgcuugcg

SEQ ID NO: 1403704 - RNA, 22 nt, Pseudomonas aeruginosa PA01
gguggcucagcgcggcggcggc

SEQ ID NO: 1403705 - RNA, 17 nt, Pseudomonas aeruginosa PA01
gguggcggacugguagg

SEQ ID NO: 1403706 - RNA, 16 nt, Pseudomonas aeruginosa PA01
gguggcggcggcgagu

SEQ ID NO: 1403707 - RNA, 12 nt, Pseudomonas aeruginosa PA01
gguggcgcggac

SEQ ID NO: 1403708 - RNA, 14 nt, Pseudomonas aeruginosa PA01
gguggcgcuggcca

SEQ ID NO: 1403709 - RNA, 16 nt, Pseudomonas aeruginosa PA01
gguggcgcgcaccacc

SEQ ID NO: 1403710 - RNA, 17 nt, Pseudomonas aeruginosa PA01
gguggcggggaacagca

SEQ ID NO: 1403711 - RNA, 16 nt, Pseudomonas aeruginosa PA01
gguggcgccgccggcg

SEQ ID NO: 1403712 - RNA, 14 nt, Pseudomonas aeruginosa PA01
gguuagccggcgau

SEQ ID NO: 1403713 - RNA, 15 nt, Pseudomonas aeruginosa PA01
gguuauccgccgccu

SEQ ID NO: 1403714 - RNA, 14 nt, Pseudomonas aeruginosa PA01
gguuaccggcgacc

SEQ ID NO: 1403715 - RNA, 16 nt, Pseudomonas aeruginosa PA01
gguuaccggcgaccac

SEQ ID NO: 1403716 - RNA, 15 nt, Pseudomonas aeruginosa PA01
gguguuggucaggcc

SEQ ID NO: 1403717 - RNA, 18 nt, Pseudomonas aeruginosa PA01
gguguugucgcggcugac

SEQ ID NO: 1403718 - RNA, 14 nt, Pseudomonas aeruginosa PA01
gguguuucggccgc

SEQ ID NO: 1403719 - RNA, 18 nt, Pseudomonas aeruginosa PA01
gguguuucggccgcugcc

SEQ ID NO: 1403720 - RNA, 22 nt, Pseudomonas aeruginosa PA01
ggugucggugaugcgucgcacc

SEQ ID NO: 1403721 - RNA, 16 nt, Pseudomonas aeruginosa PA01
ggugucggugcccucg

SEQ ID NO: 1403722 - RNA, 22 nt, Pseudomonas aeruginosa PA01
ggugucggugcccucgcggacg

SEQ ID NO: 1403723 - RNA, 22 nt, Pseudomonas aeruginosa PA01
ggugucgacgacgaaaggccgc

SEQ ID NO: 1403724 - RNA, 15 nt, Pseudomonas aeruginosa PA01
ggugucgaugccgcc

SEQ ID NO: 1403725 - RNA, 12 nt, Pseudomonas aeruginosa PA01
ggugugcgcugc

SEQ ID NO: 1403726 - RNA, 17 nt, Pseudomonas aeruginosa PA01
ggugugcagcagcacgg

SEQ ID NO: 1403727 - RNA, 13 nt, Pseudomonas aeruginosa PA01
ggugugaucacca

SEQ ID NO: 1403728 - RNA, 19 nt, Pseudomonas aeruginosa PA01
gguguagccguugagcacc

SEQ ID NO: 1403729 - RNA, 18 nt, Pseudomonas aeruginosa PA01
gguguagguauccgccgg

SEQ ID NO: 1403730 - RNA, 13 nt, Pseudomonas aeruginosa PA01
gguguccaccacc

SEQ ID NO: 1403731 - RNA, 13 nt, Pseudomonas aeruginosa PA01
ggugucaggccga

SEQ ID NO: 1403732 - RNA, 22 nt, Pseudomonas aeruginosa PA01
gguguccgauucuuggcucggc

SEQ ID NO: 1403733 - RNA, 13 nt, Pseudomonas aeruginosa PA01
gguguccgcggug

SEQ ID NO: 1403734 - RNA, 14 nt, Pseudomonas aeruginosa PA01
gguguccggcggcg

SEQ ID NO: 1403735 - RNA, 20 nt, Pseudomonas aeruginosa PA01
gguggucguagcagguccgc

SEQ ID NO: 1403736 - RNA, 18 nt, Pseudomonas aeruginosa PA01
gguggucgccgcccacgc

SEQ ID NO: 1403737 - RNA, 15 nt, Pseudomonas aeruginosa PA01
gguggucugcacggc

SEQ ID NO: 1403738 - RNA, 14 nt, Pseudomonas aeruginosa PA01
gguggucuugcgca

SEQ ID NO: 1403739 - RNA, 18 nt, Pseudomonas aeruginosa PA01
gguggucuugcgcaggcg

SEQ ID NO: 1403740 - RNA, 23 nt, Pseudomonas aeruginosa PA01
gguggugacauggaugaccacgu

SEQ ID NO: 1403741 - RNA, 22 nt, Pseudomonas aeruginosa PA01
gguggugauccaggcgucguug

SEQ ID NO: 1403742 - RNA, 21 nt, Pseudomonas aeruginosa PA01
gguggucagccagccgagcaa

SEQ ID NO: 1403743 - RNA, 15 nt, Pseudomonas aeruginosa PA01
gguuuggcgcccgcc

SEQ ID NO: 1403744 - RNA, 17 nt, Pseudomonas aeruginosa PA01
gguuuggcgcccgccuu

SEQ ID NO: 1403745 - RNA, 22 nt, Pseudomonas aeruginosa PA01
gguuuuugagcgaaaacagccg

SEQ ID NO: 1403746 - RNA, 16 nt, Pseudomonas aeruginosa PA01
gguugucaccggcagg

SEQ ID NO: 1403747 - RNA, 13 nt, Pseudomonas aeruginosa PA01
gguuguaggcgcc

SEQ ID NO: 1403748 - RNA, 17 nt, Pseudomonas aeruginosa PA01
gguuguaggcgccgccg

SEQ ID NO: 1403749 - RNA, 15 nt, Pseudomonas aeruginosa PA01
gguuggucugcucgg

SEQ ID NO: 1403750 - RNA, 18 nt, Pseudomonas aeruginosa PA01
gguuggucugcucggcga

SEQ ID NO: 1403751 - RNA, 13 nt, Pseudomonas aeruginosa PA01
gguuggcuuccag

SEQ ID NO: 1403752 - RNA, 20 nt, Pseudomonas aeruginosa PA01
gguuggcuuccagccagccc

SEQ ID NO: 1403753 - RNA, 15 nt, Pseudomonas aeruginosa PA01
gguugggcaggcgca

SEQ ID NO: 1403754 - RNA, 17 nt, Pseudomonas aeruginosa PA01
gguuggccuggcccggc

SEQ ID NO: 1403755 - RNA, 15 nt, Pseudomonas aeruginosa PA01
gguuggcgcaggccg

SEQ ID NO: 1403756 - RNA, 22 nt, Pseudomonas aeruginosa PA01
gguuggccgccuggcgcauggc

SEQ ID NO: 1403757 - RNA, 14 nt, Pseudomonas aeruginosa PA01
gguucgacgcgcca

SEQ ID NO: 1403758 - RNA, 16 nt, Pseudomonas aeruginosa PA01
gguucgacgcgccacg

SEQ ID NO: 1403759 - RNA, 18 nt, Pseudomonas aeruginosa PA01
gguugcugcuugcgcgcg

SEQ ID NO: 1403760 - RNA, 21 nt, Pseudomonas aeruginosa PA01
gguugcugcuugcgcgcggcg

SEQ ID NO: 1403761 - RNA, 20 nt, Pseudomonas aeruginosa PA01
gguugcugugcacccagacc

SEQ ID NO: 1403762 - RNA, 23 nt, Pseudomonas aeruginosa PA01
gguuggaaaagccccgcuucggc

SEQ ID NO: 1403763 - RNA, 14 nt, Pseudomonas aeruginosa PA01
gguuggccccgccg

SEQ ID NO: 1403764 - RNA, 17 nt, Pseudomonas aeruginosa PA01
gguuggccccgccgagg

SEQ ID NO: 1403765 - RNA, 23 nt, Pseudomonas aeruginosa PA01
gguucccgcagcgaucagcacca

SEQ ID NO: 1403766 - RNA, 23 nt, Pseudomonas aeruginosa PA01
gguuccaugcgaaaacggcgacc

SEQ ID NO: 1403767 - RNA, 23 nt, Pseudomonas aeruginosa PA01
gguucccagcagcaacagcgccg

SEQ ID NO: 1403768 - RNA, 16 nt, Pseudomonas aeruginosa PA01
gguuccuccugggccg

SEQ ID NO: 1403769 - RNA, 19 nt, Pseudomonas aeruginosa PA01
gguuccuccugggccgacg

SEQ ID NO: 1403770 - RNA, 16 nt, Pseudomonas aeruginosa PA01
gguuccuggcuggagu

SEQ ID NO: 1403771 - RNA, 16 nt, Pseudomonas aeruginosa PA01
gguucgaauccuccug

SEQ ID NO: 1403772 - RNA, 15 nt, Pseudomonas aeruginosa PA01
gguuccgcggcgacg

SEQ ID NO: 1403773 - RNA, 18 nt, Pseudomonas aeruginosa PA01
guaagacuggugaucgca

SEQ ID NO: 1403774 - RNA, 20 nt, Pseudomonas aeruginosa PA01
guaaugagcgauguccaggc

SEQ ID NO: 1403775 - RNA, 13 nt, Pseudomonas aeruginosa PA01
guacaccgccagg

SEQ ID NO: 1403776 - RNA, 17 nt, Pseudomonas aeruginosa PA01
guacaccuuggcgcgac

SEQ ID NO: 1403777 - RNA, 23 nt, Pseudomonas aeruginosa PA01
guacaccagauggcuggucaggc

SEQ ID NO: 1403778 - RNA, 23 nt, Pseudomonas aeruginosa PA01
guacagcgcgacaucggcgaugg

SEQ ID NO: 1403779 - RNA, 15 nt, Pseudomonas aeruginosa PA01
guacagcgggccggg

SEQ ID NO: 1403780 - RNA, 16 nt, Pseudomonas aeruginosa PA01
guacagcgggccgggg

SEQ ID NO: 1403781 - RNA, 17 nt, Pseudomonas aeruginosa PA01
guacagcgggccgggga

SEQ ID NO: 1403782 - RNA, 23 nt, Pseudomonas aeruginosa PA01
guacagcgacucgcugccggcgc

SEQ ID NO: 1403783 - RNA, 11 nt, Pseudomonas aeruginosa PA01
guacagcgagg

SEQ ID NO: 1403784 - RNA, 18 nt, Pseudomonas aeruginosa PA01
guacaggcgcaccuggcg

SEQ ID NO: 1403785 - RNA, 13 nt, Pseudomonas aeruginosa PA01
guacagcucgcgc

SEQ ID NO: 1403786 - RNA, 20 nt, Pseudomonas aeruginosa PA01
guacagcucggcgcccuggc

SEQ ID NO: 1403787 - RNA, 14 nt, Pseudomonas aeruginosa PA01
guacagcucguccu

SEQ ID NO: 1403788 - RNA, 23 nt, Pseudomonas aeruginosa PA01
guacagcuguccgcgccgcgucg

SEQ ID NO: 1403789 - RNA, 12 nt, Pseudomonas aeruginosa PA01
guacagcaggag

SEQ ID NO: 1403790 - RNA, 22 nt, Pseudomonas aeruginosa PA01
guacagaaacaaagagcccgcc

SEQ ID NO: 1403791 - RNA, 18 nt, Pseudomonas aeruginosa PA01
guacagcccccgccggcc

SEQ ID NO: 1403792 - RNA, 19 nt, Pseudomonas aeruginosa PA01
guacagggucuugccggua

SEQ ID NO: 1403793 - RNA, 16 nt, Pseudomonas aeruginosa PA01
guacaggucggcgccg

SEQ ID NO: 1403794 - RNA, 20 nt, Pseudomonas aeruginosa PA01
guacaggucggcgccggugc

SEQ ID NO: 1403795 - RNA, 13 nt, Pseudomonas aeruginosa PA01
guaccacgcagcc

SEQ ID NO: 1403796 - RNA, 20 nt, Pseudomonas aeruginosa PA01
gugccgccaucgccucgccg

SEQ ID NO: 1403797 - RNA, 22 nt, Pseudomonas aeruginosa PA01
gugccgccaucgccucgccggc

SEQ ID NO: 1403798 - RNA, 23 nt, Pseudomonas aeruginosa PA01
gugccgccaucgccucgccggcc

SEQ ID NO: 1403799 - RNA, 15 nt, Pseudomonas aeruginosa PA01
gugccgcaggccgcg

SEQ ID NO: 1403800 - RNA, 17 nt, Pseudomonas aeruginosa PA01
gugccgcaggccgcggc

SEQ ID NO: 1403801 - RNA, 19 nt, Pseudomonas aeruginosa PA01
gugccgcaggccgcggccg

SEQ ID NO: 1403802 - RNA, 21 nt, Pseudomonas aeruginosa PA01
gugccgcagacaucgccgagg

SEQ ID NO: 1403803 - RNA, 13 nt, Pseudomonas aeruginosa PA01
gugccgaucagcc

SEQ ID NO: 1403804 - RNA, 15 nt, Pseudomonas aeruginosa PA01
gugccgaggccgccg

SEQ ID NO: 1403805 - RNA, 16 nt, Pseudomonas aeruginosa PA01
gugccgaggccgccgc

SEQ ID NO: 1403806 - RNA, 14 nt, Pseudomonas aeruginosa PA01
gugccgagcaggau

SEQ ID NO: 1403807 - RNA, 16 nt, Pseudomonas aeruginosa PA01
gugccgagcaggauga

SEQ ID NO: 1403808 - RNA, 14 nt, Pseudomonas aeruginosa PA01
gugccgacuagauc

SEQ ID NO: 1403809 - RNA, 14 nt, Pseudomonas aeruginosa PA01
gugccgcccggcgc

SEQ ID NO: 1403810 - RNA, 21 nt, Pseudomonas aeruginosa PA01
gugccgcccggcgccaccgcg

SEQ ID NO: 1403811 - RNA, 13 nt, Pseudomonas aeruginosa PA01
gugccgccaggcc

SEQ ID NO: 1403812 - RNA, 19 nt, Pseudomonas aeruginosa PA01
gugccgccagucggccugg

SEQ ID NO: 1403813 - RNA, 21 nt, Pseudomonas aeruginosa PA01
gugccgcccugcucuugccga

SEQ ID NO: 1403814 - RNA, 14 nt, Pseudomonas aeruginosa PA01
gugccgggggcggc

SEQ ID NO: 1403815 - RNA, 20 nt, Pseudomonas aeruginosa PA01
gugccggguauccagcaccc

SEQ ID NO: 1403816 - RNA, 23 nt, Pseudomonas aeruginosa PA01
gugccggguauccagcacccgca

SEQ ID NO: 1403817 - RNA, 15 nt, Pseudomonas aeruginosa PA01
gugccgggccggcca

SEQ ID NO: 1403818 - RNA, 16 nt, Pseudomonas aeruginosa PA01
gugccgggccggccag

SEQ ID NO: 1403819 - RNA, 20 nt, Pseudomonas aeruginosa PA01
gugccgggccggccagggcg

SEQ ID NO: 1403820 - RNA, 21 nt, Pseudomonas aeruginosa PA01
gugccgggaagcgcaggccgc

SEQ ID NO: 1403821 - RNA, 22 nt, Pseudomonas aeruginosa PA01
gugccgggaagcgcaggccgcc

SEQ ID NO: 1403822 - RNA, 17 nt, Pseudomonas aeruginosa PA01
gugccgggcagugcgcc

SEQ ID NO: 1403823 - RNA, 13 nt, Pseudomonas aeruginosa PA01
gugccgggccagc

SEQ ID NO: 1403824 - RNA, 16 nt, Pseudomonas aeruginosa PA01
gugcaggucgcgcggc

SEQ ID NO: 1403825 - RNA, 20 nt, Pseudomonas aeruginosa PA01
gugcagguacggcgccgcug

SEQ ID NO: 1403826 - RNA, 13 nt, Pseudomonas aeruginosa PA01
gugcagggucagg

SEQ ID NO: 1403827 - RNA, 18 nt, Pseudomonas aeruginosa PA01
gugcagggucagucgagc

SEQ ID NO: 1403828 - RNA, 14 nt, Pseudomonas aeruginosa PA01
gugcagggcgucca

SEQ ID NO: 1403829 - RNA, 22 nt, Pseudomonas aeruginosa PA01
gugcaggguauuuuccagcagg

SEQ ID NO: 1403830 - RNA, 23 nt, Pseudomonas aeruginosa PA01
gugcaggguauuuuccagcaggc

SEQ ID NO: 1403831 - RNA, 16 nt, Pseudomonas aeruginosa PA01
gugcagggucacgcug

SEQ ID NO: 1403832 - RNA, 22 nt, Pseudomonas aeruginosa PA01
gugcagggucacgcugggcagg

SEQ ID NO: 1403833 - RNA, 13 nt, Pseudomonas aeruginosa PA01
gugcaggcgcccu

SEQ ID NO: 1403834 - RNA, 15 nt, Pseudomonas aeruginosa PA01
gugcaggcgcccugg

SEQ ID NO: 1403835 - RNA, 18 nt, Pseudomonas aeruginosa PA01
gugcaggcgcccuggccg

SEQ ID NO: 1403836 - RNA, 20 nt, Pseudomonas aeruginosa PA01
gugcaggcgcccuggccguc

SEQ ID NO: 1403837 - RNA, 14 nt, Pseudomonas aeruginosa PA01
gugcaggccgcgcg

SEQ ID NO: 1403838 - RNA, 19 nt, Pseudomonas aeruginosa PA01
gugcaggccgcgcgauggc

SEQ ID NO: 1403839 - RNA, 16 nt, Pseudomonas aeruginosa PA01
gugccaauccgggcgu

SEQ ID NO: 1403840 - RNA, 20 nt, Pseudomonas aeruginosa PA01
gugcccucgcggacgcuggc

SEQ ID NO: 1403841 - RNA, 16 nt, Pseudomonas aeruginosa PA01
gugcccuggaagccgg

SEQ ID NO: 1403842 - RNA, 13 nt, Pseudomonas aeruginosa PA01
gugcccuugccgg

SEQ ID NO: 1403843 - RNA, 17 nt, Pseudomonas aeruginosa PA01
gugcccuuuuccuccag

SEQ ID NO: 1403844 - RNA, 17 nt, Pseudomonas aeruginosa PA01
gugccguggcucggcgg

SEQ ID NO: 1403845 - RNA, 21 nt, Pseudomonas aeruginosa PA01
gugcgagucaccccgaccagc

SEQ ID NO: 1403846 - RNA, 19 nt, Pseudomonas aeruginosa PA01
gugccguacucauggccgc

SEQ ID NO: 1403847 - RNA, 22 nt, Pseudomonas aeruginosa PA01
gugccguacucauggccgcagc

SEQ ID NO: 1403848 - RNA, 20 nt, Pseudomonas aeruginosa PA01
gugccgucaggcaccucguc

SEQ ID NO: 1403849 - RNA, 24 nt, Pseudomonas aeruginosa PA01
gugccggugcggguggucgccgcc

SEQ ID NO: 1403850 - RNA, 17 nt, Pseudomonas aeruginosa PA01
gugccgguagcuggcca

SEQ ID NO: 1403851 - RNA, 19 nt, Pseudomonas aeruginosa PA01
gugccgguagcuggccaug

SEQ ID NO: 1403852 - RNA, 20 nt, Pseudomonas aeruginosa PA01
gugcgcacgcaauggcgcag

SEQ ID NO: 1403853 - RNA, 13 nt, Pseudomonas aeruginosa PA01
gugcgcgaauggu

SEQ ID NO: 1403854 - RNA, 11 nt, Pseudomonas aeruginosa PA01
gugcggccagg

SEQ ID NO: 1403855 - RNA, 13 nt, Pseudomonas aeruginosa PA01
gugcggccaggcg

SEQ ID NO: 1403856 - RNA, 17 nt, Pseudomonas aeruginosa PA01
gugcggcauuccgggcg

SEQ ID NO: 1403857 - RNA, 13 nt, Pseudomonas aeruginosa PA01
gugcggcaccagc

SEQ ID NO: 1403858 - RNA, 13 nt, Pseudomonas aeruginosa PA01
gugcggccgagga

SEQ ID NO: 1403859 - RNA, 13 nt, Pseudomonas aeruginosa PA01
gugcggccgauca

SEQ ID NO: 1403860 - RNA, 21 nt, Pseudomonas aeruginosa PA01
gugcggccuacuugaucagcc

SEQ ID NO: 1403861 - RNA, 13 nt, Pseudomonas aeruginosa PA01
gugcguauggauc

SEQ ID NO: 1403862 - RNA, 18 nt, Pseudomonas aeruginosa PA01
gugcguacuuggcccggc

SEQ ID NO: 1403863 - RNA, 13 nt, Pseudomonas aeruginosa PA01
gugcggcgggcgc

SEQ ID NO: 1403864 - RNA, 16 nt, Pseudomonas aeruginosa PA01
gugcguccauccaggc

SEQ ID NO: 1403865 - RNA, 18 nt, Pseudomonas aeruginosa PA01
gugcguccauccaggcuu

SEQ ID NO: 1403866 - RNA, 13 nt, Pseudomonas aeruginosa PA01
gugcgcgcggccu

SEQ ID NO: 1403867 - RNA, 14 nt, Pseudomonas aeruginosa PA01
gugcgcgcggccug

SEQ ID NO: 1403868 - RNA, 16 nt, Pseudomonas aeruginosa PA01
gugcgcgguccgcgug

SEQ ID NO: 1403869 - RNA, 15 nt, Pseudomonas aeruginosa PA01
gugcgcuccgccagg

SEQ ID NO: 1403870 - RNA, 22 nt, Pseudomonas aeruginosa PA01
gugcgcuccgccaggccgcgca

SEQ ID NO: 1403871 - RNA, 19 nt, Pseudomonas aeruginosa PA01
gugcgcuccuguugcuggc

SEQ ID NO: 1403872 - RNA, 16 nt, Pseudomonas aeruginosa PA01
gugcggaaaccgcggc

SEQ ID NO: 1403873 - RNA, 18 nt, Pseudomonas aeruginosa PA01
gugcggaaaccgcggccg

SEQ ID NO: 1403874 - RNA, 20 nt, Pseudomonas aeruginosa PA01
gugcggaaaccgcggccggc

SEQ ID NO: 1403875 - RNA, 19 nt, Pseudomonas aeruginosa PA01
gugcgcugcaucggcgcgc

SEQ ID NO: 1403876 - RNA, 21 nt, Pseudomonas aeruginosa PA01
gugcgcugcaucggcgcgccg

SEQ ID NO: 1403877 - RNA, 19 nt, Pseudomonas aeruginosa PA01
gugcgcuggaacggccagg

SEQ ID NO: 1403878 - RNA, 20 nt, Pseudomonas aeruginosa PA01
gugcgcuggaacggccaggu

SEQ ID NO: 1403879 - RNA, 14 nt, Pseudomonas aeruginosa PA01
gugacggccggggc

SEQ ID NO: 1403880 - RNA, 19 nt, Pseudomonas aeruginosa PA01
gugagggcgacccagcgcu

SEQ ID NO: 1403881 - RNA, 13 nt, Pseudomonas aeruginosa PA01
gugagggcgacgu

SEQ ID NO: 1403882 - RNA, 13 nt, Pseudomonas aeruginosa PA01
gugagcuugucca

SEQ ID NO: 1403883 - RNA, 22 nt, Pseudomonas aeruginosa PA01
gugaggaucacgcaagugcccu

SEQ ID NO: 1403884 - RNA, 13 nt, Pseudomonas aeruginosa PA01
gugaggccgagcc

SEQ ID NO: 1403885 - RNA, 16 nt, Pseudomonas aeruginosa PA01
gugaggccgagccgac

SEQ ID NO: 1403886 - RNA, 15 nt, Pseudomonas aeruginosa PA01
gugaccuggccgccg

SEQ ID NO: 1403887 - RNA, 21 nt, Pseudomonas aeruginosa PA01
gugacgaacgaagcgcccucg

SEQ ID NO: 1403888 - RNA, 14 nt, Pseudomonas aeruginosa PA01
gugacgaaaccggc

SEQ ID NO: 1403889 - RNA, 19 nt, Pseudomonas aeruginosa PA01
gugaccgugcgggucgagg

SEQ ID NO: 1403890 - RNA, 23 nt, Pseudomonas aeruginosa PA01
gugaccgugcgggucgaggccga

SEQ ID NO: 1403891 - RNA, 20 nt, Pseudomonas aeruginosa PA01
gugaccguuucgccgccggc

SEQ ID NO: 1403892 - RNA, 21 nt, Pseudomonas aeruginosa PA01
gugaccguuucgccgccggcc

SEQ ID NO: 1403893 - RNA, 22 nt, Pseudomonas aeruginosa PA01
gugaccguuucgccgccggcca

SEQ ID NO: 1403894 - RNA, 13 nt, Pseudomonas aeruginosa PA01
gugcaccuggcga

SEQ ID NO: 1403895 - RNA, 18 nt, Pseudomonas aeruginosa PA01
gugcaccuggcgaugccc

SEQ ID NO: 1403896 - RNA, 23 nt, Pseudomonas aeruginosa PA01
gugcacgaacaggugcugguggc

SEQ ID NO: 1403897 - RNA, 15 nt, Pseudomonas aeruginosa PA01
gugcacguuccagcu

SEQ ID NO: 1403898 - RNA, 17 nt, Pseudomonas aeruginosa PA01
gugcacguuccagcucg

SEQ ID NO: 1403899 - RNA, 22 nt, Pseudomonas aeruginosa PA01
gugcacggcgacccgccguucg

SEQ ID NO: 1403900 - RNA, 17 nt, Pseudomonas aeruginosa PA01
gugcagagaggcuggcg

SEQ ID NO: 1403901 - RNA, 13 nt, Pseudomonas aeruginosa PA01
gugcaggccgacg

SEQ ID NO: 1403902 - RNA, 19 nt, Pseudomonas aeruginosa PA01
gugcaggccgagcugcucg

SEQ ID NO: 1403903 - RNA, 14 nt, Pseudomonas aeruginosa PA01
gugcaggccgauca

SEQ ID NO: 1403904 - RNA, 23 nt, Pseudomonas aeruginosa PA01
gugcagcacauagagggucagcc

SEQ ID NO: 1403905 - RNA, 16 nt, Pseudomonas aeruginosa PA01
gugcagaugaccagcg

SEQ ID NO: 1403906 - RNA, 18 nt, Pseudomonas aeruginosa PA01
gugcagaugaccagcgca

SEQ ID NO: 1403907 - RNA, 14 nt, Pseudomonas aeruginosa PA01
gugauggcgaucgg

SEQ ID NO: 1403908 - RNA, 19 nt, Pseudomonas aeruginosa PA01
gugauuucuucagccuggg

SEQ ID NO: 1403909 - RNA, 15 nt, Pseudomonas aeruginosa PA01
gugagggucgcgccg

SEQ ID NO: 1403910 - RNA, 14 nt, Pseudomonas aeruginosa PA01
gugagguugccgcc

SEQ ID NO: 1403911 - RNA, 15 nt, Pseudomonas aeruginosa PA01
gugaucucgcggcgc

SEQ ID NO: 1403912 - RNA, 20 nt, Pseudomonas aeruginosa PA01
gugaucucgcggcgcggcgg

SEQ ID NO: 1403913 - RNA, 17 nt, Pseudomonas aeruginosa PA01
gugaucugguagcgggc

SEQ ID NO: 1403914 - RNA, 14 nt, Pseudomonas aeruginosa PA01
gucgguucggucga

SEQ ID NO: 1403915 - RNA, 19 nt, Pseudomonas aeruginosa PA01
gucgguuagaauaccggcc

SEQ ID NO: 1403916 - RNA, 19 nt, Pseudomonas aeruginosa PA01
gucgguucagcgcggagcg

SEQ ID NO: 1403917 - RNA, 13 nt, Pseudomonas aeruginosa PA01
gucgguucgccca

SEQ ID NO: 1403918 - RNA, 15 nt, Pseudomonas aeruginosa PA01
gucgguucgcggcgc

SEQ ID NO: 1403919 - RNA, 14 nt, Pseudomonas aeruginosa PA01
gucguacaccagau

SEQ ID NO: 1403920 - RNA, 16 nt, Pseudomonas aeruginosa PA01
gucguagucguagcgc

SEQ ID NO: 1403921 - RNA, 16 nt, Pseudomonas aeruginosa PA01
gucguauaggcgcugg

SEQ ID NO: 1403922 - RNA, 22 nt, Pseudomonas aeruginosa PA01
gucguagcccuucuccgccagc

SEQ ID NO: 1403923 - RNA, 23 nt, Pseudomonas aeruginosa PA01
gucguagcccuucuccgccagcc

SEQ ID NO: 1403924 - RNA, 18 nt, Pseudomonas aeruginosa PA01
gucguagccgcgcgccag

SEQ ID NO: 1403925 - RNA, 23 nt, Pseudomonas aeruginosa PA01
gucguagccgcgcgccagcaacg

SEQ ID NO: 1403926 - RNA, 22 nt, Pseudomonas aeruginosa PA01
gucguaggaacgugcggccugc

SEQ ID NO: 1403927 - RNA, 14 nt, Pseudomonas aeruginosa PA01
gucguagcgcagcg

SEQ ID NO: 1403928 - RNA, 15 nt, Pseudomonas aeruginosa PA01
gucguaggccgagcc

SEQ ID NO: 1403929 - RNA, 19 nt, Pseudomonas aeruginosa PA01
gucguaggucugcccgacg

SEQ ID NO: 1403930 - RNA, 22 nt, Pseudomonas aeruginosa PA01
gucguagagcgugcggccgauc

SEQ ID NO: 1403931 - RNA, 19 nt, Pseudomonas aeruginosa PA01
gucguagccaggcaccacc

SEQ ID NO: 1403932 - RNA, 15 nt, Pseudomonas aeruginosa PA01
gucguagcccauggu

SEQ ID NO: 1403933 - RNA, 20 nt, Pseudomonas aeruginosa PA01
gucguagagguugccgugca

SEQ ID NO: 1403934 - RNA, 15 nt, Pseudomonas aeruginosa PA01
gucguagacgcccgg

SEQ ID NO: 1403935 - RNA, 14 nt, Pseudomonas aeruginosa PA01
gucgucggccuuga

SEQ ID NO: 1403936 - RNA, 22 nt, Pseudomonas aeruginosa PA01
gucgucggcgaaagccggaccu

SEQ ID NO: 1403937 - RNA, 20 nt, Pseudomonas aeruginosa PA01
gucgucggcgaccuugucga

SEQ ID NO: 1403938 - RNA, 16 nt, Pseudomonas aeruginosa PA01
gucgucgcaggccugg

SEQ ID NO: 1403939 - RNA, 14 nt, Pseudomonas aeruginosa PA01
gucgucgggaucga

SEQ ID NO: 1403940 - RNA, 21 nt, Pseudomonas aeruginosa PA01
gucgucggggugccgccaguc

SEQ ID NO: 1403941 - RNA, 18 nt, Pseudomonas aeruginosa PA01
gucguccagcagguucgg

SEQ ID NO: 1403942 - RNA, 14 nt, Pseudomonas aeruginosa PA01
gucguccagcgccg

SEQ ID NO: 1403943 - RNA, 15 nt, Pseudomonas aeruginosa PA01
gucguccagcggcuc

SEQ ID NO: 1403944 - RNA, 18 nt, Pseudomonas aeruginosa PA01
gucgucaccucggcgcca

SEQ ID NO: 1403945 - RNA, 15 nt, Pseudomonas aeruginosa PA01
gucgucaagcgcgga

SEQ ID NO: 1403946 - RNA, 14 nt, Pseudomonas aeruginosa PA01
gucguccaccucca

SEQ ID NO: 1403947 - RNA, 16 nt, Pseudomonas aeruginosa PA01
gucggcagcucuaccg

SEQ ID NO: 1403948 - RNA, 16 nt, Pseudomonas aeruginosa PA01
gucggcauccggcagg

SEQ ID NO: 1403949 - RNA, 13 nt, Pseudomonas aeruginosa PA01
gucggcagucgcc

SEQ ID NO: 1403950 - RNA, 18 nt, Pseudomonas aeruginosa PA01
gucggcagucgccgcacc

SEQ ID NO: 1403951 - RNA, 14 nt, Pseudomonas aeruginosa PA01
gucggcaucgcgua

SEQ ID NO: 1403952 - RNA, 18 nt, Pseudomonas aeruginosa PA01
gucggcaucgcguagggc

SEQ ID NO: 1403953 - RNA, 22 nt, Pseudomonas aeruginosa PA01
gucggccaccagggugcgaugg

SEQ ID NO: 1403954 - RNA, 19 nt, Pseudomonas aeruginosa PA01
gucggcagcagcuugccgg

SEQ ID NO: 1403955 - RNA, 19 nt, Pseudomonas aeruginosa PA01
gucggcgggcaccgccagc

SEQ ID NO: 1403956 - RNA, 22 nt, Pseudomonas aeruginosa PA01
gucggcgggcaccgccagcccg

SEQ ID NO: 1403957 - RNA, 19 nt, Pseudomonas aeruginosa PA01
gucggcggggcgcaccgcc

SEQ ID NO: 1403958 - RNA, 23 nt, Pseudomonas aeruginosa PA01
gucggcggucucgaacgccaggc

SEQ ID NO: 1403959 - RNA, 16 nt, Pseudomonas aeruginosa PA01
gucggcguagugcugg

SEQ ID NO: 1403960 - RNA, 13 nt, Pseudomonas aeruginosa PA01
gucggcguaggcc

SEQ ID NO: 1403961 - RNA, 20 nt, Pseudomonas aeruginosa PA01
gucggcguaggccaguucgc

SEQ ID NO: 1403962 - RNA, 16 nt, Pseudomonas aeruginosa PA01
gucggcucgcgccggc

SEQ ID NO: 1403963 - RNA, 13 nt, Pseudomonas aeruginosa PA01
gucggcguagcgc

SEQ ID NO: 1403964 - RNA, 14 nt, Pseudomonas aeruginosa PA01
gucggcugcgcugg

SEQ ID NO: 1403965 - RNA, 15 nt, Pseudomonas aeruginosa PA01
gucggcugcgcuggg

SEQ ID NO: 1403966 - RNA, 20 nt, Pseudomonas aeruginosa PA01
gucggcugcgcugggcgccg

SEQ ID NO: 1403967 - RNA, 19 nt, Pseudomonas aeruginosa PA01
gucggcuggcagggcgcgu

SEQ ID NO: 1403968 - RNA, 14 nt, Pseudomonas aeruginosa PA01
gucggggccggcga

SEQ ID NO: 1403969 - RNA, 18 nt, Pseudomonas aeruginosa PA01
gucggggccggcgaugcg

SEQ ID NO: 1403970 - RNA, 20 nt, Pseudomonas aeruginosa PA01
gucggggcgcaaggccagcg

SEQ ID NO: 1403971 - RNA, 16 nt, Pseudomonas aeruginosa PA01
gucggcuuccgccgcc

SEQ ID NO: 1403972 - RNA, 20 nt, Pseudomonas aeruginosa PA01
gucggcuuccgccgccaggu

SEQ ID NO: 1403973 - RNA, 15 nt, Pseudomonas aeruginosa PA01
gucggggcaggcgca

SEQ ID NO: 1403974 - RNA, 19 nt, Pseudomonas aeruginosa PA01
gucggggcauucguccagc

SEQ ID NO: 1403975 - RNA, 13 nt, Pseudomonas aeruginosa PA01
gucggggugccgc

SEQ ID NO: 1403976 - RNA, 17 nt, Pseudomonas aeruginosa PA01
gucggggugccgccagu

SEQ ID NO: 1403977 - RNA, 22 nt, Pseudomonas aeruginosa PA01
gucggguccgggcccugcuucg

SEQ ID NO: 1403978 - RNA, 14 nt, Pseudomonas aeruginosa PA01
gucgggucggcgaa

SEQ ID NO: 1403979 - RNA, 17 nt, Pseudomonas aeruginosa PA01
gucgggugaaggucugg

SEQ ID NO: 1403980 - RNA, 19 nt, Pseudomonas aeruginosa PA01
gucggugagcacgccgcga

SEQ ID NO: 1403981 - RNA, 21 nt, Pseudomonas aeruginosa PA01
gucggugagcacgccgcgacc

SEQ ID NO: 1403982 - RNA, 13 nt, Pseudomonas aeruginosa PA01
gucggugccgccc

SEQ ID NO: 1403983 - RNA, 15 nt, Pseudomonas aeruginosa PA01
gucggugccgcccgg

SEQ ID NO: 1403984 - RNA, 20 nt, Pseudomonas aeruginosa PA01
gucggugcccucgcggacgc

SEQ ID NO: 1403985 - RNA, 16 nt, Pseudomonas aeruginosa PA01
gugacacccugccgcg

SEQ ID NO: 1403986 - RNA, 16 nt, Pseudomonas aeruginosa PA01
gugacccgcacggcga

SEQ ID NO: 1403987 - RNA, 18 nt, Pseudomonas aeruginosa PA01
gugacccacuccggcagg

SEQ ID NO: 1403988 - RNA, 22 nt, Pseudomonas aeruginosa PA01
gugacccacuccggcaggcgcu

SEQ ID NO: 1403989 - RNA, 23 nt, Pseudomonas aeruginosa PA01
gugacccacuccggcaggcgcuc

SEQ ID NO: 1403990 - RNA, 17 nt, Pseudomonas aeruginosa PA01
gugaccagcagguucgg

SEQ ID NO: 1403991 - RNA, 16 nt, Pseudomonas aeruginosa PA01
gugaccagcauggcgg

SEQ ID NO: 1403992 - RNA, 17 nt, Pseudomonas aeruginosa PA01
gugaccagcauggcggg

SEQ ID NO: 1403993 - RNA, 18 nt, Pseudomonas aeruginosa PA01
gugaccagcauggcgggc

SEQ ID NO: 1403994 - RNA, 20 nt, Pseudomonas aeruginosa PA01
gugaccagcauggcgggcca

SEQ ID NO: 1403995 - RNA, 23 nt, Pseudomonas aeruginosa PA01
gugaccaccuugauccgcgacga

SEQ ID NO: 1403996 - RNA, 15 nt, Pseudomonas aeruginosa PA01
gugacauucgacagc

SEQ ID NO: 1403997 - RNA, 14 nt, Pseudomonas aeruginosa PA01
gugaccaccaggcg

SEQ ID NO: 1403998 - RNA, 15 nt, Pseudomonas aeruginosa PA01
gugaccaccaggcgg

SEQ ID NO: 1403999 - RNA, 16 nt, Pseudomonas aeruginosa PA01
gugaccaccaggcggu

SEQ ID NO: 1404000 - RNA, 17 nt, Pseudomonas aeruginosa PA01
gugaccaccaggcgguc

SEQ ID NO: 1404001 - RNA, 18 nt, Pseudomonas aeruginosa PA01
gugacauggaugaccacg

SEQ ID NO: 1404002 - RNA, 16 nt, Pseudomonas aeruginosa PA01
gucuucggcggcgccg

SEQ ID NO: 1404003 - RNA, 20 nt, Pseudomonas aeruginosa PA01
gucuucggcggcgccgguga

SEQ ID NO: 1404004 - RNA, 17 nt, Pseudomonas aeruginosa PA01
gucuucgccggccugcg

SEQ ID NO: 1404005 - RNA, 20 nt, Pseudomonas aeruginosa PA01
gucuucucaaagggcagcgg

SEQ ID NO: 1404006 - RNA, 22 nt, Pseudomonas aeruginosa PA01
gucuggggaaauucgcgcugga

SEQ ID NO: 1404007 - RNA, 23 nt, Pseudomonas aeruginosa PA01
gucuggggaaauucgcgcuggau

SEQ ID NO: 1404008 - RNA, 17 nt, Pseudomonas aeruginosa PA01
gucugggugaccagcag

SEQ ID NO: 1404009 - RNA, 17 nt, Pseudomonas aeruginosa PA01
gucugguaguaggcgcu

SEQ ID NO: 1404010 - RNA, 13 nt, Pseudomonas aeruginosa PA01
gucuucgcuggcg

SEQ ID NO: 1404011 - RNA, 14 nt, Pseudomonas aeruginosa PA01
gucuucgcuggcga

SEQ ID NO: 1404012 - RNA, 21 nt, Pseudomonas aeruginosa PA01
gucuucggccaguucgagcag

SEQ ID NO: 1404013 - RNA, 17 nt, Pseudomonas aeruginosa PA01
gucuucgauggcggccg

SEQ ID NO: 1404014 - RNA, 23 nt, Pseudomonas aeruginosa PA01
gugaagcccaccaccaccgacgc

SEQ ID NO: 1404015 - RNA, 20 nt, Pseudomonas aeruginosa PA01
gugaagcgcggcggcgcgga

SEQ ID NO: 1404016 - RNA, 16 nt, Pseudomonas aeruginosa PA01
gugaagcugccgucga

SEQ ID NO: 1404017 - RNA, 19 nt, Pseudomonas aeruginosa PA01
gugaauaaccgcuugcggu

SEQ ID NO: 1404018 - RNA, 14 nt, Pseudomonas aeruginosa PA01
gugaagugaucgau

SEQ ID NO: 1404019 - RNA, 15 nt, Pseudomonas aeruginosa PA01
gugaaguagccgccg

SEQ ID NO: 1404020 - RNA, 15 nt, Pseudomonas aeruginosa PA01
gucuugaggaagucg

SEQ ID NO: 1404021 - RNA, 13 nt, Pseudomonas aeruginosa PA01
gucuugccgcugc

SEQ ID NO: 1404022 - RNA, 17 nt, Pseudomonas aeruginosa PA01
gucuugccggcugcgcc

SEQ ID NO: 1404023 - RNA, 19 nt, Pseudomonas aeruginosa PA01
gucuugcgcaggcggucgg

SEQ ID NO: 1404024 - RNA, 21 nt, Pseudomonas aeruginosa PA01
gucuugcgcagggcggcgagc

SEQ ID NO: 1404025 - RNA, 22 nt, Pseudomonas aeruginosa PA01
gugaagagcucccugccgcccu

SEQ ID NO: 1404026 - RNA, 22 nt, Pseudomonas aeruginosa PA01
gucucggugcucaggcggccga

SEQ ID NO: 1404027 - RNA, 16 nt, Pseudomonas aeruginosa PA01
gucucguccggcgugg

SEQ ID NO: 1404028 - RNA, 20 nt, Pseudomonas aeruginosa PA01
gucucgucgagcgagggcgu

SEQ ID NO: 1404029 - RNA, 20 nt, Pseudomonas aeruginosa PA01
gucugcgguauaggccuugg

SEQ ID NO: 1404030 - RNA, 14 nt, Pseudomonas aeruginosa PA01
gucucggcugccgc

SEQ ID NO: 1404031 - RNA, 15 nt, Pseudomonas aeruginosa PA01
gucucggcugccgcc

SEQ ID NO: 1404032 - RNA, 21 nt, Pseudomonas aeruginosa PA01
gucucggcgggugcguggugc

SEQ ID NO: 1404033 - RNA, 20 nt, Pseudomonas aeruginosa PA01
gucucgcguucaucgucggc

SEQ ID NO: 1404034 - RNA, 17 nt, Pseudomonas aeruginosa PA01
gucucgcugacccaggc

SEQ ID NO: 1404035 - RNA, 13 nt, Pseudomonas aeruginosa PA01
gucucggcgaacg

SEQ ID NO: 1404036 - RNA, 22 nt, Pseudomonas aeruginosa PA01
gucucggcgaacgacagcacca

SEQ ID NO: 1404037 - RNA, 22 nt, Pseudomonas aeruginosa PA01
gucugcucggaaaccucgccgg

SEQ ID NO: 1404038 - RNA, 15 nt, Pseudomonas aeruginosa PA01
gucugcucggcgaug

SEQ ID NO: 1404039 - RNA, 14 nt, Pseudomonas aeruginosa PA01
gucugcucggcgcc

SEQ ID NO: 1404040 - RNA, 16 nt, Pseudomonas aeruginosa PA01
gucugcucggcgcccu

SEQ ID NO: 1404041 - RNA, 21 nt, Pseudomonas aeruginosa PA01
gucugcugguagcugcugccg

SEQ ID NO: 1404042 - RNA, 12 nt, Pseudomonas aeruginosa PA01
gucugcuugcgc

SEQ ID NO: 1404043 - RNA, 16 nt, Pseudomonas aeruginosa PA01
gucuggcgcauccgcc

SEQ ID NO: 1404044 - RNA, 17 nt, Pseudomonas aeruginosa PA01
gucuggcgcauccgccc

SEQ ID NO: 1404045 - RNA, 19 nt, Pseudomonas aeruginosa PA01
gucuggcgccuggccugga

SEQ ID NO: 1404046 - RNA, 13 nt, Pseudomonas aeruginosa PA01
gucuggccggcga

SEQ ID NO: 1404047 - RNA, 15 nt, Pseudomonas aeruginosa PA01
gucugggacggcagc

SEQ ID NO: 1404048 - RNA, 19 nt, Pseudomonas aeruginosa PA01
gucugggaguuccgcgcaa

SEQ ID NO: 1404049 - RNA, 23 nt, Pseudomonas aeruginosa PA01
gucucgccagcccggcaggucga

SEQ ID NO: 1404050 - RNA, 22 nt, Pseudomonas aeruginosa PA01
gucucgauggcagccuuggcca

SEQ ID NO: 1404051 - RNA, 20 nt, Pseudomonas aeruginosa PA01
gucucgaucggcccgggcgc

SEQ ID NO: 1404052 - RNA, 17 nt, Pseudomonas aeruginosa PA01
gucucgaacgccaggca

SEQ ID NO: 1404053 - RNA, 14 nt, Pseudomonas aeruginosa PA01
gucuccugccgccg

SEQ ID NO: 1404054 - RNA, 12 nt, Pseudomonas aeruginosa PA01
gucguucgcccu

SEQ ID NO: 1404055 - RNA, 23 nt, Pseudomonas aeruginosa PA01
gucguucucgcgcaucgcggaca

SEQ ID NO: 1404056 - RNA, 14 nt, Pseudomonas aeruginosa PA01
gucgucguccaccg

SEQ ID NO: 1404057 - RNA, 24 nt, Pseudomonas aeruginosa PA01
gucgucguccagcgggcccauggc

SEQ ID NO: 1404058 - RNA, 21 nt, Pseudomonas aeruginosa PA01
gucgucguccaucgccgcggc

SEQ ID NO: 1404059 - RNA, 20 nt, Pseudomonas aeruginosa PA01
gucgaacagcagcucgccgc

SEQ ID NO: 1404060 - RNA, 20 nt, Pseudomonas aeruginosa PA01
gucgaacaccggcgccgccu

SEQ ID NO: 1404061 - RNA, 21 nt, Pseudomonas aeruginosa PA01
gucgaacagguggcuuuccag

SEQ ID NO: 1404062 - RNA, 16 nt, Pseudomonas aeruginosa PA01
gucgaaccagccgcgu

SEQ ID NO: 1404063 - RNA, 16 nt, Pseudomonas aeruginosa PA01
gucgaaccagcucagc

SEQ ID NO: 1404064 - RNA, 17 nt, Pseudomonas aeruginosa PA01
gucgaaccagcucagcu

SEQ ID NO: 1404065 - RNA, 19 nt, Pseudomonas aeruginosa PA01
gucgaaccagggacgcccg

SEQ ID NO: 1404066 - RNA, 22 nt, Pseudomonas aeruginosa PA01
gucgaagaccuguugcagagcg

SEQ ID NO: 1404067 - RNA, 15 nt, Pseudomonas aeruginosa PA01
gucgaagcucggcgc

SEQ ID NO: 1404068 - RNA, 18 nt, Pseudomonas aeruginosa PA01
gucgaagcugucggcccg

SEQ ID NO: 1404069 - RNA, 21 nt, Pseudomonas aeruginosa PA01
gucgaagcugucggcccgcgc

SEQ ID NO: 1404070 - RNA, 20 nt, Pseudomonas aeruginosa PA01
gucgaaggugaagcugccgu

SEQ ID NO: 1404071 - RNA, 21 nt, Pseudomonas aeruginosa PA01
gucgaaggugaagcugccguc

SEQ ID NO: 1404072 - RNA, 22 nt, Pseudomonas aeruginosa PA01
gucgaaggugaagcugccgucg

SEQ ID NO: 1404073 - RNA, 23 nt, Pseudomonas aeruginosa PA01
gucgaaggugaagcugccgucga

SEQ ID NO: 1404074 - RNA, 21 nt, Pseudomonas aeruginosa PA01
gucgaaggccucgucgcccgg

SEQ ID NO: 1404075 - RNA, 16 nt, Pseudomonas aeruginosa PA01
gucgaagcgcagcagg

SEQ ID NO: 1404076 - RNA, 19 nt, Pseudomonas aeruginosa PA01
gucgaaggcggcgcggcgg

SEQ ID NO: 1404077 - RNA, 14 nt, Pseudomonas aeruginosa PA01
gucgaaguacaccu

SEQ ID NO: 1404078 - RNA, 13 nt, Pseudomonas aeruginosa PA01
guccugggccggu

SEQ ID NO: 1404079 - RNA, 16 nt, Pseudomonas aeruginosa PA01
guccugggccaccugg

SEQ ID NO: 1404080 - RNA, 19 nt, Pseudomonas aeruginosa PA01
guccugggccaccuggcuc

SEQ ID NO: 1404081 - RNA, 14 nt, Pseudomonas aeruginosa PA01
guccuggcgcgaga

SEQ ID NO: 1404082 - RNA, 19 nt, Pseudomonas aeruginosa PA01
guccuggcgcgagaagcca

SEQ ID NO: 1404083 - RNA, 20 nt, Pseudomonas aeruginosa PA01
guccuggauaagccgcgcca

SEQ ID NO: 1404084 - RNA, 13 nt, Pseudomonas aeruginosa PA01
guccuggaucggc

SEQ ID NO: 1404085 - RNA, 19 nt, Pseudomonas aeruginosa PA01
guccuggaucggcagcucg

SEQ ID NO: 1404086 - RNA, 14 nt, Pseudomonas aeruginosa PA01
guccuggccgagcc

SEQ ID NO: 1404087 - RNA, 16 nt, Pseudomonas aeruginosa PA01
guccugcugcuggccu

SEQ ID NO: 1404088 - RNA, 23 nt, Pseudomonas aeruginosa PA01
guccugcugcuggccuucgucgg

SEQ ID NO: 1404089 - RNA, 15 nt, Pseudomonas aeruginosa PA01
guccugcggcggcag

SEQ ID NO: 1404090 - RNA, 20 nt, Pseudomonas aeruginosa PA01
guccugcggcggcaggucgg

SEQ ID NO: 1404091 - RNA, 16 nt, Pseudomonas aeruginosa PA01
guccugcucccuggcg

SEQ ID NO: 1404092 - RNA, 17 nt, Pseudomonas aeruginosa PA01
guccugcucccuggcgg

SEQ ID NO: 1404093 - RNA, 16 nt, Pseudomonas aeruginosa PA01
guccugccggugcucg

SEQ ID NO: 1404094 - RNA, 14 nt, Pseudomonas aeruginosa PA01
guccugcgcggcga

SEQ ID NO: 1404095 - RNA, 17 nt, Pseudomonas aeruginosa PA01
guccugcgcggcgacga

SEQ ID NO: 1404096 - RNA, 23 nt, Pseudomonas aeruginosa PA01
guccugcggauucaucggcggca

SEQ ID NO: 1404097 - RNA, 13 nt, Pseudomonas aeruginosa PA01
guccugcggccgc

SEQ ID NO: 1404098 - RNA, 19 nt, Pseudomonas aeruginosa PA01
gucgaaagccugccgggca

SEQ ID NO: 1404099 - RNA, 19 nt, Pseudomonas aeruginosa PA01
gucgaaagcuucgucgcgc

SEQ ID NO: 1404100 - RNA, 23 nt, Pseudomonas aeruginosa PA01
gucgaaagcuucgucgcgcaggc

SEQ ID NO: 1404101 - RNA, 17 nt, Pseudomonas aeruginosa PA01
gucgaaaaccggcgggc

SEQ ID NO: 1404102 - RNA, 17 nt, Pseudomonas aeruginosa PA01
gucgaaacgggcgcucu

SEQ ID NO: 1404103 - RNA, 15 nt, Pseudomonas aeruginosa PA01
guccuuguucggcug

SEQ ID NO: 1404104 - RNA, 13 nt, Pseudomonas aeruginosa PA01
guccuugggccag

SEQ ID NO: 1404105 - RNA, 14 nt, Pseudomonas aeruginosa PA01
guccuugggccagg

SEQ ID NO: 1404106 - RNA, 19 nt, Pseudomonas aeruginosa PA01
guccuugaguagcuggcgc

SEQ ID NO: 1404107 - RNA, 15 nt, Pseudomonas aeruginosa PA01
guccuugcccggcgc

SEQ ID NO: 1404108 - RNA, 14 nt, Pseudomonas aeruginosa PA01
guccuucggccagu

SEQ ID NO: 1404109 - RNA, 13 nt, Pseudomonas aeruginosa PA01
guccuucggccgc

SEQ ID NO: 1404110 - RNA, 14 nt, Pseudomonas aeruginosa PA01
guccuucggcgcau

SEQ ID NO: 1404111 - RNA, 15 nt, Pseudomonas aeruginosa PA01
guccuggugaucauc

SEQ ID NO: 1404112 - RNA, 19 nt, Pseudomonas aeruginosa PA01
guccuguggcgcuucguug

SEQ ID NO: 1404113 - RNA, 17 nt, Pseudomonas aeruginosa PA01
guccuuauucggcccau

SEQ ID NO: 1404114 - RNA, 20 nt, Pseudomonas aeruginosa PA01
guccuuccagcucucgcugg

SEQ ID NO: 1404115 - RNA, 20 nt, Pseudomonas aeruginosa PA01
guccuccagcugcgccugca

SEQ ID NO: 1404116 - RNA, 14 nt, Pseudomonas aeruginosa PA01
guccuccaggacca

SEQ ID NO: 1404117 - RNA, 22 nt, Pseudomonas aeruginosa PA01
guccucgacauggaucaccgcc

SEQ ID NO: 1404118 - RNA, 15 nt, Pseudomonas aeruginosa PA01
guccguucggcgccc

SEQ ID NO: 1404119 - RNA, 16 nt, Pseudomonas aeruginosa PA01
guccguucggcgccca

SEQ ID NO: 1404120 - RNA, 14 nt, Pseudomonas aeruginosa PA01
guccguugcgcagc

SEQ ID NO: 1404121 - RNA, 22 nt, Pseudomonas aeruginosa PA01
guccucaauaccgaacaccagc

SEQ ID NO: 1404122 - RNA, 17 nt, Pseudomonas aeruginosa PA01
guccucagccucacccu

SEQ ID NO: 1404123 - RNA, 13 nt, Pseudomonas aeruginosa PA01
guccuccaccccc

SEQ ID NO: 1404124 - RNA, 22 nt, Pseudomonas aeruginosa PA01
guccuccaccgcuccggcgccg

SEQ ID NO: 1404125 - RNA, 23 nt, Pseudomonas aeruginosa PA01
guccucccagugcgagucggcga

SEQ ID NO: 1404126 - RNA, 19 nt, Pseudomonas aeruginosa PA01
guccucguggcgcgccgcu

SEQ ID NO: 1404127 - RNA, 22 nt, Pseudomonas aeruginosa PA01
guccucggggaagcgcggcucg

SEQ ID NO: 1404128 - RNA, 16 nt, Pseudomonas aeruginosa PA01
guccucguacaugcgc

SEQ ID NO: 1404129 - RNA, 20 nt, Pseudomonas aeruginosa PA01
guccucguacaugcgcgagu

SEQ ID NO: 1404130 - RNA, 18 nt, Pseudomonas aeruginosa PA01
guccucgcgacaccgggc

SEQ ID NO: 1404131 - RNA, 19 nt, Pseudomonas aeruginosa PA01
guccucggcguagccggcc

SEQ ID NO: 1404132 - RNA, 15 nt, Pseudomonas aeruginosa PA01
guccucgggcaccag

SEQ ID NO: 1404133 - RNA, 16 nt, Pseudomonas aeruginosa PA01
guccucgggcaccagc

SEQ ID NO: 1404134 - RNA, 17 nt, Pseudomonas aeruginosa PA01
guccucgggcaccagca

SEQ ID NO: 1404135 - RNA, 21 nt, Pseudomonas aeruginosa PA01
guccugcaacugcucgaucaa

SEQ ID NO: 1404136 - RNA, 16 nt, Pseudomonas aeruginosa PA01
guccgggaaguccggg

SEQ ID NO: 1404137 - RNA, 18 nt, Pseudomonas aeruginosa PA01
guccgggaaguccgggcg

SEQ ID NO: 1404138 - RNA, 18 nt, Pseudomonas aeruginosa PA01
guccgggaaugcucagca

SEQ ID NO: 1404139 - RNA, 21 nt, Pseudomonas aeruginosa PA01
guccgggcacgcauagcgcgc

SEQ ID NO: 1404140 - RNA, 15 nt, Pseudomonas aeruginosa PA01
guccggcgucccgca

SEQ ID NO: 1404141 - RNA, 13 nt, Pseudomonas aeruginosa PA01
guccgggugcccc

SEQ ID NO: 1404142 - RNA, 17 nt, Pseudomonas aeruginosa PA01
guccgggugccccaggc

SEQ ID NO: 1404143 - RNA, 17 nt, Pseudomonas aeruginosa PA01
guccggguaguccagcg

SEQ ID NO: 1404144 - RNA, 19 nt, Pseudomonas aeruginosa PA01
guccggguaguccagcgag

SEQ ID NO: 1404145 - RNA, 21 nt, Pseudomonas aeruginosa PA01
guccgggcgguacaggcgcac

SEQ ID NO: 1404146 - RNA, 13 nt, Pseudomonas aeruginosa PA01
guccgggcccugc

SEQ ID NO: 1404147 - RNA, 17 nt, Pseudomonas aeruginosa PA01
guccggucgcaccgcca

SEQ ID NO: 1404148 - RNA, 18 nt, Pseudomonas aeruginosa PA01
guccggucgcaccgccag

SEQ ID NO: 1404149 - RNA, 21 nt, Pseudomonas aeruginosa PA01
guccggucgcaccgccagcag

SEQ ID NO: 1404150 - RNA, 17 nt, Pseudomonas aeruginosa PA01
guccgguacugcugggc

SEQ ID NO: 1404151 - RNA, 23 nt, Pseudomonas aeruginosa PA01
guccggucagcagcagggucggg

SEQ ID NO: 1404152 - RNA, 17 nt, Pseudomonas aeruginosa PA01
guccgggugggucaugg

SEQ ID NO: 1404153 - RNA, 13 nt, Pseudomonas aeruginosa PA01
guccggguugacc

SEQ ID NO: 1404154 - RNA, 19 nt, Pseudomonas aeruginosa PA01
guccggguugagcaccccg

SEQ ID NO: 1404155 - RNA, 19 nt, Pseudomonas aeruginosa PA01
guccggguugucguugcgc

SEQ ID NO: 1404156 - RNA, 20 nt, Pseudomonas aeruginosa PA01
guccggguuggcgcaggccg

SEQ ID NO: 1404157 - RNA, 23 nt, Pseudomonas aeruginosa PA01
guccguaaugcaacccgccgcug

SEQ ID NO: 1404158 - RNA, 21 nt, Pseudomonas aeruginosa PA01
guccguccagcgcgcccggcg

SEQ ID NO: 1404159 - RNA, 22 nt, Pseudomonas aeruginosa PA01
guccguccagcgcgcccggcgc

SEQ ID NO: 1404160 - RNA, 17 nt, Pseudomonas aeruginosa PA01
guccgucccacaggccg

SEQ ID NO: 1404161 - RNA, 16 nt, Pseudomonas aeruginosa PA01
guccgucgcgcgcccg

SEQ ID NO: 1404162 - RNA, 23 nt, Pseudomonas aeruginosa PA01
guccggaccgggcggcaggcgcc

SEQ ID NO: 1404163 - RNA, 14 nt, Pseudomonas aeruginosa PA01
guccggagccgggc

SEQ ID NO: 1404164 - RNA, 15 nt, Pseudomonas aeruginosa PA01
guccggagccgggca

SEQ ID NO: 1404165 - RNA, 23 nt, Pseudomonas aeruginosa PA01
guccggcaccaccagcgcgcgcu

SEQ ID NO: 1404166 - RNA, 17 nt, Pseudomonas aeruginosa PA01
guccggagugaugccga

SEQ ID NO: 1404167 - RNA, 20 nt, Pseudomonas aeruginosa PA01
guccggauugccgcgggucu

SEQ ID NO: 1404168 - RNA, 17 nt, Pseudomonas aeruginosa PA01
guccggcagcacggcga

SEQ ID NO: 1404169 - RNA, 18 nt, Pseudomonas aeruginosa PA01
guccggcagcacggcgau

SEQ ID NO: 1404170 - RNA, 13 nt, Pseudomonas aeruginosa PA01
guccggcagcgcc

SEQ ID NO: 1404171 - RNA, 14 nt, Pseudomonas aeruginosa PA01
guccggcagcgccu

SEQ ID NO: 1404172 - RNA, 16 nt, Pseudomonas aeruginosa PA01
guccgcuucagcgcgc

SEQ ID NO: 1404173 - RNA, 19 nt, Pseudomonas aeruginosa PA01
guccgcuucagcgcgccga

SEQ ID NO: 1404174 - RNA, 20 nt, Pseudomonas aeruginosa PA01
guccgcuucagcgcgccgag

SEQ ID NO: 1404175 - RNA, 22 nt, Pseudomonas aeruginosa PA01
guccgcuucagcgcgccgagcc

SEQ ID NO: 1404176 - RNA, 20 nt, Pseudomonas aeruginosa PA01
guccggccgcccgagccgcu

SEQ ID NO: 1404177 - RNA, 16 nt, Pseudomonas aeruginosa PA01
guccggccagccuggc

SEQ ID NO: 1404178 - RNA, 23 nt, Pseudomonas aeruginosa PA01
guccggccagccuggccagcgcu

SEQ ID NO: 1404179 - RNA, 21 nt, Pseudomonas aeruginosa PA01
guccggcagggccucgggcgg

SEQ ID NO: 1404180 - RNA, 14 nt, Pseudomonas aeruginosa PA01
guccggcgcugagc

SEQ ID NO: 1404181 - RNA, 18 nt, Pseudomonas aeruginosa PA01
guccggcccggagcgcga

SEQ ID NO: 1404182 - RNA, 22 nt, Pseudomonas aeruginosa PA01
guccggcgccaacugcuugccg

SEQ ID NO: 1404183 - RNA, 18 nt, Pseudomonas aeruginosa PA01
guccggcgagcacggcga

SEQ ID NO: 1404184 - RNA, 14 nt, Pseudomonas aeruginosa PA01
guccgaacgcgcug

SEQ ID NO: 1404185 - RNA, 19 nt, Pseudomonas aeruginosa PA01
guccgccagguccaggcuc

SEQ ID NO: 1404186 - RNA, 23 nt, Pseudomonas aeruginosa PA01
guccgcccaguucgccggccagc

SEQ ID NO: 1404187 - RNA, 22 nt, Pseudomonas aeruginosa PA01
guccgccgaggugcugcaccgg

SEQ ID NO: 1404188 - RNA, 24 nt, Pseudomonas aeruginosa PA01
guccgaacagaggaaggcgccggc

SEQ ID NO: 1404189 - RNA, 20 nt, Pseudomonas aeruginosa PA01
gucccuugaucagcgcgcgu

SEQ ID NO: 1404190 - RNA, 23 nt, Pseudomonas aeruginosa PA01
gucccuuguuuuccuggcccugg

SEQ ID NO: 1404191 - RNA, 18 nt, Pseudomonas aeruginosa PA01
gucccuggagcagggcga

SEQ ID NO: 1404192 - RNA, 14 nt, Pseudomonas aeruginosa PA01
gucccuggccggcg

SEQ ID NO: 1404193 - RNA, 16 nt, Pseudomonas aeruginosa PA01
gucccugggccugcag

SEQ ID NO: 1404194 - RNA, 17 nt, Pseudomonas aeruginosa PA01
gucccugggccugcagg

SEQ ID NO: 1404195 - RNA, 13 nt, Pseudomonas aeruginosa PA01
gucccggacgacg

SEQ ID NO: 1404196 - RNA, 15 nt, Pseudomonas aeruginosa PA01
gucccuaccagcgca

SEQ ID NO: 1404197 - RNA, 16 nt, Pseudomonas aeruginosa PA01
gucccugaccagcagg

SEQ ID NO: 1404198 - RNA, 17 nt, Pseudomonas aeruginosa PA01
gucccugaccagcaggg

SEQ ID NO: 1404199 - RNA, 23 nt, Pseudomonas aeruginosa PA01
guccgcgccgcgcguucgcgcga

SEQ ID NO: 1404200 - RNA, 15 nt, Pseudomonas aeruginosa PA01
guccgcgccgcgucg

SEQ ID NO: 1404201 - RNA, 20 nt, Pseudomonas aeruginosa PA01
guccgcgccgcgucgccgcc

SEQ ID NO: 1404202 - RNA, 14 nt, Pseudomonas aeruginosa PA01
guccgcgcgcgcgc

SEQ ID NO: 1404203 - RNA, 15 nt, Pseudomonas aeruginosa PA01
guccgcgcgcgcgcu

SEQ ID NO: 1404204 - RNA, 16 nt, Pseudomonas aeruginosa PA01
guccgcgcgcuuccag

SEQ ID NO: 1404205 - RNA, 20 nt, Pseudomonas aeruginosa PA01
guccgcgcgcuuccaggcac

SEQ ID NO: 1404206 - RNA, 15 nt, Pseudomonas aeruginosa PA01
guccgcgcaggcggu

SEQ ID NO: 1404207 - RNA, 23 nt, Pseudomonas aeruginosa PA01
guccgcgcaggcggucgccgaac

SEQ ID NO: 1404208 - RNA, 18 nt, Pseudomonas aeruginosa PA01
guccgcgccaugccggcg

SEQ ID NO: 1404209 - RNA, 20 nt, Pseudomonas aeruginosa PA01
guccgcgccaugccggcgcc

SEQ ID NO: 1404210 - RNA, 12 nt, Pseudomonas aeruginosa PA01
guccgcgaugcg

SEQ ID NO: 1404211 - RNA, 12 nt, Pseudomonas aeruginosa PA01
guccgccgccgc

SEQ ID NO: 1404212 - RNA, 16 nt, Pseudomonas aeruginosa PA01
guccgccgccgcggcg

SEQ ID NO: 1404213 - RNA, 20 nt, Pseudomonas aeruginosa PA01
guccgccugggacggaacgu

SEQ ID NO: 1404214 - RNA, 16 nt, Pseudomonas aeruginosa PA01
guccgccucgcugagc

SEQ ID NO: 1404215 - RNA, 17 nt, Pseudomonas aeruginosa PA01
guccaucgccgcggcga

SEQ ID NO: 1404216 - RNA, 13 nt, Pseudomonas aeruginosa PA01
guccaucgccgcg

SEQ ID NO: 1404217 - RNA, 15 nt, Pseudomonas aeruginosa PA01
guccaucaccgcggu

SEQ ID NO: 1404218 - RNA, 18 nt, Pseudomonas aeruginosa PA01
guccaucccugcuucgac

SEQ ID NO: 1404219 - RNA, 23 nt, Pseudomonas aeruginosa PA01
guccaucccuucgugcuggcgga

SEQ ID NO: 1404220 - RNA, 16 nt, Pseudomonas aeruginosa PA01
guccaguucagggcca

SEQ ID NO: 1404221 - RNA, 15 nt, Pseudomonas aeruginosa PA01
guccagugcggcagu

SEQ ID NO: 1404222 - RNA, 17 nt, Pseudomonas aeruginosa PA01
guccaggccgcagguga

SEQ ID NO: 1404223 - RNA, 14 nt, Pseudomonas aeruginosa PA01
guccaguagcgccu

SEQ ID NO: 1404224 - RNA, 16 nt, Pseudomonas aeruginosa PA01
guccaguagcgccugg

SEQ ID NO: 1404225 - RNA, 15 nt, Pseudomonas aeruginosa PA01
guccagucaccaggu

SEQ ID NO: 1404226 - RNA, 18 nt, Pseudomonas aeruginosa PA01
gucccgcuccagccggca

SEQ ID NO: 1404227 - RNA, 19 nt, Pseudomonas aeruginosa PA01
gucccgcuccagccggcaa

SEQ ID NO: 1404228 - RNA, 22 nt, Pseudomonas aeruginosa PA01
gucccgccggagacuucagcgc

SEQ ID NO: 1404229 - RNA, 15 nt, Pseudomonas aeruginosa PA01
gucccgcgcggcccu

SEQ ID NO: 1404230 - RNA, 19 nt, Pseudomonas aeruginosa PA01
gucccgccaggcgccgauc

SEQ ID NO: 1404231 - RNA, 13 nt, Pseudomonas aeruginosa PA01
gucccgccgcgcc

SEQ ID NO: 1404232 - RNA, 18 nt, Pseudomonas aeruginosa PA01
guccccggccccgcggua

SEQ ID NO: 1404233 - RNA, 15 nt, Pseudomonas aeruginosa PA01
guccccucacggcgc

SEQ ID NO: 1404234 - RNA, 19 nt, Pseudomonas aeruginosa PA01
guccccucacggcgcgaga

SEQ ID NO: 1404235 - RNA, 16 nt, Pseudomonas aeruginosa PA01
guccccuccagguagg

SEQ ID NO: 1404236 - RNA, 20 nt, Pseudomonas aeruginosa PA01
guccccuuccuccucgccgc

SEQ ID NO: 1404237 - RNA, 16 nt, Pseudomonas aeruginosa PA01
gucccgauuccgcgca

SEQ ID NO: 1404238 - RNA, 18 nt, Pseudomonas aeruginosa PA01
gucccgcaaagcccgcuc

SEQ ID NO: 1404239 - RNA, 21 nt, Pseudomonas aeruginosa PA01
gucccgcaaagcccgcuccgc

SEQ ID NO: 1404240 - RNA, 18 nt, Pseudomonas aeruginosa PA01
gucccgaguaggcgcugc

SEQ ID NO: 1404241 - RNA, 20 nt, Pseudomonas aeruginosa PA01
gucccgaguaggcgcugcaa

SEQ ID NO: 1404242 - RNA, 22 nt, Pseudomonas aeruginosa PA01
gucacggucuuggcggcgaucg

SEQ ID NO: 1404243 - RNA, 18 nt, Pseudomonas aeruginosa PA01
gucacggugaggaccugg

SEQ ID NO: 1404244 - RNA, 22 nt, Pseudomonas aeruginosa PA01
gucacggugaggaccuggccgc

SEQ ID NO: 1404245 - RNA, 16 nt, Pseudomonas aeruginosa PA01
gucacggcgugccgca

SEQ ID NO: 1404246 - RNA, 17 nt, Pseudomonas aeruginosa PA01
gucacggcgugccgcag

SEQ ID NO: 1404247 - RNA, 20 nt, Pseudomonas aeruginosa PA01
gucacggccuccgguggcgg

SEQ ID NO: 1404248 - RNA, 21 nt, Pseudomonas aeruginosa PA01
gucacggcgaaaccggccagc

SEQ ID NO: 1404249 - RNA, 22 nt, Pseudomonas aeruginosa PA01
gucacgguaucccacuuccucg

SEQ ID NO: 1404250 - RNA, 16 nt, Pseudomonas aeruginosa PA01
gucacggacccgcucg

SEQ ID NO: 1404251 - RNA, 19 nt, Pseudomonas aeruginosa PA01
gucacggacccgcucggcc

SEQ ID NO: 1404252 - RNA, 22 nt, Pseudomonas aeruginosa PA01
gucagcaacugccaaccgcgcu

SEQ ID NO: 1404253 - RNA, 17 nt, Pseudomonas aeruginosa PA01
guccagcuccaccaggc

SEQ ID NO: 1404254 - RNA, 19 nt, Pseudomonas aeruginosa PA01
guccagcuccaccaggcca

SEQ ID NO: 1404255 - RNA, 19 nt, Pseudomonas aeruginosa PA01
guccagcucggucagcggc

SEQ ID NO: 1404256 - RNA, 16 nt, Pseudomonas aeruginosa PA01
guccagcuggcgcagc

SEQ ID NO: 1404257 - RNA, 18 nt, Pseudomonas aeruginosa PA01
gucgcugcgcaacugccg

SEQ ID NO: 1404258 - RNA, 19 nt, Pseudomonas aeruginosa PA01
gucgcugcgcaacugccgg

SEQ ID NO: 1404259 - RNA, 14 nt, Pseudomonas aeruginosa PA01
gucgcugccgcuga

SEQ ID NO: 1404260 - RNA, 21 nt, Pseudomonas aeruginosa PA01
gucgcugccgccgcgcccggc

SEQ ID NO: 1404261 - RNA, 16 nt, Pseudomonas aeruginosa PA01
gucgcugcuggcgccg

SEQ ID NO: 1404262 - RNA, 20 nt, Pseudomonas aeruginosa PA01
gucgcugcucggccuugucc

SEQ ID NO: 1404263 - RNA, 20 nt, Pseudomonas aeruginosa PA01
gucgcuggagcugcgcgcga

SEQ ID NO: 1404264 - RNA, 19 nt, Pseudomonas aeruginosa PA01
gucgcuggcaccggccagg

SEQ ID NO: 1404265 - RNA, 21 nt, Pseudomonas aeruginosa PA01
gucgcuggcaccggccaggcg

SEQ ID NO: 1404266 - RNA, 23 nt, Pseudomonas aeruginosa PA01
gucgcuggcaccggccaggcgcu

SEQ ID NO: 1404267 - RNA, 13 nt, Pseudomonas aeruginosa PA01
gucgcuggccagc

SEQ ID NO: 1404268 - RNA, 15 nt, Pseudomonas aeruginosa PA01
gucggacuccgccca

SEQ ID NO: 1404269 - RNA, 15 nt, Pseudomonas aeruginosa PA01
gucgcuggccugggg

SEQ ID NO: 1404270 - RNA, 11 nt, Pseudomonas aeruginosa PA01
gucgcuccggc

SEQ ID NO: 1404271 - RNA, 23 nt, Pseudomonas aeruginosa PA01
gucgcuccagaccuccagguagg

SEQ ID NO: 1404272 - RNA, 17 nt, Pseudomonas aeruginosa PA01
gucgcucauccgcgagg

SEQ ID NO: 1404273 - RNA, 18 nt, Pseudomonas aeruginosa PA01
gucgcucauggcgccgcc

SEQ ID NO: 1404274 - RNA, 19 nt, Pseudomonas aeruginosa PA01
gucgcucauggcgccgcca

SEQ ID NO: 1404275 - RNA, 13 nt, Pseudomonas aeruginosa PA01
gucgcucagcggg

SEQ ID NO: 1404276 - RNA, 16 nt, Pseudomonas aeruginosa PA01
gucgcucagcgggccg

SEQ ID NO: 1404277 - RNA, 17 nt, Pseudomonas aeruginosa PA01
gucgcguucgucggcca

SEQ ID NO: 1404278 - RNA, 18 nt, Pseudomonas aeruginosa PA01
gucgcguucgucggccac

SEQ ID NO: 1404279 - RNA, 16 nt, Pseudomonas aeruginosa PA01
gucgcggucaucgccg

SEQ ID NO: 1404280 - RNA, 17 nt, Pseudomonas aeruginosa PA01
gucgcggucaucgccgg

SEQ ID NO: 1404281 - RNA, 16 nt, Pseudomonas aeruginosa PA01
gucgcguuggcgugcu

SEQ ID NO: 1404282 - RNA, 17 nt, Pseudomonas aeruginosa PA01
gucgcggucuuccgccg

SEQ ID NO: 1404283 - RNA, 12 nt, Pseudomonas aeruginosa PA01
gucgcgcgccgg

SEQ ID NO: 1404284 - RNA, 20 nt, Pseudomonas aeruginosa PA01
gucgcgcgccggagccaccg

SEQ ID NO: 1404285 - RNA, 14 nt, Pseudomonas aeruginosa PA01
gucgcgcgcggcca

SEQ ID NO: 1404286 - RNA, 16 nt, Pseudomonas aeruginosa PA01
gucgcgcgcggccagc

SEQ ID NO: 1404287 - RNA, 15 nt, Pseudomonas aeruginosa PA01
gucgcggcgccuggc

SEQ ID NO: 1404288 - RNA, 17 nt, Pseudomonas aeruginosa PA01
gucgcggcgccuggcgu

SEQ ID NO: 1404289 - RNA, 14 nt, Pseudomonas aeruginosa PA01
gucgcgcaccuggc

SEQ ID NO: 1404290 - RNA, 17 nt, Pseudomonas aeruginosa PA01
gucgcgcaccuggcggu

SEQ ID NO: 1404291 - RNA, 22 nt, Pseudomonas aeruginosa PA01
gucgcgcaccuggcggucgccg

SEQ ID NO: 1404292 - RNA, 14 nt, Pseudomonas aeruginosa PA01
gucgcgccgguggc

SEQ ID NO: 1404293 - RNA, 17 nt, Pseudomonas aeruginosa PA01
gucgcgccgguggcgua

SEQ ID NO: 1404294 - RNA, 23 nt, Pseudomonas aeruginosa PA01
gucgcgccgguggcguacccgcc

SEQ ID NO: 1404295 - RNA, 21 nt, Pseudomonas aeruginosa PA01
gucgcgccgcggaaucgcgua

SEQ ID NO: 1404296 - RNA, 14 nt, Pseudomonas aeruginosa PA01
gucgcgcggccagc

SEQ ID NO: 1404297 - RNA, 17 nt, Pseudomonas aeruginosa PA01
gucgcgcggccagcgug

SEQ ID NO: 1404298 - RNA, 14 nt, Pseudomonas aeruginosa PA01
gucgcggcuggccg

SEQ ID NO: 1404299 - RNA, 15 nt, Pseudomonas aeruginosa PA01
gucgcggcuggccgc

SEQ ID NO: 1404300 - RNA, 17 nt, Pseudomonas aeruginosa PA01
gucgcggcuggccgccu

SEQ ID NO: 1404301 - RNA, 20 nt, Pseudomonas aeruginosa PA01
gucgcggcuggccgccuggc

SEQ ID NO: 1404302 - RNA, 22 nt, Pseudomonas aeruginosa PA01
gucgcggcuuucuuccagcacg

SEQ ID NO: 1404303 - RNA, 19 nt, Pseudomonas aeruginosa PA01
gucgcggcugaaggccgaa

SEQ ID NO: 1404304 - RNA, 14 nt, Pseudomonas aeruginosa PA01
gucgcgggcgaugg

SEQ ID NO: 1404305 - RNA, 13 nt, Pseudomonas aeruginosa PA01
gucgcgggccagg

SEQ ID NO: 1404306 - RNA, 15 nt, Pseudomonas aeruginosa PA01
gucgcgggccaggcc

SEQ ID NO: 1404307 - RNA, 17 nt, Pseudomonas aeruginosa PA01
gucgcgggccaggcccu

SEQ ID NO: 1404308 - RNA, 15 nt, Pseudomonas aeruginosa PA01
gucgcgggccugggc

SEQ ID NO: 1404309 - RNA, 13 nt, Pseudomonas aeruginosa PA01
gucgccggcaugg

SEQ ID NO: 1404310 - RNA, 19 nt, Pseudomonas aeruginosa PA01
gucgccggcaucguggcca

SEQ ID NO: 1404311 - RNA, 23 nt, Pseudomonas aeruginosa PA01
gucgccggcgacggucagcaggc

SEQ ID NO: 1404312 - RNA, 15 nt, Pseudomonas aeruginosa PA01
gucgccggcgaacuc

SEQ ID NO: 1404313 - RNA, 16 nt, Pseudomonas aeruginosa PA01
gucgccugccaggcgg

SEQ ID NO: 1404314 - RNA, 13 nt, Pseudomonas aeruginosa PA01
gucgccucggggg

SEQ ID NO: 1404315 - RNA, 17 nt, Pseudomonas aeruginosa PA01
gucgccggucaggcugc

SEQ ID NO: 1404316 - RNA, 20 nt, Pseudomonas aeruginosa PA01
gucgccgggaaacagggcga

SEQ ID NO: 1404317 - RNA, 22 nt, Pseudomonas aeruginosa PA01
gucgccgggauuguugcggcgg

SEQ ID NO: 1404318 - RNA, 15 nt, Pseudomonas aeruginosa PA01
gucgccuggcccugg

SEQ ID NO: 1404319 - RNA, 20 nt, Pseudomonas aeruginosa PA01
gucgccuggcccuggaccuc

SEQ ID NO: 1404320 - RNA, 15 nt, Pseudomonas aeruginosa PA01
gucgccuuccggcag

SEQ ID NO: 1404321 - RNA, 16 nt, Pseudomonas aeruginosa PA01
gucgccuuccggcagg

SEQ ID NO: 1404322 - RNA, 17 nt, Pseudomonas aeruginosa PA01
gucgccuuccggcaggu

SEQ ID NO: 1404323 - RNA, 16 nt, Pseudomonas aeruginosa PA01
gucgccuuccucggcg

SEQ ID NO: 1404324 - RNA, 17 nt, Pseudomonas aeruginosa PA01
gucgccuuccucggcga

SEQ ID NO: 1404325 - RNA, 18 nt, Pseudomonas aeruginosa PA01
gucgccuuccucggcgaa

SEQ ID NO: 1404326 - RNA, 16 nt, Pseudomonas aeruginosa PA01
gucgccuugaccagcg

SEQ ID NO: 1404327 - RNA, 19 nt, Pseudomonas aeruginosa PA01
gucgccuugaccagcggcc

SEQ ID NO: 1404328 - RNA, 19 nt, Pseudomonas aeruginosa PA01
gucgcgaacucggcgccga

SEQ ID NO: 1404329 - RNA, 18 nt, Pseudomonas aeruginosa PA01
gucgcgaagaccggccgg

SEQ ID NO: 1404330 - RNA, 20 nt, Pseudomonas aeruginosa PA01
gucgcgaagaccggccggcu

SEQ ID NO: 1404331 - RNA, 17 nt, Pseudomonas aeruginosa PA01
gucgcgacugaccacgc

SEQ ID NO: 1404332 - RNA, 19 nt, Pseudomonas aeruginosa PA01
gucgcgacugaccacgcag

SEQ ID NO: 1404333 - RNA, 20 nt, Pseudomonas aeruginosa PA01
gucgcgacugaccacgcaga

SEQ ID NO: 1404334 - RNA, 18 nt, Pseudomonas aeruginosa PA01
gucgcgagguuccgcggc

SEQ ID NO: 1404335 - RNA, 16 nt, Pseudomonas aeruginosa PA01
gucgcgauagacgccg

SEQ ID NO: 1404336 - RNA, 19 nt, Pseudomonas aeruginosa PA01
gucgcgauagacgccggcg

SEQ ID NO: 1404337 - RNA, 21 nt, Pseudomonas aeruginosa PA01
gucgcgauagacgccggcgac

SEQ ID NO: 1404338 - RNA, 13 nt, Pseudomonas aeruginosa PA01
gucgcgaucaccg

SEQ ID NO: 1404339 - RNA, 17 nt, Pseudomonas aeruginosa PA01
gucgcgaucaccgcguc

SEQ ID NO: 1404340 - RNA, 18 nt, Pseudomonas aeruginosa PA01
gucgcgaucaccgcgucc

SEQ ID NO: 1404341 - RNA, 19 nt, Pseudomonas aeruginosa PA01
gucgcgauccaccgccagg

SEQ ID NO: 1404342 - RNA, 20 nt, Pseudomonas aeruginosa PA01
gucgcgauccaccgccaggg

SEQ ID NO: 1404343 - RNA, 22 nt, Pseudomonas aeruginosa PA01
gucgcgauccaccgccagggcg

SEQ ID NO: 1404344 - RNA, 19 nt, Pseudomonas aeruginosa PA01
gucgcgauguuggcgucga

SEQ ID NO: 1404345 - RNA, 15 nt, Pseudomonas aeruginosa PA01
gucgcgcaccaccca

SEQ ID NO: 1404346 - RNA, 14 nt, Pseudomonas aeruginosa PA01
gucgccgcccacgc

SEQ ID NO: 1404347 - RNA, 13 nt, Pseudomonas aeruginosa PA01
gucgccgcccggc

SEQ ID NO: 1404348 - RNA, 15 nt, Pseudomonas aeruginosa PA01
gucgccgcccggcag

SEQ ID NO: 1404349 - RNA, 12 nt, Pseudomonas aeruginosa PA01
gucgccgccagc

SEQ ID NO: 1404350 - RNA, 13 nt, Pseudomonas aeruginosa PA01
gucgccgccagca

SEQ ID NO: 1404351 - RNA, 15 nt, Pseudomonas aeruginosa PA01
gucgccgccagcaug

SEQ ID NO: 1404352 - RNA, 13 nt, Pseudomonas aeruginosa PA01
gucgccgccagcg

SEQ ID NO: 1404353 - RNA, 23 nt, Pseudomonas aeruginosa PA01
gucgccgccagcgccggccauug

SEQ ID NO: 1404354 - RNA, 13 nt, Pseudomonas aeruginosa PA01
gucgccgccagcu

SEQ ID NO: 1404355 - RNA, 19 nt, Pseudomonas aeruginosa PA01
gucgccgccaguucggcca

SEQ ID NO: 1404356 - RNA, 21 nt, Pseudomonas aeruginosa PA01
gucgccgccaguucggccauc

SEQ ID NO: 1404357 - RNA, 16 nt, Pseudomonas aeruginosa PA01
gucgccgccgaggcgc

SEQ ID NO: 1404358 - RNA, 17 nt, Pseudomonas aeruginosa PA01
gucgccgccgaggcgcg

SEQ ID NO: 1404359 - RNA, 20 nt, Pseudomonas aeruginosa PA01
gucgccgccgaggcgcgcca

SEQ ID NO: 1404360 - RNA, 22 nt, Pseudomonas aeruginosa PA01
gucgccgccgaggcgcgccacg

SEQ ID NO: 1404361 - RNA, 23 nt, Pseudomonas aeruginosa PA01
gucgccgccgaggcgcgccacgc

SEQ ID NO: 1404362 - RNA, 17 nt, Pseudomonas aeruginosa PA01
gucgccgccgccgggaa

SEQ ID NO: 1404363 - RNA, 12 nt, Pseudomonas aeruginosa PA01
gucgccgaccag

SEQ ID NO: 1404364 - RNA, 13 nt, Pseudomonas aeruginosa PA01
gucgccgaccagg

SEQ ID NO: 1404365 - RNA, 18 nt, Pseudomonas aeruginosa PA01
gucgccgaccaggcggcc

SEQ ID NO: 1404366 - RNA, 19 nt, Pseudomonas aeruginosa PA01
gucgccgaccaggcggccg

SEQ ID NO: 1404367 - RNA, 20 nt, Pseudomonas aeruginosa PA01
gucgccgaccaggcggccgu

SEQ ID NO: 1404368 - RNA, 17 nt, Pseudomonas aeruginosa PA01
gucgccgacccugcacc

SEQ ID NO: 1404369 - RNA, 23 nt, Pseudomonas aeruginosa PA01
gucgccgcaccggcgauggccgg

SEQ ID NO: 1404370 - RNA, 23 nt, Pseudomonas aeruginosa PA01
gucgccgcagcccuaggcgaccc

SEQ ID NO: 1404371 - RNA, 18 nt, Pseudomonas aeruginosa PA01
gucgccgaacggcagcug

SEQ ID NO: 1404372 - RNA, 19 nt, Pseudomonas aeruginosa PA01
gucgccgaacuccgagcag

SEQ ID NO: 1404373 - RNA, 19 nt, Pseudomonas aeruginosa PA01
gucgcccugcagcgcgcgc

SEQ ID NO: 1404374 - RNA, 14 nt, Pseudomonas aeruginosa PA01
gucgcccuggccga

SEQ ID NO: 1404375 - RNA, 22 nt, Pseudomonas aeruginosa PA01
gucgcccuggugcacggcgacc

SEQ ID NO: 1404376 - RNA, 20 nt, Pseudomonas aeruginosa PA01
gucgcccgugccucggcgga

SEQ ID NO: 1404377 - RNA, 16 nt, Pseudomonas aeruginosa PA01
gucgcccucgcggagc

SEQ ID NO: 1404378 - RNA, 17 nt, Pseudomonas aeruginosa PA01
gucgcccucgcggagcu

SEQ ID NO: 1404379 - RNA, 13 nt, Pseudomonas aeruginosa PA01
gucgcccucggcc

SEQ ID NO: 1404380 - RNA, 14 nt, Pseudomonas aeruginosa PA01
gucgcccucggcca

SEQ ID NO: 1404381 - RNA, 16 nt, Pseudomonas aeruginosa PA01
gucgcccucggccagg

SEQ ID NO: 1404382 - RNA, 14 nt, Pseudomonas aeruginosa PA01
gucgcccucggcgc

SEQ ID NO: 1404383 - RNA, 19 nt, Pseudomonas aeruginosa PA01
gucgcccucggcgcuggcc

SEQ ID NO: 1404384 - RNA, 22 nt, Pseudomonas aeruginosa PA01
gucgccacgcaguucgcgggcc

SEQ ID NO: 1404385 - RNA, 15 nt, Pseudomonas aeruginosa PA01
gucgccacgcccgcc

SEQ ID NO: 1404386 - RNA, 16 nt, Pseudomonas aeruginosa PA01
gucgccacgcccgccg

SEQ ID NO: 1404387 - RNA, 18 nt, Pseudomonas aeruginosa PA01
gucgccacgcccgccgug

SEQ ID NO: 1404388 - RNA, 22 nt, Pseudomonas aeruginosa PA01
gucgccacgcccgccguggcgg

SEQ ID NO: 1404389 - RNA, 12 nt, Pseudomonas aeruginosa PA01
gucgccagcgcc

SEQ ID NO: 1404390 - RNA, 16 nt, Pseudomonas aeruginosa PA01
gucgaucagcgcgcgg

SEQ ID NO: 1404391 - RNA, 17 nt, Pseudomonas aeruginosa PA01
gucgaucagcgcgcgga

SEQ ID NO: 1404392 - RNA, 15 nt, Pseudomonas aeruginosa PA01
gucgauccgaccugg

SEQ ID NO: 1404393 - RNA, 21 nt, Pseudomonas aeruginosa PA01
gucgauccgaccuggggcggc

SEQ ID NO: 1404394 - RNA, 15 nt, Pseudomonas aeruginosa PA01
gucgauccgcgccug

SEQ ID NO: 1404395 - RNA, 16 nt, Pseudomonas aeruginosa PA01
gucgauccgcgccugc

SEQ ID NO: 1404396 - RNA, 14 nt, Pseudomonas aeruginosa PA01
gucgaucaggcgca

SEQ ID NO: 1404397 - RNA, 15 nt, Pseudomonas aeruginosa PA01
gucgaucaggcgcau

SEQ ID NO: 1404398 - RNA, 19 nt, Pseudomonas aeruginosa PA01
gucgaucagguaggccggc

SEQ ID NO: 1404399 - RNA, 19 nt, Pseudomonas aeruginosa PA01
gucgaucagguccuggccg

SEQ ID NO: 1404400 - RNA, 14 nt, Pseudomonas aeruginosa PA01
gucgaucaggucgc

SEQ ID NO: 1404401 - RNA, 21 nt, Pseudomonas aeruginosa PA01
gucgaugcguccgcgcaggcg

SEQ ID NO: 1404402 - RNA, 22 nt, Pseudomonas aeruginosa PA01
gucgaugcuccaaugcaccugc

SEQ ID NO: 1404403 - RNA, 23 nt, Pseudomonas aeruginosa PA01
gucgaugcuccaaugcaccugcg

SEQ ID NO: 1404404 - RNA, 13 nt, Pseudomonas aeruginosa PA01
gucgaugcugccg

SEQ ID NO: 1404405 - RNA, 14 nt, Pseudomonas aeruginosa PA01
gucgaugcugccgu

SEQ ID NO: 1404406 - RNA, 19 nt, Pseudomonas aeruginosa PA01
gucgaugcugccguagcgc

SEQ ID NO: 1404407 - RNA, 22 nt, Pseudomonas aeruginosa PA01
gucgauguauccguacuggcgc

SEQ ID NO: 1404408 - RNA, 16 nt, Pseudomonas aeruginosa PA01
gucgaugggcgacagc

SEQ ID NO: 1404409 - RNA, 23 nt, Pseudomonas aeruginosa PA01
gucgaugucgcggcugaaggccg

SEQ ID NO: 1404410 - RNA, 21 nt, Pseudomonas aeruginosa PA01
gucgauguccugggccaccug

SEQ ID NO: 1404411 - RNA, 16 nt, Pseudomonas aeruginosa PA01
gucgcagucguagcgc

SEQ ID NO: 1404412 - RNA, 21 nt, Pseudomonas aeruginosa PA01
gucgcaggccugguaggcguc

SEQ ID NO: 1404413 - RNA, 15 nt, Pseudomonas aeruginosa PA01
gucgcaggcgaugcc

SEQ ID NO: 1404414 - RNA, 19 nt, Pseudomonas aeruginosa PA01
gucgcaggcgaugccgacg

SEQ ID NO: 1404415 - RNA, 23 nt, Pseudomonas aeruginosa PA01
gucgcaggcucaguucggccagc

SEQ ID NO: 1404416 - RNA, 19 nt, Pseudomonas aeruginosa PA01
gucgcagguaacccgcggc

SEQ ID NO: 1404417 - RNA, 21 nt, Pseudomonas aeruginosa PA01
gucgcagguaacccgcggcga

SEQ ID NO: 1404418 - RNA, 16 nt, Pseudomonas aeruginosa PA01
gucgccaagcccggcg

SEQ ID NO: 1404419 - RNA, 21 nt, Pseudomonas aeruginosa PA01
gucgccaaagaaaaggcccgc

SEQ ID NO: 1404420 - RNA, 15 nt, Pseudomonas aeruginosa PA01
gucgaguaccgcugc

SEQ ID NO: 1404421 - RNA, 21 nt, Pseudomonas aeruginosa PA01
gucgaguaccgcugcggccgg

SEQ ID NO: 1404422 - RNA, 22 nt, Pseudomonas aeruginosa PA01
gucgaguaccgcugcggccggc

SEQ ID NO: 1404423 - RNA, 19 nt, Pseudomonas aeruginosa PA01
gucgagucgcgcagccagu

SEQ ID NO: 1404424 - RNA, 15 nt, Pseudomonas aeruginosa PA01
gucgauaccagcgcc

SEQ ID NO: 1404425 - RNA, 16 nt, Pseudomonas aeruginosa PA01
gucgauaccagcgccg

SEQ ID NO: 1404426 - RNA, 17 nt, Pseudomonas aeruginosa PA01
gucgauaccagcgccgc

SEQ ID NO: 1404427 - RNA, 18 nt, Pseudomonas aeruginosa PA01
gucgauaccagcgccgcu

SEQ ID NO: 1404428 - RNA, 20 nt, Pseudomonas aeruginosa PA01
gucgauaccagcgccgcucc

SEQ ID NO: 1404429 - RNA, 20 nt, Pseudomonas aeruginosa PA01
gucgauacgcaucugcucga

SEQ ID NO: 1404430 - RNA, 20 nt, Pseudomonas aeruginosa PA01
gucgaucagcagcagcgcca

SEQ ID NO: 1404431 - RNA, 22 nt, Pseudomonas aeruginosa PA01
gucgaucagcagcagcgccaug

SEQ ID NO: 1404432 - RNA, 20 nt, Pseudomonas aeruginosa PA01
gucgauauagcccugggcgc

SEQ ID NO: 1404433 - RNA, 23 nt, Pseudomonas aeruginosa PA01
gucgauauagcccugggcgccgc

SEQ ID NO: 1404434 - RNA, 16 nt, Pseudomonas aeruginosa PA01
gucgauauccagcggc

SEQ ID NO: 1404435 - RNA, 17 nt, Pseudomonas aeruginosa PA01
gucgauauccagcggca

SEQ ID NO: 1404436 - RNA, 18 nt, Pseudomonas aeruginosa PA01
gucgauauccagcggcag

SEQ ID NO: 1404437 - RNA, 23 nt, Pseudomonas aeruginosa PA01
gucgauauccagcggcagccccu

SEQ ID NO: 1404438 - RNA, 16 nt, Pseudomonas aeruginosa PA01
gucgagggucugcucg

SEQ ID NO: 1404439 - RNA, 17 nt, Pseudomonas aeruginosa PA01
gucgagggucugcucga

SEQ ID NO: 1404440 - RNA, 14 nt, Pseudomonas aeruginosa PA01
gucgagcaccagca

SEQ ID NO: 1404441 - RNA, 19 nt, Pseudomonas aeruginosa PA01
gucgagcaccagcaggucg

SEQ ID NO: 1404442 - RNA, 19 nt, Pseudomonas aeruginosa PA01
gucgagggcaaaggcgcgc

SEQ ID NO: 1404443 - RNA, 22 nt, Pseudomonas aeruginosa PA01
gucgagggcaaaggcgcgcagg

SEQ ID NO: 1404444 - RNA, 19 nt, Pseudomonas aeruginosa PA01
gucgagaugcugcgggcgc

SEQ ID NO: 1404445 - RNA, 22 nt, Pseudomonas aeruginosa PA01
gucgagaugcugcgggcgccgc

SEQ ID NO: 1404446 - RNA, 19 nt, Pseudomonas aeruginosa PA01
gucgaggucgacggcggcc

SEQ ID NO: 1404447 - RNA, 19 nt, Pseudomonas aeruginosa PA01
gucgagguagguccaggcg

SEQ ID NO: 1404448 - RNA, 20 nt, Pseudomonas aeruginosa PA01
gucgagguagguccaggcga

SEQ ID NO: 1404449 - RNA, 17 nt, Pseudomonas aeruginosa PA01
gucgagguagucgguga

SEQ ID NO: 1404450 - RNA, 20 nt, Pseudomonas aeruginosa PA01
gucgaggguggcgccgagca

SEQ ID NO: 1404451 - RNA, 22 nt, Pseudomonas aeruginosa PA01
gucgaggguggucagccagccg

SEQ ID NO: 1404452 - RNA, 23 nt, Pseudomonas aeruginosa PA01
gucgaggguggucagccagccga

SEQ ID NO: 1404453 - RNA, 23 nt, Pseudomonas aeruginosa PA01
gucgagggugguuuccaggcuca

SEQ ID NO: 1404454 - RNA, 22 nt, Pseudomonas aeruginosa PA01
gucgaggguugucaccggcagg

SEQ ID NO: 1404455 - RNA, 14 nt, Pseudomonas aeruginosa PA01
gucgaggucggcga

SEQ ID NO: 1404456 - RNA, 19 nt, Pseudomonas aeruginosa PA01
gucgaccuugccgacgccg

SEQ ID NO: 1404457 - RNA, 22 nt, Pseudomonas aeruginosa PA01
gucgacgaacaggaagcgcggg

SEQ ID NO: 1404458 - RNA, 17 nt, Pseudomonas aeruginosa PA01
gucgaccgucgccacgc

SEQ ID NO: 1404459 - RNA, 14 nt, Pseudomonas aeruginosa PA01
gucgaccucgaugg

SEQ ID NO: 1404460 - RNA, 18 nt, Pseudomonas aeruginosa PA01
gucgacgaccuugcccac

SEQ ID NO: 1404461 - RNA, 17 nt, Pseudomonas aeruginosa PA01
gucgacgcccugggcga

SEQ ID NO: 1404462 - RNA, 22 nt, Pseudomonas aeruginosa PA01
gucgacgcagccgggccgcagc

SEQ ID NO: 1404463 - RNA, 14 nt, Pseudomonas aeruginosa PA01
gucgacgcagggcg

SEQ ID NO: 1404464 - RNA, 16 nt, Pseudomonas aeruginosa PA01
gucgacgcagggcggc

SEQ ID NO: 1404465 - RNA, 21 nt, Pseudomonas aeruginosa PA01
gucgacgcagggcggcgccug

SEQ ID NO: 1404466 - RNA, 20 nt, Pseudomonas aeruginosa PA01
gucgacgcaucgacggggcg

SEQ ID NO: 1404467 - RNA, 17 nt, Pseudomonas aeruginosa PA01
gucgacgccgaagccgc

SEQ ID NO: 1404468 - RNA, 19 nt, Pseudomonas aeruginosa PA01
gucgacgccgaagccgcug

SEQ ID NO: 1404469 - RNA, 13 nt, Pseudomonas aeruginosa PA01
gucgacgccgguc

SEQ ID NO: 1404470 - RNA, 20 nt, Pseudomonas aeruginosa PA01
gucgacgccggucucggcga

SEQ ID NO: 1404471 - RNA, 20 nt, Pseudomonas aeruginosa PA01
gucgagacgccagccgcccu

SEQ ID NO: 1404472 - RNA, 15 nt, Pseudomonas aeruginosa PA01
gucgagacgcgggcc

SEQ ID NO: 1404473 - RNA, 17 nt, Pseudomonas aeruginosa PA01
gucgagagaauccgccg

SEQ ID NO: 1404474 - RNA, 18 nt, Pseudomonas aeruginosa PA01
gucgagagaauccgccgu

SEQ ID NO: 1404475 - RNA, 21 nt, Pseudomonas aeruginosa PA01
gucgagagcggguagcgccgg

SEQ ID NO: 1404476 - RNA, 15 nt, Pseudomonas aeruginosa PA01
gucgacuucgcacca

SEQ ID NO: 1404477 - RNA, 17 nt, Pseudomonas aeruginosa PA01
gucgacuucgcaccagc

SEQ ID NO: 1404478 - RNA, 19 nt, Pseudomonas aeruginosa PA01
gucgacuucgcaccagccg

SEQ ID NO: 1404479 - RNA, 22 nt, Pseudomonas aeruginosa PA01
gucgacuucgcaccagccggcc

SEQ ID NO: 1404480 - RNA, 24 nt, Pseudomonas aeruginosa PA01
gucgacuucgcaccagccggccgc

SEQ ID NO: 1404481 - RNA, 23 nt, Pseudomonas aeruginosa PA01
gucgacuugccgaucaugggggc

SEQ ID NO: 1404482 - RNA, 14 nt, Pseudomonas aeruginosa PA01
gucgagaaggcugc

SEQ ID NO: 1404483 - RNA, 18 nt, Pseudomonas aeruginosa PA01
gucgacugcuggguacgg

SEQ ID NO: 1404484 - RNA, 15 nt, Pseudomonas aeruginosa PA01
gucgacguugucgca

SEQ ID NO: 1404485 - RNA, 14 nt, Pseudomonas aeruginosa PA01
gucgacucagcggg

SEQ ID NO: 1404486 - RNA, 21 nt, Pseudomonas aeruginosa PA01
gucgacacugauauccgcucu

SEQ ID NO: 1404487 - RNA, 22 nt, Pseudomonas aeruginosa PA01
gucgacacugauauccgcucug

SEQ ID NO: 1404488 - RNA, 22 nt, Pseudomonas aeruginosa PA01
gucgacaccuggcaacaaggca

SEQ ID NO: 1404489 - RNA, 21 nt, Pseudomonas aeruginosa PA01
gucgacacgagccgcugcggc

SEQ ID NO: 1404490 - RNA, 22 nt, Pseudomonas aeruginosa PA01
gucgacacgagccgcugcggcu

SEQ ID NO: 1404491 - RNA, 18 nt, Pseudomonas aeruginosa PA01
gucgacaccgaucaccug

SEQ ID NO: 1404492 - RNA, 18 nt, Pseudomonas aeruginosa PA01
gucgacaugcaggccggc

SEQ ID NO: 1404493 - RNA, 21 nt, Pseudomonas aeruginosa PA01
gucgacaugcaggccggccuc

SEQ ID NO: 1404494 - RNA, 17 nt, Pseudomonas aeruginosa PA01
gucgacauagcgcagca

SEQ ID NO: 1404495 - RNA, 14 nt, Pseudomonas aeruginosa PA01
gucgaccagcggcg

SEQ ID NO: 1404496 - RNA, 19 nt, Pseudomonas aeruginosa PA01
gucgaccaccgcguggugc

SEQ ID NO: 1404497 - RNA, 15 nt, Pseudomonas aeruginosa PA01
gucgacccaggccca

SEQ ID NO: 1404498 - RNA, 19 nt, Pseudomonas aeruginosa PA01
gucgacccaggcccagccg

SEQ ID NO: 1404499 - RNA, 23 nt, Pseudomonas aeruginosa PA01
gucgacccaggcccagccgguga

SEQ ID NO: 1404500 - RNA, 16 nt, Pseudomonas aeruginosa PA01
gucgaccaucaccagc

SEQ ID NO: 1404501 - RNA, 19 nt, Pseudomonas aeruginosa PA01
gucgaccaucaccagcgcc

SEQ ID NO: 1404502 - RNA, 21 nt, Pseudomonas aeruginosa PA01
gucgaccaugguguuggcggc

SEQ ID NO: 1404503 - RNA, 21 nt, Pseudomonas aeruginosa PA01
gucgaccauucccacgacccg

SEQ ID NO: 1404504 - RNA, 21 nt, Pseudomonas aeruginosa PA01
gucgaccggaaucacgucgau

SEQ ID NO: 1404505 - RNA, 14 nt, Pseudomonas aeruginosa PA01
gcgcccgcucgacc

SEQ ID NO: 1404506 - RNA, 21 nt, Pseudomonas aeruginosa PA01
gcgcccggcaaucaggcgcga

SEQ ID NO: 1404507 - RNA, 19 nt, Pseudomonas aeruginosa PA01
gcgccgacagcacgauggc

SEQ ID NO: 1404508 - RNA, 15 nt, Pseudomonas aeruginosa PA01
gcgccgaccacgacc

SEQ ID NO: 1404509 - RNA, 22 nt, Pseudomonas aeruginosa PA01
gcgccgaccacgaccgcgucca

SEQ ID NO: 1404510 - RNA, 14 nt, Pseudomonas aeruginosa PA01
gcgccgaccagccg

SEQ ID NO: 1404511 - RNA, 16 nt, Pseudomonas aeruginosa PA01
gcgccgaccagccgca

SEQ ID NO: 1404512 - RNA, 21 nt, Pseudomonas aeruginosa PA01
gcgccgaccagccgcaggcug

SEQ ID NO: 1404513 - RNA, 14 nt, Pseudomonas aeruginosa PA01
gcgccgaaggcgau

SEQ ID NO: 1404514 - RNA, 14 nt, Pseudomonas aeruginosa PA01
gcgccgaaggccag

SEQ ID NO: 1404515 - RNA, 16 nt, Pseudomonas aeruginosa PA01
gcgccgaaggccagcu

SEQ ID NO: 1404516 - RNA, 15 nt, Pseudomonas aeruginosa PA01
gcgccgaauccaggc

SEQ ID NO: 1404517 - RNA, 18 nt, Pseudomonas aeruginosa PA01
gcgccgaauccaggccga

SEQ ID NO: 1404518 - RNA, 20 nt, Pseudomonas aeruginosa PA01
gcgccgaaggcgucgggcag

SEQ ID NO: 1404519 - RNA, 19 nt, Pseudomonas aeruginosa PA01
gcgccgaccgcaccgccag

SEQ ID NO: 1404520 - RNA, 18 nt, Pseudomonas aeruginosa PA01
gcgccgagacgaucagca

SEQ ID NO: 1404521 - RNA, 13 nt, Pseudomonas aeruginosa PA01
gcgccgaccgcgc

SEQ ID NO: 1404522 - RNA, 15 nt, Pseudomonas aeruginosa PA01
gcgccgaccgcgcgc

SEQ ID NO: 1404523 - RNA, 20 nt, Pseudomonas aeruginosa PA01
gcgccgaccgcgcgccugca

SEQ ID NO: 1404524 - RNA, 19 nt, Pseudomonas aeruginosa PA01
gcgccgacccagagcgcgc

SEQ ID NO: 1404525 - RNA, 21 nt, Pseudomonas aeruginosa PA01
gcgccgacccagagcgcgccc

SEQ ID NO: 1404526 - RNA, 17 nt, Pseudomonas aeruginosa PA01
gcgccgagcagcggcgc

SEQ ID NO: 1404527 - RNA, 15 nt, Pseudomonas aeruginosa PA01
gcgccgagccggcug

SEQ ID NO: 1404528 - RNA, 16 nt, Pseudomonas aeruginosa PA01
gcgccgagccggcugc

SEQ ID NO: 1404529 - RNA, 16 nt, Pseudomonas aeruginosa PA01
gcgccgagcuggcgcg

SEQ ID NO: 1404530 - RNA, 17 nt, Pseudomonas aeruginosa PA01
gcgccgaugccggccgg

SEQ ID NO: 1404531 - RNA, 19 nt, Pseudomonas aeruginosa PA01
gcgccgaugccggccggca

SEQ ID NO: 1404532 - RNA, 14 nt, Pseudomonas aeruginosa PA01
gcgccgaugccggc

SEQ ID NO: 1404533 - RNA, 16 nt, Pseudomonas aeruginosa PA01
gcgccgaugcccaggc

SEQ ID NO: 1404534 - RNA, 19 nt, Pseudomonas aeruginosa PA01
gcgccgaugcccaggccga

SEQ ID NO: 1404535 - RNA, 20 nt, Pseudomonas aeruginosa PA01
gcgccgagggguacagggca

SEQ ID NO: 1404536 - RNA, 19 nt, Pseudomonas aeruginosa PA01
gcgccgauguacggcacca

SEQ ID NO: 1404537 - RNA, 22 nt, Pseudomonas aeruginosa PA01
gcgccgauguacggcaccacca

SEQ ID NO: 1404538 - RNA, 13 nt, Pseudomonas aeruginosa PA01
gcgccgcagggcc

SEQ ID NO: 1404539 - RNA, 17 nt, Pseudomonas aeruginosa PA01
gcgccgcggcuggccau

SEQ ID NO: 1404540 - RNA, 17 nt, Pseudomonas aeruginosa PA01
gcgccgcgucgccgcca

SEQ ID NO: 1404541 - RNA, 16 nt, Pseudomonas aeruginosa PA01
gcgccgcuagggcgcc

SEQ ID NO: 1404542 - RNA, 21 nt, Pseudomonas aeruginosa PA01
gcgccgcuagggcgcccucgc

SEQ ID NO: 1404543 - RNA, 17 nt, Pseudomonas aeruginosa PA01
gcgccgcuaugggcacc

SEQ ID NO: 1404544 - RNA, 22 nt, Pseudomonas aeruginosa PA01
gcgccgcuaugggcaccgcgcc

SEQ ID NO: 1404545 - RNA, 16 nt, Pseudomonas aeruginosa PA01
gcgccgcucaggcguc

SEQ ID NO: 1404546 - RNA, 20 nt, Pseudomonas aeruginosa PA01
gcgccgcucaggcgucccgc

SEQ ID NO: 1404547 - RNA, 15 nt, Pseudomonas aeruginosa PA01
gcgccgcucggcgag

SEQ ID NO: 1404548 - RNA, 20 nt, Pseudomonas aeruginosa PA01
gcgccgcucggcgagccgcc

SEQ ID NO: 1404549 - RNA, 21 nt, Pseudomonas aeruginosa PA01
gcgccgcucggcgagccgccg

SEQ ID NO: 1404550 - RNA, 23 nt, Pseudomonas aeruginosa PA01
gcgccgcucggcgagccgccggg

SEQ ID NO: 1404551 - RNA, 22 nt, Pseudomonas aeruginosa PA01
gcgccgcucgaugcccgccagc

SEQ ID NO: 1404552 - RNA, 15 nt, Pseudomonas aeruginosa PA01
gcgccgcuccuccuc

SEQ ID NO: 1404553 - RNA, 19 nt, Pseudomonas aeruginosa PA01
gcgccgcuccuccucgcuc

SEQ ID NO: 1404554 - RNA, 21 nt, Pseudomonas aeruginosa PA01
gcgccgcuccuggcaggcuca

SEQ ID NO: 1404555 - RNA, 13 nt, Pseudomonas aeruginosa PA01
gcgccgcucgcgc

SEQ ID NO: 1404556 - RNA, 15 nt, Pseudomonas aeruginosa PA01
gcgccgcugcccaga

SEQ ID NO: 1404557 - RNA, 15 nt, Pseudomonas aeruginosa PA01
gcgccgcugcggcug

SEQ ID NO: 1404558 - RNA, 18 nt, Pseudomonas aeruginosa PA01
gcgccgcuggcguggugg

SEQ ID NO: 1404559 - RNA, 12 nt, Pseudomonas aeruginosa PA01
gcgccgcgggcc

SEQ ID NO: 1404560 - RNA, 17 nt, Pseudomonas aeruginosa PA01
gcgccgcgggccagccg

SEQ ID NO: 1404561 - RNA, 14 nt, Pseudomonas aeruginosa PA01
gcgccgcgggcgcu

SEQ ID NO: 1404562 - RNA, 19 nt, Pseudomonas aeruginosa PA01
gcgccgcgguuuccgugcg

SEQ ID NO: 1404563 - RNA, 13 nt, Pseudomonas aeruginosa PA01
gcgccgcggguca

SEQ ID NO: 1404564 - RNA, 15 nt, Pseudomonas aeruginosa PA01
gcgccgcgggucacc

SEQ ID NO: 1404565 - RNA, 18 nt, Pseudomonas aeruginosa PA01
gcgccgcgggucaccagc

SEQ ID NO: 1404566 - RNA, 21 nt, Pseudomonas aeruginosa PA01
gcgccgcgggucaccagcgcc

SEQ ID NO: 1404567 - RNA, 13 nt, Pseudomonas aeruginosa PA01
gcgccgcgggucu

SEQ ID NO: 1404568 - RNA, 23 nt, Pseudomonas aeruginosa PA01
gcgccgcgggucugcucggcgcc

SEQ ID NO: 1404569 - RNA, 13 nt, Pseudomonas aeruginosa PA01
gcgccgcggcggc

SEQ ID NO: 1404570 - RNA, 14 nt, Pseudomonas aeruginosa PA01
gcgccgcggcggcg

SEQ ID NO: 1404571 - RNA, 14 nt, Pseudomonas aeruginosa PA01
gcgccgcggcgacc

SEQ ID NO: 1404572 - RNA, 15 nt, Pseudomonas aeruginosa PA01
gcgccgcggcccggc

SEQ ID NO: 1404573 - RNA, 16 nt, Pseudomonas aeruginosa PA01
gcgccgcgcuuggccu

SEQ ID NO: 1404574 - RNA, 21 nt, Pseudomonas aeruginosa PA01
gcgccgcgcuuggccuugccg

SEQ ID NO: 1404575 - RNA, 13 nt, Pseudomonas aeruginosa PA01
gcgccgcgcugcg

SEQ ID NO: 1404576 - RNA, 20 nt, Pseudomonas aeruginosa PA01
gcgccgcgccaacuggcgca

SEQ ID NO: 1404577 - RNA, 21 nt, Pseudomonas aeruginosa PA01
gcgccgcgcggcaacaccaca

SEQ ID NO: 1404578 - RNA, 16 nt, Pseudomonas aeruginosa PA01
gcgccgcgcggcgccc

SEQ ID NO: 1404579 - RNA, 14 nt, Pseudomonas aeruginosa PA01
gcgccgcauuggcc

SEQ ID NO: 1404580 - RNA, 17 nt, Pseudomonas aeruginosa PA01
gcgccgcauuggccagg

SEQ ID NO: 1404581 - RNA, 18 nt, Pseudomonas aeruginosa PA01
gcgccgcauuggccaggc

SEQ ID NO: 1404582 - RNA, 12 nt, Pseudomonas aeruginosa PA01
gcgccgccaacc

SEQ ID NO: 1404583 - RNA, 12 nt, Pseudomonas aeruginosa PA01
gcgccgccggcg

SEQ ID NO: 1404584 - RNA, 13 nt, Pseudomonas aeruginosa PA01
gcgccgccggugc

SEQ ID NO: 1404585 - RNA, 12 nt, Pseudomonas aeruginosa PA01
gcgccgccgucu

SEQ ID NO: 1404586 - RNA, 16 nt, Pseudomonas aeruginosa PA01
gcgccgccucgaaggc

SEQ ID NO: 1404587 - RNA, 18 nt, Pseudomonas aeruginosa PA01
gcgccgccucgaaggccg

SEQ ID NO: 1404588 - RNA, 19 nt, Pseudomonas aeruginosa PA01
gcgccgccucgaaggccgg

SEQ ID NO: 1404589 - RNA, 20 nt, Pseudomonas aeruginosa PA01
gcgccgccucgaaggccggc

SEQ ID NO: 1404590 - RNA, 22 nt, Pseudomonas aeruginosa PA01
gcgccgccucgaaggccggcaa

SEQ ID NO: 1404591 - RNA, 12 nt, Pseudomonas aeruginosa PA01
gcgccgccggug

SEQ ID NO: 1404592 - RNA, 13 nt, Pseudomonas aeruginosa PA01
gcgccgccgggcg

SEQ ID NO: 1404593 - RNA, 15 nt, Pseudomonas aeruginosa PA01
gcgccgccgggcgcc

SEQ ID NO: 1404594 - RNA, 14 nt, Pseudomonas aeruginosa PA01
gcgccgccgggcgu

SEQ ID NO: 1404595 - RNA, 14 nt, Pseudomonas aeruginosa PA01
gcgccgcgccagca

SEQ ID NO: 1404596 - RNA, 17 nt, Pseudomonas aeruginosa PA01
gcgccgcgccagcaggc

SEQ ID NO: 1404597 - RNA, 23 nt, Pseudomonas aeruginosa PA01
gcgccgcgccagcaggcgcagca

SEQ ID NO: 1404598 - RNA, 13 nt, Pseudomonas aeruginosa PA01
gcgccgcgccagg

SEQ ID NO: 1404599 - RNA, 17 nt, Pseudomonas aeruginosa PA01
gcgccgcgcagcgcggc

SEQ ID NO: 1404600 - RNA, 23 nt, Pseudomonas aeruginosa PA01
gcgccgcgcaguucguccaucgc

SEQ ID NO: 1404601 - RNA, 18 nt, Pseudomonas aeruginosa PA01
gcgccgcgcauccucggc

SEQ ID NO: 1404602 - RNA, 20 nt, Pseudomonas aeruginosa PA01
gcgccgcgcauccucggcau

SEQ ID NO: 1404603 - RNA, 13 nt, Pseudomonas aeruginosa PA01
gcgccgcgcagcg

SEQ ID NO: 1404604 - RNA, 12 nt, Pseudomonas aeruginosa PA01
gcgccgcgcacc

SEQ ID NO: 1404605 - RNA, 18 nt, Pseudomonas aeruginosa PA01
gcgccgcgcaccugggcg

SEQ ID NO: 1404606 - RNA, 21 nt, Pseudomonas aeruginosa PA01
gcgccgccucgcugggcgggc

SEQ ID NO: 1404607 - RNA, 20 nt, Pseudomonas aeruginosa PA01
gcgccgccuuucugcccggc

SEQ ID NO: 1404608 - RNA, 21 nt, Pseudomonas aeruginosa PA01
gcgccgccuuucugcccggcu

SEQ ID NO: 1404609 - RNA, 22 nt, Pseudomonas aeruginosa PA01
gcgccgcgaacacacccugcgc

SEQ ID NO: 1404610 - RNA, 21 nt, Pseudomonas aeruginosa PA01
gcgccgccucgcgcaacgccu

SEQ ID NO: 1404611 - RNA, 14 nt, Pseudomonas aeruginosa PA01
gcgccgccucgaug

SEQ ID NO: 1404612 - RNA, 16 nt, Pseudomonas aeruginosa PA01
gcgccgccucgauggc

SEQ ID NO: 1404613 - RNA, 19 nt, Pseudomonas aeruginosa PA01
gcgccgccucgauggcggc

SEQ ID NO: 1404614 - RNA, 15 nt, Pseudomonas aeruginosa PA01
gcgccgccuggccgg

SEQ ID NO: 1404615 - RNA, 16 nt, Pseudomonas aeruginosa PA01
gcgccgccuggccggu

SEQ ID NO: 1404616 - RNA, 18 nt, Pseudomonas aeruginosa PA01
gcgcccaacgucuucagg

SEQ ID NO: 1404617 - RNA, 21 nt, Pseudomonas aeruginosa PA01
gcgcccaacgucuucaggcgc

SEQ ID NO: 1404618 - RNA, 22 nt, Pseudomonas aeruginosa PA01
gcgcccaacgucuucaggcgcu

SEQ ID NO: 1404619 - RNA, 18 nt, Pseudomonas aeruginosa PA01
gcgcccaaugcaucggcc

SEQ ID NO: 1404620 - RNA, 20 nt, Pseudomonas aeruginosa PA01
gcgcccaaugcaucggccgg

SEQ ID NO: 1404621 - RNA, 13 nt, Pseudomonas aeruginosa PA01
gcgcccagcagca

SEQ ID NO: 1404622 - RNA, 15 nt, Pseudomonas aeruginosa PA01
gcgcccagaguucgc

SEQ ID NO: 1404623 - RNA, 17 nt, Pseudomonas aeruginosa PA01
gcgcccagccagagcgu

SEQ ID NO: 1404624 - RNA, 16 nt, Pseudomonas aeruginosa PA01
gcgcccagcagcaggc

SEQ ID NO: 1404625 - RNA, 17 nt, Pseudomonas aeruginosa PA01
gcgcccagcagcaggcc

SEQ ID NO: 1404626 - RNA, 19 nt, Pseudomonas aeruginosa PA01
gcgcccagcagcaggccgg

SEQ ID NO: 1404627 - RNA, 20 nt, Pseudomonas aeruginosa PA01
gcgcccagcagcaggccggc

SEQ ID NO: 1404628 - RNA, 21 nt, Pseudomonas aeruginosa PA01
gcgcccagcagcaggccggcg

SEQ ID NO: 1404629 - RNA, 16 nt, Pseudomonas aeruginosa PA01
gcgccauugugcgcgc

SEQ ID NO: 1404630 - RNA, 20 nt, Pseudomonas aeruginosa PA01
gcgccauuucaaggcgacgc

SEQ ID NO: 1404631 - RNA, 23 nt, Pseudomonas aeruginosa PA01
gcgccauuucaaggcgacgcucu

SEQ ID NO: 1404632 - RNA, 17 nt, Pseudomonas aeruginosa PA01
gcgccauugccgccagg

SEQ ID NO: 1404633 - RNA, 21 nt, Pseudomonas aeruginosa PA01
gcgccauaccggcaaggcggc

SEQ ID NO: 1404634 - RNA, 23 nt, Pseudomonas aeruginosa PA01
gcgccauaccggcaaggcggccu

SEQ ID NO: 1404635 - RNA, 14 nt, Pseudomonas aeruginosa PA01
gcgccagugccugc

SEQ ID NO: 1404636 - RNA, 15 nt, Pseudomonas aeruginosa PA01
gcgccagugccugca

SEQ ID NO: 1404637 - RNA, 12 nt, Pseudomonas aeruginosa PA01
gcgccaguucgc

SEQ ID NO: 1404638 - RNA, 16 nt, Pseudomonas aeruginosa PA01
gcgccaguuggacgcg

SEQ ID NO: 1404639 - RNA, 20 nt, Pseudomonas aeruginosa PA01
gcgcccgaugaucgagcgca

SEQ ID NO: 1404640 - RNA, 18 nt, Pseudomonas aeruginosa PA01
gcgcccgauaggcgccgg

SEQ ID NO: 1404641 - RNA, 15 nt, Pseudomonas aeruginosa PA01
gcgccccaggcgccc

SEQ ID NO: 1404642 - RNA, 21 nt, Pseudomonas aeruginosa PA01
gcgccccagaucgccagcgcc

SEQ ID NO: 1404643 - RNA, 14 nt, Pseudomonas aeruginosa PA01
gcgcccccagcgcc

SEQ ID NO: 1404644 - RNA, 18 nt, Pseudomonas aeruginosa PA01
gcgcccccagcgcccgca

SEQ ID NO: 1404645 - RNA, 18 nt, Pseudomonas aeruginosa PA01
gcgcccagugcccggcag

SEQ ID NO: 1404646 - RNA, 13 nt, Pseudomonas aeruginosa PA01
gcgccccagcgcc

SEQ ID NO: 1404647 - RNA, 14 nt, Pseudomonas aeruginosa PA01
gcgccccagcggca

SEQ ID NO: 1404648 - RNA, 17 nt, Pseudomonas aeruginosa PA01
gcgccccagcucagcag

SEQ ID NO: 1404649 - RNA, 19 nt, Pseudomonas aeruginosa PA01
gcgccccagcucagcaggu

SEQ ID NO: 1404650 - RNA, 19 nt, Pseudomonas aeruginosa PA01
gcgccccacggcgcggccg

SEQ ID NO: 1404651 - RNA, 14 nt, Pseudomonas aeruginosa PA01
gcgccccaccaggc

SEQ ID NO: 1404652 - RNA, 16 nt, Pseudomonas aeruginosa PA01
gcgccccaccaggcuc

SEQ ID NO: 1404653 - RNA, 16 nt, Pseudomonas aeruginosa PA01
gcgcccaugccgcccg

SEQ ID NO: 1404654 - RNA, 18 nt, Pseudomonas aeruginosa PA01
gcgcccaugccgcccggc

SEQ ID NO: 1404655 - RNA, 16 nt, Pseudomonas aeruginosa PA01
gcgcccaggcugccgg

SEQ ID NO: 1404656 - RNA, 22 nt, Pseudomonas aeruginosa PA01
gcgcccaggcugccggccaggu

SEQ ID NO: 1404657 - RNA, 21 nt, Pseudomonas aeruginosa PA01
gcgcccagggacgcgccggcg

SEQ ID NO: 1404658 - RNA, 12 nt, Pseudomonas aeruginosa PA01
gcgcccagggcu

SEQ ID NO: 1404659 - RNA, 19 nt, Pseudomonas aeruginosa PA01
gcgcccagggcuucgcggu

SEQ ID NO: 1404660 - RNA, 12 nt, Pseudomonas aeruginosa PA01
gcgcccaggcug

SEQ ID NO: 1404661 - RNA, 20 nt, Pseudomonas aeruginosa PA01
gcgcccaggcccagcgcggc

SEQ ID NO: 1404662 - RNA, 13 nt, Pseudomonas aeruginosa PA01
gcgcccaggccca

SEQ ID NO: 1404663 - RNA, 14 nt, Pseudomonas aeruginosa PA01
gcgcccaggcagca

SEQ ID NO: 1404664 - RNA, 17 nt, Pseudomonas aeruginosa PA01
gcgcccaggcagcagag

SEQ ID NO: 1404665 - RNA, 12 nt, Pseudomonas aeruginosa PA01
gcgccaggccgu

SEQ ID NO: 1404666 - RNA, 13 nt, Pseudomonas aeruginosa PA01
gcgccagcggcag

SEQ ID NO: 1404667 - RNA, 20 nt, Pseudomonas aeruginosa PA01
gcgccagguuggccuggccc

SEQ ID NO: 1404668 - RNA, 23 nt, Pseudomonas aeruginosa PA01
gcgccagguuggccuggcccggc

SEQ ID NO: 1404669 - RNA, 13 nt, Pseudomonas aeruginosa PA01
gcgccaggccgcc

SEQ ID NO: 1404670 - RNA, 17 nt, Pseudomonas aeruginosa PA01
gcgccaggccgccgaag

SEQ ID NO: 1404671 - RNA, 22 nt, Pseudomonas aeruginosa PA01
gcgccaggccgccgaagaacuc

SEQ ID NO: 1404672 - RNA, 14 nt, Pseudomonas aeruginosa PA01
gcgccaggccgcgu

SEQ ID NO: 1404673 - RNA, 12 nt, Pseudomonas aeruginosa PA01
gcgccaggccgg

SEQ ID NO: 1404674 - RNA, 17 nt, Pseudomonas aeruginosa PA01
gcgccaggcccacgccc

SEQ ID NO: 1404675 - RNA, 21 nt, Pseudomonas aeruginosa PA01
gcgccaggcccacgcccaucg

SEQ ID NO: 1404676 - RNA, 23 nt, Pseudomonas aeruginosa PA01
gcgccagucccgcaaagcccgcu

SEQ ID NO: 1404677 - RNA, 17 nt, Pseudomonas aeruginosa PA01
gcgccaggcccggcgcu

SEQ ID NO: 1404678 - RNA, 18 nt, Pseudomonas aeruginosa PA01
gcgccaggcccggcgcug

SEQ ID NO: 1404679 - RNA, 20 nt, Pseudomonas aeruginosa PA01
gcgccaggcccucggcgacc

SEQ ID NO: 1404680 - RNA, 12 nt, Pseudomonas aeruginosa PA01
gcgccaggccga

SEQ ID NO: 1404681 - RNA, 21 nt, Pseudomonas aeruginosa PA01
gcgccaggccgaucagcgccu

SEQ ID NO: 1404682 - RNA, 22 nt, Pseudomonas aeruginosa PA01
gcgccaggccgaucagcgccuc

SEQ ID NO: 1404683 - RNA, 23 nt, Pseudomonas aeruginosa PA01
gcgccaggccgaucagcgccucg

SEQ ID NO: 1404684 - RNA, 14 nt, Pseudomonas aeruginosa PA01
gcgccaggagcagg

SEQ ID NO: 1404685 - RNA, 17 nt, Pseudomonas aeruginosa PA01
gcgccaggacucgccau

SEQ ID NO: 1404686 - RNA, 22 nt, Pseudomonas aeruginosa PA01
gcgccaggacucgccaucggcc

SEQ ID NO: 1404687 - RNA, 16 nt, Pseudomonas aeruginosa PA01
gcgccaggaagccgcg

SEQ ID NO: 1404688 - RNA, 18 nt, Pseudomonas aeruginosa PA01
gcgccaggaagccgcgcc

SEQ ID NO: 1404689 - RNA, 21 nt, Pseudomonas aeruginosa PA01
gcgccaggaagccgcgcccca

SEQ ID NO: 1404690 - RNA, 13 nt, Pseudomonas aeruginosa PA01
gcgccagcgccgc

SEQ ID NO: 1404691 - RNA, 12 nt, Pseudomonas aeruginosa PA01
gcgccagcgccc

SEQ ID NO: 1404692 - RNA, 14 nt, Pseudomonas aeruginosa PA01
gcgccagcgcccca

SEQ ID NO: 1404693 - RNA, 18 nt, Pseudomonas aeruginosa PA01
gcgccagcgccccaccag

SEQ ID NO: 1404694 - RNA, 21 nt, Pseudomonas aeruginosa PA01
gcgccagcgccccaccaggcu

SEQ ID NO: 1404695 - RNA, 15 nt, Pseudomonas aeruginosa PA01
gcgccagcgccgcca

SEQ ID NO: 1404696 - RNA, 12 nt, Pseudomonas aeruginosa PA01
gcgccagcgcca

SEQ ID NO: 1404697 - RNA, 19 nt, Pseudomonas aeruginosa PA01
gcgccagcgccacggcgau

SEQ ID NO: 1404698 - RNA, 16 nt, Pseudomonas aeruginosa PA01
gcgccagaccagcccc

SEQ ID NO: 1404699 - RNA, 14 nt, Pseudomonas aeruginosa PA01
gcgccagcaccagc

SEQ ID NO: 1404700 - RNA, 15 nt, Pseudomonas aeruginosa PA01
gcgccagcaccagca

SEQ ID NO: 1404701 - RNA, 16 nt, Pseudomonas aeruginosa PA01
gcgccagcaccagcag

SEQ ID NO: 1404702 - RNA, 18 nt, Pseudomonas aeruginosa PA01
gcgcaucuggcugcgcgc

SEQ ID NO: 1404703 - RNA, 22 nt, Pseudomonas aeruginosa PA01
gcgcaucggugccggcaggccu

SEQ ID NO: 1404704 - RNA, 23 nt, Pseudomonas aeruginosa PA01
gcgcaucgucgaaacgcuggcgg

SEQ ID NO: 1404705 - RNA, 13 nt, Pseudomonas aeruginosa PA01
gcgcaucggcgga

SEQ ID NO: 1404706 - RNA, 19 nt, Pseudomonas aeruginosa PA01
gcgcaugaaaaagcccggc

SEQ ID NO: 1404707 - RNA, 20 nt, Pseudomonas aeruginosa PA01
gcgcaugaaaaagcccggca

SEQ ID NO: 1404708 - RNA, 20 nt, Pseudomonas aeruginosa PA01
gcgccacgcgagaagccgcc

SEQ ID NO: 1404709 - RNA, 19 nt, Pseudomonas aeruginosa PA01
gcgccacgcgcaucgugca

SEQ ID NO: 1404710 - RNA, 21 nt, Pseudomonas aeruginosa PA01
gcgccacggaugcagucccgc

SEQ ID NO: 1404711 - RNA, 13 nt, Pseudomonas aeruginosa PA01
gcgccacggccag

SEQ ID NO: 1404712 - RNA, 16 nt, Pseudomonas aeruginosa PA01
gcgccacggccagcag

SEQ ID NO: 1404713 - RNA, 18 nt, Pseudomonas aeruginosa PA01
gcgccacggccagcagga

SEQ ID NO: 1404714 - RNA, 21 nt, Pseudomonas aeruginosa PA01
gcgccacggcgaucgccgggu

SEQ ID NO: 1404715 - RNA, 17 nt, Pseudomonas aeruginosa PA01
gcgccagagaucgccca

SEQ ID NO: 1404716 - RNA, 18 nt, Pseudomonas aeruginosa PA01
gcgccagagaucgcccag

SEQ ID NO: 1404717 - RNA, 24 nt, Pseudomonas aeruginosa PA01
gcgccagagaucgcccagcggcug

SEQ ID NO: 1404718 - RNA, 17 nt, Pseudomonas aeruginosa PA01
gcgccagagcaggcgga

SEQ ID NO: 1404719 - RNA, 19 nt, Pseudomonas aeruginosa PA01
gcgccagaagcggccgacc

SEQ ID NO: 1404720 - RNA, 23 nt, Pseudomonas aeruginosa PA01
gcgccagaagcggccgaccaggc

SEQ ID NO: 1404721 - RNA, 13 nt, Pseudomonas aeruginosa PA01
gcgcaccgcgccg

SEQ ID NO: 1404722 - RNA, 12 nt, Pseudomonas aeruginosa PA01
gcgcaccgcggc

SEQ ID NO: 1404723 - RNA, 14 nt, Pseudomonas aeruginosa PA01
gcgcaccgcggcga

SEQ ID NO: 1404724 - RNA, 14 nt, Pseudomonas aeruginosa PA01
gcgcaccgcggcca

SEQ ID NO: 1404725 - RNA, 17 nt, Pseudomonas aeruginosa PA01
gcgcaccuccucgggcg

SEQ ID NO: 1404726 - RNA, 22 nt, Pseudomonas aeruginosa PA01
gcgcaccucgaccgcgccggcg

SEQ ID NO: 1404727 - RNA, 15 nt, Pseudomonas aeruginosa PA01
gcgcaccucggccag

SEQ ID NO: 1404728 - RNA, 16 nt, Pseudomonas aeruginosa PA01
gcgcaccucggccagg

SEQ ID NO: 1404729 - RNA, 18 nt, Pseudomonas aeruginosa PA01
gcgcaccucggccaggcg

SEQ ID NO: 1404730 - RNA, 17 nt, Pseudomonas aeruginosa PA01
gcgcaccuggcggucgc

SEQ ID NO: 1404731 - RNA, 22 nt, Pseudomonas aeruginosa PA01
gcgcaccuggcggucgccgccg

SEQ ID NO: 1404732 - RNA, 23 nt, Pseudomonas aeruginosa PA01
gcgcaccuggcggucgccgccgg

SEQ ID NO: 1404733 - RNA, 21 nt, Pseudomonas aeruginosa PA01
gcgcaccugggcguuggccag

SEQ ID NO: 1404734 - RNA, 14 nt, Pseudomonas aeruginosa PA01
gcgcacgcuucucc

SEQ ID NO: 1404735 - RNA, 22 nt, Pseudomonas aeruginosa PA01
gcgcacgcucuguuucgggucg

SEQ ID NO: 1404736 - RNA, 23 nt, Pseudomonas aeruginosa PA01
gcgcacgcucuguuucgggucgc

SEQ ID NO: 1404737 - RNA, 13 nt, Pseudomonas aeruginosa PA01
gcgcacgccgcgg

SEQ ID NO: 1404738 - RNA, 15 nt, Pseudomonas aeruginosa PA01
gcgcacgccggccuc

SEQ ID NO: 1404739 - RNA, 23 nt, Pseudomonas aeruginosa PA01
gcgcacgccguggaccaggauca

SEQ ID NO: 1404740 - RNA, 17 nt, Pseudomonas aeruginosa PA01
gcgcaccaggucgcgcu

SEQ ID NO: 1404741 - RNA, 12 nt, Pseudomonas aeruginosa PA01
gcgaucacccgg

SEQ ID NO: 1404742 - RNA, 14 nt, Pseudomonas aeruginosa PA01
gcgauaucccgccg

SEQ ID NO: 1404743 - RNA, 20 nt, Pseudomonas aeruginosa PA01
gcgauaucccgccgccgcgc

SEQ ID NO: 1404744 - RNA, 23 nt, Pseudomonas aeruginosa PA01
gcgauaucccgccgccgcgccuu

SEQ ID NO: 1404745 - RNA, 12 nt, Pseudomonas aeruginosa PA01
gcgauauccgcc

SEQ ID NO: 1404746 - RNA, 14 nt, Pseudomonas aeruginosa PA01
gcgauauccgccag

SEQ ID NO: 1404747 - RNA, 16 nt, Pseudomonas aeruginosa PA01
gcgauauccgccaggc

SEQ ID NO: 1404748 - RNA, 18 nt, Pseudomonas aeruginosa PA01
gcgauauggccguagccg

SEQ ID NO: 1404749 - RNA, 16 nt, Pseudomonas aeruginosa PA01
gcgauaucgcaggcca

SEQ ID NO: 1404750 - RNA, 14 nt, Pseudomonas aeruginosa PA01
gcgcaccgacgccg

SEQ ID NO: 1404751 - RNA, 14 nt, Pseudomonas aeruginosa PA01
gcgcaccgcccugc

SEQ ID NO: 1404752 - RNA, 20 nt, Pseudomonas aeruginosa PA01
gcgcaccgccucgaccccgg

SEQ ID NO: 1404753 - RNA, 16 nt, Pseudomonas aeruginosa PA01
gcgcaccgccaaggau

SEQ ID NO: 1404754 - RNA, 13 nt, Pseudomonas aeruginosa PA01
gcgcaccgccugc

SEQ ID NO: 1404755 - RNA, 16 nt, Pseudomonas aeruginosa PA01
gcgcacccgcucggcc

SEQ ID NO: 1404756 - RNA, 22 nt, Pseudomonas aeruginosa PA01
gcgcaccauagcgagccgcgcu

SEQ ID NO: 1404757 - RNA, 15 nt, Pseudomonas aeruginosa PA01
gcgcagagcggugaa

SEQ ID NO: 1404758 - RNA, 13 nt, Pseudomonas aeruginosa PA01
gcgcagaggcgcu

SEQ ID NO: 1404759 - RNA, 16 nt, Pseudomonas aeruginosa PA01
gcgcagaggcgcucca

SEQ ID NO: 1404760 - RNA, 22 nt, Pseudomonas aeruginosa PA01
gcgcagaggcgcuccaccaggg

SEQ ID NO: 1404761 - RNA, 13 nt, Pseudomonas aeruginosa PA01
gcgcagaucgccg

SEQ ID NO: 1404762 - RNA, 14 nt, Pseudomonas aeruginosa PA01
gcgcagaucgccgc

SEQ ID NO: 1404763 - RNA, 16 nt, Pseudomonas aeruginosa PA01
gcgcagaucgcggcgc

SEQ ID NO: 1404764 - RNA, 16 nt, Pseudomonas aeruginosa PA01
gcgcagaucgcgucca

SEQ ID NO: 1404765 - RNA, 19 nt, Pseudomonas aeruginosa PA01
gcgcagaucgcguccaggg

SEQ ID NO: 1404766 - RNA, 19 nt, Pseudomonas aeruginosa PA01
gcgcagaugaucgccaccg

SEQ ID NO: 1404767 - RNA, 17 nt, Pseudomonas aeruginosa PA01
gcgcagaugcggggcga

SEQ ID NO: 1404768 - RNA, 19 nt, Pseudomonas aeruginosa PA01
gcgcagaugcggggcgacc

SEQ ID NO: 1404769 - RNA, 18 nt, Pseudomonas aeruginosa PA01
gcgcacugagggucagcc

SEQ ID NO: 1404770 - RNA, 21 nt, Pseudomonas aeruginosa PA01
gcgcacugagggucagccgca

SEQ ID NO: 1404771 - RNA, 15 nt, Pseudomonas aeruginosa PA01
gcgcagaacugccgg

SEQ ID NO: 1404772 - RNA, 17 nt, Pseudomonas aeruginosa PA01
gcgcagaacugccgggc

SEQ ID NO: 1404773 - RNA, 19 nt, Pseudomonas aeruginosa PA01
gcgcagaacugccgggcca

SEQ ID NO: 1404774 - RNA, 23 nt, Pseudomonas aeruginosa PA01
gcgcagaacugccgggccagcuc

SEQ ID NO: 1404775 - RNA, 20 nt, Pseudomonas aeruginosa PA01
gcgcagacaggccuccagca

SEQ ID NO: 1404776 - RNA, 17 nt, Pseudomonas aeruginosa PA01
gcgcagacgggugcuga

SEQ ID NO: 1404777 - RNA, 20 nt, Pseudomonas aeruginosa PA01
gcgcacuuccucggcgacca

SEQ ID NO: 1404778 - RNA, 21 nt, Pseudomonas aeruginosa PA01
gcgcacuuccucggcgaccac

SEQ ID NO: 1404779 - RNA, 17 nt, Pseudomonas aeruginosa PA01
gcgcacugccaggagca

SEQ ID NO: 1404780 - RNA, 18 nt, Pseudomonas aeruginosa PA01
gcgcacugccaggagcac

SEQ ID NO: 1404781 - RNA, 23 nt, Pseudomonas aeruginosa PA01
gcgcacugcguggguagccaugg

SEQ ID NO: 1404782 - RNA, 13 nt, Pseudomonas aeruginosa PA01
gcgcacggccugc

SEQ ID NO: 1404783 - RNA, 16 nt, Pseudomonas aeruginosa PA01
gcgcacggccugcacc

SEQ ID NO: 1404784 - RNA, 14 nt, Pseudomonas aeruginosa PA01
gcgcacggaucgcg

SEQ ID NO: 1404785 - RNA, 21 nt, Pseudomonas aeruginosa PA01
gcgcacggaucgcgcugggcg

SEQ ID NO: 1404786 - RNA, 13 nt, Pseudomonas aeruginosa PA01
gcgcacgucgagg

SEQ ID NO: 1404787 - RNA, 14 nt, Pseudomonas aeruginosa PA01
gcgcacgucgaggu

SEQ ID NO: 1404788 - RNA, 19 nt, Pseudomonas aeruginosa PA01
gcgcagcaacuggucgccg

SEQ ID NO: 1404789 - RNA, 12 nt, Pseudomonas aeruginosa PA01
gcgcagcaccgg

SEQ ID NO: 1404790 - RNA, 13 nt, Pseudomonas aeruginosa PA01
gcgcagcaccggc

SEQ ID NO: 1404791 - RNA, 18 nt, Pseudomonas aeruginosa PA01
gcgcagcacgaugcacag

SEQ ID NO: 1404792 - RNA, 20 nt, Pseudomonas aeruginosa PA01
gcgcagcacgaugcacaggc

SEQ ID NO: 1404793 - RNA, 19 nt, Pseudomonas aeruginosa PA01
gcgcagcaccgagacgccc

SEQ ID NO: 1404794 - RNA, 16 nt, Pseudomonas aeruginosa PA01
gcgcagcaccacaugg

SEQ ID NO: 1404795 - RNA, 13 nt, Pseudomonas aeruginosa PA01
gcgcagcaccacg

SEQ ID NO: 1404796 - RNA, 17 nt, Pseudomonas aeruginosa PA01
gcgcagcaccacgaugc

SEQ ID NO: 1404797 - RNA, 19 nt, Pseudomonas aeruginosa PA01
gcgcagcaguaccuggcgg

SEQ ID NO: 1404798 - RNA, 21 nt, Pseudomonas aeruginosa PA01
gcgcagcagguagugcggcgg

SEQ ID NO: 1404799 - RNA, 19 nt, Pseudomonas aeruginosa PA01
gcgcagcaggauccaggug

SEQ ID NO: 1404800 - RNA, 13 nt, Pseudomonas aeruginosa PA01
gcgcagcagcguc

SEQ ID NO: 1404801 - RNA, 17 nt, Pseudomonas aeruginosa PA01
gcgcagcaggcggccca

SEQ ID NO: 1404802 - RNA, 11 nt, Pseudomonas aeruginosa PA01
gcgcagcagcg

SEQ ID NO: 1404803 - RNA, 13 nt, Pseudomonas aeruginosa PA01
gcgcagcagcgcc

SEQ ID NO: 1404804 - RNA, 15 nt, Pseudomonas aeruginosa PA01
gcgcagcagcgacuc

SEQ ID NO: 1404805 - RNA, 14 nt, Pseudomonas aeruginosa PA01
gcgcagcagcaggu

SEQ ID NO: 1404806 - RNA, 13 nt, Pseudomonas aeruginosa PA01
gcgcagcagcagg

SEQ ID NO: 1404807 - RNA, 14 nt, Pseudomonas aeruginosa PA01
gcgcagcgccgccg

SEQ ID NO: 1404808 - RNA, 14 nt, Pseudomonas aeruginosa PA01
gcgcagcgcggcgc

SEQ ID NO: 1404809 - RNA, 21 nt, Pseudomonas aeruginosa PA01
gcgcagcggaggauucagcag

SEQ ID NO: 1404810 - RNA, 23 nt, Pseudomonas aeruginosa PA01
gcgcagcggaggauucagcagga

SEQ ID NO: 1404811 - RNA, 13 nt, Pseudomonas aeruginosa PA01
gcgcagcggcagc

SEQ ID NO: 1404812 - RNA, 16 nt, Pseudomonas aeruginosa PA01
gcgcagcggcagcgcc

SEQ ID NO: 1404813 - RNA, 17 nt, Pseudomonas aeruginosa PA01
gcgcagcggcagcgcca

SEQ ID NO: 1404814 - RNA, 15 nt, Pseudomonas aeruginosa PA01
gcgcagcggcaggcc

SEQ ID NO: 1404815 - RNA, 21 nt, Pseudomonas aeruginosa PA01
gcgcagcgacucgaugaacgc

SEQ ID NO: 1404816 - RNA, 23 nt, Pseudomonas aeruginosa PA01
gcgcagcgacucgaugaacgccc

SEQ ID NO: 1404817 - RNA, 15 nt, Pseudomonas aeruginosa PA01
gcgcagcgccaccag

SEQ ID NO: 1404818 - RNA, 12 nt, Pseudomonas aeruginosa PA01
gcgcagcgccgc

SEQ ID NO: 1404819 - RNA, 12 nt, Pseudomonas aeruginosa PA01
gcgcagcccagc

SEQ ID NO: 1404820 - RNA, 13 nt, Pseudomonas aeruginosa PA01
gcgcagccaggcg

SEQ ID NO: 1404821 - RNA, 15 nt, Pseudomonas aeruginosa PA01
gcgcagccaggcgau

SEQ ID NO: 1404822 - RNA, 19 nt, Pseudomonas aeruginosa PA01
gcgcagccagagcuccagg

SEQ ID NO: 1404823 - RNA, 23 nt, Pseudomonas aeruginosa PA01
gcgcagccacuggcggaccgccu

SEQ ID NO: 1404824 - RNA, 17 nt, Pseudomonas aeruginosa PA01
gcgcagccacccgcucg

SEQ ID NO: 1404825 - RNA, 17 nt, Pseudomonas aeruginosa PA01
gcgcagcccuugcaacc

SEQ ID NO: 1404826 - RNA, 16 nt, Pseudomonas aeruginosa PA01
gcgcagccgcaaggcc

SEQ ID NO: 1404827 - RNA, 17 nt, Pseudomonas aeruginosa PA01
gcgcagccgcaaggcca

SEQ ID NO: 1404828 - RNA, 14 nt, Pseudomonas aeruginosa PA01
gcgcagcccagccg

SEQ ID NO: 1404829 - RNA, 15 nt, Pseudomonas aeruginosa PA01
gcgcagcccagccgc

SEQ ID NO: 1404830 - RNA, 19 nt, Pseudomonas aeruginosa PA01
gcgcagcccagccgcucgc

SEQ ID NO: 1404831 - RNA, 21 nt, Pseudomonas aeruginosa PA01
gcgcagccucgcgcucggcgg

SEQ ID NO: 1404832 - RNA, 19 nt, Pseudomonas aeruginosa PA01
gcgcagccugcuggccugg

SEQ ID NO: 1404833 - RNA, 23 nt, Pseudomonas aeruginosa PA01
gcgcagccugcuggccugggacg

SEQ ID NO: 1404834 - RNA, 14 nt, Pseudomonas aeruginosa PA01
gcgcagccgcugcu

SEQ ID NO: 1404835 - RNA, 19 nt, Pseudomonas aeruginosa PA01
gcgcagccgcugggccacg

SEQ ID NO: 1404836 - RNA, 13 nt, Pseudomonas aeruginosa PA01
gcgcagccgcucg

SEQ ID NO: 1404837 - RNA, 18 nt, Pseudomonas aeruginosa PA01
gcgcagccgcucggccgc

SEQ ID NO: 1404838 - RNA, 20 nt, Pseudomonas aeruginosa PA01
gcgcagccgcucggccgcca

SEQ ID NO: 1404839 - RNA, 22 nt, Pseudomonas aeruginosa PA01
gcgcagccgcucggccgccagc

SEQ ID NO: 1404840 - RNA, 12 nt, Pseudomonas aeruginosa PA01
gcgcagccgcug

SEQ ID NO: 1404841 - RNA, 13 nt, Pseudomonas aeruginosa PA01
gcgcagccgcugc

SEQ ID NO: 1404842 - RNA, 14 nt, Pseudomonas aeruginosa PA01
gcgcaggauguuga

SEQ ID NO: 1404843 - RNA, 21 nt, Pseudomonas aeruginosa PA01
gcgcaggauguugaacaggcu

SEQ ID NO: 1404844 - RNA, 17 nt, Pseudomonas aeruginosa PA01
gcgcaggccgccggcgg

SEQ ID NO: 1404845 - RNA, 19 nt, Pseudomonas aeruginosa PA01
gcgcaggccgccggcggcc

SEQ ID NO: 1404846 - RNA, 21 nt, Pseudomonas aeruginosa PA01
gcgcaggccgccggcggccag

SEQ ID NO: 1404847 - RNA, 23 nt, Pseudomonas aeruginosa PA01
gcgcaggccgccggcggccaggg

SEQ ID NO: 1404848 - RNA, 14 nt, Pseudomonas aeruginosa PA01
gcgcaggccgaggu

SEQ ID NO: 1404849 - RNA, 23 nt, Pseudomonas aeruginosa PA01
gcgcaggccgagguuuccaguug

SEQ ID NO: 1404850 - RNA, 13 nt, Pseudomonas aeruginosa PA01
gcgcaggccggga

SEQ ID NO: 1404851 - RNA, 14 nt, Pseudomonas aeruginosa PA01
gcgcaggccgggcg

SEQ ID NO: 1404852 - RNA, 22 nt, Pseudomonas aeruginosa PA01
gcgcaggccuucgacuucgacg

SEQ ID NO: 1404853 - RNA, 21 nt, Pseudomonas aeruginosa PA01
gcgcaggcgaggauggccguc

SEQ ID NO: 1404854 - RNA, 15 nt, Pseudomonas aeruginosa PA01
gcgcaggcggcgcug

SEQ ID NO: 1404855 - RNA, 14 nt, Pseudomonas aeruginosa PA01
gcgcaggcggcugg

SEQ ID NO: 1404856 - RNA, 16 nt, Pseudomonas aeruginosa PA01
gcgcaggcggcuggcg

SEQ ID NO: 1404857 - RNA, 18 nt, Pseudomonas aeruginosa PA01
gcgcaggcggcuggcgcg

SEQ ID NO: 1404858 - RNA, 20 nt, Pseudomonas aeruginosa PA01
gcgcaggcgggcggcgucga

SEQ ID NO: 1404859 - RNA, 20 nt, Pseudomonas aeruginosa PA01
gcgcaggcgguaggugagcg

SEQ ID NO: 1404860 - RNA, 13 nt, Pseudomonas aeruginosa PA01
gcgcaggcggucg

SEQ ID NO: 1404861 - RNA, 17 nt, Pseudomonas aeruginosa PA01
gcgcaggcggucgccga

SEQ ID NO: 1404862 - RNA, 20 nt, Pseudomonas aeruginosa PA01
gcgcaggcggucgccgaaca

SEQ ID NO: 1404863 - RNA, 22 nt, Pseudomonas aeruginosa PA01
gcgcaggcggucgccgaacagc

SEQ ID NO: 1404864 - RNA, 18 nt, Pseudomonas aeruginosa PA01
gcgcaggcgcuggcgggc

SEQ ID NO: 1404865 - RNA, 23 nt, Pseudomonas aeruginosa PA01
gcgcaggcguuccucgacgaaau

SEQ ID NO: 1404866 - RNA, 23 nt, Pseudomonas aeruginosa PA01
gcgcaggcugcgggcgacaaggc

SEQ ID NO: 1404867 - RNA, 13 nt, Pseudomonas aeruginosa PA01
gcgcaggcgcucg

SEQ ID NO: 1404868 - RNA, 14 nt, Pseudomonas aeruginosa PA01
gcgcaggcgcucgc

SEQ ID NO: 1404869 - RNA, 22 nt, Pseudomonas aeruginosa PA01
gcgcaggcgcucgcgggccgcc

SEQ ID NO: 1404870 - RNA, 23 nt, Pseudomonas aeruginosa PA01
gcgcagcuaggcgaggaucgcuc

SEQ ID NO: 1404871 - RNA, 15 nt, Pseudomonas aeruginosa PA01
gcgcagcuccggcag

SEQ ID NO: 1404872 - RNA, 18 nt, Pseudomonas aeruginosa PA01
gcgcagcuccggcagcag

SEQ ID NO: 1404873 - RNA, 19 nt, Pseudomonas aeruginosa PA01
gcgcagcuccggcagcagg

SEQ ID NO: 1404874 - RNA, 15 nt, Pseudomonas aeruginosa PA01
gcgcagcuccucggc

SEQ ID NO: 1404875 - RNA, 14 nt, Pseudomonas aeruginosa PA01
gcgcaggaccgcca

SEQ ID NO: 1404876 - RNA, 21 nt, Pseudomonas aeruginosa PA01
gcgcagcuugccuuccaggcu

SEQ ID NO: 1404877 - RNA, 20 nt, Pseudomonas aeruginosa PA01
gcgcagcuguucacaaaggc

SEQ ID NO: 1404878 - RNA, 16 nt, Pseudomonas aeruginosa PA01
gcgcagcguccugccc

SEQ ID NO: 1404879 - RNA, 12 nt, Pseudomonas aeruginosa PA01
gcgcagcggcuc

SEQ ID NO: 1404880 - RNA, 11 nt, Pseudomonas aeruginosa PA01
gcgcagcggcg

SEQ ID NO: 1404881 - RNA, 14 nt, Pseudomonas aeruginosa PA01
gcgcagcggcgccg

SEQ ID NO: 1404882 - RNA, 15 nt, Pseudomonas aeruginosa PA01
gcgcagcggcgccga

SEQ ID NO: 1404883 - RNA, 14 nt, Pseudomonas aeruginosa PA01
gcgcagcggcgcgu

SEQ ID NO: 1404884 - RNA, 23 nt, Pseudomonas aeruginosa PA01
gcgcaggggcgagagacugaacu

SEQ ID NO: 1404885 - RNA, 15 nt, Pseudomonas aeruginosa PA01
gcgcaggggcgcgcc

SEQ ID NO: 1404886 - RNA, 20 nt, Pseudomonas aeruginosa PA01
gcgcaggggcgcgccggcuu

SEQ ID NO: 1404887 - RNA, 15 nt, Pseudomonas aeruginosa PA01
gcgcaggggcgcggc

SEQ ID NO: 1404888 - RNA, 19 nt, Pseudomonas aeruginosa PA01
gcgcaggggcgcggcgcgg

SEQ ID NO: 1404889 - RNA, 16 nt, Pseudomonas aeruginosa PA01
gcgcagggcgccgucg

SEQ ID NO: 1404890 - RNA, 22 nt, Pseudomonas aeruginosa PA01
gcgcagggcgucgaaggcggcg

SEQ ID NO: 1404891 - RNA, 14 nt, Pseudomonas aeruginosa PA01
gcgcagggcggcga

SEQ ID NO: 1404892 - RNA, 15 nt, Pseudomonas aeruginosa PA01
gcgcagggcggcgag

SEQ ID NO: 1404893 - RNA, 16 nt, Pseudomonas aeruginosa PA01
gcgcagggcggcgagc

SEQ ID NO: 1404894 - RNA, 18 nt, Pseudomonas aeruginosa PA01
gcgcaggcuuggucaggg

SEQ ID NO: 1404895 - RNA, 21 nt, Pseudomonas aeruginosa PA01
gcgcaggcuuggucagggucg

SEQ ID NO: 1404896 - RNA, 14 nt, Pseudomonas aeruginosa PA01
gcgcaggcugucgg

SEQ ID NO: 1404897 - RNA, 22 nt, Pseudomonas aeruginosa PA01
gcgcaggcugucggccagcccc

SEQ ID NO: 1404898 - RNA, 15 nt, Pseudomonas aeruginosa PA01
gcgcaggcuggccga

SEQ ID NO: 1404899 - RNA, 17 nt, Pseudomonas aeruginosa PA01
gcgcaggcuggccgagc

SEQ ID NO: 1404900 - RNA, 14 nt, Pseudomonas aeruginosa PA01
gcgcaggcugguau

SEQ ID NO: 1404901 - RNA, 20 nt, Pseudomonas aeruginosa PA01
gcgcaggcugguaugcagca

SEQ ID NO: 1404902 - RNA, 17 nt, Pseudomonas aeruginosa PA01
gcgcagggcagcgcgau

SEQ ID NO: 1404903 - RNA, 13 nt, Pseudomonas aeruginosa PA01
gcgcagggccagg

SEQ ID NO: 1404904 - RNA, 14 nt, Pseudomonas aeruginosa PA01
gcgcagggccaggg

SEQ ID NO: 1404905 - RNA, 16 nt, Pseudomonas aeruginosa PA01
gcgcagguagcggcga

SEQ ID NO: 1404906 - RNA, 18 nt, Pseudomonas aeruginosa PA01
gcgcagguagcggcgaag

SEQ ID NO: 1404907 - RNA, 16 nt, Pseudomonas aeruginosa PA01
gcgcagguacucgccg

SEQ ID NO: 1404908 - RNA, 19 nt, Pseudomonas aeruginosa PA01
gcgcagguacucgccggcg

SEQ ID NO: 1404909 - RNA, 20 nt, Pseudomonas aeruginosa PA01
gcgcagguagaaggugccca

SEQ ID NO: 1404910 - RNA, 12 nt, Pseudomonas aeruginosa PA01
gcgcagggucag

SEQ ID NO: 1404911 - RNA, 16 nt, Pseudomonas aeruginosa PA01
gcgcagggucaggccc

SEQ ID NO: 1404912 - RNA, 17 nt, Pseudomonas aeruginosa PA01
gcgcagggucaggcccu

SEQ ID NO: 1404913 - RNA, 18 nt, Pseudomonas aeruginosa PA01
gcgcagggucgcguuggc

SEQ ID NO: 1404914 - RNA, 23 nt, Pseudomonas aeruginosa PA01
gcgcagguagucgcucauggcgc

SEQ ID NO: 1404915 - RNA, 17 nt, Pseudomonas aeruginosa PA01
gcgcaggucgcuggcgu

SEQ ID NO: 1404916 - RNA, 18 nt, Pseudomonas aeruginosa PA01
gcgcaggucgcuggcguc

SEQ ID NO: 1404917 - RNA, 18 nt, Pseudomonas aeruginosa PA01
gcgcaggucgcugucgcg

SEQ ID NO: 1404918 - RNA, 19 nt, Pseudomonas aeruginosa PA01
gcgcaggucgcugucgcgu

SEQ ID NO: 1404919 - RNA, 16 nt, Pseudomonas aeruginosa PA01
gcgcagucccgcgcgg

SEQ ID NO: 1404920 - RNA, 15 nt, Pseudomonas aeruginosa PA01
gcgcagugucgcgaa

SEQ ID NO: 1404921 - RNA, 15 nt, Pseudomonas aeruginosa PA01
gcgcaguucagggcg

SEQ ID NO: 1404922 - RNA, 17 nt, Pseudomonas aeruginosa PA01
gcgcaguucagggcgua

SEQ ID NO: 1404923 - RNA, 21 nt, Pseudomonas aeruginosa PA01
gcgcaguucagggcguagcgg

SEQ ID NO: 1404924 - RNA, 23 nt, Pseudomonas aeruginosa PA01
gcgcaguucguccaucgccaggc

SEQ ID NO: 1404925 - RNA, 17 nt, Pseudomonas aeruginosa PA01
gcgcaguucgucgccca

SEQ ID NO: 1404926 - RNA, 16 nt, Pseudomonas aeruginosa PA01
gcgcaguucgccgccg

SEQ ID NO: 1404927 - RNA, 17 nt, Pseudomonas aeruginosa PA01
gcgcaguucgccgccga

SEQ ID NO: 1404928 - RNA, 17 nt, Pseudomonas aeruginosa PA01
gcgcaggugcaccgcgc

SEQ ID NO: 1404929 - RNA, 21 nt, Pseudomonas aeruginosa PA01
gcgcaggugcaccgcgcugga

SEQ ID NO: 1404930 - RNA, 22 nt, Pseudomonas aeruginosa PA01
gcgcaggugcaccgcgcuggag

SEQ ID NO: 1404931 - RNA, 13 nt, Pseudomonas aeruginosa PA01
gcgcagguucauc

SEQ ID NO: 1404932 - RNA, 16 nt, Pseudomonas aeruginosa PA01
gcgcagguucaucgcc

SEQ ID NO: 1404933 - RNA, 17 nt, Pseudomonas aeruginosa PA01
gcgcagguucaucgccg

SEQ ID NO: 1404934 - RNA, 18 nt, Pseudomonas aeruginosa PA01
gcgcagguucaucgccgc

SEQ ID NO: 1404935 - RNA, 23 nt, Pseudomonas aeruginosa PA01
gcgcagguucaucgccgccaggc

SEQ ID NO: 1404936 - RNA, 22 nt, Pseudomonas aeruginosa PA01
gcgcagguugagggccgcgcug

SEQ ID NO: 1404937 - RNA, 19 nt, Pseudomonas aeruginosa PA01
gcgcagguugcgcuggcgc

SEQ ID NO: 1404938 - RNA, 20 nt, Pseudomonas aeruginosa PA01
gcgcagguugcgcuggcgca

SEQ ID NO: 1404939 - RNA, 21 nt, Pseudomonas aeruginosa PA01
gcgcagguugcgcuggcgcag

SEQ ID NO: 1404940 - RNA, 22 nt, Pseudomonas aeruginosa PA01
gcgcagguugcgcuggcgcagc

SEQ ID NO: 1404941 - RNA, 15 nt, Pseudomonas aeruginosa PA01
gcgcaguacccggcc

SEQ ID NO: 1404942 - RNA, 13 nt, Pseudomonas aeruginosa PA01
gcgcaguagcugg

SEQ ID NO: 1404943 - RNA, 13 nt, Pseudomonas aeruginosa PA01
gcgcaguagucga

SEQ ID NO: 1404944 - RNA, 14 nt, Pseudomonas aeruginosa PA01
gcgcauccucggca

SEQ ID NO: 1404945 - RNA, 17 nt, Pseudomonas aeruginosa PA01
gcgcaucgaggccggca

SEQ ID NO: 1404946 - RNA, 19 nt, Pseudomonas aeruginosa PA01
gcgcauccgcccgaucgcc

SEQ ID NO: 1404947 - RNA, 23 nt, Pseudomonas aeruginosa PA01
gcgcaguucgucuuccagcggcc

SEQ ID NO: 1404948 - RNA, 24 nt, Pseudomonas aeruginosa PA01
gcgcaguucgucuuccagcggcca

SEQ ID NO: 1404949 - RNA, 13 nt, Pseudomonas aeruginosa PA01
gcgcauaaccgcu

SEQ ID NO: 1404950 - RNA, 14 nt, Pseudomonas aeruginosa PA01
gcgcauagccaccg

SEQ ID NO: 1404951 - RNA, 17 nt, Pseudomonas aeruginosa PA01
gcgcauagccaccgccg

SEQ ID NO: 1404952 - RNA, 14 nt, Pseudomonas aeruginosa PA01
gcgcauagcggcca

SEQ ID NO: 1404953 - RNA, 21 nt, Pseudomonas aeruginosa PA01
gcgcauacgaaaacggcccuc

SEQ ID NO: 1404954 - RNA, 14 nt, Pseudomonas aeruginosa PA01
gcgcaucagcgccg

SEQ ID NO: 1404955 - RNA, 16 nt, Pseudomonas aeruginosa PA01
gcgcggcacaggcggc

SEQ ID NO: 1404956 - RNA, 15 nt, Pseudomonas aeruginosa PA01
gcgcgggccgacggc

SEQ ID NO: 1404957 - RNA, 14 nt, Pseudomonas aeruginosa PA01
gcgcgggccgaggu

SEQ ID NO: 1404958 - RNA, 18 nt, Pseudomonas aeruginosa PA01
gcgcgggccgaggucgcg

SEQ ID NO: 1404959 - RNA, 14 nt, Pseudomonas aeruginosa PA01
gcgcggcuugccgg

SEQ ID NO: 1404960 - RNA, 17 nt, Pseudomonas aeruginosa PA01
gcgcggcuugccggcgc

SEQ ID NO: 1404961 - RNA, 22 nt, Pseudomonas aeruginosa PA01
gcgcggcuucagagcuggacga

SEQ ID NO: 1404962 - RNA, 15 nt, Pseudomonas aeruginosa PA01
gcgcggcuggugcga

SEQ ID NO: 1404963 - RNA, 16 nt, Pseudomonas aeruginosa PA01
gcgcggcugcuugccg

SEQ ID NO: 1404964 - RNA, 13 nt, Pseudomonas aeruginosa PA01
gcgcggcaggaaa

SEQ ID NO: 1404965 - RNA, 20 nt, Pseudomonas aeruginosa PA01
gcgcggcaggaaauccgccg

SEQ ID NO: 1404966 - RNA, 15 nt, Pseudomonas aeruginosa PA01
gcgcggcagcaccag

SEQ ID NO: 1404967 - RNA, 17 nt, Pseudomonas aeruginosa PA01
gcgcggcagcaccaggc

SEQ ID NO: 1404968 - RNA, 23 nt, Pseudomonas aeruginosa PA01
gcgcggcagcaccaggccaucga

SEQ ID NO: 1404969 - RNA, 14 nt, Pseudomonas aeruginosa PA01
gcgcggcagcgcca

SEQ ID NO: 1404970 - RNA, 17 nt, Pseudomonas aeruginosa PA01
gcgcggcucgggcggca

SEQ ID NO: 1404971 - RNA, 19 nt, Pseudomonas aeruginosa PA01
gcgcggcucgggcggcaag

SEQ ID NO: 1404972 - RNA, 13 nt, Pseudomonas aeruginosa PA01
gcgcggcugaucg

SEQ ID NO: 1404973 - RNA, 20 nt, Pseudomonas aeruginosa PA01
gcgcggcugaucggccgcca

SEQ ID NO: 1404974 - RNA, 21 nt, Pseudomonas aeruginosa PA01
gcgcggcugaucggccgccag

SEQ ID NO: 1404975 - RNA, 14 nt, Pseudomonas aeruginosa PA01
gcgcggacggccug

SEQ ID NO: 1404976 - RNA, 19 nt, Pseudomonas aeruginosa PA01
gcgcggacggccugcgccc

SEQ ID NO: 1404977 - RNA, 12 nt, Pseudomonas aeruginosa PA01
gcgcggaucccc

SEQ ID NO: 1404978 - RNA, 21 nt, Pseudomonas aeruginosa PA01
gcgcggauccccucccgcgcc

SEQ ID NO: 1404979 - RNA, 22 nt, Pseudomonas aeruginosa PA01
gcgcggauccccucccgcgcca

SEQ ID NO: 1404980 - RNA, 24 nt, Pseudomonas aeruginosa PA01
gcgcggauccccucccgcgccagc

SEQ ID NO: 1404981 - RNA, 17 nt, Pseudomonas aeruginosa PA01
gcgcggaauccuucgcg

SEQ ID NO: 1404982 - RNA, 14 nt, Pseudomonas aeruginosa PA01
gcgcggaccgcaac

SEQ ID NO: 1404983 - RNA, 19 nt, Pseudomonas aeruginosa PA01
gcgcggaccgcaaccgguc

SEQ ID NO: 1404984 - RNA, 15 nt, Pseudomonas aeruginosa PA01
gcgcggacauggcgc

SEQ ID NO: 1404985 - RNA, 19 nt, Pseudomonas aeruginosa PA01
gcgcggacauggcgcucga

SEQ ID NO: 1404986 - RNA, 14 nt, Pseudomonas aeruginosa PA01
gcgcggcaacacca

SEQ ID NO: 1404987 - RNA, 19 nt, Pseudomonas aeruginosa PA01
gcgcggauguucgccacgc

SEQ ID NO: 1404988 - RNA, 21 nt, Pseudomonas aeruginosa PA01
gcgcggauguucgccacgcug

SEQ ID NO: 1404989 - RNA, 22 nt, Pseudomonas aeruginosa PA01
gcgcggauguucgccacgcugc

SEQ ID NO: 1404990 - RNA, 18 nt, Pseudomonas aeruginosa PA01
gcgcggugcgcgccauca

SEQ ID NO: 1404991 - RNA, 13 nt, Pseudomonas aeruginosa PA01
gcgcguacgcccg

SEQ ID NO: 1404992 - RNA, 20 nt, Pseudomonas aeruginosa PA01
gcgcguacucaggccgggcg

SEQ ID NO: 1404993 - RNA, 17 nt, Pseudomonas aeruginosa PA01
gcgcguagcgugccgcc

SEQ ID NO: 1404994 - RNA, 18 nt, Pseudomonas aeruginosa PA01
gcgcguacuugccagggc

SEQ ID NO: 1404995 - RNA, 20 nt, Pseudomonas aeruginosa PA01
gcgcguacuugccagggcag

SEQ ID NO: 1404996 - RNA, 19 nt, Pseudomonas aeruginosa PA01
gcgcguagaggaugccggc

SEQ ID NO: 1404997 - RNA, 20 nt, Pseudomonas aeruginosa PA01
gcgcguagaggaugccggcc

SEQ ID NO: 1404998 - RNA, 21 nt, Pseudomonas aeruginosa PA01
gcgcguagaggaugccggccu

SEQ ID NO: 1404999 - RNA, 20 nt, Pseudomonas aeruginosa PA01
gcgcguacaucccgccgaua

SEQ ID NO: 1405000 - RNA, 19 nt, Pseudomonas aeruginosa PA01
gcgcggugggccuugagca

SEQ ID NO: 1405001 - RNA, 14 nt, Pseudomonas aeruginosa PA01
gcgcggguggcguc

SEQ ID NO: 1405002 - RNA, 16 nt, Pseudomonas aeruginosa PA01
gcgcggguucgugcca

SEQ ID NO: 1405003 - RNA, 14 nt, Pseudomonas aeruginosa PA01
gcgcgggugcggcu

SEQ ID NO: 1405004 - RNA, 16 nt, Pseudomonas aeruginosa PA01
gcgcgggucugcucgc

SEQ ID NO: 1405005 - RNA, 19 nt, Pseudomonas aeruginosa PA01
gcgcgggucuucaggccgc

SEQ ID NO: 1405006 - RNA, 17 nt, Pseudomonas aeruginosa PA01
gcgcgggucuugccggu

SEQ ID NO: 1405007 - RNA, 19 nt, Pseudomonas aeruginosa PA01
gcgcgggucuugccggucu

SEQ ID NO: 1405008 - RNA, 14 nt, Pseudomonas aeruginosa PA01
gcgcgggcaaucgg

SEQ ID NO: 1405009 - RNA, 18 nt, Pseudomonas aeruginosa PA01
gcgcggggucuggccggc

SEQ ID NO: 1405010 - RNA, 14 nt, Pseudomonas aeruginosa PA01
gcgcgggguggccg

SEQ ID NO: 1405011 - RNA, 17 nt, Pseudomonas aeruginosa PA01
gcgcgggucaucggccc

SEQ ID NO: 1405012 - RNA, 18 nt, Pseudomonas aeruginosa PA01
gcgcgucgcugccgccgc

SEQ ID NO: 1405013 - RNA, 22 nt, Pseudomonas aeruginosa PA01
gcgcgucgcugccgccgcgccc

SEQ ID NO: 1405014 - RNA, 17 nt, Pseudomonas aeruginosa PA01
gcgcgucggcacgccga

SEQ ID NO: 1405015 - RNA, 19 nt, Pseudomonas aeruginosa PA01
gcgcgucggcacgccgaag

SEQ ID NO: 1405016 - RNA, 13 nt, Pseudomonas aeruginosa PA01
gcgcgucgcugcg

SEQ ID NO: 1405017 - RNA, 13 nt, Pseudomonas aeruginosa PA01
gcgcgucggcggu

SEQ ID NO: 1405018 - RNA, 21 nt, Pseudomonas aeruginosa PA01
gcgcgucggccgcucggccuu

SEQ ID NO: 1405019 - RNA, 22 nt, Pseudomonas aeruginosa PA01
gcgcgucggccgcucggccuug

SEQ ID NO: 1405020 - RNA, 13 nt, Pseudomonas aeruginosa PA01
gcgcgucggccgc

SEQ ID NO: 1405021 - RNA, 16 nt, Pseudomonas aeruginosa PA01
gcgcgucggugccgcc

SEQ ID NO: 1405022 - RNA, 20 nt, Pseudomonas aeruginosa PA01
gcgcgucgccgaacggcagc

SEQ ID NO: 1405023 - RNA, 16 nt, Pseudomonas aeruginosa PA01
gcgcgucgaccaccgc

SEQ ID NO: 1405024 - RNA, 20 nt, Pseudomonas aeruginosa PA01
gcgcgucgaccaccgcgugg

SEQ ID NO: 1405025 - RNA, 15 nt, Pseudomonas aeruginosa PA01
gcgcgucgaccacga

SEQ ID NO: 1405026 - RNA, 17 nt, Pseudomonas aeruginosa PA01
gcgcgucgaccacgaag

SEQ ID NO: 1405027 - RNA, 22 nt, Pseudomonas aeruginosa PA01
gcgcguaggcgaacacgucggc

SEQ ID NO: 1405028 - RNA, 19 nt, Pseudomonas aeruginosa PA01
gcgcguaggcuuggucggg

SEQ ID NO: 1405029 - RNA, 21 nt, Pseudomonas aeruginosa PA01
gcgcguccggagugaugccga

SEQ ID NO: 1405030 - RNA, 22 nt, Pseudomonas aeruginosa PA01
gcgcguccggagugaugccgau

SEQ ID NO: 1405031 - RNA, 21 nt, Pseudomonas aeruginosa PA01
gcgcgucccugcccgcgccuc

SEQ ID NO: 1405032 - RNA, 19 nt, Pseudomonas aeruginosa PA01
gcgcgucccugggcgcagg

SEQ ID NO: 1405033 - RNA, 18 nt, Pseudomonas aeruginosa PA01
gcgcguuucucagcgccg

SEQ ID NO: 1405034 - RNA, 16 nt, Pseudomonas aeruginosa PA01
gcgcucaacgccucgc

SEQ ID NO: 1405035 - RNA, 21 nt, Pseudomonas aeruginosa PA01
gcgcucaacgccucgcggcua

SEQ ID NO: 1405036 - RNA, 23 nt, Pseudomonas aeruginosa PA01
gcgcucagccgaggucgccgcca

SEQ ID NO: 1405037 - RNA, 14 nt, Pseudomonas aeruginosa PA01
gcgcucagcgcgag

SEQ ID NO: 1405038 - RNA, 23 nt, Pseudomonas aeruginosa PA01
gcgcucaccgaggcgaacggcag

SEQ ID NO: 1405039 - RNA, 20 nt, Pseudomonas aeruginosa PA01
gcgcucaccgcauagucgcg

SEQ ID NO: 1405040 - RNA, 21 nt, Pseudomonas aeruginosa PA01
gcgcucaccgcauagucgcga

SEQ ID NO: 1405041 - RNA, 17 nt, Pseudomonas aeruginosa PA01
gcgcguugcuuccaggc

SEQ ID NO: 1405042 - RNA, 21 nt, Pseudomonas aeruginosa PA01
gcgcguugcuuccaggcaccg

SEQ ID NO: 1405043 - RNA, 15 nt, Pseudomonas aeruginosa PA01
gcgcguugcgaccaa

SEQ ID NO: 1405044 - RNA, 14 nt, Pseudomonas aeruginosa PA01
gcgcguuucagcgc

SEQ ID NO: 1405045 - RNA, 15 nt, Pseudomonas aeruginosa PA01
gcgcguugugccgcc

SEQ ID NO: 1405046 - RNA, 17 nt, Pseudomonas aeruginosa PA01
gcgcguugugccgccac

SEQ ID NO: 1405047 - RNA, 19 nt, Pseudomonas aeruginosa PA01
gcgcguugugccgccaccu

SEQ ID NO: 1405048 - RNA, 14 nt, Pseudomonas aeruginosa PA01
gcgcgucuccagcu

SEQ ID NO: 1405049 - RNA, 20 nt, Pseudomonas aeruginosa PA01
gcgcgugccccguggcgggc

SEQ ID NO: 1405050 - RNA, 23 nt, Pseudomonas aeruginosa PA01
gcgcgugccccguggcgggccag

SEQ ID NO: 1405051 - RNA, 16 nt, Pseudomonas aeruginosa PA01
gcgcgugcaggcgccc

SEQ ID NO: 1405052 - RNA, 21 nt, Pseudomonas aeruginosa PA01
gcgcgugcaggcgcccuggcc

SEQ ID NO: 1405053 - RNA, 13 nt, Pseudomonas aeruginosa PA01
gcgcuuccaccgc

SEQ ID NO: 1405054 - RNA, 17 nt, Pseudomonas aeruginosa PA01
gcgcuuccaccgccugc

SEQ ID NO: 1405055 - RNA, 20 nt, Pseudomonas aeruginosa PA01
gcgcuuccugggaauugcgc

SEQ ID NO: 1405056 - RNA, 14 nt, Pseudomonas aeruginosa PA01
gcgcuucgcgcagg

SEQ ID NO: 1405057 - RNA, 14 nt, Pseudomonas aeruginosa PA01
gcgcuuccaggcac

SEQ ID NO: 1405058 - RNA, 20 nt, Pseudomonas aeruginosa PA01
gcgcuuccaggguagcgccg

SEQ ID NO: 1405059 - RNA, 21 nt, Pseudomonas aeruginosa PA01
gcgcuucccgcggcuccagcc

SEQ ID NO: 1405060 - RNA, 18 nt, Pseudomonas aeruginosa PA01
gcgcuuccgcaucggccg

SEQ ID NO: 1405061 - RNA, 15 nt, Pseudomonas aeruginosa PA01
gcgcuuccggcagcc

SEQ ID NO: 1405062 - RNA, 18 nt, Pseudomonas aeruginosa PA01
gcgcuuccggcagccagc

SEQ ID NO: 1405063 - RNA, 23 nt, Pseudomonas aeruginosa PA01
gcgcuuccggcagccagccgccg

SEQ ID NO: 1405064 - RNA, 13 nt, Pseudomonas aeruginosa PA01
gcgcuucggcgga

SEQ ID NO: 1405065 - RNA, 23 nt, Pseudomonas aeruginosa PA01
gcgcuucggcggcuucgcgcucc

SEQ ID NO: 1405066 - RNA, 13 nt, Pseudomonas aeruginosa PA01
gcgcuucguugcu

SEQ ID NO: 1405067 - RNA, 14 nt, Pseudomonas aeruginosa PA01
gcgcuucugcgagc

SEQ ID NO: 1405068 - RNA, 14 nt, Pseudomonas aeruginosa PA01
gcgcuucucggcag

SEQ ID NO: 1405069 - RNA, 17 nt, Pseudomonas aeruginosa PA01
gcgcuucugcaggccgu

SEQ ID NO: 1405070 - RNA, 18 nt, Pseudomonas aeruginosa PA01
gcgcuucugcucggccug

SEQ ID NO: 1405071 - RNA, 24 nt, Pseudomonas aeruginosa PA01
gcgcuucugcucggccuggaucgc

SEQ ID NO: 1405072 - RNA, 15 nt, Pseudomonas aeruginosa PA01
gcgcuugaagccggc

SEQ ID NO: 1405073 - RNA, 13 nt, Pseudomonas aeruginosa PA01
gcgcuugagcagc

SEQ ID NO: 1405074 - RNA, 20 nt, Pseudomonas aeruginosa PA01
gcgcuugcgcagcaucuucu

SEQ ID NO: 1405075 - RNA, 12 nt, Pseudomonas aeruginosa PA01
gcgcuugcccag

SEQ ID NO: 1405076 - RNA, 16 nt, Pseudomonas aeruginosa PA01
gcgcuugcccagguag

SEQ ID NO: 1405077 - RNA, 21 nt, Pseudomonas aeruginosa PA01
gcgcuugccgcgcccggccag

SEQ ID NO: 1405078 - RNA, 15 nt, Pseudomonas aeruginosa PA01
gcgcuugaguugcca

SEQ ID NO: 1405079 - RNA, 17 nt, Pseudomonas aeruginosa PA01
gcgcuugcgggcgcgcc

SEQ ID NO: 1405080 - RNA, 13 nt, Pseudomonas aeruginosa PA01
gcgcuugcuggcg

SEQ ID NO: 1405081 - RNA, 15 nt, Pseudomonas aeruginosa PA01
gcgcuugcuggcgcg

SEQ ID NO: 1405082 - RNA, 18 nt, Pseudomonas aeruginosa PA01
gcgcuugcuggcgcgauc

SEQ ID NO: 1405083 - RNA, 15 nt, Pseudomonas aeruginosa PA01
gcgcuuuccggcgcg

SEQ ID NO: 1405084 - RNA, 19 nt, Pseudomonas aeruginosa PA01
gcgcuuucgcucuggucga

SEQ ID NO: 1405085 - RNA, 13 nt, Pseudomonas aeruginosa PA01
gcgcuuguagcag

SEQ ID NO: 1405086 - RNA, 16 nt, Pseudomonas aeruginosa PA01
gcgcuuguagcagccg

SEQ ID NO: 1405087 - RNA, 17 nt, Pseudomonas aeruginosa PA01
gcgcuuguagcagccgc

SEQ ID NO: 1405088 - RNA, 13 nt, Pseudomonas aeruginosa PA01
gcgcuuguagccc

SEQ ID NO: 1405089 - RNA, 21 nt, Pseudomonas aeruginosa PA01
gcgcuuguagcccaggggcac

SEQ ID NO: 1405090 - RNA, 21 nt, Pseudomonas aeruginosa PA01
gcgcugguccagcacgcuggc

SEQ ID NO: 1405091 - RNA, 15 nt, Pseudomonas aeruginosa PA01
gcgcugguugacgaa

SEQ ID NO: 1405092 - RNA, 21 nt, Pseudomonas aeruginosa PA01
gcgcugguuuagcucggcgau

SEQ ID NO: 1405093 - RNA, 23 nt, Pseudomonas aeruginosa PA01
gcgcugguuuagcucggcgaugg

SEQ ID NO: 1405094 - RNA, 15 nt, Pseudomonas aeruginosa PA01
gcgcuggucguaggc

SEQ ID NO: 1405095 - RNA, 17 nt, Pseudomonas aeruginosa PA01
gcgcuggucguaggcgc

SEQ ID NO: 1405096 - RNA, 21 nt, Pseudomonas aeruginosa PA01
gcgcuggucguucucgcgcau

SEQ ID NO: 1405097 - RNA, 20 nt, Pseudomonas aeruginosa PA01
gcgcuggucgacguaggcgg

SEQ ID NO: 1405098 - RNA, 21 nt, Pseudomonas aeruginosa PA01
gcgcuggucgacguaggcggc

SEQ ID NO: 1405099 - RNA, 14 nt, Pseudomonas aeruginosa PA01
gcgcuguagccggc

SEQ ID NO: 1405100 - RNA, 16 nt, Pseudomonas aeruginosa PA01
gcgcuguagccggcgc

SEQ ID NO: 1405101 - RNA, 17 nt, Pseudomonas aeruginosa PA01
gcgcuguagccggcgcc

SEQ ID NO: 1405102 - RNA, 22 nt, Pseudomonas aeruginosa PA01
gcgcuguagccggcgccgucga

SEQ ID NO: 1405103 - RNA, 14 nt, Pseudomonas aeruginosa PA01
gcgcuguaggcgag

SEQ ID NO: 1405104 - RNA, 23 nt, Pseudomonas aeruginosa PA01
gcgcugucucgccagcccggcag

SEQ ID NO: 1405105 - RNA, 14 nt, Pseudomonas aeruginosa PA01
gcgcugucgccggu

SEQ ID NO: 1405106 - RNA, 16 nt, Pseudomonas aeruginosa PA01
gcgcugucgccgguca

SEQ ID NO: 1405107 - RNA, 19 nt, Pseudomonas aeruginosa PA01
gcgcugucgcccgggcgcc

SEQ ID NO: 1405108 - RNA, 15 nt, Pseudomonas aeruginosa PA01
gcgcuguucgggucg

SEQ ID NO: 1405109 - RNA, 15 nt, Pseudomonas aeruginosa PA01
gcgcuguuggccugg

SEQ ID NO: 1405110 - RNA, 17 nt, Pseudomonas aeruginosa PA01
gcgcuguuggccugggc

SEQ ID NO: 1405111 - RNA, 11 nt, Pseudomonas aeruginosa PA01
gcgcuucacca

SEQ ID NO: 1405112 - RNA, 21 nt, Pseudomonas aeruginosa PA01
gcgcuucagcucgaggccagg

SEQ ID NO: 1405113 - RNA, 13 nt, Pseudomonas aeruginosa PA01
gcgcuucaggcag

SEQ ID NO: 1405114 - RNA, 14 nt, Pseudomonas aeruginosa PA01
gcgcugcgcggccu

SEQ ID NO: 1405115 - RNA, 20 nt, Pseudomonas aeruginosa PA01
gcgcugcgcggccugcgccg

SEQ ID NO: 1405116 - RNA, 16 nt, Pseudomonas aeruginosa PA01
gcgcugcgcggcgucg

SEQ ID NO: 1405117 - RNA, 22 nt, Pseudomonas aeruginosa PA01
gcgcugcgcggcgucggcgaag

SEQ ID NO: 1405118 - RNA, 23 nt, Pseudomonas aeruginosa PA01
gcgcuggagagauagagcuucuc

SEQ ID NO: 1405119 - RNA, 14 nt, Pseudomonas aeruginosa PA01
gcgcugccggccag

SEQ ID NO: 1405120 - RNA, 21 nt, Pseudomonas aeruginosa PA01
gcgcugccggccagggucgcc

SEQ ID NO: 1405121 - RNA, 16 nt, Pseudomonas aeruginosa PA01
gcgcugccugcaccgg

SEQ ID NO: 1405122 - RNA, 19 nt, Pseudomonas aeruginosa PA01
gcgcugccuucgaagccgg

SEQ ID NO: 1405123 - RNA, 20 nt, Pseudomonas aeruginosa PA01
gcgcugccuucgaagccggc

SEQ ID NO: 1405124 - RNA, 21 nt, Pseudomonas aeruginosa PA01
gcgcugccuucgaagccggca

SEQ ID NO: 1405125 - RNA, 21 nt, Pseudomonas aeruginosa PA01
gcgcugcgaaucgucgccgga

SEQ ID NO: 1405126 - RNA, 21 nt, Pseudomonas aeruginosa PA01
gcgcugggucaugcucggggu

SEQ ID NO: 1405127 - RNA, 16 nt, Pseudomonas aeruginosa PA01
gcgcugggcggcuggc

SEQ ID NO: 1405128 - RNA, 18 nt, Pseudomonas aeruginosa PA01
gcgcugggcggcuggccg

SEQ ID NO: 1405129 - RNA, 15 nt, Pseudomonas aeruginosa PA01
gcgcuggcgcagcag

SEQ ID NO: 1405130 - RNA, 20 nt, Pseudomonas aeruginosa PA01
gcgcuggcgcagcagcaggu

SEQ ID NO: 1405131 - RNA, 13 nt, Pseudomonas aeruginosa PA01
gcgcuggcgcagc

SEQ ID NO: 1405132 - RNA, 13 nt, Pseudomonas aeruginosa PA01
gcgcuggcgauca

SEQ ID NO: 1405133 - RNA, 19 nt, Pseudomonas aeruginosa PA01
gcgcuggcgaucaccaggg

SEQ ID NO: 1405134 - RNA, 18 nt, Pseudomonas aeruginosa PA01
gcgcuggauuucgccgag

SEQ ID NO: 1405135 - RNA, 20 nt, Pseudomonas aeruginosa PA01
gcgcuggaugaaacgggcga

SEQ ID NO: 1405136 - RNA, 23 nt, Pseudomonas aeruginosa PA01
gcgcuggaugaaacgggcgaucu

SEQ ID NO: 1405137 - RNA, 12 nt, Pseudomonas aeruginosa PA01
gcgcuggccagc

SEQ ID NO: 1405138 - RNA, 14 nt, Pseudomonas aeruginosa PA01
gcgcuggccgagcu

SEQ ID NO: 1405139 - RNA, 18 nt, Pseudomonas aeruginosa PA01
gcgcuggccgagcugccg

SEQ ID NO: 1405140 - RNA, 19 nt, Pseudomonas aeruginosa PA01
gcgcuggccgagcugccgc

SEQ ID NO: 1405141 - RNA, 20 nt, Pseudomonas aeruginosa PA01
gcgcuccauccagucggcgc

SEQ ID NO: 1405142 - RNA, 21 nt, Pseudomonas aeruginosa PA01
gcgcuccauccagucggcgcu

SEQ ID NO: 1405143 - RNA, 23 nt, Pseudomonas aeruginosa PA01
gcgcuccauccagucggcgcugg

SEQ ID NO: 1405144 - RNA, 14 nt, Pseudomonas aeruginosa PA01
gcgcucacgcaccu

SEQ ID NO: 1405145 - RNA, 19 nt, Pseudomonas aeruginosa PA01
gcgcuccaggcccggcagg

SEQ ID NO: 1405146 - RNA, 12 nt, Pseudomonas aeruginosa PA01
gcgcuccaggcg

SEQ ID NO: 1405147 - RNA, 14 nt, Pseudomonas aeruginosa PA01
gcgcuccaggcggg

SEQ ID NO: 1405148 - RNA, 15 nt, Pseudomonas aeruginosa PA01
gcgcuccaggcgggu

SEQ ID NO: 1405149 - RNA, 13 nt, Pseudomonas aeruginosa PA01
gcgcuccagggcg

SEQ ID NO: 1405150 - RNA, 17 nt, Pseudomonas aeruginosa PA01
gcgcucgguggcauggu

SEQ ID NO: 1405151 - RNA, 22 nt, Pseudomonas aeruginosa PA01
gcgcucccauucgcugucgucg

SEQ ID NO: 1405152 - RNA, 14 nt, Pseudomonas aeruginosa PA01
gcgcucggucagcu

SEQ ID NO: 1405153 - RNA, 17 nt, Pseudomonas aeruginosa PA01
gcgcucggucagcuccc

SEQ ID NO: 1405154 - RNA, 19 nt, Pseudomonas aeruginosa PA01
gcgcucgguccagaucgcc

SEQ ID NO: 1405155 - RNA, 13 nt, Pseudomonas aeruginosa PA01
gcgcuccggcgcg

SEQ ID NO: 1405156 - RNA, 14 nt, Pseudomonas aeruginosa PA01
gcgcuccggcgcgc

SEQ ID NO: 1405157 - RNA, 16 nt, Pseudomonas aeruginosa PA01
gcgcuccggcgcgcca

SEQ ID NO: 1405158 - RNA, 18 nt, Pseudomonas aeruginosa PA01
gcgcuccggcgcgccaug

SEQ ID NO: 1405159 - RNA, 15 nt, Pseudomonas aeruginosa PA01
gcgcuccgccaggcc

SEQ ID NO: 1405160 - RNA, 16 nt, Pseudomonas aeruginosa PA01
gcgcuccgccaggccg

SEQ ID NO: 1405161 - RNA, 17 nt, Pseudomonas aeruginosa PA01
gcgcuccgccaggccgc

SEQ ID NO: 1405162 - RNA, 12 nt, Pseudomonas aeruginosa PA01
gcgcuccgcugg

SEQ ID NO: 1405163 - RNA, 17 nt, Pseudomonas aeruginosa PA01
gcgcuccuccagcgccg

SEQ ID NO: 1405164 - RNA, 14 nt, Pseudomonas aeruginosa PA01
gcgcuccgguggcg

SEQ ID NO: 1405165 - RNA, 20 nt, Pseudomonas aeruginosa PA01
gcgcuccgguggcggacugg

SEQ ID NO: 1405166 - RNA, 14 nt, Pseudomonas aeruginosa PA01
gcgcugagcgagac

SEQ ID NO: 1405167 - RNA, 16 nt, Pseudomonas aeruginosa PA01
gcgcugagcgccucga

SEQ ID NO: 1405168 - RNA, 21 nt, Pseudomonas aeruginosa PA01
gcgcugaggaagagcagcgcg

SEQ ID NO: 1405169 - RNA, 20 nt, Pseudomonas aeruginosa PA01
gcgcugaucacgaucggcac

SEQ ID NO: 1405170 - RNA, 21 nt, Pseudomonas aeruginosa PA01
gcgcugaccuggucguugcgc

SEQ ID NO: 1405171 - RNA, 20 nt, Pseudomonas aeruginosa PA01
gcgcucguugauccgcgugg

SEQ ID NO: 1405172 - RNA, 20 nt, Pseudomonas aeruginosa PA01
gcgcucguagguuuccgggu

SEQ ID NO: 1405173 - RNA, 13 nt, Pseudomonas aeruginosa PA01
gcgcucguagaac

SEQ ID NO: 1405174 - RNA, 19 nt, Pseudomonas aeruginosa PA01
gcgcucguagaacucgccc

SEQ ID NO: 1405175 - RNA, 16 nt, Pseudomonas aeruginosa PA01
gcgcucguagccggcg

SEQ ID NO: 1405176 - RNA, 22 nt, Pseudomonas aeruginosa PA01
gcgcucguagccggcgcggcgc

SEQ ID NO: 1405177 - RNA, 21 nt, Pseudomonas aeruginosa PA01
gcgcgcgacacauggucggcc

SEQ ID NO: 1405178 - RNA, 13 nt, Pseudomonas aeruginosa PA01
gcgcgcgccaccg

SEQ ID NO: 1405179 - RNA, 13 nt, Pseudomonas aeruginosa PA01
gcgcgcgccaggu

SEQ ID NO: 1405180 - RNA, 12 nt, Pseudomonas aeruginosa PA01
gcgcgcgccagu

SEQ ID NO: 1405181 - RNA, 11 nt, Pseudomonas aeruginosa PA01
gcgcgcgccga

SEQ ID NO: 1405182 - RNA, 13 nt, Pseudomonas aeruginosa PA01
gcgcgcgccgaac

SEQ ID NO: 1405183 - RNA, 14 nt, Pseudomonas aeruginosa PA01
gcgcgcgccgagca

SEQ ID NO: 1405184 - RNA, 15 nt, Pseudomonas aeruginosa PA01
gcgcgcgccgagcaa

SEQ ID NO: 1405185 - RNA, 19 nt, Pseudomonas aeruginosa PA01
gcgcgcgcccccuggccgu

SEQ ID NO: 1405186 - RNA, 13 nt, Pseudomonas aeruginosa PA01
gcgcgcgccgggc

SEQ ID NO: 1405187 - RNA, 14 nt, Pseudomonas aeruginosa PA01
gcgcgcgcgccagg

SEQ ID NO: 1405188 - RNA, 13 nt, Pseudomonas aeruginosa PA01
gcgcgcgcgcugc

SEQ ID NO: 1405189 - RNA, 14 nt, Pseudomonas aeruginosa PA01
gcgcgcgcugccag

SEQ ID NO: 1405190 - RNA, 15 nt, Pseudomonas aeruginosa PA01
gcgcgcgcuggcgca

SEQ ID NO: 1405191 - RNA, 16 nt, Pseudomonas aeruginosa PA01
gcgcgcggucgagcag

SEQ ID NO: 1405192 - RNA, 22 nt, Pseudomonas aeruginosa PA01
gcgcgcggucgagcagcgccgc

SEQ ID NO: 1405193 - RNA, 18 nt, Pseudomonas aeruginosa PA01
gcgcgcggggucuggccg

SEQ ID NO: 1405194 - RNA, 22 nt, Pseudomonas aeruginosa PA01
gcgcgcggggucuggccggcga

SEQ ID NO: 1405195 - RNA, 17 nt, Pseudomonas aeruginosa PA01
gcgcgcgguuucuucgc

SEQ ID NO: 1405196 - RNA, 12 nt, Pseudomonas aeruginosa PA01
gcgcgcggcgag

SEQ ID NO: 1405197 - RNA, 18 nt, Pseudomonas aeruginosa PA01
gcgcgcggcgagccgcga

SEQ ID NO: 1405198 - RNA, 17 nt, Pseudomonas aeruginosa PA01
gcgcgcggccuguucgg

SEQ ID NO: 1405199 - RNA, 21 nt, Pseudomonas aeruginosa PA01
gcgcgcgcuucuugucgucgg

SEQ ID NO: 1405200 - RNA, 14 nt, Pseudomonas aeruginosa PA01
gcgcgcggaccgaa

SEQ ID NO: 1405201 - RNA, 14 nt, Pseudomonas aeruginosa PA01
gcgcgcgcuggucg

SEQ ID NO: 1405202 - RNA, 21 nt, Pseudomonas aeruginosa PA01
gcgcgcggccagcucgccggu

SEQ ID NO: 1405203 - RNA, 13 nt, Pseudomonas aeruginosa PA01
gcgcgcggccagc

SEQ ID NO: 1405204 - RNA, 13 nt, Pseudomonas aeruginosa PA01
gcgcgcugcgggu

SEQ ID NO: 1405205 - RNA, 15 nt, Pseudomonas aeruginosa PA01
gcgcgcugcgugcgc

SEQ ID NO: 1405206 - RNA, 15 nt, Pseudomonas aeruginosa PA01
gcgcgcuggaugccc

SEQ ID NO: 1405207 - RNA, 23 nt, Pseudomonas aeruginosa PA01
gcgcgcuggaugcccuccugggc

SEQ ID NO: 1405208 - RNA, 19 nt, Pseudomonas aeruginosa PA01
gcgcgcuggauuucgccga

SEQ ID NO: 1405209 - RNA, 20 nt, Pseudomonas aeruginosa PA01
gcgcgcuggcagaacgcguc

SEQ ID NO: 1405210 - RNA, 13 nt, Pseudomonas aeruginosa PA01
gcgcgcuggcgca

SEQ ID NO: 1405211 - RNA, 16 nt, Pseudomonas aeruginosa PA01
gcgcgcuguagccggc

SEQ ID NO: 1405212 - RNA, 18 nt, Pseudomonas aeruginosa PA01
gcgcgcuguagccggcgc

SEQ ID NO: 1405213 - RNA, 22 nt, Pseudomonas aeruginosa PA01
gcgcgcuggucguaggcgcggg

SEQ ID NO: 1405214 - RNA, 20 nt, Pseudomonas aeruginosa PA01
gcgcgcuggucguucucgcg

SEQ ID NO: 1405215 - RNA, 16 nt, Pseudomonas aeruginosa PA01
gcgcggaagcgccugc

SEQ ID NO: 1405216 - RNA, 20 nt, Pseudomonas aeruginosa PA01
gcgcggaagcgccugcggug

SEQ ID NO: 1405217 - RNA, 19 nt, Pseudomonas aeruginosa PA01
gcgcgcuuuccggcgcggc

SEQ ID NO: 1405218 - RNA, 23 nt, Pseudomonas aeruginosa PA01
gcgcgcuuuccggcgcggccugc

SEQ ID NO: 1405219 - RNA, 18 nt, Pseudomonas aeruginosa PA01
gcgcgcuuuuccggcgcc

SEQ ID NO: 1405220 - RNA, 21 nt, Pseudomonas aeruginosa PA01
gcgcgcuuuuccggcgccggc

SEQ ID NO: 1405221 - RNA, 21 nt, Pseudomonas aeruginosa PA01
gcgcggaaaaucaaaaccagc

SEQ ID NO: 1405222 - RNA, 15 nt, Pseudomonas aeruginosa PA01
gcgcgcuugccgcug

SEQ ID NO: 1405223 - RNA, 16 nt, Pseudomonas aeruginosa PA01
gcgcgcuuccaggcac

SEQ ID NO: 1405224 - RNA, 19 nt, Pseudomonas aeruginosa PA01
gcgcgcuuccuccaguagc

SEQ ID NO: 1405225 - RNA, 20 nt, Pseudomonas aeruginosa PA01
gcgcgcuucuugucgucgga

SEQ ID NO: 1405226 - RNA, 14 nt, Pseudomonas aeruginosa PA01
gcgcgcucucgccg

SEQ ID NO: 1405227 - RNA, 15 nt, Pseudomonas aeruginosa PA01
gcgcgcucucgccgg

SEQ ID NO: 1405228 - RNA, 16 nt, Pseudomonas aeruginosa PA01
gcgcgcucucgccggc

SEQ ID NO: 1405229 - RNA, 21 nt, Pseudomonas aeruginosa PA01
gcgcgcucucgccggccugga

SEQ ID NO: 1405230 - RNA, 17 nt, Pseudomonas aeruginosa PA01
gcgcgcucgggaucgcc

SEQ ID NO: 1405231 - RNA, 21 nt, Pseudomonas aeruginosa PA01
gcgcgcucgggaucgccucgu

SEQ ID NO: 1405232 - RNA, 12 nt, Pseudomonas aeruginosa PA01
gcgcgcucggcc

SEQ ID NO: 1405233 - RNA, 16 nt, Pseudomonas aeruginosa PA01
gcgcgcucgaucaggu

SEQ ID NO: 1405234 - RNA, 22 nt, Pseudomonas aeruginosa PA01
gcgcgcgucggcgaacccggcg

SEQ ID NO: 1405235 - RNA, 22 nt, Pseudomonas aeruginosa PA01
gcgcgccgguuucgaccggcgc

SEQ ID NO: 1405236 - RNA, 14 nt, Pseudomonas aeruginosa PA01
gcgcgccggcuugg

SEQ ID NO: 1405237 - RNA, 16 nt, Pseudomonas aeruginosa PA01
gcgcgccggcuuggcu

SEQ ID NO: 1405238 - RNA, 12 nt, Pseudomonas aeruginosa PA01
gcgcgccgcgca

SEQ ID NO: 1405239 - RNA, 16 nt, Pseudomonas aeruginosa PA01
gcgcgccggacaggcc

SEQ ID NO: 1405240 - RNA, 19 nt, Pseudomonas aeruginosa PA01
gcgcgccggacaggccacc

SEQ ID NO: 1405241 - RNA, 14 nt, Pseudomonas aeruginosa PA01
gcgcgccggagcca

SEQ ID NO: 1405242 - RNA, 21 nt, Pseudomonas aeruginosa PA01
gcgcgccggcccgggucacgg

SEQ ID NO: 1405243 - RNA, 14 nt, Pseudomonas aeruginosa PA01
gcgcgccgugcggc

SEQ ID NO: 1405244 - RNA, 18 nt, Pseudomonas aeruginosa PA01
gcgcgccucagcggcugg

SEQ ID NO: 1405245 - RNA, 22 nt, Pseudomonas aeruginosa PA01
gcgcgccucagcggcuggcgau

SEQ ID NO: 1405246 - RNA, 17 nt, Pseudomonas aeruginosa PA01
gcgcgccucgccccaga

SEQ ID NO: 1405247 - RNA, 18 nt, Pseudomonas aeruginosa PA01
gcgcgccucgcggcguuc

SEQ ID NO: 1405248 - RNA, 13 nt, Pseudomonas aeruginosa PA01
gcgcgccucgccc

SEQ ID NO: 1405249 - RNA, 15 nt, Pseudomonas aeruginosa PA01
gcgcgccggugaucg

SEQ ID NO: 1405250 - RNA, 15 nt, Pseudomonas aeruginosa PA01
gcgcgccugagcugg

SEQ ID NO: 1405251 - RNA, 16 nt, Pseudomonas aeruginosa PA01
gcgcgccugagcuggc

SEQ ID NO: 1405252 - RNA, 13 nt, Pseudomonas aeruginosa PA01
gcgcgccugcaac

SEQ ID NO: 1405253 - RNA, 19 nt, Pseudomonas aeruginosa PA01
gcgcgccugcaacgccagc

SEQ ID NO: 1405254 - RNA, 20 nt, Pseudomonas aeruginosa PA01
gcgcgccugcaacgccagca

SEQ ID NO: 1405255 - RNA, 22 nt, Pseudomonas aeruginosa PA01
gcgcgccuucagccccagcacg

SEQ ID NO: 1405256 - RNA, 17 nt, Pseudomonas aeruginosa PA01
gcgcgccuucagcgccu

SEQ ID NO: 1405257 - RNA, 18 nt, Pseudomonas aeruginosa PA01
gcgcgccuucagcgccuc

SEQ ID NO: 1405258 - RNA, 13 nt, Pseudomonas aeruginosa PA01
gcgcgccuggccc

SEQ ID NO: 1405259 - RNA, 21 nt, Pseudomonas aeruginosa PA01
gcgcgccugcucuucggcggc

SEQ ID NO: 1405260 - RNA, 20 nt, Pseudomonas aeruginosa PA01
gcgcgccuggaucagcgccu

SEQ ID NO: 1405261 - RNA, 14 nt, Pseudomonas aeruginosa PA01
gcgcgccuggcugg

SEQ ID NO: 1405262 - RNA, 17 nt, Pseudomonas aeruginosa PA01
gcgcgccuggcuggcca

SEQ ID NO: 1405263 - RNA, 18 nt, Pseudomonas aeruginosa PA01
gcgcgccuggcuggccag

SEQ ID NO: 1405264 - RNA, 19 nt, Pseudomonas aeruginosa PA01
gcgcgccuggcuggccagc

SEQ ID NO: 1405265 - RNA, 21 nt, Pseudomonas aeruginosa PA01
gcgcgccuggcuggccagcag

SEQ ID NO: 1405266 - RNA, 22 nt, Pseudomonas aeruginosa PA01
gcgcgccuggcuggccagcagg

SEQ ID NO: 1405267 - RNA, 11 nt, Pseudomonas aeruginosa PA01
gcgcgccacca

SEQ ID NO: 1405268 - RNA, 15 nt, Pseudomonas aeruginosa PA01
gcgcgccaccagcgu

SEQ ID NO: 1405269 - RNA, 21 nt, Pseudomonas aeruginosa PA01
gcgcgcccgccuggaaggcgc

SEQ ID NO: 1405270 - RNA, 20 nt, Pseudomonas aeruginosa PA01
gcgcgcaugaaaaagcccgg

SEQ ID NO: 1405271 - RNA, 23 nt, Pseudomonas aeruginosa PA01
gcgcgcaucggugccggcaggcc

SEQ ID NO: 1405272 - RNA, 13 nt, Pseudomonas aeruginosa PA01
gcgcgccaaggcc

SEQ ID NO: 1405273 - RNA, 20 nt, Pseudomonas aeruginosa PA01
gcgcgccaaggccgccaggc

SEQ ID NO: 1405274 - RNA, 17 nt, Pseudomonas aeruginosa PA01
gcgcgcaguaggcgcug

SEQ ID NO: 1405275 - RNA, 18 nt, Pseudomonas aeruginosa PA01
gcgcgcaguaggcgcugc

SEQ ID NO: 1405276 - RNA, 14 nt, Pseudomonas aeruginosa PA01
gcgcgccgagccag

SEQ ID NO: 1405277 - RNA, 16 nt, Pseudomonas aeruginosa PA01
gcgcgccgagccaggu

SEQ ID NO: 1405278 - RNA, 18 nt, Pseudomonas aeruginosa PA01
gcgcgccgagccagguac

SEQ ID NO: 1405279 - RNA, 20 nt, Pseudomonas aeruginosa PA01
gcgcgccgagcccccggcgc

SEQ ID NO: 1405280 - RNA, 20 nt, Pseudomonas aeruginosa PA01
gcgcgccgaguucgccgcga

SEQ ID NO: 1405281 - RNA, 12 nt, Pseudomonas aeruginosa PA01
gcgcgccgagca

SEQ ID NO: 1405282 - RNA, 14 nt, Pseudomonas aeruginosa PA01
gcgcgcccggcgca

SEQ ID NO: 1405283 - RNA, 16 nt, Pseudomonas aeruginosa PA01
gcgcgcccggcgcccu

SEQ ID NO: 1405284 - RNA, 16 nt, Pseudomonas aeruginosa PA01
gcgcgcccugcaggcc

SEQ ID NO: 1405285 - RNA, 18 nt, Pseudomonas aeruginosa PA01
gcgcgcccugcaggccga

SEQ ID NO: 1405286 - RNA, 14 nt, Pseudomonas aeruginosa PA01
gcgcgccgaacucg

SEQ ID NO: 1405287 - RNA, 22 nt, Pseudomonas aeruginosa PA01
gcgcgccgacagcacgauggcg

SEQ ID NO: 1405288 - RNA, 22 nt, Pseudomonas aeruginosa PA01
gcgcgccgccgggcgcccggcc

SEQ ID NO: 1405289 - RNA, 12 nt, Pseudomonas aeruginosa PA01
gcgcgccgccga

SEQ ID NO: 1405290 - RNA, 13 nt, Pseudomonas aeruginosa PA01
gcgcgccgccgag

SEQ ID NO: 1405291 - RNA, 15 nt, Pseudomonas aeruginosa PA01
gcgcgccgccgaggu

SEQ ID NO: 1405292 - RNA, 14 nt, Pseudomonas aeruginosa PA01
gcgcgccgccgccg

SEQ ID NO: 1405293 - RNA, 15 nt, Pseudomonas aeruginosa PA01
gcgccuucgggcgcc

SEQ ID NO: 1405294 - RNA, 21 nt, Pseudomonas aeruginosa PA01
gcgccuucgugaccauaggcu

SEQ ID NO: 1405295 - RNA, 20 nt, Pseudomonas aeruginosa PA01
gcgccuuccuugauccacuc

SEQ ID NO: 1405296 - RNA, 20 nt, Pseudomonas aeruginosa PA01
gcgccuucugcaccuuggcc

SEQ ID NO: 1405297 - RNA, 22 nt, Pseudomonas aeruginosa PA01
gcgccuugaaaccggcgaacca

SEQ ID NO: 1405298 - RNA, 23 nt, Pseudomonas aeruginosa PA01
gcgccuugaaaccggcgaaccag

SEQ ID NO: 1405299 - RNA, 18 nt, Pseudomonas aeruginosa PA01
gcgccuuccagcccuucg

SEQ ID NO: 1405300 - RNA, 12 nt, Pseudomonas aeruginosa PA01
gcgccuuccagg

SEQ ID NO: 1405301 - RNA, 13 nt, Pseudomonas aeruginosa PA01
gcgccuuccaggc

SEQ ID NO: 1405302 - RNA, 14 nt, Pseudomonas aeruginosa PA01
gcgccuuccaggcg

SEQ ID NO: 1405303 - RNA, 15 nt, Pseudomonas aeruginosa PA01
gcgccuuccaggcgu

SEQ ID NO: 1405304 - RNA, 23 nt, Pseudomonas aeruginosa PA01
gcgccuugaccucgacgccgagc

SEQ ID NO: 1405305 - RNA, 19 nt, Pseudomonas aeruginosa PA01
gcgccuugcgguccagcga

SEQ ID NO: 1405306 - RNA, 14 nt, Pseudomonas aeruginosa PA01
gcgccuugcgccag

SEQ ID NO: 1405307 - RNA, 15 nt, Pseudomonas aeruginosa PA01
gcgcgaccgcggcgc

SEQ ID NO: 1405308 - RNA, 16 nt, Pseudomonas aeruginosa PA01
gcgcgaccgcggcgcu

SEQ ID NO: 1405309 - RNA, 19 nt, Pseudomonas aeruginosa PA01
gcgcgaccgcggcgcucgg

SEQ ID NO: 1405310 - RNA, 22 nt, Pseudomonas aeruginosa PA01
gcgcgaccgcggcgcucggcau

SEQ ID NO: 1405311 - RNA, 12 nt, Pseudomonas aeruginosa PA01
gcgcgaccgucg

SEQ ID NO: 1405312 - RNA, 16 nt, Pseudomonas aeruginosa PA01
gcgcgaccgucggccg

SEQ ID NO: 1405313 - RNA, 17 nt, Pseudomonas aeruginosa PA01
gcgcgaccgucggccgg

SEQ ID NO: 1405314 - RNA, 18 nt, Pseudomonas aeruginosa PA01
gcgcgaccgucggccggg

SEQ ID NO: 1405315 - RNA, 16 nt, Pseudomonas aeruginosa PA01
gcgcgacgaggcgcgg

SEQ ID NO: 1405316 - RNA, 17 nt, Pseudomonas aeruginosa PA01
gcgcgacgcuccaggug

SEQ ID NO: 1405317 - RNA, 16 nt, Pseudomonas aeruginosa PA01
gcgcgacugucgagca

SEQ ID NO: 1405318 - RNA, 14 nt, Pseudomonas aeruginosa PA01
gcgcgacuuggaca

SEQ ID NO: 1405319 - RNA, 20 nt, Pseudomonas aeruginosa PA01
gcgcgacuuggacagcgucu

SEQ ID NO: 1405320 - RNA, 18 nt, Pseudomonas aeruginosa PA01
gcgcgagaagccagccag

SEQ ID NO: 1405321 - RNA, 20 nt, Pseudomonas aeruginosa PA01
gcgcgagaagccagccaggu

SEQ ID NO: 1405322 - RNA, 21 nt, Pseudomonas aeruginosa PA01
gcgcgagaugaagcgccgcag

SEQ ID NO: 1405323 - RNA, 15 nt, Pseudomonas aeruginosa PA01
gcgcgagcaccgcgc

SEQ ID NO: 1405324 - RNA, 17 nt, Pseudomonas aeruginosa PA01
gcgcgagcaccgcgcag

SEQ ID NO: 1405325 - RNA, 13 nt, Pseudomonas aeruginosa PA01
gcgcgcaggcgcu

SEQ ID NO: 1405326 - RNA, 18 nt, Pseudomonas aeruginosa PA01
gcgcgcagggccagcaac

SEQ ID NO: 1405327 - RNA, 19 nt, Pseudomonas aeruginosa PA01
gcgcgcaccaccuggcagg

SEQ ID NO: 1405328 - RNA, 13 nt, Pseudomonas aeruginosa PA01
gcgcgcaccaggc

SEQ ID NO: 1405329 - RNA, 16 nt, Pseudomonas aeruginosa PA01
gcgcgcaccaggccuc

SEQ ID NO: 1405330 - RNA, 12 nt, Pseudomonas aeruginosa PA01
gcgcgcaccagc

SEQ ID NO: 1405331 - RNA, 13 nt, Pseudomonas aeruginosa PA01
gcgcgcaccagcg

SEQ ID NO: 1405332 - RNA, 19 nt, Pseudomonas aeruginosa PA01
gcgcgcaccagcgggucgu

SEQ ID NO: 1405333 - RNA, 14 nt, Pseudomonas aeruginosa PA01
gcgcgcaaggccga

SEQ ID NO: 1405334 - RNA, 17 nt, Pseudomonas aeruginosa PA01
gcgcgcaaggccgaaga

SEQ ID NO: 1405335 - RNA, 15 nt, Pseudomonas aeruginosa PA01
gcgcgcaacuggucg

SEQ ID NO: 1405336 - RNA, 12 nt, Pseudomonas aeruginosa PA01
gcgcgagcggca

SEQ ID NO: 1405337 - RNA, 12 nt, Pseudomonas aeruginosa PA01
gcgccucagcgg

SEQ ID NO: 1405338 - RNA, 22 nt, Pseudomonas aeruginosa PA01
gcgccucagcggaacuugcgcc

SEQ ID NO: 1405339 - RNA, 13 nt, Pseudomonas aeruginosa PA01
gcgccucagcggc

SEQ ID NO: 1405340 - RNA, 14 nt, Pseudomonas aeruginosa PA01
gcgccucagcggcc

SEQ ID NO: 1405341 - RNA, 16 nt, Pseudomonas aeruginosa PA01
gcgccucagcggccuu

SEQ ID NO: 1405342 - RNA, 15 nt, Pseudomonas aeruginosa PA01
gcgccucagcggcug

SEQ ID NO: 1405343 - RNA, 17 nt, Pseudomonas aeruginosa PA01
gcgccucagcggcuggc

SEQ ID NO: 1405344 - RNA, 20 nt, Pseudomonas aeruginosa PA01
gcgccucagcggcuggcgau

SEQ ID NO: 1405345 - RNA, 15 nt, Pseudomonas aeruginosa PA01
gcgccguugccgaug

SEQ ID NO: 1405346 - RNA, 18 nt, Pseudomonas aeruginosa PA01
gcgccguuuucguaucac

SEQ ID NO: 1405347 - RNA, 23 nt, Pseudomonas aeruginosa PA01
gcgccguugccgguacucgccgg

SEQ ID NO: 1405348 - RNA, 18 nt, Pseudomonas aeruginosa PA01
gcgccguugcggcagcau

SEQ ID NO: 1405349 - RNA, 20 nt, Pseudomonas aeruginosa PA01
gcgccggaaguggcagcgcc

SEQ ID NO: 1405350 - RNA, 24 nt, Pseudomonas aeruginosa PA01
gcgccggaaguggcagcgccguug

SEQ ID NO: 1405351 - RNA, 16 nt, Pseudomonas aeruginosa PA01
gcgccggaaucgacgg

SEQ ID NO: 1405352 - RNA, 16 nt, Pseudomonas aeruginosa PA01
gcgccggacaggccac

SEQ ID NO: 1405353 - RNA, 21 nt, Pseudomonas aeruginosa PA01
gcgccggacaggccacccgcc

SEQ ID NO: 1405354 - RNA, 21 nt, Pseudomonas aeruginosa PA01
gcgccggaccaacugcgaacc

SEQ ID NO: 1405355 - RNA, 19 nt, Pseudomonas aeruginosa PA01
gcgccggaccagaucggcg

SEQ ID NO: 1405356 - RNA, 19 nt, Pseudomonas aeruginosa PA01
gcgccggaccagccggucc

SEQ ID NO: 1405357 - RNA, 15 nt, Pseudomonas aeruginosa PA01
gcgccggagcugguc

SEQ ID NO: 1405358 - RNA, 16 nt, Pseudomonas aeruginosa PA01
gcgccguggaucgccc

SEQ ID NO: 1405359 - RNA, 17 nt, Pseudomonas aeruginosa PA01
gcgccguggaucgcccg

SEQ ID NO: 1405360 - RNA, 17 nt, Pseudomonas aeruginosa PA01
gcgccguggcaccaggu

SEQ ID NO: 1405361 - RNA, 16 nt, Pseudomonas aeruginosa PA01
gcgccguucacgccug

SEQ ID NO: 1405362 - RNA, 19 nt, Pseudomonas aeruginosa PA01
gcgccguucacgccuggcg

SEQ ID NO: 1405363 - RNA, 13 nt, Pseudomonas aeruginosa PA01
gcgccucgcccca

SEQ ID NO: 1405364 - RNA, 13 nt, Pseudomonas aeruginosa PA01
gcgccucgccgag

SEQ ID NO: 1405365 - RNA, 15 nt, Pseudomonas aeruginosa PA01
gcgccucgccgagca

SEQ ID NO: 1405366 - RNA, 23 nt, Pseudomonas aeruginosa PA01
gcgccucgcaaaggucggcgaag

SEQ ID NO: 1405367 - RNA, 17 nt, Pseudomonas aeruginosa PA01
gcgccucccgcugaucg

SEQ ID NO: 1405368 - RNA, 21 nt, Pseudomonas aeruginosa PA01
gcgccucgaggaucuugcgcc

SEQ ID NO: 1405369 - RNA, 22 nt, Pseudomonas aeruginosa PA01
gcgccucgaucgccucgggcga

SEQ ID NO: 1405370 - RNA, 14 nt, Pseudomonas aeruginosa PA01
gcgccucgcgcaac

SEQ ID NO: 1405371 - RNA, 18 nt, Pseudomonas aeruginosa PA01
gcgccucgcgcaacgccg

SEQ ID NO: 1405372 - RNA, 19 nt, Pseudomonas aeruginosa PA01
gcgccucgcgcaacgccga

SEQ ID NO: 1405373 - RNA, 13 nt, Pseudomonas aeruginosa PA01
gcgccucggcauc

SEQ ID NO: 1405374 - RNA, 17 nt, Pseudomonas aeruginosa PA01
gcgccucggcaucgacc

SEQ ID NO: 1405375 - RNA, 13 nt, Pseudomonas aeruginosa PA01
gcgccuccggcag

SEQ ID NO: 1405376 - RNA, 14 nt, Pseudomonas aeruginosa PA01
gcgccuccucggcg

SEQ ID NO: 1405377 - RNA, 17 nt, Pseudomonas aeruginosa PA01
gcgccuccucuaccagg

SEQ ID NO: 1405378 - RNA, 21 nt, Pseudomonas aeruginosa PA01
gcgccuccucuaccaggcggu

SEQ ID NO: 1405379 - RNA, 13 nt, Pseudomonas aeruginosa PA01
gcgccucgaaggc

SEQ ID NO: 1405380 - RNA, 23 nt, Pseudomonas aeruginosa PA01
gcgccucgaccagaucggcaugg

SEQ ID NO: 1405381 - RNA, 17 nt, Pseudomonas aeruginosa PA01
gcgccucgaccucggcc

SEQ ID NO: 1405382 - RNA, 18 nt, Pseudomonas aeruginosa PA01
gcgccucgaccucggccg

SEQ ID NO: 1405383 - RNA, 17 nt, Pseudomonas aeruginosa PA01
gcgccucgaccuggcca

SEQ ID NO: 1405384 - RNA, 14 nt, Pseudomonas aeruginosa PA01
gcgccuccagcacc

SEQ ID NO: 1405385 - RNA, 16 nt, Pseudomonas aeruginosa PA01
gcgccuccagcgggcc

SEQ ID NO: 1405386 - RNA, 12 nt, Pseudomonas aeruginosa PA01
gcgccuccagga

SEQ ID NO: 1405387 - RNA, 22 nt, Pseudomonas aeruginosa PA01
gcgccuccaggaauccuccgcc

SEQ ID NO: 1405388 - RNA, 21 nt, Pseudomonas aeruginosa PA01
gcgccuccaggaccuugucgc

SEQ ID NO: 1405389 - RNA, 12 nt, Pseudomonas aeruginosa PA01
gcgccuccaggc

SEQ ID NO: 1405390 - RNA, 13 nt, Pseudomonas aeruginosa PA01
gcgccuccaggcg

SEQ ID NO: 1405391 - RNA, 18 nt, Pseudomonas aeruginosa PA01
gcgccuccaggcgcgccu

SEQ ID NO: 1405392 - RNA, 20 nt, Pseudomonas aeruginosa PA01
gcgccuccaggcgcgccugg

SEQ ID NO: 1405393 - RNA, 23 nt, Pseudomonas aeruginosa PA01
gcgccuccagguagaccuugccg

SEQ ID NO: 1405394 - RNA, 18 nt, Pseudomonas aeruginosa PA01
gcgccucguggaacagcg

SEQ ID NO: 1405395 - RNA, 22 nt, Pseudomonas aeruginosa PA01
gcgccucguggaacagcgcguc

SEQ ID NO: 1405396 - RNA, 17 nt, Pseudomonas aeruginosa PA01
gcgccucgucgcgccag

SEQ ID NO: 1405397 - RNA, 20 nt, Pseudomonas aeruginosa PA01
gcgccucgucgcgccaggcg

SEQ ID NO: 1405398 - RNA, 21 nt, Pseudomonas aeruginosa PA01
gcgccucgucgcgccaggcga

SEQ ID NO: 1405399 - RNA, 18 nt, Pseudomonas aeruginosa PA01
gcgccucgucggucggcg

SEQ ID NO: 1405400 - RNA, 17 nt, Pseudomonas aeruginosa PA01
gcgccucgucgacgccc

SEQ ID NO: 1405401 - RNA, 20 nt, Pseudomonas aeruginosa PA01
gcgccucgucgacgcccugg

SEQ ID NO: 1405402 - RNA, 17 nt, Pseudomonas aeruginosa PA01
gcgccucgucgacgcuc

SEQ ID NO: 1405403 - RNA, 15 nt, Pseudomonas aeruginosa PA01
gcgccucggcccugg

SEQ ID NO: 1405404 - RNA, 19 nt, Pseudomonas aeruginosa PA01
gcgccucggcccuggcggc

SEQ ID NO: 1405405 - RNA, 14 nt, Pseudomonas aeruginosa PA01
gcgccucgggccgg

SEQ ID NO: 1405406 - RNA, 16 nt, Pseudomonas aeruginosa PA01
gcgccucgggccggag

SEQ ID NO: 1405407 - RNA, 19 nt, Pseudomonas aeruginosa PA01
gcgccucgggccggagcag

SEQ ID NO: 1405408 - RNA, 22 nt, Pseudomonas aeruginosa PA01
gcgccucgggccggagcaggcc

SEQ ID NO: 1405409 - RNA, 14 nt, Pseudomonas aeruginosa PA01
gcgccuucaucgcc

SEQ ID NO: 1405410 - RNA, 18 nt, Pseudomonas aeruginosa PA01
gcgccuucaucgccaccu

SEQ ID NO: 1405411 - RNA, 19 nt, Pseudomonas aeruginosa PA01
gcgccuucaccguucccag

SEQ ID NO: 1405412 - RNA, 23 nt, Pseudomonas aeruginosa PA01
gcgccuucaccguucccagcagc

SEQ ID NO: 1405413 - RNA, 14 nt, Pseudomonas aeruginosa PA01
gcgccuucagcccc

SEQ ID NO: 1405414 - RNA, 15 nt, Pseudomonas aeruginosa PA01
gcgccuucagcccca

SEQ ID NO: 1405415 - RNA, 16 nt, Pseudomonas aeruginosa PA01
gcgccuucagcgccag

SEQ ID NO: 1405416 - RNA, 17 nt, Pseudomonas aeruginosa PA01
gcgccuucagcgccagc

SEQ ID NO: 1405417 - RNA, 18 nt, Pseudomonas aeruginosa PA01
gcgccuucagcgccagca

SEQ ID NO: 1405418 - RNA, 16 nt, Pseudomonas aeruginosa PA01
gcgccuucagcgccgc

SEQ ID NO: 1405419 - RNA, 18 nt, Pseudomonas aeruginosa PA01
gcgccuucagcgccgcca

SEQ ID NO: 1405420 - RNA, 20 nt, Pseudomonas aeruginosa PA01
gcgccuucagcgccgccagg

SEQ ID NO: 1405421 - RNA, 22 nt, Pseudomonas aeruginosa PA01
gcgccuucagcgccgccaggcc

SEQ ID NO: 1405422 - RNA, 15 nt, Pseudomonas aeruginosa PA01
gcgccuucagcgccu

SEQ ID NO: 1405423 - RNA, 17 nt, Pseudomonas aeruginosa PA01
gcgccugguauugcgcc

SEQ ID NO: 1405424 - RNA, 22 nt, Pseudomonas aeruginosa PA01
gcgccugguauugcgcccagag

SEQ ID NO: 1405425 - RNA, 12 nt, Pseudomonas aeruginosa PA01
gcgccuggucgg

SEQ ID NO: 1405426 - RNA, 13 nt, Pseudomonas aeruginosa PA01
gcgccuggucggc

SEQ ID NO: 1405427 - RNA, 14 nt, Pseudomonas aeruginosa PA01
gcgccuggucggcg

SEQ ID NO: 1405428 - RNA, 10 nt, Pseudomonas aeruginosa PA01
gcgccugguu

SEQ ID NO: 1405429 - RNA, 16 nt, Pseudomonas aeruginosa PA01
gccgggcggacgcugg

SEQ ID NO: 1405430 - RNA, 22 nt, Pseudomonas aeruginosa PA01
gccgggcggaugaccuguccag

SEQ ID NO: 1405431 - RNA, 14 nt, Pseudomonas aeruginosa PA01
gccgggcgcccggc

SEQ ID NO: 1405432 - RNA, 15 nt, Pseudomonas aeruginosa PA01
gccgggcggcgucgc

SEQ ID NO: 1405433 - RNA, 15 nt, Pseudomonas aeruginosa PA01
gccgggcggcggcgc

SEQ ID NO: 1405434 - RNA, 22 nt, Pseudomonas aeruginosa PA01
gccgggccagcuccagcaccgg

SEQ ID NO: 1405435 - RNA, 14 nt, Pseudomonas aeruginosa PA01
gccgggcccugggc

SEQ ID NO: 1405436 - RNA, 15 nt, Pseudomonas aeruginosa PA01
gccgggcccugggcc

SEQ ID NO: 1405437 - RNA, 16 nt, Pseudomonas aeruginosa PA01
gccgggcccugggccc

SEQ ID NO: 1405438 - RNA, 18 nt, Pseudomonas aeruginosa PA01
gccgggccgaucuucgcc

SEQ ID NO: 1405439 - RNA, 20 nt, Pseudomonas aeruginosa PA01
gccgggccgaucuucgccga

SEQ ID NO: 1405440 - RNA, 12 nt, Pseudomonas aeruginosa PA01
gccgggccgccu

SEQ ID NO: 1405441 - RNA, 17 nt, Pseudomonas aeruginosa PA01
gccgggccgccuugcgc

SEQ ID NO: 1405442 - RNA, 19 nt, Pseudomonas aeruginosa PA01
gccgggccggccagggcga

SEQ ID NO: 1405443 - RNA, 12 nt, Pseudomonas aeruginosa PA01
gccgggccucgg

SEQ ID NO: 1405444 - RNA, 13 nt, Pseudomonas aeruginosa PA01
gccgggcgagcug

SEQ ID NO: 1405445 - RNA, 17 nt, Pseudomonas aeruginosa PA01
gccgggcgagucgauca

SEQ ID NO: 1405446 - RNA, 20 nt, Pseudomonas aeruginosa PA01
gccgggcgagucgaucaggu

SEQ ID NO: 1405447 - RNA, 18 nt, Pseudomonas aeruginosa PA01
gccggccccaccagcaac

SEQ ID NO: 1405448 - RNA, 15 nt, Pseudomonas aeruginosa PA01
gccggcccauccgcc

SEQ ID NO: 1405449 - RNA, 20 nt, Pseudomonas aeruginosa PA01
gccggcccauccgccgcagg

SEQ ID NO: 1405450 - RNA, 12 nt, Pseudomonas aeruginosa PA01
gccgggcaacgc

SEQ ID NO: 1405451 - RNA, 17 nt, Pseudomonas aeruginosa PA01
gccgggcaacgccaggc

SEQ ID NO: 1405452 - RNA, 21 nt, Pseudomonas aeruginosa PA01
gccgggcaacgccaggccgcu

SEQ ID NO: 1405453 - RNA, 16 nt, Pseudomonas aeruginosa PA01
gccgggaugcucaccg

SEQ ID NO: 1405454 - RNA, 23 nt, Pseudomonas aeruginosa PA01
gccgggauuguugcggcggguca

SEQ ID NO: 1405455 - RNA, 20 nt, Pseudomonas aeruginosa PA01
gccgggcagugcgcccucga

SEQ ID NO: 1405456 - RNA, 20 nt, Pseudomonas aeruginosa PA01
gccgggcaucaugccgagca

SEQ ID NO: 1405457 - RNA, 21 nt, Pseudomonas aeruginosa PA01
gccgggcaucaugccgagcau

SEQ ID NO: 1405458 - RNA, 20 nt, Pseudomonas aeruginosa PA01
gccgggcaggccgaggccgg

SEQ ID NO: 1405459 - RNA, 19 nt, Pseudomonas aeruginosa PA01
gccgggcagacuucgccgu

SEQ ID NO: 1405460 - RNA, 22 nt, Pseudomonas aeruginosa PA01
gccgggcauucgcagcggcccc

SEQ ID NO: 1405461 - RNA, 18 nt, Pseudomonas aeruginosa PA01
gccgggcaacgcgcagag

SEQ ID NO: 1405462 - RNA, 23 nt, Pseudomonas aeruginosa PA01
gccgggcaacgcgcagaggcgcu

SEQ ID NO: 1405463 - RNA, 13 nt, Pseudomonas aeruginosa PA01
gccgggcaccguc

SEQ ID NO: 1405464 - RNA, 17 nt, Pseudomonas aeruginosa PA01
gccgggcaccccgagcg

SEQ ID NO: 1405465 - RNA, 23 nt, Pseudomonas aeruginosa PA01
gccgggucgccgcagcccuaggc

SEQ ID NO: 1405466 - RNA, 18 nt, Pseudomonas aeruginosa PA01
gccgggucguacaccaga

SEQ ID NO: 1405467 - RNA, 14 nt, Pseudomonas aeruginosa PA01
gccgggucgauggg

SEQ ID NO: 1405468 - RNA, 21 nt, Pseudomonas aeruginosa PA01
gccgggucgaccuugccgacg

SEQ ID NO: 1405469 - RNA, 22 nt, Pseudomonas aeruginosa PA01
gccgggucgaccuugccgacgc

SEQ ID NO: 1405470 - RNA, 13 nt, Pseudomonas aeruginosa PA01
gccgggugccggu

SEQ ID NO: 1405471 - RNA, 17 nt, Pseudomonas aeruginosa PA01
gccgggugcuaugcgcc

SEQ ID NO: 1405472 - RNA, 21 nt, Pseudomonas aeruginosa PA01
gccgggugcuaugcgccgggc

SEQ ID NO: 1405473 - RNA, 16 nt, Pseudomonas aeruginosa PA01
gccgggugaccgugcg

SEQ ID NO: 1405474 - RNA, 19 nt, Pseudomonas aeruginosa PA01
gccgggugaccgugcgggu

SEQ ID NO: 1405475 - RNA, 16 nt, Pseudomonas aeruginosa PA01
gccgggguugaguugc

SEQ ID NO: 1405476 - RNA, 23 nt, Pseudomonas aeruginosa PA01
gccgggguugaguugcaggccgg

SEQ ID NO: 1405477 - RNA, 21 nt, Pseudomonas aeruginosa PA01
gccgggguggaguaccaggcc

SEQ ID NO: 1405478 - RNA, 22 nt, Pseudomonas aeruginosa PA01
gccgggguggaguaccaggcca

SEQ ID NO: 1405479 - RNA, 19 nt, Pseudomonas aeruginosa PA01
gccgggggucgcggcgacc

SEQ ID NO: 1405480 - RNA, 15 nt, Pseudomonas aeruginosa PA01
gccgggguccgccgg

SEQ ID NO: 1405481 - RNA, 16 nt, Pseudomonas aeruginosa PA01
gccggggucaggccga

SEQ ID NO: 1405482 - RNA, 18 nt, Pseudomonas aeruginosa PA01
gccggggucaggccgagg

SEQ ID NO: 1405483 - RNA, 19 nt, Pseudomonas aeruginosa PA01
gccggggucaggccgaggc

SEQ ID NO: 1405484 - RNA, 18 nt, Pseudomonas aeruginosa PA01
gccgggucaucaccggca

SEQ ID NO: 1405485 - RNA, 20 nt, Pseudomonas aeruginosa PA01
gccggguccaccgcggccuc

SEQ ID NO: 1405486 - RNA, 23 nt, Pseudomonas aeruginosa PA01
gccggguccaccgcggccucgcu

SEQ ID NO: 1405487 - RNA, 22 nt, Pseudomonas aeruginosa PA01
gccgggucgacaugcaggccgg

SEQ ID NO: 1405488 - RNA, 23 nt, Pseudomonas aeruginosa PA01
gccgggucgacaugcaggccggc

SEQ ID NO: 1405489 - RNA, 12 nt, Pseudomonas aeruginosa PA01
gccgggucgacc

SEQ ID NO: 1405490 - RNA, 20 nt, Pseudomonas aeruginosa PA01
gccggguagcguuaucgccg

SEQ ID NO: 1405491 - RNA, 21 nt, Pseudomonas aeruginosa PA01
gccggguagcguuaucgccgg

SEQ ID NO: 1405492 - RNA, 16 nt, Pseudomonas aeruginosa PA01
gccgggcuucggugua

SEQ ID NO: 1405493 - RNA, 21 nt, Pseudomonas aeruginosa PA01
gccgggcugguucagcggguu

SEQ ID NO: 1405494 - RNA, 17 nt, Pseudomonas aeruginosa PA01
gccgggcuggccgucga

SEQ ID NO: 1405495 - RNA, 13 nt, Pseudomonas aeruginosa PA01
gccgggcuggccg

SEQ ID NO: 1405496 - RNA, 13 nt, Pseudomonas aeruginosa PA01
gccgggcugccga

SEQ ID NO: 1405497 - RNA, 21 nt, Pseudomonas aeruginosa PA01
gccggggaagauguucgccgc

SEQ ID NO: 1405498 - RNA, 21 nt, Pseudomonas aeruginosa PA01
gccgggcuuuuucauggcugg

SEQ ID NO: 1405499 - RNA, 23 nt, Pseudomonas aeruginosa PA01
gccgggcuuuuucaugggcgcgc

SEQ ID NO: 1405500 - RNA, 13 nt, Pseudomonas aeruginosa PA01
gccggggaacagg

SEQ ID NO: 1405501 - RNA, 14 nt, Pseudomonas aeruginosa PA01
gccggggaacaggu

SEQ ID NO: 1405502 - RNA, 20 nt, Pseudomonas aeruginosa PA01
gccgggcucugguagccgca

SEQ ID NO: 1405503 - RNA, 14 nt, Pseudomonas aeruginosa PA01
gccgggcuggccac

SEQ ID NO: 1405504 - RNA, 17 nt, Pseudomonas aeruginosa PA01
gccgggcuggccaccgc

SEQ ID NO: 1405505 - RNA, 23 nt, Pseudomonas aeruginosa PA01
gccgggcgugucgaggaaggcca

SEQ ID NO: 1405506 - RNA, 18 nt, Pseudomonas aeruginosa PA01
gccgggcgucugcccggu

SEQ ID NO: 1405507 - RNA, 20 nt, Pseudomonas aeruginosa PA01
gccgggcguuuucguugccg

SEQ ID NO: 1405508 - RNA, 20 nt, Pseudomonas aeruginosa PA01
gccgggcuagguuuccccgu

SEQ ID NO: 1405509 - RNA, 17 nt, Pseudomonas aeruginosa PA01
gccgggcucacucccgu

SEQ ID NO: 1405510 - RNA, 19 nt, Pseudomonas aeruginosa PA01
gccggggaucaggucgccg

SEQ ID NO: 1405511 - RNA, 23 nt, Pseudomonas aeruginosa PA01
gccggggaucaggucgccgcuga

SEQ ID NO: 1405512 - RNA, 15 nt, Pseudomonas aeruginosa PA01
gccggggcaggcaug

SEQ ID NO: 1405513 - RNA, 22 nt, Pseudomonas aeruginosa PA01
gccggggcaggcaugcggcccc

SEQ ID NO: 1405514 - RNA, 23 nt, Pseudomonas aeruginosa PA01
gccggggccuacugcuggacggc

SEQ ID NO: 1405515 - RNA, 15 nt, Pseudomonas aeruginosa PA01
gccggggccggcacc

SEQ ID NO: 1405516 - RNA, 19 nt, Pseudomonas aeruginosa PA01
gccgggggcggcgccuggu

SEQ ID NO: 1405517 - RNA, 14 nt, Pseudomonas aeruginosa PA01
gccggggcgcaggu

SEQ ID NO: 1405518 - RNA, 14 nt, Pseudomonas aeruginosa PA01
gccggggcgcgccc

SEQ ID NO: 1405519 - RNA, 13 nt, Pseudomonas aeruginosa PA01
gccggggcgugca

SEQ ID NO: 1405520 - RNA, 20 nt, Pseudomonas aeruginosa PA01
gccggggcucaggccuuggc

SEQ ID NO: 1405521 - RNA, 20 nt, Pseudomonas aeruginosa PA01
gccggggcggauucaggcgc

SEQ ID NO: 1405522 - RNA, 15 nt, Pseudomonas aeruginosa PA01
gccggggcgggccgc

SEQ ID NO: 1405523 - RNA, 18 nt, Pseudomonas aeruginosa PA01
gccggucaggcugcggcg

SEQ ID NO: 1405524 - RNA, 19 nt, Pseudomonas aeruginosa PA01
gccggucaggcugcggcgg

SEQ ID NO: 1405525 - RNA, 14 nt, Pseudomonas aeruginosa PA01
gccggucagguagg

SEQ ID NO: 1405526 - RNA, 21 nt, Pseudomonas aeruginosa PA01
gccggucagguaggcaucgac

SEQ ID NO: 1405527 - RNA, 22 nt, Pseudomonas aeruginosa PA01
gccggucugguagcgaaucugc

SEQ ID NO: 1405528 - RNA, 18 nt, Pseudomonas aeruginosa PA01
gccggucucgauggcagc

SEQ ID NO: 1405529 - RNA, 12 nt, Pseudomonas aeruginosa PA01
gccggucucggc

SEQ ID NO: 1405530 - RNA, 13 nt, Pseudomonas aeruginosa PA01
gccggucucggcg

SEQ ID NO: 1405531 - RNA, 22 nt, Pseudomonas aeruginosa PA01
gccggucggccuugaggcgggc

SEQ ID NO: 1405532 - RNA, 24 nt, Pseudomonas aeruginosa PA01
gccggucggccuugaggcgggcca

SEQ ID NO: 1405533 - RNA, 14 nt, Pseudomonas aeruginosa PA01
gccggucauugucg

SEQ ID NO: 1405534 - RNA, 17 nt, Pseudomonas aeruginosa PA01
gccggucgcgcucaggc

SEQ ID NO: 1405535 - RNA, 18 nt, Pseudomonas aeruginosa PA01
gccggucgcgcucaggcg

SEQ ID NO: 1405536 - RNA, 19 nt, Pseudomonas aeruginosa PA01
gccggucgcgcucaggcgc

SEQ ID NO: 1405537 - RNA, 22 nt, Pseudomonas aeruginosa PA01
gccggucgcgcucaggcgcagc

SEQ ID NO: 1405538 - RNA, 19 nt, Pseudomonas aeruginosa PA01
gccggucggaacgaccacg

SEQ ID NO: 1405539 - RNA, 20 nt, Pseudomonas aeruginosa PA01
gccggucggaacgaccacgc

SEQ ID NO: 1405540 - RNA, 19 nt, Pseudomonas aeruginosa PA01
gccgguccgacaaucagcg

SEQ ID NO: 1405541 - RNA, 23 nt, Pseudomonas aeruginosa PA01
gccgguccgacaaucagcggcgg

SEQ ID NO: 1405542 - RNA, 16 nt, Pseudomonas aeruginosa PA01
gccggguuucgucggu

SEQ ID NO: 1405543 - RNA, 22 nt, Pseudomonas aeruginosa PA01
gccgguaauuggccaggcucgc

SEQ ID NO: 1405544 - RNA, 23 nt, Pseudomonas aeruginosa PA01
gccgguaaugacgaucucgauga

SEQ ID NO: 1405545 - RNA, 13 nt, Pseudomonas aeruginosa PA01
gccggguucccag

SEQ ID NO: 1405546 - RNA, 22 nt, Pseudomonas aeruginosa PA01
gccggguucccaguugcugggc

SEQ ID NO: 1405547 - RNA, 18 nt, Pseudomonas aeruginosa PA01
gccggguucaucgacacc

SEQ ID NO: 1405548 - RNA, 16 nt, Pseudomonas aeruginosa PA01
gccggguuguccaggc

SEQ ID NO: 1405549 - RNA, 14 nt, Pseudomonas aeruginosa PA01
gccggguugccgcu

SEQ ID NO: 1405550 - RNA, 16 nt, Pseudomonas aeruginosa PA01
gccggguugccgcugg

SEQ ID NO: 1405551 - RNA, 19 nt, Pseudomonas aeruginosa PA01
gccgguaguucgcugaccg

SEQ ID NO: 1405552 - RNA, 17 nt, Pseudomonas aeruginosa PA01
gccgguacucgccgggc

SEQ ID NO: 1405553 - RNA, 14 nt, Pseudomonas aeruginosa PA01
gccgguacgcacca

SEQ ID NO: 1405554 - RNA, 18 nt, Pseudomonas aeruginosa PA01
gccgguacgcaccagcgg

SEQ ID NO: 1405555 - RNA, 14 nt, Pseudomonas aeruginosa PA01
gccgguagccggcg

SEQ ID NO: 1405556 - RNA, 16 nt, Pseudomonas aeruginosa PA01
gccgguagccggcgau

SEQ ID NO: 1405557 - RNA, 17 nt, Pseudomonas aeruginosa PA01
gccgguagccggcgauc

SEQ ID NO: 1405558 - RNA, 18 nt, Pseudomonas aeruginosa PA01
gccgguagccggcgauca

SEQ ID NO: 1405559 - RNA, 19 nt, Pseudomonas aeruginosa PA01
gccggucaaccgcgggcga

SEQ ID NO: 1405560 - RNA, 17 nt, Pseudomonas aeruginosa PA01
gccggucaauucgcgga

SEQ ID NO: 1405561 - RNA, 18 nt, Pseudomonas aeruginosa PA01
gccggucaccacuggaaa

SEQ ID NO: 1405562 - RNA, 20 nt, Pseudomonas aeruginosa PA01
gccggugcggguggucgccg

SEQ ID NO: 1405563 - RNA, 22 nt, Pseudomonas aeruginosa PA01
gccggugcggguggucgccgcc

SEQ ID NO: 1405564 - RNA, 20 nt, Pseudomonas aeruginosa PA01
gccggugccuucggcggcgc

SEQ ID NO: 1405565 - RNA, 15 nt, Pseudomonas aeruginosa PA01
gccggugcgaaccgg

SEQ ID NO: 1405566 - RNA, 18 nt, Pseudomonas aeruginosa PA01
gccggugcgaaccggccu

SEQ ID NO: 1405567 - RNA, 19 nt, Pseudomonas aeruginosa PA01
gccggugcgaaccggccuu

SEQ ID NO: 1405568 - RNA, 13 nt, Pseudomonas aeruginosa PA01
gccggugcggucg

SEQ ID NO: 1405569 - RNA, 16 nt, Pseudomonas aeruginosa PA01
gccggugcucggccug

SEQ ID NO: 1405570 - RNA, 18 nt, Pseudomonas aeruginosa PA01
gccggugcucggccugau

SEQ ID NO: 1405571 - RNA, 15 nt, Pseudomonas aeruginosa PA01
gccggugcuggugcg

SEQ ID NO: 1405572 - RNA, 21 nt, Pseudomonas aeruginosa PA01
gccggugcuggugcggccgau

SEQ ID NO: 1405573 - RNA, 22 nt, Pseudomonas aeruginosa PA01
gccggugcuggugcggccgaug

SEQ ID NO: 1405574 - RNA, 23 nt, Pseudomonas aeruginosa PA01
gccggugcuggugcggccgauga

SEQ ID NO: 1405575 - RNA, 13 nt, Pseudomonas aeruginosa PA01
gccggugcuggcg

SEQ ID NO: 1405576 - RNA, 14 nt, Pseudomonas aeruginosa PA01
gccgguggcgccca

SEQ ID NO: 1405577 - RNA, 19 nt, Pseudomonas aeruginosa PA01
gccgguggcgcccagccag

SEQ ID NO: 1405578 - RNA, 23 nt, Pseudomonas aeruginosa PA01
gccgguggcgcccagccagagcg

SEQ ID NO: 1405579 - RNA, 13 nt, Pseudomonas aeruginosa PA01
gccgguggccagg

SEQ ID NO: 1405580 - RNA, 19 nt, Pseudomonas aeruginosa PA01
gccgguggccaggacgcug

SEQ ID NO: 1405581 - RNA, 14 nt, Pseudomonas aeruginosa PA01
gccgguggccaggc

SEQ ID NO: 1405582 - RNA, 19 nt, Pseudomonas aeruginosa PA01
gccgguggcguuauccgcc

SEQ ID NO: 1405583 - RNA, 20 nt, Pseudomonas aeruginosa PA01
gccgguggcguuauucgccc

SEQ ID NO: 1405584 - RNA, 20 nt, Pseudomonas aeruginosa PA01
gccggugugacggccggggc

SEQ ID NO: 1405585 - RNA, 16 nt, Pseudomonas aeruginosa PA01
gccggugccgccggcc

SEQ ID NO: 1405586 - RNA, 14 nt, Pseudomonas aeruginosa PA01
gccggugccgcccu

SEQ ID NO: 1405587 - RNA, 16 nt, Pseudomonas aeruginosa PA01
gccggugccgcccugg

SEQ ID NO: 1405588 - RNA, 17 nt, Pseudomonas aeruginosa PA01
gccggugccgcccuggg

SEQ ID NO: 1405589 - RNA, 14 nt, Pseudomonas aeruginosa PA01
gccggugccggcgg

SEQ ID NO: 1405590 - RNA, 15 nt, Pseudomonas aeruginosa PA01
gccggugccggcggc

SEQ ID NO: 1405591 - RNA, 22 nt, Pseudomonas aeruginosa PA01
gccggugcaugaaggcgcugag

SEQ ID NO: 1405592 - RNA, 15 nt, Pseudomonas aeruginosa PA01
gccggugccaggacc

SEQ ID NO: 1405593 - RNA, 19 nt, Pseudomonas aeruginosa PA01
gccggugccaggaccagcc

SEQ ID NO: 1405594 - RNA, 19 nt, Pseudomonas aeruginosa PA01
gccggugccauacagcgcc

SEQ ID NO: 1405595 - RNA, 17 nt, Pseudomonas aeruginosa PA01
gccggugaucgagccgc

SEQ ID NO: 1405596 - RNA, 20 nt, Pseudomonas aeruginosa PA01
gccggugauguaggacgccu

SEQ ID NO: 1405597 - RNA, 15 nt, Pseudomonas aeruginosa PA01
gccggugaugucggc

SEQ ID NO: 1405598 - RNA, 13 nt, Pseudomonas aeruginosa PA01
gccggugcaccag

SEQ ID NO: 1405599 - RNA, 15 nt, Pseudomonas aeruginosa PA01
gccggugcaccaggc

SEQ ID NO: 1405600 - RNA, 19 nt, Pseudomonas aeruginosa PA01
gccggugcaccaggcgaug

SEQ ID NO: 1405601 - RNA, 23 nt, Pseudomonas aeruginosa PA01
gccggugcagaagacgcccagca

SEQ ID NO: 1405602 - RNA, 22 nt, Pseudomonas aeruginosa PA01
gccggugacccacuccggcagg

SEQ ID NO: 1405603 - RNA, 17 nt, Pseudomonas aeruginosa PA01
gccggugacgcugcuca

SEQ ID NO: 1405604 - RNA, 17 nt, Pseudomonas aeruginosa PA01
gccggugaggcgcagca

SEQ ID NO: 1405605 - RNA, 21 nt, Pseudomonas aeruginosa PA01
gccggugaggcgcagcagcgc

SEQ ID NO: 1405606 - RNA, 23 nt, Pseudomonas aeruginosa PA01
gccggugaggcgcagcagcgcca

SEQ ID NO: 1405607 - RNA, 17 nt, Pseudomonas aeruginosa PA01
gccggugaucucgcggc

SEQ ID NO: 1405608 - RNA, 18 nt, Pseudomonas aeruginosa PA01
gccggucuugccggcugc

SEQ ID NO: 1405609 - RNA, 20 nt, Pseudomonas aeruginosa PA01
gccggucuucacgccuugcu

SEQ ID NO: 1405610 - RNA, 23 nt, Pseudomonas aeruginosa PA01
gccggucuucacgccuugcugcg

SEQ ID NO: 1405611 - RNA, 17 nt, Pseudomonas aeruginosa PA01
gccggugacauucgaca

SEQ ID NO: 1405612 - RNA, 20 nt, Pseudomonas aeruginosa PA01
gccggugacauucgacagca

SEQ ID NO: 1405613 - RNA, 13 nt, Pseudomonas aeruginosa PA01
gccggugaacagg

SEQ ID NO: 1405614 - RNA, 14 nt, Pseudomonas aeruginosa PA01
gccggugaacaggu

SEQ ID NO: 1405615 - RNA, 17 nt, Pseudomonas aeruginosa PA01
gccggugaacagguagc

SEQ ID NO: 1405616 - RNA, 22 nt, Pseudomonas aeruginosa PA01
gccggugaacagguagcuggaa

SEQ ID NO: 1405617 - RNA, 17 nt, Pseudomonas aeruginosa PA01
gccggugacgaaaccgg

SEQ ID NO: 1405618 - RNA, 23 nt, Pseudomonas aeruginosa PA01
gccggugacgaaaccggcguccu

SEQ ID NO: 1405619 - RNA, 18 nt, Pseudomonas aeruginosa PA01
gccgucacggccuccggu

SEQ ID NO: 1405620 - RNA, 23 nt, Pseudomonas aeruginosa PA01
gccgucacuugaagucccauugc

SEQ ID NO: 1405621 - RNA, 14 nt, Pseudomonas aeruginosa PA01
gccgucagacgcgg

SEQ ID NO: 1405622 - RNA, 16 nt, Pseudomonas aeruginosa PA01
gccguccaccagccag

SEQ ID NO: 1405623 - RNA, 18 nt, Pseudomonas aeruginosa PA01
gccguccaccagccagcu

SEQ ID NO: 1405624 - RNA, 20 nt, Pseudomonas aeruginosa PA01
gccguccaccagccagcucg

SEQ ID NO: 1405625 - RNA, 14 nt, Pseudomonas aeruginosa PA01
gccgucaccagcag

SEQ ID NO: 1405626 - RNA, 15 nt, Pseudomonas aeruginosa PA01
gccgucaccagcagc

SEQ ID NO: 1405627 - RNA, 15 nt, Pseudomonas aeruginosa PA01
gccguauccgcggca

SEQ ID NO: 1405628 - RNA, 20 nt, Pseudomonas aeruginosa PA01
gccguauccgcggcaggggc

SEQ ID NO: 1405629 - RNA, 21 nt, Pseudomonas aeruginosa PA01
gccguauccgcggcaggggcu

SEQ ID NO: 1405630 - RNA, 16 nt, Pseudomonas aeruginosa PA01
gccguccugcaacugc

SEQ ID NO: 1405631 - RNA, 18 nt, Pseudomonas aeruginosa PA01
gccguccugcaacugcuc

SEQ ID NO: 1405632 - RNA, 15 nt, Pseudomonas aeruginosa PA01
gccguccugcggccg

SEQ ID NO: 1405633 - RNA, 16 nt, Pseudomonas aeruginosa PA01
gccguccugcggccgc

SEQ ID NO: 1405634 - RNA, 17 nt, Pseudomonas aeruginosa PA01
gccguccugcggccgca

SEQ ID NO: 1405635 - RNA, 14 nt, Pseudomonas aeruginosa PA01
gccguccucgucga

SEQ ID NO: 1405636 - RNA, 17 nt, Pseudomonas aeruginosa PA01
gccguccuugucgcagc

SEQ ID NO: 1405637 - RNA, 22 nt, Pseudomonas aeruginosa PA01
gccguccuugucgcagcggccg

SEQ ID NO: 1405638 - RNA, 14 nt, Pseudomonas aeruginosa PA01
gccguccuucagga

SEQ ID NO: 1405639 - RNA, 14 nt, Pseudomonas aeruginosa PA01
gccguccugcuuga

SEQ ID NO: 1405640 - RNA, 15 nt, Pseudomonas aeruginosa PA01
gccgucgaacagcag

SEQ ID NO: 1405641 - RNA, 20 nt, Pseudomonas aeruginosa PA01
gccgucgaacagcagcucgc

SEQ ID NO: 1405642 - RNA, 23 nt, Pseudomonas aeruginosa PA01
gccgucgacacugauauccgcuc

SEQ ID NO: 1405643 - RNA, 22 nt, Pseudomonas aeruginosa PA01
gccgucgaucagguaggccggc

SEQ ID NO: 1405644 - RNA, 18 nt, Pseudomonas aeruginosa PA01
gccgucgaagggcacgcc

SEQ ID NO: 1405645 - RNA, 22 nt, Pseudomonas aeruginosa PA01
gccgucgaagggcacgccgcuc

SEQ ID NO: 1405646 - RNA, 14 nt, Pseudomonas aeruginosa PA01
gccguccgucggca

SEQ ID NO: 1405647 - RNA, 15 nt, Pseudomonas aeruginosa PA01
gccguccgucggcag

SEQ ID NO: 1405648 - RNA, 20 nt, Pseudomonas aeruginosa PA01
gccguccgucggcaguggug

SEQ ID NO: 1405649 - RNA, 13 nt, Pseudomonas aeruginosa PA01
gccguccgccagg

SEQ ID NO: 1405650 - RNA, 14 nt, Pseudomonas aeruginosa PA01
gccguccgccaggu

SEQ ID NO: 1405651 - RNA, 22 nt, Pseudomonas aeruginosa PA01
gccguccgcccaguucgccggc

SEQ ID NO: 1405652 - RNA, 13 nt, Pseudomonas aeruginosa PA01
gccguccagccgg

SEQ ID NO: 1405653 - RNA, 15 nt, Pseudomonas aeruginosa PA01
gccguccagccggcg

SEQ ID NO: 1405654 - RNA, 16 nt, Pseudomonas aeruginosa PA01
gccguccagccggcgc

SEQ ID NO: 1405655 - RNA, 22 nt, Pseudomonas aeruginosa PA01
gccgucuuccucgaaggucgcg

SEQ ID NO: 1405656 - RNA, 14 nt, Pseudomonas aeruginosa PA01
gccgucuccaggcg

SEQ ID NO: 1405657 - RNA, 17 nt, Pseudomonas aeruginosa PA01
gccgugaaaagcggcgu

SEQ ID NO: 1405658 - RNA, 20 nt, Pseudomonas aeruginosa PA01
gccgugaaaagcggcgugca

SEQ ID NO: 1405659 - RNA, 15 nt, Pseudomonas aeruginosa PA01
gccgucuugccgcug

SEQ ID NO: 1405660 - RNA, 17 nt, Pseudomonas aeruginosa PA01
gccgucuugccgcugcg

SEQ ID NO: 1405661 - RNA, 20 nt, Pseudomonas aeruginosa PA01
gccgucuugccgcugcgcgc

SEQ ID NO: 1405662 - RNA, 21 nt, Pseudomonas aeruginosa PA01
gccgugaagcacggugacacc

SEQ ID NO: 1405663 - RNA, 16 nt, Pseudomonas aeruginosa PA01
gccgugaucaccugga

SEQ ID NO: 1405664 - RNA, 22 nt, Pseudomonas aeruginosa PA01
gccgugaucaccuggaucgcca

SEQ ID NO: 1405665 - RNA, 23 nt, Pseudomonas aeruginosa PA01
gccgugcaacuggguugccaggu

SEQ ID NO: 1405666 - RNA, 16 nt, Pseudomonas aeruginosa PA01
gccgugaggcgcgcgc

SEQ ID NO: 1405667 - RNA, 17 nt, Pseudomonas aeruginosa PA01
gccgugaggcgcgcgcc

SEQ ID NO: 1405668 - RNA, 19 nt, Pseudomonas aeruginosa PA01
gccgugaggcgcgcgccga

SEQ ID NO: 1405669 - RNA, 19 nt, Pseudomonas aeruginosa PA01
gccgugacgaggggcugcg

SEQ ID NO: 1405670 - RNA, 14 nt, Pseudomonas aeruginosa PA01
gccgucgcgcacca

SEQ ID NO: 1405671 - RNA, 17 nt, Pseudomonas aeruginosa PA01
gccgucgcgcaccaccc

SEQ ID NO: 1405672 - RNA, 13 nt, Pseudomonas aeruginosa PA01
gccgucgcggaag

SEQ ID NO: 1405673 - RNA, 19 nt, Pseudomonas aeruginosa PA01
gccgucgcggaagccgugc

SEQ ID NO: 1405674 - RNA, 14 nt, Pseudomonas aeruginosa PA01
gccgucguccgggu

SEQ ID NO: 1405675 - RNA, 13 nt, Pseudomonas aeruginosa PA01
gccgucgcugccg

SEQ ID NO: 1405676 - RNA, 15 nt, Pseudomonas aeruginosa PA01
gccgucgcggccauc

SEQ ID NO: 1405677 - RNA, 16 nt, Pseudomonas aeruginosa PA01
gccgucguagcgcagc

SEQ ID NO: 1405678 - RNA, 17 nt, Pseudomonas aeruginosa PA01
gccgucguagcgcagcg

SEQ ID NO: 1405679 - RNA, 23 nt, Pseudomonas aeruginosa PA01
gccgucguagcgcagcggcaggc

SEQ ID NO: 1405680 - RNA, 23 nt, Pseudomonas aeruginosa PA01
gccgucgguguccgcggugccgc

SEQ ID NO: 1405681 - RNA, 18 nt, Pseudomonas aeruginosa PA01
gccgugccucagagucgc

SEQ ID NO: 1405682 - RNA, 14 nt, Pseudomonas aeruginosa PA01
gccgugccggucgc

SEQ ID NO: 1405683 - RNA, 20 nt, Pseudomonas aeruginosa PA01
gccgugcggcguucgccgcg

SEQ ID NO: 1405684 - RNA, 13 nt, Pseudomonas aeruginosa PA01
gccguucugugcg

SEQ ID NO: 1405685 - RNA, 19 nt, Pseudomonas aeruginosa PA01
gccguucugugcggcgaug

SEQ ID NO: 1405686 - RNA, 22 nt, Pseudomonas aeruginosa PA01
gccgugcucgaugaucgacugc

SEQ ID NO: 1405687 - RNA, 12 nt, Pseudomonas aeruginosa PA01
gccgugcggcgu

SEQ ID NO: 1405688 - RNA, 20 nt, Pseudomonas aeruginosa PA01
gccgugcgcuccgccaggcc

SEQ ID NO: 1405689 - RNA, 21 nt, Pseudomonas aeruginosa PA01
gccgugcgcuccgccaggccg

SEQ ID NO: 1405690 - RNA, 22 nt, Pseudomonas aeruginosa PA01
gccgugcggagggucaggccga

SEQ ID NO: 1405691 - RNA, 18 nt, Pseudomonas aeruginosa PA01
gccguugccgaugccgga

SEQ ID NO: 1405692 - RNA, 13 nt, Pseudomonas aeruginosa PA01
gccguugcgcagg

SEQ ID NO: 1405693 - RNA, 14 nt, Pseudomonas aeruginosa PA01
gccguugcgcaggc

SEQ ID NO: 1405694 - RNA, 15 nt, Pseudomonas aeruginosa PA01
gccguugcgcaggcg

SEQ ID NO: 1405695 - RNA, 23 nt, Pseudomonas aeruginosa PA01
gccguucuuguugagcuggccga

SEQ ID NO: 1405696 - RNA, 15 nt, Pseudomonas aeruginosa PA01
gccguugaaacgcuc

SEQ ID NO: 1405697 - RNA, 20 nt, Pseudomonas aeruginosa PA01
gccguugaaacgcucggcgu

SEQ ID NO: 1405698 - RNA, 20 nt, Pseudomonas aeruginosa PA01
gccguugaccagcgcgucga

SEQ ID NO: 1405699 - RNA, 14 nt, Pseudomonas aeruginosa PA01
gccguugcaggccc

SEQ ID NO: 1405700 - RNA, 19 nt, Pseudomonas aeruginosa PA01
gccguugaugacgaacugc

SEQ ID NO: 1405701 - RNA, 16 nt, Pseudomonas aeruginosa PA01
gccguugaggccgucg

SEQ ID NO: 1405702 - RNA, 19 nt, Pseudomonas aeruginosa PA01
gccguugaggccgucgaag

SEQ ID NO: 1405703 - RNA, 17 nt, Pseudomonas aeruginosa PA01
gccuagacccugggcca

SEQ ID NO: 1405704 - RNA, 19 nt, Pseudomonas aeruginosa PA01
gccucaacgaccgcccagg

SEQ ID NO: 1405705 - RNA, 20 nt, Pseudomonas aeruginosa PA01
gccucaacgaccgcccaggc

SEQ ID NO: 1405706 - RNA, 18 nt, Pseudomonas aeruginosa PA01
gccuauccacgacgucgg

SEQ ID NO: 1405707 - RNA, 22 nt, Pseudomonas aeruginosa PA01
gccuauccgugacgucggcggc

SEQ ID NO: 1405708 - RNA, 17 nt, Pseudomonas aeruginosa PA01
gccguugcucacgccga

SEQ ID NO: 1405709 - RNA, 18 nt, Pseudomonas aeruginosa PA01
gccguugcggcagcaucc

SEQ ID NO: 1405710 - RNA, 19 nt, Pseudomonas aeruginosa PA01
gccguuggccuucacuucg

SEQ ID NO: 1405711 - RNA, 16 nt, Pseudomonas aeruginosa PA01
gccguuggcgaggacu

SEQ ID NO: 1405712 - RNA, 15 nt, Pseudomonas aeruginosa PA01
gccguuggccagcag

SEQ ID NO: 1405713 - RNA, 18 nt, Pseudomonas aeruginosa PA01
gccguuguagaucggcag

SEQ ID NO: 1405714 - RNA, 20 nt, Pseudomonas aeruginosa PA01
gccguuguagaucggcagca

SEQ ID NO: 1405715 - RNA, 19 nt, Pseudomonas aeruginosa PA01
gccguuguucaggcgcgcg

SEQ ID NO: 1405716 - RNA, 21 nt, Pseudomonas aeruginosa PA01
gccuacuucucgacgaaggcg

SEQ ID NO: 1405717 - RNA, 23 nt, Pseudomonas aeruginosa PA01
gccuacuucucgacgaaggcgcg

SEQ ID NO: 1405718 - RNA, 16 nt, Pseudomonas aeruginosa PA01
gccuacuugaucagcc

SEQ ID NO: 1405719 - RNA, 19 nt, Pseudomonas aeruginosa PA01
gccuacuugaucagccgca

SEQ ID NO: 1405720 - RNA, 22 nt, Pseudomonas aeruginosa PA01
gccuacuugaucagccgcaggc

SEQ ID NO: 1405721 - RNA, 13 nt, Pseudomonas aeruginosa PA01
gccucgcgugcgc

SEQ ID NO: 1405722 - RNA, 16 nt, Pseudomonas aeruginosa PA01
gccucgcgcucggcgg

SEQ ID NO: 1405723 - RNA, 19 nt, Pseudomonas aeruginosa PA01
gccucgcgcucggcggccu

SEQ ID NO: 1405724 - RNA, 18 nt, Pseudomonas aeruginosa PA01
gccucgcggaccucgggc

SEQ ID NO: 1405725 - RNA, 13 nt, Pseudomonas aeruginosa PA01
gccucgcuggcga

SEQ ID NO: 1405726 - RNA, 13 nt, Pseudomonas aeruginosa PA01
gccucgcuggcgu

SEQ ID NO: 1405727 - RNA, 18 nt, Pseudomonas aeruginosa PA01
gccucgcuggcguucucc

SEQ ID NO: 1405728 - RNA, 16 nt, Pseudomonas aeruginosa PA01
gccucgcugggcgggc

SEQ ID NO: 1405729 - RNA, 17 nt, Pseudomonas aeruginosa PA01
gccucgcugggcgggcg

SEQ ID NO: 1405730 - RNA, 20 nt, Pseudomonas aeruginosa PA01
gccucggaaucggcgaucgg

SEQ ID NO: 1405731 - RNA, 15 nt, Pseudomonas aeruginosa PA01
gccucgcugccgccg

SEQ ID NO: 1405732 - RNA, 19 nt, Pseudomonas aeruginosa PA01
gccucgcugccgccgcaga

SEQ ID NO: 1405733 - RNA, 14 nt, Pseudomonas aeruginosa PA01
gccucgcugccugg

SEQ ID NO: 1405734 - RNA, 11 nt, Pseudomonas aeruginosa PA01
gccucgcugcg

SEQ ID NO: 1405735 - RNA, 13 nt, Pseudomonas aeruginosa PA01
gccucgcugcgca

SEQ ID NO: 1405736 - RNA, 15 nt, Pseudomonas aeruginosa PA01
gccucgcugcgcaga

SEQ ID NO: 1405737 - RNA, 23 nt, Pseudomonas aeruginosa PA01
gccucgcugcgcagaugcggggc

SEQ ID NO: 1405738 - RNA, 15 nt, Pseudomonas aeruginosa PA01
gccucgccuucgucc

SEQ ID NO: 1405739 - RNA, 18 nt, Pseudomonas aeruginosa PA01
gccucgccggucgcgcuc

SEQ ID NO: 1405740 - RNA, 17 nt, Pseudomonas aeruginosa PA01
gccucgcgcaacgccga

SEQ ID NO: 1405741 - RNA, 19 nt, Pseudomonas aeruginosa PA01
gccucgcgcaacgccgacg

SEQ ID NO: 1405742 - RNA, 23 nt, Pseudomonas aeruginosa PA01
gccucgcgcaacgccgacggcgu

SEQ ID NO: 1405743 - RNA, 20 nt, Pseudomonas aeruginosa PA01
gccucgcgcaacgccuugcc

SEQ ID NO: 1405744 - RNA, 20 nt, Pseudomonas aeruginosa PA01
gccucgcgcaacugcggggc

SEQ ID NO: 1405745 - RNA, 22 nt, Pseudomonas aeruginosa PA01
gccucgcgccagagaucgccca

SEQ ID NO: 1405746 - RNA, 18 nt, Pseudomonas aeruginosa PA01
gccucgcgccgcgccagc

SEQ ID NO: 1405747 - RNA, 12 nt, Pseudomonas aeruginosa PA01
gccucgcgccgu

SEQ ID NO: 1405748 - RNA, 19 nt, Pseudomonas aeruginosa PA01
gccucgcgcguggccgcca

SEQ ID NO: 1405749 - RNA, 18 nt, Pseudomonas aeruginosa PA01
gccucgaggucggccugg

SEQ ID NO: 1405750 - RNA, 19 nt, Pseudomonas aeruginosa PA01
gccucgaggucggccuggc

SEQ ID NO: 1405751 - RNA, 18 nt, Pseudomonas aeruginosa PA01
gccucgaucgccucgggc

SEQ ID NO: 1405752 - RNA, 20 nt, Pseudomonas aeruginosa PA01
gccucgaucgccucgggcga

SEQ ID NO: 1405753 - RNA, 14 nt, Pseudomonas aeruginosa PA01
gccucgaucucguc

SEQ ID NO: 1405754 - RNA, 16 nt, Pseudomonas aeruginosa PA01
gccucgaucucguccu

SEQ ID NO: 1405755 - RNA, 22 nt, Pseudomonas aeruginosa PA01
gccucgaucucguccucggcgu

SEQ ID NO: 1405756 - RNA, 16 nt, Pseudomonas aeruginosa PA01
gccucgaugaucgccg

SEQ ID NO: 1405757 - RNA, 20 nt, Pseudomonas aeruginosa PA01
gccucgaggaacaggucgac

SEQ ID NO: 1405758 - RNA, 21 nt, Pseudomonas aeruginosa PA01
gccucgaugugcuugagucgc

SEQ ID NO: 1405759 - RNA, 17 nt, Pseudomonas aeruginosa PA01
gccucgcaaaggucggc

SEQ ID NO: 1405760 - RNA, 18 nt, Pseudomonas aeruginosa PA01
gccucgcaaaggucggcg

SEQ ID NO: 1405761 - RNA, 20 nt, Pseudomonas aeruginosa PA01
gccucgcaaaggucggcgaa

SEQ ID NO: 1405762 - RNA, 23 nt, Pseudomonas aeruginosa PA01
gccucgcaaaggucggcgaaggc

SEQ ID NO: 1405763 - RNA, 16 nt, Pseudomonas aeruginosa PA01
gccucgcagagcgcca

SEQ ID NO: 1405764 - RNA, 18 nt, Pseudomonas aeruginosa PA01
gccucgcagagcgccagc

SEQ ID NO: 1405765 - RNA, 21 nt, Pseudomonas aeruginosa PA01
gccucgcagagcgccagccag

SEQ ID NO: 1405766 - RNA, 22 nt, Pseudomonas aeruginosa PA01
gccucgcagagcgccagccagc

SEQ ID NO: 1405767 - RNA, 13 nt, Pseudomonas aeruginosa PA01
gccucgccgcccg

SEQ ID NO: 1405768 - RNA, 14 nt, Pseudomonas aeruginosa PA01
gccucgccgcccga

SEQ ID NO: 1405769 - RNA, 11 nt, Pseudomonas aeruginosa PA01
gccucgccgcg

SEQ ID NO: 1405770 - RNA, 14 nt, Pseudomonas aeruginosa PA01
gccucgccgcggca

SEQ ID NO: 1405771 - RNA, 17 nt, Pseudomonas aeruginosa PA01
gccucgaccucggccgc

SEQ ID NO: 1405772 - RNA, 15 nt, Pseudomonas aeruginosa PA01
gccucgaccuggcca

SEQ ID NO: 1405773 - RNA, 21 nt, Pseudomonas aeruginosa PA01
gccucgaccuggccacgcccg

SEQ ID NO: 1405774 - RNA, 20 nt, Pseudomonas aeruginosa PA01
gccucgaccaucggcggcgg

SEQ ID NO: 1405775 - RNA, 18 nt, Pseudomonas aeruginosa PA01
gccucgaccccggaaagg

SEQ ID NO: 1405776 - RNA, 16 nt, Pseudomonas aeruginosa PA01
gccucgaccagcgccg

SEQ ID NO: 1405777 - RNA, 17 nt, Pseudomonas aeruginosa PA01
gccucgaccagcgccgc

SEQ ID NO: 1405778 - RNA, 19 nt, Pseudomonas aeruginosa PA01
gccucgaccagcgccgcgg

SEQ ID NO: 1405779 - RNA, 22 nt, Pseudomonas aeruginosa PA01
gccucgaccagcgccgcggcga

SEQ ID NO: 1405780 - RNA, 23 nt, Pseudomonas aeruginosa PA01
gccucgaggaucuugcgcccggc

SEQ ID NO: 1405781 - RNA, 17 nt, Pseudomonas aeruginosa PA01
gccucgagcaucuccgg

SEQ ID NO: 1405782 - RNA, 17 nt, Pseudomonas aeruginosa PA01
gccucgacgcagagcgc

SEQ ID NO: 1405783 - RNA, 14 nt, Pseudomonas aeruginosa PA01
gccucgacgcucuc

SEQ ID NO: 1405784 - RNA, 18 nt, Pseudomonas aeruginosa PA01
gccuccugcaacgccugg

SEQ ID NO: 1405785 - RNA, 15 nt, Pseudomonas aeruginosa PA01
gccucgaacauggcc

SEQ ID NO: 1405786 - RNA, 20 nt, Pseudomonas aeruginosa PA01
gccucgaacauggccaccga

SEQ ID NO: 1405787 - RNA, 19 nt, Pseudomonas aeruginosa PA01
gccucgaccagaucggcau

SEQ ID NO: 1405788 - RNA, 16 nt, Pseudomonas aeruginosa PA01
gccucgaaggucagcc

SEQ ID NO: 1405789 - RNA, 15 nt, Pseudomonas aeruginosa PA01
gccucgaagcggauc

SEQ ID NO: 1405790 - RNA, 22 nt, Pseudomonas aeruginosa PA01
gccucgaagcggaucucgucgc

SEQ ID NO: 1405791 - RNA, 15 nt, Pseudomonas aeruginosa PA01
gccucgaaggccggc

SEQ ID NO: 1405792 - RNA, 16 nt, Pseudomonas aeruginosa PA01
gccucgaaggccucgg

SEQ ID NO: 1405793 - RNA, 17 nt, Pseudomonas aeruginosa PA01
gccucgaaggccucggu

SEQ ID NO: 1405794 - RNA, 23 nt, Pseudomonas aeruginosa PA01
gccucgaagaaaaggcccggcgu

SEQ ID NO: 1405795 - RNA, 15 nt, Pseudomonas aeruginosa PA01
gccuccuggcggcgu

SEQ ID NO: 1405796 - RNA, 21 nt, Pseudomonas aeruginosa PA01
gccuccuggcggcguggcacc

SEQ ID NO: 1405797 - RNA, 20 nt, Pseudomonas aeruginosa PA01
gccuccgggcggaggcgagg

SEQ ID NO: 1405798 - RNA, 19 nt, Pseudomonas aeruginosa PA01
gccuccuccggcucgcuga

SEQ ID NO: 1405799 - RNA, 21 nt, Pseudomonas aeruginosa PA01
gccuccggcacgcugccgccg

SEQ ID NO: 1405800 - RNA, 22 nt, Pseudomonas aeruginosa PA01
gccuccggcacgcugccgccga

SEQ ID NO: 1405801 - RNA, 13 nt, Pseudomonas aeruginosa PA01
gccuccggcagcg

SEQ ID NO: 1405802 - RNA, 14 nt, Pseudomonas aeruginosa PA01
gccuccgcucugcu

SEQ ID NO: 1405803 - RNA, 20 nt, Pseudomonas aeruginosa PA01
gccuccgcucugcuggccac

SEQ ID NO: 1405804 - RNA, 17 nt, Pseudomonas aeruginosa PA01
gccucagaacugcucgg

SEQ ID NO: 1405805 - RNA, 20 nt, Pseudomonas aeruginosa PA01
gccucagaacugcucggcgu

SEQ ID NO: 1405806 - RNA, 23 nt, Pseudomonas aeruginosa PA01
gccucagaacugcucggcgucca

SEQ ID NO: 1405807 - RNA, 23 nt, Pseudomonas aeruginosa PA01
gccucagaaguauuucaaccagg

SEQ ID NO: 1405808 - RNA, 16 nt, Pseudomonas aeruginosa PA01
gccucagagucgcacc

SEQ ID NO: 1405809 - RNA, 13 nt, Pseudomonas aeruginosa PA01
gccucaccccacg

SEQ ID NO: 1405810 - RNA, 23 nt, Pseudomonas aeruginosa PA01
gccucaccccacgggcgacccag

SEQ ID NO: 1405811 - RNA, 13 nt, Pseudomonas aeruginosa PA01
gccucacccugcu

SEQ ID NO: 1405812 - RNA, 18 nt, Pseudomonas aeruginosa PA01
gccucacccugcugggcg

SEQ ID NO: 1405813 - RNA, 22 nt, Pseudomonas aeruginosa PA01
gccugccguuuuacucgucgcc

SEQ ID NO: 1405814 - RNA, 13 nt, Pseudomonas aeruginosa PA01
gccucgcugagca

SEQ ID NO: 1405815 - RNA, 20 nt, Pseudomonas aeruginosa PA01
gccucgcuagucuuccugca

SEQ ID NO: 1405816 - RNA, 22 nt, Pseudomonas aeruginosa PA01
gccucgcuagucuuccugcacg

SEQ ID NO: 1405817 - RNA, 16 nt, Pseudomonas aeruginosa PA01
gccucggagaacagca

SEQ ID NO: 1405818 - RNA, 19 nt, Pseudomonas aeruginosa PA01
gccucggagaacagcagcg

SEQ ID NO: 1405819 - RNA, 22 nt, Pseudomonas aeruginosa PA01
gccucggagaacagcagcggca

SEQ ID NO: 1405820 - RNA, 23 nt, Pseudomonas aeruginosa PA01
gccucggagaacagcagcggcac

SEQ ID NO: 1405821 - RNA, 15 nt, Pseudomonas aeruginosa PA01
gccugcgccucggcc

SEQ ID NO: 1405822 - RNA, 17 nt, Pseudomonas aeruginosa PA01
gccugcgccucggcccu

SEQ ID NO: 1405823 - RNA, 22 nt, Pseudomonas aeruginosa PA01
gccugcgccucggcccuggcgg

SEQ ID NO: 1405824 - RNA, 16 nt, Pseudomonas aeruginosa PA01
gccugcgcgcaccagg

SEQ ID NO: 1405825 - RNA, 13 nt, Pseudomonas aeruginosa PA01
gccugcgcccuca

SEQ ID NO: 1405826 - RNA, 20 nt, Pseudomonas aeruginosa PA01
gccugcgcagggcuuccuug

SEQ ID NO: 1405827 - RNA, 15 nt, Pseudomonas aeruginosa PA01
gccuggccgcccagg

SEQ ID NO: 1405828 - RNA, 17 nt, Pseudomonas aeruginosa PA01
gccuggccgcgcaggac

SEQ ID NO: 1405829 - RNA, 13 nt, Pseudomonas aeruginosa PA01
gccuggccggcca

SEQ ID NO: 1405830 - RNA, 20 nt, Pseudomonas aeruginosa PA01
gccuggccgucuuccagggc

SEQ ID NO: 1405831 - RNA, 15 nt, Pseudomonas aeruginosa PA01
gccuggccguugcgc

SEQ ID NO: 1405832 - RNA, 18 nt, Pseudomonas aeruginosa PA01
gccuggccguugcgcagg

SEQ ID NO: 1405833 - RNA, 21 nt, Pseudomonas aeruginosa PA01
gccuggccguugcgcaggcgg

SEQ ID NO: 1405834 - RNA, 22 nt, Pseudomonas aeruginosa PA01
gccugcuucagcccggcaccag

SEQ ID NO: 1405835 - RNA, 13 nt, Pseudomonas aeruginosa PA01
gccugcuggccgg

SEQ ID NO: 1405836 - RNA, 12 nt, Pseudomonas aeruginosa PA01
gccugcuggccu

SEQ ID NO: 1405837 - RNA, 16 nt, Pseudomonas aeruginosa PA01
gccugcuggccuggga

SEQ ID NO: 1405838 - RNA, 16 nt, Pseudomonas aeruginosa PA01
gccugcuggcugccca

SEQ ID NO: 1405839 - RNA, 19 nt, Pseudomonas aeruginosa PA01
gccuggccagcgcuucgcg

SEQ ID NO: 1405840 - RNA, 17 nt, Pseudomonas aeruginosa PA01
gccuggccagcgucgcc

SEQ ID NO: 1405841 - RNA, 14 nt, Pseudomonas aeruginosa PA01
gccuggccaggcgc

SEQ ID NO: 1405842 - RNA, 17 nt, Pseudomonas aeruginosa PA01
gccuggccaggcgcucc

SEQ ID NO: 1405843 - RNA, 19 nt, Pseudomonas aeruginosa PA01
gccugcucggcucgcgguu

SEQ ID NO: 1405844 - RNA, 16 nt, Pseudomonas aeruginosa PA01
gccugcucggccugcu

SEQ ID NO: 1405845 - RNA, 21 nt, Pseudomonas aeruginosa PA01
gccugcucggccugcugcgcc

SEQ ID NO: 1405846 - RNA, 15 nt, Pseudomonas aeruginosa PA01
gccugcucuucggcg

SEQ ID NO: 1405847 - RNA, 19 nt, Pseudomonas aeruginosa PA01
gccugcucuucggcggcca

SEQ ID NO: 1405848 - RNA, 22 nt, Pseudomonas aeruginosa PA01
gccugcucuucggcggccagcg

SEQ ID NO: 1405849 - RNA, 13 nt, Pseudomonas aeruginosa PA01
gccugcugcgcgg

SEQ ID NO: 1405850 - RNA, 16 nt, Pseudomonas aeruginosa PA01
gccugcugcgcgggug

SEQ ID NO: 1405851 - RNA, 19 nt, Pseudomonas aeruginosa PA01
gccugcugcgcgggugucg

SEQ ID NO: 1405852 - RNA, 12 nt, Pseudomonas aeruginosa PA01
gccugcugcggg

SEQ ID NO: 1405853 - RNA, 14 nt, Pseudomonas aeruginosa PA01
gccugcugcgggcg

SEQ ID NO: 1405854 - RNA, 20 nt, Pseudomonas aeruginosa PA01
gccugcugcucgaccgccug

SEQ ID NO: 1405855 - RNA, 22 nt, Pseudomonas aeruginosa PA01
gccugcugcucgaccgccugcu

SEQ ID NO: 1405856 - RNA, 22 nt, Pseudomonas aeruginosa PA01
gccugcggcguaguggugccac

SEQ ID NO: 1405857 - RNA, 21 nt, Pseudomonas aeruginosa PA01
gccugcucgaacggcggaucg

SEQ ID NO: 1405858 - RNA, 23 nt, Pseudomonas aeruginosa PA01
gccugcucgaacggcggaucgau

SEQ ID NO: 1405859 - RNA, 19 nt, Pseudomonas aeruginosa PA01
gccugcucgcggcuggccg

SEQ ID NO: 1405860 - RNA, 12 nt, Pseudomonas aeruginosa PA01
gccugcggcgag

SEQ ID NO: 1405861 - RNA, 17 nt, Pseudomonas aeruginosa PA01
gccugcggccagcgcca

SEQ ID NO: 1405862 - RNA, 20 nt, Pseudomonas aeruginosa PA01
gccugcggauagccaaccag

SEQ ID NO: 1405863 - RNA, 19 nt, Pseudomonas aeruginosa PA01
gccugcgcuguucgggucg

SEQ ID NO: 1405864 - RNA, 16 nt, Pseudomonas aeruginosa PA01
gccugcgcuuccggca

SEQ ID NO: 1405865 - RNA, 17 nt, Pseudomonas aeruginosa PA01
gccugcgcuuccggcag

SEQ ID NO: 1405866 - RNA, 18 nt, Pseudomonas aeruginosa PA01
gccugcgcuuccggcagc

SEQ ID NO: 1405867 - RNA, 18 nt, Pseudomonas aeruginosa PA01
gccugcgcuucguuggcg

SEQ ID NO: 1405868 - RNA, 16 nt, Pseudomonas aeruginosa PA01
gccuucaccgcgccgc

SEQ ID NO: 1405869 - RNA, 19 nt, Pseudomonas aeruginosa PA01
gccuucaccgcgccgcgcu

SEQ ID NO: 1405870 - RNA, 14 nt, Pseudomonas aeruginosa PA01
gccuuccaccacca

SEQ ID NO: 1405871 - RNA, 15 nt, Pseudomonas aeruginosa PA01
gccuuccaccggcgu

SEQ ID NO: 1405872 - RNA, 15 nt, Pseudomonas aeruginosa PA01
gccuuccacgccuuc

SEQ ID NO: 1405873 - RNA, 21 nt, Pseudomonas aeruginosa PA01
gccuuccacgccuucgcggcc

SEQ ID NO: 1405874 - RNA, 23 nt, Pseudomonas aeruginosa PA01
gccuuccacgccuucgcggccga

SEQ ID NO: 1405875 - RNA, 20 nt, Pseudomonas aeruginosa PA01
gccuucaggcgggcucuuug

SEQ ID NO: 1405876 - RNA, 16 nt, Pseudomonas aeruginosa PA01
gccuucaggcugcgcg

SEQ ID NO: 1405877 - RNA, 21 nt, Pseudomonas aeruginosa PA01
gccuucagcgccagcaggcga

SEQ ID NO: 1405878 - RNA, 19 nt, Pseudomonas aeruginosa PA01
gccuguggauagaaaagca

SEQ ID NO: 1405879 - RNA, 20 nt, Pseudomonas aeruginosa PA01
gccuguggcguuauucgccc

SEQ ID NO: 1405880 - RNA, 14 nt, Pseudomonas aeruginosa PA01
gccuuccagcaggu

SEQ ID NO: 1405881 - RNA, 13 nt, Pseudomonas aeruginosa PA01
gccuuccagcccu

SEQ ID NO: 1405882 - RNA, 18 nt, Pseudomonas aeruginosa PA01
gccuucuugcugccggcg

SEQ ID NO: 1405883 - RNA, 19 nt, Pseudomonas aeruginosa PA01
gccuugaccucgacgccga

SEQ ID NO: 1405884 - RNA, 15 nt, Pseudomonas aeruginosa PA01
gccuugaccugcugg

SEQ ID NO: 1405885 - RNA, 22 nt, Pseudomonas aeruginosa PA01
gccuugaccugcugggccagcg

SEQ ID NO: 1405886 - RNA, 16 nt, Pseudomonas aeruginosa PA01
gccuugaccagcggcc

SEQ ID NO: 1405887 - RNA, 15 nt, Pseudomonas aeruginosa PA01
gccuugaccaccgcc

SEQ ID NO: 1405888 - RNA, 21 nt, Pseudomonas aeruginosa PA01
gccuugacccgcaguuccuug

SEQ ID NO: 1405889 - RNA, 14 nt, Pseudomonas aeruginosa PA01
gccuugagcgccga

SEQ ID NO: 1405890 - RNA, 14 nt, Pseudomonas aeruginosa PA01
gccuugagcggcgc

SEQ ID NO: 1405891 - RNA, 22 nt, Pseudomonas aeruginosa PA01
gccuugagcggcgcccuggcuc

SEQ ID NO: 1405892 - RNA, 14 nt, Pseudomonas aeruginosa PA01
gccuugaugccggc

SEQ ID NO: 1405893 - RNA, 22 nt, Pseudomonas aeruginosa PA01
gccuguaccccguagcgcucgg

SEQ ID NO: 1405894 - RNA, 21 nt, Pseudomonas aeruginosa PA01
gccugucacucaggcaugcgg

SEQ ID NO: 1405895 - RNA, 23 nt, Pseudomonas aeruginosa PA01
gccugucacucaggcaugcgggc

SEQ ID NO: 1405896 - RNA, 15 nt, Pseudomonas aeruginosa PA01
gccugucacgccggg

SEQ ID NO: 1405897 - RNA, 18 nt, Pseudomonas aeruginosa PA01
gccuguaccgcuuccugg

SEQ ID NO: 1405898 - RNA, 18 nt, Pseudomonas aeruginosa PA01
gccuguccaccgguggcg

SEQ ID NO: 1405899 - RNA, 19 nt, Pseudomonas aeruginosa PA01
gccugucgggggcugcgca

SEQ ID NO: 1405900 - RNA, 14 nt, Pseudomonas aeruginosa PA01
gccuguccgcugcg

SEQ ID NO: 1405901 - RNA, 15 nt, Pseudomonas aeruginosa PA01
gccuguccgaagaca

SEQ ID NO: 1405902 - RNA, 19 nt, Pseudomonas aeruginosa PA01
gccuggcgucccguugcgc

SEQ ID NO: 1405903 - RNA, 21 nt, Pseudomonas aeruginosa PA01
gccuggcgucgcacugcugcu

SEQ ID NO: 1405904 - RNA, 20 nt, Pseudomonas aeruginosa PA01
gccuggcgugccgccaggcc

SEQ ID NO: 1405905 - RNA, 14 nt, Pseudomonas aeruginosa PA01
gccuggcuggccag

SEQ ID NO: 1405906 - RNA, 17 nt, Pseudomonas aeruginosa PA01
gccuggugacccggaca

SEQ ID NO: 1405907 - RNA, 17 nt, Pseudomonas aeruginosa PA01
gccuggcucgaucggca

SEQ ID NO: 1405908 - RNA, 20 nt, Pseudomonas aeruginosa PA01
gccuggcucgaucggcaggg

SEQ ID NO: 1405909 - RNA, 16 nt, Pseudomonas aeruginosa PA01
gccuggcugccgagca

SEQ ID NO: 1405910 - RNA, 18 nt, Pseudomonas aeruginosa PA01
gccugguucccucaaccg

SEQ ID NO: 1405911 - RNA, 22 nt, Pseudomonas aeruginosa PA01
gccugguuguaggcgccgccgu

SEQ ID NO: 1405912 - RNA, 16 nt, Pseudomonas aeruginosa PA01
gccugguucugcuccg

SEQ ID NO: 1405913 - RNA, 17 nt, Pseudomonas aeruginosa PA01
gccuggugcccgaugcc

SEQ ID NO: 1405914 - RNA, 20 nt, Pseudomonas aeruginosa PA01
gccuggcgguugaugccgac

SEQ ID NO: 1405915 - RNA, 22 nt, Pseudomonas aeruginosa PA01
gccuggcguagcguugcgcgag

SEQ ID NO: 1405916 - RNA, 17 nt, Pseudomonas aeruginosa PA01
gccuggugcaccuggcg

SEQ ID NO: 1405917 - RNA, 18 nt, Pseudomonas aeruginosa PA01
gccuggugcaccuggcga

SEQ ID NO: 1405918 - RNA, 16 nt, Pseudomonas aeruginosa PA01
gccuggugcacgccga

SEQ ID NO: 1405919 - RNA, 20 nt, Pseudomonas aeruginosa PA01
gccuggugcacgccgauggc

SEQ ID NO: 1405920 - RNA, 16 nt, Pseudomonas aeruginosa PA01
gccuggugcaggucgc

SEQ ID NO: 1405921 - RNA, 16 nt, Pseudomonas aeruginosa PA01
gccuggcgcagcggca

SEQ ID NO: 1405922 - RNA, 22 nt, Pseudomonas aeruginosa PA01
gccuggcgcgacgaggcgcggc

SEQ ID NO: 1405923 - RNA, 19 nt, Pseudomonas aeruginosa PA01
gccuggcgcaacaggcgca

SEQ ID NO: 1405924 - RNA, 14 nt, Pseudomonas aeruginosa PA01
gccuggcgcaacgc

SEQ ID NO: 1405925 - RNA, 17 nt, Pseudomonas aeruginosa PA01
gccuggcgcaacgccgg

SEQ ID NO: 1405926 - RNA, 19 nt, Pseudomonas aeruginosa PA01
gccuggcgcaacgccggca

SEQ ID NO: 1405927 - RNA, 17 nt, Pseudomonas aeruginosa PA01
gccuggcgcaaggugcc

SEQ ID NO: 1405928 - RNA, 21 nt, Pseudomonas aeruginosa PA01
gccuggcgcaaggugccgagg

SEQ ID NO: 1405929 - RNA, 16 nt, Pseudomonas aeruginosa PA01
gcgaacggcagcgucu

SEQ ID NO: 1405930 - RNA, 15 nt, Pseudomonas aeruginosa PA01
gcgaacuccgccagc

SEQ ID NO: 1405931 - RNA, 16 nt, Pseudomonas aeruginosa PA01
gcgaacggaccgacgu

SEQ ID NO: 1405932 - RNA, 17 nt, Pseudomonas aeruginosa PA01
gcgaacgggcguugccg

SEQ ID NO: 1405933 - RNA, 20 nt, Pseudomonas aeruginosa PA01
gcgaacgggcguugccggca

SEQ ID NO: 1405934 - RNA, 16 nt, Pseudomonas aeruginosa PA01
gcgaagaacacgcccc

SEQ ID NO: 1405935 - RNA, 19 nt, Pseudomonas aeruginosa PA01
gcgaagaacacgccccaga

SEQ ID NO: 1405936 - RNA, 17 nt, Pseudomonas aeruginosa PA01
gcgaagaacagcggguc

SEQ ID NO: 1405937 - RNA, 23 nt, Pseudomonas aeruginosa PA01
gcgaacuucaggccggcgccgau

SEQ ID NO: 1405938 - RNA, 14 nt, Pseudomonas aeruginosa PA01
gcgaacugccgacg

SEQ ID NO: 1405939 - RNA, 20 nt, Pseudomonas aeruginosa PA01
gcgaagccaggaagcggcgg

SEQ ID NO: 1405940 - RNA, 15 nt, Pseudomonas aeruginosa PA01
gcgaagcccagcgag

SEQ ID NO: 1405941 - RNA, 20 nt, Pseudomonas aeruginosa PA01
gcgaagcccagcgagccgau

SEQ ID NO: 1405942 - RNA, 15 nt, Pseudomonas aeruginosa PA01
gcgaagcccagcgcc

SEQ ID NO: 1405943 - RNA, 17 nt, Pseudomonas aeruginosa PA01
gcgaagcccagcgccgc

SEQ ID NO: 1405944 - RNA, 15 nt, Pseudomonas aeruginosa PA01
gcgaagaccggccgg

SEQ ID NO: 1405945 - RNA, 17 nt, Pseudomonas aeruginosa PA01
gcgaagaccggccggcu

SEQ ID NO: 1405946 - RNA, 21 nt, Pseudomonas aeruginosa PA01
gcgaagaucucgccauggcgg

SEQ ID NO: 1405947 - RNA, 23 nt, Pseudomonas aeruginosa PA01
gcgaagaucucgccauggcggac

SEQ ID NO: 1405948 - RNA, 19 nt, Pseudomonas aeruginosa PA01
gcgaacgcccggcuuuccu

SEQ ID NO: 1405949 - RNA, 14 nt, Pseudomonas aeruginosa PA01
gcgaacgccgcagc

SEQ ID NO: 1405950 - RNA, 15 nt, Pseudomonas aeruginosa PA01
gcgaacgccgcagcu

SEQ ID NO: 1405951 - RNA, 16 nt, Pseudomonas aeruginosa PA01
gcgaaccucgguagcc

SEQ ID NO: 1405952 - RNA, 21 nt, Pseudomonas aeruginosa PA01
gcgaaccucgguagccggcca

SEQ ID NO: 1405953 - RNA, 16 nt, Pseudomonas aeruginosa PA01
gcgaacgauggugguc

SEQ ID NO: 1405954 - RNA, 18 nt, Pseudomonas aeruginosa PA01
gcgaacccggcgcggcgc

SEQ ID NO: 1405955 - RNA, 18 nt, Pseudomonas aeruginosa PA01
gcgaaccgagacccuggc

SEQ ID NO: 1405956 - RNA, 22 nt, Pseudomonas aeruginosa PA01
gcgaaccgagacccuggcgcug

SEQ ID NO: 1405957 - RNA, 14 nt, Pseudomonas aeruginosa PA01
gcgaaccgcuggug

SEQ ID NO: 1405958 - RNA, 13 nt, Pseudomonas aeruginosa PA01
gcgaaccgccggc

SEQ ID NO: 1405959 - RNA, 14 nt, Pseudomonas aeruginosa PA01
gcgaaccagcagca

SEQ ID NO: 1405960 - RNA, 15 nt, Pseudomonas aeruginosa PA01
gcgaaccaguccagc

SEQ ID NO: 1405961 - RNA, 16 nt, Pseudomonas aeruginosa PA01
gcgaaccaggcggccg

SEQ ID NO: 1405962 - RNA, 17 nt, Pseudomonas aeruginosa PA01
gcgaaccaggcggccga

SEQ ID NO: 1405963 - RNA, 17 nt, Pseudomonas aeruginosa PA01
gcgaacaugaagccgcg

SEQ ID NO: 1405964 - RNA, 18 nt, Pseudomonas aeruginosa PA01
gcgaacaugaagccgcgc

SEQ ID NO: 1405965 - RNA, 20 nt, Pseudomonas aeruginosa PA01
gcgaaccacaccaggucgcc

SEQ ID NO: 1405966 - RNA, 23 nt, Pseudomonas aeruginosa PA01
gcgaaccacaccaggucgccgca

SEQ ID NO: 1405967 - RNA, 21 nt, Pseudomonas aeruginosa PA01
gcgaacaggcagcgggccagg

SEQ ID NO: 1405968 - RNA, 22 nt, Pseudomonas aeruginosa PA01
gcgaacaggcagcgggccaggc

SEQ ID NO: 1405969 - RNA, 23 nt, Pseudomonas aeruginosa PA01
gcgaacaggcagcgggccaggcg

SEQ ID NO: 1405970 - RNA, 14 nt, Pseudomonas aeruginosa PA01
gcgaacagcgccgc

SEQ ID NO: 1405971 - RNA, 20 nt, Pseudomonas aeruginosa PA01
gcgaacagcgccgcggcugg

SEQ ID NO: 1405972 - RNA, 16 nt, Pseudomonas aeruginosa PA01
gcgaacagcgcuuccu

SEQ ID NO: 1405973 - RNA, 14 nt, Pseudomonas aeruginosa PA01
gcgaacagguagcc

SEQ ID NO: 1405974 - RNA, 16 nt, Pseudomonas aeruginosa PA01
gccuugcgccaggccu

SEQ ID NO: 1405975 - RNA, 16 nt, Pseudomonas aeruginosa PA01
gccuugcccuggccgg

SEQ ID NO: 1405976 - RNA, 17 nt, Pseudomonas aeruginosa PA01
gccuugcccuggccggc

SEQ ID NO: 1405977 - RNA, 14 nt, Pseudomonas aeruginosa PA01
gccuugccgcgacc

SEQ ID NO: 1405978 - RNA, 18 nt, Pseudomonas aeruginosa PA01
gccuugccaagguguggc

SEQ ID NO: 1405979 - RNA, 13 nt, Pseudomonas aeruginosa PA01
gccuugcagggcc

SEQ ID NO: 1405980 - RNA, 20 nt, Pseudomonas aeruginosa PA01
gccuugcagggccgccagcc

SEQ ID NO: 1405981 - RNA, 20 nt, Pseudomonas aeruginosa PA01
gccuugcagggggcuuugcg

SEQ ID NO: 1405982 - RNA, 19 nt, Pseudomonas aeruginosa PA01
gccuugcagcaacucgccg

SEQ ID NO: 1405983 - RNA, 23 nt, Pseudomonas aeruginosa PA01
gccuugcagcaacucgccgccga

SEQ ID NO: 1405984 - RNA, 14 nt, Pseudomonas aeruginosa PA01
gccuugcagcaccg

SEQ ID NO: 1405985 - RNA, 16 nt, Pseudomonas aeruginosa PA01
gcgaaaaucgaagggu

SEQ ID NO: 1405986 - RNA, 19 nt, Pseudomonas aeruginosa PA01
gcgaaaacucccggccugg

SEQ ID NO: 1405987 - RNA, 11 nt, Pseudomonas aeruginosa PA01
gcgaaaaccgg

SEQ ID NO: 1405988 - RNA, 14 nt, Pseudomonas aeruginosa PA01
gcgaaaacggcgac

SEQ ID NO: 1405989 - RNA, 16 nt, Pseudomonas aeruginosa PA01
gcgaaaacggcgaccc

SEQ ID NO: 1405990 - RNA, 20 nt, Pseudomonas aeruginosa PA01
gccuuuucggcggccaggcg

SEQ ID NO: 1405991 - RNA, 24 nt, Pseudomonas aeruginosa PA01
gcgaaaaauacuccgcgacgucca

SEQ ID NO: 1405992 - RNA, 19 nt, Pseudomonas aeruginosa PA01
gccuuuuuugugcccggcg

SEQ ID NO: 1405993 - RNA, 23 nt, Pseudomonas aeruginosa PA01
gccuuuuucauggccuggcgcuc

SEQ ID NO: 1405994 - RNA, 14 nt, Pseudomonas aeruginosa PA01
gcgaaacggcaggc

SEQ ID NO: 1405995 - RNA, 16 nt, Pseudomonas aeruginosa PA01
gcgaaacggcaggcca

SEQ ID NO: 1405996 - RNA, 21 nt, Pseudomonas aeruginosa PA01
gcgaaacgccccgucgacgca

SEQ ID NO: 1405997 - RNA, 13 nt, Pseudomonas aeruginosa PA01
gcgaaaccggcca

SEQ ID NO: 1405998 - RNA, 14 nt, Pseudomonas aeruginosa PA01
gcgaaaccggccag

SEQ ID NO: 1405999 - RNA, 15 nt, Pseudomonas aeruginosa PA01
gcgaaacggcgcuga

SEQ ID NO: 1406000 - RNA, 13 nt, Pseudomonas aeruginosa PA01
gcgaaacggcgga

SEQ ID NO: 1406001 - RNA, 15 nt, Pseudomonas aeruginosa PA01
gcgaaagcgccccgg

SEQ ID NO: 1406002 - RNA, 15 nt, Pseudomonas aeruginosa PA01
gcgaaagcgucagcg

SEQ ID NO: 1406003 - RNA, 17 nt, Pseudomonas aeruginosa PA01
gcgaaagcgucagcgcg

SEQ ID NO: 1406004 - RNA, 20 nt, Pseudomonas aeruginosa PA01
gcgaaagcgucagcgcgcca

SEQ ID NO: 1406005 - RNA, 24 nt, Pseudomonas aeruginosa PA01
gcgaacagcagcgguaggcgcgug

SEQ ID NO: 1406006 - RNA, 17 nt, Pseudomonas aeruginosa PA01
gcgaacagcgagacccg

SEQ ID NO: 1406007 - RNA, 18 nt, Pseudomonas aeruginosa PA01
gcgaacagcgagacccgg

SEQ ID NO: 1406008 - RNA, 15 nt, Pseudomonas aeruginosa PA01
gcgaacacgucggcg

SEQ ID NO: 1406009 - RNA, 21 nt, Pseudomonas aeruginosa PA01
gcgaacagcaccuuggccaug

SEQ ID NO: 1406010 - RNA, 18 nt, Pseudomonas aeruginosa PA01
gcgaacaccgggccgccg

SEQ ID NO: 1406011 - RNA, 21 nt, Pseudomonas aeruginosa PA01
gcgaacaccgggccgccggcg

SEQ ID NO: 1406012 - RNA, 23 nt, Pseudomonas aeruginosa PA01
gcgaacaccgggccgccggcgac

SEQ ID NO: 1406013 - RNA, 13 nt, Pseudomonas aeruginosa PA01
gcgaaacucgugc

SEQ ID NO: 1406014 - RNA, 16 nt, Pseudomonas aeruginosa PA01
gcgaaagucggcgcga

SEQ ID NO: 1406015 - RNA, 18 nt, Pseudomonas aeruginosa PA01
gcgaaagucggcgcgacu

SEQ ID NO: 1406016 - RNA, 16 nt, Pseudomonas aeruginosa PA01
gcgaacaacgccgccg

SEQ ID NO: 1406017 - RNA, 17 nt, Pseudomonas aeruginosa PA01
gcgaacacaccgaccgc

SEQ ID NO: 1406018 - RNA, 18 nt, Pseudomonas aeruginosa PA01
gcgaacacaccgaccgcg

SEQ ID NO: 1406019 - RNA, 17 nt, Pseudomonas aeruginosa PA01
gcgacgcugaugccggc

SEQ ID NO: 1406020 - RNA, 15 nt, Pseudomonas aeruginosa PA01
gcgacgcuccagcgg

SEQ ID NO: 1406021 - RNA, 19 nt, Pseudomonas aeruginosa PA01
gcgacgcuccagcggcagc

SEQ ID NO: 1406022 - RNA, 20 nt, Pseudomonas aeruginosa PA01
gcgacgcuccagcggcagcu

SEQ ID NO: 1406023 - RNA, 21 nt, Pseudomonas aeruginosa PA01
gcgacgcuccaggugcacggc

SEQ ID NO: 1406024 - RNA, 19 nt, Pseudomonas aeruginosa PA01
gcgacgcucuucagcgguc

SEQ ID NO: 1406025 - RNA, 15 nt, Pseudomonas aeruginosa PA01
gcgacgcgacauccu

SEQ ID NO: 1406026 - RNA, 14 nt, Pseudomonas aeruginosa PA01
gcgacgcgaccucc

SEQ ID NO: 1406027 - RNA, 15 nt, Pseudomonas aeruginosa PA01
gcgacgcgaccuccg

SEQ ID NO: 1406028 - RNA, 19 nt, Pseudomonas aeruginosa PA01
gcgacgcgaccuccggcgc

SEQ ID NO: 1406029 - RNA, 21 nt, Pseudomonas aeruginosa PA01
gcgacgcgaccuccggcgcca

SEQ ID NO: 1406030 - RNA, 22 nt, Pseudomonas aeruginosa PA01
gcgacgcgaccuccggcgccag

SEQ ID NO: 1406031 - RNA, 18 nt, Pseudomonas aeruginosa PA01
gcgacgcguccggugacg

SEQ ID NO: 1406032 - RNA, 21 nt, Pseudomonas aeruginosa PA01
gcgacgcuacguuccagggcc

SEQ ID NO: 1406033 - RNA, 23 nt, Pseudomonas aeruginosa PA01
gcgacgcuacguuccagggccug

SEQ ID NO: 1406034 - RNA, 14 nt, Pseudomonas aeruginosa PA01
gcgacgcgcuggac

SEQ ID NO: 1406035 - RNA, 23 nt, Pseudomonas aeruginosa PA01
gcgacgcgcuggaccauggccgg

SEQ ID NO: 1406036 - RNA, 12 nt, Pseudomonas aeruginosa PA01
gcgacgccgcgc

SEQ ID NO: 1406037 - RNA, 22 nt, Pseudomonas aeruginosa PA01
gcgacgcccuugcggcgcggcc

SEQ ID NO: 1406038 - RNA, 23 nt, Pseudomonas aeruginosa PA01
gcgacgcccuugcggcgcggccc

SEQ ID NO: 1406039 - RNA, 23 nt, Pseudomonas aeruginosa PA01
gcgacgcccauguagaccaccag

SEQ ID NO: 1406040 - RNA, 17 nt, Pseudomonas aeruginosa PA01
gcgacgcauggaucaug

SEQ ID NO: 1406041 - RNA, 16 nt, Pseudomonas aeruginosa PA01
gcgacgcagcacggcg

SEQ ID NO: 1406042 - RNA, 17 nt, Pseudomonas aeruginosa PA01
gcgacgcagcacggcgg

SEQ ID NO: 1406043 - RNA, 18 nt, Pseudomonas aeruginosa PA01
gcgacgcagcacggcggc

SEQ ID NO: 1406044 - RNA, 17 nt, Pseudomonas aeruginosa PA01
gcgacgcacaccgucga

SEQ ID NO: 1406045 - RNA, 21 nt, Pseudomonas aeruginosa PA01
gcgacgaugcgccccagcgcc

SEQ ID NO: 1406046 - RNA, 18 nt, Pseudomonas aeruginosa PA01
gcgacgauguucuccacg

SEQ ID NO: 1406047 - RNA, 23 nt, Pseudomonas aeruginosa PA01
gcgacgaugccgccgccgcccca

SEQ ID NO: 1406048 - RNA, 17 nt, Pseudomonas aeruginosa PA01
gcgacgaucagcccgcc

SEQ ID NO: 1406049 - RNA, 13 nt, Pseudomonas aeruginosa PA01
gcgacgaucaccc

SEQ ID NO: 1406050 - RNA, 13 nt, Pseudomonas aeruginosa PA01
gcgacgaggcgcg

SEQ ID NO: 1406051 - RNA, 16 nt, Pseudomonas aeruginosa PA01
gcgacgaggcgcggcg

SEQ ID NO: 1406052 - RNA, 21 nt, Pseudomonas aeruginosa PA01
gcgacgacuugcccaccccgg

SEQ ID NO: 1406053 - RNA, 20 nt, Pseudomonas aeruginosa PA01
gcgacgagaaaaagcccggc

SEQ ID NO: 1406054 - RNA, 21 nt, Pseudomonas aeruginosa PA01
gcgacgagaaaaagcccggca

SEQ ID NO: 1406055 - RNA, 16 nt, Pseudomonas aeruginosa PA01
gcgacgacgaucccgg

SEQ ID NO: 1406056 - RNA, 20 nt, Pseudomonas aeruginosa PA01
gcgacgacgaucccggcggu

SEQ ID NO: 1406057 - RNA, 17 nt, Pseudomonas aeruginosa PA01
gcgacgacugcggcagc

SEQ ID NO: 1406058 - RNA, 18 nt, Pseudomonas aeruginosa PA01
gcgacgacugcggcagcu

SEQ ID NO: 1406059 - RNA, 17 nt, Pseudomonas aeruginosa PA01
gcgaccuucagcggguc

SEQ ID NO: 1406060 - RNA, 22 nt, Pseudomonas aeruginosa PA01
gcgaccuucagcgggucgagcc

SEQ ID NO: 1406061 - RNA, 21 nt, Pseudomonas aeruginosa PA01
gcgaccgcaucguuggcgccg

SEQ ID NO: 1406062 - RNA, 18 nt, Pseudomonas aeruginosa PA01
gcgaccgagaugcucgcg

SEQ ID NO: 1406063 - RNA, 22 nt, Pseudomonas aeruginosa PA01
gcgaccgagaugcucgcgcagc

SEQ ID NO: 1406064 - RNA, 19 nt, Pseudomonas aeruginosa PA01
gcgaccgagaugcugccga

SEQ ID NO: 1406065 - RNA, 23 nt, Pseudomonas aeruginosa PA01
gcgaccgagaugcugccgaagcc

SEQ ID NO: 1406066 - RNA, 13 nt, Pseudomonas aeruginosa PA01
gcgaccgccaggc

SEQ ID NO: 1406067 - RNA, 17 nt, Pseudomonas aeruginosa PA01
gcgaccgccaggcggcc

SEQ ID NO: 1406068 - RNA, 15 nt, Pseudomonas aeruginosa PA01
gcgacgaaggccugg

SEQ ID NO: 1406069 - RNA, 19 nt, Pseudomonas aeruginosa PA01
gcgacgaaggccuggucga

SEQ ID NO: 1406070 - RNA, 20 nt, Pseudomonas aeruginosa PA01
gcgacgaaggucggcggcag

SEQ ID NO: 1406071 - RNA, 14 nt, Pseudomonas aeruginosa PA01
gcgaccuugacgaa

SEQ ID NO: 1406072 - RNA, 19 nt, Pseudomonas aeruginosa PA01
gcgaccuugacgaagccgg

SEQ ID NO: 1406073 - RNA, 20 nt, Pseudomonas aeruginosa PA01
gcgaccuugacgaagccggc

SEQ ID NO: 1406074 - RNA, 16 nt, Pseudomonas aeruginosa PA01
gcgaccuuggccagcc

SEQ ID NO: 1406075 - RNA, 15 nt, Pseudomonas aeruginosa PA01
gcgaccuuguccagg

SEQ ID NO: 1406076 - RNA, 18 nt, Pseudomonas aeruginosa PA01
gcgaccuuguccaggcgc

SEQ ID NO: 1406077 - RNA, 21 nt, Pseudomonas aeruginosa PA01
gcgaccuuguccaggcgcugc

SEQ ID NO: 1406078 - RNA, 13 nt, Pseudomonas aeruginosa PA01
gcgaccuugucga

SEQ ID NO: 1406079 - RNA, 17 nt, Pseudomonas aeruginosa PA01
gcgacgaagcccaggcu

SEQ ID NO: 1406080 - RNA, 13 nt, Pseudomonas aeruginosa PA01
gcgacccaggccg

SEQ ID NO: 1406081 - RNA, 19 nt, Pseudomonas aeruginosa PA01
gcgacccaggccgacagcg

SEQ ID NO: 1406082 - RNA, 19 nt, Pseudomonas aeruginosa PA01
gcgacccagaccugccgcc

SEQ ID NO: 1406083 - RNA, 23 nt, Pseudomonas aeruginosa PA01
gcgacccagaccugccgcccggc

SEQ ID NO: 1406084 - RNA, 16 nt, Pseudomonas aeruginosa PA01
gcgacccaucgccgaa

SEQ ID NO: 1406085 - RNA, 22 nt, Pseudomonas aeruginosa PA01
gcgacccaucgccgaagacgcc

SEQ ID NO: 1406086 - RNA, 19 nt, Pseudomonas aeruginosa PA01
gcgaccgaacagcgcgcca

SEQ ID NO: 1406087 - RNA, 17 nt, Pseudomonas aeruginosa PA01
gcgacccucagucgccc

SEQ ID NO: 1406088 - RNA, 20 nt, Pseudomonas aeruginosa PA01
gcgacccucagucgccccca

SEQ ID NO: 1406089 - RNA, 12 nt, Pseudomonas aeruginosa PA01
gcgacccuggcc

SEQ ID NO: 1406090 - RNA, 14 nt, Pseudomonas aeruginosa PA01
gcgacccuggccgc

SEQ ID NO: 1406091 - RNA, 15 nt, Pseudomonas aeruginosa PA01
gcgacccuggccgcg

SEQ ID NO: 1406092 - RNA, 17 nt, Pseudomonas aeruginosa PA01
gcgacccuggggucgcc

SEQ ID NO: 1406093 - RNA, 19 nt, Pseudomonas aeruginosa PA01
gcgacccgccguucgcccg

SEQ ID NO: 1406094 - RNA, 13 nt, Pseudomonas aeruginosa PA01
gcgacccggguca

SEQ ID NO: 1406095 - RNA, 18 nt, Pseudomonas aeruginosa PA01
gcgacccgggucaggccg

SEQ ID NO: 1406096 - RNA, 22 nt, Pseudomonas aeruginosa PA01
gcgaccacccggcgguccgccg

SEQ ID NO: 1406097 - RNA, 15 nt, Pseudomonas aeruginosa PA01
gcgaccaccgccggg

SEQ ID NO: 1406098 - RNA, 20 nt, Pseudomonas aeruginosa PA01
gcgaccaccgcgaauccgcg

SEQ ID NO: 1406099 - RNA, 22 nt, Pseudomonas aeruginosa PA01
gcgaccaccgcgaauccgcggc

SEQ ID NO: 1406100 - RNA, 22 nt, Pseudomonas aeruginosa PA01
gcgaccaccuucuacaccguac

SEQ ID NO: 1406101 - RNA, 19 nt, Pseudomonas aeruginosa PA01
gcgaccacaggcggcggaa

SEQ ID NO: 1406102 - RNA, 16 nt, Pseudomonas aeruginosa PA01
gcgaccaccaccaggu

SEQ ID NO: 1406103 - RNA, 21 nt, Pseudomonas aeruginosa PA01
gcgaccaccaccaggucggcg

SEQ ID NO: 1406104 - RNA, 22 nt, Pseudomonas aeruginosa PA01
gcgaccaccaccaggucggcgc

SEQ ID NO: 1406105 - RNA, 16 nt, Pseudomonas aeruginosa PA01
gcgacaguucgccgcc

SEQ ID NO: 1406106 - RNA, 17 nt, Pseudomonas aeruginosa PA01
gcgacaguucgccgccc

SEQ ID NO: 1406107 - RNA, 21 nt, Pseudomonas aeruginosa PA01
gcgacaggcccuugaacaggc

SEQ ID NO: 1406108 - RNA, 17 nt, Pseudomonas aeruginosa PA01
gcgacaggcgaucgccg

SEQ ID NO: 1406109 - RNA, 17 nt, Pseudomonas aeruginosa PA01
gcgacagguucaggacg

SEQ ID NO: 1406110 - RNA, 21 nt, Pseudomonas aeruginosa PA01
gcgacagguucaggacgcucc

SEQ ID NO: 1406111 - RNA, 18 nt, Pseudomonas aeruginosa PA01
gcgaagccgauacccugg

SEQ ID NO: 1406112 - RNA, 13 nt, Pseudomonas aeruginosa PA01
gcgaagccgcgcc

SEQ ID NO: 1406113 - RNA, 15 nt, Pseudomonas aeruginosa PA01
gcgaagccgcgcccg

SEQ ID NO: 1406114 - RNA, 13 nt, Pseudomonas aeruginosa PA01
gcgaagccggcgg

SEQ ID NO: 1406115 - RNA, 18 nt, Pseudomonas aeruginosa PA01
gcgaagccugcggcgaga

SEQ ID NO: 1406116 - RNA, 13 nt, Pseudomonas aeruginosa PA01
gcgaagcgcuugc

SEQ ID NO: 1406117 - RNA, 18 nt, Pseudomonas aeruginosa PA01
gcgaagcgcuugcccagg

SEQ ID NO: 1406118 - RNA, 18 nt, Pseudomonas aeruginosa PA01
gcgaagcggaagcgcagc

SEQ ID NO: 1406119 - RNA, 17 nt, Pseudomonas aeruginosa PA01
gcgaagcgacggcgcaa

SEQ ID NO: 1406120 - RNA, 13 nt, Pseudomonas aeruginosa PA01
gcgaagcgcaggc

SEQ ID NO: 1406121 - RNA, 14 nt, Pseudomonas aeruginosa PA01
gcgaagcgcaggcu

SEQ ID NO: 1406122 - RNA, 18 nt, Pseudomonas aeruginosa PA01
gcgaagcucggccgcucg

SEQ ID NO: 1406123 - RNA, 19 nt, Pseudomonas aeruginosa PA01
gcgaagcucggccgcucga

SEQ ID NO: 1406124 - RNA, 17 nt, Pseudomonas aeruginosa PA01
gcgaagcuggcgcaacu

SEQ ID NO: 1406125 - RNA, 18 nt, Pseudomonas aeruginosa PA01
gcgacaacggccguccca

SEQ ID NO: 1406126 - RNA, 23 nt, Pseudomonas aeruginosa PA01
gcgaagcggcccuugucgccgcu

SEQ ID NO: 1406127 - RNA, 16 nt, Pseudomonas aeruginosa PA01
gcgaagcuccucgaua

SEQ ID NO: 1406128 - RNA, 21 nt, Pseudomonas aeruginosa PA01
gcgaagcgguuagccggcgau

SEQ ID NO: 1406129 - RNA, 19 nt, Pseudomonas aeruginosa PA01
gcgaagcggcucggccagg

SEQ ID NO: 1406130 - RNA, 20 nt, Pseudomonas aeruginosa PA01
gcgaagcggcuggccgcggu

SEQ ID NO: 1406131 - RNA, 19 nt, Pseudomonas aeruginosa PA01
gcgacagcucguggcuggc

SEQ ID NO: 1406132 - RNA, 20 nt, Pseudomonas aeruginosa PA01
gcgacagcucguggcuggcg

SEQ ID NO: 1406133 - RNA, 21 nt, Pseudomonas aeruginosa PA01
gcgacagcucguggcuggcgc

SEQ ID NO: 1406134 - RNA, 18 nt, Pseudomonas aeruginosa PA01
gcgacagcucugggguca

SEQ ID NO: 1406135 - RNA, 21 nt, Pseudomonas aeruginosa PA01
gcgacagcuuccagugcuuga

SEQ ID NO: 1406136 - RNA, 20 nt, Pseudomonas aeruginosa PA01
gcgacacauggucggccagg

SEQ ID NO: 1406137 - RNA, 23 nt, Pseudomonas aeruginosa PA01
gcgacaccaugcuccgccuggcg

SEQ ID NO: 1406138 - RNA, 14 nt, Pseudomonas aeruginosa PA01
gcgacaccgccagc

SEQ ID NO: 1406139 - RNA, 16 nt, Pseudomonas aeruginosa PA01
gcgacaccgccagcac

SEQ ID NO: 1406140 - RNA, 14 nt, Pseudomonas aeruginosa PA01
gcgagcgcccgccg

SEQ ID NO: 1406141 - RNA, 11 nt, Pseudomonas aeruginosa PA01
gcgagcgccgc

SEQ ID NO: 1406142 - RNA, 14 nt, Pseudomonas aeruginosa PA01
gcgagcgccgccgg

SEQ ID NO: 1406143 - RNA, 13 nt, Pseudomonas aeruginosa PA01
gcgagcgccgccu

SEQ ID NO: 1406144 - RNA, 22 nt, Pseudomonas aeruginosa PA01
gcgagcgccgccuugagcggcg

SEQ ID NO: 1406145 - RNA, 14 nt, Pseudomonas aeruginosa PA01
gcgagcgcggccgg

SEQ ID NO: 1406146 - RNA, 17 nt, Pseudomonas aeruginosa PA01
gcgagcgacggugauag

SEQ ID NO: 1406147 - RNA, 15 nt, Pseudomonas aeruginosa PA01
gcgagcgccgcggcg

SEQ ID NO: 1406148 - RNA, 18 nt, Pseudomonas aeruginosa PA01
gcgagcuggaucggcagg

SEQ ID NO: 1406149 - RNA, 20 nt, Pseudomonas aeruginosa PA01
gcgagcuggaucggcaggcu

SEQ ID NO: 1406150 - RNA, 21 nt, Pseudomonas aeruginosa PA01
gcgagcuggaucggcaggcug

SEQ ID NO: 1406151 - RNA, 14 nt, Pseudomonas aeruginosa PA01
gcgaggacgccggg

SEQ ID NO: 1406152 - RNA, 15 nt, Pseudomonas aeruginosa PA01
gcgaggacgccgggc

SEQ ID NO: 1406153 - RNA, 20 nt, Pseudomonas aeruginosa PA01
gcgaggaacacccagaagcc

SEQ ID NO: 1406154 - RNA, 15 nt, Pseudomonas aeruginosa PA01
gcgaggaacagcacc

SEQ ID NO: 1406155 - RNA, 17 nt, Pseudomonas aeruginosa PA01
gcgaggaacagcaccag

SEQ ID NO: 1406156 - RNA, 21 nt, Pseudomonas aeruginosa PA01
gcgaggaacagcgagaggggc

SEQ ID NO: 1406157 - RNA, 23 nt, Pseudomonas aeruginosa PA01
gcgagcuugcaauccgugcgccg

SEQ ID NO: 1406158 - RNA, 14 nt, Pseudomonas aeruginosa PA01
gcgagcuucgccgc

SEQ ID NO: 1406159 - RNA, 17 nt, Pseudomonas aeruginosa PA01
gcgagcuucgccgcgca

SEQ ID NO: 1406160 - RNA, 15 nt, Pseudomonas aeruginosa PA01
gcgagcuuggcccug

SEQ ID NO: 1406161 - RNA, 18 nt, Pseudomonas aeruginosa PA01
gcgagcuuggcccuggcc

SEQ ID NO: 1406162 - RNA, 19 nt, Pseudomonas aeruginosa PA01
gcgaggaaaaggaucgccg

SEQ ID NO: 1406163 - RNA, 22 nt, Pseudomonas aeruginosa PA01
gcgaggaaaaggaucgccgcga

SEQ ID NO: 1406164 - RNA, 19 nt, Pseudomonas aeruginosa PA01
gcgagucaccccgaccagc

SEQ ID NO: 1406165 - RNA, 22 nt, Pseudomonas aeruginosa PA01
gcgagucaccccgaccagcgcg

SEQ ID NO: 1406166 - RNA, 15 nt, Pseudomonas aeruginosa PA01
gcgagucgacccagg

SEQ ID NO: 1406167 - RNA, 18 nt, Pseudomonas aeruginosa PA01
gcgagucgacccaggccc

SEQ ID NO: 1406168 - RNA, 18 nt, Pseudomonas aeruginosa PA01
gcgaguagucgcggggcg

SEQ ID NO: 1406169 - RNA, 23 nt, Pseudomonas aeruginosa PA01
gcgaguaguagcguuccuggcgc

SEQ ID NO: 1406170 - RNA, 15 nt, Pseudomonas aeruginosa PA01
gcgaguaguaggucg

SEQ ID NO: 1406171 - RNA, 13 nt, Pseudomonas aeruginosa PA01
gcgaggaucagcc

SEQ ID NO: 1406172 - RNA, 22 nt, Pseudomonas aeruginosa PA01
gcgaggaucagccacgggcgcc

SEQ ID NO: 1406173 - RNA, 15 nt, Pseudomonas aeruginosa PA01
gcgaggaucgccagc

SEQ ID NO: 1406174 - RNA, 16 nt, Pseudomonas aeruginosa PA01
gcgagguugcccacgg

SEQ ID NO: 1406175 - RNA, 18 nt, Pseudomonas aeruginosa PA01
gcgagguugcccacggcc

SEQ ID NO: 1406176 - RNA, 21 nt, Pseudomonas aeruginosa PA01
gcgagguuucgcuuuccucgg

SEQ ID NO: 1406177 - RNA, 13 nt, Pseudomonas aeruginosa PA01
gcgauagccgggg

SEQ ID NO: 1406178 - RNA, 13 nt, Pseudomonas aeruginosa PA01
gcgauaggcgcgc

SEQ ID NO: 1406179 - RNA, 19 nt, Pseudomonas aeruginosa PA01
gcgauaggcgcgcaacgcu

SEQ ID NO: 1406180 - RNA, 16 nt, Pseudomonas aeruginosa PA01
gcgauagacgccggcg

SEQ ID NO: 1406181 - RNA, 17 nt, Pseudomonas aeruginosa PA01
gcgauagacgccggcga

SEQ ID NO: 1406182 - RNA, 14 nt, Pseudomonas aeruginosa PA01
gcgauaaccgcguu

SEQ ID NO: 1406183 - RNA, 17 nt, Pseudomonas aeruginosa PA01
gcgauacccaggccguc

SEQ ID NO: 1406184 - RNA, 19 nt, Pseudomonas aeruginosa PA01
gcgauacccaggccgucga

SEQ ID NO: 1406185 - RNA, 13 nt, Pseudomonas aeruginosa PA01
gcgauacaccugc

SEQ ID NO: 1406186 - RNA, 15 nt, Pseudomonas aeruginosa PA01
gcgaguucgccggcc

SEQ ID NO: 1406187 - RNA, 17 nt, Pseudomonas aeruginosa PA01
gcgaguucgccggccag

SEQ ID NO: 1406188 - RNA, 18 nt, Pseudomonas aeruginosa PA01
gcgaguucgccggccagg

SEQ ID NO: 1406189 - RNA, 19 nt, Pseudomonas aeruginosa PA01
gcgaguucgccggccaggu

SEQ ID NO: 1406190 - RNA, 21 nt, Pseudomonas aeruginosa PA01
gcgagucguuacgaaacggcg

SEQ ID NO: 1406191 - RNA, 19 nt, Pseudomonas aeruginosa PA01
gcgagucuugaggaagucg

SEQ ID NO: 1406192 - RNA, 13 nt, Pseudomonas aeruginosa PA01
gcgaguucggcgu

SEQ ID NO: 1406193 - RNA, 14 nt, Pseudomonas aeruginosa PA01
gcgaguugcgcgag

SEQ ID NO: 1406194 - RNA, 21 nt, Pseudomonas aeruginosa PA01
gcgagcaugcucacugcgagc

SEQ ID NO: 1406195 - RNA, 15 nt, Pseudomonas aeruginosa PA01
gcgagcaucucggcc

SEQ ID NO: 1406196 - RNA, 17 nt, Pseudomonas aeruginosa PA01
gcgagcaucucggccag

SEQ ID NO: 1406197 - RNA, 18 nt, Pseudomonas aeruginosa PA01
gcgagcaucucggccagg

SEQ ID NO: 1406198 - RNA, 19 nt, Pseudomonas aeruginosa PA01
gcgagcaucucggccaggc

SEQ ID NO: 1406199 - RNA, 20 nt, Pseudomonas aeruginosa PA01
gcgagcaucucggccaggcc

SEQ ID NO: 1406200 - RNA, 17 nt, Pseudomonas aeruginosa PA01
gcgagcauuccucagcg

SEQ ID NO: 1406201 - RNA, 19 nt, Pseudomonas aeruginosa PA01
gcgagcauuccucagcgcc

SEQ ID NO: 1406202 - RNA, 20 nt, Pseudomonas aeruginosa PA01
gcgagcauuccucagcgccg

SEQ ID NO: 1406203 - RNA, 16 nt, Pseudomonas aeruginosa PA01
gcgagccgcagcggcu

SEQ ID NO: 1406204 - RNA, 20 nt, Pseudomonas aeruginosa PA01
gcgagccggcgcaucagcgc

SEQ ID NO: 1406205 - RNA, 12 nt, Pseudomonas aeruginosa PA01
gcgagccgcgcu

SEQ ID NO: 1406206 - RNA, 13 nt, Pseudomonas aeruginosa PA01
gcgagccgcgcug

SEQ ID NO: 1406207 - RNA, 16 nt, Pseudomonas aeruginosa PA01
gcgagccagccguggc

SEQ ID NO: 1406208 - RNA, 20 nt, Pseudomonas aeruginosa PA01
gcgagccgguagugcuucag

SEQ ID NO: 1406209 - RNA, 19 nt, Pseudomonas aeruginosa PA01
gcgagccuucagcacggcg

SEQ ID NO: 1406210 - RNA, 18 nt, Pseudomonas aeruginosa PA01
gcgagcgaaacggcgcug

SEQ ID NO: 1406211 - RNA, 20 nt, Pseudomonas aeruginosa PA01
gcgagcgaaacggcgcugaa

SEQ ID NO: 1406212 - RNA, 15 nt, Pseudomonas aeruginosa PA01
gcgagcagccgacga

SEQ ID NO: 1406213 - RNA, 21 nt, Pseudomonas aeruginosa PA01
gcgagcagggaggagggcgag

SEQ ID NO: 1406214 - RNA, 16 nt, Pseudomonas aeruginosa PA01
gcgagcagggcgaugc

SEQ ID NO: 1406215 - RNA, 18 nt, Pseudomonas aeruginosa PA01
gcgagcagggcgaugccg

SEQ ID NO: 1406216 - RNA, 19 nt, Pseudomonas aeruginosa PA01
gcgagcagggcgaugccga

SEQ ID NO: 1406217 - RNA, 20 nt, Pseudomonas aeruginosa PA01
gcgagaacuugccggcgcca

SEQ ID NO: 1406218 - RNA, 15 nt, Pseudomonas aeruginosa PA01
gcgagaagccagcca

SEQ ID NO: 1406219 - RNA, 14 nt, Pseudomonas aeruginosa PA01
gcgagaagccgccc

SEQ ID NO: 1406220 - RNA, 21 nt, Pseudomonas aeruginosa PA01
gcgacggcgcaagggcgccgc

SEQ ID NO: 1406221 - RNA, 20 nt, Pseudomonas aeruginosa PA01
gcgacugaccacgcagagcg

SEQ ID NO: 1406222 - RNA, 19 nt, Pseudomonas aeruginosa PA01
gcgacuggaugcagccgau

SEQ ID NO: 1406223 - RNA, 14 nt, Pseudomonas aeruginosa PA01
gcgacugcugauca

SEQ ID NO: 1406224 - RNA, 16 nt, Pseudomonas aeruginosa PA01
gcgacugcugcugcgg

SEQ ID NO: 1406225 - RNA, 20 nt, Pseudomonas aeruginosa PA01
gcgacugcgcuggccgagcu

SEQ ID NO: 1406226 - RNA, 21 nt, Pseudomonas aeruginosa PA01
gcgacugcgcuggccgagcug

SEQ ID NO: 1406227 - RNA, 20 nt, Pseudomonas aeruginosa PA01
gcgacuguucucuacgccgu

SEQ ID NO: 1406228 - RNA, 13 nt, Pseudomonas aeruginosa PA01
gcgacuggugguc

SEQ ID NO: 1406229 - RNA, 18 nt, Pseudomonas aeruginosa PA01
gcgacuuggacagcgucu

SEQ ID NO: 1406230 - RNA, 21 nt, Pseudomonas aeruginosa PA01
gcgagaaaggcugcuucggca

SEQ ID NO: 1406231 - RNA, 23 nt, Pseudomonas aeruginosa PA01
gcgagaaaggcugcuucggcagc

SEQ ID NO: 1406232 - RNA, 22 nt, Pseudomonas aeruginosa PA01
gcgagaaaaaccacgggaaugg

SEQ ID NO: 1406233 - RNA, 18 nt, Pseudomonas aeruginosa PA01
gcgacuuccuugcgcggg

SEQ ID NO: 1406234 - RNA, 15 nt, Pseudomonas aeruginosa PA01
gcggcauugagcgcc

SEQ ID NO: 1406235 - RNA, 19 nt, Pseudomonas aeruginosa PA01
gcggcauugagcgccagca

SEQ ID NO: 1406236 - RNA, 15 nt, Pseudomonas aeruginosa PA01
gcggcauucgcgcug

SEQ ID NO: 1406237 - RNA, 14 nt, Pseudomonas aeruginosa PA01
gcggcauggucagc

SEQ ID NO: 1406238 - RNA, 23 nt, Pseudomonas aeruginosa PA01
gcggcaugggcauccugccgccu

SEQ ID NO: 1406239 - RNA, 20 nt, Pseudomonas aeruginosa PA01
gcggcaucggccugguugua

SEQ ID NO: 1406240 - RNA, 13 nt, Pseudomonas aeruginosa PA01
gcggcaucggcgc

SEQ ID NO: 1406241 - RNA, 15 nt, Pseudomonas aeruginosa PA01
gcggcaucggcgccg

SEQ ID NO: 1406242 - RNA, 19 nt, Pseudomonas aeruginosa PA01
gcggcaucggcgccgcgca

SEQ ID NO: 1406243 - RNA, 15 nt, Pseudomonas aeruginosa PA01
gcggcaugccguaga

SEQ ID NO: 1406244 - RNA, 21 nt, Pseudomonas aeruginosa PA01
gcggcaugccguugggccagg

SEQ ID NO: 1406245 - RNA, 16 nt, Pseudomonas aeruginosa PA01
gcggcaugcccugccg

SEQ ID NO: 1406246 - RNA, 22 nt, Pseudomonas aeruginosa PA01
gcggcaugcccugccggcgcag

SEQ ID NO: 1406247 - RNA, 17 nt, Pseudomonas aeruginosa PA01
gcggccaccaccgugac

SEQ ID NO: 1406248 - RNA, 16 nt, Pseudomonas aeruginosa PA01
gcggccaaccucuccc

SEQ ID NO: 1406249 - RNA, 17 nt, Pseudomonas aeruginosa PA01
gcggcauccgccgcugg

SEQ ID NO: 1406250 - RNA, 18 nt, Pseudomonas aeruginosa PA01
gcggcauccgccgcuggg

SEQ ID NO: 1406251 - RNA, 13 nt, Pseudomonas aeruginosa PA01
gcggcaucgcgua

SEQ ID NO: 1406252 - RNA, 17 nt, Pseudomonas aeruginosa PA01
gcggcaucgcguagggc

SEQ ID NO: 1406253 - RNA, 15 nt, Pseudomonas aeruginosa PA01
gcggcauagcgcagc

SEQ ID NO: 1406254 - RNA, 23 nt, Pseudomonas aeruginosa PA01
gcggcauagaugccggccucgac

SEQ ID NO: 1406255 - RNA, 16 nt, Pseudomonas aeruginosa PA01
gcggaaaccugcaacu

SEQ ID NO: 1406256 - RNA, 22 nt, Pseudomonas aeruginosa PA01
gcggaaaccugcaacucggcgc

SEQ ID NO: 1406257 - RNA, 21 nt, Pseudomonas aeruginosa PA01
gcggaaaccgcauugacccgg

SEQ ID NO: 1406258 - RNA, 14 nt, Pseudomonas aeruginosa PA01
gcggaaaccgcggc

SEQ ID NO: 1406259 - RNA, 15 nt, Pseudomonas aeruginosa PA01
gcggaaaccgcggcc

SEQ ID NO: 1406260 - RNA, 17 nt, Pseudomonas aeruginosa PA01
gcgcuuuuccggcgccg

SEQ ID NO: 1406261 - RNA, 21 nt, Pseudomonas aeruginosa PA01
gcgcuuuuccggcgccggcag

SEQ ID NO: 1406262 - RNA, 17 nt, Pseudomonas aeruginosa PA01
gcgcuuuuccucgaccc

SEQ ID NO: 1406263 - RNA, 16 nt, Pseudomonas aeruginosa PA01
gcggaaaugcucgccg

SEQ ID NO: 1406264 - RNA, 15 nt, Pseudomonas aeruginosa PA01
gcggaaauacggcuc

SEQ ID NO: 1406265 - RNA, 15 nt, Pseudomonas aeruginosa PA01
gcggaaagcgacgcc

SEQ ID NO: 1406266 - RNA, 16 nt, Pseudomonas aeruginosa PA01
gcggaaagcgacgccg

SEQ ID NO: 1406267 - RNA, 19 nt, Pseudomonas aeruginosa PA01
gcggaaagcgacgccgcga

SEQ ID NO: 1406268 - RNA, 22 nt, Pseudomonas aeruginosa PA01
gcggcaguccucgccguuggcg

SEQ ID NO: 1406269 - RNA, 17 nt, Pseudomonas aeruginosa PA01
gcggaacaccgccugga

SEQ ID NO: 1406270 - RNA, 15 nt, Pseudomonas aeruginosa PA01
gcggcagugcucgau

SEQ ID NO: 1406271 - RNA, 21 nt, Pseudomonas aeruginosa PA01
gcggcagugcucgaucaggcu

SEQ ID NO: 1406272 - RNA, 15 nt, Pseudomonas aeruginosa PA01
gcggccacggcggau

SEQ ID NO: 1406273 - RNA, 13 nt, Pseudomonas aeruginosa PA01
gcggccagccccc

SEQ ID NO: 1406274 - RNA, 19 nt, Pseudomonas aeruginosa PA01
gcggccagcccccucgccc

SEQ ID NO: 1406275 - RNA, 19 nt, Pseudomonas aeruginosa PA01
gcggccagccgcuagcggu

SEQ ID NO: 1406276 - RNA, 15 nt, Pseudomonas aeruginosa PA01
gcggccagcagcacg

SEQ ID NO: 1406277 - RNA, 22 nt, Pseudomonas aeruginosa PA01
gcggccagcagcacgcccuggg

SEQ ID NO: 1406278 - RNA, 19 nt, Pseudomonas aeruginosa PA01
gcggccagcagcacggcga

SEQ ID NO: 1406279 - RNA, 21 nt, Pseudomonas aeruginosa PA01
gcggccagcggaugcuggcgg

SEQ ID NO: 1406280 - RNA, 14 nt, Pseudomonas aeruginosa PA01
gcggccagggcgag

SEQ ID NO: 1406281 - RNA, 13 nt, Pseudomonas aeruginosa PA01
gcggccaggcgcu

SEQ ID NO: 1406282 - RNA, 19 nt, Pseudomonas aeruginosa PA01
gcggccagggcauggguca

SEQ ID NO: 1406283 - RNA, 21 nt, Pseudomonas aeruginosa PA01
gcggccagggcaugggucagc

SEQ ID NO: 1406284 - RNA, 24 nt, Pseudomonas aeruginosa PA01
gcggccagggcaugggucagcgcc

SEQ ID NO: 1406285 - RNA, 14 nt, Pseudomonas aeruginosa PA01
gcggccagcgcggc

SEQ ID NO: 1406286 - RNA, 21 nt, Pseudomonas aeruginosa PA01
gcggccagcauuuugcggaaa

SEQ ID NO: 1406287 - RNA, 16 nt, Pseudomonas aeruginosa PA01
gcggcccgagggcggc

SEQ ID NO: 1406288 - RNA, 19 nt, Pseudomonas aeruginosa PA01
gcggcccgagggcggcagg

SEQ ID NO: 1406289 - RNA, 22 nt, Pseudomonas aeruginosa PA01
gcggccccuucagcuccagcag

SEQ ID NO: 1406290 - RNA, 23 nt, Pseudomonas aeruginosa PA01
gcggccccuucagcuccagcagu

SEQ ID NO: 1406291 - RNA, 13 nt, Pseudomonas aeruginosa PA01
gcggccccgagcg

SEQ ID NO: 1406292 - RNA, 19 nt, Pseudomonas aeruginosa PA01
gcggccccgagcgggccga

SEQ ID NO: 1406293 - RNA, 18 nt, Pseudomonas aeruginosa PA01
gcggccccaaggggccgc

SEQ ID NO: 1406294 - RNA, 15 nt, Pseudomonas aeruginosa PA01
gcggccccggcgcuc

SEQ ID NO: 1406295 - RNA, 17 nt, Pseudomonas aeruginosa PA01
gcggccccggcgcucgc

SEQ ID NO: 1406296 - RNA, 12 nt, Pseudomonas aeruginosa PA01
gcggcccaugcg

SEQ ID NO: 1406297 - RNA, 18 nt, Pseudomonas aeruginosa PA01
gcggcccaugcggaucgc

SEQ ID NO: 1406298 - RNA, 15 nt, Pseudomonas aeruginosa PA01
gcggcccagcggcag

SEQ ID NO: 1406299 - RNA, 22 nt, Pseudomonas aeruginosa PA01
gcggccauugcccgguggccuc

SEQ ID NO: 1406300 - RNA, 17 nt, Pseudomonas aeruginosa PA01
gcggccauugucggccu

SEQ ID NO: 1406301 - RNA, 13 nt, Pseudomonas aeruginosa PA01
gcggccaucggcg

SEQ ID NO: 1406302 - RNA, 14 nt, Pseudomonas aeruginosa PA01
gcggccaucggcga

SEQ ID NO: 1406303 - RNA, 15 nt, Pseudomonas aeruginosa PA01
gcggccaucggcgaa

SEQ ID NO: 1406304 - RNA, 17 nt, Pseudomonas aeruginosa PA01
gcggccaucggcgaagc

SEQ ID NO: 1406305 - RNA, 22 nt, Pseudomonas aeruginosa PA01
gcggccaguucggggucggccu

SEQ ID NO: 1406306 - RNA, 23 nt, Pseudomonas aeruginosa PA01
gcggccaguuguuccggcuggac

SEQ ID NO: 1406307 - RNA, 16 nt, Pseudomonas aeruginosa PA01
gcggccaucaggcgcu

SEQ ID NO: 1406308 - RNA, 15 nt, Pseudomonas aeruginosa PA01
gcggccgagggcgag

SEQ ID NO: 1406309 - RNA, 22 nt, Pseudomonas aeruginosa PA01
gcggccgaggaaggcgcuggcg

SEQ ID NO: 1406310 - RNA, 21 nt, Pseudomonas aeruginosa PA01
gcggccgaugcuaucgcgugg

SEQ ID NO: 1406311 - RNA, 14 nt, Pseudomonas aeruginosa PA01
gcggccgaguucgc

SEQ ID NO: 1406312 - RNA, 17 nt, Pseudomonas aeruginosa PA01
gcggccgaguucgcgca

SEQ ID NO: 1406313 - RNA, 18 nt, Pseudomonas aeruginosa PA01
gcggccgccaucgcccgg

SEQ ID NO: 1406314 - RNA, 14 nt, Pseudomonas aeruginosa PA01
gcggccgccgagca

SEQ ID NO: 1406315 - RNA, 16 nt, Pseudomonas aeruginosa PA01
gcggccgccgagcaac

SEQ ID NO: 1406316 - RNA, 16 nt, Pseudomonas aeruginosa PA01
gcggccgccgccgaca

SEQ ID NO: 1406317 - RNA, 13 nt, Pseudomonas aeruginosa PA01
gcggccgccggcg

SEQ ID NO: 1406318 - RNA, 14 nt, Pseudomonas aeruginosa PA01
gcggccgccggcgc

SEQ ID NO: 1406319 - RNA, 15 nt, Pseudomonas aeruginosa PA01
gcggccgccggcgcc

SEQ ID NO: 1406320 - RNA, 16 nt, Pseudomonas aeruginosa PA01
gcggccgccggcgccc

SEQ ID NO: 1406321 - RNA, 19 nt, Pseudomonas aeruginosa PA01
gcggccgccggcgcccugc

SEQ ID NO: 1406322 - RNA, 14 nt, Pseudomonas aeruginosa PA01
gcggccgccgcgca

SEQ ID NO: 1406323 - RNA, 20 nt, Pseudomonas aeruginosa PA01
gcggccgcgagcgcggccgg

SEQ ID NO: 1406324 - RNA, 17 nt, Pseudomonas aeruginosa PA01
gcggcccugcucgccgg

SEQ ID NO: 1406325 - RNA, 13 nt, Pseudomonas aeruginosa PA01
gcggcccugcgcc

SEQ ID NO: 1406326 - RNA, 15 nt, Pseudomonas aeruginosa PA01
gcggcccugcgccgc

SEQ ID NO: 1406327 - RNA, 17 nt, Pseudomonas aeruginosa PA01
gcggcccugcgccgcag

SEQ ID NO: 1406328 - RNA, 13 nt, Pseudomonas aeruginosa PA01
gcggcccuugucg

SEQ ID NO: 1406329 - RNA, 20 nt, Pseudomonas aeruginosa PA01
gcggcccuugucgccgcugg

SEQ ID NO: 1406330 - RNA, 19 nt, Pseudomonas aeruginosa PA01
gcggcccuuguucgcggcg

SEQ ID NO: 1406331 - RNA, 19 nt, Pseudomonas aeruginosa PA01
gcggccgagcaccacgcgc

SEQ ID NO: 1406332 - RNA, 22 nt, Pseudomonas aeruginosa PA01
gcggccgagcaggcgcgccagg

SEQ ID NO: 1406333 - RNA, 21 nt, Pseudomonas aeruginosa PA01
gcggccgagcauguaggcgca

SEQ ID NO: 1406334 - RNA, 17 nt, Pseudomonas aeruginosa PA01
gcggccgaccaggccgu

SEQ ID NO: 1406335 - RNA, 22 nt, Pseudomonas aeruginosa PA01
gcggccgaccaggccguaggcg

SEQ ID NO: 1406336 - RNA, 17 nt, Pseudomonas aeruginosa PA01
gcggccgaacucuggcg

SEQ ID NO: 1406337 - RNA, 20 nt, Pseudomonas aeruginosa PA01
gcggccgaacucuggcggcg

SEQ ID NO: 1406338 - RNA, 16 nt, Pseudomonas aeruginosa PA01
gcggccgaacuggaug

SEQ ID NO: 1406339 - RNA, 21 nt, Pseudomonas aeruginosa PA01
gcggccgaacuggaugauggu

SEQ ID NO: 1406340 - RNA, 18 nt, Pseudomonas aeruginosa PA01
gcggccgaauccuccagc

SEQ ID NO: 1406341 - RNA, 21 nt, Pseudomonas aeruginosa PA01
gcggccgaauccuccagccgg

SEQ ID NO: 1406342 - RNA, 22 nt, Pseudomonas aeruginosa PA01
gcggccgaauccuccagccggc

SEQ ID NO: 1406343 - RNA, 23 nt, Pseudomonas aeruginosa PA01
gcggccgaauccuccagccggcg

SEQ ID NO: 1406344 - RNA, 22 nt, Pseudomonas aeruginosa PA01
gcggcccgccacagaucgccag

SEQ ID NO: 1406345 - RNA, 16 nt, Pseudomonas aeruginosa PA01
gcggcccggcaggcgc

SEQ ID NO: 1406346 - RNA, 20 nt, Pseudomonas aeruginosa PA01
gcggcccggcaggcgcacgc

SEQ ID NO: 1406347 - RNA, 13 nt, Pseudomonas aeruginosa PA01
gcggcccggcgcu

SEQ ID NO: 1406348 - RNA, 13 nt, Pseudomonas aeruginosa PA01
gcggcccggcgua

SEQ ID NO: 1406349 - RNA, 16 nt, Pseudomonas aeruginosa PA01
gcggcccguccgcgcc

SEQ ID NO: 1406350 - RNA, 19 nt, Pseudomonas aeruginosa PA01
gcggcccguccgcgccacg

SEQ ID NO: 1406351 - RNA, 14 nt, Pseudomonas aeruginosa PA01
gcggcccgcacagg

SEQ ID NO: 1406352 - RNA, 14 nt, Pseudomonas aeruginosa PA01
gcggcccgccggcg

SEQ ID NO: 1406353 - RNA, 15 nt, Pseudomonas aeruginosa PA01
gcggcccgccggcga

SEQ ID NO: 1406354 - RNA, 16 nt, Pseudomonas aeruginosa PA01
gcggcccgccggcgaa

SEQ ID NO: 1406355 - RNA, 14 nt, Pseudomonas aeruginosa PA01
gcggcccgcgguca

SEQ ID NO: 1406356 - RNA, 15 nt, Pseudomonas aeruginosa PA01
gcggccguucgcccu

SEQ ID NO: 1406357 - RNA, 18 nt, Pseudomonas aeruginosa PA01
gcggccucaggccuggcg

SEQ ID NO: 1406358 - RNA, 20 nt, Pseudomonas aeruginosa PA01
gcggccucaggccuggcgca

SEQ ID NO: 1406359 - RNA, 15 nt, Pseudomonas aeruginosa PA01
gcggccuacuugauc

SEQ ID NO: 1406360 - RNA, 18 nt, Pseudomonas aeruginosa PA01
gcggccuacuugaucagc

SEQ ID NO: 1406361 - RNA, 21 nt, Pseudomonas aeruginosa PA01
gcggccuacuugaucagccgc

SEQ ID NO: 1406362 - RNA, 19 nt, Pseudomonas aeruginosa PA01
gcggccucgaggucggccu

SEQ ID NO: 1406363 - RNA, 17 nt, Pseudomonas aeruginosa PA01
gcggccucgauggcggc

SEQ ID NO: 1406364 - RNA, 18 nt, Pseudomonas aeruginosa PA01
gcggccucgauggcggca

SEQ ID NO: 1406365 - RNA, 16 nt, Pseudomonas aeruginosa PA01
gcggccucgcuggcga

SEQ ID NO: 1406366 - RNA, 15 nt, Pseudomonas aeruginosa PA01
gcggccucggccucg

SEQ ID NO: 1406367 - RNA, 17 nt, Pseudomonas aeruginosa PA01
gcggccucggccucguc

SEQ ID NO: 1406368 - RNA, 21 nt, Pseudomonas aeruginosa PA01
gcggccucggccucgucgagc

SEQ ID NO: 1406369 - RNA, 18 nt, Pseudomonas aeruginosa PA01
gcggccucguaggcggcg

SEQ ID NO: 1406370 - RNA, 12 nt, Pseudomonas aeruginosa PA01
gcggccucggcc

SEQ ID NO: 1406371 - RNA, 13 nt, Pseudomonas aeruginosa PA01
gcggccugggccg

SEQ ID NO: 1406372 - RNA, 21 nt, Pseudomonas aeruginosa PA01
gcggccugggccgaaggccag

SEQ ID NO: 1406373 - RNA, 22 nt, Pseudomonas aeruginosa PA01
gcggccugggccgaaggccagg

SEQ ID NO: 1406374 - RNA, 19 nt, Pseudomonas aeruginosa PA01
gcggccugguagucgccgg

SEQ ID NO: 1406375 - RNA, 15 nt, Pseudomonas aeruginosa PA01
gcggccuucggcguc

SEQ ID NO: 1406376 - RNA, 19 nt, Pseudomonas aeruginosa PA01
gcggccuucggcgucgaag

SEQ ID NO: 1406377 - RNA, 17 nt, Pseudomonas aeruginosa PA01
gcggccuucucgucgcc

SEQ ID NO: 1406378 - RNA, 18 nt, Pseudomonas aeruginosa PA01
gcggccuucucgucgccg

SEQ ID NO: 1406379 - RNA, 19 nt, Pseudomonas aeruginosa PA01
gcggccuucuugcugccgg

SEQ ID NO: 1406380 - RNA, 20 nt, Pseudomonas aeruginosa PA01
gcggccuucuugcugccggc

SEQ ID NO: 1406381 - RNA, 15 nt, Pseudomonas aeruginosa PA01
gcggccugcucgcgc

SEQ ID NO: 1406382 - RNA, 14 nt, Pseudomonas aeruginosa PA01
gcggccugcucggc

SEQ ID NO: 1406383 - RNA, 17 nt, Pseudomonas aeruginosa PA01
gcggccugcucggcucg

SEQ ID NO: 1406384 - RNA, 18 nt, Pseudomonas aeruginosa PA01
gcggccugcucggcucgc

SEQ ID NO: 1406385 - RNA, 15 nt, Pseudomonas aeruginosa PA01
gcggccugcagcgac

SEQ ID NO: 1406386 - RNA, 16 nt, Pseudomonas aeruginosa PA01
gcggccucuucgucgg

SEQ ID NO: 1406387 - RNA, 16 nt, Pseudomonas aeruginosa PA01
gcggccugagccggcc

SEQ ID NO: 1406388 - RNA, 23 nt, Pseudomonas aeruginosa PA01
gcggccugagcugccgcuucggc

SEQ ID NO: 1406389 - RNA, 14 nt, Pseudomonas aeruginosa PA01
gcggccugcaacgc

SEQ ID NO: 1406390 - RNA, 17 nt, Pseudomonas aeruginosa PA01
gcggccugcaacgccgc

SEQ ID NO: 1406391 - RNA, 19 nt, Pseudomonas aeruginosa PA01
gcggccugcaacgccgcca

SEQ ID NO: 1406392 - RNA, 18 nt, Pseudomonas aeruginosa PA01
gcggccggcuucagcaac

SEQ ID NO: 1406393 - RNA, 14 nt, Pseudomonas aeruginosa PA01
gcggccggcgccgc

SEQ ID NO: 1406394 - RNA, 13 nt, Pseudomonas aeruginosa PA01
gcggccggcgacc

SEQ ID NO: 1406395 - RNA, 14 nt, Pseudomonas aeruginosa PA01
gcggccggcgaccu

SEQ ID NO: 1406396 - RNA, 20 nt, Pseudomonas aeruginosa PA01
gcggccggcgcggacggccu

SEQ ID NO: 1406397 - RNA, 11 nt, Pseudomonas aeruginosa PA01
gcggccggcag

SEQ ID NO: 1406398 - RNA, 14 nt, Pseudomonas aeruginosa PA01
gcggccggcaggcc

SEQ ID NO: 1406399 - RNA, 16 nt, Pseudomonas aeruginosa PA01
gcggccggcaggccga

SEQ ID NO: 1406400 - RNA, 20 nt, Pseudomonas aeruginosa PA01
gcggccggcaggccgauggc

SEQ ID NO: 1406401 - RNA, 13 nt, Pseudomonas aeruginosa PA01
gcggccggccagg

SEQ ID NO: 1406402 - RNA, 14 nt, Pseudomonas aeruginosa PA01
gcggccggccaggu

SEQ ID NO: 1406403 - RNA, 21 nt, Pseudomonas aeruginosa PA01
gcggccggugccuucggcggc

SEQ ID NO: 1406404 - RNA, 16 nt, Pseudomonas aeruginosa PA01
gcggccguagccgucg

SEQ ID NO: 1406405 - RNA, 17 nt, Pseudomonas aeruginosa PA01
gcggccguagccgucga

SEQ ID NO: 1406406 - RNA, 18 nt, Pseudomonas aeruginosa PA01
gcggccgugcaugccgac

SEQ ID NO: 1406407 - RNA, 15 nt, Pseudomonas aeruginosa PA01
gcggccguuguccag

SEQ ID NO: 1406408 - RNA, 14 nt, Pseudomonas aeruginosa PA01
gcggccgucggccu

SEQ ID NO: 1406409 - RNA, 20 nt, Pseudomonas aeruginosa PA01
gcgggacagcuugccgucca

SEQ ID NO: 1406410 - RNA, 14 nt, Pseudomonas aeruginosa PA01
gcgggacgccgcag

SEQ ID NO: 1406411 - RNA, 15 nt, Pseudomonas aeruginosa PA01
gcgggacgccgcagg

SEQ ID NO: 1406412 - RNA, 15 nt, Pseudomonas aeruginosa PA01
gcgggacgaugccga

SEQ ID NO: 1406413 - RNA, 16 nt, Pseudomonas aeruginosa PA01
gcgggacgaugccgau

SEQ ID NO: 1406414 - RNA, 18 nt, Pseudomonas aeruginosa PA01
gcgggacgcguucccccg

SEQ ID NO: 1406415 - RNA, 19 nt, Pseudomonas aeruginosa PA01
gcgggacuuguacucgccg

SEQ ID NO: 1406416 - RNA, 22 nt, Pseudomonas aeruginosa PA01
gcgggacuuguacucgccggug

SEQ ID NO: 1406417 - RNA, 13 nt, Pseudomonas aeruginosa PA01
gcgggagcggccu

SEQ ID NO: 1406418 - RNA, 20 nt, Pseudomonas aeruginosa PA01
gcgggagagggcggcgaccg

SEQ ID NO: 1406419 - RNA, 14 nt, Pseudomonas aeruginosa PA01
gcgggaggccgccu

SEQ ID NO: 1406420 - RNA, 17 nt, Pseudomonas aeruginosa PA01
gcgggaggccgccucga

SEQ ID NO: 1406421 - RNA, 16 nt, Pseudomonas aeruginosa PA01
gcgggcagacaccacc

SEQ ID NO: 1406422 - RNA, 16 nt, Pseudomonas aeruginosa PA01
gcgggcaugcaccuac

SEQ ID NO: 1406423 - RNA, 14 nt, Pseudomonas aeruginosa PA01
gcgggcccagcggu

SEQ ID NO: 1406424 - RNA, 21 nt, Pseudomonas aeruginosa PA01
gcggcuucagccagaccggca

SEQ ID NO: 1406425 - RNA, 20 nt, Pseudomonas aeruginosa PA01
gcggcucgccgaaaggccgu

SEQ ID NO: 1406426 - RNA, 16 nt, Pseudomonas aeruginosa PA01
gcggcuuccagguacg

SEQ ID NO: 1406427 - RNA, 14 nt, Pseudomonas aeruginosa PA01
gcggcuugcccugc

SEQ ID NO: 1406428 - RNA, 21 nt, Pseudomonas aeruginosa PA01
gcggcuugcccugcucgucgc

SEQ ID NO: 1406429 - RNA, 21 nt, Pseudomonas aeruginosa PA01
gcggcuugcagucgaaaaccg

SEQ ID NO: 1406430 - RNA, 20 nt, Pseudomonas aeruginosa PA01
gcggcuucgcgcuccaggcc

SEQ ID NO: 1406431 - RNA, 21 nt, Pseudomonas aeruginosa PA01
gcggcuucgcgcuccaggccc

SEQ ID NO: 1406432 - RNA, 19 nt, Pseudomonas aeruginosa PA01
gcggcuugccggcgcgcgg

SEQ ID NO: 1406433 - RNA, 15 nt, Pseudomonas aeruginosa PA01
gcggcuuguccuggc

SEQ ID NO: 1406434 - RNA, 16 nt, Pseudomonas aeruginosa PA01
gcggcuuguccuggcg

SEQ ID NO: 1406435 - RNA, 14 nt, Pseudomonas aeruginosa PA01
gcgggaacuuggcg

SEQ ID NO: 1406436 - RNA, 21 nt, Pseudomonas aeruginosa PA01
gcgggaacuuggcgcgcaggg

SEQ ID NO: 1406437 - RNA, 23 nt, Pseudomonas aeruginosa PA01
gcggcguuuuucauugggcagcc

SEQ ID NO: 1406438 - RNA, 15 nt, Pseudomonas aeruginosa PA01
gcggcguugucggcc

SEQ ID NO: 1406439 - RNA, 16 nt, Pseudomonas aeruginosa PA01
gcggcguugucggcca

SEQ ID NO: 1406440 - RNA, 18 nt, Pseudomonas aeruginosa PA01
gcggcguugucggccagc

SEQ ID NO: 1406441 - RNA, 19 nt, Pseudomonas aeruginosa PA01
gcggcguugucggccagca

SEQ ID NO: 1406442 - RNA, 20 nt, Pseudomonas aeruginosa PA01
gcggcguugucggccagcag

SEQ ID NO: 1406443 - RNA, 21 nt, Pseudomonas aeruginosa PA01
gcggcguugucggccagcagc

SEQ ID NO: 1406444 - RNA, 18 nt, Pseudomonas aeruginosa PA01
gcggcucggcuccaggac

SEQ ID NO: 1406445 - RNA, 12 nt, Pseudomonas aeruginosa PA01
gcggcucggcca

SEQ ID NO: 1406446 - RNA, 13 nt, Pseudomonas aeruginosa PA01
gcggcucggccag

SEQ ID NO: 1406447 - RNA, 19 nt, Pseudomonas aeruginosa PA01
gcggcucggccagggccgc

SEQ ID NO: 1406448 - RNA, 16 nt, Pseudomonas aeruginosa PA01
gcggcuccggcgccag

SEQ ID NO: 1406449 - RNA, 17 nt, Pseudomonas aeruginosa PA01
gcggcuccggcgccagg

SEQ ID NO: 1406450 - RNA, 18 nt, Pseudomonas aeruginosa PA01
gcggcuccggcgccaggc

SEQ ID NO: 1406451 - RNA, 19 nt, Pseudomonas aeruginosa PA01
gcggcuccggcgccaggcc

SEQ ID NO: 1406452 - RNA, 14 nt, Pseudomonas aeruginosa PA01
gcggcuccucggcc

SEQ ID NO: 1406453 - RNA, 15 nt, Pseudomonas aeruginosa PA01
gcggcuccucggccu

SEQ ID NO: 1406454 - RNA, 17 nt, Pseudomonas aeruginosa PA01
gcggcuccucggccugg

SEQ ID NO: 1406455 - RNA, 23 nt, Pseudomonas aeruginosa PA01
gcggcuccucggccugggcgcag

SEQ ID NO: 1406456 - RNA, 16 nt, Pseudomonas aeruginosa PA01
gcgggcccguggcagg

SEQ ID NO: 1406457 - RNA, 17 nt, Pseudomonas aeruginosa PA01
gcgggcccguggcaggu

SEQ ID NO: 1406458 - RNA, 16 nt, Pseudomonas aeruginosa PA01
gcgggccgaggucgcg

SEQ ID NO: 1406459 - RNA, 21 nt, Pseudomonas aeruginosa PA01
gcgggccgaggucgcgggcca

SEQ ID NO: 1406460 - RNA, 23 nt, Pseudomonas aeruginosa PA01
gcgggccgaggucgcgggccagg

SEQ ID NO: 1406461 - RNA, 14 nt, Pseudomonas aeruginosa PA01
gcgggccgauccgc

SEQ ID NO: 1406462 - RNA, 12 nt, Pseudomonas aeruginosa PA01
gcgggccgacgg

SEQ ID NO: 1406463 - RNA, 16 nt, Pseudomonas aeruginosa PA01
gcgggccgcggcgacc

SEQ ID NO: 1406464 - RNA, 19 nt, Pseudomonas aeruginosa PA01
gcgggccgcucaggaugcg

SEQ ID NO: 1406465 - RNA, 16 nt, Pseudomonas aeruginosa PA01
gcgggccgcucgcgcg

SEQ ID NO: 1406466 - RNA, 18 nt, Pseudomonas aeruginosa PA01
gcgggccgccuggucggg

SEQ ID NO: 1406467 - RNA, 12 nt, Pseudomonas aeruginosa PA01
gcgggccgcgcc

SEQ ID NO: 1406468 - RNA, 15 nt, Pseudomonas aeruginosa PA01
gcgggccggcgaugg

SEQ ID NO: 1406469 - RNA, 17 nt, Pseudomonas aeruginosa PA01
gcgggccggcguccagg

SEQ ID NO: 1406470 - RNA, 19 nt, Pseudomonas aeruginosa PA01
gcgggccguagggcgaaca

SEQ ID NO: 1406471 - RNA, 15 nt, Pseudomonas aeruginosa PA01
gcgggccucggcggg

SEQ ID NO: 1406472 - RNA, 17 nt, Pseudomonas aeruginosa PA01
gcgggcgacgugggccu

SEQ ID NO: 1406473 - RNA, 15 nt, Pseudomonas aeruginosa PA01
gcgggcgagggcggc

SEQ ID NO: 1406474 - RNA, 17 nt, Pseudomonas aeruginosa PA01
gcgggcgagggcggcgc

SEQ ID NO: 1406475 - RNA, 13 nt, Pseudomonas aeruginosa PA01
gcgggccugggca

SEQ ID NO: 1406476 - RNA, 16 nt, Pseudomonas aeruginosa PA01
gcgggccuucgccagc

SEQ ID NO: 1406477 - RNA, 17 nt, Pseudomonas aeruginosa PA01
gcgggccuucgccagcg

SEQ ID NO: 1406478 - RNA, 23 nt, Pseudomonas aeruginosa PA01
gcgggccuucgccagcggccagg

SEQ ID NO: 1406479 - RNA, 23 nt, Pseudomonas aeruginosa PA01
gcgggccuucgccuucggcgugc

SEQ ID NO: 1406480 - RNA, 23 nt, Pseudomonas aeruginosa PA01
gcgggccuugaccaccgccaggc

SEQ ID NO: 1406481 - RNA, 20 nt, Pseudomonas aeruginosa PA01
gcgggcgaagcgcagcuccg

SEQ ID NO: 1406482 - RNA, 21 nt, Pseudomonas aeruginosa PA01
gcgggcgaagcgcagcuccgg

SEQ ID NO: 1406483 - RNA, 13 nt, Pseudomonas aeruginosa PA01
gcgggccuuggcg

SEQ ID NO: 1406484 - RNA, 15 nt, Pseudomonas aeruginosa PA01
gcgggccuuggcgua

SEQ ID NO: 1406485 - RNA, 21 nt, Pseudomonas aeruginosa PA01
gcgggcgcuugaagccggcgu

SEQ ID NO: 1406486 - RNA, 21 nt, Pseudomonas aeruginosa PA01
gcgggcggccccuucagcucc

SEQ ID NO: 1406487 - RNA, 15 nt, Pseudomonas aeruginosa PA01
gcgggcggcgucgaa

SEQ ID NO: 1406488 - RNA, 16 nt, Pseudomonas aeruginosa PA01
gcgggcggcgucgaaa

SEQ ID NO: 1406489 - RNA, 19 nt, Pseudomonas aeruginosa PA01
gcgggcggucgucgccauc

SEQ ID NO: 1406490 - RNA, 14 nt, Pseudomonas aeruginosa PA01
gcgggcguccggcg

SEQ ID NO: 1406491 - RNA, 17 nt, Pseudomonas aeruginosa PA01
gcgggcguccggcgagc

SEQ ID NO: 1406492 - RNA, 22 nt, Pseudomonas aeruginosa PA01
gcgggcguccggcgagcacggc

SEQ ID NO: 1406493 - RNA, 17 nt, Pseudomonas aeruginosa PA01
gcgggcguagcgcggca

SEQ ID NO: 1406494 - RNA, 22 nt, Pseudomonas aeruginosa PA01
gcgggcguagcgcggcagcgcc

SEQ ID NO: 1406495 - RNA, 23 nt, Pseudomonas aeruginosa PA01
gcgggcguagcgcggcagcgcca

SEQ ID NO: 1406496 - RNA, 20 nt, Pseudomonas aeruginosa PA01
gcgggcgguagcgggccagc

SEQ ID NO: 1406497 - RNA, 22 nt, Pseudomonas aeruginosa PA01
gcgggcgguagcgggccagcag

SEQ ID NO: 1406498 - RNA, 21 nt, Pseudomonas aeruginosa PA01
gcgggcgaugaggcuguccag

SEQ ID NO: 1406499 - RNA, 23 nt, Pseudomonas aeruginosa PA01
gcgggcgaugaggcuguccagca

SEQ ID NO: 1406500 - RNA, 15 nt, Pseudomonas aeruginosa PA01
gcgggcgaucucgcg

SEQ ID NO: 1406501 - RNA, 19 nt, Pseudomonas aeruginosa PA01
gcgggcgaucuccucgauc

SEQ ID NO: 1406502 - RNA, 13 nt, Pseudomonas aeruginosa PA01
gcgggcgccgaug

SEQ ID NO: 1406503 - RNA, 17 nt, Pseudomonas aeruginosa PA01
gcgggcgccgaugccgg

SEQ ID NO: 1406504 - RNA, 18 nt, Pseudomonas aeruginosa PA01
gcgggcgccgaugccggc

SEQ ID NO: 1406505 - RNA, 19 nt, Pseudomonas aeruginosa PA01
gcgggcgccgaugccggcc

SEQ ID NO: 1406506 - RNA, 20 nt, Pseudomonas aeruginosa PA01
gcgggcgccgaugccggccg

SEQ ID NO: 1406507 - RNA, 13 nt, Pseudomonas aeruginosa PA01
gcgggcgccgccg

SEQ ID NO: 1406508 - RNA, 21 nt, Pseudomonas aeruginosa PA01
gcgggcgccguggaucgcccg

SEQ ID NO: 1406509 - RNA, 14 nt, Pseudomonas aeruginosa PA01
gcgggcgccggacc

SEQ ID NO: 1406510 - RNA, 24 nt, Pseudomonas aeruginosa PA01
gcgggcgcgaggcgcccgccggcc

SEQ ID NO: 1406511 - RNA, 15 nt, Pseudomonas aeruginosa PA01
gcgggcgcgcagcag

SEQ ID NO: 1406512 - RNA, 20 nt, Pseudomonas aeruginosa PA01
gcgggcgcgggcguugucca

SEQ ID NO: 1406513 - RNA, 12 nt, Pseudomonas aeruginosa PA01
gcgggcgcggua

SEQ ID NO: 1406514 - RNA, 21 nt, Pseudomonas aeruginosa PA01
gcgggcgcgguaggugaugcg

SEQ ID NO: 1406515 - RNA, 19 nt, Pseudomonas aeruginosa PA01
gcgggcgcggaucggcgug

SEQ ID NO: 1406516 - RNA, 16 nt, Pseudomonas aeruginosa PA01
gcggcgcguaggcgaa

SEQ ID NO: 1406517 - RNA, 18 nt, Pseudomonas aeruginosa PA01
gcggcgcguaggcgaaca

SEQ ID NO: 1406518 - RNA, 17 nt, Pseudomonas aeruginosa PA01
gcggcgcgggcgcgcgc

SEQ ID NO: 1406519 - RNA, 13 nt, Pseudomonas aeruginosa PA01
gcggcgcgggucu

SEQ ID NO: 1406520 - RNA, 15 nt, Pseudomonas aeruginosa PA01
gcggcggcaccacgu

SEQ ID NO: 1406521 - RNA, 22 nt, Pseudomonas aeruginosa PA01
gcggcggcaccacgugcagcag

SEQ ID NO: 1406522 - RNA, 15 nt, Pseudomonas aeruginosa PA01
gcggcggcaccgacg

SEQ ID NO: 1406523 - RNA, 21 nt, Pseudomonas aeruginosa PA01
gcggcggcaccgacgccgaag

SEQ ID NO: 1406524 - RNA, 14 nt, Pseudomonas aeruginosa PA01
gcggcggcacgacc

SEQ ID NO: 1406525 - RNA, 15 nt, Pseudomonas aeruginosa PA01
gcggcgcgucggugc

SEQ ID NO: 1406526 - RNA, 18 nt, Pseudomonas aeruginosa PA01
gcggcgcgucggugccgc

SEQ ID NO: 1406527 - RNA, 22 nt, Pseudomonas aeruginosa PA01
gcggcgcuacgaaggcgugccg

SEQ ID NO: 1406528 - RNA, 14 nt, Pseudomonas aeruginosa PA01
gcggcggcaggcca

SEQ ID NO: 1406529 - RNA, 17 nt, Pseudomonas aeruginosa PA01
gcggcgcccucugccgg

SEQ ID NO: 1406530 - RNA, 23 nt, Pseudomonas aeruginosa PA01
gcggcgcccucugccggucggaa

SEQ ID NO: 1406531 - RNA, 13 nt, Pseudomonas aeruginosa PA01
gcggcgcgaugcc

SEQ ID NO: 1406532 - RNA, 15 nt, Pseudomonas aeruginosa PA01
gcggcgcccuggcuc

SEQ ID NO: 1406533 - RNA, 23 nt, Pseudomonas aeruginosa PA01
gcggcgcggauguucgccacgcu

SEQ ID NO: 1406534 - RNA, 13 nt, Pseudomonas aeruginosa PA01
gcggcgcgcugaa

SEQ ID NO: 1406535 - RNA, 19 nt, Pseudomonas aeruginosa PA01
gcggcgcgccuucagcgcc

SEQ ID NO: 1406536 - RNA, 14 nt, Pseudomonas aeruginosa PA01
gcggcgccagcgcc

SEQ ID NO: 1406537 - RNA, 12 nt, Pseudomonas aeruginosa PA01
gcggcgccaggc

SEQ ID NO: 1406538 - RNA, 17 nt, Pseudomonas aeruginosa PA01
gcggcgccaggccggcg

SEQ ID NO: 1406539 - RNA, 12 nt, Pseudomonas aeruginosa PA01
gcggcgcccgcc

SEQ ID NO: 1406540 - RNA, 22 nt, Pseudomonas aeruginosa PA01
gcggcgcccgccaagggcgccg

SEQ ID NO: 1406541 - RNA, 13 nt, Pseudomonas aeruginosa PA01
gcggcgccccagg

SEQ ID NO: 1406542 - RNA, 14 nt, Pseudomonas aeruginosa PA01
gcggcgccccaggc

SEQ ID NO: 1406543 - RNA, 19 nt, Pseudomonas aeruginosa PA01
gcggcgccccaggcgccca

SEQ ID NO: 1406544 - RNA, 20 nt, Pseudomonas aeruginosa PA01
gcggcgccccaggcgcccag

SEQ ID NO: 1406545 - RNA, 14 nt, Pseudomonas aeruginosa PA01
gcggcgcagcaacu

SEQ ID NO: 1406546 - RNA, 22 nt, Pseudomonas aeruginosa PA01
gcggcgcagccagagcuccagg

SEQ ID NO: 1406547 - RNA, 23 nt, Pseudomonas aeruginosa PA01
gcggcgccagcuccagcgcccag

SEQ ID NO: 1406548 - RNA, 18 nt, Pseudomonas aeruginosa PA01
gcggcgcaccgacgccgc

SEQ ID NO: 1406549 - RNA, 20 nt, Pseudomonas aeruginosa PA01
gcggcgcacugagggucagc

SEQ ID NO: 1406550 - RNA, 19 nt, Pseudomonas aeruginosa PA01
gcggccuucagcgguggcg

SEQ ID NO: 1406551 - RNA, 18 nt, Pseudomonas aeruginosa PA01
gcggccuuggucucgauc

SEQ ID NO: 1406552 - RNA, 19 nt, Pseudomonas aeruginosa PA01
gcggccuuuucggcggcca

SEQ ID NO: 1406553 - RNA, 22 nt, Pseudomonas aeruginosa PA01
gcggccuuuucggcggccaggc

SEQ ID NO: 1406554 - RNA, 23 nt, Pseudomonas aeruginosa PA01
gcggccuuuucggcggccaggcg

SEQ ID NO: 1406555 - RNA, 21 nt, Pseudomonas aeruginosa PA01
gcggcgcaaucagggcugggc

SEQ ID NO: 1406556 - RNA, 23 nt, Pseudomonas aeruginosa PA01
gcggcgcaaucagggcugggcgc

SEQ ID NO: 1406557 - RNA, 15 nt, Pseudomonas aeruginosa PA01
gcggcgaaacggcgg

SEQ ID NO: 1406558 - RNA, 19 nt, Pseudomonas aeruginosa PA01
gcggcgaugucggccugca

SEQ ID NO: 1406559 - RNA, 15 nt, Pseudomonas aeruginosa PA01
gcggcguucggaccu

SEQ ID NO: 1406560 - RNA, 14 nt, Pseudomonas aeruginosa PA01
gcggcguucgcccu

SEQ ID NO: 1406561 - RNA, 17 nt, Pseudomonas aeruginosa PA01
gcggcguucgcccugcg

SEQ ID NO: 1406562 - RNA, 19 nt, Pseudomonas aeruginosa PA01
gcggcguucgcccugcgga

SEQ ID NO: 1406563 - RNA, 20 nt, Pseudomonas aeruginosa PA01
gcggcguucgcccugcggau

SEQ ID NO: 1406564 - RNA, 15 nt, Pseudomonas aeruginosa PA01
gcggcguucgccgag

SEQ ID NO: 1406565 - RNA, 14 nt, Pseudomonas aeruginosa PA01
gcggcguucaucgc

SEQ ID NO: 1406566 - RNA, 19 nt, Pseudomonas aeruginosa PA01
gcggcguuauccgcccugc

SEQ ID NO: 1406567 - RNA, 17 nt, Pseudomonas aeruginosa PA01
gcggcguggaaggccac

SEQ ID NO: 1406568 - RNA, 23 nt, Pseudomonas aeruginosa PA01
gcggcguggcucgaucagccggc

SEQ ID NO: 1406569 - RNA, 17 nt, Pseudomonas aeruginosa PA01
gcggcgugaagccgccg

SEQ ID NO: 1406570 - RNA, 21 nt, Pseudomonas aeruginosa PA01
gcggcgugaagccgccgccca

SEQ ID NO: 1406571 - RNA, 23 nt, Pseudomonas aeruginosa PA01
gcggcgugaagccgccgcccagc

SEQ ID NO: 1406572 - RNA, 19 nt, Pseudomonas aeruginosa PA01
gcggcguauccucggccau

SEQ ID NO: 1406573 - RNA, 18 nt, Pseudomonas aeruginosa PA01
gcggcguaugcgccucca

SEQ ID NO: 1406574 - RNA, 17 nt, Pseudomonas aeruginosa PA01
gcggcguauucgccgaa

SEQ ID NO: 1406575 - RNA, 18 nt, Pseudomonas aeruginosa PA01
gcggcguauucgccgaag

SEQ ID NO: 1406576 - RNA, 19 nt, Pseudomonas aeruginosa PA01
gcggcguauucgccgaaga

SEQ ID NO: 1406577 - RNA, 15 nt, Pseudomonas aeruginosa PA01
gcggcgucccggcgc

SEQ ID NO: 1406578 - RNA, 16 nt, Pseudomonas aeruginosa PA01
gcggcgucccggcgcc

SEQ ID NO: 1406579 - RNA, 17 nt, Pseudomonas aeruginosa PA01
gcggcgucccggcgccg

SEQ ID NO: 1406580 - RNA, 14 nt, Pseudomonas aeruginosa PA01
gcggcguccgcguc

SEQ ID NO: 1406581 - RNA, 15 nt, Pseudomonas aeruginosa PA01
gcggcggguggcgcu

SEQ ID NO: 1406582 - RNA, 20 nt, Pseudomonas aeruginosa PA01
gcggcguaccuucgagcagg

SEQ ID NO: 1406583 - RNA, 13 nt, Pseudomonas aeruginosa PA01
gcggcguaggccu

SEQ ID NO: 1406584 - RNA, 15 nt, Pseudomonas aeruginosa PA01
gcggcguaggcgcgc

SEQ ID NO: 1406585 - RNA, 17 nt, Pseudomonas aeruginosa PA01
gcggcguaggcgcgcca

SEQ ID NO: 1406586 - RNA, 19 nt, Pseudomonas aeruginosa PA01
gcggcguaggcgcgccaag

SEQ ID NO: 1406587 - RNA, 19 nt, Pseudomonas aeruginosa PA01
gcggcggcguauucgccga

SEQ ID NO: 1406588 - RNA, 14 nt, Pseudomonas aeruginosa PA01
gcggcggcggccgc

SEQ ID NO: 1406589 - RNA, 15 nt, Pseudomonas aeruginosa PA01
gcggcggcggccgca

SEQ ID NO: 1406590 - RNA, 20 nt, Pseudomonas aeruginosa PA01
gcggcggcuucagccagacc

SEQ ID NO: 1406591 - RNA, 13 nt, Pseudomonas aeruginosa PA01
gcggcggcggcca

SEQ ID NO: 1406592 - RNA, 16 nt, Pseudomonas aeruginosa PA01
gcggcggcggccagca

SEQ ID NO: 1406593 - RNA, 13 nt, Pseudomonas aeruginosa PA01
gcggcggcucagg

SEQ ID NO: 1406594 - RNA, 22 nt, Pseudomonas aeruginosa PA01
gcggcggcuccggcgccaggcc

SEQ ID NO: 1406595 - RNA, 14 nt, Pseudomonas aeruginosa PA01
gcggcggcgugcag

SEQ ID NO: 1406596 - RNA, 17 nt, Pseudomonas aeruginosa PA01
gcggcgggacuggggca

SEQ ID NO: 1406597 - RNA, 20 nt, Pseudomonas aeruginosa PA01
gcggcgggaggucacaccga

SEQ ID NO: 1406598 - RNA, 14 nt, Pseudomonas aeruginosa PA01
gcggcgggccggcg

SEQ ID NO: 1406599 - RNA, 13 nt, Pseudomonas aeruginosa PA01
gcggcggcgacgc

SEQ ID NO: 1406600 - RNA, 13 nt, Pseudomonas aeruginosa PA01
gcggcggccgucg

SEQ ID NO: 1406601 - RNA, 15 nt, Pseudomonas aeruginosa PA01
gcggcggcggacagc

SEQ ID NO: 1406602 - RNA, 13 nt, Pseudomonas aeruginosa PA01
gcggcggcgcgga

SEQ ID NO: 1406603 - RNA, 14 nt, Pseudomonas aeruginosa PA01
gcggcggcgcggag

SEQ ID NO: 1406604 - RNA, 16 nt, Pseudomonas aeruginosa PA01
gcggcggcgcggagau

SEQ ID NO: 1406605 - RNA, 12 nt, Pseudomonas aeruginosa PA01
gcggcggcgcgu

SEQ ID NO: 1406606 - RNA, 15 nt, Pseudomonas aeruginosa PA01
gcggcggcgcgucgg

SEQ ID NO: 1406607 - RNA, 12 nt, Pseudomonas aeruginosa PA01
gcggcggcccgc

SEQ ID NO: 1406608 - RNA, 12 nt, Pseudomonas aeruginosa PA01
gcggcggccagc

SEQ ID NO: 1406609 - RNA, 13 nt, Pseudomonas aeruginosa PA01
gcggcggccagca

SEQ ID NO: 1406610 - RNA, 15 nt, Pseudomonas aeruginosa PA01
gcggcggccagcagc

SEQ ID NO: 1406611 - RNA, 18 nt, Pseudomonas aeruginosa PA01
gcggcggccgcaugccgg

SEQ ID NO: 1406612 - RNA, 15 nt, Pseudomonas aeruginosa PA01
gcguucgcccugcgg

SEQ ID NO: 1406613 - RNA, 19 nt, Pseudomonas aeruginosa PA01
gcguugacgcaguuccgcg

SEQ ID NO: 1406614 - RNA, 17 nt, Pseudomonas aeruginosa PA01
gcguugacgcggaugcc

SEQ ID NO: 1406615 - RNA, 12 nt, Pseudomonas aeruginosa PA01
gcguucgccgcg

SEQ ID NO: 1406616 - RNA, 17 nt, Pseudomonas aeruginosa PA01
gcguucgaucuccucgc

SEQ ID NO: 1406617 - RNA, 15 nt, Pseudomonas aeruginosa PA01
gcguucgccgaggcg

SEQ ID NO: 1406618 - RNA, 19 nt, Pseudomonas aeruginosa PA01
gcguucgccgaggcggcgc

SEQ ID NO: 1406619 - RNA, 13 nt, Pseudomonas aeruginosa PA01
gcguucugcugcu

SEQ ID NO: 1406620 - RNA, 21 nt, Pseudomonas aeruginosa PA01
gcguucugcuucucggcuacc

SEQ ID NO: 1406621 - RNA, 13 nt, Pseudomonas aeruginosa PA01
gcguucuucaccc

SEQ ID NO: 1406622 - RNA, 23 nt, Pseudomonas aeruginosa PA01
gcguucuucacccgcagcggcag

SEQ ID NO: 1406623 - RNA, 24 nt, Pseudomonas aeruginosa PA01
gcguucuucacccgcagcggcagc

SEQ ID NO: 1406624 - RNA, 15 nt, Pseudomonas aeruginosa PA01
gcguucuucagcacu

SEQ ID NO: 1406625 - RNA, 19 nt, Pseudomonas aeruginosa PA01
gcguuauucgcccuacagc

SEQ ID NO: 1406626 - RNA, 18 nt, Pseudomonas aeruginosa PA01
gcguuauucgcccuacgc

SEQ ID NO: 1406627 - RNA, 21 nt, Pseudomonas aeruginosa PA01
gcguucagccacggacgcgca

SEQ ID NO: 1406628 - RNA, 14 nt, Pseudomonas aeruginosa PA01
gcguucaccgcgca

SEQ ID NO: 1406629 - RNA, 18 nt, Pseudomonas aeruginosa PA01
gcguucgacgccuugccc

SEQ ID NO: 1406630 - RNA, 21 nt, Pseudomonas aeruginosa PA01
gcguucgacgccuugcccggc

SEQ ID NO: 1406631 - RNA, 22 nt, Pseudomonas aeruginosa PA01
gcguucgaagucauaggucacg

SEQ ID NO: 1406632 - RNA, 16 nt, Pseudomonas aeruginosa PA01
gcguuccuggcgcgcg

SEQ ID NO: 1406633 - RNA, 14 nt, Pseudomonas aeruginosa PA01
gcguuccuguccau

SEQ ID NO: 1406634 - RNA, 22 nt, Pseudomonas aeruginosa PA01
gcguuccuguucgcugccuucc

SEQ ID NO: 1406635 - RNA, 15 nt, Pseudomonas aeruginosa PA01
gcguucacgcgacca

SEQ ID NO: 1406636 - RNA, 18 nt, Pseudomonas aeruginosa PA01
gcguuccgggucgcugcc

SEQ ID NO: 1406637 - RNA, 20 nt, Pseudomonas aeruginosa PA01
gcguuccgggcagcggcgca

SEQ ID NO: 1406638 - RNA, 19 nt, Pseudomonas aeruginosa PA01
gcgugucgaggaaggccag

SEQ ID NO: 1406639 - RNA, 21 nt, Pseudomonas aeruginosa PA01
gcguguuacaucagaucgcgu

SEQ ID NO: 1406640 - RNA, 14 nt, Pseudomonas aeruginosa PA01
gcguguucggcggc

SEQ ID NO: 1406641 - RNA, 14 nt, Pseudomonas aeruginosa PA01
gcguguucgucgau

SEQ ID NO: 1406642 - RNA, 13 nt, Pseudomonas aeruginosa PA01
gcguuaugcgccc

SEQ ID NO: 1406643 - RNA, 23 nt, Pseudomonas aeruginosa PA01
gcguuaugcgcccuaccuguccc

SEQ ID NO: 1406644 - RNA, 17 nt, Pseudomonas aeruginosa PA01
gcguuauccgccgccga

SEQ ID NO: 1406645 - RNA, 20 nt, Pseudomonas aeruginosa PA01
gcguggaaccgcggcgcccu

SEQ ID NO: 1406646 - RNA, 13 nt, Pseudomonas aeruginosa PA01
gcgugcggccgau

SEQ ID NO: 1406647 - RNA, 21 nt, Pseudomonas aeruginosa PA01
gcguggccagcgaacccaggc

SEQ ID NO: 1406648 - RNA, 14 nt, Pseudomonas aeruginosa PA01
gcguggccagcgcc

SEQ ID NO: 1406649 - RNA, 15 nt, Pseudomonas aeruginosa PA01
gcguggccagcgccc

SEQ ID NO: 1406650 - RNA, 14 nt, Pseudomonas aeruginosa PA01
gcguggcaccgcuu

SEQ ID NO: 1406651 - RNA, 22 nt, Pseudomonas aeruginosa PA01
gcguggcacguacguccagggc

SEQ ID NO: 1406652 - RNA, 18 nt, Pseudomonas aeruginosa PA01
gcguuuuucauggcggca

SEQ ID NO: 1406653 - RNA, 19 nt, Pseudomonas aeruginosa PA01
gcguuuuucauugggcagc

SEQ ID NO: 1406654 - RNA, 13 nt, Pseudomonas aeruginosa PA01
gcguuucguugcg

SEQ ID NO: 1406655 - RNA, 17 nt, Pseudomonas aeruginosa PA01
gcguugcucgcaccagg

SEQ ID NO: 1406656 - RNA, 18 nt, Pseudomonas aeruginosa PA01
gcguugcucgcaccaggc

SEQ ID NO: 1406657 - RNA, 23 nt, Pseudomonas aeruginosa PA01
gcguugcucgcaccaggccaggu

SEQ ID NO: 1406658 - RNA, 18 nt, Pseudomonas aeruginosa PA01
gcguugcgccagaccagc

SEQ ID NO: 1406659 - RNA, 24 nt, Pseudomonas aeruginosa PA01
gcguuggaauaguggaucgcccga

SEQ ID NO: 1406660 - RNA, 15 nt, Pseudomonas aeruginosa PA01
gcguugcuuccaggc

SEQ ID NO: 1406661 - RNA, 17 nt, Pseudomonas aeruginosa PA01
gcguugcuuccaggcac

SEQ ID NO: 1406662 - RNA, 20 nt, Pseudomonas aeruginosa PA01
gcguugcuuguguccgccga

SEQ ID NO: 1406663 - RNA, 15 nt, Pseudomonas aeruginosa PA01
gcguuggccagcgcc

SEQ ID NO: 1406664 - RNA, 16 nt, Pseudomonas aeruginosa PA01
gcguuggccagcgcca

SEQ ID NO: 1406665 - RNA, 17 nt, Pseudomonas aeruginosa PA01
gcguuggccagcgccac

SEQ ID NO: 1406666 - RNA, 14 nt, Pseudomonas aeruginosa PA01
gcguugggccucgc

SEQ ID NO: 1406667 - RNA, 19 nt, Pseudomonas aeruginosa PA01
gcguugggccucgcugcgc

SEQ ID NO: 1406668 - RNA, 14 nt, Pseudomonas aeruginosa PA01
gcguuggcggugcc

SEQ ID NO: 1406669 - RNA, 15 nt, Pseudomonas aeruginosa PA01
gcguuggcggugccg

SEQ ID NO: 1406670 - RNA, 19 nt, Pseudomonas aeruginosa PA01
gcguuggcggugccgcaga

SEQ ID NO: 1406671 - RNA, 16 nt, Pseudomonas aeruginosa PA01
gcguuguucuucgacg

SEQ ID NO: 1406672 - RNA, 19 nt, Pseudomonas aeruginosa PA01
gcguugucggccagcagca

SEQ ID NO: 1406673 - RNA, 21 nt, Pseudomonas aeruginosa PA01
gcguuguagaucugcaccgcc

SEQ ID NO: 1406674 - RNA, 20 nt, Pseudomonas aeruginosa PA01
gcguuguaggaauagaucgc

SEQ ID NO: 1406675 - RNA, 18 nt, Pseudomonas aeruginosa PA01
gcguugucccugucccgc

SEQ ID NO: 1406676 - RNA, 21 nt, Pseudomonas aeruginosa PA01
gcguuuccggucacgcaggcg

SEQ ID NO: 1406677 - RNA, 23 nt, Pseudomonas aeruginosa PA01
gcgucgccgggaaacagggcgac

SEQ ID NO: 1406678 - RNA, 14 nt, Pseudomonas aeruginosa PA01
gcgucgccgggcgu

SEQ ID NO: 1406679 - RNA, 19 nt, Pseudomonas aeruginosa PA01
gcgucgccgccgcgggcga

SEQ ID NO: 1406680 - RNA, 17 nt, Pseudomonas aeruginosa PA01
gcgucgccugccaggcg

SEQ ID NO: 1406681 - RNA, 16 nt, Pseudomonas aeruginosa PA01
gcgucggcauggcugu

SEQ ID NO: 1406682 - RNA, 15 nt, Pseudomonas aeruginosa PA01
gcgucggcacgccga

SEQ ID NO: 1406683 - RNA, 16 nt, Pseudomonas aeruginosa PA01
gcgucggcacgccgaa

SEQ ID NO: 1406684 - RNA, 14 nt, Pseudomonas aeruginosa PA01
gcguccauggcggc

SEQ ID NO: 1406685 - RNA, 17 nt, Pseudomonas aeruginosa PA01
gcgucccauggcgccac

SEQ ID NO: 1406686 - RNA, 20 nt, Pseudomonas aeruginosa PA01
gcgucccgcuccagccggca

SEQ ID NO: 1406687 - RNA, 14 nt, Pseudomonas aeruginosa PA01
gcgucccggcgccg

SEQ ID NO: 1406688 - RNA, 16 nt, Pseudomonas aeruginosa PA01
gcguccgaacgcgcug

SEQ ID NO: 1406689 - RNA, 17 nt, Pseudomonas aeruginosa PA01
gcguccgaacgcgcuga

SEQ ID NO: 1406690 - RNA, 13 nt, Pseudomonas aeruginosa PA01
gcgucccugggcc

SEQ ID NO: 1406691 - RNA, 17 nt, Pseudomonas aeruginosa PA01
gcgucccugggcgcagg

SEQ ID NO: 1406692 - RNA, 16 nt, Pseudomonas aeruginosa PA01
gcgucccuuggcgucg

SEQ ID NO: 1406693 - RNA, 17 nt, Pseudomonas aeruginosa PA01
gcgucccuuggcgucgc

SEQ ID NO: 1406694 - RNA, 13 nt, Pseudomonas aeruginosa PA01
gcgucccugcaca

SEQ ID NO: 1406695 - RNA, 21 nt, Pseudomonas aeruginosa PA01
gcgucccuggagcagggcgau

SEQ ID NO: 1406696 - RNA, 14 nt, Pseudomonas aeruginosa PA01
gcgucgccgccagc

SEQ ID NO: 1406697 - RNA, 20 nt, Pseudomonas aeruginosa PA01
gcgucgccgacuucggcaag

SEQ ID NO: 1406698 - RNA, 16 nt, Pseudomonas aeruginosa PA01
gcgucgccgaacggca

SEQ ID NO: 1406699 - RNA, 23 nt, Pseudomonas aeruginosa PA01
gcgucgccgaacggcagcuggau

SEQ ID NO: 1406700 - RNA, 18 nt, Pseudomonas aeruginosa PA01
gcgucguaguggcgcaac

SEQ ID NO: 1406701 - RNA, 20 nt, Pseudomonas aeruginosa PA01
gcgucguaguugccucucga

SEQ ID NO: 1406702 - RNA, 17 nt, Pseudomonas aeruginosa PA01
gcgucguagagcgugcg

SEQ ID NO: 1406703 - RNA, 22 nt, Pseudomonas aeruginosa PA01
gcgucguagagcgugcggccga

SEQ ID NO: 1406704 - RNA, 21 nt, Pseudomonas aeruginosa PA01
gcgucgggcgaaacggcaggc

SEQ ID NO: 1406705 - RNA, 19 nt, Pseudomonas aeruginosa PA01
gcgucgggcgggaucaggu

SEQ ID NO: 1406706 - RNA, 23 nt, Pseudomonas aeruginosa PA01
gcgucgggcgggaucaggucgcc

SEQ ID NO: 1406707 - RNA, 13 nt, Pseudomonas aeruginosa PA01
gcgucggcgauca

SEQ ID NO: 1406708 - RNA, 14 nt, Pseudomonas aeruginosa PA01
gcgucggcgaucac

SEQ ID NO: 1406709 - RNA, 23 nt, Pseudomonas aeruginosa PA01
gcgucgggaaaggccgccacggc

SEQ ID NO: 1406710 - RNA, 14 nt, Pseudomonas aeruginosa PA01
gcgucggccuggcg

SEQ ID NO: 1406711 - RNA, 15 nt, Pseudomonas aeruginosa PA01
gcgucggccuggcgc

SEQ ID NO: 1406712 - RNA, 18 nt, Pseudomonas aeruginosa PA01
gcgucggccuggcgcagc

SEQ ID NO: 1406713 - RNA, 23 nt, Pseudomonas aeruginosa PA01
gcgucggccuggcgcagcggcag

SEQ ID NO: 1406714 - RNA, 16 nt, Pseudomonas aeruginosa PA01
gcgucggugccgcccg

SEQ ID NO: 1406715 - RNA, 14 nt, Pseudomonas aeruginosa PA01
gcgucgggcagggc

SEQ ID NO: 1406716 - RNA, 20 nt, Pseudomonas aeruginosa PA01
gcgucggucaggacagcgug

SEQ ID NO: 1406717 - RNA, 22 nt, Pseudomonas aeruginosa PA01
gcgucggucaggacagcgugcg

SEQ ID NO: 1406718 - RNA, 20 nt, Pseudomonas aeruginosa PA01
gcgucugcucauucggccag

SEQ ID NO: 1406719 - RNA, 23 nt, Pseudomonas aeruginosa PA01
gcgucucauggaacagcagccag

SEQ ID NO: 1406720 - RNA, 17 nt, Pseudomonas aeruginosa PA01
gcgucugccgcucguug

SEQ ID NO: 1406721 - RNA, 16 nt, Pseudomonas aeruginosa PA01
gcgucugccgcuggcg

SEQ ID NO: 1406722 - RNA, 20 nt, Pseudomonas aeruginosa PA01
gcgucguuggccggcugcuc

SEQ ID NO: 1406723 - RNA, 13 nt, Pseudomonas aeruginosa PA01
gcgucucagcccu

SEQ ID NO: 1406724 - RNA, 15 nt, Pseudomonas aeruginosa PA01
gcgucugggacggca

SEQ ID NO: 1406725 - RNA, 22 nt, Pseudomonas aeruginosa PA01
gcgucugggacggcagccuggg

SEQ ID NO: 1406726 - RNA, 17 nt, Pseudomonas aeruginosa PA01
gcgucugggugaccagc

SEQ ID NO: 1406727 - RNA, 20 nt, Pseudomonas aeruginosa PA01
gcgugaagccgccgcccagc

SEQ ID NO: 1406728 - RNA, 16 nt, Pseudomonas aeruginosa PA01
gcgugaacgcggcgag

SEQ ID NO: 1406729 - RNA, 18 nt, Pseudomonas aeruginosa PA01
gcgugaaguagccgccgg

SEQ ID NO: 1406730 - RNA, 20 nt, Pseudomonas aeruginosa PA01
gcgugaaguagccgccggga

SEQ ID NO: 1406731 - RNA, 21 nt, Pseudomonas aeruginosa PA01
gcgugaaguagccgccgggac

SEQ ID NO: 1406732 - RNA, 20 nt, Pseudomonas aeruginosa PA01
gcgucuucgccgaugcgccg

SEQ ID NO: 1406733 - RNA, 21 nt, Pseudomonas aeruginosa PA01
gcgucuucgccgaugcgccga

SEQ ID NO: 1406734 - RNA, 13 nt, Pseudomonas aeruginosa PA01
gcgugccgggcag

SEQ ID NO: 1406735 - RNA, 20 nt, Pseudomonas aeruginosa PA01
gcgugccgggccggccaggg

SEQ ID NO: 1406736 - RNA, 23 nt, Pseudomonas aeruginosa PA01
gcgugccguggcucggcggcagg

SEQ ID NO: 1406737 - RNA, 15 nt, Pseudomonas aeruginosa PA01
gcgugccgcuggccg

SEQ ID NO: 1406738 - RNA, 15 nt, Pseudomonas aeruginosa PA01
gcgugccgccggacc

SEQ ID NO: 1406739 - RNA, 13 nt, Pseudomonas aeruginosa PA01
gcgugccgcaggc

SEQ ID NO: 1406740 - RNA, 14 nt, Pseudomonas aeruginosa PA01
gcgugccgcaggcc

SEQ ID NO: 1406741 - RNA, 17 nt, Pseudomonas aeruginosa PA01
gcgugccgcaggccgcg

SEQ ID NO: 1406742 - RNA, 21 nt, Pseudomonas aeruginosa PA01
gcgugccgcaggccgcggccg

SEQ ID NO: 1406743 - RNA, 21 nt, Pseudomonas aeruginosa PA01
gcgugccgccaucgccucgcc

SEQ ID NO: 1406744 - RNA, 22 nt, Pseudomonas aeruginosa PA01
gcgugcgagggcggcggcucag

SEQ ID NO: 1406745 - RNA, 16 nt, Pseudomonas aeruginosa PA01
gcgugcgcaugcccgc

SEQ ID NO: 1406746 - RNA, 19 nt, Pseudomonas aeruginosa PA01
gcgugccuguuccuccgcc

SEQ ID NO: 1406747 - RNA, 22 nt, Pseudomonas aeruginosa PA01
gcgugccuguuccuccgccagg

SEQ ID NO: 1406748 - RNA, 23 nt, Pseudomonas aeruginosa PA01
gcgugccuguuccuccgccaggu

SEQ ID NO: 1406749 - RNA, 18 nt, Pseudomonas aeruginosa PA01
gcgugcgcgcccucggug

SEQ ID NO: 1406750 - RNA, 16 nt, Pseudomonas aeruginosa PA01
gcgugcgcgccgccgg

SEQ ID NO: 1406751 - RNA, 13 nt, Pseudomonas aeruginosa PA01
gcgugaggaucac

SEQ ID NO: 1406752 - RNA, 21 nt, Pseudomonas aeruginosa PA01
gcgugaggaucacgcaagugc

SEQ ID NO: 1406753 - RNA, 23 nt, Pseudomonas aeruginosa PA01
gcgugagggucgcgccgacgacc

SEQ ID NO: 1406754 - RNA, 24 nt, Pseudomonas aeruginosa PA01
gcgugauacagcucgcugucgccg

SEQ ID NO: 1406755 - RNA, 19 nt, Pseudomonas aeruginosa PA01
gcgucaacgaagucgcgag

SEQ ID NO: 1406756 - RNA, 16 nt, Pseudomonas aeruginosa PA01
gcguauucgccgaaga

SEQ ID NO: 1406757 - RNA, 14 nt, Pseudomonas aeruginosa PA01
gcguaucgaugcgc

SEQ ID NO: 1406758 - RNA, 13 nt, Pseudomonas aeruginosa PA01
gcguauaaccgcu

SEQ ID NO: 1406759 - RNA, 19 nt, Pseudomonas aeruginosa PA01
gcguauaaccgcucgcggu

SEQ ID NO: 1406760 - RNA, 14 nt, Pseudomonas aeruginosa PA01
gcguauagcccggg

SEQ ID NO: 1406761 - RNA, 16 nt, Pseudomonas aeruginosa PA01
gcguaguugagcccca

SEQ ID NO: 1406762 - RNA, 17 nt, Pseudomonas aeruginosa PA01
gcguagugcaucagccu

SEQ ID NO: 1406763 - RNA, 17 nt, Pseudomonas aeruginosa PA01
gcguagugcuccucguc

SEQ ID NO: 1406764 - RNA, 22 nt, Pseudomonas aeruginosa PA01
gcguagugcuggguggaggccc

SEQ ID NO: 1406765 - RNA, 17 nt, Pseudomonas aeruginosa PA01
gcguagugcugguaggg

SEQ ID NO: 1406766 - RNA, 18 nt, Pseudomonas aeruginosa PA01
gcguagguggcgccgccg

SEQ ID NO: 1406767 - RNA, 22 nt, Pseudomonas aeruginosa PA01
gcguagguggcgccgccggcga

SEQ ID NO: 1406768 - RNA, 16 nt, Pseudomonas aeruginosa PA01
gcguagcgacaggccc

SEQ ID NO: 1406769 - RNA, 22 nt, Pseudomonas aeruginosa PA01
gcguaguagccggacuccgacg

SEQ ID NO: 1406770 - RNA, 19 nt, Pseudomonas aeruginosa PA01
gcguagcugggcgaucacg

SEQ ID NO: 1406771 - RNA, 22 nt, Pseudomonas aeruginosa PA01
gcguagcugggcgaucacgccg

SEQ ID NO: 1406772 - RNA, 15 nt, Pseudomonas aeruginosa PA01
gcguaggcgcgccaa

SEQ ID NO: 1406773 - RNA, 22 nt, Pseudomonas aeruginosa PA01
gcguaggcgcgccaaggccgcc

SEQ ID NO: 1406774 - RNA, 18 nt, Pseudomonas aeruginosa PA01
gcguacaucccgccgaua

SEQ ID NO: 1406775 - RNA, 16 nt, Pseudomonas aeruginosa PA01
gcguaccagccgcggu

SEQ ID NO: 1406776 - RNA, 20 nt, Pseudomonas aeruginosa PA01
gcguaccggcuacaggccgu

SEQ ID NO: 1406777 - RNA, 19 nt, Pseudomonas aeruginosa PA01
gcguacgacuucggcgaca

SEQ ID NO: 1406778 - RNA, 12 nt, Pseudomonas aeruginosa PA01
gcguacgcccag

SEQ ID NO: 1406779 - RNA, 17 nt, Pseudomonas aeruginosa PA01
gcguacgcccagcagcg

SEQ ID NO: 1406780 - RNA, 22 nt, Pseudomonas aeruginosa PA01
gcguacgcccagcagcggcagg

SEQ ID NO: 1406781 - RNA, 13 nt, Pseudomonas aeruginosa PA01
gcguacaggcccc

SEQ ID NO: 1406782 - RNA, 16 nt, Pseudomonas aeruginosa PA01
gcguacaggccccagg

SEQ ID NO: 1406783 - RNA, 21 nt, Pseudomonas aeruginosa PA01
gcguagaagucguccucgccc

SEQ ID NO: 1406784 - RNA, 22 nt, Pseudomonas aeruginosa PA01
gcguagaccuugcggccguucu

SEQ ID NO: 1406785 - RNA, 23 nt, Pseudomonas aeruginosa PA01
gcguacgucgauauugccgcggg

SEQ ID NO: 1406786 - RNA, 17 nt, Pseudomonas aeruginosa PA01
gcguagaguucgcugcg

SEQ ID NO: 1406787 - RNA, 16 nt, Pseudomonas aeruginosa PA01
gcguacuucggcgcgg

SEQ ID NO: 1406788 - RNA, 16 nt, Pseudomonas aeruginosa PA01
gcguacuugccagggc

SEQ ID NO: 1406789 - RNA, 21 nt, Pseudomonas aeruginosa PA01
gcguacuugccagggcaggga

SEQ ID NO: 1406790 - RNA, 17 nt, Pseudomonas aeruginosa PA01
gcguacuuggcccggcg

SEQ ID NO: 1406791 - RNA, 14 nt, Pseudomonas aeruginosa PA01
gcguagcgccaggc

SEQ ID NO: 1406792 - RNA, 16 nt, Pseudomonas aeruginosa PA01
gcguagcgccaggccu

SEQ ID NO: 1406793 - RNA, 15 nt, Pseudomonas aeruginosa PA01
gcguagccggccagg

SEQ ID NO: 1406794 - RNA, 16 nt, Pseudomonas aeruginosa PA01
gcguagccggccaggg

SEQ ID NO: 1406795 - RNA, 17 nt, Pseudomonas aeruginosa PA01
gcguagcgcuucccgcg

SEQ ID NO: 1406796 - RNA, 15 nt, Pseudomonas aeruginosa PA01
gcguagcggaagccg

SEQ ID NO: 1406797 - RNA, 19 nt, Pseudomonas aeruginosa PA01
gcguaggccgucgcugccg

SEQ ID NO: 1406798 - RNA, 13 nt, Pseudomonas aeruginosa PA01
gcguagcgugccg

SEQ ID NO: 1406799 - RNA, 14 nt, Pseudomonas aeruginosa PA01
gcguagcguugcgc

SEQ ID NO: 1406800 - RNA, 16 nt, Pseudomonas aeruginosa PA01
gcguccaccagcgccc

SEQ ID NO: 1406801 - RNA, 22 nt, Pseudomonas aeruginosa PA01
gcguccaccagcgcccguagca

SEQ ID NO: 1406802 - RNA, 13 nt, Pseudomonas aeruginosa PA01
gcgucaugccgcc

SEQ ID NO: 1406803 - RNA, 15 nt, Pseudomonas aeruginosa PA01
gcgucaugccgccgu

SEQ ID NO: 1406804 - RNA, 17 nt, Pseudomonas aeruginosa PA01
gcgucaugccgccgucg

SEQ ID NO: 1406805 - RNA, 20 nt, Pseudomonas aeruginosa PA01
gcgucaugccgccgucgcgg

SEQ ID NO: 1406806 - RNA, 23 nt, Pseudomonas aeruginosa PA01
gcgucaugccgccgucgcggcca

SEQ ID NO: 1406807 - RNA, 12 nt, Pseudomonas aeruginosa PA01
gcgucauccgcc

SEQ ID NO: 1406808 - RNA, 13 nt, Pseudomonas aeruginosa PA01
gcgucauccgcca

SEQ ID NO: 1406809 - RNA, 13 nt, Pseudomonas aeruginosa PA01
gcgucauccgccu

SEQ ID NO: 1406810 - RNA, 14 nt, Pseudomonas aeruginosa PA01
gcguccauccaggc

SEQ ID NO: 1406811 - RNA, 15 nt, Pseudomonas aeruginosa PA01
gcguccauccaggcu

SEQ ID NO: 1406812 - RNA, 13 nt, Pseudomonas aeruginosa PA01
gcguccauccccg

SEQ ID NO: 1406813 - RNA, 15 nt, Pseudomonas aeruginosa PA01
gcguccauccccgcc

SEQ ID NO: 1406814 - RNA, 16 nt, Pseudomonas aeruginosa PA01
gcguccaguagcgccu

SEQ ID NO: 1406815 - RNA, 19 nt, Pseudomonas aeruginosa PA01
gcguccagggcuucgacau

SEQ ID NO: 1406816 - RNA, 14 nt, Pseudomonas aeruginosa PA01
gcguccaccuggcg

SEQ ID NO: 1406817 - RNA, 14 nt, Pseudomonas aeruginosa PA01
gcguccagcuccac

SEQ ID NO: 1406818 - RNA, 17 nt, Pseudomonas aeruginosa PA01
gcguccagcuccaccag

SEQ ID NO: 1406819 - RNA, 17 nt, Pseudomonas aeruginosa PA01
gcgucagcgcgccagca

SEQ ID NO: 1406820 - RNA, 17 nt, Pseudomonas aeruginosa PA01
gcgucacggacccgcuc

SEQ ID NO: 1406821 - RNA, 18 nt, Pseudomonas aeruginosa PA01
gcgucacggacccgcucg

SEQ ID NO: 1406822 - RNA, 16 nt, Pseudomonas aeruginosa PA01
gcgucacucgacaggc

SEQ ID NO: 1406823 - RNA, 19 nt, Pseudomonas aeruginosa PA01
gcgucacucgacaggccau

SEQ ID NO: 1406824 - RNA, 13 nt, Pseudomonas aeruginosa PA01
gcgucacucccag

SEQ ID NO: 1406825 - RNA, 15 nt, Pseudomonas aeruginosa PA01
gcgucaccgcgccga

SEQ ID NO: 1406826 - RNA, 16 nt, Pseudomonas aeruginosa PA01
gcgucaccgcgccgaa

SEQ ID NO: 1406827 - RNA, 19 nt, Pseudomonas aeruginosa PA01
gcgucacgccgaucccggc

SEQ ID NO: 1406828 - RNA, 20 nt, Pseudomonas aeruginosa PA01
gcgucacgccgaucccggcg

SEQ ID NO: 1406829 - RNA, 21 nt, Pseudomonas aeruginosa PA01
gcggucggguccgggcccugc

SEQ ID NO: 1406830 - RNA, 22 nt, Pseudomonas aeruginosa PA01
gcggucgggcagauguccaggc

SEQ ID NO: 1406831 - RNA, 22 nt, Pseudomonas aeruginosa PA01
gcggucggcucagccgaccacc

SEQ ID NO: 1406832 - RNA, 14 nt, Pseudomonas aeruginosa PA01
gcggucgugcagca

SEQ ID NO: 1406833 - RNA, 18 nt, Pseudomonas aeruginosa PA01
gcggucgugcagcagcgc

SEQ ID NO: 1406834 - RNA, 19 nt, Pseudomonas aeruginosa PA01
gcggucgugcagcagcgcc

SEQ ID NO: 1406835 - RNA, 17 nt, Pseudomonas aeruginosa PA01
gcggucucuucgucggu

SEQ ID NO: 1406836 - RNA, 22 nt, Pseudomonas aeruginosa PA01
gcggucguugaucacgaacagc

SEQ ID NO: 1406837 - RNA, 23 nt, Pseudomonas aeruginosa PA01
gcggucucgcguucaucgucggc

SEQ ID NO: 1406838 - RNA, 17 nt, Pseudomonas aeruginosa PA01
gcggucucggcgggugc

SEQ ID NO: 1406839 - RNA, 18 nt, Pseudomonas aeruginosa PA01
gcggucgagcagcgccgc

SEQ ID NO: 1406840 - RNA, 15 nt, Pseudomonas aeruginosa PA01
gcggucgagcucggc

SEQ ID NO: 1406841 - RNA, 21 nt, Pseudomonas aeruginosa PA01
gcggucgagcucggccaggca

SEQ ID NO: 1406842 - RNA, 23 nt, Pseudomonas aeruginosa PA01
gcggucgagcucggccaggcaca

SEQ ID NO: 1406843 - RNA, 18 nt, Pseudomonas aeruginosa PA01
gcggucgaggcccucggc

SEQ ID NO: 1406844 - RNA, 23 nt, Pseudomonas aeruginosa PA01
gcggucgaggcccucggcggcga

SEQ ID NO: 1406845 - RNA, 13 nt, Pseudomonas aeruginosa PA01
gcggucggccagg

SEQ ID NO: 1406846 - RNA, 14 nt, Pseudomonas aeruginosa PA01
gcggucggccaggc

SEQ ID NO: 1406847 - RNA, 17 nt, Pseudomonas aeruginosa PA01
gcggucggccaggcggc

SEQ ID NO: 1406848 - RNA, 20 nt, Pseudomonas aeruginosa PA01
gcggucggccaggcggccga

SEQ ID NO: 1406849 - RNA, 23 nt, Pseudomonas aeruginosa PA01
gcggucggccaggcggccgacga

SEQ ID NO: 1406850 - RNA, 20 nt, Pseudomonas aeruginosa PA01
gcggucggccaucuggcugc

SEQ ID NO: 1406851 - RNA, 15 nt, Pseudomonas aeruginosa PA01
gcggucggccauggc

SEQ ID NO: 1406852 - RNA, 20 nt, Pseudomonas aeruginosa PA01
gcgguccucgggcaccagca

SEQ ID NO: 1406853 - RNA, 12 nt, Pseudomonas aeruginosa PA01
gcgguccggacu

SEQ ID NO: 1406854 - RNA, 14 nt, Pseudomonas aeruginosa PA01
gcgguccggcgaag

SEQ ID NO: 1406855 - RNA, 19 nt, Pseudomonas aeruginosa PA01
gcgggcuucggacuuuucg

SEQ ID NO: 1406856 - RNA, 19 nt, Pseudomonas aeruginosa PA01
gcgggcugcgugccagcac

SEQ ID NO: 1406857 - RNA, 12 nt, Pseudomonas aeruginosa PA01
gcgggcuggaaa

SEQ ID NO: 1406858 - RNA, 23 nt, Pseudomonas aeruginosa PA01
gcgggcuggccaccgggaucagc

SEQ ID NO: 1406859 - RNA, 18 nt, Pseudomonas aeruginosa PA01
gcgggcuuuuucguuggc

SEQ ID NO: 1406860 - RNA, 23 nt, Pseudomonas aeruginosa PA01
gcgggcuuuuuucauucauggcg

SEQ ID NO: 1406861 - RNA, 15 nt, Pseudomonas aeruginosa PA01
gcggucacucggccu

SEQ ID NO: 1406862 - RNA, 18 nt, Pseudomonas aeruginosa PA01
gcggucacucggccucgg

SEQ ID NO: 1406863 - RNA, 21 nt, Pseudomonas aeruginosa PA01
gcggucacucggccucggcgu

SEQ ID NO: 1406864 - RNA, 20 nt, Pseudomonas aeruginosa PA01
gcggucacccauucgaugcc

SEQ ID NO: 1406865 - RNA, 22 nt, Pseudomonas aeruginosa PA01
gcggucacccauucgaugccgc

SEQ ID NO: 1406866 - RNA, 13 nt, Pseudomonas aeruginosa PA01
gcggucaucgcgc

SEQ ID NO: 1406867 - RNA, 15 nt, Pseudomonas aeruginosa PA01
gcggucaucgcgccg

SEQ ID NO: 1406868 - RNA, 16 nt, Pseudomonas aeruginosa PA01
gcggucaucgcgccgc

SEQ ID NO: 1406869 - RNA, 17 nt, Pseudomonas aeruginosa PA01
gcggucauccgcccugc

SEQ ID NO: 1406870 - RNA, 20 nt, Pseudomonas aeruginosa PA01
gcggucauccgccggcgcgu

SEQ ID NO: 1406871 - RNA, 14 nt, Pseudomonas aeruginosa PA01
gcggucaucgccgg

SEQ ID NO: 1406872 - RNA, 17 nt, Pseudomonas aeruginosa PA01
gcggucaucgccggcgc

SEQ ID NO: 1406873 - RNA, 14 nt, Pseudomonas aeruginosa PA01
gcggucaugcgccc

SEQ ID NO: 1406874 - RNA, 23 nt, Pseudomonas aeruginosa PA01
gcggucagcuugcccucagggaa

SEQ ID NO: 1406875 - RNA, 19 nt, Pseudomonas aeruginosa PA01
gcggucagcgacuggcccu

SEQ ID NO: 1406876 - RNA, 22 nt, Pseudomonas aeruginosa PA01
gcggucagcgacuggcccuggu

SEQ ID NO: 1406877 - RNA, 17 nt, Pseudomonas aeruginosa PA01
gcgguugaugccgacgu

SEQ ID NO: 1406878 - RNA, 15 nt, Pseudomonas aeruginosa PA01
gcgguguagaccacc

SEQ ID NO: 1406879 - RNA, 19 nt, Pseudomonas aeruginosa PA01
gcgguguagaccaccagca

SEQ ID NO: 1406880 - RNA, 22 nt, Pseudomonas aeruginosa PA01
gcgguuggcgccucgcaaaggu

SEQ ID NO: 1406881 - RNA, 17 nt, Pseudomonas aeruginosa PA01
gcgguuggcccgcgccg

SEQ ID NO: 1406882 - RNA, 21 nt, Pseudomonas aeruginosa PA01
gcggugucgcgguugcgcugc

SEQ ID NO: 1406883 - RNA, 23 nt, Pseudomonas aeruginosa PA01
gcgguugccgaagcgcucgguca

SEQ ID NO: 1406884 - RNA, 12 nt, Pseudomonas aeruginosa PA01
gcgguugccgcu

SEQ ID NO: 1406885 - RNA, 20 nt, Pseudomonas aeruginosa PA01
gcgguugccgcugcggcggu

SEQ ID NO: 1406886 - RNA, 16 nt, Pseudomonas aeruginosa PA01
gcgguuggagcgagcg

SEQ ID NO: 1406887 - RNA, 13 nt, Pseudomonas aeruginosa PA01
gcgguugcgcugc

SEQ ID NO: 1406888 - RNA, 14 nt, Pseudomonas aeruginosa PA01
gcgguugcggaacu

SEQ ID NO: 1406889 - RNA, 20 nt, Pseudomonas aeruginosa PA01
gcguaacguuacgcagauag

SEQ ID NO: 1406890 - RNA, 18 nt, Pseudomonas aeruginosa PA01
gcguaauaggcgaagcgg

SEQ ID NO: 1406891 - RNA, 23 nt, Pseudomonas aeruginosa PA01
gcguaauaggcgaagcggcucgg

SEQ ID NO: 1406892 - RNA, 17 nt, Pseudomonas aeruginosa PA01
gcggugagguugccgcc

SEQ ID NO: 1406893 - RNA, 19 nt, Pseudomonas aeruginosa PA01
gcggugagguugccgccga

SEQ ID NO: 1406894 - RNA, 20 nt, Pseudomonas aeruginosa PA01
gcggugagguugccgccgau

SEQ ID NO: 1406895 - RNA, 21 nt, Pseudomonas aeruginosa PA01
gcggugcagcggaagcccugc

SEQ ID NO: 1406896 - RNA, 13 nt, Pseudomonas aeruginosa PA01
gcggugagggcga

SEQ ID NO: 1406897 - RNA, 15 nt, Pseudomonas aeruginosa PA01
gcggugcagaacgcg

SEQ ID NO: 1406898 - RNA, 14 nt, Pseudomonas aeruginosa PA01
gcgguggaugccgg

SEQ ID NO: 1406899 - RNA, 13 nt, Pseudomonas aeruginosa PA01
gcgguggccacgu

SEQ ID NO: 1406900 - RNA, 20 nt, Pseudomonas aeruginosa PA01
gcgguggccacgucgcccca

SEQ ID NO: 1406901 - RNA, 20 nt, Pseudomonas aeruginosa PA01
gcgguggagcacgucgagca

SEQ ID NO: 1406902 - RNA, 13 nt, Pseudomonas aeruginosa PA01
gcgguggaggcgg

SEQ ID NO: 1406903 - RNA, 16 nt, Pseudomonas aeruginosa PA01
gcgguggaggcggcgg

SEQ ID NO: 1406904 - RNA, 15 nt, Pseudomonas aeruginosa PA01
gcggugcgccggcgg

SEQ ID NO: 1406905 - RNA, 17 nt, Pseudomonas aeruginosa PA01
gcggugcgcgccaucaa

SEQ ID NO: 1406906 - RNA, 17 nt, Pseudomonas aeruginosa PA01
gcggugcggucggcgcc

SEQ ID NO: 1406907 - RNA, 14 nt, Pseudomonas aeruginosa PA01
gcuccugcaggccc

SEQ ID NO: 1406908 - RNA, 18 nt, Pseudomonas aeruginosa PA01
gcuccugcaggcccugcc

SEQ ID NO: 1406909 - RNA, 20 nt, Pseudomonas aeruginosa PA01
gcuccucgucguacuggcgg

SEQ ID NO: 1406910 - RNA, 18 nt, Pseudomonas aeruginosa PA01
gcuccucugccugcgccc

SEQ ID NO: 1406911 - RNA, 17 nt, Pseudomonas aeruginosa PA01
gcuccucggccugggcg

SEQ ID NO: 1406912 - RNA, 23 nt, Pseudomonas aeruginosa PA01
gcuccucggccugggcgcaggcc

SEQ ID NO: 1406913 - RNA, 24 nt, Pseudomonas aeruginosa PA01
gcuccucggccugggcgcaggccg

SEQ ID NO: 1406914 - RNA, 20 nt, Pseudomonas aeruginosa PA01
gcuccucggccuugcuggcg

SEQ ID NO: 1406915 - RNA, 20 nt, Pseudomonas aeruginosa PA01
gcuccuggaagaacaggcgc

SEQ ID NO: 1406916 - RNA, 21 nt, Pseudomonas aeruginosa PA01
gcuccuggaagaacaggcgcu

SEQ ID NO: 1406917 - RNA, 21 nt, Pseudomonas aeruginosa PA01
gcuccuggaugcuccgcgccu

SEQ ID NO: 1406918 - RNA, 16 nt, Pseudomonas aeruginosa PA01
gcuccuggcaggcuca

SEQ ID NO: 1406919 - RNA, 20 nt, Pseudomonas aeruginosa PA01
gcuccuggugcggcaccagc

SEQ ID NO: 1406920 - RNA, 21 nt, Pseudomonas aeruginosa PA01
gcuccuggugcggcaccagcc

SEQ ID NO: 1406921 - RNA, 23 nt, Pseudomonas aeruginosa PA01
gcuccuggugcggcaccagccag

SEQ ID NO: 1406922 - RNA, 20 nt, Pseudomonas aeruginosa PA01
gcuccuuggcuggccagccc

SEQ ID NO: 1406923 - RNA, 21 nt, Pseudomonas aeruginosa PA01
gcuccuuucggaacagcgccu

SEQ ID NO: 1406924 - RNA, 15 nt, Pseudomonas aeruginosa PA01
gcuccuugcgcuccu

SEQ ID NO: 1406925 - RNA, 23 nt, Pseudomonas aeruginosa PA01
gcuccuucuccggggcccggcag

SEQ ID NO: 1406926 - RNA, 19 nt, Pseudomonas aeruginosa PA01
gcuccuguugcuggccggu

SEQ ID NO: 1406927 - RNA, 14 nt, Pseudomonas aeruginosa PA01
gcuccugcgccggc

SEQ ID NO: 1406928 - RNA, 15 nt, Pseudomonas aeruginosa PA01
gcuccugcgccggcu

SEQ ID NO: 1406929 - RNA, 21 nt, Pseudomonas aeruginosa PA01
gcuccugcgccggcucgugcg

SEQ ID NO: 1406930 - RNA, 16 nt, Pseudomonas aeruginosa PA01
gcuccugcggcuggcg

SEQ ID NO: 1406931 - RNA, 17 nt, Pseudomonas aeruginosa PA01
gcuccugcggcuggcga

SEQ ID NO: 1406932 - RNA, 16 nt, Pseudomonas aeruginosa PA01
gcuccggugccagggc

SEQ ID NO: 1406933 - RNA, 18 nt, Pseudomonas aeruginosa PA01
gcuccgggcuggccacca

SEQ ID NO: 1406934 - RNA, 20 nt, Pseudomonas aeruginosa PA01
gcuccgggcuggccaccagc

SEQ ID NO: 1406935 - RNA, 15 nt, Pseudomonas aeruginosa PA01
gcuccggggcgcugu

SEQ ID NO: 1406936 - RNA, 18 nt, Pseudomonas aeruginosa PA01
gcuccggauggcugaccc

SEQ ID NO: 1406937 - RNA, 14 nt, Pseudomonas aeruginosa PA01
gcuccgugucggcg

SEQ ID NO: 1406938 - RNA, 18 nt, Pseudomonas aeruginosa PA01
gcuccgugucggcggcgc

SEQ ID NO: 1406939 - RNA, 21 nt, Pseudomonas aeruginosa PA01
gcuccgugucggcggcgccuu

SEQ ID NO: 1406940 - RNA, 16 nt, Pseudomonas aeruginosa PA01
gcuccgucgcuucgcc

SEQ ID NO: 1406941 - RNA, 17 nt, Pseudomonas aeruginosa PA01
gcuccgucgcuucgccc

SEQ ID NO: 1406942 - RNA, 18 nt, Pseudomonas aeruginosa PA01
gcuccgucgcuucgcccg

SEQ ID NO: 1406943 - RNA, 20 nt, Pseudomonas aeruginosa PA01
gcuccgucgcuucgcccgcc

SEQ ID NO: 1406944 - RNA, 20 nt, Pseudomonas aeruginosa PA01
gcuccgucuguucggccagg

SEQ ID NO: 1406945 - RNA, 17 nt, Pseudomonas aeruginosa PA01
gcuccguagggcgacgc

SEQ ID NO: 1406946 - RNA, 21 nt, Pseudomonas aeruginosa PA01
gcuccguagggcgacgcccga

SEQ ID NO: 1406947 - RNA, 22 nt, Pseudomonas aeruginosa PA01
gcuccguagggcgacgcccgag

SEQ ID NO: 1406948 - RNA, 20 nt, Pseudomonas aeruginosa PA01
gcuccucggcagcgcuggcg

SEQ ID NO: 1406949 - RNA, 20 nt, Pseudomonas aeruginosa PA01
gcuccucgauccgcuccagc

SEQ ID NO: 1406950 - RNA, 17 nt, Pseudomonas aeruginosa PA01
gcuccucgcgcugcccg

SEQ ID NO: 1406951 - RNA, 18 nt, Pseudomonas aeruginosa PA01
gcuccucgcgcugcccgg

SEQ ID NO: 1406952 - RNA, 19 nt, Pseudomonas aeruginosa PA01
gcuccucgcgcugcccggc

SEQ ID NO: 1406953 - RNA, 20 nt, Pseudomonas aeruginosa PA01
gcuccucgcgcugcccggcg

SEQ ID NO: 1406954 - RNA, 13 nt, Pseudomonas aeruginosa PA01
gcuccuccgggcg

SEQ ID NO: 1406955 - RNA, 17 nt, Pseudomonas aeruginosa PA01
gcuccuccgggcgugcc

SEQ ID NO: 1406956 - RNA, 22 nt, Pseudomonas aeruginosa PA01
gcuccuccgggcgugccaggag

SEQ ID NO: 1406957 - RNA, 15 nt, Pseudomonas aeruginosa PA01
gcuccuccagcgccg

SEQ ID NO: 1406958 - RNA, 16 nt, Pseudomonas aeruginosa PA01
gcuccuccagcgccgc

SEQ ID NO: 1406959 - RNA, 18 nt, Pseudomonas aeruginosa PA01
gcuccuccagcgccgcca

SEQ ID NO: 1406960 - RNA, 22 nt, Pseudomonas aeruginosa PA01
gcuccuccagcgccgccaggcg

SEQ ID NO: 1406961 - RNA, 17 nt, Pseudomonas aeruginosa PA01
gcuccuccgacgccccc

SEQ ID NO: 1406962 - RNA, 14 nt, Pseudomonas aeruginosa PA01
gcuccggcgcgcca

SEQ ID NO: 1406963 - RNA, 22 nt, Pseudomonas aeruginosa PA01
gcuccucagaggcgaccagccg

SEQ ID NO: 1406964 - RNA, 16 nt, Pseudomonas aeruginosa PA01
gcucgacccgcccgcc

SEQ ID NO: 1406965 - RNA, 15 nt, Pseudomonas aeruginosa PA01
gcucgaccgccugcu

SEQ ID NO: 1406966 - RNA, 21 nt, Pseudomonas aeruginosa PA01
gcucgaccgccugcucgcggc

SEQ ID NO: 1406967 - RNA, 14 nt, Pseudomonas aeruginosa PA01
gcucgacaggucgg

SEQ ID NO: 1406968 - RNA, 17 nt, Pseudomonas aeruginosa PA01
gcucgacaggucggcga

SEQ ID NO: 1406969 - RNA, 18 nt, Pseudomonas aeruginosa PA01
gcucgacauacuccgccg

SEQ ID NO: 1406970 - RNA, 21 nt, Pseudomonas aeruginosa PA01
gcucgacauacuccgccgcuu

SEQ ID NO: 1406971 - RNA, 16 nt, Pseudomonas aeruginosa PA01
gcucgaccaccucggc

SEQ ID NO: 1406972 - RNA, 15 nt, Pseudomonas aeruginosa PA01
gcucgacagcgucgu

SEQ ID NO: 1406973 - RNA, 21 nt, Pseudomonas aeruginosa PA01
gcucgaacaucagcagcgcca

SEQ ID NO: 1406974 - RNA, 22 nt, Pseudomonas aeruginosa PA01
gcucgaacgccgcccgucgcgc

SEQ ID NO: 1406975 - RNA, 13 nt, Pseudomonas aeruginosa PA01
gcucgaacgggca

SEQ ID NO: 1406976 - RNA, 12 nt, Pseudomonas aeruginosa PA01
gcucgaagccgc

SEQ ID NO: 1406977 - RNA, 16 nt, Pseudomonas aeruginosa PA01
gcucgaagcuccagcg

SEQ ID NO: 1406978 - RNA, 21 nt, Pseudomonas aeruginosa PA01
gcucgaauaaaaaaccggcca

SEQ ID NO: 1406979 - RNA, 21 nt, Pseudomonas aeruginosa PA01
gcucgaaugcuguuccucguc

SEQ ID NO: 1406980 - RNA, 23 nt, Pseudomonas aeruginosa PA01
gcucgaaugcuguuccucgucga

SEQ ID NO: 1406981 - RNA, 16 nt, Pseudomonas aeruginosa PA01
gcucgacgagccgcga

SEQ ID NO: 1406982 - RNA, 17 nt, Pseudomonas aeruginosa PA01
gcucgacgagccgcgac

SEQ ID NO: 1406983 - RNA, 21 nt, Pseudomonas aeruginosa PA01
gcucgacgaggaacgccucgc

SEQ ID NO: 1406984 - RNA, 22 nt, Pseudomonas aeruginosa PA01
gcucgacgaggaacgccucgca

SEQ ID NO: 1406985 - RNA, 18 nt, Pseudomonas aeruginosa PA01
gcucgacggucagcggac

SEQ ID NO: 1406986 - RNA, 21 nt, Pseudomonas aeruginosa PA01
gcucgacggcaccagcgcguc

SEQ ID NO: 1406987 - RNA, 23 nt, Pseudomonas aeruginosa PA01
gcucgacggcaccagcgcgucga

SEQ ID NO: 1406988 - RNA, 22 nt, Pseudomonas aeruginosa PA01
gcucgacuuccugggaugccgg

SEQ ID NO: 1406989 - RNA, 23 nt, Pseudomonas aeruginosa PA01
gcucgacuuccugggaugccggg

SEQ ID NO: 1406990 - RNA, 21 nt, Pseudomonas aeruginosa PA01
gcuacaggccguagcgcucga

SEQ ID NO: 1406991 - RNA, 20 nt, Pseudomonas aeruginosa PA01
gcucccaccgcuuucagcgc

SEQ ID NO: 1406992 - RNA, 15 nt, Pseudomonas aeruginosa PA01
gcucccagccgacgu

SEQ ID NO: 1406993 - RNA, 15 nt, Pseudomonas aeruginosa PA01
gcucccaggcgucgc

SEQ ID NO: 1406994 - RNA, 18 nt, Pseudomonas aeruginosa PA01
gcucccaggcgucgccga

SEQ ID NO: 1406995 - RNA, 16 nt, Pseudomonas aeruginosa PA01
gcuccccacucggcca

SEQ ID NO: 1406996 - RNA, 20 nt, Pseudomonas aeruginosa PA01
gcucccccacguacuccagc

SEQ ID NO: 1406997 - RNA, 15 nt, Pseudomonas aeruginosa PA01
gcucccccgcgccgc

SEQ ID NO: 1406998 - RNA, 17 nt, Pseudomonas aeruginosa PA01
gcucccauucgcugucg

SEQ ID NO: 1406999 - RNA, 21 nt, Pseudomonas aeruginosa PA01
gcuaccaggaagcucggcagc

SEQ ID NO: 1407000 - RNA, 19 nt, Pseudomonas aeruginosa PA01
gcuacaucgucugcgcggc

SEQ ID NO: 1407001 - RNA, 20 nt, Pseudomonas aeruginosa PA01
gcucccaacagucgucgcgc

SEQ ID NO: 1407002 - RNA, 19 nt, Pseudomonas aeruginosa PA01
gcuccggcucuccccgcuc

SEQ ID NO: 1407003 - RNA, 15 nt, Pseudomonas aeruginosa PA01
gcuccggcugcgcgg

SEQ ID NO: 1407004 - RNA, 13 nt, Pseudomonas aeruginosa PA01
gcuccggcuccgc

SEQ ID NO: 1407005 - RNA, 14 nt, Pseudomonas aeruginosa PA01
gcuccggcuccgcg

SEQ ID NO: 1407006 - RNA, 16 nt, Pseudomonas aeruginosa PA01
gcuccggcuccgcgca

SEQ ID NO: 1407007 - RNA, 19 nt, Pseudomonas aeruginosa PA01
gcuccggcagcagggucag

SEQ ID NO: 1407008 - RNA, 14 nt, Pseudomonas aeruginosa PA01
gcuccggcagcgcg

SEQ ID NO: 1407009 - RNA, 15 nt, Pseudomonas aeruginosa PA01
gcuccggcagcgcgu

SEQ ID NO: 1407010 - RNA, 15 nt, Pseudomonas aeruginosa PA01
gcuccggcgccaggc

SEQ ID NO: 1407011 - RNA, 12 nt, Pseudomonas aeruginosa PA01
gcuccggcgccg

SEQ ID NO: 1407012 - RNA, 13 nt, Pseudomonas aeruginosa PA01
gcuccggcgccga

SEQ ID NO: 1407013 - RNA, 14 nt, Pseudomonas aeruginosa PA01
gcuccggcgccgag

SEQ ID NO: 1407014 - RNA, 15 nt, Pseudomonas aeruginosa PA01
gcuccggcgccgagg

SEQ ID NO: 1407015 - RNA, 12 nt, Pseudomonas aeruginosa PA01
gcuccgccgccg

SEQ ID NO: 1407016 - RNA, 12 nt, Pseudomonas aeruginosa PA01
gcuccgccgcga

SEQ ID NO: 1407017 - RNA, 16 nt, Pseudomonas aeruginosa PA01
gcuccgccgcgagcga

SEQ ID NO: 1407018 - RNA, 20 nt, Pseudomonas aeruginosa PA01
gcuccgccgaacgccaccag

SEQ ID NO: 1407019 - RNA, 19 nt, Pseudomonas aeruginosa PA01
gcuccgcgcguucagccac

SEQ ID NO: 1407020 - RNA, 17 nt, Pseudomonas aeruginosa PA01
gcuccgccuggcggaua

SEQ ID NO: 1407021 - RNA, 19 nt, Pseudomonas aeruginosa PA01
gcuccgcuaagcgucacuc

SEQ ID NO: 1407022 - RNA, 14 nt, Pseudomonas aeruginosa PA01
gcuccgcugcucag

SEQ ID NO: 1407023 - RNA, 18 nt, Pseudomonas aeruginosa PA01
gcuccggaacgccugcau

SEQ ID NO: 1407024 - RNA, 17 nt, Pseudomonas aeruginosa PA01
gcuccggacugccgaug

SEQ ID NO: 1407025 - RNA, 16 nt, Pseudomonas aeruginosa PA01
gcuccccgccgccagg

SEQ ID NO: 1407026 - RNA, 19 nt, Pseudomonas aeruginosa PA01
gcuccccuggaaugccggc

SEQ ID NO: 1407027 - RNA, 14 nt, Pseudomonas aeruginosa PA01
gcuccccuggagcc

SEQ ID NO: 1407028 - RNA, 14 nt, Pseudomonas aeruginosa PA01
gcucccgccgcucc

SEQ ID NO: 1407029 - RNA, 14 nt, Pseudomonas aeruginosa PA01
gcuccgccaggccg

SEQ ID NO: 1407030 - RNA, 16 nt, Pseudomonas aeruginosa PA01
gcuccgccaggccgcg

SEQ ID NO: 1407031 - RNA, 17 nt, Pseudomonas aeruginosa PA01
gcuccgccaggccgcgc

SEQ ID NO: 1407032 - RNA, 13 nt, Pseudomonas aeruginosa PA01
gcuccgagcaggc

SEQ ID NO: 1407033 - RNA, 17 nt, Pseudomonas aeruginosa PA01
gcuccgauggcgcugga

SEQ ID NO: 1407034 - RNA, 19 nt, Pseudomonas aeruginosa PA01
gcuccgaugaagcaggcgg

SEQ ID NO: 1407035 - RNA, 15 nt, Pseudomonas aeruginosa PA01
gcucccuugccgccg

SEQ ID NO: 1407036 - RNA, 16 nt, Pseudomonas aeruginosa PA01
gcucccuugccgccgg

SEQ ID NO: 1407037 - RNA, 16 nt, Pseudomonas aeruginosa PA01
gcucccugauccgcgu

SEQ ID NO: 1407038 - RNA, 17 nt, Pseudomonas aeruginosa PA01
gcucccugccgcccuuc

SEQ ID NO: 1407039 - RNA, 19 nt, Pseudomonas aeruginosa PA01
gcuccgacuccugcaacag

SEQ ID NO: 1407040 - RNA, 16 nt, Pseudomonas aeruginosa PA01
gcucgcagagggcgau

SEQ ID NO: 1407041 - RNA, 13 nt, Pseudomonas aeruginosa PA01
gcucgcaccaggc

SEQ ID NO: 1407042 - RNA, 16 nt, Pseudomonas aeruginosa PA01
gcucgcaccaggccag

SEQ ID NO: 1407043 - RNA, 18 nt, Pseudomonas aeruginosa PA01
gcucgcaccaggccaggu

SEQ ID NO: 1407044 - RNA, 15 nt, Pseudomonas aeruginosa PA01
gcucgcaaucagcgc

SEQ ID NO: 1407045 - RNA, 17 nt, Pseudomonas aeruginosa PA01
gcucgcaaucagcgcga

SEQ ID NO: 1407046 - RNA, 18 nt, Pseudomonas aeruginosa PA01
gcucgaucucauggucgg

SEQ ID NO: 1407047 - RNA, 18 nt, Pseudomonas aeruginosa PA01
gcucgauggcggccuggu

SEQ ID NO: 1407048 - RNA, 15 nt, Pseudomonas aeruginosa PA01
gcucgaugaucacca

SEQ ID NO: 1407049 - RNA, 18 nt, Pseudomonas aeruginosa PA01
gcucgaugaucaccagac

SEQ ID NO: 1407050 - RNA, 13 nt, Pseudomonas aeruginosa PA01
gcucgaugaucga

SEQ ID NO: 1407051 - RNA, 14 nt, Pseudomonas aeruginosa PA01
gcucgaugcccgcc

SEQ ID NO: 1407052 - RNA, 18 nt, Pseudomonas aeruginosa PA01
gcucgaugcccgccagca

SEQ ID NO: 1407053 - RNA, 15 nt, Pseudomonas aeruginosa PA01
gcucgauggcgaagc

SEQ ID NO: 1407054 - RNA, 16 nt, Pseudomonas aeruginosa PA01
gcucgauccagccggc

SEQ ID NO: 1407055 - RNA, 20 nt, Pseudomonas aeruginosa PA01
gcucgauccagccggcaucc

SEQ ID NO: 1407056 - RNA, 18 nt, Pseudomonas aeruginosa PA01
gcucgaucccggcgcgga

SEQ ID NO: 1407057 - RNA, 13 nt, Pseudomonas aeruginosa PA01
gcucgaucagccc

SEQ ID NO: 1407058 - RNA, 16 nt, Pseudomonas aeruginosa PA01
gcucgaucagcccgcc

SEQ ID NO: 1407059 - RNA, 15 nt, Pseudomonas aeruginosa PA01
gcucgaucagccggc

SEQ ID NO: 1407060 - RNA, 24 nt, Pseudomonas aeruginosa PA01
gcucgaucggcagggcgccgacca

SEQ ID NO: 1407061 - RNA, 22 nt, Pseudomonas aeruginosa PA01
gcucgaggccaggaucgucggc

SEQ ID NO: 1407062 - RNA, 18 nt, Pseudomonas aeruginosa PA01
gcucgagggcgaccgcca

SEQ ID NO: 1407063 - RNA, 18 nt, Pseudomonas aeruginosa PA01
gcucgaggaagcgcccga

SEQ ID NO: 1407064 - RNA, 14 nt, Pseudomonas aeruginosa PA01
gcucgagggugucg

SEQ ID NO: 1407065 - RNA, 12 nt, Pseudomonas aeruginosa PA01
gcucgaucacca

SEQ ID NO: 1407066 - RNA, 18 nt, Pseudomonas aeruginosa PA01
gcucgaucaaccccugga

SEQ ID NO: 1407067 - RNA, 17 nt, Pseudomonas aeruginosa PA01
gcucgaggggcgacgga

SEQ ID NO: 1407068 - RNA, 15 nt, Pseudomonas aeruginosa PA01
gcucgaggccgagcc

SEQ ID NO: 1407069 - RNA, 20 nt, Pseudomonas aeruginosa PA01
gcucgaggccgagccggcau

SEQ ID NO: 1407070 - RNA, 13 nt, Pseudomonas aeruginosa PA01
gcucgccgccagc

SEQ ID NO: 1407071 - RNA, 15 nt, Pseudomonas aeruginosa PA01
gcucgccgccagcag

SEQ ID NO: 1407072 - RNA, 16 nt, Pseudomonas aeruginosa PA01
gcucgccgccagcagg

SEQ ID NO: 1407073 - RNA, 15 nt, Pseudomonas aeruginosa PA01
gcucgccgcgcugca

SEQ ID NO: 1407074 - RNA, 12 nt, Pseudomonas aeruginosa PA01
gcucgccgcucc

SEQ ID NO: 1407075 - RNA, 15 nt, Pseudomonas aeruginosa PA01
gcucgccgccggcga

SEQ ID NO: 1407076 - RNA, 17 nt, Pseudomonas aeruginosa PA01
gcucgccgccggcgagg

SEQ ID NO: 1407077 - RNA, 22 nt, Pseudomonas aeruginosa PA01
gcucgccggguuguccaggcga

SEQ ID NO: 1407078 - RNA, 14 nt, Pseudomonas aeruginosa PA01
gcucgccggcgucc

SEQ ID NO: 1407079 - RNA, 19 nt, Pseudomonas aeruginosa PA01
gcucgccgggaaucgccag

SEQ ID NO: 1407080 - RNA, 20 nt, Pseudomonas aeruginosa PA01
gcucgccgggaaucgccagc

SEQ ID NO: 1407081 - RNA, 21 nt, Pseudomonas aeruginosa PA01
gcucgccgggaaucgccagca

SEQ ID NO: 1407082 - RNA, 22 nt, Pseudomonas aeruginosa PA01
gcucgccgggaaucgccagcag

SEQ ID NO: 1407083 - RNA, 20 nt, Pseudomonas aeruginosa PA01
gcucgccgggucgccgcagc

SEQ ID NO: 1407084 - RNA, 18 nt, Pseudomonas aeruginosa PA01
gcucgcccaugcgcggcg

SEQ ID NO: 1407085 - RNA, 21 nt, Pseudomonas aeruginosa PA01
gcucgcccaugcgcggcgaga

SEQ ID NO: 1407086 - RNA, 16 nt, Pseudomonas aeruginosa PA01
gcucgccccggcggcg

SEQ ID NO: 1407087 - RNA, 11 nt, Pseudomonas aeruginosa PA01
gcucgccccgg

SEQ ID NO: 1407088 - RNA, 12 nt, Pseudomonas aeruginosa PA01
gcucgccccggc

SEQ ID NO: 1407089 - RNA, 17 nt, Pseudomonas aeruginosa PA01
gcucgccgaacaggauc

SEQ ID NO: 1407090 - RNA, 19 nt, Pseudomonas aeruginosa PA01
gcucgccgagguugcugcg

SEQ ID NO: 1407091 - RNA, 21 nt, Pseudomonas aeruginosa PA01
gcucgccgagguugcugcggc

SEQ ID NO: 1407092 - RNA, 14 nt, Pseudomonas aeruginosa PA01
gcucgccgacggcu

SEQ ID NO: 1407093 - RNA, 21 nt, Pseudomonas aeruginosa PA01
gcucgccgacggcuucgacca

SEQ ID NO: 1407094 - RNA, 18 nt, Pseudomonas aeruginosa PA01
gcucgccgacuuccaggc

SEQ ID NO: 1407095 - RNA, 22 nt, Pseudomonas aeruginosa PA01
gcucgcccagcaggcgcgcccu

SEQ ID NO: 1407096 - RNA, 13 nt, Pseudomonas aeruginosa PA01
gcucgccagauga

SEQ ID NO: 1407097 - RNA, 16 nt, Pseudomonas aeruginosa PA01
gcucgccagaugacga

SEQ ID NO: 1407098 - RNA, 22 nt, Pseudomonas aeruginosa PA01
gcucgccagaugacgauggccg

SEQ ID NO: 1407099 - RNA, 17 nt, Pseudomonas aeruginosa PA01
gcucgccuaccggcgcc

SEQ ID NO: 1407100 - RNA, 19 nt, Pseudomonas aeruginosa PA01
gcucgccuaccggcgccgc

SEQ ID NO: 1407101 - RNA, 15 nt, Pseudomonas aeruginosa PA01
gcucgccucgggcca

SEQ ID NO: 1407102 - RNA, 14 nt, Pseudomonas aeruginosa PA01
gcucgccugguagg

SEQ ID NO: 1407103 - RNA, 15 nt, Pseudomonas aeruginosa PA01
gcucgccgucaucga

SEQ ID NO: 1407104 - RNA, 15 nt, Pseudomonas aeruginosa PA01
gcucgcgcacggcga

SEQ ID NO: 1407105 - RNA, 18 nt, Pseudomonas aeruginosa PA01
gcucgcgcagcgacucga

SEQ ID NO: 1407106 - RNA, 18 nt, Pseudomonas aeruginosa PA01
gcucgcgcagcggcgcgu

SEQ ID NO: 1407107 - RNA, 21 nt, Pseudomonas aeruginosa PA01
gcucgcgcaaccagccggaga

SEQ ID NO: 1407108 - RNA, 19 nt, Pseudomonas aeruginosa PA01
gcucgcgcagccacuggcg

SEQ ID NO: 1407109 - RNA, 20 nt, Pseudomonas aeruginosa PA01
gcucgcgcagccacuggcgg

SEQ ID NO: 1407110 - RNA, 14 nt, Pseudomonas aeruginosa PA01
gcucgcgcagccag

SEQ ID NO: 1407111 - RNA, 17 nt, Pseudomonas aeruginosa PA01
gcucgcgcagccaggcg

SEQ ID NO: 1407112 - RNA, 17 nt, Pseudomonas aeruginosa PA01
gcucgcgcaugaccuuc

SEQ ID NO: 1407113 - RNA, 23 nt, Pseudomonas aeruginosa PA01
gcucgcgcaugaccuucagcacc

SEQ ID NO: 1407114 - RNA, 23 nt, Pseudomonas aeruginosa PA01
gcucgcgcaugaucgccucggcg

SEQ ID NO: 1407115 - RNA, 18 nt, Pseudomonas aeruginosa PA01
gcucgcgcagggucgagg

SEQ ID NO: 1407116 - RNA, 14 nt, Pseudomonas aeruginosa PA01
gcucgcgggucacc

SEQ ID NO: 1407117 - RNA, 17 nt, Pseudomonas aeruginosa PA01
gcucgcgggucaccacc

SEQ ID NO: 1407118 - RNA, 18 nt, Pseudomonas aeruginosa PA01
gcucgcgggucaccaccg

SEQ ID NO: 1407119 - RNA, 16 nt, Pseudomonas aeruginosa PA01
gcucgcgggccgccug

SEQ ID NO: 1407120 - RNA, 19 nt, Pseudomonas aeruginosa PA01
gcucgcgggccgccugguc

SEQ ID NO: 1407121 - RNA, 15 nt, Pseudomonas aeruginosa PA01
gcucgcggcuggccg

SEQ ID NO: 1407122 - RNA, 16 nt, Pseudomonas aeruginosa PA01
gcucgcggcuggccgc

SEQ ID NO: 1407123 - RNA, 19 nt, Pseudomonas aeruginosa PA01
gcucgcggcuggccgccuc

SEQ ID NO: 1407124 - RNA, 22 nt, Pseudomonas aeruginosa PA01
gcucgcggcuggccgccucgcg

SEQ ID NO: 1407125 - RNA, 23 nt, Pseudomonas aeruginosa PA01
gcucgcggcuggccgccucgcgc

SEQ ID NO: 1407126 - RNA, 13 nt, Pseudomonas aeruginosa PA01
gcucgcggcgcuc

SEQ ID NO: 1407127 - RNA, 19 nt, Pseudomonas aeruginosa PA01
gcucgcggcaucccgcccg

SEQ ID NO: 1407128 - RNA, 20 nt, Pseudomonas aeruginosa PA01
gcucgcggcaucccgcccgg

SEQ ID NO: 1407129 - RNA, 15 nt, Pseudomonas aeruginosa PA01
gcucgcggaccagcu

SEQ ID NO: 1407130 - RNA, 17 nt, Pseudomonas aeruginosa PA01
gcucgcggaccucugcg

SEQ ID NO: 1407131 - RNA, 19 nt, Pseudomonas aeruginosa PA01
gcucgcgcggggcgcgcug

SEQ ID NO: 1407132 - RNA, 14 nt, Pseudomonas aeruginosa PA01
gcucgcgccggcgc

SEQ ID NO: 1407133 - RNA, 19 nt, Pseudomonas aeruginosa PA01
gcucgcgccagccccaggc

SEQ ID NO: 1407134 - RNA, 20 nt, Pseudomonas aeruginosa PA01
gcucgcgccagccccaggcg

SEQ ID NO: 1407135 - RNA, 22 nt, Pseudomonas aeruginosa PA01
gcucgcgccagccccaggcgcg

SEQ ID NO: 1407136 - RNA, 19 nt, Pseudomonas aeruginosa PA01
gcucggcgaguucgcgcag

SEQ ID NO: 1407137 - RNA, 22 nt, Pseudomonas aeruginosa PA01
gcucggcgaggaacagcaccag

SEQ ID NO: 1407138 - RNA, 23 nt, Pseudomonas aeruginosa PA01
gcucggcgaggaacagcaccagc

SEQ ID NO: 1407139 - RNA, 17 nt, Pseudomonas aeruginosa PA01
gcucggcgaggccggcg

SEQ ID NO: 1407140 - RNA, 18 nt, Pseudomonas aeruginosa PA01
gcucggcgaggccggcga

SEQ ID NO: 1407141 - RNA, 15 nt, Pseudomonas aeruginosa PA01
gcucggccaggucgc

SEQ ID NO: 1407142 - RNA, 13 nt, Pseudomonas aeruginosa PA01
gcucggccagcuc

SEQ ID NO: 1407143 - RNA, 16 nt, Pseudomonas aeruginosa PA01
gcucggccagcucgcc

SEQ ID NO: 1407144 - RNA, 14 nt, Pseudomonas aeruginosa PA01
gcucggccaggcac

SEQ ID NO: 1407145 - RNA, 19 nt, Pseudomonas aeruginosa PA01
gcucggccagggccgcucg

SEQ ID NO: 1407146 - RNA, 19 nt, Pseudomonas aeruginosa PA01
gcucggccaguucgcggcg

SEQ ID NO: 1407147 - RNA, 21 nt, Pseudomonas aeruginosa PA01
gcucggccaguucgcggcgca

SEQ ID NO: 1407148 - RNA, 20 nt, Pseudomonas aeruginosa PA01
gcucggccaguucgucgagc

SEQ ID NO: 1407149 - RNA, 21 nt, Pseudomonas aeruginosa PA01
gcucggccaguucgucgagca

SEQ ID NO: 1407150 - RNA, 20 nt, Pseudomonas aeruginosa PA01
gcucggccaucagcgccagg

SEQ ID NO: 1407151 - RNA, 21 nt, Pseudomonas aeruginosa PA01
gcucggccaucagcgccaggg

SEQ ID NO: 1407152 - RNA, 19 nt, Pseudomonas aeruginosa PA01
gcucggccagcgccacggc

SEQ ID NO: 1407153 - RNA, 20 nt, Pseudomonas aeruginosa PA01
gcucggccagcgccacggcg

SEQ ID NO: 1407154 - RNA, 15 nt, Pseudomonas aeruginosa PA01
gcucgcuucagcgag

SEQ ID NO: 1407155 - RNA, 19 nt, Pseudomonas aeruginosa PA01
gcucgcugaaauccaccag

SEQ ID NO: 1407156 - RNA, 22 nt, Pseudomonas aeruginosa PA01
gcucgcugaaauccaccagcac

SEQ ID NO: 1407157 - RNA, 18 nt, Pseudomonas aeruginosa PA01
gcucgcuccgagcaggcc

SEQ ID NO: 1407158 - RNA, 19 nt, Pseudomonas aeruginosa PA01
gcucgcuccgagcaggccu

SEQ ID NO: 1407159 - RNA, 19 nt, Pseudomonas aeruginosa PA01
gcucgcucucgaacaccgg

SEQ ID NO: 1407160 - RNA, 12 nt, Pseudomonas aeruginosa PA01
gcucgcugcccg

SEQ ID NO: 1407161 - RNA, 16 nt, Pseudomonas aeruginosa PA01
gcucgcuguccagcac

SEQ ID NO: 1407162 - RNA, 17 nt, Pseudomonas aeruginosa PA01
gcucgcugucgccgagc

SEQ ID NO: 1407163 - RNA, 18 nt, Pseudomonas aeruginosa PA01
gcucgcugucgccgagca

SEQ ID NO: 1407164 - RNA, 19 nt, Pseudomonas aeruginosa PA01
gcucgcugucgcucagcgg

SEQ ID NO: 1407165 - RNA, 18 nt, Pseudomonas aeruginosa PA01
gcucgcgguuauccgccg

SEQ ID NO: 1407166 - RNA, 20 nt, Pseudomonas aeruginosa PA01
gcucgcgguuauccgccgcc

SEQ ID NO: 1407167 - RNA, 22 nt, Pseudomonas aeruginosa PA01
gcucgcgguuauccgccgccgg

SEQ ID NO: 1407168 - RNA, 20 nt, Pseudomonas aeruginosa PA01
gcucgcgguuauccgccgga

SEQ ID NO: 1407169 - RNA, 16 nt, Pseudomonas aeruginosa PA01
gcucgcgguucgagga

SEQ ID NO: 1407170 - RNA, 18 nt, Pseudomonas aeruginosa PA01
gcucgcgguucgaggacu

SEQ ID NO: 1407171 - RNA, 20 nt, Pseudomonas aeruginosa PA01
gcucgcuacagccgggaucu

SEQ ID NO: 1407172 - RNA, 16 nt, Pseudomonas aeruginosa PA01
gcucgcuaugcagcag

SEQ ID NO: 1407173 - RNA, 18 nt, Pseudomonas aeruginosa PA01
gcucggcgauggcgcgcg

SEQ ID NO: 1407174 - RNA, 23 nt, Pseudomonas aeruginosa PA01
gcucggcgauggcgcgcgggccu

SEQ ID NO: 1407175 - RNA, 20 nt, Pseudomonas aeruginosa PA01
gcucggcgaucucgcccagg

SEQ ID NO: 1407176 - RNA, 18 nt, Pseudomonas aeruginosa PA01
gcucggcgaugccgccgg

SEQ ID NO: 1407177 - RNA, 22 nt, Pseudomonas aeruginosa PA01
gcucggcgcgaugaugccgccg

SEQ ID NO: 1407178 - RNA, 23 nt, Pseudomonas aeruginosa PA01
gcucggcgcgaugaugccgccgu

SEQ ID NO: 1407179 - RNA, 14 nt, Pseudomonas aeruginosa PA01
gcucggcgcccugg

SEQ ID NO: 1407180 - RNA, 15 nt, Pseudomonas aeruginosa PA01
gcucggcgcccuggc

SEQ ID NO: 1407181 - RNA, 17 nt, Pseudomonas aeruginosa PA01
gcucggcgcccuggccg

SEQ ID NO: 1407182 - RNA, 15 nt, Pseudomonas aeruginosa PA01
gcucgugcagguagc

SEQ ID NO: 1407183 - RNA, 19 nt, Pseudomonas aeruginosa PA01
gcucgugccaucaggccgc

SEQ ID NO: 1407184 - RNA, 13 nt, Pseudomonas aeruginosa PA01
gcucguucgccca

SEQ ID NO: 1407185 - RNA, 16 nt, Pseudomonas aeruginosa PA01
gcucguuggcggccag

SEQ ID NO: 1407186 - RNA, 15 nt, Pseudomonas aeruginosa PA01
gcucguugcgccgcu

SEQ ID NO: 1407187 - RNA, 18 nt, Pseudomonas aeruginosa PA01
gcucguugcacagcgccc

SEQ ID NO: 1407188 - RNA, 23 nt, Pseudomonas aeruginosa PA01
gcucguugcacagcgcccagaca

SEQ ID NO: 1407189 - RNA, 14 nt, Pseudomonas aeruginosa PA01
gcucguugcccggc

SEQ ID NO: 1407190 - RNA, 17 nt, Pseudomonas aeruginosa PA01
gcucucccgaggcgauc

SEQ ID NO: 1407191 - RNA, 19 nt, Pseudomonas aeruginosa PA01
gcucucgaacaccaggcgc

SEQ ID NO: 1407192 - RNA, 20 nt, Pseudomonas aeruginosa PA01
gcucucgaacaccggcgagc

SEQ ID NO: 1407193 - RNA, 21 nt, Pseudomonas aeruginosa PA01
gcucucgaacaccggcgagca

SEQ ID NO: 1407194 - RNA, 16 nt, Pseudomonas aeruginosa PA01
gcucucgaacagcagc

SEQ ID NO: 1407195 - RNA, 17 nt, Pseudomonas aeruginosa PA01
gcucucgaacagcagca

SEQ ID NO: 1407196 - RNA, 14 nt, Pseudomonas aeruginosa PA01
gcucucgagcaugc

SEQ ID NO: 1407197 - RNA, 14 nt, Pseudomonas aeruginosa PA01
gcucucgaggacgu

SEQ ID NO: 1407198 - RNA, 17 nt, Pseudomonas aeruginosa PA01
gcugaccagcccggcgg

SEQ ID NO: 1407199 - RNA, 18 nt, Pseudomonas aeruginosa PA01
gcugaccaccagggcgau

SEQ ID NO: 1407200 - RNA, 20 nt, Pseudomonas aeruginosa PA01
gcugacccaggcuucggcgc

SEQ ID NO: 1407201 - RNA, 15 nt, Pseudomonas aeruginosa PA01
gcugacauccaccag

SEQ ID NO: 1407202 - RNA, 13 nt, Pseudomonas aeruginosa PA01
gcucucgccgcgc

SEQ ID NO: 1407203 - RNA, 20 nt, Pseudomonas aeruginosa PA01
gcugaaauggaaacgccagc

SEQ ID NO: 1407204 - RNA, 17 nt, Pseudomonas aeruginosa PA01
gcugaacaagcccuggu

SEQ ID NO: 1407205 - RNA, 18 nt, Pseudomonas aeruginosa PA01
gcugaacaagcccuggug

SEQ ID NO: 1407206 - RNA, 23 nt, Pseudomonas aeruginosa PA01
gcugaacagcuggcgcgucgcug

SEQ ID NO: 1407207 - RNA, 14 nt, Pseudomonas aeruginosa PA01
gcugaacagcgcca

SEQ ID NO: 1407208 - RNA, 19 nt, Pseudomonas aeruginosa PA01
gcugaacagcgccaccagc

SEQ ID NO: 1407209 - RNA, 15 nt, Pseudomonas aeruginosa PA01
gcugcaauucgucgg

SEQ ID NO: 1407210 - RNA, 20 nt, Pseudomonas aeruginosa PA01
gcugcaauucgucggccugc

SEQ ID NO: 1407211 - RNA, 17 nt, Pseudomonas aeruginosa PA01
gcugcaaucgcugccgg

SEQ ID NO: 1407212 - RNA, 21 nt, Pseudomonas aeruginosa PA01
gcugcaaggcuucggcgguca

SEQ ID NO: 1407213 - RNA, 16 nt, Pseudomonas aeruginosa PA01
gcugcaacuccgccug

SEQ ID NO: 1407214 - RNA, 18 nt, Pseudomonas aeruginosa PA01
gcugcaacuccgccuguc

SEQ ID NO: 1407215 - RNA, 13 nt, Pseudomonas aeruginosa PA01
gcugcagcaucag

SEQ ID NO: 1407216 - RNA, 19 nt, Pseudomonas aeruginosa PA01
gcugcagcaucaggcgcuc

SEQ ID NO: 1407217 - RNA, 13 nt, Pseudomonas aeruginosa PA01
gcugcaccagcag

SEQ ID NO: 1407218 - RNA, 14 nt, Pseudomonas aeruginosa PA01
gcugcaccagcagg

SEQ ID NO: 1407219 - RNA, 22 nt, Pseudomonas aeruginosa PA01
gcugaucacccgcccgccgucg

SEQ ID NO: 1407220 - RNA, 15 nt, Pseudomonas aeruginosa PA01
gcugaugccggcgaa

SEQ ID NO: 1407221 - RNA, 20 nt, Pseudomonas aeruginosa PA01
gcugaugccggcgucggcga

SEQ ID NO: 1407222 - RNA, 13 nt, Pseudomonas aeruginosa PA01
gcugaugcccggg

SEQ ID NO: 1407223 - RNA, 15 nt, Pseudomonas aeruginosa PA01
gcugaugcccggguc

SEQ ID NO: 1407224 - RNA, 13 nt, Pseudomonas aeruginosa PA01
gcugaucugccgg

SEQ ID NO: 1407225 - RNA, 13 nt, Pseudomonas aeruginosa PA01
gcugaccuggucg

SEQ ID NO: 1407226 - RNA, 20 nt, Pseudomonas aeruginosa PA01
gcugaccuucacuucgcgcg

SEQ ID NO: 1407227 - RNA, 15 nt, Pseudomonas aeruginosa PA01
gcugaccuucgccgu

SEQ ID NO: 1407228 - RNA, 15 nt, Pseudomonas aeruginosa PA01
gcugacgaggacgcc

SEQ ID NO: 1407229 - RNA, 16 nt, Pseudomonas aeruginosa PA01
gcugacgaggacgccg

SEQ ID NO: 1407230 - RNA, 15 nt, Pseudomonas aeruginosa PA01
gcugacgaacaucgc

SEQ ID NO: 1407231 - RNA, 17 nt, Pseudomonas aeruginosa PA01
gcugacgaacaucgcca

SEQ ID NO: 1407232 - RNA, 19 nt, Pseudomonas aeruginosa PA01
gcugacgaacaucgccagc

SEQ ID NO: 1407233 - RNA, 23 nt, Pseudomonas aeruginosa PA01
gcugacgaacaucgccagcgcca

SEQ ID NO: 1407234 - RNA, 22 nt, Pseudomonas aeruginosa PA01
gcugaccgggcggaucgccaac

SEQ ID NO: 1407235 - RNA, 14 nt, Pseudomonas aeruginosa PA01
gcugaccggccgca

SEQ ID NO: 1407236 - RNA, 15 nt, Pseudomonas aeruginosa PA01
gcugaccggccgcag

SEQ ID NO: 1407237 - RNA, 20 nt, Pseudomonas aeruginosa PA01
gcugaccggccgcagcaggu

SEQ ID NO: 1407238 - RNA, 23 nt, Pseudomonas aeruginosa PA01
gcugagcagcagguggcaagccu

SEQ ID NO: 1407239 - RNA, 15 nt, Pseudomonas aeruginosa PA01
gcugagacgcugccg

SEQ ID NO: 1407240 - RNA, 15 nt, Pseudomonas aeruginosa PA01
gcugagcagucgccu

SEQ ID NO: 1407241 - RNA, 16 nt, Pseudomonas aeruginosa PA01
gcugagcagucgccug

SEQ ID NO: 1407242 - RNA, 18 nt, Pseudomonas aeruginosa PA01
gcugagcaguugcgggcg

SEQ ID NO: 1407243 - RNA, 22 nt, Pseudomonas aeruginosa PA01
gcugagcaguugcgggcgcagg

SEQ ID NO: 1407244 - RNA, 19 nt, Pseudomonas aeruginosa PA01
gcugaggccgcccuggccg

SEQ ID NO: 1407245 - RNA, 14 nt, Pseudomonas aeruginosa PA01
gcugaggccggugu

SEQ ID NO: 1407246 - RNA, 13 nt, Pseudomonas aeruginosa PA01
gcugagcaggccg

SEQ ID NO: 1407247 - RNA, 14 nt, Pseudomonas aeruginosa PA01
gcugaggcucgccg

SEQ ID NO: 1407248 - RNA, 15 nt, Pseudomonas aeruginosa PA01
gcugaggcucgccgg

SEQ ID NO: 1407249 - RNA, 17 nt, Pseudomonas aeruginosa PA01
gcugaggucgcgggcga

SEQ ID NO: 1407250 - RNA, 22 nt, Pseudomonas aeruginosa PA01
gcugaggguggaacccauggcg

SEQ ID NO: 1407251 - RNA, 18 nt, Pseudomonas aeruginosa PA01
gcugaguucgucgagcau

SEQ ID NO: 1407252 - RNA, 19 nt, Pseudomonas aeruginosa PA01
gcugaguuugcccagcgcc

SEQ ID NO: 1407253 - RNA, 23 nt, Pseudomonas aeruginosa PA01
gcugaguuugcccagcgccgccu

SEQ ID NO: 1407254 - RNA, 15 nt, Pseudomonas aeruginosa PA01
gcugcgaccuggcgc

SEQ ID NO: 1407255 - RNA, 18 nt, Pseudomonas aeruginosa PA01
gcugcgaccuggcgccga

SEQ ID NO: 1407256 - RNA, 18 nt, Pseudomonas aeruginosa PA01
gcugcgagaacaggcgga

SEQ ID NO: 1407257 - RNA, 19 nt, Pseudomonas aeruginosa PA01
gcugcgauauggccgauca

SEQ ID NO: 1407258 - RNA, 23 nt, Pseudomonas aeruginosa PA01
gcugcgagggauguuccaggccc

SEQ ID NO: 1407259 - RNA, 21 nt, Pseudomonas aeruginosa PA01
gcugcgagcgcuucauccugc

SEQ ID NO: 1407260 - RNA, 19 nt, Pseudomonas aeruginosa PA01
gcugcgaaucgucgccgga

SEQ ID NO: 1407261 - RNA, 17 nt, Pseudomonas aeruginosa PA01
gcugccuggggacggca

SEQ ID NO: 1407262 - RNA, 18 nt, Pseudomonas aeruginosa PA01
gcugccuggggacggcag

SEQ ID NO: 1407263 - RNA, 22 nt, Pseudomonas aeruginosa PA01
gcugccuggggacggcaggccc

SEQ ID NO: 1407264 - RNA, 16 nt, Pseudomonas aeruginosa PA01
gcugccugucgcagcg

SEQ ID NO: 1407265 - RNA, 15 nt, Pseudomonas aeruginosa PA01
gcugccuuccagcag

SEQ ID NO: 1407266 - RNA, 16 nt, Pseudomonas aeruginosa PA01
gcugccuuccagcagg

SEQ ID NO: 1407267 - RNA, 18 nt, Pseudomonas aeruginosa PA01
gcugccuucgacguagac

SEQ ID NO: 1407268 - RNA, 16 nt, Pseudomonas aeruginosa PA01
gcugccguccaggcgc

SEQ ID NO: 1407269 - RNA, 18 nt, Pseudomonas aeruginosa PA01
gcugccguccaggcgcga

SEQ ID NO: 1407270 - RNA, 22 nt, Pseudomonas aeruginosa PA01
gcugccguccaggcgcgaacgc

SEQ ID NO: 1407271 - RNA, 13 nt, Pseudomonas aeruginosa PA01
gcugccggucagg

SEQ ID NO: 1407272 - RNA, 23 nt, Pseudomonas aeruginosa PA01
gcugccggucaggcuggugccgc

SEQ ID NO: 1407273 - RNA, 23 nt, Pseudomonas aeruginosa PA01
gcugccgccuucgcgggccaggc

SEQ ID NO: 1407274 - RNA, 18 nt, Pseudomonas aeruginosa PA01
gcugccgggcucugguag

SEQ ID NO: 1407275 - RNA, 13 nt, Pseudomonas aeruginosa PA01
gcugccgggcgag

SEQ ID NO: 1407276 - RNA, 14 nt, Pseudomonas aeruginosa PA01
gcugccgggcgagc

SEQ ID NO: 1407277 - RNA, 18 nt, Pseudomonas aeruginosa PA01
gcugccgggcgagcugca

SEQ ID NO: 1407278 - RNA, 13 nt, Pseudomonas aeruginosa PA01
gcugccggcgcgc

SEQ ID NO: 1407279 - RNA, 20 nt, Pseudomonas aeruginosa PA01
gcugccggcuugcugcaggu

SEQ ID NO: 1407280 - RNA, 21 nt, Pseudomonas aeruginosa PA01
gcugccguagaggucgccguc

SEQ ID NO: 1407281 - RNA, 18 nt, Pseudomonas aeruginosa PA01
gcugccguugcaggccca

SEQ ID NO: 1407282 - RNA, 20 nt, Pseudomonas aeruginosa PA01
gcugccucgguuuccggcca

SEQ ID NO: 1407283 - RNA, 22 nt, Pseudomonas aeruginosa PA01
gcugccucgguuuccggccagg

SEQ ID NO: 1407284 - RNA, 12 nt, Pseudomonas aeruginosa PA01
gcugccugcacc

SEQ ID NO: 1407285 - RNA, 16 nt, Pseudomonas aeruginosa PA01
gcugccugcaccgggc

SEQ ID NO: 1407286 - RNA, 17 nt, Pseudomonas aeruginosa PA01
gcugccugcaccgggcc

SEQ ID NO: 1407287 - RNA, 19 nt, Pseudomonas aeruginosa PA01
gcugccugcaccgggccga

SEQ ID NO: 1407288 - RNA, 15 nt, Pseudomonas aeruginosa PA01
gcugccgucgaaguc

SEQ ID NO: 1407289 - RNA, 17 nt, Pseudomonas aeruginosa PA01
gcugccguugcggcccu

SEQ ID NO: 1407290 - RNA, 12 nt, Pseudomonas aeruginosa PA01
gcugcagcgccc

SEQ ID NO: 1407291 - RNA, 14 nt, Pseudomonas aeruginosa PA01
gcugccauggcggc

SEQ ID NO: 1407292 - RNA, 17 nt, Pseudomonas aeruginosa PA01
gcugccauggcggcgga

SEQ ID NO: 1407293 - RNA, 13 nt, Pseudomonas aeruginosa PA01
gcugccaguggcg

SEQ ID NO: 1407294 - RNA, 22 nt, Pseudomonas aeruginosa PA01
gcugcagccacuguccaugaau

SEQ ID NO: 1407295 - RNA, 15 nt, Pseudomonas aeruginosa PA01
gcugcccagguagcc

SEQ ID NO: 1407296 - RNA, 19 nt, Pseudomonas aeruginosa PA01
gcugcccagguagccggcg

SEQ ID NO: 1407297 - RNA, 14 nt, Pseudomonas aeruginosa PA01
gcugcccaucgccu

SEQ ID NO: 1407298 - RNA, 16 nt, Pseudomonas aeruginosa PA01
gcugcccagcccgccu

SEQ ID NO: 1407299 - RNA, 15 nt, Pseudomonas aeruginosa PA01
gcugccgcaccgccu

SEQ ID NO: 1407300 - RNA, 19 nt, Pseudomonas aeruginosa PA01
gcugccccacaggcccugc

SEQ ID NO: 1407301 - RNA, 20 nt, Pseudomonas aeruginosa PA01
gcugcccaguugcgcggcga

SEQ ID NO: 1407302 - RNA, 22 nt, Pseudomonas aeruginosa PA01
gcugcccaguugcgcggcgagu

SEQ ID NO: 1407303 - RNA, 14 nt, Pseudomonas aeruginosa PA01
gcugccgccgcaga

SEQ ID NO: 1407304 - RNA, 23 nt, Pseudomonas aeruginosa PA01
gcugccgccgcagagccagccgc

SEQ ID NO: 1407305 - RNA, 24 nt, Pseudomonas aeruginosa PA01
gcugccgccgcagagccagccgca

SEQ ID NO: 1407306 - RNA, 11 nt, Pseudomonas aeruginosa PA01
gcugccgcccg

SEQ ID NO: 1407307 - RNA, 13 nt, Pseudomonas aeruginosa PA01
gcugccgccgucu

SEQ ID NO: 1407308 - RNA, 12 nt, Pseudomonas aeruginosa PA01
gcugccgccguc

SEQ ID NO: 1407309 - RNA, 13 nt, Pseudomonas aeruginosa PA01
gcugccgccgccg

SEQ ID NO: 1407310 - RNA, 14 nt, Pseudomonas aeruginosa PA01
gcugccgccgccgu

SEQ ID NO: 1407311 - RNA, 13 nt, Pseudomonas aeruginosa PA01
gcugccgccgcgc

SEQ ID NO: 1407312 - RNA, 14 nt, Pseudomonas aeruginosa PA01
gcugccgccgcgca

SEQ ID NO: 1407313 - RNA, 17 nt, Pseudomonas aeruginosa PA01
gcugccgccgcgcaggc

SEQ ID NO: 1407314 - RNA, 14 nt, Pseudomonas aeruginosa PA01
gcugccgccgcgcc

SEQ ID NO: 1407315 - RNA, 22 nt, Pseudomonas aeruginosa PA01
gcugccgccgcgcccggcgcca

SEQ ID NO: 1407316 - RNA, 23 nt, Pseudomonas aeruginosa PA01
gcugccgccgcgcccggcgccag

SEQ ID NO: 1407317 - RNA, 14 nt, Pseudomonas aeruginosa PA01
gcugccgccgcgcu

SEQ ID NO: 1407318 - RNA, 18 nt, Pseudomonas aeruginosa PA01
gcugcgccguuucgacga

SEQ ID NO: 1407319 - RNA, 14 nt, Pseudomonas aeruginosa PA01
gcugcgccuggccg

SEQ ID NO: 1407320 - RNA, 15 nt, Pseudomonas aeruginosa PA01
gcugcgccuggccgc

SEQ ID NO: 1407321 - RNA, 18 nt, Pseudomonas aeruginosa PA01
gcugcgccuggccgcgca

SEQ ID NO: 1407322 - RNA, 19 nt, Pseudomonas aeruginosa PA01
gcugcgccuggccgcgcag

SEQ ID NO: 1407323 - RNA, 20 nt, Pseudomonas aeruginosa PA01
gcugcgccuggccgcgcagg

SEQ ID NO: 1407324 - RNA, 20 nt, Pseudomonas aeruginosa PA01
gcugcgccgcugcggcugca

SEQ ID NO: 1407325 - RNA, 13 nt, Pseudomonas aeruginosa PA01
gcugcgccggcgc

SEQ ID NO: 1407326 - RNA, 15 nt, Pseudomonas aeruginosa PA01
gcugcgccugcagcu

SEQ ID NO: 1407327 - RNA, 13 nt, Pseudomonas aeruginosa PA01
gcugcgcgccgca

SEQ ID NO: 1407328 - RNA, 14 nt, Pseudomonas aeruginosa PA01
gcugcgcgcggccc

SEQ ID NO: 1407329 - RNA, 13 nt, Pseudomonas aeruginosa PA01
gcugcgcggcguc

SEQ ID NO: 1407330 - RNA, 15 nt, Pseudomonas aeruginosa PA01
gcugcgcggcgucgg

SEQ ID NO: 1407331 - RNA, 18 nt, Pseudomonas aeruginosa PA01
gcugcgcggcgucggcga

SEQ ID NO: 1407332 - RNA, 16 nt, Pseudomonas aeruginosa PA01
gcugcgcaacugccgg

SEQ ID NO: 1407333 - RNA, 22 nt, Pseudomonas aeruginosa PA01
gcugcgcaacugccggucggcc

SEQ ID NO: 1407334 - RNA, 14 nt, Pseudomonas aeruginosa PA01
gcugcgcaggccga

SEQ ID NO: 1407335 - RNA, 16 nt, Pseudomonas aeruginosa PA01
gcugcgcaggccgaga

SEQ ID NO: 1407336 - RNA, 14 nt, Pseudomonas aeruginosa PA01
gcugcgcagggcgc

SEQ ID NO: 1407337 - RNA, 15 nt, Pseudomonas aeruginosa PA01
gcugcgcagggcgcc

SEQ ID NO: 1407338 - RNA, 16 nt, Pseudomonas aeruginosa PA01
gcugcgcagggcgccg

SEQ ID NO: 1407339 - RNA, 15 nt, Pseudomonas aeruginosa PA01
gcugcgcaucgccug

SEQ ID NO: 1407340 - RNA, 17 nt, Pseudomonas aeruginosa PA01
gcugcgcaucgccuggg

SEQ ID NO: 1407341 - RNA, 19 nt, Pseudomonas aeruginosa PA01
gcugcgcaucgccugggcc

SEQ ID NO: 1407342 - RNA, 17 nt, Pseudomonas aeruginosa PA01
gcugcgcaucaggucgg

SEQ ID NO: 1407343 - RNA, 13 nt, Pseudomonas aeruginosa PA01
gcugcgccaggcc

SEQ ID NO: 1407344 - RNA, 14 nt, Pseudomonas aeruginosa PA01
gcugcgccgccguc

SEQ ID NO: 1407345 - RNA, 15 nt, Pseudomonas aeruginosa PA01
gcugcgccgccgucu

SEQ ID NO: 1407346 - RNA, 13 nt, Pseudomonas aeruginosa PA01
gcugcgccgccuu

SEQ ID NO: 1407347 - RNA, 12 nt, Pseudomonas aeruginosa PA01
gcugcgcccgcu

SEQ ID NO: 1407348 - RNA, 13 nt, Pseudomonas aeruginosa PA01
gcugcggccggcg

SEQ ID NO: 1407349 - RNA, 12 nt, Pseudomonas aeruginosa PA01
gcugcggccgag

SEQ ID NO: 1407350 - RNA, 13 nt, Pseudomonas aeruginosa PA01
gcugcggccgagc

SEQ ID NO: 1407351 - RNA, 14 nt, Pseudomonas aeruginosa PA01
gcugcggccgagca

SEQ ID NO: 1407352 - RNA, 16 nt, Pseudomonas aeruginosa PA01
gcugcggaaaccggga

SEQ ID NO: 1407353 - RNA, 22 nt, Pseudomonas aeruginosa PA01
gcugcggaucaacuccgccagg

SEQ ID NO: 1407354 - RNA, 18 nt, Pseudomonas aeruginosa PA01
gcugcggaugggcgacga

SEQ ID NO: 1407355 - RNA, 17 nt, Pseudomonas aeruginosa PA01
gcugcgcucggcgcucg

SEQ ID NO: 1407356 - RNA, 12 nt, Pseudomonas aeruginosa PA01
gcugcgcugcca

SEQ ID NO: 1407357 - RNA, 14 nt, Pseudomonas aeruginosa PA01
gcugcgcugccagc

SEQ ID NO: 1407358 - RNA, 17 nt, Pseudomonas aeruginosa PA01
gcugcgcugccagcgcc

SEQ ID NO: 1407359 - RNA, 18 nt, Pseudomonas aeruginosa PA01
gcugcgcguacaucccgc

SEQ ID NO: 1407360 - RNA, 13 nt, Pseudomonas aeruginosa PA01
gcugcgcgggucg

SEQ ID NO: 1407361 - RNA, 16 nt, Pseudomonas aeruginosa PA01
gcugcgcgggucgucc

SEQ ID NO: 1407362 - RNA, 22 nt, Pseudomonas aeruginosa PA01
gcugcgcgggucguccuccacc

SEQ ID NO: 1407363 - RNA, 13 nt, Pseudomonas aeruginosa PA01
gcugcgcgggucu

SEQ ID NO: 1407364 - RNA, 20 nt, Pseudomonas aeruginosa PA01
gcugcgcgggugucgcgacg

SEQ ID NO: 1407365 - RNA, 14 nt, Pseudomonas aeruginosa PA01
gcugcgcuccaggc

SEQ ID NO: 1407366 - RNA, 14 nt, Pseudomonas aeruginosa PA01
gcugcucagcgcgc

SEQ ID NO: 1407367 - RNA, 15 nt, Pseudomonas aeruginosa PA01
gcugcucagcgcgcu

SEQ ID NO: 1407368 - RNA, 15 nt, Pseudomonas aeruginosa PA01
gcugcucagggccgc

SEQ ID NO: 1407369 - RNA, 23 nt, Pseudomonas aeruginosa PA01
gcugcugaaaaacgccugggcgu

SEQ ID NO: 1407370 - RNA, 17 nt, Pseudomonas aeruginosa PA01
gcugcugaucaggagga

SEQ ID NO: 1407371 - RNA, 17 nt, Pseudomonas aeruginosa PA01
gcugcuaggcuggaagc

SEQ ID NO: 1407372 - RNA, 19 nt, Pseudomonas aeruginosa PA01
gcugcguggguagccgccc

SEQ ID NO: 1407373 - RNA, 20 nt, Pseudomonas aeruginosa PA01
gcugcguggguagccgccca

SEQ ID NO: 1407374 - RNA, 23 nt, Pseudomonas aeruginosa PA01
gcugcguggguagccgcccaccg

SEQ ID NO: 1407375 - RNA, 15 nt, Pseudomonas aeruginosa PA01
gcugcggcucgccga

SEQ ID NO: 1407376 - RNA, 18 nt, Pseudomonas aeruginosa PA01
gcugcggcggaaggcggc

SEQ ID NO: 1407377 - RNA, 14 nt, Pseudomonas aeruginosa PA01
gcugcggcggcacc

SEQ ID NO: 1407378 - RNA, 15 nt, Pseudomonas aeruginosa PA01
gcugcgugaggauca

SEQ ID NO: 1407379 - RNA, 15 nt, Pseudomonas aeruginosa PA01
gcugcgugccagggc

SEQ ID NO: 1407380 - RNA, 15 nt, Pseudomonas aeruginosa PA01
gcugcgucgucgcgg

SEQ ID NO: 1407381 - RNA, 19 nt, Pseudomonas aeruginosa PA01
gcugcgucgucgcggcgcc

SEQ ID NO: 1407382 - RNA, 21 nt, Pseudomonas aeruginosa PA01
gcugcgugcguugcgcggcag

SEQ ID NO: 1407383 - RNA, 13 nt, Pseudomonas aeruginosa PA01
ggagaagggcgcg

SEQ ID NO: 1407384 - RNA, 23 nt, Pseudomonas aeruginosa PA01
ggagaacaguugcaggguggcga

SEQ ID NO: 1407385 - RNA, 13 nt, Pseudomonas aeruginosa PA01
ggagaagcgccuc

SEQ ID NO: 1407386 - RNA, 21 nt, Pseudomonas aeruginosa PA01
ggagaagcgccucgccuucgu

SEQ ID NO: 1407387 - RNA, 16 nt, Pseudomonas aeruginosa PA01
ggagaaggagaacgac

SEQ ID NO: 1407388 - RNA, 20 nt, Pseudomonas aeruginosa PA01
ggagaaggagaacgacaugc

SEQ ID NO: 1407389 - RNA, 15 nt, Pseudomonas aeruginosa PA01
ggagaaacucgcggg

SEQ ID NO: 1407390 - RNA, 18 nt, Pseudomonas aeruginosa PA01
ggagaacagcagcggcac

SEQ ID NO: 1407391 - RNA, 21 nt, Pseudomonas aeruginosa PA01
ggagaacagcagggucagggu

SEQ ID NO: 1407392 - RNA, 17 nt, Pseudomonas aeruginosa PA01
ggacuuccuugcacuug

SEQ ID NO: 1407393 - RNA, 20 nt, Pseudomonas aeruginosa PA01
ggacugguaggacagggcca

SEQ ID NO: 1407394 - RNA, 23 nt, Pseudomonas aeruginosa PA01
ggacugguugaccugcagcgccu

SEQ ID NO: 1407395 - RNA, 21 nt, Pseudomonas aeruginosa PA01
ggacucgacgucauaggccuu

SEQ ID NO: 1407396 - RNA, 17 nt, Pseudomonas aeruginosa PA01
ggacugcccagcgccgc

SEQ ID NO: 1407397 - RNA, 20 nt, Pseudomonas aeruginosa PA01
ggacugcccagcgccgccag

SEQ ID NO: 1407398 - RNA, 18 nt, Pseudomonas aeruginosa PA01
ggacugcgaggcggugca

SEQ ID NO: 1407399 - RNA, 19 nt, Pseudomonas aeruginosa PA01
ggacugcgaggcggugcag

SEQ ID NO: 1407400 - RNA, 17 nt, Pseudomonas aeruginosa PA01
ggacguuuccagcggcu

SEQ ID NO: 1407401 - RNA, 20 nt, Pseudomonas aeruginosa PA01
ggacgugggaaaucaccgcc

SEQ ID NO: 1407402 - RNA, 15 nt, Pseudomonas aeruginosa PA01
ggacuccgacgcguc

SEQ ID NO: 1407403 - RNA, 18 nt, Pseudomonas aeruginosa PA01
ggacuccggaggcgcaca

SEQ ID NO: 1407404 - RNA, 14 nt, Pseudomonas aeruginosa PA01
ggacggucucgccg

SEQ ID NO: 1407405 - RNA, 15 nt, Pseudomonas aeruginosa PA01
ggacggugcaggccg

SEQ ID NO: 1407406 - RNA, 14 nt, Pseudomonas aeruginosa PA01
ggacguaacggcuu

SEQ ID NO: 1407407 - RNA, 16 nt, Pseudomonas aeruginosa PA01
ggacgucgaggucgac

SEQ ID NO: 1407408 - RNA, 13 nt, Pseudomonas aeruginosa PA01
ggacgucgacgag

SEQ ID NO: 1407409 - RNA, 17 nt, Pseudomonas aeruginosa PA01
ggacgucgucggcgacc

SEQ ID NO: 1407410 - RNA, 20 nt, Pseudomonas aeruginosa PA01
ggacggauaacggcagccgc

SEQ ID NO: 1407411 - RNA, 19 nt, Pseudomonas aeruginosa PA01
ggacggaagcauggccggc

SEQ ID NO: 1407412 - RNA, 20 nt, Pseudomonas aeruginosa PA01
ggacggaagcauggccggcu

SEQ ID NO: 1407413 - RNA, 19 nt, Pseudomonas aeruginosa PA01
ggacggcagccuggggguc

SEQ ID NO: 1407414 - RNA, 20 nt, Pseudomonas aeruginosa PA01
ggacggcagggucagccgau

SEQ ID NO: 1407415 - RNA, 23 nt, Pseudomonas aeruginosa PA01
ggacggcagggucagccgaugcu

SEQ ID NO: 1407416 - RNA, 18 nt, Pseudomonas aeruginosa PA01
ggacggcugaggcuggcg

SEQ ID NO: 1407417 - RNA, 21 nt, Pseudomonas aeruginosa PA01
ggacgcgcagggucaggcccu

SEQ ID NO: 1407418 - RNA, 16 nt, Pseudomonas aeruginosa PA01
ggacgcggccugggcc

SEQ ID NO: 1407419 - RNA, 13 nt, Pseudomonas aeruginosa PA01
ggacgcuggcgau

SEQ ID NO: 1407420 - RNA, 15 nt, Pseudomonas aeruginosa PA01
ggacgcuggcgauca

SEQ ID NO: 1407421 - RNA, 19 nt, Pseudomonas aeruginosa PA01
ggacgcugggcugggucgg

SEQ ID NO: 1407422 - RNA, 12 nt, Pseudomonas aeruginosa PA01
ggacgcuguccc

SEQ ID NO: 1407423 - RNA, 19 nt, Pseudomonas aeruginosa PA01
ggacgcuuguccuucggcc

SEQ ID NO: 1407424 - RNA, 18 nt, Pseudomonas aeruginosa PA01
ggacgcuccugcgccggc

SEQ ID NO: 1407425 - RNA, 19 nt, Pseudomonas aeruginosa PA01
ggacgcuccugcgccggcu

SEQ ID NO: 1407426 - RNA, 21 nt, Pseudomonas aeruginosa PA01
ggacgcuccugcgccggcucg

SEQ ID NO: 1407427 - RNA, 22 nt, Pseudomonas aeruginosa PA01
ggacgcuacgcucggggugcgc

SEQ ID NO: 1407428 - RNA, 14 nt, Pseudomonas aeruginosa PA01
ggaauuccugcucg

SEQ ID NO: 1407429 - RNA, 22 nt, Pseudomonas aeruginosa PA01
ggaaugacuaucgggccgaucg

SEQ ID NO: 1407430 - RNA, 13 nt, Pseudomonas aeruginosa PA01
ggaaugccggccg

SEQ ID NO: 1407431 - RNA, 21 nt, Pseudomonas aeruginosa PA01
ggaaugccggccggggccggc

SEQ ID NO: 1407432 - RNA, 12 nt, Pseudomonas aeruginosa PA01
ggaauggcgcgc

SEQ ID NO: 1407433 - RNA, 16 nt, Pseudomonas aeruginosa PA01
ggaaugcucagcacgg

SEQ ID NO: 1407434 - RNA, 19 nt, Pseudomonas aeruginosa PA01
ggaaugauguacucgcggc

SEQ ID NO: 1407435 - RNA, 20 nt, Pseudomonas aeruginosa PA01
ggaaucaccacucgccagcg

SEQ ID NO: 1407436 - RNA, 21 nt, Pseudomonas aeruginosa PA01
ggaaucaccacucgccagcgc

SEQ ID NO: 1407437 - RNA, 22 nt, Pseudomonas aeruginosa PA01
ggaaucaccacucgccagcgcg

SEQ ID NO: 1407438 - RNA, 21 nt, Pseudomonas aeruginosa PA01
ggacauacaggcgcgccuggc

SEQ ID NO: 1407439 - RNA, 12 nt, Pseudomonas aeruginosa PA01
ggaccagcuccg

SEQ ID NO: 1407440 - RNA, 18 nt, Pseudomonas aeruginosa PA01
ggaccaguucagcgcgcu

SEQ ID NO: 1407441 - RNA, 21 nt, Pseudomonas aeruginosa PA01
ggaccaguucagcgcgcucgc

SEQ ID NO: 1407442 - RNA, 16 nt, Pseudomonas aeruginosa PA01
ggaccaguucgccgcc

SEQ ID NO: 1407443 - RNA, 15 nt, Pseudomonas aeruginosa PA01
ggaccaucaccaccu

SEQ ID NO: 1407444 - RNA, 15 nt, Pseudomonas aeruginosa PA01
ggaccagggcgccgg

SEQ ID NO: 1407445 - RNA, 16 nt, Pseudomonas aeruginosa PA01
ggacaggucgacggcc

SEQ ID NO: 1407446 - RNA, 12 nt, Pseudomonas aeruginosa PA01
ggacaggucgcg

SEQ ID NO: 1407447 - RNA, 18 nt, Pseudomonas aeruginosa PA01
ggacagguuggcgccggg

SEQ ID NO: 1407448 - RNA, 20 nt, Pseudomonas aeruginosa PA01
ggacagguuggcgccgggcg

SEQ ID NO: 1407449 - RNA, 14 nt, Pseudomonas aeruginosa PA01
ggacagggccaggc

SEQ ID NO: 1407450 - RNA, 15 nt, Pseudomonas aeruginosa PA01
ggacagggccaggcc

SEQ ID NO: 1407451 - RNA, 17 nt, Pseudomonas aeruginosa PA01
ggacagggccaggccga

SEQ ID NO: 1407452 - RNA, 20 nt, Pseudomonas aeruginosa PA01
ggaccauuugcgccucgucg

SEQ ID NO: 1407453 - RNA, 23 nt, Pseudomonas aeruginosa PA01
ggacccagaaaccgaucagcacc

SEQ ID NO: 1407454 - RNA, 12 nt, Pseudomonas aeruginosa PA01
ggaccauggccg

SEQ ID NO: 1407455 - RNA, 14 nt, Pseudomonas aeruginosa PA01
ggaccauggccggc

SEQ ID NO: 1407456 - RNA, 16 nt, Pseudomonas aeruginosa PA01
ggaccauggccggcgu

SEQ ID NO: 1407457 - RNA, 21 nt, Pseudomonas aeruginosa PA01
ggaccaugucgcacuggucgg

SEQ ID NO: 1407458 - RNA, 22 nt, Pseudomonas aeruginosa PA01
ggacccagccauugagcgcgcc

SEQ ID NO: 1407459 - RNA, 14 nt, Pseudomonas aeruginosa PA01
ggaccggcucgucg

SEQ ID NO: 1407460 - RNA, 20 nt, Pseudomonas aeruginosa PA01
ggaccggcucucuucggccg

SEQ ID NO: 1407461 - RNA, 22 nt, Pseudomonas aeruginosa PA01
ggaccggcucucuucggccgau

SEQ ID NO: 1407462 - RNA, 19 nt, Pseudomonas aeruginosa PA01
ggacccaguugggccagga

SEQ ID NO: 1407463 - RNA, 18 nt, Pseudomonas aeruginosa PA01
ggaccgggcgccucgucg

SEQ ID NO: 1407464 - RNA, 14 nt, Pseudomonas aeruginosa PA01
ggaccgggcggcag

SEQ ID NO: 1407465 - RNA, 15 nt, Pseudomonas aeruginosa PA01
ggaccgggcggcgcg

SEQ ID NO: 1407466 - RNA, 17 nt, Pseudomonas aeruginosa PA01
ggaccgggcggcgcggc

SEQ ID NO: 1407467 - RNA, 18 nt, Pseudomonas aeruginosa PA01
ggaccgggcggcgcggcg

SEQ ID NO: 1407468 - RNA, 20 nt, Pseudomonas aeruginosa PA01
ggaccgggcggcgcggcgca

SEQ ID NO: 1407469 - RNA, 17 nt, Pseudomonas aeruginosa PA01
ggacgccaccaggccgc

SEQ ID NO: 1407470 - RNA, 19 nt, Pseudomonas aeruginosa PA01
ggacgccaccaggccgcug

SEQ ID NO: 1407471 - RNA, 12 nt, Pseudomonas aeruginosa PA01
ggacgccaggcg

SEQ ID NO: 1407472 - RNA, 13 nt, Pseudomonas aeruginosa PA01
ggacgccaggcgu

SEQ ID NO: 1407473 - RNA, 19 nt, Pseudomonas aeruginosa PA01
ggacgcauaaccgcuugcg

SEQ ID NO: 1407474 - RNA, 13 nt, Pseudomonas aeruginosa PA01
ggacgcaccagca

SEQ ID NO: 1407475 - RNA, 18 nt, Pseudomonas aeruginosa PA01
ggacgcaccagcaggccg

SEQ ID NO: 1407476 - RNA, 20 nt, Pseudomonas aeruginosa PA01
ggacgcaccagcaggccgau

SEQ ID NO: 1407477 - RNA, 21 nt, Pseudomonas aeruginosa PA01
ggacgcaccagcaggccgauc

SEQ ID NO: 1407478 - RNA, 18 nt, Pseudomonas aeruginosa PA01
ggacgauggucgccgcga

SEQ ID NO: 1407479 - RNA, 22 nt, Pseudomonas aeruginosa PA01
ggacgauauugguguagcugca

SEQ ID NO: 1407480 - RNA, 14 nt, Pseudomonas aeruginosa PA01
ggacgaugccgauc

SEQ ID NO: 1407481 - RNA, 15 nt, Pseudomonas aeruginosa PA01
ggacgaugccgaucu

SEQ ID NO: 1407482 - RNA, 15 nt, Pseudomonas aeruginosa PA01
ggaccggugccccgc

SEQ ID NO: 1407483 - RNA, 15 nt, Pseudomonas aeruginosa PA01
ggaaguugcgcaccc

SEQ ID NO: 1407484 - RNA, 14 nt, Pseudomonas aeruginosa PA01
ggaaguggaucggc

SEQ ID NO: 1407485 - RNA, 16 nt, Pseudomonas aeruginosa PA01
ggaagugucgguugaa

SEQ ID NO: 1407486 - RNA, 14 nt, Pseudomonas aeruginosa PA01
ggaaguuaucgggg

SEQ ID NO: 1407487 - RNA, 15 nt, Pseudomonas aeruginosa PA01
ggaagcgcgcgccag

SEQ ID NO: 1407488 - RNA, 18 nt, Pseudomonas aeruginosa PA01
ggaagcgcggcucgggga

SEQ ID NO: 1407489 - RNA, 18 nt, Pseudomonas aeruginosa PA01
ggaagcgaucuccugccg

SEQ ID NO: 1407490 - RNA, 22 nt, Pseudomonas aeruginosa PA01
ggaagcgaucuccugccgcggc

SEQ ID NO: 1407491 - RNA, 19 nt, Pseudomonas aeruginosa PA01
ggaagcgggccucggcggg

SEQ ID NO: 1407492 - RNA, 17 nt, Pseudomonas aeruginosa PA01
ggaagcgucagccgcgg

SEQ ID NO: 1407493 - RNA, 19 nt, Pseudomonas aeruginosa PA01
ggaagcgucgugcgccggc

SEQ ID NO: 1407494 - RNA, 17 nt, Pseudomonas aeruginosa PA01
ggaagcguugcucgagc

SEQ ID NO: 1407495 - RNA, 14 nt, Pseudomonas aeruginosa PA01
ggaagcucggcagc

SEQ ID NO: 1407496 - RNA, 14 nt, Pseudomonas aeruginosa PA01
ggaagcugacgaac

SEQ ID NO: 1407497 - RNA, 18 nt, Pseudomonas aeruginosa PA01
ggaagaugcacaccagcu

SEQ ID NO: 1407498 - RNA, 16 nt, Pseudomonas aeruginosa PA01
ggaagauguucgccgc

SEQ ID NO: 1407499 - RNA, 17 nt, Pseudomonas aeruginosa PA01
ggaagauguucgccgcc

SEQ ID NO: 1407500 - RNA, 16 nt, Pseudomonas aeruginosa PA01
ggaagaaaagaaggcg

SEQ ID NO: 1407501 - RNA, 15 nt, Pseudomonas aeruginosa PA01
ggaagaacaggcgcu

SEQ ID NO: 1407502 - RNA, 20 nt, Pseudomonas aeruginosa PA01
ggaagagcaucucgccggca

SEQ ID NO: 1407503 - RNA, 22 nt, Pseudomonas aeruginosa PA01
ggaagagcaucucgccggcacu

SEQ ID NO: 1407504 - RNA, 14 nt, Pseudomonas aeruginosa PA01
ggaagagcgccgcg

SEQ ID NO: 1407505 - RNA, 20 nt, Pseudomonas aeruginosa PA01
ggaacuugcgccgaccgcgc

SEQ ID NO: 1407506 - RNA, 18 nt, Pseudomonas aeruginosa PA01
ggaacuggucgauccgcg

SEQ ID NO: 1407507 - RNA, 21 nt, Pseudomonas aeruginosa PA01
ggaacuucaugaugcgcccgg

SEQ ID NO: 1407508 - RNA, 17 nt, Pseudomonas aeruginosa PA01
ggaagaauaccgccagc

SEQ ID NO: 1407509 - RNA, 19 nt, Pseudomonas aeruginosa PA01
ggaagaauaccgccagcuc

SEQ ID NO: 1407510 - RNA, 15 nt, Pseudomonas aeruginosa PA01
ggaagccgggaagcc

SEQ ID NO: 1407511 - RNA, 20 nt, Pseudomonas aeruginosa PA01
ggaagccgggaagccgcucg

SEQ ID NO: 1407512 - RNA, 16 nt, Pseudomonas aeruginosa PA01
ggaagccgucggcgau

SEQ ID NO: 1407513 - RNA, 14 nt, Pseudomonas aeruginosa PA01
ggaagccguggcgg

SEQ ID NO: 1407514 - RNA, 18 nt, Pseudomonas aeruginosa PA01
ggaagccguggcgggcca

SEQ ID NO: 1407515 - RNA, 22 nt, Pseudomonas aeruginosa PA01
ggaagccgcgccccagcggcag

SEQ ID NO: 1407516 - RNA, 15 nt, Pseudomonas aeruginosa PA01
ggaagccgcgcucgc

SEQ ID NO: 1407517 - RNA, 18 nt, Pseudomonas aeruginosa PA01
ggaagccgcgcucgcgga

SEQ ID NO: 1407518 - RNA, 17 nt, Pseudomonas aeruginosa PA01
ggaagcaggucucgacg

SEQ ID NO: 1407519 - RNA, 20 nt, Pseudomonas aeruginosa PA01
ggaagcacggcucggcgagg

SEQ ID NO: 1407520 - RNA, 19 nt, Pseudomonas aeruginosa PA01
ggaagccgaccacucgcga

SEQ ID NO: 1407521 - RNA, 15 nt, Pseudomonas aeruginosa PA01
ggaagccgaccggcg

SEQ ID NO: 1407522 - RNA, 13 nt, Pseudomonas aeruginosa PA01
ggaaaugccuggc

SEQ ID NO: 1407523 - RNA, 20 nt, Pseudomonas aeruginosa PA01
ggaaaucggccacuccagcc

SEQ ID NO: 1407524 - RNA, 19 nt, Pseudomonas aeruginosa PA01
ggaaaucgguugccgcgcc

SEQ ID NO: 1407525 - RNA, 21 nt, Pseudomonas aeruginosa PA01
ggaacacccagaagccgaccu

SEQ ID NO: 1407526 - RNA, 17 nt, Pseudomonas aeruginosa PA01
ggaacaccaggccgcaa

SEQ ID NO: 1407527 - RNA, 15 nt, Pseudomonas aeruginosa PA01
ggaaauucagcgcuu

SEQ ID NO: 1407528 - RNA, 14 nt, Pseudomonas aeruginosa PA01
ggaacaagccgccu

SEQ ID NO: 1407529 - RNA, 23 nt, Pseudomonas aeruginosa PA01
ggaaccacgacgaagcgccggcg

SEQ ID NO: 1407530 - RNA, 21 nt, Pseudomonas aeruginosa PA01
ggaaccaggggucgacgcagg

SEQ ID NO: 1407531 - RNA, 21 nt, Pseudomonas aeruginosa PA01
ggaacccagguucuggucgcc

SEQ ID NO: 1407532 - RNA, 15 nt, Pseudomonas aeruginosa PA01
ggaacccgcggcgcg

SEQ ID NO: 1407533 - RNA, 14 nt, Pseudomonas aeruginosa PA01
ggaacagcgccagc

SEQ ID NO: 1407534 - RNA, 18 nt, Pseudomonas aeruginosa PA01
ggaacagguucggcaggc

SEQ ID NO: 1407535 - RNA, 17 nt, Pseudomonas aeruginosa PA01
ggaacaguucggcgagu

SEQ ID NO: 1407536 - RNA, 12 nt, Pseudomonas aeruginosa PA01
ggaacagcagcc

SEQ ID NO: 1407537 - RNA, 16 nt, Pseudomonas aeruginosa PA01
ggaacagcagccaggc

SEQ ID NO: 1407538 - RNA, 17 nt, Pseudomonas aeruginosa PA01
ggaacagcagccaggcg

SEQ ID NO: 1407539 - RNA, 12 nt, Pseudomonas aeruginosa PA01
ggaacagcauca

SEQ ID NO: 1407540 - RNA, 15 nt, Pseudomonas aeruginosa PA01
gcuuuccuggccgac

SEQ ID NO: 1407541 - RNA, 18 nt, Pseudomonas aeruginosa PA01
gcuuuccuggccgacccg

SEQ ID NO: 1407542 - RNA, 21 nt, Pseudomonas aeruginosa PA01
gcuuuccgucucaggcgccag

SEQ ID NO: 1407543 - RNA, 22 nt, Pseudomonas aeruginosa PA01
gcuuuccgucucaggcgccagg

SEQ ID NO: 1407544 - RNA, 15 nt, Pseudomonas aeruginosa PA01
gcuuuccucggccau

SEQ ID NO: 1407545 - RNA, 21 nt, Pseudomonas aeruginosa PA01
gcuuuccucggccaugccggc

SEQ ID NO: 1407546 - RNA, 17 nt, Pseudomonas aeruginosa PA01
gcuuucgguuugcgccg

SEQ ID NO: 1407547 - RNA, 20 nt, Pseudomonas aeruginosa PA01
gcuuucguaggcaggcgcgg

SEQ ID NO: 1407548 - RNA, 21 nt, Pseudomonas aeruginosa PA01
gcuuucguaggcaggcgcggc

SEQ ID NO: 1407549 - RNA, 22 nt, Pseudomonas aeruginosa PA01
gcuuucguaggcaggcgcggca

SEQ ID NO: 1407550 - RNA, 23 nt, Pseudomonas aeruginosa PA01
gcuuucguaggcaggcgcggcau

SEQ ID NO: 1407551 - RNA, 14 nt, Pseudomonas aeruginosa PA01
gcuuuccgcggcgu

SEQ ID NO: 1407552 - RNA, 17 nt, Pseudomonas aeruginosa PA01
gcuuuccggcgcggccu

SEQ ID NO: 1407553 - RNA, 16 nt, Pseudomonas aeruginosa PA01
gcuuucccugcugcgg

SEQ ID NO: 1407554 - RNA, 16 nt, Pseudomonas aeruginosa PA01
gcuuuccgccgagcgu

SEQ ID NO: 1407555 - RNA, 15 nt, Pseudomonas aeruginosa PA01
gcuuguggccggucu

SEQ ID NO: 1407556 - RNA, 19 nt, Pseudomonas aeruginosa PA01
gcuucugucccugggccau

SEQ ID NO: 1407557 - RNA, 20 nt, Pseudomonas aeruginosa PA01
gcuucugucccugggccaug

SEQ ID NO: 1407558 - RNA, 19 nt, Pseudomonas aeruginosa PA01
gcuucugguucguccgcgc

SEQ ID NO: 1407559 - RNA, 21 nt, Pseudomonas aeruginosa PA01
gcuucugguuguaagcgucgg

SEQ ID NO: 1407560 - RNA, 16 nt, Pseudomonas aeruginosa PA01
gcuucuucaccaggcc

SEQ ID NO: 1407561 - RNA, 15 nt, Pseudomonas aeruginosa PA01
gcuugaagccggcgu

SEQ ID NO: 1407562 - RNA, 15 nt, Pseudomonas aeruginosa PA01
gcuucuucugcagcu

SEQ ID NO: 1407563 - RNA, 17 nt, Pseudomonas aeruginosa PA01
gcuucuggaaggcgguc

SEQ ID NO: 1407564 - RNA, 17 nt, Pseudomonas aeruginosa PA01
gcuucuuccuggccggg

SEQ ID NO: 1407565 - RNA, 17 nt, Pseudomonas aeruginosa PA01
gcuuguguccgccgagg

SEQ ID NO: 1407566 - RNA, 22 nt, Pseudomonas aeruginosa PA01
gcuuguuggccagcagccaggc

SEQ ID NO: 1407567 - RNA, 23 nt, Pseudomonas aeruginosa PA01
gcuuguuggccagcagccaggcc

SEQ ID NO: 1407568 - RNA, 21 nt, Pseudomonas aeruginosa PA01
gcuugucgccuuccucggcga

SEQ ID NO: 1407569 - RNA, 18 nt, Pseudomonas aeruginosa PA01
gcuugucgauggucagga

SEQ ID NO: 1407570 - RNA, 22 nt, Pseudomonas aeruginosa PA01
gcuugucgauggucaggaucac

SEQ ID NO: 1407571 - RNA, 17 nt, Pseudomonas aeruginosa PA01
ggaaaccucgccgguca

SEQ ID NO: 1407572 - RNA, 23 nt, Pseudomonas aeruginosa PA01
ggaaacgcgcgcucucgccggcc

SEQ ID NO: 1407573 - RNA, 17 nt, Pseudomonas aeruginosa PA01
ggaaagccuggccggcg

SEQ ID NO: 1407574 - RNA, 19 nt, Pseudomonas aeruginosa PA01
ggaaaggccgccacggcgg

SEQ ID NO: 1407575 - RNA, 14 nt, Pseudomonas aeruginosa PA01
ggaaaggccucggc

SEQ ID NO: 1407576 - RNA, 20 nt, Pseudomonas aeruginosa PA01
ggaaagcuccucggccuugc

SEQ ID NO: 1407577 - RNA, 21 nt, Pseudomonas aeruginosa PA01
ggaaaggcgucguugccgauc

SEQ ID NO: 1407578 - RNA, 20 nt, Pseudomonas aeruginosa PA01
ggaaacccaugcccgccccg

SEQ ID NO: 1407579 - RNA, 18 nt, Pseudomonas aeruginosa PA01
ggaaaccccggccuggcg

SEQ ID NO: 1407580 - RNA, 14 nt, Pseudomonas aeruginosa PA01
ggaaaccgcggccg

SEQ ID NO: 1407581 - RNA, 15 nt, Pseudomonas aeruginosa PA01
ggaaaccgcggccgg

SEQ ID NO: 1407582 - RNA, 22 nt, Pseudomonas aeruginosa PA01
ggaaacccgugguccgccagca

SEQ ID NO: 1407583 - RNA, 19 nt, Pseudomonas aeruginosa PA01
ggaaacccucaggucggcg

SEQ ID NO: 1407584 - RNA, 23 nt, Pseudomonas aeruginosa PA01
ggaaacccucaggucggcgccug

SEQ ID NO: 1407585 - RNA, 21 nt, Pseudomonas aeruginosa PA01
ggaaaccugugcugcgcgccg

SEQ ID NO: 1407586 - RNA, 21 nt, Pseudomonas aeruginosa PA01
ggaaaccuucgguggcgacca

SEQ ID NO: 1407587 - RNA, 12 nt, Pseudomonas aeruginosa PA01
gcuuugcgcagc

SEQ ID NO: 1407588 - RNA, 15 nt, Pseudomonas aeruginosa PA01
gcuuugcggcaaggc

SEQ ID NO: 1407589 - RNA, 22 nt, Pseudomonas aeruginosa PA01
gcuuugcccgucuagcgcaggc

SEQ ID NO: 1407590 - RNA, 15 nt, Pseudomonas aeruginosa PA01
ggaaaagaagccgcg

SEQ ID NO: 1407591 - RNA, 16 nt, Pseudomonas aeruginosa PA01
ggaaaagcccgcuccg

SEQ ID NO: 1407592 - RNA, 15 nt, Pseudomonas aeruginosa PA01
gcuguuccucgucga

SEQ ID NO: 1407593 - RNA, 17 nt, Pseudomonas aeruginosa PA01
gcuguucagcgggugcc

SEQ ID NO: 1407594 - RNA, 13 nt, Pseudomonas aeruginosa PA01
gcuguguccggcg

SEQ ID NO: 1407595 - RNA, 15 nt, Pseudomonas aeruginosa PA01
gcuguguccggcgga

SEQ ID NO: 1407596 - RNA, 20 nt, Pseudomonas aeruginosa PA01
gcugugugccucugaccgcg

SEQ ID NO: 1407597 - RNA, 22 nt, Pseudomonas aeruginosa PA01
gcugugugccucugaccgcgcc

SEQ ID NO: 1407598 - RNA, 14 nt, Pseudomonas aeruginosa PA01
gcuguggcgcggcu

SEQ ID NO: 1407599 - RNA, 22 nt, Pseudomonas aeruginosa PA01
gcugugcucgaggaagcgcccg

SEQ ID NO: 1407600 - RNA, 14 nt, Pseudomonas aeruginosa PA01
gcugugcuggccac

SEQ ID NO: 1407601 - RNA, 19 nt, Pseudomonas aeruginosa PA01
gcugugcuggccacccuug

SEQ ID NO: 1407602 - RNA, 19 nt, Pseudomonas aeruginosa PA01
gcugucgccguuggccuuc

SEQ ID NO: 1407603 - RNA, 16 nt, Pseudomonas aeruginosa PA01
gcugucgcccucgcgg

SEQ ID NO: 1407604 - RNA, 17 nt, Pseudomonas aeruginosa PA01
gcugucgcccucgcgga

SEQ ID NO: 1407605 - RNA, 19 nt, Pseudomonas aeruginosa PA01
gcugucgcccucgcggagc

SEQ ID NO: 1407606 - RNA, 17 nt, Pseudomonas aeruginosa PA01
gcuguggaaguacggcg

SEQ ID NO: 1407607 - RNA, 22 nt, Pseudomonas aeruginosa PA01
gcuguggaaguacggcgcggug

SEQ ID NO: 1407608 - RNA, 13 nt, Pseudomonas aeruginosa PA01
gcuguccuccagc

SEQ ID NO: 1407609 - RNA, 16 nt, Pseudomonas aeruginosa PA01
gcuguccuccagcggc

SEQ ID NO: 1407610 - RNA, 18 nt, Pseudomonas aeruginosa PA01
gcuguccuccagcggcgg

SEQ ID NO: 1407611 - RNA, 15 nt, Pseudomonas aeruginosa PA01
gcuguccgccgccgc

SEQ ID NO: 1407612 - RNA, 15 nt, Pseudomonas aeruginosa PA01
gcuguccgccggccu

SEQ ID NO: 1407613 - RNA, 15 nt, Pseudomonas aeruginosa PA01
gcuguccgcgccgcg

SEQ ID NO: 1407614 - RNA, 16 nt, Pseudomonas aeruginosa PA01
gcuguccgcgccgcgu

SEQ ID NO: 1407615 - RNA, 21 nt, Pseudomonas aeruginosa PA01
gcuguccagcgcuccuugcgc

SEQ ID NO: 1407616 - RNA, 15 nt, Pseudomonas aeruginosa PA01
gcugucgagcgaagc

SEQ ID NO: 1407617 - RNA, 16 nt, Pseudomonas aeruginosa PA01
gcuguccuguggcgcu

SEQ ID NO: 1407618 - RNA, 14 nt, Pseudomonas aeruginosa PA01
gcuguacaagcgca

SEQ ID NO: 1407619 - RNA, 18 nt, Pseudomonas aeruginosa PA01
gcuguacaagcgcaacgc

SEQ ID NO: 1407620 - RNA, 16 nt, Pseudomonas aeruginosa PA01
gcuguaaucgccgcuu

SEQ ID NO: 1407621 - RNA, 18 nt, Pseudomonas aeruginosa PA01
gcugguuuagcucggcga

SEQ ID NO: 1407622 - RNA, 15 nt, Pseudomonas aeruginosa PA01
gcuguagccacggcg

SEQ ID NO: 1407623 - RNA, 16 nt, Pseudomonas aeruginosa PA01
gcuguagaaugcgccu

SEQ ID NO: 1407624 - RNA, 14 nt, Pseudomonas aeruginosa PA01
gcuguagccggcgc

SEQ ID NO: 1407625 - RNA, 16 nt, Pseudomonas aeruginosa PA01
gcuguagccggcgccg

SEQ ID NO: 1407626 - RNA, 21 nt, Pseudomonas aeruginosa PA01
gcuguagccucccgccgcggc

SEQ ID NO: 1407627 - RNA, 22 nt, Pseudomonas aeruginosa PA01
gcuguagccucccgccgcggcg

SEQ ID NO: 1407628 - RNA, 13 nt, Pseudomonas aeruginosa PA01
gcugguccagcac

SEQ ID NO: 1407629 - RNA, 15 nt, Pseudomonas aeruginosa PA01
gcugguccagcacgc

SEQ ID NO: 1407630 - RNA, 19 nt, Pseudomonas aeruginosa PA01
gcugguccagcacgcuggc

SEQ ID NO: 1407631 - RNA, 20 nt, Pseudomonas aeruginosa PA01
gcugguccagcacgcuggcg

SEQ ID NO: 1407632 - RNA, 18 nt, Pseudomonas aeruginosa PA01
gcugguccagcuggcgca

SEQ ID NO: 1407633 - RNA, 19 nt, Pseudomonas aeruginosa PA01
gcugguccagcuggcgcag

SEQ ID NO: 1407634 - RNA, 18 nt, Pseudomonas aeruginosa PA01
gcugguggcccugggcgg

SEQ ID NO: 1407635 - RNA, 18 nt, Pseudomonas aeruginosa PA01
gcugguugaagccgaucg

SEQ ID NO: 1407636 - RNA, 16 nt, Pseudomonas aeruginosa PA01
gcugguugaccaggcc

SEQ ID NO: 1407637 - RNA, 14 nt, Pseudomonas aeruginosa PA01
gcugguuggcgagg

SEQ ID NO: 1407638 - RNA, 18 nt, Pseudomonas aeruginosa PA01
gcugguugccagcagcgc

SEQ ID NO: 1407639 - RNA, 15 nt, Pseudomonas aeruginosa PA01
gcugguugcccaggg

SEQ ID NO: 1407640 - RNA, 15 nt, Pseudomonas aeruginosa PA01
gcuggugggcgucgc

SEQ ID NO: 1407641 - RNA, 20 nt, Pseudomonas aeruginosa PA01
gcugguggucaccgccagcg

SEQ ID NO: 1407642 - RNA, 22 nt, Pseudomonas aeruginosa PA01
gcugguggucaccgccagcggg

SEQ ID NO: 1407643 - RNA, 20 nt, Pseudomonas aeruginosa PA01
gcuggcggcgacgaaggucg

SEQ ID NO: 1407644 - RNA, 22 nt, Pseudomonas aeruginosa PA01
gcuggcggcgacgaaggucggc

SEQ ID NO: 1407645 - RNA, 15 nt, Pseudomonas aeruginosa PA01
gcuggcggccuucgg

SEQ ID NO: 1407646 - RNA, 13 nt, Pseudomonas aeruginosa PA01
gcuggcggccagg

SEQ ID NO: 1407647 - RNA, 15 nt, Pseudomonas aeruginosa PA01
gcuggcggccagggc

SEQ ID NO: 1407648 - RNA, 16 nt, Pseudomonas aeruginosa PA01
gcuggcggccagggca

SEQ ID NO: 1407649 - RNA, 18 nt, Pseudomonas aeruginosa PA01
gcuggcggccgaguucgc

SEQ ID NO: 1407650 - RNA, 22 nt, Pseudomonas aeruginosa PA01
gcuggcggccgaguucgcgcag

SEQ ID NO: 1407651 - RNA, 23 nt, Pseudomonas aeruginosa PA01
gcuggcguugacugccugcaggu

SEQ ID NO: 1407652 - RNA, 18 nt, Pseudomonas aeruginosa PA01
gcuggcguucucggccag

SEQ ID NO: 1407653 - RNA, 19 nt, Pseudomonas aeruginosa PA01
gcuggcguucucggccagg

SEQ ID NO: 1407654 - RNA, 22 nt, Pseudomonas aeruginosa PA01
gcuggcguucucggccagguac

SEQ ID NO: 1407655 - RNA, 19 nt, Pseudomonas aeruginosa PA01
gcuggcugacagcuugucg

SEQ ID NO: 1407656 - RNA, 24 nt, Pseudomonas aeruginosa PA01
gcuggcugcccaguugcgcggcga

SEQ ID NO: 1407657 - RNA, 16 nt, Pseudomonas aeruginosa PA01
gcuggcggcauaggcc

SEQ ID NO: 1407658 - RNA, 12 nt, Pseudomonas aeruginosa PA01
gcuggcggcauc

SEQ ID NO: 1407659 - RNA, 20 nt, Pseudomonas aeruginosa PA01
gcuggcggcaucggcgccgc

SEQ ID NO: 1407660 - RNA, 14 nt, Pseudomonas aeruginosa PA01
gcuggcgcuugccg

SEQ ID NO: 1407661 - RNA, 18 nt, Pseudomonas aeruginosa PA01
gcuggcgcuugccgcgcc

SEQ ID NO: 1407662 - RNA, 20 nt, Pseudomonas aeruginosa PA01
gcuggcgcuugccgcgcccg

SEQ ID NO: 1407663 - RNA, 21 nt, Pseudomonas aeruginosa PA01
gcuggcgcuugccgcgcccgg

SEQ ID NO: 1407664 - RNA, 22 nt, Pseudomonas aeruginosa PA01
gcuggcgcuugccgcgcccggc

SEQ ID NO: 1407665 - RNA, 20 nt, Pseudomonas aeruginosa PA01
gcuggcgcugguccuugauc

SEQ ID NO: 1407666 - RNA, 21 nt, Pseudomonas aeruginosa PA01
gcuggcgcuguaggcgagcag

SEQ ID NO: 1407667 - RNA, 22 nt, Pseudomonas aeruginosa PA01
gcuggcgcgucgcugccgccgc

SEQ ID NO: 1407668 - RNA, 20 nt, Pseudomonas aeruginosa PA01
gcuggcgcucucgaacacca

SEQ ID NO: 1407669 - RNA, 14 nt, Pseudomonas aeruginosa PA01
gcugcugcggcuuc

SEQ ID NO: 1407670 - RNA, 16 nt, Pseudomonas aeruginosa PA01
gcugcugcgccuggcc

SEQ ID NO: 1407671 - RNA, 21 nt, Pseudomonas aeruginosa PA01
gcugcugccauccgcgccgac

SEQ ID NO: 1407672 - RNA, 23 nt, Pseudomonas aeruginosa PA01
gcugcugccauccgcgccgacca

SEQ ID NO: 1407673 - RNA, 14 nt, Pseudomonas aeruginosa PA01
gcugcugcaaccga

SEQ ID NO: 1407674 - RNA, 16 nt, Pseudomonas aeruginosa PA01
gcuggguuggcgcgag

SEQ ID NO: 1407675 - RNA, 17 nt, Pseudomonas aeruginosa PA01
gcuggguuggcgcgaga

SEQ ID NO: 1407676 - RNA, 17 nt, Pseudomonas aeruginosa PA01
gcugguaauccagggag

SEQ ID NO: 1407677 - RNA, 16 nt, Pseudomonas aeruginosa PA01
gcugguagcccaggcc

SEQ ID NO: 1407678 - RNA, 17 nt, Pseudomonas aeruginosa PA01
gcugguagcccaggccg

SEQ ID NO: 1407679 - RNA, 18 nt, Pseudomonas aeruginosa PA01
gcugguagcccaggccga

SEQ ID NO: 1407680 - RNA, 20 nt, Pseudomonas aeruginosa PA01
gcugguagcuaccgucggcc

SEQ ID NO: 1407681 - RNA, 21 nt, Pseudomonas aeruginosa PA01
gcugguagcuaccgucggccu

SEQ ID NO: 1407682 - RNA, 22 nt, Pseudomonas aeruginosa PA01
gcugguagcuaccgucggccug

SEQ ID NO: 1407683 - RNA, 18 nt, Pseudomonas aeruginosa PA01
gcugggugcggugggcga

SEQ ID NO: 1407684 - RNA, 13 nt, Pseudomonas aeruginosa PA01
gcuggguucggcg

SEQ ID NO: 1407685 - RNA, 15 nt, Pseudomonas aeruginosa PA01
gcuggguucggcgag

SEQ ID NO: 1407686 - RNA, 16 nt, Pseudomonas aeruginosa PA01
gcuggguucggcgagg

SEQ ID NO: 1407687 - RNA, 22 nt, Pseudomonas aeruginosa PA01
gcuggguucggcgaggaucgcc

SEQ ID NO: 1407688 - RNA, 18 nt, Pseudomonas aeruginosa PA01
gcuggucagaaccaccgg

SEQ ID NO: 1407689 - RNA, 19 nt, Pseudomonas aeruginosa PA01
gcuggucagaaccaccggu

SEQ ID NO: 1407690 - RNA, 14 nt, Pseudomonas aeruginosa PA01
gcugguaugcagca

SEQ ID NO: 1407691 - RNA, 20 nt, Pseudomonas aeruginosa PA01
gcuggcuguaggugcccggc

SEQ ID NO: 1407692 - RNA, 17 nt, Pseudomonas aeruginosa PA01
gcuggcuauucgcccag

SEQ ID NO: 1407693 - RNA, 13 nt, Pseudomonas aeruginosa PA01
gcuggcugguaac

SEQ ID NO: 1407694 - RNA, 22 nt, Pseudomonas aeruginosa PA01
gcuggcugguaacgggcgaacc

SEQ ID NO: 1407695 - RNA, 15 nt, Pseudomonas aeruginosa PA01
gcugggccagcgccg

SEQ ID NO: 1407696 - RNA, 16 nt, Pseudomonas aeruginosa PA01
gcugggccagcgccgu

SEQ ID NO: 1407697 - RNA, 20 nt, Pseudomonas aeruginosa PA01
gcugggcagcacgcuggcgu

SEQ ID NO: 1407698 - RNA, 13 nt, Pseudomonas aeruginosa PA01
gcugggcagcgcc

SEQ ID NO: 1407699 - RNA, 22 nt, Pseudomonas aeruginosa PA01
gcuuaaagcaacgcggagcagg

SEQ ID NO: 1407700 - RNA, 22 nt, Pseudomonas aeruginosa PA01
gcuuacggagaagggcgcgccc

SEQ ID NO: 1407701 - RNA, 15 nt, Pseudomonas aeruginosa PA01
gcuuacccgcgacca

SEQ ID NO: 1407702 - RNA, 14 nt, Pseudomonas aeruginosa PA01
gcuuacgcggccuu

SEQ ID NO: 1407703 - RNA, 15 nt, Pseudomonas aeruginosa PA01
gcuuagcccgggauc

SEQ ID NO: 1407704 - RNA, 18 nt, Pseudomonas aeruginosa PA01
gcuucaaccguggcucga

SEQ ID NO: 1407705 - RNA, 21 nt, Pseudomonas aeruginosa PA01
gcuucaaccguggcucgauga

SEQ ID NO: 1407706 - RNA, 21 nt, Pseudomonas aeruginosa PA01
gcuucagccagaccggcagcg

SEQ ID NO: 1407707 - RNA, 14 nt, Pseudomonas aeruginosa PA01
gcuucagccgaccg

SEQ ID NO: 1407708 - RNA, 16 nt, Pseudomonas aeruginosa PA01
gcuucagcgagcgguc

SEQ ID NO: 1407709 - RNA, 15 nt, Pseudomonas aeruginosa PA01
gcuucagcgccgggu

SEQ ID NO: 1407710 - RNA, 21 nt, Pseudomonas aeruginosa PA01
gcuucagcgccgggucgaccu

SEQ ID NO: 1407711 - RNA, 21 nt, Pseudomonas aeruginosa PA01
gcuucagcgcgccgagccagg

SEQ ID NO: 1407712 - RNA, 17 nt, Pseudomonas aeruginosa PA01
gcuuccaccagacgcag

SEQ ID NO: 1407713 - RNA, 22 nt, Pseudomonas aeruginosa PA01
gcuuccaccagacgcagcaugu

SEQ ID NO: 1407714 - RNA, 15 nt, Pseudomonas aeruginosa PA01
gcuuccaccgccugc

SEQ ID NO: 1407715 - RNA, 17 nt, Pseudomonas aeruginosa PA01
gcuuccaccgccugccc

SEQ ID NO: 1407716 - RNA, 20 nt, Pseudomonas aeruginosa PA01
gcuuccagggucgagggcau

SEQ ID NO: 1407717 - RNA, 17 nt, Pseudomonas aeruginosa PA01
gcuuccagcuuggcacg

SEQ ID NO: 1407718 - RNA, 19 nt, Pseudomonas aeruginosa PA01
gcuuccagaccucgagcag

SEQ ID NO: 1407719 - RNA, 23 nt, Pseudomonas aeruginosa PA01
gcuuccagaggcauucaucacca

SEQ ID NO: 1407720 - RNA, 13 nt, Pseudomonas aeruginosa PA01
gcuucaggcaguc

SEQ ID NO: 1407721 - RNA, 15 nt, Pseudomonas aeruginosa PA01
gcuucagcuccgagc

SEQ ID NO: 1407722 - RNA, 18 nt, Pseudomonas aeruginosa PA01
gcuucagcuccgagccac

SEQ ID NO: 1407723 - RNA, 12 nt, Pseudomonas aeruginosa PA01
gcuucagcuucu

SEQ ID NO: 1407724 - RNA, 12 nt, Pseudomonas aeruginosa PA01
gcuucaggcgca

SEQ ID NO: 1407725 - RNA, 22 nt, Pseudomonas aeruginosa PA01
gcuucaggguggcgcugccuuc

SEQ ID NO: 1407726 - RNA, 23 nt, Pseudomonas aeruginosa PA01
gcuucaggguggcgcugccuucg

SEQ ID NO: 1407727 - RNA, 12 nt, Pseudomonas aeruginosa PA01
gcuucagguagc

SEQ ID NO: 1407728 - RNA, 14 nt, Pseudomonas aeruginosa PA01
gcuucauccugcgc

SEQ ID NO: 1407729 - RNA, 17 nt, Pseudomonas aeruginosa PA01
gcuucauccugcgcgcc

SEQ ID NO: 1407730 - RNA, 18 nt, Pseudomonas aeruginosa PA01
gcuucauccugcgcgccu

SEQ ID NO: 1407731 - RNA, 23 nt, Pseudomonas aeruginosa PA01
gcuucgggaucguaggcgcgcac

SEQ ID NO: 1407732 - RNA, 20 nt, Pseudomonas aeruginosa PA01
gcuucggcuccagcaccagc

SEQ ID NO: 1407733 - RNA, 18 nt, Pseudomonas aeruginosa PA01
gcuucgguguaucggcgg

SEQ ID NO: 1407734 - RNA, 19 nt, Pseudomonas aeruginosa PA01
gcuucgguguaucggcgga

SEQ ID NO: 1407735 - RNA, 23 nt, Pseudomonas aeruginosa PA01
gcuucgguguaucggcggauaac

SEQ ID NO: 1407736 - RNA, 19 nt, Pseudomonas aeruginosa PA01
gcuucggcugcugcugcgg

SEQ ID NO: 1407737 - RNA, 13 nt, Pseudomonas aeruginosa PA01
gcuucguccagcg

SEQ ID NO: 1407738 - RNA, 14 nt, Pseudomonas aeruginosa PA01
gcuucguccagcga

SEQ ID NO: 1407739 - RNA, 14 nt, Pseudomonas aeruginosa PA01
gcuucggcagccuu

SEQ ID NO: 1407740 - RNA, 16 nt, Pseudomonas aeruginosa PA01
gcuucggcggcgcgcu

SEQ ID NO: 1407741 - RNA, 21 nt, Pseudomonas aeruginosa PA01
gcuucggcggucaggcucagc

SEQ ID NO: 1407742 - RNA, 12 nt, Pseudomonas aeruginosa PA01
gcuucggcgggg

SEQ ID NO: 1407743 - RNA, 17 nt, Pseudomonas aeruginosa PA01
gcuucgcgugccagacg

SEQ ID NO: 1407744 - RNA, 20 nt, Pseudomonas aeruginosa PA01
gcuucgcguugcaggcgacg

SEQ ID NO: 1407745 - RNA, 19 nt, Pseudomonas aeruginosa PA01
gcuucgccgcgcaagcucg

SEQ ID NO: 1407746 - RNA, 16 nt, Pseudomonas aeruginosa PA01
gcuucgcgcuccaggc

SEQ ID NO: 1407747 - RNA, 17 nt, Pseudomonas aeruginosa PA01
gcuucgcgcuccaggcc

SEQ ID NO: 1407748 - RNA, 18 nt, Pseudomonas aeruginosa PA01
gcuucgcgcuccaggccc

SEQ ID NO: 1407749 - RNA, 22 nt, Pseudomonas aeruginosa PA01
gcuucuccaccggaucgcccug

SEQ ID NO: 1407750 - RNA, 21 nt, Pseudomonas aeruginosa PA01
gcuucucgacguaggcggcga

SEQ ID NO: 1407751 - RNA, 14 nt, Pseudomonas aeruginosa PA01
gcuucucgucgccg

SEQ ID NO: 1407752 - RNA, 21 nt, Pseudomonas aeruginosa PA01
gcuucucuuucaccuggucgc

SEQ ID NO: 1407753 - RNA, 13 nt, Pseudomonas aeruginosa PA01
gcuucucggcagc

SEQ ID NO: 1407754 - RNA, 14 nt, Pseudomonas aeruginosa PA01
gcuucucggcuacc

SEQ ID NO: 1407755 - RNA, 20 nt, Pseudomonas aeruginosa PA01
gcuucucggcuaccccacgc

SEQ ID NO: 1407756 - RNA, 15 nt, Pseudomonas aeruginosa PA01
gcuucugcucggccu

SEQ ID NO: 1407757 - RNA, 23 nt, Pseudomonas aeruginosa PA01
gcuucugcucggccuggaucgcc

SEQ ID NO: 1407758 - RNA, 14 nt, Pseudomonas aeruginosa PA01
gcuucugcuggccg

SEQ ID NO: 1407759 - RNA, 15 nt, Pseudomonas aeruginosa PA01
gcuucguccgccugg

SEQ ID NO: 1407760 - RNA, 21 nt, Pseudomonas aeruginosa PA01
gcuucuacgccuugcggcgcc

SEQ ID NO: 1407761 - RNA, 22 nt, Pseudomonas aeruginosa PA01
gcuucuacgccuugcggcgccg

SEQ ID NO: 1407762 - RNA, 23 nt, Pseudomonas aeruginosa PA01
gcuucucaccgaggaucggcacg

SEQ ID NO: 1407763 - RNA, 22 nt, Pseudomonas aeruginosa PA01
gcuucgaagcucucgccgcgcu

SEQ ID NO: 1407764 - RNA, 16 nt, Pseudomonas aeruginosa PA01
gcuucgaacgugcgcg

SEQ ID NO: 1407765 - RNA, 18 nt, Pseudomonas aeruginosa PA01
gcuucgaacgugcgcgca

SEQ ID NO: 1407766 - RNA, 19 nt, Pseudomonas aeruginosa PA01
gcuucgaacgugcgcgcaa

SEQ ID NO: 1407767 - RNA, 16 nt, Pseudomonas aeruginosa PA01
gcuucgaggcgggcgu

SEQ ID NO: 1407768 - RNA, 21 nt, Pseudomonas aeruginosa PA01
gcuucgaggcgggcgucggcg

SEQ ID NO: 1407769 - RNA, 18 nt, Pseudomonas aeruginosa PA01
gcuucgagcaccccgagc

SEQ ID NO: 1407770 - RNA, 23 nt, Pseudomonas aeruginosa PA01
gcuucgagcaccccgagcccggc

SEQ ID NO: 1407771 - RNA, 17 nt, Pseudomonas aeruginosa PA01
gcuucgagcacuuccca

SEQ ID NO: 1407772 - RNA, 17 nt, Pseudomonas aeruginosa PA01
gcuucgcagaugucggu

SEQ ID NO: 1407773 - RNA, 15 nt, Pseudomonas aeruginosa PA01
gcuucgaccagggca

SEQ ID NO: 1407774 - RNA, 12 nt, Pseudomonas aeruginosa PA01
gcuucgccgccc

SEQ ID NO: 1407775 - RNA, 16 nt, Pseudomonas aeruginosa PA01
gcuucgccgcccugga

SEQ ID NO: 1407776 - RNA, 15 nt, Pseudomonas aeruginosa PA01
gcuucgccgccgcgc

SEQ ID NO: 1407777 - RNA, 15 nt, Pseudomonas aeruginosa PA01
gcuucgcccgccgcc

SEQ ID NO: 1407778 - RNA, 19 nt, Pseudomonas aeruginosa PA01
gcuucgcccuacgcggcac

SEQ ID NO: 1407779 - RNA, 22 nt, Pseudomonas aeruginosa PA01
gcuucgcccuacgcggcaccgc

SEQ ID NO: 1407780 - RNA, 15 nt, Pseudomonas aeruginosa PA01
gcuuccggcuccagu

SEQ ID NO: 1407781 - RNA, 15 nt, Pseudomonas aeruginosa PA01
gcuuccggcccggcc

SEQ ID NO: 1407782 - RNA, 16 nt, Pseudomonas aeruginosa PA01
gcuuccggcccggcca

SEQ ID NO: 1407783 - RNA, 18 nt, Pseudomonas aeruginosa PA01
gcuuccggcccggccagg

SEQ ID NO: 1407784 - RNA, 12 nt, Pseudomonas aeruginosa PA01
gcuuccggcgcc

SEQ ID NO: 1407785 - RNA, 16 nt, Pseudomonas aeruginosa PA01
gcuuccggcgcuccac

SEQ ID NO: 1407786 - RNA, 13 nt, Pseudomonas aeruginosa PA01
gcuuccggcagcc

SEQ ID NO: 1407787 - RNA, 23 nt, Pseudomonas aeruginosa PA01
gcuuccugcuugucgauggucag

SEQ ID NO: 1407788 - RNA, 13 nt, Pseudomonas aeruginosa PA01
gcuuccuggcgcc

SEQ ID NO: 1407789 - RNA, 17 nt, Pseudomonas aeruginosa PA01
gcuuccuggcgccggua

SEQ ID NO: 1407790 - RNA, 12 nt, Pseudomonas aeruginosa PA01
gcuucccaggcc

SEQ ID NO: 1407791 - RNA, 13 nt, Pseudomonas aeruginosa PA01
gcuucccaggcca

SEQ ID NO: 1407792 - RNA, 15 nt, Pseudomonas aeruginosa PA01
gcuucccgcggcucc

SEQ ID NO: 1407793 - RNA, 16 nt, Pseudomonas aeruginosa PA01
gcuucccgcggcucca

SEQ ID NO: 1407794 - RNA, 18 nt, Pseudomonas aeruginosa PA01
gcuucccgcggcuccagc

SEQ ID NO: 1407795 - RNA, 18 nt, Pseudomonas aeruginosa PA01
gcuuccgcgcggcgcccu

SEQ ID NO: 1407796 - RNA, 21 nt, Pseudomonas aeruginosa PA01
gcuuccgacucuccgcgccgc

SEQ ID NO: 1407797 - RNA, 22 nt, Pseudomonas aeruginosa PA01
gcuuccgacucuccgcgccgcg

SEQ ID NO: 1407798 - RNA, 16 nt, Pseudomonas aeruginosa PA01
gcuuccgccaggcgca

SEQ ID NO: 1407799 - RNA, 15 nt, Pseudomonas aeruginosa PA01
gcuuccgccggcgcc

SEQ ID NO: 1407800 - RNA, 17 nt, Pseudomonas aeruginosa PA01
gcuuccgccggcgccgc

SEQ ID NO: 1407801 - RNA, 19 nt, Pseudomonas aeruginosa PA01
gcuuccgccggcgccgccu

SEQ ID NO: 1407802 - RNA, 15 nt, Pseudomonas aeruginosa PA01
uggucaacaccagcg

SEQ ID NO: 1407803 - RNA, 17 nt, Pseudomonas aeruginosa PA01
uggucaacaccagcgcc

SEQ ID NO: 1407804 - RNA, 19 nt, Pseudomonas aeruginosa PA01
uggucaacaccagcgccgc

SEQ ID NO: 1407805 - RNA, 22 nt, Pseudomonas aeruginosa PA01
ugguauugcgcccagaguucgc

SEQ ID NO: 1407806 - RNA, 21 nt, Pseudomonas aeruginosa PA01
uggucaguucggcccagcagc

SEQ ID NO: 1407807 - RNA, 20 nt, Pseudomonas aeruginosa PA01
uggucaccaugaucaucggc

SEQ ID NO: 1407808 - RNA, 12 nt, Pseudomonas aeruginosa PA01
ugguccagccag

SEQ ID NO: 1407809 - RNA, 13 nt, Pseudomonas aeruginosa PA01
ugguccagccagc

SEQ ID NO: 1407810 - RNA, 14 nt, Pseudomonas aeruginosa PA01
ugguccagcuggcg

SEQ ID NO: 1407811 - RNA, 14 nt, Pseudomonas aeruginosa PA01
ugguccaccagccc

SEQ ID NO: 1407812 - RNA, 16 nt, Pseudomonas aeruginosa PA01
ugguccaccagcccgc

SEQ ID NO: 1407813 - RNA, 15 nt, Pseudomonas aeruginosa PA01
ugguaugcagcaacc

SEQ ID NO: 1407814 - RNA, 16 nt, Pseudomonas aeruginosa PA01
uggucaugacgggcgg

SEQ ID NO: 1407815 - RNA, 19 nt, Pseudomonas aeruginosa PA01
uggugaagcgcuccggcag

SEQ ID NO: 1407816 - RNA, 19 nt, Pseudomonas aeruginosa PA01
uggugaagcccaccaccac

SEQ ID NO: 1407817 - RNA, 15 nt, Pseudomonas aeruginosa PA01
uggugaacgccaggc

SEQ ID NO: 1407818 - RNA, 21 nt, Pseudomonas aeruginosa PA01
ugguccgcgguguuuccgucg

SEQ ID NO: 1407819 - RNA, 20 nt, Pseudomonas aeruginosa PA01
uggucuccgugcuggccggc

SEQ ID NO: 1407820 - RNA, 14 nt, Pseudomonas aeruginosa PA01
uggucugcucggcg

SEQ ID NO: 1407821 - RNA, 18 nt, Pseudomonas aeruginosa PA01
uggucucgcgggcgacga

SEQ ID NO: 1407822 - RNA, 16 nt, Pseudomonas aeruginosa PA01
uggugcauccgccgca

SEQ ID NO: 1407823 - RNA, 15 nt, Pseudomonas aeruginosa PA01
uggugcacgcgccgg

SEQ ID NO: 1407824 - RNA, 16 nt, Pseudomonas aeruginosa PA01
uggugcccugggcggc

SEQ ID NO: 1407825 - RNA, 14 nt, Pseudomonas aeruginosa PA01
uggugcccagcagg

SEQ ID NO: 1407826 - RNA, 20 nt, Pseudomonas aeruginosa PA01
uggugcccagcaggcugcug

SEQ ID NO: 1407827 - RNA, 14 nt, Pseudomonas aeruginosa PA01
uggugcgggugccg

SEQ ID NO: 1407828 - RNA, 15 nt, Pseudomonas aeruginosa PA01
uggugcggcaccagc

SEQ ID NO: 1407829 - RNA, 20 nt, Pseudomonas aeruginosa PA01
uggugcugcaugugggcgaa

SEQ ID NO: 1407830 - RNA, 21 nt, Pseudomonas aeruginosa PA01
ugguggccguggcgccccagg

SEQ ID NO: 1407831 - RNA, 20 nt, Pseudomonas aeruginosa PA01
ugguggccguugagcaccuc

SEQ ID NO: 1407832 - RNA, 12 nt, Pseudomonas aeruginosa PA01
ugguggccgcgc

SEQ ID NO: 1407833 - RNA, 20 nt, Pseudomonas aeruginosa PA01
ugguggccgcgccgcccugg

SEQ ID NO: 1407834 - RNA, 21 nt, Pseudomonas aeruginosa PA01
uggugggcacgagucgaggcg

SEQ ID NO: 1407835 - RNA, 19 nt, Pseudomonas aeruginosa PA01
ugguggauguucgccgcca

SEQ ID NO: 1407836 - RNA, 15 nt, Pseudomonas aeruginosa PA01
ugguggaugacccgc

SEQ ID NO: 1407837 - RNA, 23 nt, Pseudomonas aeruginosa PA01
ugguggacggucucgccgccgag

SEQ ID NO: 1407838 - RNA, 15 nt, Pseudomonas aeruginosa PA01
ugguggacacccugc

SEQ ID NO: 1407839 - RNA, 15 nt, Pseudomonas aeruginosa PA01
ugguggaccagcgcc

SEQ ID NO: 1407840 - RNA, 20 nt, Pseudomonas aeruginosa PA01
ugguggaccagcgccgccaa

SEQ ID NO: 1407841 - RNA, 17 nt, Pseudomonas aeruginosa PA01
uggugcugccgaugcug

SEQ ID NO: 1407842 - RNA, 22 nt, Pseudomonas aeruginosa PA01
uggugcugccgaugcugaucac

SEQ ID NO: 1407843 - RNA, 24 nt, Pseudomonas aeruginosa PA01
ugguuuaccaggaccagcgccugc

SEQ ID NO: 1407844 - RNA, 15 nt, Pseudomonas aeruginosa PA01
ugguuguaggcgccg

SEQ ID NO: 1407845 - RNA, 22 nt, Pseudomonas aeruginosa PA01
ugguuucuucccacuccagcgc

SEQ ID NO: 1407846 - RNA, 17 nt, Pseudomonas aeruginosa PA01
uggugguagagcggcac

SEQ ID NO: 1407847 - RNA, 15 nt, Pseudomonas aeruginosa PA01
ugguugaggcgcucg

SEQ ID NO: 1407848 - RNA, 23 nt, Pseudomonas aeruginosa PA01
ugguugcucaccaaugccagugc

SEQ ID NO: 1407849 - RNA, 14 nt, Pseudomonas aeruginosa PA01
ugguugccagcagc

SEQ ID NO: 1407850 - RNA, 23 nt, Pseudomonas aeruginosa PA01
uguaccgcuccccacucggccag

SEQ ID NO: 1407851 - RNA, 17 nt, Pseudomonas aeruginosa PA01
uguacagcgaggcccgc

SEQ ID NO: 1407852 - RNA, 15 nt, Pseudomonas aeruginosa PA01
uguacguaucccagc

SEQ ID NO: 1407853 - RNA, 19 nt, Pseudomonas aeruginosa PA01
uguacccagggugcgccgg

SEQ ID NO: 1407854 - RNA, 22 nt, Pseudomonas aeruginosa PA01
uguacgccagggugcugcccag

SEQ ID NO: 1407855 - RNA, 15 nt, Pseudomonas aeruginosa PA01
uguagaucggcagca

SEQ ID NO: 1407856 - RNA, 23 nt, Pseudomonas aeruginosa PA01
uguagaucggcagcaucagccgc

SEQ ID NO: 1407857 - RNA, 15 nt, Pseudomonas aeruginosa PA01
uguagaccaccagcg

SEQ ID NO: 1407858 - RNA, 20 nt, Pseudomonas aeruginosa PA01
uguagcgcuccucgcgcugc

SEQ ID NO: 1407859 - RNA, 22 nt, Pseudomonas aeruginosa PA01
uguagcgcuccuguucgucgcg

SEQ ID NO: 1407860 - RNA, 17 nt, Pseudomonas aeruginosa PA01
uguagcagggugcgggc

SEQ ID NO: 1407861 - RNA, 13 nt, Pseudomonas aeruginosa PA01
uguagcccugggc

SEQ ID NO: 1407862 - RNA, 18 nt, Pseudomonas aeruginosa PA01
uguagcccugggcgaugc

SEQ ID NO: 1407863 - RNA, 22 nt, Pseudomonas aeruginosa PA01
uguaggacagguucaggucgau

SEQ ID NO: 1407864 - RNA, 16 nt, Pseudomonas aeruginosa PA01
uguagcucugcuggcu

SEQ ID NO: 1407865 - RNA, 13 nt, Pseudomonas aeruginosa PA01
uguagcugccggc

SEQ ID NO: 1407866 - RNA, 14 nt, Pseudomonas aeruginosa PA01
uguagcugccggcg

SEQ ID NO: 1407867 - RNA, 23 nt, Pseudomonas aeruginosa PA01
uguagcugguguagaggcucaac

SEQ ID NO: 1407868 - RNA, 21 nt, Pseudomonas aeruginosa PA01
uguagggcgaauaacgccaca

SEQ ID NO: 1407869 - RNA, 15 nt, Pseudomonas aeruginosa PA01
uguagggucgcagca

SEQ ID NO: 1407870 - RNA, 21 nt, Pseudomonas aeruginosa PA01
uguagggucgcagcaggccgc

SEQ ID NO: 1407871 - RNA, 15 nt, Pseudomonas aeruginosa PA01
uguagguauccgccg

SEQ ID NO: 1407872 - RNA, 18 nt, Pseudomonas aeruginosa PA01
uguaggucaccgcgccgg

SEQ ID NO: 1407873 - RNA, 21 nt, Pseudomonas aeruginosa PA01
uguaggcgagcagcggcacgc

SEQ ID NO: 1407874 - RNA, 14 nt, Pseudomonas aeruginosa PA01
uguaggcgccgccg

SEQ ID NO: 1407875 - RNA, 21 nt, Pseudomonas aeruginosa PA01
uguagccggcgaugugcggcg

SEQ ID NO: 1407876 - RNA, 17 nt, Pseudomonas aeruginosa PA01
ugggcugggucggcugg

SEQ ID NO: 1407877 - RNA, 18 nt, Pseudomonas aeruginosa PA01
ugggcugggucggcuggc

SEQ ID NO: 1407878 - RNA, 20 nt, Pseudomonas aeruginosa PA01
ugggcugggucggcuggcag

SEQ ID NO: 1407879 - RNA, 14 nt, Pseudomonas aeruginosa PA01
ugggcuucgccgcc

SEQ ID NO: 1407880 - RNA, 17 nt, Pseudomonas aeruginosa PA01
ugggcuucgccgccgcg

SEQ ID NO: 1407881 - RNA, 18 nt, Pseudomonas aeruginosa PA01
ugggcuucgccgccgcgc

SEQ ID NO: 1407882 - RNA, 15 nt, Pseudomonas aeruginosa PA01
ugggcuucgcugaug

SEQ ID NO: 1407883 - RNA, 17 nt, Pseudomonas aeruginosa PA01
uggggcaucucggccac

SEQ ID NO: 1407884 - RNA, 21 nt, Pseudomonas aeruginosa PA01
uggggcaucucggccaccugc

SEQ ID NO: 1407885 - RNA, 14 nt, Pseudomonas aeruginosa PA01
uggggaggugcggc

SEQ ID NO: 1407886 - RNA, 19 nt, Pseudomonas aeruginosa PA01
uggggaucgcguccgguau

SEQ ID NO: 1407887 - RNA, 14 nt, Pseudomonas aeruginosa PA01
uggggaugcgccgu

SEQ ID NO: 1407888 - RNA, 13 nt, Pseudomonas aeruginosa PA01
uggggaugcgcga

SEQ ID NO: 1407889 - RNA, 18 nt, Pseudomonas aeruginosa PA01
ugggcguuggccagcgcc

SEQ ID NO: 1407890 - RNA, 22 nt, Pseudomonas aeruginosa PA01
ugggcguuggccagcgccacca

SEQ ID NO: 1407891 - RNA, 13 nt, Pseudomonas aeruginosa PA01
ugggcguggcggc

SEQ ID NO: 1407892 - RNA, 21 nt, Pseudomonas aeruginosa PA01
ugggcgugcuuggcgaggcgc

SEQ ID NO: 1407893 - RNA, 22 nt, Pseudomonas aeruginosa PA01
ugggcgugcuuggcgaggcgcg

SEQ ID NO: 1407894 - RNA, 17 nt, Pseudomonas aeruginosa PA01
ugggcuaccgcaucgcc

SEQ ID NO: 1407895 - RNA, 22 nt, Pseudomonas aeruginosa PA01
ugggcuaccgcaucgccaccgc

SEQ ID NO: 1407896 - RNA, 21 nt, Pseudomonas aeruginosa PA01
ugggcuccagcgggaaggucg

SEQ ID NO: 1407897 - RNA, 16 nt, Pseudomonas aeruginosa PA01
ugggcucgcgcggggc

SEQ ID NO: 1407898 - RNA, 14 nt, Pseudomonas aeruginosa PA01
ugggcguccgguag

SEQ ID NO: 1407899 - RNA, 18 nt, Pseudomonas aeruginosa PA01
ugggcggucggcucagcc

SEQ ID NO: 1407900 - RNA, 17 nt, Pseudomonas aeruginosa PA01
ugggcggcuuccugcug

SEQ ID NO: 1407901 - RNA, 23 nt, Pseudomonas aeruginosa PA01
ugggugcccuugccggucaccgu

SEQ ID NO: 1407902 - RNA, 13 nt, Pseudomonas aeruginosa PA01
ugggucuucagcu

SEQ ID NO: 1407903 - RNA, 17 nt, Pseudomonas aeruginosa PA01
ugggugaugaccccggc

SEQ ID NO: 1407904 - RNA, 19 nt, Pseudomonas aeruginosa PA01
ugggugaugaccccggcga

SEQ ID NO: 1407905 - RNA, 23 nt, Pseudomonas aeruginosa PA01
ugggugcuuuccugcuccagcag

SEQ ID NO: 1407906 - RNA, 19 nt, Pseudomonas aeruginosa PA01
ugggugccgggggcggcga

SEQ ID NO: 1407907 - RNA, 21 nt, Pseudomonas aeruginosa PA01
ugggugcggugggcgagggcg

SEQ ID NO: 1407908 - RNA, 22 nt, Pseudomonas aeruginosa PA01
ugguaggccucgaugaucgccg

SEQ ID NO: 1407909 - RNA, 19 nt, Pseudomonas aeruginosa PA01
ugguaggcgucgucgaccu

SEQ ID NO: 1407910 - RNA, 23 nt, Pseudomonas aeruginosa PA01
ugguaggcucccccgcgccgccg

SEQ ID NO: 1407911 - RNA, 13 nt, Pseudomonas aeruginosa PA01
ugguagucgccgg

SEQ ID NO: 1407912 - RNA, 13 nt, Pseudomonas aeruginosa PA01
ugggugucggcga

SEQ ID NO: 1407913 - RNA, 14 nt, Pseudomonas aeruginosa PA01
ugggugucggcgau

SEQ ID NO: 1407914 - RNA, 13 nt, Pseudomonas aeruginosa PA01
uggggcgccggcu

SEQ ID NO: 1407915 - RNA, 20 nt, Pseudomonas aeruginosa PA01
uggggcgccggcucgcccag

SEQ ID NO: 1407916 - RNA, 16 nt, Pseudomonas aeruginosa PA01
uggggcugcccaccac

SEQ ID NO: 1407917 - RNA, 23 nt, Pseudomonas aeruginosa PA01
uggggcugcccaccaccaggacc

SEQ ID NO: 1407918 - RNA, 13 nt, Pseudomonas aeruginosa PA01
uggggcugccggc

SEQ ID NO: 1407919 - RNA, 22 nt, Pseudomonas aeruginosa PA01
ugggguuucugcuggccaccgc

SEQ ID NO: 1407920 - RNA, 17 nt, Pseudomonas aeruginosa PA01
uggggugaggccgagcc

SEQ ID NO: 1407921 - RNA, 17 nt, Pseudomonas aeruginosa PA01
ugggguugcggcgcccg

SEQ ID NO: 1407922 - RNA, 19 nt, Pseudomonas aeruginosa PA01
ugggcggcgaccauccagc

SEQ ID NO: 1407923 - RNA, 15 nt, Pseudomonas aeruginosa PA01
ugggcggcgaccugc

SEQ ID NO: 1407924 - RNA, 12 nt, Pseudomonas aeruginosa PA01
ugggcggccagg

SEQ ID NO: 1407925 - RNA, 14 nt, Pseudomonas aeruginosa PA01
ugggcggccggcca

SEQ ID NO: 1407926 - RNA, 14 nt, Pseudomonas aeruginosa PA01
ugggcggccucgua

SEQ ID NO: 1407927 - RNA, 14 nt, Pseudomonas aeruginosa PA01
ugggcgaugcgccg

SEQ ID NO: 1407928 - RNA, 12 nt, Pseudomonas aeruginosa PA01
ugggcgaugcgg

SEQ ID NO: 1407929 - RNA, 16 nt, Pseudomonas aeruginosa PA01
ugggcgccagccgcca

SEQ ID NO: 1407930 - RNA, 17 nt, Pseudomonas aeruginosa PA01
ugggcgcacuccgggca

SEQ ID NO: 1407931 - RNA, 16 nt, Pseudomonas aeruginosa PA01
ugggcgcaggggcgcg

SEQ ID NO: 1407932 - RNA, 22 nt, Pseudomonas aeruginosa PA01
ugggcgcaggggcgcgccggcu

SEQ ID NO: 1407933 - RNA, 19 nt, Pseudomonas aeruginosa PA01
ugggcgccucgccgcggca

SEQ ID NO: 1407934 - RNA, 21 nt, Pseudomonas aeruginosa PA01
ugggcgccucgucgacgcuca

SEQ ID NO: 1407935 - RNA, 14 nt, Pseudomonas aeruginosa PA01
ugggcgcgcgccgg

SEQ ID NO: 1407936 - RNA, 15 nt, Pseudomonas aeruginosa PA01
ugggcgccgccagcc

SEQ ID NO: 1407937 - RNA, 17 nt, Pseudomonas aeruginosa PA01
ugggcgccgccggugca

SEQ ID NO: 1407938 - RNA, 14 nt, Pseudomonas aeruginosa PA01
ugggcgccgcugug

SEQ ID NO: 1407939 - RNA, 15 nt, Pseudomonas aeruginosa PA01
ugggcgccggcgcgc

SEQ ID NO: 1407940 - RNA, 18 nt, Pseudomonas aeruginosa PA01
ugggcgaucacgccgcgc

SEQ ID NO: 1407941 - RNA, 16 nt, Pseudomonas aeruginosa PA01
ugggcgcucagcauca

SEQ ID NO: 1407942 - RNA, 16 nt, Pseudomonas aeruginosa PA01
ugggcgacgcggacag

SEQ ID NO: 1407943 - RNA, 15 nt, Pseudomonas aeruginosa PA01
ugggccgccgaacgg

SEQ ID NO: 1407944 - RNA, 12 nt, Pseudomonas aeruginosa PA01
ugggcgagggcg

SEQ ID NO: 1407945 - RNA, 19 nt, Pseudomonas aeruginosa PA01
ugggcgagcgacggugaua

SEQ ID NO: 1407946 - RNA, 14 nt, Pseudomonas aeruginosa PA01
ugggcgaggcgcuc

SEQ ID NO: 1407947 - RNA, 16 nt, Pseudomonas aeruginosa PA01
ugggccgaaggccagg

SEQ ID NO: 1407948 - RNA, 21 nt, Pseudomonas aeruginosa PA01
ugggccgaaggccaggccggc

SEQ ID NO: 1407949 - RNA, 14 nt, Pseudomonas aeruginosa PA01
ugggccccggccag

SEQ ID NO: 1407950 - RNA, 15 nt, Pseudomonas aeruginosa PA01
ugggccccggccagg

SEQ ID NO: 1407951 - RNA, 15 nt, Pseudomonas aeruginosa PA01
ugggccccggccggc

SEQ ID NO: 1407952 - RNA, 19 nt, Pseudomonas aeruginosa PA01
ugggccccggccggcagga

SEQ ID NO: 1407953 - RNA, 16 nt, Pseudomonas aeruginosa PA01
ugggccaucgccggcc

SEQ ID NO: 1407954 - RNA, 18 nt, Pseudomonas aeruginosa PA01
ugggccaucgccggcccg

SEQ ID NO: 1407955 - RNA, 22 nt, Pseudomonas aeruginosa PA01
ugggccaucgccggcccgcgcg

SEQ ID NO: 1407956 - RNA, 18 nt, Pseudomonas aeruginosa PA01
ugggccaugaccucggcc

SEQ ID NO: 1407957 - RNA, 21 nt, Pseudomonas aeruginosa PA01
ugggccaugaccucggccagc

SEQ ID NO: 1407958 - RNA, 16 nt, Pseudomonas aeruginosa PA01
uggcgucgacgccgaa

SEQ ID NO: 1407959 - RNA, 14 nt, Pseudomonas aeruginosa PA01
uggcgucggcgauc

SEQ ID NO: 1407960 - RNA, 15 nt, Pseudomonas aeruginosa PA01
uggcgucggcgauca

SEQ ID NO: 1407961 - RNA, 20 nt, Pseudomonas aeruginosa PA01
ugggccagcgccguacgcac

SEQ ID NO: 1407962 - RNA, 19 nt, Pseudomonas aeruginosa PA01
ugggccaggcauccagcac

SEQ ID NO: 1407963 - RNA, 14 nt, Pseudomonas aeruginosa PA01
uggcgucgcugccg

SEQ ID NO: 1407964 - RNA, 15 nt, Pseudomonas aeruginosa PA01
uggcgucgccuucca

SEQ ID NO: 1407965 - RNA, 23 nt, Pseudomonas aeruginosa PA01
uggcgucgccuuccaccaccagg

SEQ ID NO: 1407966 - RNA, 17 nt, Pseudomonas aeruginosa PA01
uggcgucgcgcacgagg

SEQ ID NO: 1407967 - RNA, 16 nt, Pseudomonas aeruginosa PA01
uggcgucgaugccgaa

SEQ ID NO: 1407968 - RNA, 14 nt, Pseudomonas aeruginosa PA01
uggcgucgcacugc

SEQ ID NO: 1407969 - RNA, 16 nt, Pseudomonas aeruginosa PA01
uggcgucgcacugcug

SEQ ID NO: 1407970 - RNA, 11 nt, Pseudomonas aeruginosa PA01
uggcgucgauc

SEQ ID NO: 1407971 - RNA, 12 nt, Pseudomonas aeruginosa PA01
uggcgucgauca

SEQ ID NO: 1407972 - RNA, 13 nt, Pseudomonas aeruginosa PA01
uggcgucgaccgc

SEQ ID NO: 1407973 - RNA, 14 nt, Pseudomonas aeruginosa PA01
uggcgucgaccgcc

SEQ ID NO: 1407974 - RNA, 13 nt, Pseudomonas aeruginosa PA01
uggcguccaccgc

SEQ ID NO: 1407975 - RNA, 17 nt, Pseudomonas aeruginosa PA01
uggcguccaccgcuucg

SEQ ID NO: 1407976 - RNA, 13 nt, Pseudomonas aeruginosa PA01
uggcggugccgca

SEQ ID NO: 1407977 - RNA, 14 nt, Pseudomonas aeruginosa PA01
uggcggucgccgac

SEQ ID NO: 1407978 - RNA, 14 nt, Pseudomonas aeruginosa PA01
uggcggucggccag

SEQ ID NO: 1407979 - RNA, 15 nt, Pseudomonas aeruginosa PA01
uggcggucggccagg

SEQ ID NO: 1407980 - RNA, 23 nt, Pseudomonas aeruginosa PA01
uggcggucggccaggcggccgac

SEQ ID NO: 1407981 - RNA, 16 nt, Pseudomonas aeruginosa PA01
uggcggucagcgacug

SEQ ID NO: 1407982 - RNA, 17 nt, Pseudomonas aeruginosa PA01
uggcgguacgcugcaug

SEQ ID NO: 1407983 - RNA, 20 nt, Pseudomonas aeruginosa PA01
uggcgguacgcugcaugucc

SEQ ID NO: 1407984 - RNA, 15 nt, Pseudomonas aeruginosa PA01
uggcgguagcccggc

SEQ ID NO: 1407985 - RNA, 17 nt, Pseudomonas aeruginosa PA01
uggcggggaacagcaug

SEQ ID NO: 1407986 - RNA, 15 nt, Pseudomonas aeruginosa PA01
uggcggggucgcgcc

SEQ ID NO: 1407987 - RNA, 22 nt, Pseudomonas aeruginosa PA01
uggcggggucgcgccgguggcg

SEQ ID NO: 1407988 - RNA, 14 nt, Pseudomonas aeruginosa PA01
uggcgggucggcgg

SEQ ID NO: 1407989 - RNA, 12 nt, Pseudomonas aeruginosa PA01
uggcgggccagc

SEQ ID NO: 1407990 - RNA, 16 nt, Pseudomonas aeruginosa PA01
uggcgggccagcaggc

SEQ ID NO: 1407991 - RNA, 19 nt, Pseudomonas aeruginosa PA01
uggcgggccagcaggcgcu

SEQ ID NO: 1407992 - RNA, 21 nt, Pseudomonas aeruginosa PA01
uggcgggccagcaggcgcucg

SEQ ID NO: 1407993 - RNA, 14 nt, Pseudomonas aeruginosa PA01
uggcgggcggcccc

SEQ ID NO: 1407994 - RNA, 20 nt, Pseudomonas aeruginosa PA01
uggcggcgacgaagcccagg

SEQ ID NO: 1407995 - RNA, 23 nt, Pseudomonas aeruginosa PA01
uggcggcgacgaaggucggcggc

SEQ ID NO: 1407996 - RNA, 13 nt, Pseudomonas aeruginosa PA01
uggcggcgaucgc

SEQ ID NO: 1407997 - RNA, 17 nt, Pseudomonas aeruginosa PA01
uggcggcgaucgccccg

SEQ ID NO: 1407998 - RNA, 18 nt, Pseudomonas aeruginosa PA01
uggcggcgaucgccccgu

SEQ ID NO: 1407999 - RNA, 22 nt, Pseudomonas aeruginosa PA01
uggcgcuguaggcgagcagcgg

SEQ ID NO: 1408000 - RNA, 18 nt, Pseudomonas aeruginosa PA01
uggcgcugucgccgguca

SEQ ID NO: 1408001 - RNA, 15 nt, Pseudomonas aeruginosa PA01
uggcgcuugggcgcg

SEQ ID NO: 1408002 - RNA, 16 nt, Pseudomonas aeruginosa PA01
uggcgcuucguugcga

SEQ ID NO: 1408003 - RNA, 20 nt, Pseudomonas aeruginosa PA01
uggcgcuucguugcgauggg

SEQ ID NO: 1408004 - RNA, 15 nt, Pseudomonas aeruginosa PA01
uggcgcuugagcagc

SEQ ID NO: 1408005 - RNA, 17 nt, Pseudomonas aeruginosa PA01
uggcgcuugagcagcca

SEQ ID NO: 1408006 - RNA, 19 nt, Pseudomonas aeruginosa PA01
uggcgcuugagcagccagg

SEQ ID NO: 1408007 - RNA, 11 nt, Pseudomonas aeruginosa PA01
uggcggcgcca

SEQ ID NO: 1408008 - RNA, 19 nt, Pseudomonas aeruginosa PA01
uggcgcucucgaacaccag

SEQ ID NO: 1408009 - RNA, 16 nt, Pseudomonas aeruginosa PA01
uggcgcugaccgcucc

SEQ ID NO: 1408010 - RNA, 19 nt, Pseudomonas aeruginosa PA01
uggcgcuccagggcgcuga

SEQ ID NO: 1408011 - RNA, 14 nt, Pseudomonas aeruginosa PA01
uggcgcucggccac

SEQ ID NO: 1408012 - RNA, 13 nt, Pseudomonas aeruginosa PA01
uggcgcuggccga

SEQ ID NO: 1408013 - RNA, 16 nt, Pseudomonas aeruginosa PA01
uggcgcgucaugccgc

SEQ ID NO: 1408014 - RNA, 19 nt, Pseudomonas aeruginosa PA01
uggcgcgucaugccgccgu

SEQ ID NO: 1408015 - RNA, 18 nt, Pseudomonas aeruginosa PA01
uggcgcguugugccgcca

SEQ ID NO: 1408016 - RNA, 17 nt, Pseudomonas aeruginosa PA01
uggcgcguacgcccgca

SEQ ID NO: 1408017 - RNA, 19 nt, Pseudomonas aeruginosa PA01
uggcgcguacgcccgcagc

SEQ ID NO: 1408018 - RNA, 22 nt, Pseudomonas aeruginosa PA01
uggcgcguacgcccgcagccac

SEQ ID NO: 1408019 - RNA, 18 nt, Pseudomonas aeruginosa PA01
uggcgcuaccgcgcaugg

SEQ ID NO: 1408020 - RNA, 17 nt, Pseudomonas aeruginosa PA01
uggcgcucacgcucgac

SEQ ID NO: 1408021 - RNA, 16 nt, Pseudomonas aeruginosa PA01
uggcgcucagcgccgc

SEQ ID NO: 1408022 - RNA, 22 nt, Pseudomonas aeruginosa PA01
uggcgcucgagcuugaggucgg

SEQ ID NO: 1408023 - RNA, 14 nt, Pseudomonas aeruginosa PA01
uggcgccggugcau

SEQ ID NO: 1408024 - RNA, 16 nt, Pseudomonas aeruginosa PA01
uggcgccggcugacgc

SEQ ID NO: 1408025 - RNA, 20 nt, Pseudomonas aeruginosa PA01
uggcgccggcugacgcuggc

SEQ ID NO: 1408026 - RNA, 21 nt, Pseudomonas aeruginosa PA01
uggcgccggcugacgcuggcg

SEQ ID NO: 1408027 - RNA, 15 nt, Pseudomonas aeruginosa PA01
uggcgccgggcgcga

SEQ ID NO: 1408028 - RNA, 16 nt, Pseudomonas aeruginosa PA01
uggcgccgggcgcgau

SEQ ID NO: 1408029 - RNA, 19 nt, Pseudomonas aeruginosa PA01
uggcgccgggcgcgaugcc

SEQ ID NO: 1408030 - RNA, 20 nt, Pseudomonas aeruginosa PA01
uggcgccgggcgcgaugccg

SEQ ID NO: 1408031 - RNA, 19 nt, Pseudomonas aeruginosa PA01
uggcgccguccugcaacug

SEQ ID NO: 1408032 - RNA, 21 nt, Pseudomonas aeruginosa PA01
uggcgccucgcaaaggucggc

SEQ ID NO: 1408033 - RNA, 23 nt, Pseudomonas aeruginosa PA01
uggcgccucgcaaaggucggcga

SEQ ID NO: 1408034 - RNA, 17 nt, Pseudomonas aeruginosa PA01
uggcgccuucggcgaca

SEQ ID NO: 1408035 - RNA, 18 nt, Pseudomonas aeruginosa PA01
uggcgcgacgaggcgcgg

SEQ ID NO: 1408036 - RNA, 22 nt, Pseudomonas aeruginosa PA01
uggcgcgacgaggcgcggcgga

SEQ ID NO: 1408037 - RNA, 17 nt, Pseudomonas aeruginosa PA01
uggcgcgaaucuucggc

SEQ ID NO: 1408038 - RNA, 20 nt, Pseudomonas aeruginosa PA01
uggcgcgacugucgagcagg

SEQ ID NO: 1408039 - RNA, 22 nt, Pseudomonas aeruginosa PA01
uggcgcgagaagccagccaggu

SEQ ID NO: 1408040 - RNA, 22 nt, Pseudomonas aeruginosa PA01
uggcgcggcugaucggccgcca

SEQ ID NO: 1408041 - RNA, 15 nt, Pseudomonas aeruginosa PA01
uggcgcaacgccggc

SEQ ID NO: 1408042 - RNA, 15 nt, Pseudomonas aeruginosa PA01
uggcgcaacugcgcc

SEQ ID NO: 1408043 - RNA, 22 nt, Pseudomonas aeruginosa PA01
uggcgcaacugcgccagccgac

SEQ ID NO: 1408044 - RNA, 19 nt, Pseudomonas aeruginosa PA01
uggcgauguucaccgcggc

SEQ ID NO: 1408045 - RNA, 17 nt, Pseudomonas aeruginosa PA01
uggcgauguagcugccg

SEQ ID NO: 1408046 - RNA, 19 nt, Pseudomonas aeruginosa PA01
uggcgauguagcugccggc

SEQ ID NO: 1408047 - RNA, 13 nt, Pseudomonas aeruginosa PA01
uggcgcaccacug

SEQ ID NO: 1408048 - RNA, 18 nt, Pseudomonas aeruginosa PA01
uggcgcaaggugccgagg

SEQ ID NO: 1408049 - RNA, 18 nt, Pseudomonas aeruginosa PA01
uggcgcaauacaccgcug

SEQ ID NO: 1408050 - RNA, 16 nt, Pseudomonas aeruginosa PA01
uggcgcacugccagga

SEQ ID NO: 1408051 - RNA, 15 nt, Pseudomonas aeruginosa PA01
uggcgcacggccugc

SEQ ID NO: 1408052 - RNA, 20 nt, Pseudomonas aeruginosa PA01
uggcgcacggccugcaccug

SEQ ID NO: 1408053 - RNA, 23 nt, Pseudomonas aeruginosa PA01
uggcgaugcccuggccgcugccg

SEQ ID NO: 1408054 - RNA, 17 nt, Pseudomonas aeruginosa PA01
uggcgaucucggcgcgg

SEQ ID NO: 1408055 - RNA, 15 nt, Pseudomonas aeruginosa PA01
uggcgaucaggcagc

SEQ ID NO: 1408056 - RNA, 21 nt, Pseudomonas aeruginosa PA01
uggcgaucaggcagcgcgcgg

SEQ ID NO: 1408057 - RNA, 14 nt, Pseudomonas aeruginosa PA01
uggcgaucgagcug

SEQ ID NO: 1408058 - RNA, 20 nt, Pseudomonas aeruginosa PA01
uggcgaagcgcuugcccagg

SEQ ID NO: 1408059 - RNA, 15 nt, Pseudomonas aeruginosa PA01
uggcgaaggcgcucc

SEQ ID NO: 1408060 - RNA, 13 nt, Pseudomonas aeruginosa PA01
uggcgaagccagc

SEQ ID NO: 1408061 - RNA, 18 nt, Pseudomonas aeruginosa PA01
uggcgaacggcuggucgg

SEQ ID NO: 1408062 - RNA, 23 nt, Pseudomonas aeruginosa PA01
uggcgaacggcuggucggcuucc

SEQ ID NO: 1408063 - RNA, 19 nt, Pseudomonas aeruginosa PA01
uggcgaaguugccgccgcu

SEQ ID NO: 1408064 - RNA, 17 nt, Pseudomonas aeruginosa PA01
uggcgaauagccggcgc

SEQ ID NO: 1408065 - RNA, 18 nt, Pseudomonas aeruginosa PA01
uggcgacaggcgaucgac

SEQ ID NO: 1408066 - RNA, 14 nt, Pseudomonas aeruginosa PA01
uggcgaaugccuuc

SEQ ID NO: 1408067 - RNA, 16 nt, Pseudomonas aeruginosa PA01
uggcgaggcgcgccug

SEQ ID NO: 1408068 - RNA, 17 nt, Pseudomonas aeruginosa PA01
uggcgaggcgcgccugg

SEQ ID NO: 1408069 - RNA, 19 nt, Pseudomonas aeruginosa PA01
uggcgagggcgucccgcug

SEQ ID NO: 1408070 - RNA, 21 nt, Pseudomonas aeruginosa PA01
uggcgagggcgucccgcugcg

SEQ ID NO: 1408071 - RNA, 12 nt, Pseudomonas aeruginosa PA01
uggcgaggucgc

SEQ ID NO: 1408072 - RNA, 17 nt, Pseudomonas aeruginosa PA01
uggcgaggacgccgggc

SEQ ID NO: 1408073 - RNA, 21 nt, Pseudomonas aeruginosa PA01
uggcgaggaugaucagggcac

SEQ ID NO: 1408074 - RNA, 18 nt, Pseudomonas aeruginosa PA01
uggcgaggauuuccucgc

SEQ ID NO: 1408075 - RNA, 16 nt, Pseudomonas aeruginosa PA01
uggcgaacgauggugg

SEQ ID NO: 1408076 - RNA, 21 nt, Pseudomonas aeruginosa PA01
uggcgaacgaugguggucggc

SEQ ID NO: 1408077 - RNA, 14 nt, Pseudomonas aeruginosa PA01
uggccguccucguc

SEQ ID NO: 1408078 - RNA, 13 nt, Pseudomonas aeruginosa PA01
uggccgucgaagg

SEQ ID NO: 1408079 - RNA, 21 nt, Pseudomonas aeruginosa PA01
uggccgucgaagggcacgccg

SEQ ID NO: 1408080 - RNA, 16 nt, Pseudomonas aeruginosa PA01
uggccgucgacccgcc

SEQ ID NO: 1408081 - RNA, 22 nt, Pseudomonas aeruginosa PA01
uggccguagccggugccgaucu

SEQ ID NO: 1408082 - RNA, 18 nt, Pseudomonas aeruginosa PA01
uggccgggguauccgggc

SEQ ID NO: 1408083 - RNA, 15 nt, Pseudomonas aeruginosa PA01
uggccgcugagcagc

SEQ ID NO: 1408084 - RNA, 14 nt, Pseudomonas aeruginosa PA01
uggccggugccgcc

SEQ ID NO: 1408085 - RNA, 22 nt, Pseudomonas aeruginosa PA01
uggccggugugcgacuggggca

SEQ ID NO: 1408086 - RNA, 19 nt, Pseudomonas aeruginosa PA01
uggccggcugcuccgggcg

SEQ ID NO: 1408087 - RNA, 14 nt, Pseudomonas aeruginosa PA01
uggcccuucgcccu

SEQ ID NO: 1408088 - RNA, 20 nt, Pseudomonas aeruginosa PA01
uggccgaaagcacugcggcg

SEQ ID NO: 1408089 - RNA, 20 nt, Pseudomonas aeruginosa PA01
uggccgaaucgaacagggcg

SEQ ID NO: 1408090 - RNA, 17 nt, Pseudomonas aeruginosa PA01
uggcccuggcgcaggcg

SEQ ID NO: 1408091 - RNA, 16 nt, Pseudomonas aeruginosa PA01
uggcccugggcggcga

SEQ ID NO: 1408092 - RNA, 15 nt, Pseudomonas aeruginosa PA01
uggcccugcaacagg

SEQ ID NO: 1408093 - RNA, 19 nt, Pseudomonas aeruginosa PA01
uggcccggcgcggcggccg

SEQ ID NO: 1408094 - RNA, 21 nt, Pseudomonas aeruginosa PA01
uggcccggcgcggcggccgcc

SEQ ID NO: 1408095 - RNA, 13 nt, Pseudomonas aeruginosa PA01
uggcccggcgcgg

SEQ ID NO: 1408096 - RNA, 12 nt, Pseudomonas aeruginosa PA01
uggccccggcga

SEQ ID NO: 1408097 - RNA, 13 nt, Pseudomonas aeruginosa PA01
uggccccggcgau

SEQ ID NO: 1408098 - RNA, 13 nt, Pseudomonas aeruginosa PA01
uggccccagcgcg

SEQ ID NO: 1408099 - RNA, 16 nt, Pseudomonas aeruginosa PA01
uggccaugggcacgcc

SEQ ID NO: 1408100 - RNA, 20 nt, Pseudomonas aeruginosa PA01
uggccauucgcuucggccac

SEQ ID NO: 1408101 - RNA, 19 nt, Pseudomonas aeruginosa PA01
uggccaugaugugcgcagg

SEQ ID NO: 1408102 - RNA, 20 nt, Pseudomonas aeruginosa PA01
uggccaugaugugcgcaggc

SEQ ID NO: 1408103 - RNA, 22 nt, Pseudomonas aeruginosa PA01
uggccaucuucucgaagcgcgc

SEQ ID NO: 1408104 - RNA, 16 nt, Pseudomonas aeruginosa PA01
uggccaugauccggug

SEQ ID NO: 1408105 - RNA, 15 nt, Pseudomonas aeruginosa PA01
uggcccaauccgcgc

SEQ ID NO: 1408106 - RNA, 18 nt, Pseudomonas aeruginosa PA01
uggcccaauccgcgccgg

SEQ ID NO: 1408107 - RNA, 21 nt, Pseudomonas aeruginosa PA01
uggcccagaugaucaggccga

SEQ ID NO: 1408108 - RNA, 14 nt, Pseudomonas aeruginosa PA01
uggccgagggcgcg

SEQ ID NO: 1408109 - RNA, 15 nt, Pseudomonas aeruginosa PA01
uggccgagggcgcgc

SEQ ID NO: 1408110 - RNA, 16 nt, Pseudomonas aeruginosa PA01
uggccgagggcgcgca

SEQ ID NO: 1408111 - RNA, 21 nt, Pseudomonas aeruginosa PA01
uggccgagccgcuuggagcgg

SEQ ID NO: 1408112 - RNA, 18 nt, Pseudomonas aeruginosa PA01
uggccgagcccagcggca

SEQ ID NO: 1408113 - RNA, 20 nt, Pseudomonas aeruginosa PA01
uggccgagcccagcggcagg

SEQ ID NO: 1408114 - RNA, 21 nt, Pseudomonas aeruginosa PA01
uggccgagcugccgcaccgcc

SEQ ID NO: 1408115 - RNA, 23 nt, Pseudomonas aeruginosa PA01
uggccgagcugccgcaccgccuc

SEQ ID NO: 1408116 - RNA, 14 nt, Pseudomonas aeruginosa PA01
uggccgaggacccg

SEQ ID NO: 1408117 - RNA, 15 nt, Pseudomonas aeruginosa PA01
uggccgaggaggcca

SEQ ID NO: 1408118 - RNA, 21 nt, Pseudomonas aeruginosa PA01
uggccgaggaggccagcagca

SEQ ID NO: 1408119 - RNA, 13 nt, Pseudomonas aeruginosa PA01
uggccgacgccgc

SEQ ID NO: 1408120 - RNA, 15 nt, Pseudomonas aeruginosa PA01
uggccgacgccgcug

SEQ ID NO: 1408121 - RNA, 19 nt, Pseudomonas aeruginosa PA01
uggccgacgccgcuggaac

SEQ ID NO: 1408122 - RNA, 21 nt, Pseudomonas aeruginosa PA01
uggccgacgccgcuggaaccg

SEQ ID NO: 1408123 - RNA, 12 nt, Pseudomonas aeruginosa PA01
uggccgacccgc

SEQ ID NO: 1408124 - RNA, 19 nt, Pseudomonas aeruginosa PA01
uggccgacccgugcgccgc

SEQ ID NO: 1408125 - RNA, 21 nt, Pseudomonas aeruginosa PA01
uggccgacccgugcgccgcgg

SEQ ID NO: 1408126 - RNA, 15 nt, Pseudomonas aeruginosa PA01
uggccgaccgccagg

SEQ ID NO: 1408127 - RNA, 19 nt, Pseudomonas aeruginosa PA01
uggccgaccgccaggccga

SEQ ID NO: 1408128 - RNA, 15 nt, Pseudomonas aeruginosa PA01
uggccgcagcagcgg

SEQ ID NO: 1408129 - RNA, 18 nt, Pseudomonas aeruginosa PA01
uggccgauuucgaugacg

SEQ ID NO: 1408130 - RNA, 13 nt, Pseudomonas aeruginosa PA01
uggccgaugccga

SEQ ID NO: 1408131 - RNA, 16 nt, Pseudomonas aeruginosa PA01
uggccgaucaccuggc

SEQ ID NO: 1408132 - RNA, 13 nt, Pseudomonas aeruginosa PA01
uggccgcagcggc

SEQ ID NO: 1408133 - RNA, 13 nt, Pseudomonas aeruginosa PA01
uggccgccagcag

SEQ ID NO: 1408134 - RNA, 21 nt, Pseudomonas aeruginosa PA01
uggccgccagcaggccgaagg

SEQ ID NO: 1408135 - RNA, 13 nt, Pseudomonas aeruginosa PA01
uggccgccugcag

SEQ ID NO: 1408136 - RNA, 16 nt, Pseudomonas aeruginosa PA01
uggccgccuggccggc

SEQ ID NO: 1408137 - RNA, 13 nt, Pseudomonas aeruginosa PA01
uggccgccuggcg

SEQ ID NO: 1408138 - RNA, 13 nt, Pseudomonas aeruginosa PA01
uggccgcgccgcc

SEQ ID NO: 1408139 - RNA, 17 nt, Pseudomonas aeruginosa PA01
uggccgcgccgcccugg

SEQ ID NO: 1408140 - RNA, 21 nt, Pseudomonas aeruginosa PA01
uggccgcgccgcccuggccgc

SEQ ID NO: 1408141 - RNA, 12 nt, Pseudomonas aeruginosa PA01
uggccgcgccgc

SEQ ID NO: 1408142 - RNA, 19 nt, Pseudomonas aeruginosa PA01
uggccgcgccccacggcgc

SEQ ID NO: 1408143 - RNA, 21 nt, Pseudomonas aeruginosa PA01
uggccgcgccccacggcgcgg

SEQ ID NO: 1408144 - RNA, 15 nt, Pseudomonas aeruginosa PA01
uggccgcgcgaccgc

SEQ ID NO: 1408145 - RNA, 23 nt, Pseudomonas aeruginosa PA01
uggccgcguaccaguagcgacag

SEQ ID NO: 1408146 - RNA, 20 nt, Pseudomonas aeruginosa PA01
uggccgcguucgccgaggcg

SEQ ID NO: 1408147 - RNA, 16 nt, Pseudomonas aeruginosa PA01
uggccgcuacgcggcg

SEQ ID NO: 1408148 - RNA, 12 nt, Pseudomonas aeruginosa PA01
uggccgcccagg

SEQ ID NO: 1408149 - RNA, 21 nt, Pseudomonas aeruginosa PA01
uggccgcccagguugaugccg

SEQ ID NO: 1408150 - RNA, 14 nt, Pseudomonas aeruginosa PA01
uggccgcccaucga

SEQ ID NO: 1408151 - RNA, 14 nt, Pseudomonas aeruginosa PA01
uggccagcgccacc

SEQ ID NO: 1408152 - RNA, 15 nt, Pseudomonas aeruginosa PA01
uggccagcgccacca

SEQ ID NO: 1408153 - RNA, 17 nt, Pseudomonas aeruginosa PA01
uggccagcgccaccagc

SEQ ID NO: 1408154 - RNA, 20 nt, Pseudomonas aeruginosa PA01
uggccagcgccaccagcagg

SEQ ID NO: 1408155 - RNA, 19 nt, Pseudomonas aeruginosa PA01
uggccagcaggcuggcggc

SEQ ID NO: 1408156 - RNA, 19 nt, Pseudomonas aeruginosa PA01
uggccagaauuccagcagg

SEQ ID NO: 1408157 - RNA, 18 nt, Pseudomonas aeruginosa PA01
uggccagcagccaggccu

SEQ ID NO: 1408158 - RNA, 21 nt, Pseudomonas aeruginosa PA01
uggccagcaccagucccuggc

SEQ ID NO: 1408159 - RNA, 23 nt, Pseudomonas aeruginosa PA01
uggccagcaccaugcgcggcagg

SEQ ID NO: 1408160 - RNA, 22 nt, Pseudomonas aeruginosa PA01
uggccacgacccugcuggccgg

SEQ ID NO: 1408161 - RNA, 23 nt, Pseudomonas aeruginosa PA01
uggccacgacccugcuggccggu

SEQ ID NO: 1408162 - RNA, 14 nt, Pseudomonas aeruginosa PA01
uggccaccgucgga

SEQ ID NO: 1408163 - RNA, 19 nt, Pseudomonas aeruginosa PA01
uggccacgucgccccaggg

SEQ ID NO: 1408164 - RNA, 16 nt, Pseudomonas aeruginosa PA01
uggccagaaggucggg

SEQ ID NO: 1408165 - RNA, 22 nt, Pseudomonas aeruginosa PA01
uggccagcaauacccgccgcug

SEQ ID NO: 1408166 - RNA, 14 nt, Pseudomonas aeruginosa PA01
uggccagcgcggcg

SEQ ID NO: 1408167 - RNA, 17 nt, Pseudomonas aeruginosa PA01
uggccagcucgaccuug

SEQ ID NO: 1408168 - RNA, 12 nt, Pseudomonas aeruginosa PA01
uggccaggcccc

SEQ ID NO: 1408169 - RNA, 15 nt, Pseudomonas aeruginosa PA01
uggccaggccccagg

SEQ ID NO: 1408170 - RNA, 16 nt, Pseudomonas aeruginosa PA01
uggccaggccccaggc

SEQ ID NO: 1408171 - RNA, 20 nt, Pseudomonas aeruginosa PA01
uggccaggccccaggccgcc

SEQ ID NO: 1408172 - RNA, 21 nt, Pseudomonas aeruginosa PA01
uggccaggccccaggccgccg

SEQ ID NO: 1408173 - RNA, 12 nt, Pseudomonas aeruginosa PA01
uggccagcgcgg

SEQ ID NO: 1408174 - RNA, 13 nt, Pseudomonas aeruginosa PA01
uggccagcgccca

SEQ ID NO: 1408175 - RNA, 16 nt, Pseudomonas aeruginosa PA01
uggccagcgcccaggc

SEQ ID NO: 1408176 - RNA, 23 nt, Pseudomonas aeruginosa PA01
uggccagcgcccaggccgggucg

SEQ ID NO: 1408177 - RNA, 15 nt, Pseudomonas aeruginosa PA01
uggccagcccggagc

SEQ ID NO: 1408178 - RNA, 11 nt, Pseudomonas aeruginosa PA01
uggccaggcgc

SEQ ID NO: 1408179 - RNA, 20 nt, Pseudomonas aeruginosa PA01
uggccaggcgcaccagcagg

SEQ ID NO: 1408180 - RNA, 21 nt, Pseudomonas aeruginosa PA01
uggccaggcgcaccagcaggc

SEQ ID NO: 1408181 - RNA, 22 nt, Pseudomonas aeruginosa PA01
uggccaggcgcaccagcaggcg

SEQ ID NO: 1408182 - RNA, 14 nt, Pseudomonas aeruginosa PA01
uggccaggcgcgac

SEQ ID NO: 1408183 - RNA, 12 nt, Pseudomonas aeruginosa PA01
uggccaggcgcu

SEQ ID NO: 1408184 - RNA, 15 nt, Pseudomonas aeruginosa PA01
uggccaucagcgccg

SEQ ID NO: 1408185 - RNA, 17 nt, Pseudomonas aeruginosa PA01
uggccaucagcgccgcc

SEQ ID NO: 1408186 - RNA, 14 nt, Pseudomonas aeruginosa PA01
uggccagucaucgc

SEQ ID NO: 1408187 - RNA, 23 nt, Pseudomonas aeruginosa PA01
uggccaguuccaugucgcuggcc

SEQ ID NO: 1408188 - RNA, 14 nt, Pseudomonas aeruginosa PA01
uggccagggcaugu

SEQ ID NO: 1408189 - RNA, 16 nt, Pseudomonas aeruginosa PA01
uggccagggucacgcc

SEQ ID NO: 1408190 - RNA, 23 nt, Pseudomonas aeruginosa PA01
uggccaguugcgcuccgguggcg

SEQ ID NO: 1408191 - RNA, 19 nt, Pseudomonas aeruginosa PA01
uggacagcucgcgggacag

SEQ ID NO: 1408192 - RNA, 16 nt, Pseudomonas aeruginosa PA01
uggccaaccaggaagg

SEQ ID NO: 1408193 - RNA, 13 nt, Pseudomonas aeruginosa PA01
uggccaccagcac

SEQ ID NO: 1408194 - RNA, 19 nt, Pseudomonas aeruginosa PA01
uggccacccuugcgcccgg

SEQ ID NO: 1408195 - RNA, 20 nt, Pseudomonas aeruginosa PA01
uggccacccuugcgcccggc

SEQ ID NO: 1408196 - RNA, 17 nt, Pseudomonas aeruginosa PA01
uggccacccuuggagcc

SEQ ID NO: 1408197 - RNA, 21 nt, Pseudomonas aeruginosa PA01
uggccaccgggaucagcggcg

SEQ ID NO: 1408198 - RNA, 13 nt, Pseudomonas aeruginosa PA01
uggccaccgcggc

SEQ ID NO: 1408199 - RNA, 20 nt, Pseudomonas aeruginosa PA01
uggccaccgcggcguccgcg

SEQ ID NO: 1408200 - RNA, 15 nt, Pseudomonas aeruginosa PA01
uggccaccgaaucgg

SEQ ID NO: 1408201 - RNA, 17 nt, Pseudomonas aeruginosa PA01
uggccaccgccaggacc

SEQ ID NO: 1408202 - RNA, 15 nt, Pseudomonas aeruginosa PA01
uggaauccagggccg

SEQ ID NO: 1408203 - RNA, 21 nt, Pseudomonas aeruginosa PA01
uggacacccugcugcugcuca

SEQ ID NO: 1408204 - RNA, 21 nt, Pseudomonas aeruginosa PA01
uggacaccgaugccgaaggcg

SEQ ID NO: 1408205 - RNA, 18 nt, Pseudomonas aeruginosa PA01
uggacaagcgucgccggc

SEQ ID NO: 1408206 - RNA, 14 nt, Pseudomonas aeruginosa PA01
uggacaggcgcagg

SEQ ID NO: 1408207 - RNA, 17 nt, Pseudomonas aeruginosa PA01
uggacaggcgccccugg

SEQ ID NO: 1408208 - RNA, 22 nt, Pseudomonas aeruginosa PA01
uggacaucccgggguugcccag

SEQ ID NO: 1408209 - RNA, 21 nt, Pseudomonas aeruginosa PA01
uggacauacaggcgcgccugg

SEQ ID NO: 1408210 - RNA, 22 nt, Pseudomonas aeruginosa PA01
uggacauacaggcgcgccuggc

SEQ ID NO: 1408211 - RNA, 16 nt, Pseudomonas aeruginosa PA01
ugccgucggcgcccuu

SEQ ID NO: 1408212 - RNA, 18 nt, Pseudomonas aeruginosa PA01
ugccgucggcgcccuucg

SEQ ID NO: 1408213 - RNA, 14 nt, Pseudomonas aeruginosa PA01
ugccguccgucggc

SEQ ID NO: 1408214 - RNA, 14 nt, Pseudomonas aeruginosa PA01
ugccgucgagcacc

SEQ ID NO: 1408215 - RNA, 17 nt, Pseudomonas aeruginosa PA01
ugccgucgagcaccagc

SEQ ID NO: 1408216 - RNA, 17 nt, Pseudomonas aeruginosa PA01
ugccgguuaucgaggcg

SEQ ID NO: 1408217 - RNA, 22 nt, Pseudomonas aeruginosa PA01
ugccgguuaucgaggcgucggc

SEQ ID NO: 1408218 - RNA, 15 nt, Pseudomonas aeruginosa PA01
ugccgguucccgcag

SEQ ID NO: 1408219 - RNA, 12 nt, Pseudomonas aeruginosa PA01
ugccggucuugc

SEQ ID NO: 1408220 - RNA, 18 nt, Pseudomonas aeruginosa PA01
ugccggugugacggccgg

SEQ ID NO: 1408221 - RNA, 21 nt, Pseudomonas aeruginosa PA01
ugccggugugacggccggggc

SEQ ID NO: 1408222 - RNA, 15 nt, Pseudomonas aeruginosa PA01
ugccggugugccguc

SEQ ID NO: 1408223 - RNA, 19 nt, Pseudomonas aeruginosa PA01
ugccggugcuggugcggcc

SEQ ID NO: 1408224 - RNA, 23 nt, Pseudomonas aeruginosa PA01
ugccggugcuguaguaggcggug

SEQ ID NO: 1408225 - RNA, 13 nt, Pseudomonas aeruginosa PA01
ugccgguggcgcc

SEQ ID NO: 1408226 - RNA, 18 nt, Pseudomonas aeruginosa PA01
ugccgguggcgcccagcc

SEQ ID NO: 1408227 - RNA, 20 nt, Pseudomonas aeruginosa PA01
ugccgguggcgcccagccag

SEQ ID NO: 1408228 - RNA, 22 nt, Pseudomonas aeruginosa PA01
ugccggugcggucguugaucac

SEQ ID NO: 1408229 - RNA, 22 nt, Pseudomonas aeruginosa PA01
ugccggugcggguggucgccgc

SEQ ID NO: 1408230 - RNA, 23 nt, Pseudomonas aeruginosa PA01
ugccggugcggguggucgccgcc

SEQ ID NO: 1408231 - RNA, 17 nt, Pseudomonas aeruginosa PA01
ugccgguacgcaccagc

SEQ ID NO: 1408232 - RNA, 22 nt, Pseudomonas aeruginosa PA01
ugccggugccauacucggacgg

SEQ ID NO: 1408233 - RNA, 20 nt, Pseudomonas aeruginosa PA01
ugccggucaggcuggugccg

SEQ ID NO: 1408234 - RNA, 17 nt, Pseudomonas aeruginosa PA01
ugccgguacucgccggg

SEQ ID NO: 1408235 - RNA, 24 nt, Pseudomonas aeruginosa PA01
ugccgguacucgccgggcgucugc

SEQ ID NO: 1408236 - RNA, 21 nt, Pseudomonas aeruginosa PA01
ugccgggugcuaugcgccggg

SEQ ID NO: 1408237 - RNA, 12 nt, Pseudomonas aeruginosa PA01
ugccgggcgcgc

SEQ ID NO: 1408238 - RNA, 15 nt, Pseudomonas aeruginosa PA01
ugccgggggcggcga

SEQ ID NO: 1408239 - RNA, 16 nt, Pseudomonas aeruginosa PA01
ugccgggguccgccgg

SEQ ID NO: 1408240 - RNA, 17 nt, Pseudomonas aeruginosa PA01
ugccgggguccgccggu

SEQ ID NO: 1408241 - RNA, 21 nt, Pseudomonas aeruginosa PA01
ugccgggguggaguaccaggc

SEQ ID NO: 1408242 - RNA, 13 nt, Pseudomonas aeruginosa PA01
ugccgggccgagg

SEQ ID NO: 1408243 - RNA, 13 nt, Pseudomonas aeruginosa PA01
ugccgggcaacgc

SEQ ID NO: 1408244 - RNA, 19 nt, Pseudomonas aeruginosa PA01
ugccgggcaagcucgacga

SEQ ID NO: 1408245 - RNA, 22 nt, Pseudomonas aeruginosa PA01
ugccgggaagcgcaggccgccg

SEQ ID NO: 1408246 - RNA, 17 nt, Pseudomonas aeruginosa PA01
ugccggcuugcugcagg

SEQ ID NO: 1408247 - RNA, 12 nt, Pseudomonas aeruginosa PA01
ugccgggccagc

SEQ ID NO: 1408248 - RNA, 14 nt, Pseudomonas aeruginosa PA01
ugccgggcgucugc

SEQ ID NO: 1408249 - RNA, 22 nt, Pseudomonas aeruginosa PA01
ugccgggcuuuuucucgucgcg

SEQ ID NO: 1408250 - RNA, 17 nt, Pseudomonas aeruginosa PA01
ugccggggaaccacacc

SEQ ID NO: 1408251 - RNA, 22 nt, Pseudomonas aeruginosa PA01
ugccggcgccuucaucgccacc

SEQ ID NO: 1408252 - RNA, 11 nt, Pseudomonas aeruginosa PA01
ugccggcgcgc

SEQ ID NO: 1408253 - RNA, 20 nt, Pseudomonas aeruginosa PA01
ugccggcgcgcacggaggcg

SEQ ID NO: 1408254 - RNA, 13 nt, Pseudomonas aeruginosa PA01
ugccggcggcauc

SEQ ID NO: 1408255 - RNA, 12 nt, Pseudomonas aeruginosa PA01
ugccggcggcgc

SEQ ID NO: 1408256 - RNA, 17 nt, Pseudomonas aeruginosa PA01
ugccggcggcgcugagg

SEQ ID NO: 1408257 - RNA, 13 nt, Pseudomonas aeruginosa PA01
ugccggcgcgcgg

SEQ ID NO: 1408258 - RNA, 23 nt, Pseudomonas aeruginosa PA01
ugccggcguccuugccgaggaag

SEQ ID NO: 1408259 - RNA, 22 nt, Pseudomonas aeruginosa PA01
ugccggcgucguccugcgcggc

SEQ ID NO: 1408260 - RNA, 17 nt, Pseudomonas aeruginosa PA01
ugccggccagguagcgg

SEQ ID NO: 1408261 - RNA, 21 nt, Pseudomonas aeruginosa PA01
ugccggccaggaaggccgcuu

SEQ ID NO: 1408262 - RNA, 15 nt, Pseudomonas aeruginosa PA01
ugccggcaucgguau

SEQ ID NO: 1408263 - RNA, 15 nt, Pseudomonas aeruginosa PA01
ugccggccgccagca

SEQ ID NO: 1408264 - RNA, 17 nt, Pseudomonas aeruginosa PA01
ugccggccgccagcagg

SEQ ID NO: 1408265 - RNA, 18 nt, Pseudomonas aeruginosa PA01
ugccggccaugcaggcca

SEQ ID NO: 1408266 - RNA, 13 nt, Pseudomonas aeruginosa PA01
ugccggccggggc

SEQ ID NO: 1408267 - RNA, 23 nt, Pseudomonas aeruginosa PA01
ugccggccggggccggcacccgg

SEQ ID NO: 1408268 - RNA, 19 nt, Pseudomonas aeruginosa PA01
ugccggcaggccuucgacg

SEQ ID NO: 1408269 - RNA, 16 nt, Pseudomonas aeruginosa PA01
ugccggcauagccgaa

SEQ ID NO: 1408270 - RNA, 14 nt, Pseudomonas aeruginosa PA01
ugccggcacgcuca

SEQ ID NO: 1408271 - RNA, 17 nt, Pseudomonas aeruginosa PA01
ugccggcacgcucaggc

SEQ ID NO: 1408272 - RNA, 18 nt, Pseudomonas aeruginosa PA01
ugccggcagcgaccacca

SEQ ID NO: 1408273 - RNA, 20 nt, Pseudomonas aeruginosa PA01
ugccggcagcgaccaccacc

SEQ ID NO: 1408274 - RNA, 23 nt, Pseudomonas aeruginosa PA01
ugccggcagcgaccaccaccagg

SEQ ID NO: 1408275 - RNA, 22 nt, Pseudomonas aeruginosa PA01
ugccggaaagcaguucgcccgg

SEQ ID NO: 1408276 - RNA, 19 nt, Pseudomonas aeruginosa PA01
ugccggaaagccuggccgg

SEQ ID NO: 1408277 - RNA, 22 nt, Pseudomonas aeruginosa PA01
ugccggaaagccuggccggcga

SEQ ID NO: 1408278 - RNA, 24 nt, Pseudomonas aeruginosa PA01
ugccgcuucggcugcugcugcggc

SEQ ID NO: 1408279 - RNA, 22 nt, Pseudomonas aeruginosa PA01
ugccgcuugcccucgcgcccgg

SEQ ID NO: 1408280 - RNA, 15 nt, Pseudomonas aeruginosa PA01
ugccggacgcgaucc

SEQ ID NO: 1408281 - RNA, 15 nt, Pseudomonas aeruginosa PA01
ugccgcugcggcggu

SEQ ID NO: 1408282 - RNA, 18 nt, Pseudomonas aeruginosa PA01
ugccggacaacaggccgg

SEQ ID NO: 1408283 - RNA, 20 nt, Pseudomonas aeruginosa PA01
ugccggacaacaggccgggc

SEQ ID NO: 1408284 - RNA, 17 nt, Pseudomonas aeruginosa PA01
ugccggagacgauggcg

SEQ ID NO: 1408285 - RNA, 17 nt, Pseudomonas aeruginosa PA01
ugccggagaacgccgcc

SEQ ID NO: 1408286 - RNA, 19 nt, Pseudomonas aeruginosa PA01
ugccggagaugugcgcggu

SEQ ID NO: 1408287 - RNA, 17 nt, Pseudomonas aeruginosa PA01
ugccgacgcugaucauc

SEQ ID NO: 1408288 - RNA, 14 nt, Pseudomonas aeruginosa PA01
ugccgacgccgcgg

SEQ ID NO: 1408289 - RNA, 15 nt, Pseudomonas aeruginosa PA01
ugccgacgccgcggc

SEQ ID NO: 1408290 - RNA, 20 nt, Pseudomonas aeruginosa PA01
ugccgacgccgcggccggcg

SEQ ID NO: 1408291 - RNA, 21 nt, Pseudomonas aeruginosa PA01
ugccgacgccgcggccggcga

SEQ ID NO: 1408292 - RNA, 20 nt, Pseudomonas aeruginosa PA01
ugccgacgagcagcucgccg

SEQ ID NO: 1408293 - RNA, 22 nt, Pseudomonas aeruginosa PA01
ugccgacgagcagcucgccggc

SEQ ID NO: 1408294 - RNA, 17 nt, Pseudomonas aeruginosa PA01
ugccgaccgagcagcgg

SEQ ID NO: 1408295 - RNA, 19 nt, Pseudomonas aeruginosa PA01
ugccgaccgagcagcggac

SEQ ID NO: 1408296 - RNA, 15 nt, Pseudomonas aeruginosa PA01
ugccgaccuguaccg

SEQ ID NO: 1408297 - RNA, 20 nt, Pseudomonas aeruginosa PA01
ugccgaccuucaccaccagc

SEQ ID NO: 1408298 - RNA, 16 nt, Pseudomonas aeruginosa PA01
ugccgaccuugccggu

SEQ ID NO: 1408299 - RNA, 23 nt, Pseudomonas aeruginosa PA01
ugccgaacaccugcaucaccagg

SEQ ID NO: 1408300 - RNA, 17 nt, Pseudomonas aeruginosa PA01
ugccgcuagcccugcug

SEQ ID NO: 1408301 - RNA, 14 nt, Pseudomonas aeruginosa PA01
ugccgacgucgaug

SEQ ID NO: 1408302 - RNA, 13 nt, Pseudomonas aeruginosa PA01
ugccgacggcggc

SEQ ID NO: 1408303 - RNA, 17 nt, Pseudomonas aeruginosa PA01
ugccgcugcacgccuuc

SEQ ID NO: 1408304 - RNA, 15 nt, Pseudomonas aeruginosa PA01
ugccgcucguuggcg

SEQ ID NO: 1408305 - RNA, 17 nt, Pseudomonas aeruginosa PA01
ugccgcucguuggcggc

SEQ ID NO: 1408306 - RNA, 18 nt, Pseudomonas aeruginosa PA01
ugccgcucguuggcggcc

SEQ ID NO: 1408307 - RNA, 19 nt, Pseudomonas aeruginosa PA01
ugccgcucguuggcggcca

SEQ ID NO: 1408308 - RNA, 14 nt, Pseudomonas aeruginosa PA01
ugccgcuaucgcug

SEQ ID NO: 1408309 - RNA, 19 nt, Pseudomonas aeruginosa PA01
ugccgcuaucgcuggcgca

SEQ ID NO: 1408310 - RNA, 21 nt, Pseudomonas aeruginosa PA01
ugccgcuaucgcuggcgcagc

SEQ ID NO: 1408311 - RNA, 17 nt, Pseudomonas aeruginosa PA01
ugccgcugcgcaucagg

SEQ ID NO: 1408312 - RNA, 13 nt, Pseudomonas aeruginosa PA01
ugccgcugcgcgc

SEQ ID NO: 1408313 - RNA, 14 nt, Pseudomonas aeruginosa PA01
ugccgcuggccgac

SEQ ID NO: 1408314 - RNA, 18 nt, Pseudomonas aeruginosa PA01
ugccgcuggugaucgacc

SEQ ID NO: 1408315 - RNA, 15 nt, Pseudomonas aeruginosa PA01
ugccgcuggcggccu

SEQ ID NO: 1408316 - RNA, 16 nt, Pseudomonas aeruginosa PA01
ugcgaaaagcccgcca

SEQ ID NO: 1408317 - RNA, 18 nt, Pseudomonas aeruginosa PA01
ugccuucgccgucgagcc

SEQ ID NO: 1408318 - RNA, 17 nt, Pseudomonas aeruginosa PA01
ugccuucggcggcgccu

SEQ ID NO: 1408319 - RNA, 21 nt, Pseudomonas aeruginosa PA01
ugccuucgggagagcccgggc

SEQ ID NO: 1408320 - RNA, 23 nt, Pseudomonas aeruginosa PA01
ugccuucguaggugaagcccagg

SEQ ID NO: 1408321 - RNA, 23 nt, Pseudomonas aeruginosa PA01
ugccuuccugggcgugcuuggcg

SEQ ID NO: 1408322 - RNA, 15 nt, Pseudomonas aeruginosa PA01
ugccuucgaagccgg

SEQ ID NO: 1408323 - RNA, 14 nt, Pseudomonas aeruginosa PA01
ugccuugcggcccc

SEQ ID NO: 1408324 - RNA, 13 nt, Pseudomonas aeruginosa PA01
ugccuuccagcag

SEQ ID NO: 1408325 - RNA, 23 nt, Pseudomonas aeruginosa PA01
ugccuuccagcaggucgagggcg

SEQ ID NO: 1408326 - RNA, 17 nt, Pseudomonas aeruginosa PA01
ugccuuccaggcuguag

SEQ ID NO: 1408327 - RNA, 14 nt, Pseudomonas aeruginosa PA01
ugccuguccagcuc

SEQ ID NO: 1408328 - RNA, 18 nt, Pseudomonas aeruginosa PA01
ugccuguuccuccgccag

SEQ ID NO: 1408329 - RNA, 15 nt, Pseudomonas aeruginosa PA01
ugccguucaggccgg

SEQ ID NO: 1408330 - RNA, 16 nt, Pseudomonas aeruginosa PA01
ugccguucaggccggc

SEQ ID NO: 1408331 - RNA, 21 nt, Pseudomonas aeruginosa PA01
ugccguucaggccggcgccgc

SEQ ID NO: 1408332 - RNA, 13 nt, Pseudomonas aeruginosa PA01
ugccguucgcccg

SEQ ID NO: 1408333 - RNA, 16 nt, Pseudomonas aeruginosa PA01
ugccguucgcccgcgg

SEQ ID NO: 1408334 - RNA, 17 nt, Pseudomonas aeruginosa PA01
ugccguucgcccgcggc

SEQ ID NO: 1408335 - RNA, 16 nt, Pseudomonas aeruginosa PA01
ugccugucgcagcggg

SEQ ID NO: 1408336 - RNA, 21 nt, Pseudomonas aeruginosa PA01
ugcgaugcugucagcgcccgg

SEQ ID NO: 1408337 - RNA, 22 nt, Pseudomonas aeruginosa PA01
ugcgaugcugucagcgcccggc

SEQ ID NO: 1408338 - RNA, 20 nt, Pseudomonas aeruginosa PA01
ugcgauggaacgagcgcgac

SEQ ID NO: 1408339 - RNA, 22 nt, Pseudomonas aeruginosa PA01
ugcgauggaaguugcgcacccg

SEQ ID NO: 1408340 - RNA, 18 nt, Pseudomonas aeruginosa PA01
ugcgacuggaugcagccg

SEQ ID NO: 1408341 - RNA, 24 nt, Pseudomonas aeruginosa PA01
ugcgacuggaugcagccgauggcg

SEQ ID NO: 1408342 - RNA, 14 nt, Pseudomonas aeruginosa PA01
ugcgaaucgucgcc

SEQ ID NO: 1408343 - RNA, 18 nt, Pseudomonas aeruginosa PA01
ugcgagcaccaugccgau

SEQ ID NO: 1408344 - RNA, 19 nt, Pseudomonas aeruginosa PA01
ugcgcaacgggacgccagg

SEQ ID NO: 1408345 - RNA, 15 nt, Pseudomonas aeruginosa PA01
ugcgcaacgggcggc

SEQ ID NO: 1408346 - RNA, 14 nt, Pseudomonas aeruginosa PA01
ugcgcaacugccgg

SEQ ID NO: 1408347 - RNA, 14 nt, Pseudomonas aeruginosa PA01
ugcgauggaugcgc

SEQ ID NO: 1408348 - RNA, 20 nt, Pseudomonas aeruginosa PA01
ugcgaugggugccgcgcagg

SEQ ID NO: 1408349 - RNA, 15 nt, Pseudomonas aeruginosa PA01
ugcgccagaccagcc

SEQ ID NO: 1408350 - RNA, 14 nt, Pseudomonas aeruginosa PA01
ugcgccagagcagg

SEQ ID NO: 1408351 - RNA, 18 nt, Pseudomonas aeruginosa PA01
ugcgccagaagguaucgg

SEQ ID NO: 1408352 - RNA, 22 nt, Pseudomonas aeruginosa PA01
ugcgccagaagguaucggccau

SEQ ID NO: 1408353 - RNA, 23 nt, Pseudomonas aeruginosa PA01
ugcgccagcaucgcaucggcgac

SEQ ID NO: 1408354 - RNA, 18 nt, Pseudomonas aeruginosa PA01
ugcgccagcggcccggca

SEQ ID NO: 1408355 - RNA, 15 nt, Pseudomonas aeruginosa PA01
ugcgccaggcccggc

SEQ ID NO: 1408356 - RNA, 16 nt, Pseudomonas aeruginosa PA01
ugcgccaggccggugc

SEQ ID NO: 1408357 - RNA, 21 nt, Pseudomonas aeruginosa PA01
ugcgccaggccguucucgaag

SEQ ID NO: 1408358 - RNA, 22 nt, Pseudomonas aeruginosa PA01
ugcgccaggcuuuccgccgagc

SEQ ID NO: 1408359 - RNA, 20 nt, Pseudomonas aeruginosa PA01
ugcgccagccgacuggcggu

SEQ ID NO: 1408360 - RNA, 16 nt, Pseudomonas aeruginosa PA01
ugcgcaccucggccag

SEQ ID NO: 1408361 - RNA, 13 nt, Pseudomonas aeruginosa PA01
ugcgcaccgccug

SEQ ID NO: 1408362 - RNA, 20 nt, Pseudomonas aeruginosa PA01
ugcgcaccacucccggcgac

SEQ ID NO: 1408363 - RNA, 18 nt, Pseudomonas aeruginosa PA01
ugcgcaccagggccagga

SEQ ID NO: 1408364 - RNA, 22 nt, Pseudomonas aeruginosa PA01
ugcgcaccaugcccgcugggca

SEQ ID NO: 1408365 - RNA, 16 nt, Pseudomonas aeruginosa PA01
ugcgcagaugcggggc

SEQ ID NO: 1408366 - RNA, 17 nt, Pseudomonas aeruginosa PA01
ugcgcccgcucgacccg

SEQ ID NO: 1408367 - RNA, 13 nt, Pseudomonas aeruginosa PA01
ugcgcccgucgaa

SEQ ID NO: 1408368 - RNA, 14 nt, Pseudomonas aeruginosa PA01
ugcgcccggcgcga

SEQ ID NO: 1408369 - RNA, 22 nt, Pseudomonas aeruginosa PA01
ugcgcccggcgcgaccgucggc

SEQ ID NO: 1408370 - RNA, 13 nt, Pseudomonas aeruginosa PA01
ugcgcccggcuuc

SEQ ID NO: 1408371 - RNA, 17 nt, Pseudomonas aeruginosa PA01
ugcgcccggcuucggcg

SEQ ID NO: 1408372 - RNA, 18 nt, Pseudomonas aeruginosa PA01
ugcgcccggcuucggcgg

SEQ ID NO: 1408373 - RNA, 22 nt, Pseudomonas aeruginosa PA01
ugcgcccggcuucggcggcgcg

SEQ ID NO: 1408374 - RNA, 24 nt, Pseudomonas aeruginosa PA01
ugcgcccggcuucggcggcgcgcu

SEQ ID NO: 1408375 - RNA, 22 nt, Pseudomonas aeruginosa PA01
ugcgccgaaggaaucaccacuc

SEQ ID NO: 1408376 - RNA, 15 nt, Pseudomonas aeruginosa PA01
ugcgccgaaggcguc

SEQ ID NO: 1408377 - RNA, 16 nt, Pseudomonas aeruginosa PA01
ugcgccgacgccacca

SEQ ID NO: 1408378 - RNA, 22 nt, Pseudomonas aeruginosa PA01
ugcgccgacgccaccagccagg

SEQ ID NO: 1408379 - RNA, 16 nt, Pseudomonas aeruginosa PA01
ugcgcccuaccugucc

SEQ ID NO: 1408380 - RNA, 18 nt, Pseudomonas aeruginosa PA01
ugcgcccucgaacggcgu

SEQ ID NO: 1408381 - RNA, 12 nt, Pseudomonas aeruginosa PA01
ugcgccggcggg

SEQ ID NO: 1408382 - RNA, 16 nt, Pseudomonas aeruginosa PA01
ugcgccggcugccgcg

SEQ ID NO: 1408383 - RNA, 12 nt, Pseudomonas aeruginosa PA01
ugcgccgcagcg

SEQ ID NO: 1408384 - RNA, 13 nt, Pseudomonas aeruginosa PA01
ugcgccgcagcgg

SEQ ID NO: 1408385 - RNA, 14 nt, Pseudomonas aeruginosa PA01
ugcgccggcgcugc

SEQ ID NO: 1408386 - RNA, 15 nt, Pseudomonas aeruginosa PA01
ugcgccggcgcugcg

SEQ ID NO: 1408387 - RNA, 16 nt, Pseudomonas aeruginosa PA01
ugcgccgagcgcucgc

SEQ ID NO: 1408388 - RNA, 15 nt, Pseudomonas aeruginosa PA01
ugcgccgaccgcgcg

SEQ ID NO: 1408389 - RNA, 14 nt, Pseudomonas aeruginosa PA01
ugcgccgcagcaag

SEQ ID NO: 1408390 - RNA, 18 nt, Pseudomonas aeruginosa PA01
ugcgccgcaaguggcggc

SEQ ID NO: 1408391 - RNA, 20 nt, Pseudomonas aeruginosa PA01
ugcgccccgggucgcugcuc

SEQ ID NO: 1408392 - RNA, 19 nt, Pseudomonas aeruginosa PA01
ugcgccccggucucgcgca

SEQ ID NO: 1408393 - RNA, 20 nt, Pseudomonas aeruginosa PA01
ugcgccccggucucgcgcag

SEQ ID NO: 1408394 - RNA, 17 nt, Pseudomonas aeruginosa PA01
ugcgccauugccgccag

SEQ ID NO: 1408395 - RNA, 19 nt, Pseudomonas aeruginosa PA01
ugcgccauugccgccaggu

SEQ ID NO: 1408396 - RNA, 20 nt, Pseudomonas aeruginosa PA01
ugcgccauugccgccaggug

SEQ ID NO: 1408397 - RNA, 21 nt, Pseudomonas aeruginosa PA01
ugcgccauuucaaggcgacgc

SEQ ID NO: 1408398 - RNA, 16 nt, Pseudomonas aeruginosa PA01
ugcgccccagcucagc

SEQ ID NO: 1408399 - RNA, 15 nt, Pseudomonas aeruginosa PA01
ugcgccccaggugca

SEQ ID NO: 1408400 - RNA, 19 nt, Pseudomonas aeruginosa PA01
ugcgccccaggugcagcga

SEQ ID NO: 1408401 - RNA, 23 nt, Pseudomonas aeruginosa PA01
ugcgccaugccguucaggccggc

SEQ ID NO: 1408402 - RNA, 17 nt, Pseudomonas aeruginosa PA01
ugcgccaugcgcccgcu

SEQ ID NO: 1408403 - RNA, 13 nt, Pseudomonas aeruginosa PA01
ugcgcccagcagc

SEQ ID NO: 1408404 - RNA, 14 nt, Pseudomonas aeruginosa PA01
ugcgcccagcagca

SEQ ID NO: 1408405 - RNA, 15 nt, Pseudomonas aeruginosa PA01
ugcgcccagcagcag

SEQ ID NO: 1408406 - RNA, 16 nt, Pseudomonas aeruginosa PA01
ugcgcccagcagcagg

SEQ ID NO: 1408407 - RNA, 21 nt, Pseudomonas aeruginosa PA01
ugcgcccagcagcaggccggc

SEQ ID NO: 1408408 - RNA, 16 nt, Pseudomonas aeruginosa PA01
ugcgcccagggacgcg

SEQ ID NO: 1408409 - RNA, 19 nt, Pseudomonas aeruginosa PA01
ugcgccagguagccuggau

SEQ ID NO: 1408410 - RNA, 20 nt, Pseudomonas aeruginosa PA01
ugcgguugaaacugcgcagg

SEQ ID NO: 1408411 - RNA, 21 nt, Pseudomonas aeruginosa PA01
ugcgguuuuccugccccgugc

SEQ ID NO: 1408412 - RNA, 20 nt, Pseudomonas aeruginosa PA01
ugcgucgucgcggcgccugg

SEQ ID NO: 1408413 - RNA, 16 nt, Pseudomonas aeruginosa PA01
ugcggugccgcgcagc

SEQ ID NO: 1408414 - RNA, 13 nt, Pseudomonas aeruginosa PA01
ugcggugcggcca

SEQ ID NO: 1408415 - RNA, 21 nt, Pseudomonas aeruginosa PA01
ugcggugggcgagggcgcgca

SEQ ID NO: 1408416 - RNA, 13 nt, Pseudomonas aeruginosa PA01
ugcgguuccuggc

SEQ ID NO: 1408417 - RNA, 18 nt, Pseudomonas aeruginosa PA01
ugcgguuccuggcuggag

SEQ ID NO: 1408418 - RNA, 18 nt, Pseudomonas aeruginosa PA01
ugcgguuauccgccgccg

SEQ ID NO: 1408419 - RNA, 18 nt, Pseudomonas aeruginosa PA01
ugcgguuauccgccgucg

SEQ ID NO: 1408420 - RNA, 17 nt, Pseudomonas aeruginosa PA01
ugcgguuauccgccgug

SEQ ID NO: 1408421 - RNA, 16 nt, Pseudomonas aeruginosa PA01
ugcgguuauucgcccu

SEQ ID NO: 1408422 - RNA, 15 nt, Pseudomonas aeruginosa PA01
ugcggugucccuucu

SEQ ID NO: 1408423 - RNA, 17 nt, Pseudomonas aeruginosa PA01
ugcgguagucgcugcug

SEQ ID NO: 1408424 - RNA, 18 nt, Pseudomonas aeruginosa PA01
ugcggucauccgccggcg

SEQ ID NO: 1408425 - RNA, 19 nt, Pseudomonas aeruginosa PA01
ugcggucauccgccggcgc

SEQ ID NO: 1408426 - RNA, 12 nt, Pseudomonas aeruginosa PA01
ugcgguccagcg

SEQ ID NO: 1408427 - RNA, 15 nt, Pseudomonas aeruginosa PA01
ugcggucgcgcccgc

SEQ ID NO: 1408428 - RNA, 15 nt, Pseudomonas aeruginosa PA01
ugcggggcgaccagc

SEQ ID NO: 1408429 - RNA, 20 nt, Pseudomonas aeruginosa PA01
ugcggggaaagcuccucggc

SEQ ID NO: 1408430 - RNA, 12 nt, Pseudomonas aeruginosa PA01
ugcggggccgga

SEQ ID NO: 1408431 - RNA, 13 nt, Pseudomonas aeruginosa PA01
ugcggggcgcuca

SEQ ID NO: 1408432 - RNA, 15 nt, Pseudomonas aeruginosa PA01
ugcggggcgcucagg

SEQ ID NO: 1408433 - RNA, 17 nt, Pseudomonas aeruginosa PA01
ugcggggcgcucgcccu

SEQ ID NO: 1408434 - RNA, 20 nt, Pseudomonas aeruginosa PA01
ugcggggcgcucgcccuugc

SEQ ID NO: 1408435 - RNA, 14 nt, Pseudomonas aeruginosa PA01
ugcggggcggcgca

SEQ ID NO: 1408436 - RNA, 12 nt, Pseudomonas aeruginosa PA01
ugcgggcgaugu

SEQ ID NO: 1408437 - RNA, 12 nt, Pseudomonas aeruginosa PA01
ugcgggcgcagg

SEQ ID NO: 1408438 - RNA, 23 nt, Pseudomonas aeruginosa PA01
ugcgggcgcagguugagggccgc

SEQ ID NO: 1408439 - RNA, 14 nt, Pseudomonas aeruginosa PA01
ugcgggcgcgccug

SEQ ID NO: 1408440 - RNA, 15 nt, Pseudomonas aeruginosa PA01
ugcgggcgcgccuga

SEQ ID NO: 1408441 - RNA, 16 nt, Pseudomonas aeruginosa PA01
ugcgggcaguccuggc

SEQ ID NO: 1408442 - RNA, 17 nt, Pseudomonas aeruginosa PA01
ugcgggcaguccuggcg

SEQ ID NO: 1408443 - RNA, 22 nt, Pseudomonas aeruginosa PA01
ugcgggcaguccuggcgguagc

SEQ ID NO: 1408444 - RNA, 20 nt, Pseudomonas aeruginosa PA01
ugcgggcagacaccaccagg

SEQ ID NO: 1408445 - RNA, 21 nt, Pseudomonas aeruginosa PA01
ugcgggcgaugaggcugucca

SEQ ID NO: 1408446 - RNA, 14 nt, Pseudomonas aeruginosa PA01
ugcgggcgagcagg

SEQ ID NO: 1408447 - RNA, 13 nt, Pseudomonas aeruginosa PA01
ugcgggucgaggc

SEQ ID NO: 1408448 - RNA, 14 nt, Pseudomonas aeruginosa PA01
ugcgggugcgcagg

SEQ ID NO: 1408449 - RNA, 19 nt, Pseudomonas aeruginosa PA01
ugcgggguucgacgcgcca

SEQ ID NO: 1408450 - RNA, 21 nt, Pseudomonas aeruginosa PA01
ugcggguuggucggcaccagg

SEQ ID NO: 1408451 - RNA, 14 nt, Pseudomonas aeruginosa PA01
ugcgguauagcuca

SEQ ID NO: 1408452 - RNA, 14 nt, Pseudomonas aeruginosa PA01
ugcgguaggugaug

SEQ ID NO: 1408453 - RNA, 17 nt, Pseudomonas aeruginosa PA01
ugcggguggucgccgcc

SEQ ID NO: 1408454 - RNA, 19 nt, Pseudomonas aeruginosa PA01
ugcggguggucgccgccca

SEQ ID NO: 1408455 - RNA, 14 nt, Pseudomonas aeruginosa PA01
ugcgccuccucggc

SEQ ID NO: 1408456 - RNA, 13 nt, Pseudomonas aeruginosa PA01
ugcgcuugccggc

SEQ ID NO: 1408457 - RNA, 18 nt, Pseudomonas aeruginosa PA01
ugcgcuugccggccgcca

SEQ ID NO: 1408458 - RNA, 20 nt, Pseudomonas aeruginosa PA01
ugcgcuuccggcagccagcc

SEQ ID NO: 1408459 - RNA, 17 nt, Pseudomonas aeruginosa PA01
ugcgccggggaucaggu

SEQ ID NO: 1408460 - RNA, 20 nt, Pseudomonas aeruginosa PA01
ugcgccgguccuuguccggg

SEQ ID NO: 1408461 - RNA, 16 nt, Pseudomonas aeruginosa PA01
ugcgccguggcaccag

SEQ ID NO: 1408462 - RNA, 18 nt, Pseudomonas aeruginosa PA01
ugcgccguggcaccaggu

SEQ ID NO: 1408463 - RNA, 20 nt, Pseudomonas aeruginosa PA01
ugcgccguuucgacgaugcu

SEQ ID NO: 1408464 - RNA, 12 nt, Pseudomonas aeruginosa PA01
ugcggaucgccu

SEQ ID NO: 1408465 - RNA, 18 nt, Pseudomonas aeruginosa PA01
ugcggaaaccgcggccgg

SEQ ID NO: 1408466 - RNA, 21 nt, Pseudomonas aeruginosa PA01
ugcggcaaggcgaucccggcg

SEQ ID NO: 1408467 - RNA, 18 nt, Pseudomonas aeruginosa PA01
ugcggcacgaaccauugc

SEQ ID NO: 1408468 - RNA, 19 nt, Pseudomonas aeruginosa PA01
ugcggauucaucggcggca

SEQ ID NO: 1408469 - RNA, 21 nt, Pseudomonas aeruginosa PA01
ugcggauucaucggcggcagg

SEQ ID NO: 1408470 - RNA, 14 nt, Pseudomonas aeruginosa PA01
ugcggcaacgacgg

SEQ ID NO: 1408471 - RNA, 17 nt, Pseudomonas aeruginosa PA01
ugcggcaacgacggcaa

SEQ ID NO: 1408472 - RNA, 15 nt, Pseudomonas aeruginosa PA01
ugcggccccggcgcu

SEQ ID NO: 1408473 - RNA, 18 nt, Pseudomonas aeruginosa PA01
ugcggccccggcgcucgc

SEQ ID NO: 1408474 - RNA, 20 nt, Pseudomonas aeruginosa PA01
ugcggcccgagggcggcagg

SEQ ID NO: 1408475 - RNA, 12 nt, Pseudomonas aeruginosa PA01
ugcggcccgcca

SEQ ID NO: 1408476 - RNA, 12 nt, Pseudomonas aeruginosa PA01
ugcggcccgccu

SEQ ID NO: 1408477 - RNA, 15 nt, Pseudomonas aeruginosa PA01
ugcggcccgccucgg

SEQ ID NO: 1408478 - RNA, 19 nt, Pseudomonas aeruginosa PA01
ugcggcccuucaucauuuc

SEQ ID NO: 1408479 - RNA, 16 nt, Pseudomonas aeruginosa PA01
ugcggcccuuguucgc

SEQ ID NO: 1408480 - RNA, 22 nt, Pseudomonas aeruginosa PA01
ugcggcccuuguucgcggcgau

SEQ ID NO: 1408481 - RNA, 18 nt, Pseudomonas aeruginosa PA01
ugcggcgggucacgccga

SEQ ID NO: 1408482 - RNA, 14 nt, Pseudomonas aeruginosa PA01
ugcggcggaaggcg

SEQ ID NO: 1408483 - RNA, 16 nt, Pseudomonas aeruginosa PA01
ugcggcggcaggucgg

SEQ ID NO: 1408484 - RNA, 23 nt, Pseudomonas aeruginosa PA01
ugcggccgagcauguaggcgcac

SEQ ID NO: 1408485 - RNA, 13 nt, Pseudomonas aeruginosa PA01
ugcggccgaucau

SEQ ID NO: 1408486 - RNA, 23 nt, Pseudomonas aeruginosa PA01
ugcggccgaucaucggcuggucg

SEQ ID NO: 1408487 - RNA, 22 nt, Pseudomonas aeruginosa PA01
ugcggccgaugcuaucgcgugg

SEQ ID NO: 1408488 - RNA, 17 nt, Pseudomonas aeruginosa PA01
ugcggccgcaaccagcc

SEQ ID NO: 1408489 - RNA, 20 nt, Pseudomonas aeruginosa PA01
ugcggccgcaaccagcccug

SEQ ID NO: 1408490 - RNA, 22 nt, Pseudomonas aeruginosa PA01
ugcggccgcaaccagcccuggc

SEQ ID NO: 1408491 - RNA, 23 nt, Pseudomonas aeruginosa PA01
ugcggccgcaaccagcccuggcg

SEQ ID NO: 1408492 - RNA, 13 nt, Pseudomonas aeruginosa PA01
ugcggcuggcgaa

SEQ ID NO: 1408493 - RNA, 16 nt, Pseudomonas aeruginosa PA01
ugcgggaacuggcguu

SEQ ID NO: 1408494 - RNA, 21 nt, Pseudomonas aeruginosa PA01
ugcgggaacuuggcgcgcagg

SEQ ID NO: 1408495 - RNA, 18 nt, Pseudomonas aeruginosa PA01
ugcggcugugcucgagga

SEQ ID NO: 1408496 - RNA, 13 nt, Pseudomonas aeruginosa PA01
ugcggcuugccca

SEQ ID NO: 1408497 - RNA, 23 nt, Pseudomonas aeruginosa PA01
ugcggcuugcccugcucgucgcu

SEQ ID NO: 1408498 - RNA, 21 nt, Pseudomonas aeruginosa PA01
ugcggcuuucgguuugcgccg

SEQ ID NO: 1408499 - RNA, 17 nt, Pseudomonas aeruginosa PA01
ugcggcggucccagacc

SEQ ID NO: 1408500 - RNA, 15 nt, Pseudomonas aeruginosa PA01
ugcggcucgccgauu

SEQ ID NO: 1408501 - RNA, 17 nt, Pseudomonas aeruginosa PA01
ugcggcguucgccgcgg

SEQ ID NO: 1408502 - RNA, 19 nt, Pseudomonas aeruginosa PA01
ugcggcuacucgcccgacc

SEQ ID NO: 1408503 - RNA, 22 nt, Pseudomonas aeruginosa PA01
ugcuuaauacggcgcaggcuug

SEQ ID NO: 1408504 - RNA, 15 nt, Pseudomonas aeruginosa PA01
ugcuguugccgcugc

SEQ ID NO: 1408505 - RNA, 16 nt, Pseudomonas aeruginosa PA01
ugcuguugccguggcg

SEQ ID NO: 1408506 - RNA, 15 nt, Pseudomonas aeruginosa PA01
ugcuguuccucgucg

SEQ ID NO: 1408507 - RNA, 13 nt, Pseudomonas aeruginosa PA01
ugcuguguucgau

SEQ ID NO: 1408508 - RNA, 16 nt, Pseudomonas aeruginosa PA01
ugcuucaggcgcgcgg

SEQ ID NO: 1408509 - RNA, 21 nt, Pseudomonas aeruginosa PA01
ugcuggacaagguuugcgccg

SEQ ID NO: 1408510 - RNA, 15 nt, Pseudomonas aeruginosa PA01
ugcuggauccucgcc

SEQ ID NO: 1408511 - RNA, 24 nt, Pseudomonas aeruginosa PA01
ugcuggauccucgccucgcgccag

SEQ ID NO: 1408512 - RNA, 24 nt, Pseudomonas aeruginosa PA01
ugcuggacggcggacugcucgccg

SEQ ID NO: 1408513 - RNA, 16 nt, Pseudomonas aeruginosa PA01
ugcuggacucgcgcca

SEQ ID NO: 1408514 - RNA, 18 nt, Pseudomonas aeruginosa PA01
ugcuggcacagguccagc

SEQ ID NO: 1408515 - RNA, 15 nt, Pseudomonas aeruginosa PA01
ugcuggaugucggcg

SEQ ID NO: 1408516 - RNA, 20 nt, Pseudomonas aeruginosa PA01
ugcugugcguuucguugcgg

SEQ ID NO: 1408517 - RNA, 14 nt, Pseudomonas aeruginosa PA01
ugcugugcugcacc

SEQ ID NO: 1408518 - RNA, 16 nt, Pseudomonas aeruginosa PA01
ugcugugcugcaccag

SEQ ID NO: 1408519 - RNA, 14 nt, Pseudomonas aeruginosa PA01
ugcuguggagccgg

SEQ ID NO: 1408520 - RNA, 22 nt, Pseudomonas aeruginosa PA01
ugcuguggagccggugccggcg

SEQ ID NO: 1408521 - RNA, 15 nt, Pseudomonas aeruginosa PA01
ugcugcggcagguag

SEQ ID NO: 1408522 - RNA, 18 nt, Pseudomonas aeruginosa PA01
ugcugcggcaacgacggc

SEQ ID NO: 1408523 - RNA, 16 nt, Pseudomonas aeruginosa PA01
ugcugcgcgggugucg

SEQ ID NO: 1408524 - RNA, 17 nt, Pseudomonas aeruginosa PA01
ugcugcgcgggugucgc

SEQ ID NO: 1408525 - RNA, 13 nt, Pseudomonas aeruginosa PA01
ugcugcgccggca

SEQ ID NO: 1408526 - RNA, 20 nt, Pseudomonas aeruginosa PA01
ugcugcgccggcacggcauc

SEQ ID NO: 1408527 - RNA, 17 nt, Pseudomonas aeruginosa PA01
ugcugcucgccaugggc

SEQ ID NO: 1408528 - RNA, 14 nt, Pseudomonas aeruginosa PA01
ugcugcugcggggc

SEQ ID NO: 1408529 - RNA, 16 nt, Pseudomonas aeruginosa PA01
ugcugcugcggggccu

SEQ ID NO: 1408530 - RNA, 18 nt, Pseudomonas aeruginosa PA01
ugcugcugcucagcgcgc

SEQ ID NO: 1408531 - RNA, 16 nt, Pseudomonas aeruginosa PA01
ugcuuugcgccucgcg

SEQ ID NO: 1408532 - RNA, 23 nt, Pseudomonas aeruginosa PA01
ugcuuguccuuccagcucucgcu

SEQ ID NO: 1408533 - RNA, 12 nt, Pseudomonas aeruginosa PA01
ugcuugccggcg

SEQ ID NO: 1408534 - RNA, 16 nt, Pseudomonas aeruginosa PA01
ugcuugcgcgccgccg

SEQ ID NO: 1408535 - RNA, 22 nt, Pseudomonas aeruginosa PA01
ugcuugcgcgccgccgccgcgg

SEQ ID NO: 1408536 - RNA, 16 nt, Pseudomonas aeruginosa PA01
ugcuugcgcgcggcgu

SEQ ID NO: 1408537 - RNA, 16 nt, Pseudomonas aeruginosa PA01
ugcuugcgcucgagcc

SEQ ID NO: 1408538 - RNA, 16 nt, Pseudomonas aeruginosa PA01
uggaaaggccucggcg

SEQ ID NO: 1408539 - RNA, 21 nt, Pseudomonas aeruginosa PA01
uggaacagccgcagcggcaug

SEQ ID NO: 1408540 - RNA, 17 nt, Pseudomonas aeruginosa PA01
uggaacagcgcgucgcg

SEQ ID NO: 1408541 - RNA, 16 nt, Pseudomonas aeruginosa PA01
uggaaugccggccggg

SEQ ID NO: 1408542 - RNA, 21 nt, Pseudomonas aeruginosa PA01
ugcuccagaucgcauuguugc

SEQ ID NO: 1408543 - RNA, 21 nt, Pseudomonas aeruginosa PA01
ugcuccagcaaugccagcgcc

SEQ ID NO: 1408544 - RNA, 18 nt, Pseudomonas aeruginosa PA01
ugcuccagcccggcucgg

SEQ ID NO: 1408545 - RNA, 18 nt, Pseudomonas aeruginosa PA01
ugcuccagggagcgcucg

SEQ ID NO: 1408546 - RNA, 18 nt, Pseudomonas aeruginosa PA01
ugcuccagguucggcgcc

SEQ ID NO: 1408547 - RNA, 19 nt, Pseudomonas aeruginosa PA01
ugcuccagguucggcgcca

SEQ ID NO: 1408548 - RNA, 14 nt, Pseudomonas aeruginosa PA01
ugcuccacccgcag

SEQ ID NO: 1408549 - RNA, 15 nt, Pseudomonas aeruginosa PA01
ugcucauucggccag

SEQ ID NO: 1408550 - RNA, 21 nt, Pseudomonas aeruginosa PA01
ugcucauucggccagcgcggc

SEQ ID NO: 1408551 - RNA, 14 nt, Pseudomonas aeruginosa PA01
ugcucaugccguug

SEQ ID NO: 1408552 - RNA, 21 nt, Pseudomonas aeruginosa PA01
ugcuccaucaguugcgcgcgg

SEQ ID NO: 1408553 - RNA, 21 nt, Pseudomonas aeruginosa PA01
ugcuccgugucggcggcgccu

SEQ ID NO: 1408554 - RNA, 23 nt, Pseudomonas aeruginosa PA01
ugcuccguugaacucggcgccca

SEQ ID NO: 1408555 - RNA, 21 nt, Pseudomonas aeruginosa PA01
ugcuccagcagggccagcgcc

SEQ ID NO: 1408556 - RNA, 14 nt, Pseudomonas aeruginosa PA01
ugcuccuccaggcu

SEQ ID NO: 1408557 - RNA, 20 nt, Pseudomonas aeruginosa PA01
ugcuccuccccguccuggcg

SEQ ID NO: 1408558 - RNA, 14 nt, Pseudomonas aeruginosa PA01
ugcuccgccuggcg

SEQ ID NO: 1408559 - RNA, 14 nt, Pseudomonas aeruginosa PA01
ugcguguucggcgg

SEQ ID NO: 1408560 - RNA, 14 nt, Pseudomonas aeruginosa PA01
ugcucaggcgcugc

SEQ ID NO: 1408561 - RNA, 16 nt, Pseudomonas aeruginosa PA01
ugcucaguugcaccug

SEQ ID NO: 1408562 - RNA, 15 nt, Pseudomonas aeruginosa PA01
ugcucagggccgcgc

SEQ ID NO: 1408563 - RNA, 22 nt, Pseudomonas aeruginosa PA01
ugcucaggucgaacugcacccg

SEQ ID NO: 1408564 - RNA, 21 nt, Pseudomonas aeruginosa PA01
ugcucgcgcaccgcggccagu

SEQ ID NO: 1408565 - RNA, 24 nt, Pseudomonas aeruginosa PA01
ugcucgcgcaugaucgccucggcg

SEQ ID NO: 1408566 - RNA, 13 nt, Pseudomonas aeruginosa PA01
ugcucgcgccagc

SEQ ID NO: 1408567 - RNA, 14 nt, Pseudomonas aeruginosa PA01
ugcucgcgccagcc

SEQ ID NO: 1408568 - RNA, 19 nt, Pseudomonas aeruginosa PA01
ugcucgcgccagccccagg

SEQ ID NO: 1408569 - RNA, 15 nt, Pseudomonas aeruginosa PA01
ugcucgccgccggcg

SEQ ID NO: 1408570 - RNA, 20 nt, Pseudomonas aeruginosa PA01
ugcucgauggcggccuggua

SEQ ID NO: 1408571 - RNA, 21 nt, Pseudomonas aeruginosa PA01
ugcucgauggcggccugguag

SEQ ID NO: 1408572 - RNA, 21 nt, Pseudomonas aeruginosa PA01
ugcuccucggcagcgcuggcg

SEQ ID NO: 1408573 - RNA, 17 nt, Pseudomonas aeruginosa PA01
ugcucgaucaccaccac

SEQ ID NO: 1408574 - RNA, 15 nt, Pseudomonas aeruginosa PA01
ugcucgauccagccg

SEQ ID NO: 1408575 - RNA, 17 nt, Pseudomonas aeruginosa PA01
ugcucgauccagccggc

SEQ ID NO: 1408576 - RNA, 15 nt, Pseudomonas aeruginosa PA01
ugcucgaugaucgac

SEQ ID NO: 1408577 - RNA, 15 nt, Pseudomonas aeruginosa PA01
ugcucgacggcacca

SEQ ID NO: 1408578 - RNA, 17 nt, Pseudomonas aeruginosa PA01
ugcucgacggcaccagc

SEQ ID NO: 1408579 - RNA, 18 nt, Pseudomonas aeruginosa PA01
ugcucgacgggcgcuucc

SEQ ID NO: 1408580 - RNA, 13 nt, Pseudomonas aeruginosa PA01
ugcucgaccgccu

SEQ ID NO: 1408581 - RNA, 19 nt, Pseudomonas aeruginosa PA01
ugcucgcgggucaccaccg

SEQ ID NO: 1408582 - RNA, 23 nt, Pseudomonas aeruginosa PA01
ugcugagcagucgccuggcccug

SEQ ID NO: 1408583 - RNA, 16 nt, Pseudomonas aeruginosa PA01
ugcugauaagcucggc

SEQ ID NO: 1408584 - RNA, 23 nt, Pseudomonas aeruginosa PA01
ugcugaguuucacgucgagcacg

SEQ ID NO: 1408585 - RNA, 14 nt, Pseudomonas aeruginosa PA01
ugcugaucacccgc

SEQ ID NO: 1408586 - RNA, 20 nt, Pseudomonas aeruginosa PA01
ugcugcagcaucaggcgcuc

SEQ ID NO: 1408587 - RNA, 22 nt, Pseudomonas aeruginosa PA01
ugcugcaccagcaggucgaggu

SEQ ID NO: 1408588 - RNA, 14 nt, Pseudomonas aeruginosa PA01
ugcugcaccgggag

SEQ ID NO: 1408589 - RNA, 15 nt, Pseudomonas aeruginosa PA01
ugcugcaacauggcg

SEQ ID NO: 1408590 - RNA, 20 nt, Pseudomonas aeruginosa PA01
ugucucgccagcccggcagg

SEQ ID NO: 1408591 - RNA, 16 nt, Pseudomonas aeruginosa PA01
ugucguggucgccguc

SEQ ID NO: 1408592 - RNA, 18 nt, Pseudomonas aeruginosa PA01
ugugcacggucugcucgg

SEQ ID NO: 1408593 - RNA, 20 nt, Pseudomonas aeruginosa PA01
ugugauuggaauugcugacg

SEQ ID NO: 1408594 - RNA, 14 nt, Pseudomonas aeruginosa PA01
ugugcaccagcaac

SEQ ID NO: 1408595 - RNA, 13 nt, Pseudomonas aeruginosa PA01
ugugcaguucgac

SEQ ID NO: 1408596 - RNA, 16 nt, Pseudomonas aeruginosa PA01
ugugaaaacggcgcau

SEQ ID NO: 1408597 - RNA, 14 nt, Pseudomonas aeruginosa PA01
ugugaccuucaacg

SEQ ID NO: 1408598 - RNA, 16 nt, Pseudomonas aeruginosa PA01
ugugaucaccagccac

SEQ ID NO: 1408599 - RNA, 20 nt, Pseudomonas aeruginosa PA01
ugucacgguaucccacuucc

SEQ ID NO: 1408600 - RNA, 14 nt, Pseudomonas aeruginosa PA01
ugucacgccggggg

SEQ ID NO: 1408601 - RNA, 17 nt, Pseudomonas aeruginosa PA01
ugucggcucgcgccggc

SEQ ID NO: 1408602 - RNA, 15 nt, Pseudomonas aeruginosa PA01
uguaguccagcgccg

SEQ ID NO: 1408603 - RNA, 12 nt, Pseudomonas aeruginosa PA01
ugucggucaggu

SEQ ID NO: 1408604 - RNA, 18 nt, Pseudomonas aeruginosa PA01
ugucggugcccucgcgga

SEQ ID NO: 1408605 - RNA, 15 nt, Pseudomonas aeruginosa PA01
ugucgguauggaaga

SEQ ID NO: 1408606 - RNA, 16 nt, Pseudomonas aeruginosa PA01
ugucgggggcugcgca

SEQ ID NO: 1408607 - RNA, 18 nt, Pseudomonas aeruginosa PA01
ugucgggggcugcgcauc

SEQ ID NO: 1408608 - RNA, 14 nt, Pseudomonas aeruginosa PA01
ugucguagccgcgc

SEQ ID NO: 1408609 - RNA, 21 nt, Pseudomonas aeruginosa PA01
ugucguagccgcgcgccagca

SEQ ID NO: 1408610 - RNA, 16 nt, Pseudomonas aeruginosa PA01
ugucgugccuccagcc

SEQ ID NO: 1408611 - RNA, 15 nt, Pseudomonas aeruginosa PA01
ugucguggacgccgg

SEQ ID NO: 1408612 - RNA, 17 nt, Pseudomonas aeruginosa PA01
ugucgucgaggguggcg

SEQ ID NO: 1408613 - RNA, 15 nt, Pseudomonas aeruginosa PA01
ugucgucggcgcggc

SEQ ID NO: 1408614 - RNA, 15 nt, Pseudomonas aeruginosa PA01
ugugcagggucacgc

SEQ ID NO: 1408615 - RNA, 13 nt, Pseudomonas aeruginosa PA01
ugugcccggcgug

SEQ ID NO: 1408616 - RNA, 13 nt, Pseudomonas aeruginosa PA01
ugugccgccaccu

SEQ ID NO: 1408617 - RNA, 14 nt, Pseudomonas aeruginosa PA01
ugugccggccaugc

SEQ ID NO: 1408618 - RNA, 18 nt, Pseudomonas aeruginosa PA01
ugugccgguagcuggcca

SEQ ID NO: 1408619 - RNA, 16 nt, Pseudomonas aeruginosa PA01
ugugcgaggcuggccu

SEQ ID NO: 1408620 - RNA, 15 nt, Pseudomonas aeruginosa PA01
ugugcggugccgcgc

SEQ ID NO: 1408621 - RNA, 18 nt, Pseudomonas aeruginosa PA01
ugugcguguucggcggcu

SEQ ID NO: 1408622 - RNA, 14 nt, Pseudomonas aeruginosa PA01
ugugcggcguggcg

SEQ ID NO: 1408623 - RNA, 20 nt, Pseudomonas aeruginosa PA01
ugugcgcugcaucggcgcgc

SEQ ID NO: 1408624 - RNA, 20 nt, Pseudomonas aeruginosa PA01
uguggagccggugccggcgg

SEQ ID NO: 1408625 - RNA, 16 nt, Pseudomonas aeruginosa PA01
uguggauaacguccgc

SEQ ID NO: 1408626 - RNA, 17 nt, Pseudomonas aeruginosa PA01
uguggauaacguccgcg

SEQ ID NO: 1408627 - RNA, 17 nt, Pseudomonas aeruginosa PA01
uguggccgucgcgccgc

SEQ ID NO: 1408628 - RNA, 15 nt, Pseudomonas aeruginosa PA01
uguggcaggcgcugc

SEQ ID NO: 1408629 - RNA, 17 nt, Pseudomonas aeruginosa PA01
ugugcugcaccagcagg

SEQ ID NO: 1408630 - RNA, 13 nt, Pseudomonas aeruginosa PA01
ugugcuugaccgc

SEQ ID NO: 1408631 - RNA, 21 nt, Pseudomonas aeruginosa PA01
ugugcuugacgaaggcggcag

SEQ ID NO: 1408632 - RNA, 13 nt, Pseudomonas aeruginosa PA01
ugugcuggcggaa

SEQ ID NO: 1408633 - RNA, 23 nt, Pseudomonas aeruginosa PA01
ugugcuggcggaaggugccuucg

SEQ ID NO: 1408634 - RNA, 13 nt, Pseudomonas aeruginosa PA01
ugugcuggccacc

SEQ ID NO: 1408635 - RNA, 14 nt, Pseudomonas aeruginosa PA01
ugugcugccugcgg

SEQ ID NO: 1408636 - RNA, 21 nt, Pseudomonas aeruginosa PA01
ugugggacaggaagagcaggc

SEQ ID NO: 1408637 - RNA, 21 nt, Pseudomonas aeruginosa PA01
ugugggaaacggugcuagcgg

SEQ ID NO: 1408638 - RNA, 15 nt, Pseudomonas aeruginosa PA01
uguggcgcggcugga

SEQ ID NO: 1408639 - RNA, 20 nt, Pseudomonas aeruginosa PA01
uguggggaaaucgguugccg

SEQ ID NO: 1408640 - RNA, 23 nt, Pseudomonas aeruginosa PA01
ugugggcuaccgcaucgccaccg

SEQ ID NO: 1408641 - RNA, 19 nt, Pseudomonas aeruginosa PA01
uguggguauccagcggccg

SEQ ID NO: 1408642 - RNA, 14 nt, Pseudomonas aeruginosa PA01
uguucggcgggauc

SEQ ID NO: 1408643 - RNA, 17 nt, Pseudomonas aeruginosa PA01
uguucggccagccggcg

SEQ ID NO: 1408644 - RNA, 15 nt, Pseudomonas aeruginosa PA01
uguucgccgccgcca

SEQ ID NO: 1408645 - RNA, 21 nt, Pseudomonas aeruginosa PA01
uguucgcggcgaugcgcaugc

SEQ ID NO: 1408646 - RNA, 17 nt, Pseudomonas aeruginosa PA01
uguucgcggcucuggcg

SEQ ID NO: 1408647 - RNA, 22 nt, Pseudomonas aeruginosa PA01
uguucgcggcucuggcgcaggg

SEQ ID NO: 1408648 - RNA, 18 nt, Pseudomonas aeruginosa PA01
uguucgcaaagcucgcgc

SEQ ID NO: 1408649 - RNA, 12 nt, Pseudomonas aeruginosa PA01
uuagccgccagu

SEQ ID NO: 1408650 - RNA, 14 nt, Pseudomonas aeruginosa PA01
uguugacgauggcc

SEQ ID NO: 1408651 - RNA, 16 nt, Pseudomonas aeruginosa PA01
uguugaagccgccauc

SEQ ID NO: 1408652 - RNA, 13 nt, Pseudomonas aeruginosa PA01
uguucgucuggcg

SEQ ID NO: 1408653 - RNA, 19 nt, Pseudomonas aeruginosa PA01
uguucgguguaguucaccg

SEQ ID NO: 1408654 - RNA, 18 nt, Pseudomonas aeruginosa PA01
uguugcagagcggccagg

SEQ ID NO: 1408655 - RNA, 20 nt, Pseudomonas aeruginosa PA01
uguugcagggucgccggguc

SEQ ID NO: 1408656 - RNA, 17 nt, Pseudomonas aeruginosa PA01
uguugagcuggccgagc

SEQ ID NO: 1408657 - RNA, 20 nt, Pseudomonas aeruginosa PA01
uguugaucgccgcgccgccg

SEQ ID NO: 1408658 - RNA, 15 nt, Pseudomonas aeruginosa PA01
uguugaugcccacca

SEQ ID NO: 1408659 - RNA, 14 nt, Pseudomonas aeruginosa PA01
uguugaugccgauc

SEQ ID NO: 1408660 - RNA, 16 nt, Pseudomonas aeruginosa PA01
uguugauggucaccuu

SEQ ID NO: 1408661 - RNA, 20 nt, Pseudomonas aeruginosa PA01
uguugccguucugugcggcg

SEQ ID NO: 1408662 - RNA, 15 nt, Pseudomonas aeruginosa PA01
uuaaaguucgacgau

SEQ ID NO: 1408663 - RNA, 18 nt, Pseudomonas aeruginosa PA01
uucguuuucaggcgacgc

SEQ ID NO: 1408664 - RNA, 18 nt, Pseudomonas aeruginosa PA01
uucguuucagcgccagca

SEQ ID NO: 1408665 - RNA, 19 nt, Pseudomonas aeruginosa PA01
uucgucuggcgccuggccu

SEQ ID NO: 1408666 - RNA, 13 nt, Pseudomonas aeruginosa PA01
uucgucgccagcc

SEQ ID NO: 1408667 - RNA, 22 nt, Pseudomonas aeruginosa PA01
uucguccugcugcuggccuucg

SEQ ID NO: 1408668 - RNA, 14 nt, Pseudomonas aeruginosa PA01
uucguccgccacca

SEQ ID NO: 1408669 - RNA, 14 nt, Pseudomonas aeruginosa PA01
uucguccggccgcc

SEQ ID NO: 1408670 - RNA, 18 nt, Pseudomonas aeruginosa PA01
uucgggagagcccgggcg

SEQ ID NO: 1408671 - RNA, 13 nt, Pseudomonas aeruginosa PA01
uucggcuggaccu

SEQ ID NO: 1408672 - RNA, 20 nt, Pseudomonas aeruginosa PA01
uucggcuguuucaggccggc

SEQ ID NO: 1408673 - RNA, 13 nt, Pseudomonas aeruginosa PA01
uucggcggcgugc

SEQ ID NO: 1408674 - RNA, 14 nt, Pseudomonas aeruginosa PA01
uucggcgucgaagu

SEQ ID NO: 1408675 - RNA, 18 nt, Pseudomonas aeruginosa PA01
uucggcgugauccgcagg

SEQ ID NO: 1408676 - RNA, 18 nt, Pseudomonas aeruginosa PA01
uucggcgugcauggccgg

SEQ ID NO: 1408677 - RNA, 19 nt, Pseudomonas aeruginosa PA01
uucucccucgccgaccgcc

SEQ ID NO: 1408678 - RNA, 23 nt, Pseudomonas aeruginosa PA01
uucuccggggcccggcaggcagu

SEQ ID NO: 1408679 - RNA, 22 nt, Pseudomonas aeruginosa PA01
uucugcucgaacaucagcagcg

SEQ ID NO: 1408680 - RNA, 20 nt, Pseudomonas aeruginosa PA01
uucucgcuccccugccgaac

SEQ ID NO: 1408681 - RNA, 19 nt, Pseudomonas aeruginosa PA01
uucggagaacagcgagacc

SEQ ID NO: 1408682 - RNA, 16 nt, Pseudomonas aeruginosa PA01
uucggcaaggcgcagc

SEQ ID NO: 1408683 - RNA, 13 nt, Pseudomonas aeruginosa PA01
uucggcgcuggcg

SEQ ID NO: 1408684 - RNA, 14 nt, Pseudomonas aeruginosa PA01
uucggcggccaggc

SEQ ID NO: 1408685 - RNA, 16 nt, Pseudomonas aeruginosa PA01
uucgcgguagacgcag

SEQ ID NO: 1408686 - RNA, 21 nt, Pseudomonas aeruginosa PA01
uucgcccagugguuccaggag

SEQ ID NO: 1408687 - RNA, 23 nt, Pseudomonas aeruginosa PA01
uucgcggaaguaggcggcggagu

SEQ ID NO: 1408688 - RNA, 23 nt, Pseudomonas aeruginosa PA01
uucgcggcucuggcgcagggaga

SEQ ID NO: 1408689 - RNA, 17 nt, Pseudomonas aeruginosa PA01
uucgccgaugcgccgac

SEQ ID NO: 1408690 - RNA, 17 nt, Pseudomonas aeruginosa PA01
uucgccgagcgccgcca

SEQ ID NO: 1408691 - RNA, 17 nt, Pseudomonas aeruginosa PA01
uucgccgaggcccagcg

SEQ ID NO: 1408692 - RNA, 18 nt, Pseudomonas aeruginosa PA01
uucgccgaggggcgggau

SEQ ID NO: 1408693 - RNA, 17 nt, Pseudomonas aeruginosa PA01
uuccgcgcccggcuggc

SEQ ID NO: 1408694 - RNA, 16 nt, Pseudomonas aeruginosa PA01
uuccgcggagucgccg

SEQ ID NO: 1408695 - RNA, 17 nt, Pseudomonas aeruginosa PA01
uuccgcggagucgccgg

SEQ ID NO: 1408696 - RNA, 14 nt, Pseudomonas aeruginosa PA01
uuccgcggccggca

SEQ ID NO: 1408697 - RNA, 21 nt, Pseudomonas aeruginosa PA01
uuccgcggccggcaggccgau

SEQ ID NO: 1408698 - RNA, 23 nt, Pseudomonas aeruginosa PA01
uuccgccgagcguugggccucgc

SEQ ID NO: 1408699 - RNA, 16 nt, Pseudomonas aeruginosa PA01
uuccgccaggcgcagc

SEQ ID NO: 1408700 - RNA, 23 nt, Pseudomonas aeruginosa PA01
uuccgccggcgccgccucgggca

SEQ ID NO: 1408701 - RNA, 15 nt, Pseudomonas aeruginosa PA01
uucgcccgcggcggc

SEQ ID NO: 1408702 - RNA, 14 nt, Pseudomonas aeruginosa PA01
uucgccccgccgcc

SEQ ID NO: 1408703 - RNA, 16 nt, Pseudomonas aeruginosa PA01
uucgcccagcucgccg

SEQ ID NO: 1408704 - RNA, 20 nt, Pseudomonas aeruginosa PA01
uucgcccaguaccacgcagc

SEQ ID NO: 1408705 - RNA, 23 nt, Pseudomonas aeruginosa PA01
uucgccaucgauggucacuggcg

SEQ ID NO: 1408706 - RNA, 23 nt, Pseudomonas aeruginosa PA01
uucgccagcaccucguaggccga

SEQ ID NO: 1408707 - RNA, 17 nt, Pseudomonas aeruginosa PA01
uucgaagcgccaggcgu

SEQ ID NO: 1408708 - RNA, 13 nt, Pseudomonas aeruginosa PA01
uucgaagcucggc

SEQ ID NO: 1408709 - RNA, 13 nt, Pseudomonas aeruginosa PA01
uucgacagcgcgg

SEQ ID NO: 1408710 - RNA, 16 nt, Pseudomonas aeruginosa PA01
uucgaccacgacccgg

SEQ ID NO: 1408711 - RNA, 20 nt, Pseudomonas aeruginosa PA01
uucgacaaggagacucagcg

SEQ ID NO: 1408712 - RNA, 21 nt, Pseudomonas aeruginosa PA01
uuccgacccggccgaccaggu

SEQ ID NO: 1408713 - RNA, 16 nt, Pseudomonas aeruginosa PA01
uuccgcaucggccacc

SEQ ID NO: 1408714 - RNA, 22 nt, Pseudomonas aeruginosa PA01
uucccucaggauagccggcgcg

SEQ ID NO: 1408715 - RNA, 19 nt, Pseudomonas aeruginosa PA01
uucccggaucagcucgcgu

SEQ ID NO: 1408716 - RNA, 17 nt, Pseudomonas aeruginosa PA01
uucccguaaggccaggc

SEQ ID NO: 1408717 - RNA, 17 nt, Pseudomonas aeruginosa PA01
uucccguccgggcacgc

SEQ ID NO: 1408718 - RNA, 12 nt, Pseudomonas aeruginosa PA01
uuccagcccggc

SEQ ID NO: 1408719 - RNA, 19 nt, Pseudomonas aeruginosa PA01
uuccagcucggugccguca

SEQ ID NO: 1408720 - RNA, 21 nt, Pseudomonas aeruginosa PA01
uuccaggcaccgaagcugagg

SEQ ID NO: 1408721 - RNA, 13 nt, Pseudomonas aeruginosa PA01
uuccaggcgccgc

SEQ ID NO: 1408722 - RNA, 13 nt, Pseudomonas aeruginosa PA01
uuccaggcguugc

SEQ ID NO: 1408723 - RNA, 17 nt, Pseudomonas aeruginosa PA01
uuccaggcuguagccgg

SEQ ID NO: 1408724 - RNA, 23 nt, Pseudomonas aeruginosa PA01
uuccaggcuguagccggcgaugu

SEQ ID NO: 1408725 - RNA, 16 nt, Pseudomonas aeruginosa PA01
uuccaguucggccgcg

SEQ ID NO: 1408726 - RNA, 16 nt, Pseudomonas aeruginosa PA01
uuccagggcggcgcgg

SEQ ID NO: 1408727 - RNA, 22 nt, Pseudomonas aeruginosa PA01
uuccaggguagcgccgcgggcc

SEQ ID NO: 1408728 - RNA, 21 nt, Pseudomonas aeruginosa PA01
uuccagggucagcuggcgcgc

SEQ ID NO: 1408729 - RNA, 15 nt, Pseudomonas aeruginosa PA01
uuccagggucggcac

SEQ ID NO: 1408730 - RNA, 19 nt, Pseudomonas aeruginosa PA01
uuccauagggcggcgcggc

SEQ ID NO: 1408731 - RNA, 19 nt, Pseudomonas aeruginosa PA01
uuccacccgcuccgcggcc

SEQ ID NO: 1408732 - RNA, 18 nt, Pseudomonas aeruginosa PA01
uucaugggcgcgcgccgg

SEQ ID NO: 1408733 - RNA, 16 nt, Pseudomonas aeruginosa PA01
uuccaccggccgcgcc

SEQ ID NO: 1408734 - RNA, 16 nt, Pseudomonas aeruginosa PA01
uuccaccggcuggccg

SEQ ID NO: 1408735 - RNA, 23 nt, Pseudomonas aeruginosa PA01
uuccacgggucgcagccgagccc

SEQ ID NO: 1408736 - RNA, 17 nt, Pseudomonas aeruginosa PA01
uuccacgucgagcgggc

SEQ ID NO: 1408737 - RNA, 15 nt, Pseudomonas aeruginosa PA01
uuccacgugcucgcg

SEQ ID NO: 1408738 - RNA, 23 nt, Pseudomonas aeruginosa PA01
uuccacgugcucgcggaccagcu

SEQ ID NO: 1408739 - RNA, 18 nt, Pseudomonas aeruginosa PA01
uuccagaacgccgcgcac

SEQ ID NO: 1408740 - RNA, 15 nt, Pseudomonas aeruginosa PA01
uuccagcaccucgcg

SEQ ID NO: 1408741 - RNA, 19 nt, Pseudomonas aeruginosa PA01
uuccagcaccucgcgggaa

SEQ ID NO: 1408742 - RNA, 20 nt, Pseudomonas aeruginosa PA01
uuccagcaugcucgggcugc

SEQ ID NO: 1408743 - RNA, 15 nt, Pseudomonas aeruginosa PA01
uuccagcggccacgg

SEQ ID NO: 1408744 - RNA, 18 nt, Pseudomonas aeruginosa PA01
uuccagcggccgcgagcg

SEQ ID NO: 1408745 - RNA, 22 nt, Pseudomonas aeruginosa PA01
uuccagcggggaugaccguccg

SEQ ID NO: 1408746 - RNA, 13 nt, Pseudomonas aeruginosa PA01
uuccagcgccucg

SEQ ID NO: 1408747 - RNA, 13 nt, Pseudomonas aeruginosa PA01
uucagcuccagca

SEQ ID NO: 1408748 - RNA, 18 nt, Pseudomonas aeruginosa PA01
uucagcacuucggcgcgc

SEQ ID NO: 1408749 - RNA, 22 nt, Pseudomonas aeruginosa PA01
uucagcagcaugucgccgggga

SEQ ID NO: 1408750 - RNA, 22 nt, Pseudomonas aeruginosa PA01
uucacgucgagcacgccguccg

SEQ ID NO: 1408751 - RNA, 13 nt, Pseudomonas aeruginosa PA01
uucacgccuggcg

SEQ ID NO: 1408752 - RNA, 18 nt, Pseudomonas aeruginosa PA01
uucacgcaguacagcugc

SEQ ID NO: 1408753 - RNA, 18 nt, Pseudomonas aeruginosa PA01
uucauccugcgcgccucu

SEQ ID NO: 1408754 - RNA, 20 nt, Pseudomonas aeruginosa PA01
uucauccugcgcgccucuuc

SEQ ID NO: 1408755 - RNA, 12 nt, Pseudomonas aeruginosa PA01
uucaucggcggc

SEQ ID NO: 1408756 - RNA, 14 nt, Pseudomonas aeruginosa PA01
uucaucucgccguc

SEQ ID NO: 1408757 - RNA, 14 nt, Pseudomonas aeruginosa PA01
uucaggcgcucguc

SEQ ID NO: 1408758 - RNA, 16 nt, Pseudomonas aeruginosa PA01
uucaggccggcgccgc

SEQ ID NO: 1408759 - RNA, 17 nt, Pseudomonas aeruginosa PA01
uucaggccggcgccgcc

SEQ ID NO: 1408760 - RNA, 20 nt, Pseudomonas aeruginosa PA01
uucaggccggcgccgccgaa

SEQ ID NO: 1408761 - RNA, 15 nt, Pseudomonas aeruginosa PA01
uucaggcgacgccgc

SEQ ID NO: 1408762 - RNA, 18 nt, Pseudomonas aeruginosa PA01
uucaggcgacgccgcgcu

SEQ ID NO: 1408763 - RNA, 20 nt, Pseudomonas aeruginosa PA01
uucaggcgacgccgcgcugc

SEQ ID NO: 1408764 - RNA, 11 nt, Pseudomonas aeruginosa PA01
uucaggcgcgc

SEQ ID NO: 1408765 - RNA, 22 nt, Pseudomonas aeruginosa PA01
uucagggcuccgaugaagcagg

SEQ ID NO: 1408766 - RNA, 16 nt, Pseudomonas aeruginosa PA01
uucaggguggcgcugc

SEQ ID NO: 1408767 - RNA, 23 nt, Pseudomonas aeruginosa PA01
uucagguagugcaacaccuggcg

SEQ ID NO: 1408768 - RNA, 15 nt, Pseudomonas aeruginosa PA01
uuugggaucggugcu

SEQ ID NO: 1408769 - RNA, 13 nt, Pseudomonas aeruginosa PA01
uuugcccggcgag

SEQ ID NO: 1408770 - RNA, 16 nt, Pseudomonas aeruginosa PA01
uuuccccguggcgccg

SEQ ID NO: 1408771 - RNA, 16 nt, Pseudomonas aeruginosa PA01
uuucccauuguuggcg

SEQ ID NO: 1408772 - RNA, 16 nt, Pseudomonas aeruginosa PA01
uuuccaggcucaccuc

SEQ ID NO: 1408773 - RNA, 20 nt, Pseudomonas aeruginosa PA01
uuuccaguucaucgagcagg

SEQ ID NO: 1408774 - RNA, 18 nt, Pseudomonas aeruginosa PA01
uuucucggucgccgccag

SEQ ID NO: 1408775 - RNA, 20 nt, Pseudomonas aeruginosa PA01
uuucugccacccggcgcccg

SEQ ID NO: 1408776 - RNA, 12 nt, Pseudomonas aeruginosa PA01
uuucugcuggcc

SEQ ID NO: 1408777 - RNA, 14 nt, Pseudomonas aeruginosa PA01
uuucgcugcugccg

SEQ ID NO: 1408778 - RNA, 18 nt, Pseudomonas aeruginosa PA01
uuucgcucuggucgaaca

SEQ ID NO: 1408779 - RNA, 17 nt, Pseudomonas aeruginosa PA01
uuucgcggaaguaggcg

SEQ ID NO: 1408780 - RNA, 12 nt, Pseudomonas aeruginosa PA01
aauggcgcgccu

SEQ ID NO: 1408781 - RNA, 16 nt, Pseudomonas aeruginosa PA01
aauggcggucgccgac

SEQ ID NO: 1408782 - RNA, 22 nt, Pseudomonas aeruginosa PA01
aauggcuugaucgagucgccgg

SEQ ID NO: 1408783 - RNA, 17 nt, Pseudomonas aeruginosa PA01
aaugguggaccagcgcc

SEQ ID NO: 1408784 - RNA, 18 nt, Pseudomonas aeruginosa PA01
aaugccuuccgacgccgc

SEQ ID NO: 1408785 - RNA, 17 nt, Pseudomonas aeruginosa PA01
aauggauguugccgccg

SEQ ID NO: 1408786 - RNA, 21 nt, Pseudomonas aeruginosa PA01
aaugcguggguccacgccggg

SEQ ID NO: 1408787 - RNA, 20 nt, Pseudomonas aeruginosa PA01
aauggagggaucgcgcggcu

SEQ ID NO: 1408788 - RNA, 23 nt, Pseudomonas aeruginosa PA01
aaucgcuggcggaaaagcccgcu

SEQ ID NO: 1408789 - RNA, 20 nt, Pseudomonas aeruginosa PA01
aaucgccucccuggcgacgu

SEQ ID NO: 1408790 - RNA, 19 nt, Pseudomonas aeruginosa PA01
aaugacgaucucgaugacc

SEQ ID NO: 1408791 - RNA, 18 nt, Pseudomonas aeruginosa PA01
uugauggugaccggcuug

SEQ ID NO: 1408792 - RNA, 14 nt, Pseudomonas aeruginosa PA01
uugaugaagcgcug

SEQ ID NO: 1408793 - RNA, 16 nt, Pseudomonas aeruginosa PA01
uucuggaugcagccgg

SEQ ID NO: 1408794 - RNA, 16 nt, Pseudomonas aeruginosa PA01
uucugcuuuccggccc

SEQ ID NO: 1408795 - RNA, 15 nt, Pseudomonas aeruginosa PA01
uucugcuggccaccg

SEQ ID NO: 1408796 - RNA, 19 nt, Pseudomonas aeruginosa PA01
uugcacgcaggccgcugcc

SEQ ID NO: 1408797 - RNA, 17 nt, Pseudomonas aeruginosa PA01
uugcagagcggccaggu

SEQ ID NO: 1408798 - RNA, 13 nt, Pseudomonas aeruginosa PA01
uugauuccgccgg

SEQ ID NO: 1408799 - RNA, 16 nt, Pseudomonas aeruginosa PA01
uugcaugaccuucagg

SEQ ID NO: 1408800 - RNA, 17 nt, Pseudomonas aeruginosa PA01
uugcaguccaggccgua

SEQ ID NO: 1408801 - RNA, 15 nt, Pseudomonas aeruginosa PA01
uugcagggucgccgg

SEQ ID NO: 1408802 - RNA, 18 nt, Pseudomonas aeruginosa PA01
uugcagugcgccgcagcg

SEQ ID NO: 1408803 - RNA, 15 nt, Pseudomonas aeruginosa PA01
uugcaggccggcgag

SEQ ID NO: 1408804 - RNA, 16 nt, Pseudomonas aeruginosa PA01
uugcaggccggcgagc

SEQ ID NO: 1408805 - RNA, 14 nt, Pseudomonas aeruginosa PA01
uugcagggccgcca

SEQ ID NO: 1408806 - RNA, 15 nt, Pseudomonas aeruginosa PA01
uugcagggccgccag

SEQ ID NO: 1408807 - RNA, 21 nt, Pseudomonas aeruginosa PA01
uugcagcucguuggccaccug

SEQ ID NO: 1408808 - RNA, 15 nt, Pseudomonas aeruginosa PA01
uugcagcaccgccug

SEQ ID NO: 1408809 - RNA, 17 nt, Pseudomonas aeruginosa PA01
uugccguccagccggcg

SEQ ID NO: 1408810 - RNA, 19 nt, Pseudomonas aeruginosa PA01
uugccguccuucaggacga

SEQ ID NO: 1408811 - RNA, 17 nt, Pseudomonas aeruginosa PA01
uugccguggcggcgcgc

SEQ ID NO: 1408812 - RNA, 19 nt, Pseudomonas aeruginosa PA01
uugccguggcuccuggagg

SEQ ID NO: 1408813 - RNA, 22 nt, Pseudomonas aeruginosa PA01
uugccgggugcuaugcgccggg

SEQ ID NO: 1408814 - RNA, 17 nt, Pseudomonas aeruginosa PA01
uugccgguagccggcga

SEQ ID NO: 1408815 - RNA, 19 nt, Pseudomonas aeruginosa PA01
uugccgguagccggcgauc

SEQ ID NO: 1408816 - RNA, 16 nt, Pseudomonas aeruginosa PA01
uugccgcuggccucga

SEQ ID NO: 1408817 - RNA, 22 nt, Pseudomonas aeruginosa PA01
uugccggacaacaggccgggcg

SEQ ID NO: 1408818 - RNA, 16 nt, Pseudomonas aeruginosa PA01
uugccggcgccaucga

SEQ ID NO: 1408819 - RNA, 21 nt, Pseudomonas aeruginosa PA01
uugccgccgguucgcaggcca

SEQ ID NO: 1408820 - RNA, 11 nt, Pseudomonas aeruginosa PA01
uugccgccgau

SEQ ID NO: 1408821 - RNA, 19 nt, Pseudomonas aeruginosa PA01
uugccgccgaucagcgcgc

SEQ ID NO: 1408822 - RNA, 22 nt, Pseudomonas aeruginosa PA01
uugccagaggcugcgcuccagg

SEQ ID NO: 1408823 - RNA, 12 nt, Pseudomonas aeruginosa PA01
uugcccaccggg

SEQ ID NO: 1408824 - RNA, 15 nt, Pseudomonas aeruginosa PA01
uugcccacggccagg

SEQ ID NO: 1408825 - RNA, 22 nt, Pseudomonas aeruginosa PA01
uugcccgucuagcgcaggcgga

SEQ ID NO: 1408826 - RNA, 19 nt, Pseudomonas aeruginosa PA01
uugccgaucaggcugaagc

SEQ ID NO: 1408827 - RNA, 22 nt, Pseudomonas aeruginosa PA01
uugccgaagauacccagcgggc

SEQ ID NO: 1408828 - RNA, 17 nt, Pseudomonas aeruginosa PA01
uugcccugccagcgggc

SEQ ID NO: 1408829 - RNA, 16 nt, Pseudomonas aeruginosa PA01
uugugaucgaccucgc

SEQ ID NO: 1408830 - RNA, 19 nt, Pseudomonas aeruginosa PA01
uugucgcguccggccagcc

SEQ ID NO: 1408831 - RNA, 23 nt, Pseudomonas aeruginosa PA01
uugucgccuucccggucgacggc

SEQ ID NO: 1408832 - RNA, 19 nt, Pseudomonas aeruginosa PA01
uugucuuucugcgacgagc

SEQ ID NO: 1408833 - RNA, 21 nt, Pseudomonas aeruginosa PA01
uugucccugucccgccgcgcc

SEQ ID NO: 1408834 - RNA, 22 nt, Pseudomonas aeruginosa PA01
uugucgccgcuggacgaaccga

SEQ ID NO: 1408835 - RNA, 16 nt, Pseudomonas aeruginosa PA01
uuggugucgaugccgc

SEQ ID NO: 1408836 - RNA, 16 nt, Pseudomonas aeruginosa PA01
uugguggggcgccggc

SEQ ID NO: 1408837 - RNA, 14 nt, Pseudomonas aeruginosa PA01
aaucgaugucgcgg

SEQ ID NO: 1408838 - RNA, 22 nt, Pseudomonas aeruginosa PA01
aaucgagcgccaggaacgccuc

SEQ ID NO: 1408839 - RNA, 22 nt, Pseudomonas aeruginosa PA01
aauccgcggcccugcucgccgg

SEQ ID NO: 1408840 - RNA, 12 nt, Pseudomonas aeruginosa PA01
aauccgccgcuc

SEQ ID NO: 1408841 - RNA, 11 nt, Pseudomonas aeruginosa PA01
aauccgcucgg

SEQ ID NO: 1408842 - RNA, 12 nt, Pseudomonas aeruginosa PA01
aauccggcgcug

SEQ ID NO: 1408843 - RNA, 16 nt, Pseudomonas aeruginosa PA01
uuggcgaggcgcgccu

SEQ ID NO: 1408844 - RNA, 17 nt, Pseudomonas aeruginosa PA01
uuggcgaggcgcgccug

SEQ ID NO: 1408845 - RNA, 13 nt, Pseudomonas aeruginosa PA01
uuggcgaggucgc

SEQ ID NO: 1408846 - RNA, 16 nt, Pseudomonas aeruginosa PA01
uuggcgcaggccgggc

SEQ ID NO: 1408847 - RNA, 12 nt, Pseudomonas aeruginosa PA01
uuggcgcccgcc

SEQ ID NO: 1408848 - RNA, 22 nt, Pseudomonas aeruginosa PA01
uuggcgccucgcaaaggucggc

SEQ ID NO: 1408849 - RNA, 20 nt, Pseudomonas aeruginosa PA01
uuggcgcgaccgcccgccuc

SEQ ID NO: 1408850 - RNA, 23 nt, Pseudomonas aeruginosa PA01
uuggcgcgggcgaaggccucguc

SEQ ID NO: 1408851 - RNA, 20 nt, Pseudomonas aeruginosa PA01
uugguauccaccucgcccuc

SEQ ID NO: 1408852 - RNA, 19 nt, Pseudomonas aeruginosa PA01
uugguaaucguagacgcgc

SEQ ID NO: 1408853 - RNA, 18 nt, Pseudomonas aeruginosa PA01
uugguacagcucgcgcaa

SEQ ID NO: 1408854 - RNA, 13 nt, Pseudomonas aeruginosa PA01
uuggucaggccga

SEQ ID NO: 1408855 - RNA, 17 nt, Pseudomonas aeruginosa PA01
uuggucaggcugcgcac

SEQ ID NO: 1408856 - RNA, 20 nt, Pseudomonas aeruginosa PA01
uuggucaggcugcgcaccuc

SEQ ID NO: 1408857 - RNA, 13 nt, Pseudomonas aeruginosa PA01
uuggucaggucga

SEQ ID NO: 1408858 - RNA, 19 nt, Pseudomonas aeruginosa PA01
uuggucaggucgacgccgc

SEQ ID NO: 1408859 - RNA, 20 nt, Pseudomonas aeruginosa PA01
uuggucugcucggcgauggc

SEQ ID NO: 1408860 - RNA, 20 nt, Pseudomonas aeruginosa PA01
uuggccaggccccaggccgc

SEQ ID NO: 1408861 - RNA, 16 nt, Pseudomonas aeruginosa PA01
uuggccagcgcggcgc

SEQ ID NO: 1408862 - RNA, 15 nt, Pseudomonas aeruginosa PA01
uuggccagcgcggug

SEQ ID NO: 1408863 - RNA, 16 nt, Pseudomonas aeruginosa PA01
uuggccagcaggccga

SEQ ID NO: 1408864 - RNA, 19 nt, Pseudomonas aeruginosa PA01
uuggccagcaggccgagcg

SEQ ID NO: 1408865 - RNA, 23 nt, Pseudomonas aeruginosa PA01
uuggccagcaggcgccgcgcauc

SEQ ID NO: 1408866 - RNA, 16 nt, Pseudomonas aeruginosa PA01
uuggcaugaccgagca

SEQ ID NO: 1408867 - RNA, 15 nt, Pseudomonas aeruginosa PA01
aaucccagcucgccg

SEQ ID NO: 1408868 - RNA, 16 nt, Pseudomonas aeruginosa PA01
uugcgcccgucgaaga

SEQ ID NO: 1408869 - RNA, 20 nt, Pseudomonas aeruginosa PA01
uugcgccgaauccaggccga

SEQ ID NO: 1408870 - RNA, 10 nt, Pseudomonas aeruginosa PA01
uugcgccgcc

SEQ ID NO: 1408871 - RNA, 14 nt, Pseudomonas aeruginosa PA01
uugcgcccggcuuc

SEQ ID NO: 1408872 - RNA, 14 nt, Pseudomonas aeruginosa PA01
uugcgccgccucgc

SEQ ID NO: 1408873 - RNA, 13 nt, Pseudomonas aeruginosa PA01
acgcuuccagcac

SEQ ID NO: 1408874 - RNA, 15 nt, Pseudomonas aeruginosa PA01
acgcuucuccucggc

SEQ ID NO: 1408875 - RNA, 16 nt, Pseudomonas aeruginosa PA01
acgcuucugcuggccg

SEQ ID NO: 1408876 - RNA, 21 nt, Pseudomonas aeruginosa PA01
acgcuucugcuggccgcgcag

SEQ ID NO: 1408877 - RNA, 19 nt, Pseudomonas aeruginosa PA01
acgcuucgaagcucucgcc

SEQ ID NO: 1408878 - RNA, 14 nt, Pseudomonas aeruginosa PA01
acgcuugagcuggc

SEQ ID NO: 1408879 - RNA, 17 nt, Pseudomonas aeruginosa PA01
acgcuugagcuggcgcu

SEQ ID NO: 1408880 - RNA, 16 nt, Pseudomonas aeruginosa PA01
acggauaacggcagcc

SEQ ID NO: 1408881 - RNA, 21 nt, Pseudomonas aeruginosa PA01
acggagucggugugaccuuca

SEQ ID NO: 1408882 - RNA, 13 nt, Pseudomonas aeruginosa PA01
acggauaggcggc

SEQ ID NO: 1408883 - RNA, 15 nt, Pseudomonas aeruginosa PA01
acggauaggcggcgg

SEQ ID NO: 1408884 - RNA, 20 nt, Pseudomonas aeruginosa PA01
acgcuuggcgaucacggcgc

SEQ ID NO: 1408885 - RNA, 19 nt, Pseudomonas aeruginosa PA01
acggaucgcgucgcaggcg

SEQ ID NO: 1408886 - RNA, 19 nt, Pseudomonas aeruginosa PA01
acggaucgcucucgcgcuu

SEQ ID NO: 1408887 - RNA, 20 nt, Pseudomonas aeruginosa PA01
acggaucgggcuucggcagc

SEQ ID NO: 1408888 - RNA, 15 nt, Pseudomonas aeruginosa PA01
acggcacgacgccgg

SEQ ID NO: 1408889 - RNA, 14 nt, Pseudomonas aeruginosa PA01
acggcacggggcgc

SEQ ID NO: 1408890 - RNA, 16 nt, Pseudomonas aeruginosa PA01
acgcggagcaggcgga

SEQ ID NO: 1408891 - RNA, 18 nt, Pseudomonas aeruginosa PA01
acgcggagcaggcggaga

SEQ ID NO: 1408892 - RNA, 21 nt, Pseudomonas aeruginosa PA01
acgcggaucuggcccuuuucc

SEQ ID NO: 1408893 - RNA, 17 nt, Pseudomonas aeruginosa PA01
acgcggaugcccugguc

SEQ ID NO: 1408894 - RNA, 23 nt, Pseudomonas aeruginosa PA01
acgcggaugcccuggucggcggu

SEQ ID NO: 1408895 - RNA, 18 nt, Pseudomonas aeruginosa PA01
acgcggauuggccgggcc

SEQ ID NO: 1408896 - RNA, 16 nt, Pseudomonas aeruginosa PA01
acgcggcaccgcuuuc

SEQ ID NO: 1408897 - RNA, 20 nt, Pseudomonas aeruginosa PA01
acgcggauaucgcuggcgcc

SEQ ID NO: 1408898 - RNA, 22 nt, Pseudomonas aeruginosa PA01
acgcggauaucgcuggcgccca

SEQ ID NO: 1408899 - RNA, 14 nt, Pseudomonas aeruginosa PA01
acgcugcugccggc

SEQ ID NO: 1408900 - RNA, 12 nt, Pseudomonas aeruginosa PA01
acgcggccuggg

SEQ ID NO: 1408901 - RNA, 19 nt, Pseudomonas aeruginosa PA01
acgcggccugggccgaagg

SEQ ID NO: 1408902 - RNA, 15 nt, Pseudomonas aeruginosa PA01
acgcuggcggccgag

SEQ ID NO: 1408903 - RNA, 20 nt, Pseudomonas aeruginosa PA01
acgcuggcggccgaguucgc

SEQ ID NO: 1408904 - RNA, 16 nt, Pseudomonas aeruginosa PA01
acgcugggacggcugc

SEQ ID NO: 1408905 - RNA, 15 nt, Pseudomonas aeruginosa PA01
acgcuggccugccga

SEQ ID NO: 1408906 - RNA, 20 nt, Pseudomonas aeruginosa PA01
acgcuggcgauaucgaaggc

SEQ ID NO: 1408907 - RNA, 17 nt, Pseudomonas aeruginosa PA01
acgcuggcgaucaugcc

SEQ ID NO: 1408908 - RNA, 14 nt, Pseudomonas aeruginosa PA01
acggcaucaccggc

SEQ ID NO: 1408909 - RNA, 16 nt, Pseudomonas aeruginosa PA01
acggcaucaccggcgg

SEQ ID NO: 1408910 - RNA, 16 nt, Pseudomonas aeruginosa PA01
acggcagguggcgggu

SEQ ID NO: 1408911 - RNA, 22 nt, Pseudomonas aeruginosa PA01
acggcagguggcgggucggcgg

SEQ ID NO: 1408912 - RNA, 20 nt, Pseudomonas aeruginosa PA01
acggcagguggucguugcgc

SEQ ID NO: 1408913 - RNA, 22 nt, Pseudomonas aeruginosa PA01
acggcaggggcuuucuucgccu

SEQ ID NO: 1408914 - RNA, 18 nt, Pseudomonas aeruginosa PA01
acggcagggucagccgau

SEQ ID NO: 1408915 - RNA, 22 nt, Pseudomonas aeruginosa PA01
acggcagggucagccgaugcuc

SEQ ID NO: 1408916 - RNA, 21 nt, Pseudomonas aeruginosa PA01
acggcaggccagcagguagcc

SEQ ID NO: 1408917 - RNA, 15 nt, Pseudomonas aeruginosa PA01
acggcaucgauccgc

SEQ ID NO: 1408918 - RNA, 19 nt, Pseudomonas aeruginosa PA01
acggcaucggagaccacgg

SEQ ID NO: 1408919 - RNA, 14 nt, Pseudomonas aeruginosa PA01
acggcaucggccac

SEQ ID NO: 1408920 - RNA, 23 nt, Pseudomonas aeruginosa PA01
acggcauucucucuucagcaggg

SEQ ID NO: 1408921 - RNA, 19 nt, Pseudomonas aeruginosa PA01
acggcaucucgauggugaa

SEQ ID NO: 1408922 - RNA, 14 nt, Pseudomonas aeruginosa PA01
acggcccgccccgc

SEQ ID NO: 1408923 - RNA, 16 nt, Pseudomonas aeruginosa PA01
acggcccuccggcgcg

SEQ ID NO: 1408924 - RNA, 14 nt, Pseudomonas aeruginosa PA01
acggccagucgcgu

SEQ ID NO: 1408925 - RNA, 20 nt, Pseudomonas aeruginosa PA01
acggccaggccacggccggc

SEQ ID NO: 1408926 - RNA, 12 nt, Pseudomonas aeruginosa PA01
acggcgcauccc

SEQ ID NO: 1408927 - RNA, 16 nt, Pseudomonas aeruginosa PA01
acggcgauggucagga

SEQ ID NO: 1408928 - RNA, 18 nt, Pseudomonas aeruginosa PA01
acggcgcagccgcaaggc

SEQ ID NO: 1408929 - RNA, 14 nt, Pseudomonas aeruginosa PA01
acggcgaucgccgg

SEQ ID NO: 1408930 - RNA, 16 nt, Pseudomonas aeruginosa PA01
acggcgauacccaggc

SEQ ID NO: 1408931 - RNA, 19 nt, Pseudomonas aeruginosa PA01
acggcgcccucgggcgccg

SEQ ID NO: 1408932 - RNA, 13 nt, Pseudomonas aeruginosa PA01
acggcgcgaugga

SEQ ID NO: 1408933 - RNA, 22 nt, Pseudomonas aeruginosa PA01
acggcggauugacgauggccag

SEQ ID NO: 1408934 - RNA, 14 nt, Pseudomonas aeruginosa PA01
acggcggcaacgac

SEQ ID NO: 1408935 - RNA, 13 nt, Pseudomonas aeruginosa PA01
acggcgcuggucu

SEQ ID NO: 1408936 - RNA, 18 nt, Pseudomonas aeruginosa PA01
acggcggaauuccugcuc

SEQ ID NO: 1408937 - RNA, 15 nt, Pseudomonas aeruginosa PA01
acggcgcgucggcgg

SEQ ID NO: 1408938 - RNA, 16 nt, Pseudomonas aeruginosa PA01
acggcgcgucggcggu

SEQ ID NO: 1408939 - RNA, 16 nt, Pseudomonas aeruginosa PA01
acggcgcgucuccaug

SEQ ID NO: 1408940 - RNA, 15 nt, Pseudomonas aeruginosa PA01
acggcgcggugaggg

SEQ ID NO: 1408941 - RNA, 21 nt, Pseudomonas aeruginosa PA01
acggcgcggugagggcgacgu

SEQ ID NO: 1408942 - RNA, 17 nt, Pseudomonas aeruginosa PA01
acggcgcgcuccggcgc

SEQ ID NO: 1408943 - RNA, 18 nt, Pseudomonas aeruginosa PA01
acggcgcggaacaucgcc

SEQ ID NO: 1408944 - RNA, 13 nt, Pseudomonas aeruginosa PA01
acggccggggcgg

SEQ ID NO: 1408945 - RNA, 20 nt, Pseudomonas aeruginosa PA01
acggccucgcgugcgcuggu

SEQ ID NO: 1408946 - RNA, 21 nt, Pseudomonas aeruginosa PA01
acggccucgcgugcgcuggua

SEQ ID NO: 1408947 - RNA, 22 nt, Pseudomonas aeruginosa PA01
acggccggcucgguguaggcga

SEQ ID NO: 1408948 - RNA, 21 nt, Pseudomonas aeruginosa PA01
acggccgucccagguuggcga

SEQ ID NO: 1408949 - RNA, 16 nt, Pseudomonas aeruginosa PA01
acggccuccgguggcg

SEQ ID NO: 1408950 - RNA, 17 nt, Pseudomonas aeruginosa PA01
acggcgaacaccgggcc

SEQ ID NO: 1408951 - RNA, 21 nt, Pseudomonas aeruginosa PA01
acggcgaacaccgggccgccg

SEQ ID NO: 1408952 - RNA, 23 nt, Pseudomonas aeruginosa PA01
acggcgaacaccgggccgccggc

SEQ ID NO: 1408953 - RNA, 21 nt, Pseudomonas aeruginosa PA01
acggcgaaaccggccagcgcg

SEQ ID NO: 1408954 - RNA, 13 nt, Pseudomonas aeruginosa PA01
acggccuucggca

SEQ ID NO: 1408955 - RNA, 22 nt, Pseudomonas aeruginosa PA01
acggccuuggucucgcgggcga

SEQ ID NO: 1408956 - RNA, 19 nt, Pseudomonas aeruginosa PA01
acggcgacccgaaggucgc

SEQ ID NO: 1408957 - RNA, 22 nt, Pseudomonas aeruginosa PA01
acggcgacccgaaggucgccgu

SEQ ID NO: 1408958 - RNA, 14 nt, Pseudomonas aeruginosa PA01
acggcgacccgcac

SEQ ID NO: 1408959 - RNA, 22 nt, Pseudomonas aeruginosa PA01
acggcgacccuggggucgccgu

SEQ ID NO: 1408960 - RNA, 17 nt, Pseudomonas aeruginosa PA01
acggcgaagaacagcgg

SEQ ID NO: 1408961 - RNA, 13 nt, Pseudomonas aeruginosa PA01
acggcgaagccgc

SEQ ID NO: 1408962 - RNA, 20 nt, Pseudomonas aeruginosa PA01
acggcgaauucgucgccgcc

SEQ ID NO: 1408963 - RNA, 16 nt, Pseudomonas aeruginosa PA01
acggcgagacuaccga

SEQ ID NO: 1408964 - RNA, 17 nt, Pseudomonas aeruginosa PA01
acggcgagagcgccgac

SEQ ID NO: 1408965 - RNA, 18 nt, Pseudomonas aeruginosa PA01
acgggacuuuccgaagcc

SEQ ID NO: 1408966 - RNA, 15 nt, Pseudomonas aeruginosa PA01
acgggacgccaggcg

SEQ ID NO: 1408967 - RNA, 17 nt, Pseudomonas aeruginosa PA01
acgggcaucgucgaagg

SEQ ID NO: 1408968 - RNA, 14 nt, Pseudomonas aeruginosa PA01
acggcuugccggua

SEQ ID NO: 1408969 - RNA, 21 nt, Pseudomonas aeruginosa PA01
acggcuugccgguagggcgaa

SEQ ID NO: 1408970 - RNA, 16 nt, Pseudomonas aeruginosa PA01
acggcggcgaccccga

SEQ ID NO: 1408971 - RNA, 20 nt, Pseudomonas aeruginosa PA01
acggcggccggauggccgcc

SEQ ID NO: 1408972 - RNA, 23 nt, Pseudomonas aeruginosa PA01
acggcggcggcggaccuccgcca

SEQ ID NO: 1408973 - RNA, 22 nt, Pseudomonas aeruginosa PA01
acggcggguugaccccgagguc

SEQ ID NO: 1408974 - RNA, 22 nt, Pseudomonas aeruginosa PA01
acggguguuucggccgcugccg

SEQ ID NO: 1408975 - RNA, 15 nt, Pseudomonas aeruginosa PA01
acgggucgucgcccu

SEQ ID NO: 1408976 - RNA, 21 nt, Pseudomonas aeruginosa PA01
acgggugcugaagauaucgcc

SEQ ID NO: 1408977 - RNA, 23 nt, Pseudomonas aeruginosa PA01
acgggugcugaagauaucgccuu

SEQ ID NO: 1408978 - RNA, 16 nt, Pseudomonas aeruginosa PA01
acgggcgacccaggcc

SEQ ID NO: 1408979 - RNA, 17 nt, Pseudomonas aeruginosa PA01
acgggcgacccaggccg

SEQ ID NO: 1408980 - RNA, 19 nt, Pseudomonas aeruginosa PA01
acgggcgacccaggccgac

SEQ ID NO: 1408981 - RNA, 14 nt, Pseudomonas aeruginosa PA01
acgggcgccagcgg

SEQ ID NO: 1408982 - RNA, 16 nt, Pseudomonas aeruginosa PA01
acgggcgccagcgguu

SEQ ID NO: 1408983 - RNA, 13 nt, Pseudomonas aeruginosa PA01
acgggcgccaggg

SEQ ID NO: 1408984 - RNA, 13 nt, Pseudomonas aeruginosa PA01
acgggcguugccg

SEQ ID NO: 1408985 - RNA, 14 nt, Pseudomonas aeruginosa PA01
acgggcguugccgg

SEQ ID NO: 1408986 - RNA, 13 nt, Pseudomonas aeruginosa PA01
acgggccuguuga

SEQ ID NO: 1408987 - RNA, 23 nt, Pseudomonas aeruginosa PA01
acgucgagaccgaccgacuuggc

SEQ ID NO: 1408988 - RNA, 16 nt, Pseudomonas aeruginosa PA01
acgucgacuucgucga

SEQ ID NO: 1408989 - RNA, 17 nt, Pseudomonas aeruginosa PA01
acgucgacuucgucgaa

SEQ ID NO: 1408990 - RNA, 14 nt, Pseudomonas aeruginosa PA01
acgucggcgcgcau

SEQ ID NO: 1408991 - RNA, 12 nt, Pseudomonas aeruginosa PA01
acgucggcgucc

SEQ ID NO: 1408992 - RNA, 22 nt, Pseudomonas aeruginosa PA01
acgucggcguccauggcggcga

SEQ ID NO: 1408993 - RNA, 23 nt, Pseudomonas aeruginosa PA01
acgucgaucugcucguccaggcc

SEQ ID NO: 1408994 - RNA, 14 nt, Pseudomonas aeruginosa PA01
acgucgauauugcc

SEQ ID NO: 1408995 - RNA, 22 nt, Pseudomonas aeruginosa PA01
acgucgaggaaggccaggucgc

SEQ ID NO: 1408996 - RNA, 18 nt, Pseudomonas aeruginosa PA01
acguaguugacccgcccc

SEQ ID NO: 1408997 - RNA, 17 nt, Pseudomonas aeruginosa PA01
acguaggagccggccag

SEQ ID NO: 1408998 - RNA, 13 nt, Pseudomonas aeruginosa PA01
acguaggcggcga

SEQ ID NO: 1408999 - RNA, 12 nt, Pseudomonas aeruginosa PA01
acggugaccuug

SEQ ID NO: 1409000 - RNA, 17 nt, Pseudomonas aeruginosa PA01
acggugaaccaggcgcc

SEQ ID NO: 1409001 - RNA, 14 nt, Pseudomonas aeruginosa PA01
acggugacacccug

SEQ ID NO: 1409002 - RNA, 15 nt, Pseudomonas aeruginosa PA01
acguagaugccggug

SEQ ID NO: 1409003 - RNA, 13 nt, Pseudomonas aeruginosa PA01
acguagccggcgu

SEQ ID NO: 1409004 - RNA, 17 nt, Pseudomonas aeruginosa PA01
acgguagcccgcggcga

SEQ ID NO: 1409005 - RNA, 22 nt, Pseudomonas aeruginosa PA01
acggucuugcgcuugccggccg

SEQ ID NO: 1409006 - RNA, 18 nt, Pseudomonas aeruginosa PA01
acguucaguucugggcgg

SEQ ID NO: 1409007 - RNA, 17 nt, Pseudomonas aeruginosa PA01
acgucgguucagcgcgg

SEQ ID NO: 1409008 - RNA, 16 nt, Pseudomonas aeruginosa PA01
acgucguacucggcgg

SEQ ID NO: 1409009 - RNA, 18 nt, Pseudomonas aeruginosa PA01
acgucguagccaggcacc

SEQ ID NO: 1409010 - RNA, 13 nt, Pseudomonas aeruginosa PA01
acgugccccaggc

SEQ ID NO: 1409011 - RNA, 19 nt, Pseudomonas aeruginosa PA01
acgugccccaggccgaacu

SEQ ID NO: 1409012 - RNA, 17 nt, Pseudomonas aeruginosa PA01
acgucguuucucggcga

SEQ ID NO: 1409013 - RNA, 21 nt, Pseudomonas aeruginosa PA01
acgucguuucucggcgauggc

SEQ ID NO: 1409014 - RNA, 19 nt, Pseudomonas aeruginosa PA01
acguuggccgucuccaggc

SEQ ID NO: 1409015 - RNA, 17 nt, Pseudomonas aeruginosa PA01
acguucugcccgccggc

SEQ ID NO: 1409016 - RNA, 18 nt, Pseudomonas aeruginosa PA01
acguucugcccgccggcg

SEQ ID NO: 1409017 - RNA, 14 nt, Pseudomonas aeruginosa PA01
acguucugcucgcu

SEQ ID NO: 1409018 - RNA, 18 nt, Pseudomonas aeruginosa PA01
acguucugcucgcugccc

SEQ ID NO: 1409019 - RNA, 23 nt, Pseudomonas aeruginosa PA01
acguugcugugcugcaccagcag

SEQ ID NO: 1409020 - RNA, 22 nt, Pseudomonas aeruginosa PA01
acugaagagugggcgggguaau

SEQ ID NO: 1409021 - RNA, 13 nt, Pseudomonas aeruginosa PA01
acucgccgaccag

SEQ ID NO: 1409022 - RNA, 18 nt, Pseudomonas aeruginosa PA01
acucgccgggcgucugcc

SEQ ID NO: 1409023 - RNA, 20 nt, Pseudomonas aeruginosa PA01
acucgccgggcgucugcccg

SEQ ID NO: 1409024 - RNA, 11 nt, Pseudomonas aeruginosa PA01
acucgccggca

SEQ ID NO: 1409025 - RNA, 17 nt, Pseudomonas aeruginosa PA01
acucgccggcgaucucc

SEQ ID NO: 1409026 - RNA, 17 nt, Pseudomonas aeruginosa PA01
acucgcgaucgaucggc

SEQ ID NO: 1409027 - RNA, 18 nt, Pseudomonas aeruginosa PA01
acucgcgagauggcgucg

SEQ ID NO: 1409028 - RNA, 13 nt, Pseudomonas aeruginosa PA01
acucgcgagcugg

SEQ ID NO: 1409029 - RNA, 17 nt, Pseudomonas aeruginosa PA01
acucgcgagcuggcgcc

SEQ ID NO: 1409030 - RNA, 20 nt, Pseudomonas aeruginosa PA01
acucgcgagcuggcgccguc

SEQ ID NO: 1409031 - RNA, 15 nt, Pseudomonas aeruginosa PA01
acucgcugggcgccg

SEQ ID NO: 1409032 - RNA, 17 nt, Pseudomonas aeruginosa PA01
acucgcugggcgccggc

SEQ ID NO: 1409033 - RNA, 16 nt, Pseudomonas aeruginosa PA01
acucgcgggcgcgcag

SEQ ID NO: 1409034 - RNA, 21 nt, Pseudomonas aeruginosa PA01
acucgcuccuccgggcgugcc

SEQ ID NO: 1409035 - RNA, 23 nt, Pseudomonas aeruginosa PA01
acugccugcagguagcgcugcgc

SEQ ID NO: 1409036 - RNA, 14 nt, Pseudomonas aeruginosa PA01
acugccuggcaggu

SEQ ID NO: 1409037 - RNA, 20 nt, Pseudomonas aeruginosa PA01
acugccgcuaucgcuggcgc

SEQ ID NO: 1409038 - RNA, 21 nt, Pseudomonas aeruginosa PA01
acugccgcuaucgcuggcgca

SEQ ID NO: 1409039 - RNA, 22 nt, Pseudomonas aeruginosa PA01
acugccgggccagcuccagcac

SEQ ID NO: 1409040 - RNA, 17 nt, Pseudomonas aeruginosa PA01
acugccggucggccuug

SEQ ID NO: 1409041 - RNA, 19 nt, Pseudomonas aeruginosa PA01
acugcgcccccagcgcccg

SEQ ID NO: 1409042 - RNA, 23 nt, Pseudomonas aeruginosa PA01
acugcgccaguuccuucgccgaa

SEQ ID NO: 1409043 - RNA, 13 nt, Pseudomonas aeruginosa PA01
acugccgcccgcu

SEQ ID NO: 1409044 - RNA, 22 nt, Pseudomonas aeruginosa PA01
acugcgagccgacuuccagcuu

SEQ ID NO: 1409045 - RNA, 22 nt, Pseudomonas aeruginosa PA01
acugcgauggaacgagcgcgac

SEQ ID NO: 1409046 - RNA, 13 nt, Pseudomonas aeruginosa PA01
acugcccggcucg

SEQ ID NO: 1409047 - RNA, 13 nt, Pseudomonas aeruginosa PA01
acugccgaugguc

SEQ ID NO: 1409048 - RNA, 16 nt, Pseudomonas aeruginosa PA01
acugccgacggcggcg

SEQ ID NO: 1409049 - RNA, 17 nt, Pseudomonas aeruginosa PA01
acugcccagcgccgcca

SEQ ID NO: 1409050 - RNA, 21 nt, Pseudomonas aeruginosa PA01
acugccaggagcacgccgugc

SEQ ID NO: 1409051 - RNA, 19 nt, Pseudomonas aeruginosa PA01
acucccugcucgcgcaggg

SEQ ID NO: 1409052 - RNA, 17 nt, Pseudomonas aeruginosa PA01
acucccguccagcgcuu

SEQ ID NO: 1409053 - RNA, 12 nt, Pseudomonas aeruginosa PA01
acucccggccug

SEQ ID NO: 1409054 - RNA, 14 nt, Pseudomonas aeruginosa PA01
acuccggcaggcgc

SEQ ID NO: 1409055 - RNA, 17 nt, Pseudomonas aeruginosa PA01
acuccgagggccgcgcc

SEQ ID NO: 1409056 - RNA, 18 nt, Pseudomonas aeruginosa PA01
acuccgagggccgcgccg

SEQ ID NO: 1409057 - RNA, 20 nt, Pseudomonas aeruginosa PA01
acuccgagggccgcgccgac

SEQ ID NO: 1409058 - RNA, 20 nt, Pseudomonas aeruginosa PA01
acuccgccacccgcuccggc

SEQ ID NO: 1409059 - RNA, 12 nt, Pseudomonas aeruginosa PA01
acuccgccagca

SEQ ID NO: 1409060 - RNA, 23 nt, Pseudomonas aeruginosa PA01
acuccgcccaguucuucgccgcc

SEQ ID NO: 1409061 - RNA, 20 nt, Pseudomonas aeruginosa PA01
acuccgccgcuuccgccggc

SEQ ID NO: 1409062 - RNA, 16 nt, Pseudomonas aeruginosa PA01
acuccggugucaggcc

SEQ ID NO: 1409063 - RNA, 18 nt, Pseudomonas aeruginosa PA01
acuccggugucaggccga

SEQ ID NO: 1409064 - RNA, 19 nt, Pseudomonas aeruginosa PA01
acucgcagccgcgcucggc

SEQ ID NO: 1409065 - RNA, 15 nt, Pseudomonas aeruginosa PA01
acucgccagcgcgcg

SEQ ID NO: 1409066 - RNA, 15 nt, Pseudomonas aeruginosa PA01
acucgaucagcgcgg

SEQ ID NO: 1409067 - RNA, 18 nt, Pseudomonas aeruginosa PA01
acucgaugaaaccggccu

SEQ ID NO: 1409068 - RNA, 15 nt, Pseudomonas aeruginosa PA01
acucgaugaacagcg

SEQ ID NO: 1409069 - RNA, 15 nt, Pseudomonas aeruginosa PA01
acucgaugaacgccc

SEQ ID NO: 1409070 - RNA, 17 nt, Pseudomonas aeruginosa PA01
acucgaugaacgcccug

SEQ ID NO: 1409071 - RNA, 21 nt, Pseudomonas aeruginosa PA01
acucgacgcgccaggugcgcu

SEQ ID NO: 1409072 - RNA, 21 nt, Pseudomonas aeruginosa PA01
acucgaaggccagcucgucgc

SEQ ID NO: 1409073 - RNA, 14 nt, Pseudomonas aeruginosa PA01
acuccccagcaggc

SEQ ID NO: 1409074 - RNA, 15 nt, Pseudomonas aeruginosa PA01
acuccaucucgcggc

SEQ ID NO: 1409075 - RNA, 16 nt, Pseudomonas aeruginosa PA01
acuccaucucgcggcg

SEQ ID NO: 1409076 - RNA, 22 nt, Pseudomonas aeruginosa PA01
acuccaggcggcgguagccgag

SEQ ID NO: 1409077 - RNA, 16 nt, Pseudomonas aeruginosa PA01
acuccagcgggguggc

SEQ ID NO: 1409078 - RNA, 19 nt, Pseudomonas aeruginosa PA01
acuccacgaggaugucggc

SEQ ID NO: 1409079 - RNA, 16 nt, Pseudomonas aeruginosa PA01
acuccagagccauggg

SEQ ID NO: 1409080 - RNA, 18 nt, Pseudomonas aeruginosa PA01
acuccagauagugcggcc

SEQ ID NO: 1409081 - RNA, 23 nt, Pseudomonas aeruginosa PA01
acuccagauagugcggccaggcg

SEQ ID NO: 1409082 - RNA, 15 nt, Pseudomonas aeruginosa PA01
acucaugaccgccgc

SEQ ID NO: 1409083 - RNA, 15 nt, Pseudomonas aeruginosa PA01
acucaugcaggccga

SEQ ID NO: 1409084 - RNA, 15 nt, Pseudomonas aeruginosa PA01
acuagcccucgaccu

SEQ ID NO: 1409085 - RNA, 16 nt, Pseudomonas aeruginosa PA01
acuagcccucgaccug

SEQ ID NO: 1409086 - RNA, 17 nt, Pseudomonas aeruginosa PA01
acucaucaggcugccga

SEQ ID NO: 1409087 - RNA, 23 nt, Pseudomonas aeruginosa PA01
accugaacgcgcccggccaggcc

SEQ ID NO: 1409088 - RNA, 16 nt, Pseudomonas aeruginosa PA01
accugaccaucgucgc

SEQ ID NO: 1409089 - RNA, 18 nt, Pseudomonas aeruginosa PA01
accugcaacacgucggac

SEQ ID NO: 1409090 - RNA, 13 nt, Pseudomonas aeruginosa PA01
accugcaacgccc

SEQ ID NO: 1409091 - RNA, 17 nt, Pseudomonas aeruginosa PA01
accugcaacucggcguc

SEQ ID NO: 1409092 - RNA, 22 nt, Pseudomonas aeruginosa PA01
accugcaaggcggugaccagcg

SEQ ID NO: 1409093 - RNA, 22 nt, Pseudomonas aeruginosa PA01
accugcaugcuuuugaacacca

SEQ ID NO: 1409094 - RNA, 20 nt, Pseudomonas aeruginosa PA01
accugcaucacguacggcgc

SEQ ID NO: 1409095 - RNA, 12 nt, Pseudomonas aeruginosa PA01
accugccgcccg

SEQ ID NO: 1409096 - RNA, 16 nt, Pseudomonas aeruginosa PA01
accugccgcccggcca

SEQ ID NO: 1409097 - RNA, 13 nt, Pseudomonas aeruginosa PA01
accugccgaucgc

SEQ ID NO: 1409098 - RNA, 17 nt, Pseudomonas aeruginosa PA01
accugccgaucgccgcg

SEQ ID NO: 1409099 - RNA, 19 nt, Pseudomonas aeruginosa PA01
accugccccgggcgccggg

SEQ ID NO: 1409100 - RNA, 19 nt, Pseudomonas aeruginosa PA01
accugcgaauugcgcugga

SEQ ID NO: 1409101 - RNA, 23 nt, Pseudomonas aeruginosa PA01
accugcgccccggucucgcgcag

SEQ ID NO: 1409102 - RNA, 17 nt, Pseudomonas aeruginosa PA01
accugccgguaguagcg

SEQ ID NO: 1409103 - RNA, 18 nt, Pseudomonas aeruginosa PA01
accucguugcaggcacgg

SEQ ID NO: 1409104 - RNA, 19 nt, Pseudomonas aeruginosa PA01
accucguuucccggcgcgg

SEQ ID NO: 1409105 - RNA, 16 nt, Pseudomonas aeruginosa PA01
accucuggcugaagac

SEQ ID NO: 1409106 - RNA, 19 nt, Pseudomonas aeruginosa PA01
accucgggcagcuuggcgg

SEQ ID NO: 1409107 - RNA, 23 nt, Pseudomonas aeruginosa PA01
accucguauuccacgucgccgac

SEQ ID NO: 1409108 - RNA, 20 nt, Pseudomonas aeruginosa PA01
accucggcgccauaggccag

SEQ ID NO: 1409109 - RNA, 23 nt, Pseudomonas aeruginosa PA01
accucggcgccauaggccagcac

SEQ ID NO: 1409110 - RNA, 20 nt, Pseudomonas aeruginosa PA01
accucggguuuggcgcccgc

SEQ ID NO: 1409111 - RNA, 20 nt, Pseudomonas aeruginosa PA01
accucggaccagaggcugac

SEQ ID NO: 1409112 - RNA, 21 nt, Pseudomonas aeruginosa PA01
accucgcugacuuccaucagc

SEQ ID NO: 1409113 - RNA, 14 nt, Pseudomonas aeruginosa PA01
accucagaccacgc

SEQ ID NO: 1409114 - RNA, 16 nt, Pseudomonas aeruginosa PA01
accuccuguucgcgcg

SEQ ID NO: 1409115 - RNA, 12 nt, Pseudomonas aeruginosa PA01
accucgaccgcg

SEQ ID NO: 1409116 - RNA, 15 nt, Pseudomonas aeruginosa PA01
accucgaccgcgccg

SEQ ID NO: 1409117 - RNA, 16 nt, Pseudomonas aeruginosa PA01
accucgaccgcgccgg

SEQ ID NO: 1409118 - RNA, 17 nt, Pseudomonas aeruginosa PA01
accucgaccgcgccggc

SEQ ID NO: 1409119 - RNA, 19 nt, Pseudomonas aeruginosa PA01
accucgaccgcgccggcga

SEQ ID NO: 1409120 - RNA, 13 nt, Pseudomonas aeruginosa PA01
accucgacggcga

SEQ ID NO: 1409121 - RNA, 20 nt, Pseudomonas aeruginosa PA01
accucgaagcccagcgccug

SEQ ID NO: 1409122 - RNA, 19 nt, Pseudomonas aeruginosa PA01
accucgagcaggccgagga

SEQ ID NO: 1409123 - RNA, 17 nt, Pseudomonas aeruginosa PA01
accucgccaagcuggcg

SEQ ID NO: 1409124 - RNA, 22 nt, Pseudomonas aeruginosa PA01
accucgauggcguguucgucga

SEQ ID NO: 1409125 - RNA, 15 nt, Pseudomonas aeruginosa PA01
accucgauggcggcg

SEQ ID NO: 1409126 - RNA, 13 nt, Pseudomonas aeruginosa PA01
accucgauggcga

SEQ ID NO: 1409127 - RNA, 14 nt, Pseudomonas aeruginosa PA01
accucgaaccccug

SEQ ID NO: 1409128 - RNA, 16 nt, Pseudomonas aeruginosa PA01
accucgaaccccuggc

SEQ ID NO: 1409129 - RNA, 18 nt, Pseudomonas aeruginosa PA01
accucgaaccccuggcgc

SEQ ID NO: 1409130 - RNA, 22 nt, Pseudomonas aeruginosa PA01
accucgaaccccuggcgcucga

SEQ ID NO: 1409131 - RNA, 20 nt, Pseudomonas aeruginosa PA01
accuccuugggaucggcgau

SEQ ID NO: 1409132 - RNA, 14 nt, Pseudomonas aeruginosa PA01
accuccuggcgcgu

SEQ ID NO: 1409133 - RNA, 17 nt, Pseudomonas aeruginosa PA01
accuccggcgccaggcc

SEQ ID NO: 1409134 - RNA, 20 nt, Pseudomonas aeruginosa PA01
accuccucgaugaaacgcag

SEQ ID NO: 1409135 - RNA, 13 nt, Pseudomonas aeruginosa PA01
accuccagccggc

SEQ ID NO: 1409136 - RNA, 16 nt, Pseudomonas aeruginosa PA01
accuccagggccagcu

SEQ ID NO: 1409137 - RNA, 13 nt, Pseudomonas aeruginosa PA01
accuccgccagga

SEQ ID NO: 1409138 - RNA, 16 nt, Pseudomonas aeruginosa PA01
accuccgccaggaccu

SEQ ID NO: 1409139 - RNA, 13 nt, Pseudomonas aeruginosa PA01
accuccgccaggu

SEQ ID NO: 1409140 - RNA, 12 nt, Pseudomonas aeruginosa PA01
accuccgccgcu

SEQ ID NO: 1409141 - RNA, 19 nt, Pseudomonas aeruginosa PA01
accugguccgucucgucga

SEQ ID NO: 1409142 - RNA, 16 nt, Pseudomonas aeruginosa PA01
accuguugcagagcgg

SEQ ID NO: 1409143 - RNA, 24 nt, Pseudomonas aeruginosa PA01
accuguugcagagcggccaggucg

SEQ ID NO: 1409144 - RNA, 20 nt, Pseudomonas aeruginosa PA01
accuugccguugcucacgcc

SEQ ID NO: 1409145 - RNA, 16 nt, Pseudomonas aeruginosa PA01
accuugcgaaaagccc

SEQ ID NO: 1409146 - RNA, 17 nt, Pseudomonas aeruginosa PA01
accuugcgcaccgccug

SEQ ID NO: 1409147 - RNA, 14 nt, Pseudomonas aeruginosa PA01
accuugcggccguu

SEQ ID NO: 1409148 - RNA, 23 nt, Pseudomonas aeruginosa PA01
accuugcgucuucgccgaugcgc

SEQ ID NO: 1409149 - RNA, 22 nt, Pseudomonas aeruginosa PA01
accuugccgacgccgcggccgg

SEQ ID NO: 1409150 - RNA, 18 nt, Pseudomonas aeruginosa PA01
accuugcccucggcgccc

SEQ ID NO: 1409151 - RNA, 17 nt, Pseudomonas aeruginosa PA01
accuucaucaggcggca

SEQ ID NO: 1409152 - RNA, 19 nt, Pseudomonas aeruginosa PA01
accuucagauacuccagca

SEQ ID NO: 1409153 - RNA, 19 nt, Pseudomonas aeruginosa PA01
accuucagcaccugcgccg

SEQ ID NO: 1409154 - RNA, 14 nt, Pseudomonas aeruginosa PA01
accuucaggcugcu

SEQ ID NO: 1409155 - RNA, 17 nt, Pseudomonas aeruginosa PA01
accugguccaacgggcu

SEQ ID NO: 1409156 - RNA, 14 nt, Pseudomonas aeruginosa PA01
accuggucgccgaa

SEQ ID NO: 1409157 - RNA, 21 nt, Pseudomonas aeruginosa PA01
accuggggcggccucaggccu

SEQ ID NO: 1409158 - RNA, 17 nt, Pseudomonas aeruginosa PA01
accuggguugccgcgcc

SEQ ID NO: 1409159 - RNA, 19 nt, Pseudomonas aeruginosa PA01
accuggguugccgcgccga

SEQ ID NO: 1409160 - RNA, 22 nt, Pseudomonas aeruginosa PA01
accugguagcagagggucgcca

SEQ ID NO: 1409161 - RNA, 23 nt, Pseudomonas aeruginosa PA01
accugguagcagagggucgccag

SEQ ID NO: 1409162 - RNA, 20 nt, Pseudomonas aeruginosa PA01
accugggcguuggccagcgc

SEQ ID NO: 1409163 - RNA, 23 nt, Pseudomonas aeruginosa PA01
accugggcguuggccagcgccac

SEQ ID NO: 1409164 - RNA, 20 nt, Pseudomonas aeruginosa PA01
accuggcuccacugcuuggc

SEQ ID NO: 1409165 - RNA, 20 nt, Pseudomonas aeruginosa PA01
accuggcucuguuccucggc

SEQ ID NO: 1409166 - RNA, 22 nt, Pseudomonas aeruginosa PA01
accuggcucuguuccucggcgg

SEQ ID NO: 1409167 - RNA, 15 nt, Pseudomonas aeruginosa PA01
accuggcugaggcgu

SEQ ID NO: 1409168 - RNA, 19 nt, Pseudomonas aeruginosa PA01
accuggcugaggcguucca

SEQ ID NO: 1409169 - RNA, 23 nt, Pseudomonas aeruginosa PA01
accuggcugaggcguuccaguuc

SEQ ID NO: 1409170 - RNA, 23 nt, Pseudomonas aeruginosa PA01
accuggcgcucgccgugggaguc

SEQ ID NO: 1409171 - RNA, 22 nt, Pseudomonas aeruginosa PA01
accuggcgcugaacaagcccug

SEQ ID NO: 1409172 - RNA, 20 nt, Pseudomonas aeruginosa PA01
accuggcggucgccgccggc

SEQ ID NO: 1409173 - RNA, 22 nt, Pseudomonas aeruginosa PA01
accuggcggucgccgccggcga

SEQ ID NO: 1409174 - RNA, 14 nt, Pseudomonas aeruginosa PA01
accuggccgucccu

SEQ ID NO: 1409175 - RNA, 16 nt, Pseudomonas aeruginosa PA01
accuggcgaugcccug

SEQ ID NO: 1409176 - RNA, 21 nt, Pseudomonas aeruginosa PA01
accuggcagguaucgcugggc

SEQ ID NO: 1409177 - RNA, 18 nt, Pseudomonas aeruginosa PA01
accuggcagugcgccggc

SEQ ID NO: 1409178 - RNA, 13 nt, Pseudomonas aeruginosa PA01
accuggccacgcc

SEQ ID NO: 1409179 - RNA, 18 nt, Pseudomonas aeruginosa PA01
accuggccacgcccggug

SEQ ID NO: 1409180 - RNA, 19 nt, Pseudomonas aeruginosa PA01
accuggccgcguucgccga

SEQ ID NO: 1409181 - RNA, 20 nt, Pseudomonas aeruginosa PA01
accuggccgcguucgccgag

SEQ ID NO: 1409182 - RNA, 12 nt, Pseudomonas aeruginosa PA01
accuggccggcg

SEQ ID NO: 1409183 - RNA, 16 nt, Pseudomonas aeruginosa PA01
accuggccggcgaccu

SEQ ID NO: 1409184 - RNA, 16 nt, Pseudomonas aeruginosa PA01
accuggauaucaccuc

SEQ ID NO: 1409185 - RNA, 16 nt, Pseudomonas aeruginosa PA01
accuggaucgccaggc

SEQ ID NO: 1409186 - RNA, 14 nt, Pseudomonas aeruginosa PA01
accuggauggugcc

SEQ ID NO: 1409187 - RNA, 18 nt, Pseudomonas aeruginosa PA01
accugcuugggcgccucg

SEQ ID NO: 1409188 - RNA, 23 nt, Pseudomonas aeruginosa PA01
accugcuugggcgccucgccgcg

SEQ ID NO: 1409189 - RNA, 17 nt, Pseudomonas aeruginosa PA01
accugcugggccagcgc

SEQ ID NO: 1409190 - RNA, 13 nt, Pseudomonas aeruginosa PA01
accugcugcccgg

SEQ ID NO: 1409191 - RNA, 13 nt, Pseudomonas aeruginosa PA01
accugcucgucga

SEQ ID NO: 1409192 - RNA, 18 nt, Pseudomonas aeruginosa PA01
accugcucgcgcaccgcg

SEQ ID NO: 1409193 - RNA, 22 nt, Pseudomonas aeruginosa PA01
accugcucgcgcaccgcggcca

SEQ ID NO: 1409194 - RNA, 21 nt, Pseudomonas aeruginosa PA01
accugcucacggccgaacaga

SEQ ID NO: 1409195 - RNA, 16 nt, Pseudomonas aeruginosa PA01
accugcggugucccuu

SEQ ID NO: 1409196 - RNA, 13 nt, Pseudomonas aeruginosa PA01
accugcggguggc

SEQ ID NO: 1409197 - RNA, 14 nt, Pseudomonas aeruginosa PA01
acgacgaagcgccg

SEQ ID NO: 1409198 - RNA, 15 nt, Pseudomonas aeruginosa PA01
acgacgaagcgccgg

SEQ ID NO: 1409199 - RNA, 16 nt, Pseudomonas aeruginosa PA01
acgacgaagcgccggc

SEQ ID NO: 1409200 - RNA, 18 nt, Pseudomonas aeruginosa PA01
acgacgaagcgccggcgg

SEQ ID NO: 1409201 - RNA, 15 nt, Pseudomonas aeruginosa PA01
acgacgaaaggccgc

SEQ ID NO: 1409202 - RNA, 22 nt, Pseudomonas aeruginosa PA01
acgaccgguagccaugaucacg

SEQ ID NO: 1409203 - RNA, 17 nt, Pseudomonas aeruginosa PA01
acgaccgcccaggcugc

SEQ ID NO: 1409204 - RNA, 21 nt, Pseudomonas aeruginosa PA01
acgaccgcccaggcugccgcc

SEQ ID NO: 1409205 - RNA, 23 nt, Pseudomonas aeruginosa PA01
acgaccgcccaggcugccgccgc

SEQ ID NO: 1409206 - RNA, 13 nt, Pseudomonas aeruginosa PA01
acgacucgucgcc

SEQ ID NO: 1409207 - RNA, 20 nt, Pseudomonas aeruginosa PA01
acgacugcggcagcuuggcg

SEQ ID NO: 1409208 - RNA, 14 nt, Pseudomonas aeruginosa PA01
acgacucacccgcu

SEQ ID NO: 1409209 - RNA, 12 nt, Pseudomonas aeruginosa PA01
acgacuccagcu

SEQ ID NO: 1409210 - RNA, 18 nt, Pseudomonas aeruginosa PA01
accuugggguguccgauu

SEQ ID NO: 1409211 - RNA, 22 nt, Pseudomonas aeruginosa PA01
accuuggugaugaagucggcgu

SEQ ID NO: 1409212 - RNA, 14 nt, Pseudomonas aeruginosa PA01
accuuguacggcag

SEQ ID NO: 1409213 - RNA, 20 nt, Pseudomonas aeruginosa PA01
accuuguacggcagcggcgu

SEQ ID NO: 1409214 - RNA, 18 nt, Pseudomonas aeruginosa PA01
accuuggugucgaugccg

SEQ ID NO: 1409215 - RNA, 17 nt, Pseudomonas aeruginosa PA01
accuuguccaggcgcug

SEQ ID NO: 1409216 - RNA, 18 nt, Pseudomonas aeruginosa PA01
accuuguccuggccggcg

SEQ ID NO: 1409217 - RNA, 17 nt, Pseudomonas aeruginosa PA01
acgaaguuggcggccga

SEQ ID NO: 1409218 - RNA, 19 nt, Pseudomonas aeruginosa PA01
acgaagugaccgcgcgcca

SEQ ID NO: 1409219 - RNA, 22 nt, Pseudomonas aeruginosa PA01
acgaagugauggaagagcgccg

SEQ ID NO: 1409220 - RNA, 18 nt, Pseudomonas aeruginosa PA01
acgaaguugagcaccggc

SEQ ID NO: 1409221 - RNA, 19 nt, Pseudomonas aeruginosa PA01
acgaaguugagcaccggca

SEQ ID NO: 1409222 - RNA, 14 nt, Pseudomonas aeruginosa PA01
acgacaacccugac

SEQ ID NO: 1409223 - RNA, 16 nt, Pseudomonas aeruginosa PA01
acgaccacaucggcca

SEQ ID NO: 1409224 - RNA, 16 nt, Pseudomonas aeruginosa PA01
acgacccugcuggccg

SEQ ID NO: 1409225 - RNA, 18 nt, Pseudomonas aeruginosa PA01
acgacccugcuggccggu

SEQ ID NO: 1409226 - RNA, 21 nt, Pseudomonas aeruginosa PA01
acgcgcggaccuucgacggca

SEQ ID NO: 1409227 - RNA, 18 nt, Pseudomonas aeruginosa PA01
acgcgcgcucucgccggc

SEQ ID NO: 1409228 - RNA, 20 nt, Pseudomonas aeruginosa PA01
acgcgccgcgguuuccgugc

SEQ ID NO: 1409229 - RNA, 16 nt, Pseudomonas aeruginosa PA01
acgcgcccggccaggc

SEQ ID NO: 1409230 - RNA, 17 nt, Pseudomonas aeruginosa PA01
acgcgcccggccaggcc

SEQ ID NO: 1409231 - RNA, 18 nt, Pseudomonas aeruginosa PA01
acgcgccaggugcgcugg

SEQ ID NO: 1409232 - RNA, 13 nt, Pseudomonas aeruginosa PA01
acgcgcaggccgg

SEQ ID NO: 1409233 - RNA, 14 nt, Pseudomonas aeruginosa PA01
acgcgcaggccggu

SEQ ID NO: 1409234 - RNA, 17 nt, Pseudomonas aeruginosa PA01
acgcgcaggccggugau

SEQ ID NO: 1409235 - RNA, 13 nt, Pseudomonas aeruginosa PA01
acgcgcagcgccg

SEQ ID NO: 1409236 - RNA, 15 nt, Pseudomonas aeruginosa PA01
acgcgcagcgccgcc

SEQ ID NO: 1409237 - RNA, 21 nt, Pseudomonas aeruginosa PA01
acgcgcacgucaccguccuuc

SEQ ID NO: 1409238 - RNA, 16 nt, Pseudomonas aeruginosa PA01
acgcgcaugucgaggu

SEQ ID NO: 1409239 - RNA, 22 nt, Pseudomonas aeruginosa PA01
acgcgcauccguuugggaucgg

SEQ ID NO: 1409240 - RNA, 15 nt, Pseudomonas aeruginosa PA01
acgcgccacgcagga

SEQ ID NO: 1409241 - RNA, 16 nt, Pseudomonas aeruginosa PA01
acgcgccacgcaggaa

SEQ ID NO: 1409242 - RNA, 12 nt, Pseudomonas aeruginosa PA01
acgccuggcggc

SEQ ID NO: 1409243 - RNA, 16 nt, Pseudomonas aeruginosa PA01
acgccuggcggcuggc

SEQ ID NO: 1409244 - RNA, 18 nt, Pseudomonas aeruginosa PA01
acgccuggcggcuggcgu

SEQ ID NO: 1409245 - RNA, 23 nt, Pseudomonas aeruginosa PA01
acgccuggugcaggucgcgcggc

SEQ ID NO: 1409246 - RNA, 20 nt, Pseudomonas aeruginosa PA01
acgccuguggcguuauucgc

SEQ ID NO: 1409247 - RNA, 21 nt, Pseudomonas aeruginosa PA01
acgccguuguugaccgcagga

SEQ ID NO: 1409248 - RNA, 14 nt, Pseudomonas aeruginosa PA01
acgccuauggcguu

SEQ ID NO: 1409249 - RNA, 19 nt, Pseudomonas aeruginosa PA01
acgccucgcagagcgccag

SEQ ID NO: 1409250 - RNA, 21 nt, Pseudomonas aeruginosa PA01
acgccucgcagagcgccagcc

SEQ ID NO: 1409251 - RNA, 14 nt, Pseudomonas aeruginosa PA01
acgcgcaagccagc

SEQ ID NO: 1409252 - RNA, 14 nt, Pseudomonas aeruginosa PA01
acgcgauauccgcc

SEQ ID NO: 1409253 - RNA, 18 nt, Pseudomonas aeruginosa PA01
acgcgauauccgccaggc

SEQ ID NO: 1409254 - RNA, 24 nt, Pseudomonas aeruginosa PA01
acgccuugcagcaccgccuggucg

SEQ ID NO: 1409255 - RNA, 16 nt, Pseudomonas aeruginosa PA01
acgcgaggagaucggc

SEQ ID NO: 1409256 - RNA, 17 nt, Pseudomonas aeruginosa PA01
acgccuuccagaucguc

SEQ ID NO: 1409257 - RNA, 19 nt, Pseudomonas aeruginosa PA01
acgccuuccagaucgucuu

SEQ ID NO: 1409258 - RNA, 14 nt, Pseudomonas aeruginosa PA01
acgccuucguggcc

SEQ ID NO: 1409259 - RNA, 17 nt, Pseudomonas aeruginosa PA01
acgccuucguggccgcg

SEQ ID NO: 1409260 - RNA, 20 nt, Pseudomonas aeruginosa PA01
acgccggccggcucagcgcu

SEQ ID NO: 1409261 - RNA, 14 nt, Pseudomonas aeruginosa PA01
acgccguuggcguu

SEQ ID NO: 1409262 - RNA, 14 nt, Pseudomonas aeruginosa PA01
acgccggccucgcg

SEQ ID NO: 1409263 - RNA, 17 nt, Pseudomonas aeruginosa PA01
acgccggccucgcgcaa

SEQ ID NO: 1409264 - RNA, 13 nt, Pseudomonas aeruginosa PA01
acgccggccucgc

SEQ ID NO: 1409265 - RNA, 12 nt, Pseudomonas aeruginosa PA01
acgccggcaggu

SEQ ID NO: 1409266 - RNA, 22 nt, Pseudomonas aeruginosa PA01
acgccggcccgugcccguccua

SEQ ID NO: 1409267 - RNA, 19 nt, Pseudomonas aeruginosa PA01
acgccggacgcaccagcag

SEQ ID NO: 1409268 - RNA, 23 nt, Pseudomonas aeruginosa PA01
acgccgcugucguccagcgggua

SEQ ID NO: 1409269 - RNA, 17 nt, Pseudomonas aeruginosa PA01
acgccgcccgucgcgcc

SEQ ID NO: 1409270 - RNA, 22 nt, Pseudomonas aeruginosa PA01
acgccgcccgucgcgccggcca

SEQ ID NO: 1409271 - RNA, 18 nt, Pseudomonas aeruginosa PA01
acgccgcggaaggcccgc

SEQ ID NO: 1409272 - RNA, 22 nt, Pseudomonas aeruginosa PA01
acgccgcggaaggcccgcgagc

SEQ ID NO: 1409273 - RNA, 15 nt, Pseudomonas aeruginosa PA01
acgccgcggccggcg

SEQ ID NO: 1409274 - RNA, 22 nt, Pseudomonas aeruginosa PA01
acgccgcggguuccucacggcg

SEQ ID NO: 1409275 - RNA, 23 nt, Pseudomonas aeruginosa PA01
acgccgcggguuccucacggcgc

SEQ ID NO: 1409276 - RNA, 13 nt, Pseudomonas aeruginosa PA01
acgccgcggcuga

SEQ ID NO: 1409277 - RNA, 21 nt, Pseudomonas aeruginosa PA01
acgccgcuggaaccggccggc

SEQ ID NO: 1409278 - RNA, 16 nt, Pseudomonas aeruginosa PA01
acgccgcuggcggcgc

SEQ ID NO: 1409279 - RNA, 21 nt, Pseudomonas aeruginosa PA01
acgccgcuggcguuauucgcc

SEQ ID NO: 1409280 - RNA, 18 nt, Pseudomonas aeruginosa PA01
acgccgcucuaucagggu

SEQ ID NO: 1409281 - RNA, 18 nt, Pseudomonas aeruginosa PA01
acgccgcucugcccgacc

SEQ ID NO: 1409282 - RNA, 19 nt, Pseudomonas aeruginosa PA01
acgccgcucugcccgaccg

SEQ ID NO: 1409283 - RNA, 20 nt, Pseudomonas aeruginosa PA01
acgccgagcugaccaccagg

SEQ ID NO: 1409284 - RNA, 19 nt, Pseudomonas aeruginosa PA01
acgccgagcagcaccaggc

SEQ ID NO: 1409285 - RNA, 17 nt, Pseudomonas aeruginosa PA01
acgccgagggcgcggcg

SEQ ID NO: 1409286 - RNA, 23 nt, Pseudomonas aeruginosa PA01
acgccgagggcgcggcgccagcg

SEQ ID NO: 1409287 - RNA, 18 nt, Pseudomonas aeruginosa PA01
acgccgagaacgcggcga

SEQ ID NO: 1409288 - RNA, 14 nt, Pseudomonas aeruginosa PA01
acgccgagcagcac

SEQ ID NO: 1409289 - RNA, 20 nt, Pseudomonas aeruginosa PA01
acgccgacccuagggucggc

SEQ ID NO: 1409290 - RNA, 16 nt, Pseudomonas aeruginosa PA01
acgccgacaggccggu

SEQ ID NO: 1409291 - RNA, 22 nt, Pseudomonas aeruginosa PA01
acgccgacaggccggugccgcc

SEQ ID NO: 1409292 - RNA, 16 nt, Pseudomonas aeruginosa PA01
acgccgccccagccuc

SEQ ID NO: 1409293 - RNA, 18 nt, Pseudomonas aeruginosa PA01
acgccgcccccagcgcgc

SEQ ID NO: 1409294 - RNA, 22 nt, Pseudomonas aeruginosa PA01
acgccgcccccagcgcgccgcc

SEQ ID NO: 1409295 - RNA, 15 nt, Pseudomonas aeruginosa PA01
acgccgcagcucggc

SEQ ID NO: 1409296 - RNA, 13 nt, Pseudomonas aeruginosa PA01
acgccgaucaccc

SEQ ID NO: 1409297 - RNA, 14 nt, Pseudomonas aeruginosa PA01
acgccgauaccggc

SEQ ID NO: 1409298 - RNA, 20 nt, Pseudomonas aeruginosa PA01
acgccgauaccggccucgau

SEQ ID NO: 1409299 - RNA, 18 nt, Pseudomonas aeruginosa PA01
acgccgaucccggcggcg

SEQ ID NO: 1409300 - RNA, 20 nt, Pseudomonas aeruginosa PA01
acgccgaucccggcggcgac

SEQ ID NO: 1409301 - RNA, 17 nt, Pseudomonas aeruginosa PA01
acgagccgcugcggcuc

SEQ ID NO: 1409302 - RNA, 16 nt, Pseudomonas aeruginosa PA01
acgaggaugucggcga

SEQ ID NO: 1409303 - RNA, 13 nt, Pseudomonas aeruginosa PA01
acgaggaaggcgc

SEQ ID NO: 1409304 - RNA, 22 nt, Pseudomonas aeruginosa PA01
acgaggaaggcgcgcaccagcg

SEQ ID NO: 1409305 - RNA, 16 nt, Pseudomonas aeruginosa PA01
acgagcagcucgccgg

SEQ ID NO: 1409306 - RNA, 19 nt, Pseudomonas aeruginosa PA01
acgacugcacgcagacguc

SEQ ID NO: 1409307 - RNA, 17 nt, Pseudomonas aeruginosa PA01
acgagccgagcaggcca

SEQ ID NO: 1409308 - RNA, 17 nt, Pseudomonas aeruginosa PA01
acgagccgcgacgcgac

SEQ ID NO: 1409309 - RNA, 16 nt, Pseudomonas aeruginosa PA01
acgaugguggucggca

SEQ ID NO: 1409310 - RNA, 13 nt, Pseudomonas aeruginosa PA01
acgaucugcgccg

SEQ ID NO: 1409311 - RNA, 16 nt, Pseudomonas aeruginosa PA01
acgaucucaucgccca

SEQ ID NO: 1409312 - RNA, 15 nt, Pseudomonas aeruginosa PA01
acgaucucccgcgau

SEQ ID NO: 1409313 - RNA, 17 nt, Pseudomonas aeruginosa PA01
acgcaccaccaggucga

SEQ ID NO: 1409314 - RNA, 21 nt, Pseudomonas aeruginosa PA01
acgcagagcggcaggccgccg

SEQ ID NO: 1409315 - RNA, 22 nt, Pseudomonas aeruginosa PA01
acgcagagcggcaggccgccga

SEQ ID NO: 1409316 - RNA, 17 nt, Pseudomonas aeruginosa PA01
acgcaccagcucccggc

SEQ ID NO: 1409317 - RNA, 14 nt, Pseudomonas aeruginosa PA01
acgcagccgggccg

SEQ ID NO: 1409318 - RNA, 18 nt, Pseudomonas aeruginosa PA01
acgcagccgggccgcagc

SEQ ID NO: 1409319 - RNA, 16 nt, Pseudomonas aeruginosa PA01
acgcagccacccgcgg

SEQ ID NO: 1409320 - RNA, 18 nt, Pseudomonas aeruginosa PA01
acgcagcaugucgucgaa

SEQ ID NO: 1409321 - RNA, 18 nt, Pseudomonas aeruginosa PA01
acgcagcagcuucggcgc

SEQ ID NO: 1409322 - RNA, 13 nt, Pseudomonas aeruginosa PA01
acgcagcaggcga

SEQ ID NO: 1409323 - RNA, 17 nt, Pseudomonas aeruginosa PA01
acgcagcagagguagag

SEQ ID NO: 1409324 - RNA, 17 nt, Pseudomonas aeruginosa PA01
acgcaauagugcagcuc

SEQ ID NO: 1409325 - RNA, 17 nt, Pseudomonas aeruginosa PA01
acgcaagugcccugggc

SEQ ID NO: 1409326 - RNA, 22 nt, Pseudomonas aeruginosa PA01
acgauguuguugcccaccagcg

SEQ ID NO: 1409327 - RNA, 17 nt, Pseudomonas aeruginosa PA01
acgcaagcgcucggccu

SEQ ID NO: 1409328 - RNA, 13 nt, Pseudomonas aeruginosa PA01
acgccagggugcu

SEQ ID NO: 1409329 - RNA, 12 nt, Pseudomonas aeruginosa PA01
acgccaggccgc

SEQ ID NO: 1409330 - RNA, 13 nt, Pseudomonas aeruginosa PA01
acgccaggcgucc

SEQ ID NO: 1409331 - RNA, 19 nt, Pseudomonas aeruginosa PA01
acgccaggcugucagggcg

SEQ ID NO: 1409332 - RNA, 20 nt, Pseudomonas aeruginosa PA01
acgccaggcugucagggcgc

SEQ ID NO: 1409333 - RNA, 17 nt, Pseudomonas aeruginosa PA01
acgcccagcagggccag

SEQ ID NO: 1409334 - RNA, 17 nt, Pseudomonas aeruginosa PA01
acgccccuccuucgagc

SEQ ID NO: 1409335 - RNA, 23 nt, Pseudomonas aeruginosa PA01
acgccccuccuucgagccuggcc

SEQ ID NO: 1409336 - RNA, 16 nt, Pseudomonas aeruginosa PA01
acgccccgucgacgca

SEQ ID NO: 1409337 - RNA, 21 nt, Pseudomonas aeruginosa PA01
acgcccgcggcguuauccgcc

SEQ ID NO: 1409338 - RNA, 21 nt, Pseudomonas aeruginosa PA01
acgcccgaggcguuauccgcc

SEQ ID NO: 1409339 - RNA, 22 nt, Pseudomonas aeruginosa PA01
acgccccguuugccgucggcgc

SEQ ID NO: 1409340 - RNA, 15 nt, Pseudomonas aeruginosa PA01
acgcccgccguggcg

SEQ ID NO: 1409341 - RNA, 15 nt, Pseudomonas aeruginosa PA01
acgccgaacccgccu

SEQ ID NO: 1409342 - RNA, 20 nt, Pseudomonas aeruginosa PA01
acgcccgcuugcgccgccuc

SEQ ID NO: 1409343 - RNA, 17 nt, Pseudomonas aeruginosa PA01
acgcccggcacucgccg

SEQ ID NO: 1409344 - RNA, 21 nt, Pseudomonas aeruginosa PA01
acgcccggcacucgccgggcg

SEQ ID NO: 1409345 - RNA, 21 nt, Pseudomonas aeruginosa PA01
acgcccggcagaugccgggcg

SEQ ID NO: 1409346 - RNA, 13 nt, Pseudomonas aeruginosa PA01
acgcccggcaucu

SEQ ID NO: 1409347 - RNA, 15 nt, Pseudomonas aeruginosa PA01
acgccgaaguccugc

SEQ ID NO: 1409348 - RNA, 16 nt, Pseudomonas aeruginosa PA01
acgccgaagucggcga

SEQ ID NO: 1409349 - RNA, 17 nt, Pseudomonas aeruginosa PA01
acgccgaagucggcgag

SEQ ID NO: 1409350 - RNA, 13 nt, Pseudomonas aeruginosa PA01
acgccgaaguucu

SEQ ID NO: 1409351 - RNA, 24 nt, Pseudomonas aeruginosa PA01
acgccagcggcgaucgccuggucg

SEQ ID NO: 1409352 - RNA, 13 nt, Pseudomonas aeruginosa PA01
acgccacccgcau

SEQ ID NO: 1409353 - RNA, 12 nt, Pseudomonas aeruginosa PA01
acgccagcccuc

SEQ ID NO: 1409354 - RNA, 16 nt, Pseudomonas aeruginosa PA01
acgccagcccucgccc

SEQ ID NO: 1409355 - RNA, 14 nt, Pseudomonas aeruginosa PA01
acgccacaggcguu

SEQ ID NO: 1409356 - RNA, 13 nt, Pseudomonas aeruginosa PA01
acgccaccaggcc

SEQ ID NO: 1409357 - RNA, 15 nt, Pseudomonas aeruginosa PA01
acgccaccaggccgc

SEQ ID NO: 1409358 - RNA, 23 nt, Pseudomonas aeruginosa PA01
acgccaccaggccgcugccgccg

SEQ ID NO: 1409359 - RNA, 16 nt, Pseudomonas aeruginosa PA01
acgcaguuccgcggcg

SEQ ID NO: 1409360 - RNA, 23 nt, Pseudomonas aeruginosa PA01
acgcauagcgcgcuguagccggc

SEQ ID NO: 1409361 - RNA, 20 nt, Pseudomonas aeruginosa PA01
acagcaccacgccgcuggcg

SEQ ID NO: 1409362 - RNA, 23 nt, Pseudomonas aeruginosa PA01
acacugauauccgcucuguaggg

SEQ ID NO: 1409363 - RNA, 21 nt, Pseudomonas aeruginosa PA01
acagccaggggcacgcuggcg

SEQ ID NO: 1409364 - RNA, 23 nt, Pseudomonas aeruginosa PA01
acagccaggggcacgcuggcgag

SEQ ID NO: 1409365 - RNA, 19 nt, Pseudomonas aeruginosa PA01
acagccaguaguccuccgc

SEQ ID NO: 1409366 - RNA, 16 nt, Pseudomonas aeruginosa PA01
acagccauagcgccgg

SEQ ID NO: 1409367 - RNA, 17 nt, Pseudomonas aeruginosa PA01
acagccauagcgccggc

SEQ ID NO: 1409368 - RNA, 19 nt, Pseudomonas aeruginosa PA01
acagccauagugcugggcg

SEQ ID NO: 1409369 - RNA, 21 nt, Pseudomonas aeruginosa PA01
acagccauagugcugggcgac

SEQ ID NO: 1409370 - RNA, 13 nt, Pseudomonas aeruginosa PA01
acagcacgucgau

SEQ ID NO: 1409371 - RNA, 16 nt, Pseudomonas aeruginosa PA01
acagcagcaagccgau

SEQ ID NO: 1409372 - RNA, 19 nt, Pseudomonas aeruginosa PA01
acagcacgcucaggcagcg

SEQ ID NO: 1409373 - RNA, 18 nt, Pseudomonas aeruginosa PA01
acagcgcgucgcggucuu

SEQ ID NO: 1409374 - RNA, 21 nt, Pseudomonas aeruginosa PA01
acagcgccuggucggcggccu

SEQ ID NO: 1409375 - RNA, 14 nt, Pseudomonas aeruginosa PA01
acagcgccgcgcgc

SEQ ID NO: 1409376 - RNA, 16 nt, Pseudomonas aeruginosa PA01
acagcgccgcgcgcuu

SEQ ID NO: 1409377 - RNA, 13 nt, Pseudomonas aeruginosa PA01
acagcgccagcgg

SEQ ID NO: 1409378 - RNA, 15 nt, Pseudomonas aeruginosa PA01
acagcgccagcggca

SEQ ID NO: 1409379 - RNA, 17 nt, Pseudomonas aeruginosa PA01
acagcgccagcggcagc

SEQ ID NO: 1409380 - RNA, 16 nt, Pseudomonas aeruginosa PA01
acagcgaagcuggcgc

SEQ ID NO: 1409381 - RNA, 18 nt, Pseudomonas aeruginosa PA01
acagcgacucgcugccgg

SEQ ID NO: 1409382 - RNA, 15 nt, Pseudomonas aeruginosa PA01
acagcgagaccucgc

SEQ ID NO: 1409383 - RNA, 19 nt, Pseudomonas aeruginosa PA01
acagcgagaccucgcccau

SEQ ID NO: 1409384 - RNA, 20 nt, Pseudomonas aeruginosa PA01
acagcgaggcccgcgccgcc

SEQ ID NO: 1409385 - RNA, 14 nt, Pseudomonas aeruginosa PA01
acagccccagccuc

SEQ ID NO: 1409386 - RNA, 17 nt, Pseudomonas aeruginosa PA01
acacccugccgcgccgg

SEQ ID NO: 1409387 - RNA, 19 nt, Pseudomonas aeruginosa PA01
acacccugcugcugcucag

SEQ ID NO: 1409388 - RNA, 21 nt, Pseudomonas aeruginosa PA01
acaccgaucaccuggccggug

SEQ ID NO: 1409389 - RNA, 21 nt, Pseudomonas aeruginosa PA01
acaccgaugccgaaggcgugg

SEQ ID NO: 1409390 - RNA, 23 nt, Pseudomonas aeruginosa PA01
acaccgaccgcgaguucgccggc

SEQ ID NO: 1409391 - RNA, 19 nt, Pseudomonas aeruginosa PA01
acaccgaacuuccgccgaa

SEQ ID NO: 1409392 - RNA, 18 nt, Pseudomonas aeruginosa PA01
acaccgaagucgcccgcc

SEQ ID NO: 1409393 - RNA, 20 nt, Pseudomonas aeruginosa PA01
acaccgaagucgcccgccgg

SEQ ID NO: 1409394 - RNA, 23 nt, Pseudomonas aeruginosa PA01
acaccgcgcggcacagcguggcc

SEQ ID NO: 1409395 - RNA, 13 nt, Pseudomonas aeruginosa PA01
acaccgcgguguc

SEQ ID NO: 1409396 - RNA, 16 nt, Pseudomonas aeruginosa PA01
acacgcccggcacucg

SEQ ID NO: 1409397 - RNA, 13 nt, Pseudomonas aeruginosa PA01
acacgcaggcgcc

SEQ ID NO: 1409398 - RNA, 20 nt, Pseudomonas aeruginosa PA01
acacgccccagaagccccag

SEQ ID NO: 1409399 - RNA, 18 nt, Pseudomonas aeruginosa PA01
acacgcuucugcuggccg

SEQ ID NO: 1409400 - RNA, 20 nt, Pseudomonas aeruginosa PA01
acacgcuucugcuggccgcg

SEQ ID NO: 1409401 - RNA, 17 nt, Pseudomonas aeruginosa PA01
acaccguacucguugac

SEQ ID NO: 1409402 - RNA, 21 nt, Pseudomonas aeruginosa PA01
acaccguggaaaccucgccga

SEQ ID NO: 1409403 - RNA, 18 nt, Pseudomonas aeruginosa PA01
acaacccggcgcuggccg

SEQ ID NO: 1409404 - RNA, 20 nt, Pseudomonas aeruginosa PA01
acaacccggcgcuggccgcg

SEQ ID NO: 1409405 - RNA, 22 nt, Pseudomonas aeruginosa PA01
acaacccuguccccucacggcg

SEQ ID NO: 1409406 - RNA, 14 nt, Pseudomonas aeruginosa PA01
acaagggccagagc

SEQ ID NO: 1409407 - RNA, 17 nt, Pseudomonas aeruginosa PA01
acaagcgcaacgcgcgc

SEQ ID NO: 1409408 - RNA, 14 nt, Pseudomonas aeruginosa PA01
acaacgccuuccuu

SEQ ID NO: 1409409 - RNA, 13 nt, Pseudomonas aeruginosa PA01
acaacgccgccgg

SEQ ID NO: 1409410 - RNA, 21 nt, Pseudomonas aeruginosa PA01
acaacgccgccggcguuaucc

SEQ ID NO: 1409411 - RNA, 23 nt, Pseudomonas aeruginosa PA01
acaaucuugucguucggcccgac

SEQ ID NO: 1409412 - RNA, 13 nt, Pseudomonas aeruginosa PA01
acaaucccagcuc

SEQ ID NO: 1409413 - RNA, 14 nt, Pseudomonas aeruginosa PA01
acaaucagcggcgg

SEQ ID NO: 1409414 - RNA, 13 nt, Pseudomonas aeruginosa PA01
accaacagccggc

SEQ ID NO: 1409415 - RNA, 16 nt, Pseudomonas aeruginosa PA01
acaugcccgcgcgcau

SEQ ID NO: 1409416 - RNA, 15 nt, Pseudomonas aeruginosa PA01
acaucuccaggccgc

SEQ ID NO: 1409417 - RNA, 14 nt, Pseudomonas aeruginosa PA01
acaugcaccaccug

SEQ ID NO: 1409418 - RNA, 13 nt, Pseudomonas aeruginosa PA01
acaugcaccaggc

SEQ ID NO: 1409419 - RNA, 17 nt, Pseudomonas aeruginosa PA01
acaugcaccaggccgcc

SEQ ID NO: 1409420 - RNA, 19 nt, Pseudomonas aeruginosa PA01
acaugcaccaggccgccau

SEQ ID NO: 1409421 - RNA, 13 nt, Pseudomonas aeruginosa PA01
acaugcaggccgg

SEQ ID NO: 1409422 - RNA, 17 nt, Pseudomonas aeruginosa PA01
acaugcaggccggccuc

SEQ ID NO: 1409423 - RNA, 16 nt, Pseudomonas aeruginosa PA01
acaugcaggcucucgc

SEQ ID NO: 1409424 - RNA, 13 nt, Pseudomonas aeruginosa PA01
acauacaggcgcg

SEQ ID NO: 1409425 - RNA, 18 nt, Pseudomonas aeruginosa PA01
acauccaguguggcggcg

SEQ ID NO: 1409426 - RNA, 19 nt, Pseudomonas aeruginosa PA01
acauccggccaugucccgg

SEQ ID NO: 1409427 - RNA, 19 nt, Pseudomonas aeruginosa PA01
acauccugucgaggccucg

SEQ ID NO: 1409428 - RNA, 16 nt, Pseudomonas aeruginosa PA01
acaucgucugcgcggc

SEQ ID NO: 1409429 - RNA, 17 nt, Pseudomonas aeruginosa PA01
acaucgucugcgcggcg

SEQ ID NO: 1409430 - RNA, 21 nt, Pseudomonas aeruginosa PA01
acaucgaccaggucgccaugc

SEQ ID NO: 1409431 - RNA, 16 nt, Pseudomonas aeruginosa PA01
acaucguugaacucgc

SEQ ID NO: 1409432 - RNA, 14 nt, Pseudomonas aeruginosa PA01
acaguucggcgagu

SEQ ID NO: 1409433 - RNA, 15 nt, Pseudomonas aeruginosa PA01
acaguucaggcuggg

SEQ ID NO: 1409434 - RNA, 18 nt, Pseudomonas aeruginosa PA01
acaguggguaggccaggc

SEQ ID NO: 1409435 - RNA, 13 nt, Pseudomonas aeruginosa PA01
acagugccaggcu

SEQ ID NO: 1409436 - RNA, 14 nt, Pseudomonas aeruginosa PA01
acagugccaggcuc

SEQ ID NO: 1409437 - RNA, 20 nt, Pseudomonas aeruginosa PA01
acagugccaggcucgccgcc

SEQ ID NO: 1409438 - RNA, 19 nt, Pseudomonas aeruginosa PA01
acaguuggacugcgaggcg

SEQ ID NO: 1409439 - RNA, 13 nt, Pseudomonas aeruginosa PA01
acagcggcuggcg

SEQ ID NO: 1409440 - RNA, 15 nt, Pseudomonas aeruginosa PA01
acagcggcuggcgcu

SEQ ID NO: 1409441 - RNA, 23 nt, Pseudomonas aeruginosa PA01
acagcgggucgcggcuggccgcc

SEQ ID NO: 1409442 - RNA, 14 nt, Pseudomonas aeruginosa PA01
acagcgggucggcg

SEQ ID NO: 1409443 - RNA, 12 nt, Pseudomonas aeruginosa PA01
accacuccagcg

SEQ ID NO: 1409444 - RNA, 14 nt, Pseudomonas aeruginosa PA01
accacucgccagcg

SEQ ID NO: 1409445 - RNA, 15 nt, Pseudomonas aeruginosa PA01
accacucgccagcgc

SEQ ID NO: 1409446 - RNA, 22 nt, Pseudomonas aeruginosa PA01
accacucgccagcgcgcgccga

SEQ ID NO: 1409447 - RNA, 18 nt, Pseudomonas aeruginosa PA01
accacguugcgccgcagc

SEQ ID NO: 1409448 - RNA, 17 nt, Pseudomonas aeruginosa PA01
accacuucggcgguggg

SEQ ID NO: 1409449 - RNA, 14 nt, Pseudomonas aeruginosa PA01
accagcagggccag

SEQ ID NO: 1409450 - RNA, 16 nt, Pseudomonas aeruginosa PA01
accagcagggccagca

SEQ ID NO: 1409451 - RNA, 22 nt, Pseudomonas aeruginosa PA01
accagcagggccagcagcgcug

SEQ ID NO: 1409452 - RNA, 17 nt, Pseudomonas aeruginosa PA01
accagcagggccaggcc

SEQ ID NO: 1409453 - RNA, 20 nt, Pseudomonas aeruginosa PA01
accagcagggccaggccgag

SEQ ID NO: 1409454 - RNA, 14 nt, Pseudomonas aeruginosa PA01
accagcaggaagcc

SEQ ID NO: 1409455 - RNA, 19 nt, Pseudomonas aeruginosa PA01
accagcaggaagccgacca

SEQ ID NO: 1409456 - RNA, 19 nt, Pseudomonas aeruginosa PA01
accagcaggcgcaaccaga

SEQ ID NO: 1409457 - RNA, 11 nt, Pseudomonas aeruginosa PA01
accagcagggu

SEQ ID NO: 1409458 - RNA, 13 nt, Pseudomonas aeruginosa PA01
accagcagcgccg

SEQ ID NO: 1409459 - RNA, 14 nt, Pseudomonas aeruginosa PA01
accagcagcggcag

SEQ ID NO: 1409460 - RNA, 19 nt, Pseudomonas aeruginosa PA01
accagcagcggcucacgcc

SEQ ID NO: 1409461 - RNA, 23 nt, Pseudomonas aeruginosa PA01
accagcaggaucgagcccugguc

SEQ ID NO: 1409462 - RNA, 12 nt, Pseudomonas aeruginosa PA01
accagcaggccg

SEQ ID NO: 1409463 - RNA, 14 nt, Pseudomonas aeruginosa PA01
accagcagcagcgg

SEQ ID NO: 1409464 - RNA, 20 nt, Pseudomonas aeruginosa PA01
accagcagcaggucgucggc

SEQ ID NO: 1409465 - RNA, 15 nt, Pseudomonas aeruginosa PA01
accagaagccggccg

SEQ ID NO: 1409466 - RNA, 23 nt, Pseudomonas aeruginosa PA01
accagaagccggccgggugacgg

SEQ ID NO: 1409467 - RNA, 16 nt, Pseudomonas aeruginosa PA01
accagcggcgagcagg

SEQ ID NO: 1409468 - RNA, 17 nt, Pseudomonas aeruginosa PA01
accagcgaaagcgucag

SEQ ID NO: 1409469 - RNA, 22 nt, Pseudomonas aeruginosa PA01
accagcgaaagcgucagcgcgc

SEQ ID NO: 1409470 - RNA, 15 nt, Pseudomonas aeruginosa PA01
accagcgaaccgccg

SEQ ID NO: 1409471 - RNA, 14 nt, Pseudomonas aeruginosa PA01
accagcccggcggc

SEQ ID NO: 1409472 - RNA, 15 nt, Pseudomonas aeruginosa PA01
accagcccuggcgcg

SEQ ID NO: 1409473 - RNA, 22 nt, Pseudomonas aeruginosa PA01
accagccgaacaguucggcggu

SEQ ID NO: 1409474 - RNA, 16 nt, Pseudomonas aeruginosa PA01
accagcaggucggcgc

SEQ ID NO: 1409475 - RNA, 16 nt, Pseudomonas aeruginosa PA01
accagcaggucgaggu

SEQ ID NO: 1409476 - RNA, 15 nt, Pseudomonas aeruginosa PA01
accagcggcuggcug

SEQ ID NO: 1409477 - RNA, 23 nt, Pseudomonas aeruginosa PA01
accagcuucaaccguggcucgau

SEQ ID NO: 1409478 - RNA, 19 nt, Pseudomonas aeruginosa PA01
accagcucgaagccgccgu

SEQ ID NO: 1409479 - RNA, 13 nt, Pseudomonas aeruginosa PA01
accagcucggcgg

SEQ ID NO: 1409480 - RNA, 15 nt, Pseudomonas aeruginosa PA01
accagcucagcucca

SEQ ID NO: 1409481 - RNA, 23 nt, Pseudomonas aeruginosa PA01
accagcucagcuccaggccgcgg

SEQ ID NO: 1409482 - RNA, 15 nt, Pseudomonas aeruginosa PA01
accacaggcggcgga

SEQ ID NO: 1409483 - RNA, 22 nt, Pseudomonas aeruginosa PA01
accacaggcggcggaagaagcc

SEQ ID NO: 1409484 - RNA, 20 nt, Pseudomonas aeruginosa PA01
accaccggaccgggcgccuc

SEQ ID NO: 1409485 - RNA, 21 nt, Pseudomonas aeruginosa PA01
accaccggaccgggcgccucg

SEQ ID NO: 1409486 - RNA, 15 nt, Pseudomonas aeruginosa PA01
accacccuguccugc

SEQ ID NO: 1409487 - RNA, 13 nt, Pseudomonas aeruginosa PA01
accacccggugca

SEQ ID NO: 1409488 - RNA, 15 nt, Pseudomonas aeruginosa PA01
accacccggccgcgc

SEQ ID NO: 1409489 - RNA, 17 nt, Pseudomonas aeruginosa PA01
accacccggccgcgcuc

SEQ ID NO: 1409490 - RNA, 23 nt, Pseudomonas aeruginosa PA01
accacccggcgcacgccggccuc

SEQ ID NO: 1409491 - RNA, 13 nt, Pseudomonas aeruginosa PA01
accacccggcggu

SEQ ID NO: 1409492 - RNA, 17 nt, Pseudomonas aeruginosa PA01
accaccaugugcuggcg

SEQ ID NO: 1409493 - RNA, 18 nt, Pseudomonas aeruginosa PA01
accaccaugugcuggcgg

SEQ ID NO: 1409494 - RNA, 14 nt, Pseudomonas aeruginosa PA01
accaccaucgccgc

SEQ ID NO: 1409495 - RNA, 13 nt, Pseudomonas aeruginosa PA01
accaccaucaccg

SEQ ID NO: 1409496 - RNA, 14 nt, Pseudomonas aeruginosa PA01
accaccaucaccgc

SEQ ID NO: 1409497 - RNA, 15 nt, Pseudomonas aeruginosa PA01
accaccaucaccgcc

SEQ ID NO: 1409498 - RNA, 15 nt, Pseudomonas aeruginosa PA01
accacccgcagcccc

SEQ ID NO: 1409499 - RNA, 15 nt, Pseudomonas aeruginosa PA01
accaccggcuggcgg

SEQ ID NO: 1409500 - RNA, 22 nt, Pseudomonas aeruginosa PA01
accaccggcuggcggcucggcu

SEQ ID NO: 1409501 - RNA, 21 nt, Pseudomonas aeruginosa PA01
accaccgugaccagcauggcg

SEQ ID NO: 1409502 - RNA, 16 nt, Pseudomonas aeruginosa PA01
accaccgucuggcgca

SEQ ID NO: 1409503 - RNA, 20 nt, Pseudomonas aeruginosa PA01
accaccugcuugggcgccuc

SEQ ID NO: 1409504 - RNA, 21 nt, Pseudomonas aeruginosa PA01
accaccugcuugggcgccucg

SEQ ID NO: 1409505 - RNA, 20 nt, Pseudomonas aeruginosa PA01
accaccuggauggugcccgg

SEQ ID NO: 1409506 - RNA, 18 nt, Pseudomonas aeruginosa PA01
accaccguggcgccggcg

SEQ ID NO: 1409507 - RNA, 13 nt, Pseudomonas aeruginosa PA01
accaccucgccaa

SEQ ID NO: 1409508 - RNA, 15 nt, Pseudomonas aeruginosa PA01
accaccucgccaagc

SEQ ID NO: 1409509 - RNA, 16 nt, Pseudomonas aeruginosa PA01
accacggcgaagccgc

SEQ ID NO: 1409510 - RNA, 18 nt, Pseudomonas aeruginosa PA01
accacggcgaagccgcgc

SEQ ID NO: 1409511 - RNA, 12 nt, Pseudomonas aeruginosa PA01
accacggcgagg

SEQ ID NO: 1409512 - RNA, 16 nt, Pseudomonas aeruginosa PA01
accacguggccggcgc

SEQ ID NO: 1409513 - RNA, 18 nt, Pseudomonas aeruginosa PA01
accacguggccggcgcgg

SEQ ID NO: 1409514 - RNA, 18 nt, Pseudomonas aeruginosa PA01
accacgggaauggcggau

SEQ ID NO: 1409515 - RNA, 16 nt, Pseudomonas aeruginosa PA01
accggcaagcuccgcg

SEQ ID NO: 1409516 - RNA, 17 nt, Pseudomonas aeruginosa PA01
accggcaagcuccgcga

SEQ ID NO: 1409517 - RNA, 18 nt, Pseudomonas aeruginosa PA01
accggcaaggcggccuca

SEQ ID NO: 1409518 - RNA, 22 nt, Pseudomonas aeruginosa PA01
accggaucgcccuggcgccagc

SEQ ID NO: 1409519 - RNA, 14 nt, Pseudomonas aeruginosa PA01
accggaaccggggu

SEQ ID NO: 1409520 - RNA, 14 nt, Pseudomonas aeruginosa PA01
accgcuuccugggc

SEQ ID NO: 1409521 - RNA, 16 nt, Pseudomonas aeruginosa PA01
accgcuucgagcaccc

SEQ ID NO: 1409522 - RNA, 23 nt, Pseudomonas aeruginosa PA01
accgcuugcggucauccgccggc

SEQ ID NO: 1409523 - RNA, 21 nt, Pseudomonas aeruginosa PA01
accgcuucgcggaucaacgcc

SEQ ID NO: 1409524 - RNA, 20 nt, Pseudomonas aeruginosa PA01
accgcuucugugggcagcgg

SEQ ID NO: 1409525 - RNA, 17 nt, Pseudomonas aeruginosa PA01
accggaaaagaagccgc

SEQ ID NO: 1409526 - RNA, 17 nt, Pseudomonas aeruginosa PA01
accgcuuucaccagggu

SEQ ID NO: 1409527 - RNA, 16 nt, Pseudomonas aeruginosa PA01
accgcuuucagcgccg

SEQ ID NO: 1409528 - RNA, 19 nt, Pseudomonas aeruginosa PA01
accgcuuucagcgccgcuc

SEQ ID NO: 1409529 - RNA, 14 nt, Pseudomonas aeruginosa PA01
accgcgugggccgg

SEQ ID NO: 1409530 - RNA, 14 nt, Pseudomonas aeruginosa PA01
accgcguucaccgu

SEQ ID NO: 1409531 - RNA, 20 nt, Pseudomonas aeruginosa PA01
accgcguucaccguggcgcu

SEQ ID NO: 1409532 - RNA, 19 nt, Pseudomonas aeruginosa PA01
accgcucgucaggcgcuca

SEQ ID NO: 1409533 - RNA, 14 nt, Pseudomonas aeruginosa PA01
accgcucgccagau

SEQ ID NO: 1409534 - RNA, 15 nt, Pseudomonas aeruginosa PA01
accgcuccggcgccg

SEQ ID NO: 1409535 - RNA, 16 nt, Pseudomonas aeruginosa PA01
accgcucgaguucgcg

SEQ ID NO: 1409536 - RNA, 19 nt, Pseudomonas aeruginosa PA01
accgcuccccacucggcca

SEQ ID NO: 1409537 - RNA, 12 nt, Pseudomonas aeruginosa PA01
accgcucaagac

SEQ ID NO: 1409538 - RNA, 14 nt, Pseudomonas aeruginosa PA01
accgcgcgcgcaag

SEQ ID NO: 1409539 - RNA, 22 nt, Pseudomonas aeruginosa PA01
accgcgcgcgcaaggccgaaga

SEQ ID NO: 1409540 - RNA, 23 nt, Pseudomonas aeruginosa PA01
accgcgcgcgccugcaacguccu

SEQ ID NO: 1409541 - RNA, 11 nt, Pseudomonas aeruginosa PA01
accgcgcgcca

SEQ ID NO: 1409542 - RNA, 21 nt, Pseudomonas aeruginosa PA01
accgcgcgccugcaacgccag

SEQ ID NO: 1409543 - RNA, 23 nt, Pseudomonas aeruginosa PA01
accgcgcgccugcaacgccagca

SEQ ID NO: 1409544 - RNA, 16 nt, Pseudomonas aeruginosa PA01
accgcgccuuccagcc

SEQ ID NO: 1409545 - RNA, 17 nt, Pseudomonas aeruginosa PA01
accgcgccuuccagccc

SEQ ID NO: 1409546 - RNA, 19 nt, Pseudomonas aeruginosa PA01
accgcgccuuccagcccuu

SEQ ID NO: 1409547 - RNA, 22 nt, Pseudomonas aeruginosa PA01
accgcgcuugacgacugcacgc

SEQ ID NO: 1409548 - RNA, 17 nt, Pseudomonas aeruginosa PA01
accgcgcucggcgguca

SEQ ID NO: 1409549 - RNA, 17 nt, Pseudomonas aeruginosa PA01
accgcggaauccgcuuc

SEQ ID NO: 1409550 - RNA, 19 nt, Pseudomonas aeruginosa PA01
accgcggaauccgcuucgu

SEQ ID NO: 1409551 - RNA, 17 nt, Pseudomonas aeruginosa PA01
accggccucgacaucgu

SEQ ID NO: 1409552 - RNA, 23 nt, Pseudomonas aeruginosa PA01
accggccuuuuucaugggugcug

SEQ ID NO: 1409553 - RNA, 18 nt, Pseudomonas aeruginosa PA01
accggccugucacgccgg

SEQ ID NO: 1409554 - RNA, 19 nt, Pseudomonas aeruginosa PA01
accggccugucacgccggg

SEQ ID NO: 1409555 - RNA, 23 nt, Pseudomonas aeruginosa PA01
accggccugucacgccggggguc

SEQ ID NO: 1409556 - RNA, 13 nt, Pseudomonas aeruginosa PA01
accggcgcgccgg

SEQ ID NO: 1409557 - RNA, 21 nt, Pseudomonas aeruginosa PA01
accggcgcgccggacaggcca

SEQ ID NO: 1409558 - RNA, 18 nt, Pseudomonas aeruginosa PA01
accggcggauaacgccug

SEQ ID NO: 1409559 - RNA, 15 nt, Pseudomonas aeruginosa PA01
accggcgagcaacgc

SEQ ID NO: 1409560 - RNA, 14 nt, Pseudomonas aeruginosa PA01
accggcgaccaccg

SEQ ID NO: 1409561 - RNA, 19 nt, Pseudomonas aeruginosa PA01
accggcggcgccaggccgg

SEQ ID NO: 1409562 - RNA, 20 nt, Pseudomonas aeruginosa PA01
accggcuaucccccggccga

SEQ ID NO: 1409563 - RNA, 16 nt, Pseudomonas aeruginosa PA01
accggcucgucggcgu

SEQ ID NO: 1409564 - RNA, 17 nt, Pseudomonas aeruginosa PA01
accggcuccagggcgaa

SEQ ID NO: 1409565 - RNA, 16 nt, Pseudomonas aeruginosa PA01
accggcucucuucggc

SEQ ID NO: 1409566 - RNA, 21 nt, Pseudomonas aeruginosa PA01
accggcugcauguccgccagu

SEQ ID NO: 1409567 - RNA, 16 nt, Pseudomonas aeruginosa PA01
accgggcgggacucgc

SEQ ID NO: 1409568 - RNA, 19 nt, Pseudomonas aeruginosa PA01
accgggcgggacucgccgu

SEQ ID NO: 1409569 - RNA, 18 nt, Pseudomonas aeruginosa PA01
accgggcgccucgucgaa

SEQ ID NO: 1409570 - RNA, 17 nt, Pseudomonas aeruginosa PA01
accgggcggaucgccaa

SEQ ID NO: 1409571 - RNA, 17 nt, Pseudomonas aeruginosa PA01
accgggcggcaggcgcc

SEQ ID NO: 1409572 - RNA, 18 nt, Pseudomonas aeruginosa PA01
accgggcggcaggcgccg

SEQ ID NO: 1409573 - RNA, 19 nt, Pseudomonas aeruginosa PA01
accgggcggcaggcgccgg

SEQ ID NO: 1409574 - RNA, 13 nt, Pseudomonas aeruginosa PA01
accggcuggccgc

SEQ ID NO: 1409575 - RNA, 19 nt, Pseudomonas aeruginosa PA01
accgguaacuggccagggc

SEQ ID NO: 1409576 - RNA, 17 nt, Pseudomonas aeruginosa PA01
accggggugauccagcu

SEQ ID NO: 1409577 - RNA, 22 nt, Pseudomonas aeruginosa PA01
accggggugauccagcuggcgc

SEQ ID NO: 1409578 - RNA, 19 nt, Pseudomonas aeruginosa PA01
accgccgagggcgccaggu

SEQ ID NO: 1409579 - RNA, 22 nt, Pseudomonas aeruginosa PA01
accgccgagggcgccaggugca

SEQ ID NO: 1409580 - RNA, 13 nt, Pseudomonas aeruginosa PA01
accgccgccagca

SEQ ID NO: 1409581 - RNA, 12 nt, Pseudomonas aeruginosa PA01
accgccagcgca

SEQ ID NO: 1409582 - RNA, 17 nt, Pseudomonas aeruginosa PA01
accgccagcgucgccgc

SEQ ID NO: 1409583 - RNA, 20 nt, Pseudomonas aeruginosa PA01
accgccagacaggccagcuc

SEQ ID NO: 1409584 - RNA, 16 nt, Pseudomonas aeruginosa PA01
accgaccaguaccagc

SEQ ID NO: 1409585 - RNA, 17 nt, Pseudomonas aeruginosa PA01
accgacccucggcgagg

SEQ ID NO: 1409586 - RNA, 20 nt, Pseudomonas aeruginosa PA01
accgaccgcgaguucgccgg

SEQ ID NO: 1409587 - RNA, 21 nt, Pseudomonas aeruginosa PA01
accgaccgcgaguucgccggc

SEQ ID NO: 1409588 - RNA, 19 nt, Pseudomonas aeruginosa PA01
accgcagaagacgauggug

SEQ ID NO: 1409589 - RNA, 14 nt, Pseudomonas aeruginosa PA01
accgcagccggcga

SEQ ID NO: 1409590 - RNA, 14 nt, Pseudomonas aeruginosa PA01
accgcaucgcgguu

SEQ ID NO: 1409591 - RNA, 13 nt, Pseudomonas aeruginosa PA01
accgcaucgaagc

SEQ ID NO: 1409592 - RNA, 15 nt, Pseudomonas aeruginosa PA01
accgcaucgaagcgc

SEQ ID NO: 1409593 - RNA, 15 nt, Pseudomonas aeruginosa PA01
accgcaucgccaccg

SEQ ID NO: 1409594 - RNA, 15 nt, Pseudomonas aeruginosa PA01
accgcauagucgcga

SEQ ID NO: 1409595 - RNA, 15 nt, Pseudomonas aeruginosa PA01
accgcgccgggaagc

SEQ ID NO: 1409596 - RNA, 12 nt, Pseudomonas aeruginosa PA01
accgcgccggua

SEQ ID NO: 1409597 - RNA, 20 nt, Pseudomonas aeruginosa PA01
accgcgcauggcggcgaccg

SEQ ID NO: 1409598 - RNA, 23 nt, Pseudomonas aeruginosa PA01
accgcgcauggcggcgaccgcau

SEQ ID NO: 1409599 - RNA, 21 nt, Pseudomonas aeruginosa PA01
accgcgcagaugaucgccacc

SEQ ID NO: 1409600 - RNA, 23 nt, Pseudomonas aeruginosa PA01
accgcgcagaugaucgccaccgg

SEQ ID NO: 1409601 - RNA, 14 nt, Pseudomonas aeruginosa PA01
accgcgcagcguca

SEQ ID NO: 1409602 - RNA, 19 nt, Pseudomonas aeruginosa PA01
accgcgcagcgucaccgcg

SEQ ID NO: 1409603 - RNA, 17 nt, Pseudomonas aeruginosa PA01
accgcgaguucgccggc

SEQ ID NO: 1409604 - RNA, 18 nt, Pseudomonas aeruginosa PA01
accgcgaguucgccggcc

SEQ ID NO: 1409605 - RNA, 19 nt, Pseudomonas aeruginosa PA01
accgcgaguucgccggcca

SEQ ID NO: 1409606 - RNA, 19 nt, Pseudomonas aeruginosa PA01
accgcgcaaaccggcagca

SEQ ID NO: 1409607 - RNA, 13 nt, Pseudomonas aeruginosa PA01
accgcgacgcgcu

SEQ ID NO: 1409608 - RNA, 16 nt, Pseudomonas aeruginosa PA01
accgcgacgcgcugga

SEQ ID NO: 1409609 - RNA, 16 nt, Pseudomonas aeruginosa PA01
accgcgaauccgcggc

SEQ ID NO: 1409610 - RNA, 15 nt, Pseudomonas aeruginosa PA01
accgcgagcgccgcc

SEQ ID NO: 1409611 - RNA, 21 nt, Pseudomonas aeruginosa PA01
accgccucgaccaucggcggc

SEQ ID NO: 1409612 - RNA, 16 nt, Pseudomonas aeruginosa PA01
accgccucgaccccgg

SEQ ID NO: 1409613 - RNA, 22 nt, Pseudomonas aeruginosa PA01
accgccucggagaacagcagcg

SEQ ID NO: 1409614 - RNA, 17 nt, Pseudomonas aeruginosa PA01
accgccugcagcaccac

SEQ ID NO: 1409615 - RNA, 22 nt, Pseudomonas aeruginosa PA01
accgccugcucgcggcuggccg

SEQ ID NO: 1409616 - RNA, 22 nt, Pseudomonas aeruginosa PA01
accgcgaagcgguuagccggcg

SEQ ID NO: 1409617 - RNA, 13 nt, Pseudomonas aeruginosa PA01
accgcgacaaccc

SEQ ID NO: 1409618 - RNA, 15 nt, Pseudomonas aeruginosa PA01
accgcgacaacccug

SEQ ID NO: 1409619 - RNA, 21 nt, Pseudomonas aeruginosa PA01
accgccuuggcaucgccgccc

SEQ ID NO: 1409620 - RNA, 17 nt, Pseudomonas aeruginosa PA01
accgccuggucgaucuc

SEQ ID NO: 1409621 - RNA, 22 nt, Pseudomonas aeruginosa PA01
accgccuggucgaucucgucga

SEQ ID NO: 1409622 - RNA, 23 nt, Pseudomonas aeruginosa PA01
accgccuggucgaucucgucgaa

SEQ ID NO: 1409623 - RNA, 14 nt, Pseudomonas aeruginosa PA01
accgccuggucgcc

SEQ ID NO: 1409624 - RNA, 14 nt, Pseudomonas aeruginosa PA01
accgccuggaccag

SEQ ID NO: 1409625 - RNA, 22 nt, Pseudomonas aeruginosa PA01
acccugcgcaaggaacuggaag

SEQ ID NO: 1409626 - RNA, 14 nt, Pseudomonas aeruginosa PA01
acccugccgcgccg

SEQ ID NO: 1409627 - RNA, 16 nt, Pseudomonas aeruginosa PA01
acccugccccagcauc

SEQ ID NO: 1409628 - RNA, 24 nt, Pseudomonas aeruginosa PA01
acccugccccagcaucgccggcag

SEQ ID NO: 1409629 - RNA, 14 nt, Pseudomonas aeruginosa PA01
acccugaccgcgag

SEQ ID NO: 1409630 - RNA, 19 nt, Pseudomonas aeruginosa PA01
acccucggcuucguccugc

SEQ ID NO: 1409631 - RNA, 22 nt, Pseudomonas aeruginosa PA01
acccucggcuucguccugcugc

SEQ ID NO: 1409632 - RNA, 18 nt, Pseudomonas aeruginosa PA01
acccuugcucccgccgcu

SEQ ID NO: 1409633 - RNA, 18 nt, Pseudomonas aeruginosa PA01
acccuggccggccucggc

SEQ ID NO: 1409634 - RNA, 22 nt, Pseudomonas aeruginosa PA01
acccugcugcugcucagcgcgc

SEQ ID NO: 1409635 - RNA, 14 nt, Pseudomonas aeruginosa PA01
acccugcuggccgg

SEQ ID NO: 1409636 - RNA, 21 nt, Pseudomonas aeruginosa PA01
acccugcuggccggugccgcc

SEQ ID NO: 1409637 - RNA, 14 nt, Pseudomonas aeruginosa PA01
acccugcugggcgg

SEQ ID NO: 1409638 - RNA, 17 nt, Pseudomonas aeruginosa PA01
acccuggacccgggccu

SEQ ID NO: 1409639 - RNA, 14 nt, Pseudomonas aeruginosa PA01
accgaacagcgcgc

SEQ ID NO: 1409640 - RNA, 23 nt, Pseudomonas aeruginosa PA01
accgaacagcgcgccaucggcgg

SEQ ID NO: 1409641 - RNA, 14 nt, Pseudomonas aeruginosa PA01
accgaacaggcgac

SEQ ID NO: 1409642 - RNA, 21 nt, Pseudomonas aeruginosa PA01
accgaccaccaucaccgccau

SEQ ID NO: 1409643 - RNA, 17 nt, Pseudomonas aeruginosa PA01
acccgucccgcgcgccg

SEQ ID NO: 1409644 - RNA, 15 nt, Pseudomonas aeruginosa PA01
acccucuccccaacc

SEQ ID NO: 1409645 - RNA, 17 nt, Pseudomonas aeruginosa PA01
acccucggugcggccga

SEQ ID NO: 1409646 - RNA, 18 nt, Pseudomonas aeruginosa PA01
acccgugguccgccagca

SEQ ID NO: 1409647 - RNA, 22 nt, Pseudomonas aeruginosa PA01
acccgugguccgccagcaggcg

SEQ ID NO: 1409648 - RNA, 12 nt, Pseudomonas aeruginosa PA01
acccgugcgccc

SEQ ID NO: 1409649 - RNA, 18 nt, Pseudomonas aeruginosa PA01
acccgugcgccccagcuc

SEQ ID NO: 1409650 - RNA, 19 nt, Pseudomonas aeruginosa PA01
acccgugcgccccagcuca

SEQ ID NO: 1409651 - RNA, 16 nt, Pseudomonas aeruginosa PA01
acccggccauggcggg

SEQ ID NO: 1409652 - RNA, 24 nt, Pseudomonas aeruginosa PA01
acccggccgccuuccucggccgcc

SEQ ID NO: 1409653 - RNA, 23 nt, Pseudomonas aeruginosa PA01
acccggcgcggcgcagccagagc

SEQ ID NO: 1409654 - RNA, 13 nt, Pseudomonas aeruginosa PA01
acccggcgcuggc

SEQ ID NO: 1409655 - RNA, 16 nt, Pseudomonas aeruginosa PA01
acccggcgcuggccgc

SEQ ID NO: 1409656 - RNA, 22 nt, Pseudomonas aeruginosa PA01
acccggcgcacgccggccucgc

SEQ ID NO: 1409657 - RNA, 15 nt, Pseudomonas aeruginosa PA01
acccggcgcccggcg

SEQ ID NO: 1409658 - RNA, 17 nt, Pseudomonas aeruginosa PA01
accccuuugccgagcgg

SEQ ID NO: 1409659 - RNA, 18 nt, Pseudomonas aeruginosa PA01
acccgaaucccuuggcug

SEQ ID NO: 1409660 - RNA, 11 nt, Pseudomonas aeruginosa PA01
acccgccagcg

SEQ ID NO: 1409661 - RNA, 14 nt, Pseudomonas aeruginosa PA01
acccgccagcggca

SEQ ID NO: 1409662 - RNA, 22 nt, Pseudomonas aeruginosa PA01
acccgaaagccgaagcgcgagu

SEQ ID NO: 1409663 - RNA, 21 nt, Pseudomonas aeruginosa PA01
accccuucggucgcgccccgc

SEQ ID NO: 1409664 - RNA, 18 nt, Pseudomonas aeruginosa PA01
accccuugcagccagccg

SEQ ID NO: 1409665 - RNA, 17 nt, Pseudomonas aeruginosa PA01
acccgcccgccguccuc

SEQ ID NO: 1409666 - RNA, 21 nt, Pseudomonas aeruginosa PA01
acccgccccugcuccucgccg

SEQ ID NO: 1409667 - RNA, 15 nt, Pseudomonas aeruginosa PA01
acccgccucgucgcc

SEQ ID NO: 1409668 - RNA, 17 nt, Pseudomonas aeruginosa PA01
acccgccucaaggugaa

SEQ ID NO: 1409669 - RNA, 22 nt, Pseudomonas aeruginosa PA01
acccgccucaccccacgggcga

SEQ ID NO: 1409670 - RNA, 13 nt, Pseudomonas aeruginosa PA01
acccgcgaagccu

SEQ ID NO: 1409671 - RNA, 13 nt, Pseudomonas aeruginosa PA01
acccgcggcgcgc

SEQ ID NO: 1409672 - RNA, 20 nt, Pseudomonas aeruginosa PA01
acccgcuucgucggucgcga

SEQ ID NO: 1409673 - RNA, 21 nt, Pseudomonas aeruginosa PA01
acccgcuucgucggucgcgac

SEQ ID NO: 1409674 - RNA, 14 nt, Pseudomonas aeruginosa PA01
acccgcuccgcggc

SEQ ID NO: 1409675 - RNA, 14 nt, Pseudomonas aeruginosa PA01
acccgcuccgucgc

SEQ ID NO: 1409676 - RNA, 22 nt, Pseudomonas aeruginosa PA01
acccggaucaugguauggagaa

SEQ ID NO: 1409677 - RNA, 14 nt, Pseudomonas aeruginosa PA01
acccggccagcccg

SEQ ID NO: 1409678 - RNA, 20 nt, Pseudomonas aeruginosa PA01
acccggcccagcguucggcg

SEQ ID NO: 1409679 - RNA, 14 nt, Pseudomonas aeruginosa PA01
acccggcccaggcc

SEQ ID NO: 1409680 - RNA, 18 nt, Pseudomonas aeruginosa PA01
acccaggugcgcaggcgc

SEQ ID NO: 1409681 - RNA, 19 nt, Pseudomonas aeruginosa PA01
acccaggugcgcaggcgcu

SEQ ID NO: 1409682 - RNA, 22 nt, Pseudomonas aeruginosa PA01
acccagguggucgaccaggcgu

SEQ ID NO: 1409683 - RNA, 20 nt, Pseudomonas aeruginosa PA01
acccaggccgacagcggcug

SEQ ID NO: 1409684 - RNA, 23 nt, Pseudomonas aeruginosa PA01
acccagucuucgcuggcgaacgg

SEQ ID NO: 1409685 - RNA, 14 nt, Pseudomonas aeruginosa PA01
acccaucgaugcuc

SEQ ID NO: 1409686 - RNA, 24 nt, Pseudomonas aeruginosa PA01
acccaucgccgaagacgccugucg

SEQ ID NO: 1409687 - RNA, 14 nt, Pseudomonas aeruginosa PA01
acccaucugccggc

SEQ ID NO: 1409688 - RNA, 16 nt, Pseudomonas aeruginosa PA01
acccaucugccggcca

SEQ ID NO: 1409689 - RNA, 14 nt, Pseudomonas aeruginosa PA01
acccauucgaugcc

SEQ ID NO: 1409690 - RNA, 15 nt, Pseudomonas aeruginosa PA01
acccaugccgcaagc

SEQ ID NO: 1409691 - RNA, 12 nt, Pseudomonas aeruginosa PA01
acccauggcgcg

SEQ ID NO: 1409692 - RNA, 13 nt, Pseudomonas aeruginosa PA01
acccauggcgcga

SEQ ID NO: 1409693 - RNA, 13 nt, Pseudomonas aeruginosa PA01
acccagccgcggc

SEQ ID NO: 1409694 - RNA, 14 nt, Pseudomonas aeruginosa PA01
acccagccgcggcc

SEQ ID NO: 1409695 - RNA, 18 nt, Pseudomonas aeruginosa PA01
acccaggcccagccggug

SEQ ID NO: 1409696 - RNA, 15 nt, Pseudomonas aeruginosa PA01
acccagggcgcugcc

SEQ ID NO: 1409697 - RNA, 15 nt, Pseudomonas aeruginosa PA01
acccagggugcgccg

SEQ ID NO: 1409698 - RNA, 13 nt, Pseudomonas aeruginosa PA01
acccaggccuggg

SEQ ID NO: 1409699 - RNA, 22 nt, Pseudomonas aeruginosa PA01
acccaggccuggguguugucgg

SEQ ID NO: 1409700 - RNA, 21 nt, Pseudomonas aeruginosa PA01
acccaggauuuguccgcgcca

SEQ ID NO: 1409701 - RNA, 16 nt, Pseudomonas aeruginosa PA01
acccagcuugcuggcg

SEQ ID NO: 1409702 - RNA, 21 nt, Pseudomonas aeruginosa PA01
acccagcuugcuggcguagaa

SEQ ID NO: 1409703 - RNA, 21 nt, Pseudomonas aeruginosa PA01
acccagaccugccgcccggcc

SEQ ID NO: 1409704 - RNA, 22 nt, Pseudomonas aeruginosa PA01
acccagaccugccgcccggcca

SEQ ID NO: 1409705 - RNA, 23 nt, Pseudomonas aeruginosa PA01
acccagaccuuccagccgcgcgc

SEQ ID NO: 1409706 - RNA, 14 nt, Pseudomonas aeruginosa PA01
acccagagcaccag

SEQ ID NO: 1409707 - RNA, 14 nt, Pseudomonas aeruginosa PA01
acccagagccgcuc

SEQ ID NO: 1409708 - RNA, 16 nt, Pseudomonas aeruginosa PA01
acccagagccgcucgg

SEQ ID NO: 1409709 - RNA, 20 nt, Pseudomonas aeruginosa PA01
acccagagccgcucggcggg

SEQ ID NO: 1409710 - RNA, 23 nt, Pseudomonas aeruginosa PA01
accaggccaucgaaaucgcccac

SEQ ID NO: 1409711 - RNA, 22 nt, Pseudomonas aeruginosa PA01
acccacuccccagcaggcaggc

SEQ ID NO: 1409712 - RNA, 14 nt, Pseudomonas aeruginosa PA01
acccagccgcacgc

SEQ ID NO: 1409713 - RNA, 14 nt, Pseudomonas aeruginosa PA01
accaggccaccggu

SEQ ID NO: 1409714 - RNA, 14 nt, Pseudomonas aeruginosa PA01
accaggagcgccag

SEQ ID NO: 1409715 - RNA, 17 nt, Pseudomonas aeruginosa PA01
accaggagcgccagcac

SEQ ID NO: 1409716 - RNA, 16 nt, Pseudomonas aeruginosa PA01
accaggaaaucgccgu

SEQ ID NO: 1409717 - RNA, 12 nt, Pseudomonas aeruginosa PA01
accaggccaggc

SEQ ID NO: 1409718 - RNA, 19 nt, Pseudomonas aeruginosa PA01
accaggccauagcgcgccg

SEQ ID NO: 1409719 - RNA, 20 nt, Pseudomonas aeruginosa PA01
accaggccauagcgcgccgg

SEQ ID NO: 1409720 - RNA, 14 nt, Pseudomonas aeruginosa PA01
accaggaccagcgc

SEQ ID NO: 1409721 - RNA, 15 nt, Pseudomonas aeruginosa PA01
accaggaccagcgcc

SEQ ID NO: 1409722 - RNA, 17 nt, Pseudomonas aeruginosa PA01
accaggaccagcgccug

SEQ ID NO: 1409723 - RNA, 22 nt, Pseudomonas aeruginosa PA01
accaggaaggcguagaccucgc

SEQ ID NO: 1409724 - RNA, 19 nt, Pseudomonas aeruginosa PA01
accaggaauuccuggccgg

SEQ ID NO: 1409725 - RNA, 15 nt, Pseudomonas aeruginosa PA01
accagcuuguggccg

SEQ ID NO: 1409726 - RNA, 23 nt, Pseudomonas aeruginosa PA01
accagcuugcgucccuuggcguc

SEQ ID NO: 1409727 - RNA, 19 nt, Pseudomonas aeruginosa PA01
accaggaagcgucgugcgc

SEQ ID NO: 1409728 - RNA, 23 nt, Pseudomonas aeruginosa PA01
accaggaagcgucgugcgccggc

SEQ ID NO: 1409729 - RNA, 13 nt, Pseudomonas aeruginosa PA01
accaggaagcucg

SEQ ID NO: 1409730 - RNA, 18 nt, Pseudomonas aeruginosa PA01
accaggaagcucggcagc

SEQ ID NO: 1409731 - RNA, 16 nt, Pseudomonas aeruginosa PA01
accccgucgacgcccu

SEQ ID NO: 1409732 - RNA, 23 nt, Pseudomonas aeruginosa PA01
accccgggucgcgcagcggcucc

SEQ ID NO: 1409733 - RNA, 17 nt, Pseudomonas aeruginosa PA01
accccggucaggccgau

SEQ ID NO: 1409734 - RNA, 15 nt, Pseudomonas aeruginosa PA01
accccggugugcgcu

SEQ ID NO: 1409735 - RNA, 15 nt, Pseudomonas aeruginosa PA01
accccgcggguggca

SEQ ID NO: 1409736 - RNA, 14 nt, Pseudomonas aeruginosa PA01
accccggccuggcg

SEQ ID NO: 1409737 - RNA, 16 nt, Pseudomonas aeruginosa PA01
accccggccuggcgcc

SEQ ID NO: 1409738 - RNA, 14 nt, Pseudomonas aeruginosa PA01
accccggccuggcu

SEQ ID NO: 1409739 - RNA, 19 nt, Pseudomonas aeruginosa PA01
accccgccgcgcaucaccc

SEQ ID NO: 1409740 - RNA, 12 nt, Pseudomonas aeruginosa PA01
accccgccggcg

SEQ ID NO: 1409741 - RNA, 21 nt, Pseudomonas aeruginosa PA01
accccgccggcguucgacgcc

SEQ ID NO: 1409742 - RNA, 22 nt, Pseudomonas aeruginosa PA01
accccgcccaugaaaaauggcc

SEQ ID NO: 1409743 - RNA, 14 nt, Pseudomonas aeruginosa PA01
accccgcccuuggc

SEQ ID NO: 1409744 - RNA, 19 nt, Pseudomonas aeruginosa PA01
accccgcccuuggcggcgc

SEQ ID NO: 1409745 - RNA, 21 nt, Pseudomonas aeruginosa PA01
accccgcccuuggcggcgcca

SEQ ID NO: 1409746 - RNA, 13 nt, Pseudomonas aeruginosa PA01
accccgaucaccg

SEQ ID NO: 1409747 - RNA, 14 nt, Pseudomonas aeruginosa PA01
accccgaucaccgg

SEQ ID NO: 1409748 - RNA, 16 nt, Pseudomonas aeruginosa PA01
accccgaucaccggau

SEQ ID NO: 1409749 - RNA, 17 nt, Pseudomonas aeruginosa PA01
acccccaucgcccgcag

SEQ ID NO: 1409750 - RNA, 19 nt, Pseudomonas aeruginosa PA01
acccccgcaaccgcugccg

SEQ ID NO: 1409751 - RNA, 20 nt, Pseudomonas aeruginosa PA01
acccccgcaaccgcugccgc

SEQ ID NO: 1409752 - RNA, 15 nt, Pseudomonas aeruginosa PA01
acccccagcccggcc

SEQ ID NO: 1409753 - RNA, 21 nt, Pseudomonas aeruginosa PA01
accccgaaaccggcgaugcuc

SEQ ID NO: 1409754 - RNA, 15 nt, Pseudomonas aeruginosa PA01
accccgaacucgccg

SEQ ID NO: 1409755 - RNA, 14 nt, Pseudomonas aeruginosa PA01
acccccugcgcgga

SEQ ID NO: 1409756 - RNA, 17 nt, Pseudomonas aeruginosa PA01
acccccggcccggccau

SEQ ID NO: 1409757 - RNA, 23 nt, Pseudomonas aeruginosa PA01
accccgaccacccuguccugcuc

SEQ ID NO: 1409758 - RNA, 18 nt, Pseudomonas aeruginosa PA01
accccgaccagcgcgcuc

SEQ ID NO: 1409759 - RNA, 18 nt, Pseudomonas aeruginosa PA01
accccgaccaggucgcug

SEQ ID NO: 1409760 - RNA, 17 nt, Pseudomonas aeruginosa PA01
accccgaggucggcgaa

SEQ ID NO: 1409761 - RNA, 14 nt, Pseudomonas aeruginosa PA01
accccgaaguagcg

SEQ ID NO: 1409762 - RNA, 15 nt, Pseudomonas aeruginosa PA01
accccaccggucuug

SEQ ID NO: 1409763 - RNA, 18 nt, Pseudomonas aeruginosa PA01
accccaccggucuuggcg

SEQ ID NO: 1409764 - RNA, 20 nt, Pseudomonas aeruginosa PA01
accccaccggucuuggcgcg

SEQ ID NO: 1409765 - RNA, 19 nt, Pseudomonas aeruginosa PA01
accccauguaccucuggcu

SEQ ID NO: 1409766 - RNA, 13 nt, Pseudomonas aeruginosa PA01
accccauccucgc

SEQ ID NO: 1409767 - RNA, 15 nt, Pseudomonas aeruginosa PA01
accccauccucgccg

SEQ ID NO: 1409768 - RNA, 16 nt, Pseudomonas aeruginosa PA01
accccauccucgccgg

SEQ ID NO: 1409769 - RNA, 17 nt, Pseudomonas aeruginosa PA01
accccaugaaaaaggcc

SEQ ID NO: 1409770 - RNA, 13 nt, Pseudomonas aeruginosa PA01
ucggcaugguccg

SEQ ID NO: 1409771 - RNA, 23 nt, Pseudomonas aeruginosa PA01
ucggcaugguccguucggcgccc

SEQ ID NO: 1409772 - RNA, 12 nt, Pseudomonas aeruginosa PA01
ucggccaccacc

SEQ ID NO: 1409773 - RNA, 23 nt, Pseudomonas aeruginosa PA01
ucggccaccaccacgaucugcuu

SEQ ID NO: 1409774 - RNA, 20 nt, Pseudomonas aeruginosa PA01
ucggccaccagggugcgaug

SEQ ID NO: 1409775 - RNA, 21 nt, Pseudomonas aeruginosa PA01
ucggccaccgaaucgaugcug

SEQ ID NO: 1409776 - RNA, 17 nt, Pseudomonas aeruginosa PA01
ucggccaacggccgcuu

SEQ ID NO: 1409777 - RNA, 17 nt, Pseudomonas aeruginosa PA01
ucggccaacugagcggc

SEQ ID NO: 1409778 - RNA, 15 nt, Pseudomonas aeruginosa PA01
ucggccacuccagcc

SEQ ID NO: 1409779 - RNA, 18 nt, Pseudomonas aeruginosa PA01
ucggccacuccagccccg

SEQ ID NO: 1409780 - RNA, 19 nt, Pseudomonas aeruginosa PA01
ucggccaccugcuccggcg

SEQ ID NO: 1409781 - RNA, 16 nt, Pseudomonas aeruginosa PA01
ucggccaggaccaggg

SEQ ID NO: 1409782 - RNA, 17 nt, Pseudomonas aeruginosa PA01
ucggccaggaccagggc

SEQ ID NO: 1409783 - RNA, 17 nt, Pseudomonas aeruginosa PA01
ucggccagcucgccgaa

SEQ ID NO: 1409784 - RNA, 13 nt, Pseudomonas aeruginosa PA01
ucggccagcagca

SEQ ID NO: 1409785 - RNA, 17 nt, Pseudomonas aeruginosa PA01
ucggcccuccccuggcc

SEQ ID NO: 1409786 - RNA, 13 nt, Pseudomonas aeruginosa PA01
ucggcccuggcgg

SEQ ID NO: 1409787 - RNA, 17 nt, Pseudomonas aeruginosa PA01
ucggcccuggcggcgaa

SEQ ID NO: 1409788 - RNA, 16 nt, Pseudomonas aeruginosa PA01
ucggcccuucgacaug

SEQ ID NO: 1409789 - RNA, 13 nt, Pseudomonas aeruginosa PA01
ucggccaucagca

SEQ ID NO: 1409790 - RNA, 18 nt, Pseudomonas aeruginosa PA01
ucggccaucagcgccagg

SEQ ID NO: 1409791 - RNA, 19 nt, Pseudomonas aeruginosa PA01
ucggccaucagcgccaggg

SEQ ID NO: 1409792 - RNA, 17 nt, Pseudomonas aeruginosa PA01
ucggccaguucgcggcg

SEQ ID NO: 1409793 - RNA, 14 nt, Pseudomonas aeruginosa PA01
ucggccaguucguc

SEQ ID NO: 1409794 - RNA, 19 nt, Pseudomonas aeruginosa PA01
ucggccaguucgucgagca

SEQ ID NO: 1409795 - RNA, 20 nt, Pseudomonas aeruginosa PA01
ucggccauaccuccagccag

SEQ ID NO: 1409796 - RNA, 18 nt, Pseudomonas aeruginosa PA01
ucggccaguccggucagc

SEQ ID NO: 1409797 - RNA, 19 nt, Pseudomonas aeruginosa PA01
ucggccaggucgcggguga

SEQ ID NO: 1409798 - RNA, 24 nt, Pseudomonas aeruginosa PA01
ucggccagguauucgcgcucggcg

SEQ ID NO: 1409799 - RNA, 14 nt, Pseudomonas aeruginosa PA01
ucggccaggucgcg

SEQ ID NO: 1409800 - RNA, 19 nt, Pseudomonas aeruginosa PA01
ucggccagggagucgcugg

SEQ ID NO: 1409801 - RNA, 20 nt, Pseudomonas aeruginosa PA01
ucggccaggggagcgccggc

SEQ ID NO: 1409802 - RNA, 21 nt, Pseudomonas aeruginosa PA01
ucggccaggggagcgccggcg

SEQ ID NO: 1409803 - RNA, 23 nt, Pseudomonas aeruginosa PA01
ucggccaggggagcgccggcgcg

SEQ ID NO: 1409804 - RNA, 13 nt, Pseudomonas aeruginosa PA01
ucggccaggcgcc

SEQ ID NO: 1409805 - RNA, 17 nt, Pseudomonas aeruginosa PA01
ucggccaggcgccaggu

SEQ ID NO: 1409806 - RNA, 23 nt, Pseudomonas aeruginosa PA01
ucggcaccugcagacgguucagc

SEQ ID NO: 1409807 - RNA, 19 nt, Pseudomonas aeruginosa PA01
ucggcacgaugucgaccug

SEQ ID NO: 1409808 - RNA, 14 nt, Pseudomonas aeruginosa PA01
ucggcacgcagcag

SEQ ID NO: 1409809 - RNA, 15 nt, Pseudomonas aeruginosa PA01
ucggcacgcagcagc

SEQ ID NO: 1409810 - RNA, 22 nt, Pseudomonas aeruginosa PA01
ucggcaccagggcuucgcgcag

SEQ ID NO: 1409811 - RNA, 15 nt, Pseudomonas aeruginosa PA01
ucggcaccgaucgcc

SEQ ID NO: 1409812 - RNA, 18 nt, Pseudomonas aeruginosa PA01
ucggcaccgaucgcccgc

SEQ ID NO: 1409813 - RNA, 19 nt, Pseudomonas aeruginosa PA01
ucggcaccgaucgcccgcg

SEQ ID NO: 1409814 - RNA, 22 nt, Pseudomonas aeruginosa PA01
ucggcaccgaucgcccgcgccu

SEQ ID NO: 1409815 - RNA, 15 nt, Pseudomonas aeruginosa PA01
ucggcacucagccag

SEQ ID NO: 1409816 - RNA, 19 nt, Pseudomonas aeruginosa PA01
ucggcacucagccagcggc

SEQ ID NO: 1409817 - RNA, 15 nt, Pseudomonas aeruginosa PA01
ucggcauggccacgc

SEQ ID NO: 1409818 - RNA, 14 nt, Pseudomonas aeruginosa PA01
ucggcauggccgac

SEQ ID NO: 1409819 - RNA, 15 nt, Pseudomonas aeruginosa PA01
ucggcauggccgacc

SEQ ID NO: 1409820 - RNA, 17 nt, Pseudomonas aeruginosa PA01
ucggcauggccgaccgc

SEQ ID NO: 1409821 - RNA, 18 nt, Pseudomonas aeruginosa PA01
ucggcauggccgaccgcc

SEQ ID NO: 1409822 - RNA, 18 nt, Pseudomonas aeruginosa PA01
ucggcaauucuucaaggu

SEQ ID NO: 1409823 - RNA, 22 nt, Pseudomonas aeruginosa PA01
ucggcaauucuucaaggucugc

SEQ ID NO: 1409824 - RNA, 16 nt, Pseudomonas aeruginosa PA01
ucggcaacuggcuggc

SEQ ID NO: 1409825 - RNA, 18 nt, Pseudomonas aeruginosa PA01
ucggcaacuggcuggccu

SEQ ID NO: 1409826 - RNA, 21 nt, Pseudomonas aeruginosa PA01
ucggcaagcgaaccgaggagg

SEQ ID NO: 1409827 - RNA, 14 nt, Pseudomonas aeruginosa PA01
ucggagaacagcag

SEQ ID NO: 1409828 - RNA, 23 nt, Pseudomonas aeruginosa PA01
ucggagaacagcgagaccucgcc

SEQ ID NO: 1409829 - RNA, 14 nt, Pseudomonas aeruginosa PA01
ucggagaccacggu

SEQ ID NO: 1409830 - RNA, 18 nt, Pseudomonas aeruginosa PA01
ucggacuugcggcccacc

SEQ ID NO: 1409831 - RNA, 22 nt, Pseudomonas aeruginosa PA01
ucggcgacgggcuucgcgaccc

SEQ ID NO: 1409832 - RNA, 21 nt, Pseudomonas aeruginosa PA01
ucggcgaccuugcgcaccagg

SEQ ID NO: 1409833 - RNA, 16 nt, Pseudomonas aeruginosa PA01
ucggcgaucgccaggu

SEQ ID NO: 1409834 - RNA, 15 nt, Pseudomonas aeruginosa PA01
ucggcgacgcugaug

SEQ ID NO: 1409835 - RNA, 22 nt, Pseudomonas aeruginosa PA01
ucggcgacgcugaugaugccgc

SEQ ID NO: 1409836 - RNA, 14 nt, Pseudomonas aeruginosa PA01
ucggcgacgaggac

SEQ ID NO: 1409837 - RNA, 13 nt, Pseudomonas aeruginosa PA01
ucggcgagagguc

SEQ ID NO: 1409838 - RNA, 16 nt, Pseudomonas aeruginosa PA01
ucggcgagaggucggc

SEQ ID NO: 1409839 - RNA, 22 nt, Pseudomonas aeruginosa PA01
ucggcgagaggucggcgcgccc

SEQ ID NO: 1409840 - RNA, 20 nt, Pseudomonas aeruginosa PA01
ucggcgaugucgcgggcaug

SEQ ID NO: 1409841 - RNA, 12 nt, Pseudomonas aeruginosa PA01
ucggcgccggcc

SEQ ID NO: 1409842 - RNA, 18 nt, Pseudomonas aeruginosa PA01
ucggcgccgucgaucagg

SEQ ID NO: 1409843 - RNA, 23 nt, Pseudomonas aeruginosa PA01
ucggcgccgucgaucagguaggc

SEQ ID NO: 1409844 - RNA, 15 nt, Pseudomonas aeruginosa PA01
ucggcgccggugcug

SEQ ID NO: 1409845 - RNA, 12 nt, Pseudomonas aeruginosa PA01
ucggcgauggcc

SEQ ID NO: 1409846 - RNA, 18 nt, Pseudomonas aeruginosa PA01
ucggcgauggccaucagg

SEQ ID NO: 1409847 - RNA, 19 nt, Pseudomonas aeruginosa PA01
ucggcgaucugugcgagcg

SEQ ID NO: 1409848 - RNA, 20 nt, Pseudomonas aeruginosa PA01
ucggcgaugccgcgccaggc

SEQ ID NO: 1409849 - RNA, 16 nt, Pseudomonas aeruginosa PA01
ucggcgauucgcggcg

SEQ ID NO: 1409850 - RNA, 19 nt, Pseudomonas aeruginosa PA01
ucggcgauucguucgagca

SEQ ID NO: 1409851 - RNA, 21 nt, Pseudomonas aeruginosa PA01
ucggcgauucguucgagcagc

SEQ ID NO: 1409852 - RNA, 14 nt, Pseudomonas aeruginosa PA01
ucggcgauggcgua

SEQ ID NO: 1409853 - RNA, 19 nt, Pseudomonas aeruginosa PA01
ucggcgaugccgccgggca

SEQ ID NO: 1409854 - RNA, 15 nt, Pseudomonas aeruginosa PA01
ucggcgaugccgcgc

SEQ ID NO: 1409855 - RNA, 17 nt, Pseudomonas aeruginosa PA01
ucggcgaucucgcccag

SEQ ID NO: 1409856 - RNA, 17 nt, Pseudomonas aeruginosa PA01
ucggcgaugaccagcuc

SEQ ID NO: 1409857 - RNA, 20 nt, Pseudomonas aeruginosa PA01
ucggcgaugaccagcucggc

SEQ ID NO: 1409858 - RNA, 16 nt, Pseudomonas aeruginosa PA01
ucggccgccuggcgug

SEQ ID NO: 1409859 - RNA, 14 nt, Pseudomonas aeruginosa PA01
ucggccgcaccagg

SEQ ID NO: 1409860 - RNA, 12 nt, Pseudomonas aeruginosa PA01
ucggccgccagg

SEQ ID NO: 1409861 - RNA, 13 nt, Pseudomonas aeruginosa PA01
ucggccgccaggc

SEQ ID NO: 1409862 - RNA, 14 nt, Pseudomonas aeruginosa PA01
ucggccgccaggcg

SEQ ID NO: 1409863 - RNA, 13 nt, Pseudomonas aeruginosa PA01
ucggccgccaggg

SEQ ID NO: 1409864 - RNA, 12 nt, Pseudomonas aeruginosa PA01
ucggccgccagu

SEQ ID NO: 1409865 - RNA, 22 nt, Pseudomonas aeruginosa PA01
ucggccgaugugaaaacggcgc

SEQ ID NO: 1409866 - RNA, 21 nt, Pseudomonas aeruginosa PA01
ucggccgagggcagccucagc

SEQ ID NO: 1409867 - RNA, 17 nt, Pseudomonas aeruginosa PA01
ucggccuggucgucgua

SEQ ID NO: 1409868 - RNA, 17 nt, Pseudomonas aeruginosa PA01
ucggccuggugcaccug

SEQ ID NO: 1409869 - RNA, 18 nt, Pseudomonas aeruginosa PA01
ucggccuggugcaccugg

SEQ ID NO: 1409870 - RNA, 13 nt, Pseudomonas aeruginosa PA01
ucggccuguucgc

SEQ ID NO: 1409871 - RNA, 16 nt, Pseudomonas aeruginosa PA01
ucggccuguucgccca

SEQ ID NO: 1409872 - RNA, 17 nt, Pseudomonas aeruginosa PA01
ucggccuguucgcccaa

SEQ ID NO: 1409873 - RNA, 19 nt, Pseudomonas aeruginosa PA01
ucggccuggcgcagcggca

SEQ ID NO: 1409874 - RNA, 21 nt, Pseudomonas aeruginosa PA01
ucggccuggcgcagcggcagc

SEQ ID NO: 1409875 - RNA, 18 nt, Pseudomonas aeruginosa PA01
ucggccuggcugccgagc

SEQ ID NO: 1409876 - RNA, 21 nt, Pseudomonas aeruginosa PA01
ucggccuggcugccgagcagg

SEQ ID NO: 1409877 - RNA, 17 nt, Pseudomonas aeruginosa PA01
ucggccuggggcucggc

SEQ ID NO: 1409878 - RNA, 21 nt, Pseudomonas aeruginosa PA01
ucggccuggguacgcaccggc

SEQ ID NO: 1409879 - RNA, 16 nt, Pseudomonas aeruginosa PA01
ucggccugggcgcagg

SEQ ID NO: 1409880 - RNA, 20 nt, Pseudomonas aeruginosa PA01
ucggccugggcgcaggccga

SEQ ID NO: 1409881 - RNA, 15 nt, Pseudomonas aeruginosa PA01
ucggccuugcuggcg

SEQ ID NO: 1409882 - RNA, 16 nt, Pseudomonas aeruginosa PA01
ucggccuugcuggcga

SEQ ID NO: 1409883 - RNA, 21 nt, Pseudomonas aeruginosa PA01
ucggcgaacaggguggugucg

SEQ ID NO: 1409884 - RNA, 19 nt, Pseudomonas aeruginosa PA01
ucggcgaaauccucgcgca

SEQ ID NO: 1409885 - RNA, 19 nt, Pseudomonas aeruginosa PA01
ucggcgaaaugcaggccgg

SEQ ID NO: 1409886 - RNA, 20 nt, Pseudomonas aeruginosa PA01
ucggccuuggucaucagcac

SEQ ID NO: 1409887 - RNA, 21 nt, Pseudomonas aeruginosa PA01
ucggcgaacccggcgcggcgc

SEQ ID NO: 1409888 - RNA, 17 nt, Pseudomonas aeruginosa PA01
ucggcgaacuccgccag

SEQ ID NO: 1409889 - RNA, 19 nt, Pseudomonas aeruginosa PA01
ucggcgaacuccgccagcu

SEQ ID NO: 1409890 - RNA, 15 nt, Pseudomonas aeruginosa PA01
ucggcgaagcggaag

SEQ ID NO: 1409891 - RNA, 14 nt, Pseudomonas aeruginosa PA01
ucggcgaccagccc

SEQ ID NO: 1409892 - RNA, 16 nt, Pseudomonas aeruginosa PA01
ucggcgaccacccggc

SEQ ID NO: 1409893 - RNA, 19 nt, Pseudomonas aeruginosa PA01
ucggcgaccacccggcggu

SEQ ID NO: 1409894 - RNA, 21 nt, Pseudomonas aeruginosa PA01
ucggcgaaggcgaaccacacc

SEQ ID NO: 1409895 - RNA, 18 nt, Pseudomonas aeruginosa PA01
ucggcgaaguccaccagg

SEQ ID NO: 1409896 - RNA, 19 nt, Pseudomonas aeruginosa PA01
ucggcgaaguccaccaggc

SEQ ID NO: 1409897 - RNA, 14 nt, Pseudomonas aeruginosa PA01
ucggcgaagucgcc

SEQ ID NO: 1409898 - RNA, 18 nt, Pseudomonas aeruginosa PA01
ucggcgaccaacagggcg

SEQ ID NO: 1409899 - RNA, 17 nt, Pseudomonas aeruginosa PA01
ucggcgacagccgggca

SEQ ID NO: 1409900 - RNA, 20 nt, Pseudomonas aeruginosa PA01
ucgcgggugaccuggccgcc

SEQ ID NO: 1409901 - RNA, 16 nt, Pseudomonas aeruginosa PA01
ucgcgcgccuucagcc

SEQ ID NO: 1409902 - RNA, 19 nt, Pseudomonas aeruginosa PA01
ucgcgcgccuucagcccca

SEQ ID NO: 1409903 - RNA, 15 nt, Pseudomonas aeruginosa PA01
ucgcgcgcggcaucc

SEQ ID NO: 1409904 - RNA, 17 nt, Pseudomonas aeruginosa PA01
ucgcgcgcggccagcuc

SEQ ID NO: 1409905 - RNA, 13 nt, Pseudomonas aeruginosa PA01
ucgcgcgaggcgc

SEQ ID NO: 1409906 - RNA, 12 nt, Pseudomonas aeruginosa PA01
ucgcgcgccgga

SEQ ID NO: 1409907 - RNA, 17 nt, Pseudomonas aeruginosa PA01
ucgcgcggggcgcgcug

SEQ ID NO: 1409908 - RNA, 16 nt, Pseudomonas aeruginosa PA01
ucgcgggucaccaccg

SEQ ID NO: 1409909 - RNA, 15 nt, Pseudomonas aeruginosa PA01
ucgcgcggcgccugc

SEQ ID NO: 1409910 - RNA, 17 nt, Pseudomonas aeruginosa PA01
ucgcgcggcgccugcug

SEQ ID NO: 1409911 - RNA, 17 nt, Pseudomonas aeruginosa PA01
ucgcgguuauccgccgc

SEQ ID NO: 1409912 - RNA, 18 nt, Pseudomonas aeruginosa PA01
ucgcgguuauccgccgcc

SEQ ID NO: 1409913 - RNA, 19 nt, Pseudomonas aeruginosa PA01
ucgcgguuauccgccgccu

SEQ ID NO: 1409914 - RNA, 20 nt, Pseudomonas aeruginosa PA01
ucgcgguuauccgccgccua

SEQ ID NO: 1409915 - RNA, 18 nt, Pseudomonas aeruginosa PA01
ucgcgguuauccgccgga

SEQ ID NO: 1409916 - RNA, 22 nt, Pseudomonas aeruginosa PA01
ucgcgguggaugccgguggcgc

SEQ ID NO: 1409917 - RNA, 16 nt, Pseudomonas aeruginosa PA01
ucgcggugcaguucgc

SEQ ID NO: 1409918 - RNA, 21 nt, Pseudomonas aeruginosa PA01
ucgcggugcaguucgccguuc

SEQ ID NO: 1409919 - RNA, 15 nt, Pseudomonas aeruginosa PA01
ucgcgguacagccgg

SEQ ID NO: 1409920 - RNA, 17 nt, Pseudomonas aeruginosa PA01
ucgcggucaucgccggc

SEQ ID NO: 1409921 - RNA, 18 nt, Pseudomonas aeruginosa PA01
ucgcggucaucgccggcg

SEQ ID NO: 1409922 - RNA, 19 nt, Pseudomonas aeruginosa PA01
ucgcggucaucgccggcgc

SEQ ID NO: 1409923 - RNA, 23 nt, Pseudomonas aeruginosa PA01
ucgcggucccgggaaaccaccag

SEQ ID NO: 1409924 - RNA, 16 nt, Pseudomonas aeruginosa PA01
ucgcguacagcgggcc

SEQ ID NO: 1409925 - RNA, 21 nt, Pseudomonas aeruginosa PA01
ucgcguacagcgggccgggga

SEQ ID NO: 1409926 - RNA, 16 nt, Pseudomonas aeruginosa PA01
ucgcgguucgaggacu

SEQ ID NO: 1409927 - RNA, 17 nt, Pseudomonas aeruginosa PA01
ucgcgguugccgaagcg

SEQ ID NO: 1409928 - RNA, 17 nt, Pseudomonas aeruginosa PA01
ucgcgguugcgcugcuu

SEQ ID NO: 1409929 - RNA, 16 nt, Pseudomonas aeruginosa PA01
ucgcgguugcugugca

SEQ ID NO: 1409930 - RNA, 20 nt, Pseudomonas aeruginosa PA01
ucgcguagggcgacggcgcu

SEQ ID NO: 1409931 - RNA, 15 nt, Pseudomonas aeruginosa PA01
ucgcguagguggcgc

SEQ ID NO: 1409932 - RNA, 18 nt, Pseudomonas aeruginosa PA01
ucgcguagguggcgccgc

SEQ ID NO: 1409933 - RNA, 15 nt, Pseudomonas aeruginosa PA01
ucgcguagcugggcg

SEQ ID NO: 1409934 - RNA, 12 nt, Pseudomonas aeruginosa PA01
ucgcguccaggg

SEQ ID NO: 1409935 - RNA, 16 nt, Pseudomonas aeruginosa PA01
ucgcgucggccuggcg

SEQ ID NO: 1409936 - RNA, 21 nt, Pseudomonas aeruginosa PA01
ucgcgucggccuggcgcagcg

SEQ ID NO: 1409937 - RNA, 14 nt, Pseudomonas aeruginosa PA01
ucgcgucgcaggcg

SEQ ID NO: 1409938 - RNA, 17 nt, Pseudomonas aeruginosa PA01
ucgcgucgcaggcgaug

SEQ ID NO: 1409939 - RNA, 18 nt, Pseudomonas aeruginosa PA01
ucgcgucgcaggcgaugc

SEQ ID NO: 1409940 - RNA, 21 nt, Pseudomonas aeruginosa PA01
ucgcgucgcaggcgaugccga

SEQ ID NO: 1409941 - RNA, 18 nt, Pseudomonas aeruginosa PA01
ucgcucccuacgaugcug

SEQ ID NO: 1409942 - RNA, 17 nt, Pseudomonas aeruginosa PA01
ucgcuccagaccuccag

SEQ ID NO: 1409943 - RNA, 21 nt, Pseudomonas aeruginosa PA01
ucgcuccagccccacuggaag

SEQ ID NO: 1409944 - RNA, 18 nt, Pseudomonas aeruginosa PA01
ucgcucagcgggccgauc

SEQ ID NO: 1409945 - RNA, 16 nt, Pseudomonas aeruginosa PA01
ucgcucaggccucgag

SEQ ID NO: 1409946 - RNA, 16 nt, Pseudomonas aeruginosa PA01
ucgcucaacggcgugc

SEQ ID NO: 1409947 - RNA, 15 nt, Pseudomonas aeruginosa PA01
ucgcucugcgccagg

SEQ ID NO: 1409948 - RNA, 17 nt, Pseudomonas aeruginosa PA01
ucgcucugcgccaggcg

SEQ ID NO: 1409949 - RNA, 15 nt, Pseudomonas aeruginosa PA01
ucgcucugcgccgcg

SEQ ID NO: 1409950 - RNA, 13 nt, Pseudomonas aeruginosa PA01
ucgcucugcugaa

SEQ ID NO: 1409951 - RNA, 18 nt, Pseudomonas aeruginosa PA01
ucgcucgcuucagcgagc

SEQ ID NO: 1409952 - RNA, 17 nt, Pseudomonas aeruginosa PA01
ucgcugaaauccaccag

SEQ ID NO: 1409953 - RNA, 12 nt, Pseudomonas aeruginosa PA01
ucgcuccgagca

SEQ ID NO: 1409954 - RNA, 14 nt, Pseudomonas aeruginosa PA01
ucgcuccgagcagg

SEQ ID NO: 1409955 - RNA, 15 nt, Pseudomonas aeruginosa PA01
ucgcuccgagcaggc

SEQ ID NO: 1409956 - RNA, 16 nt, Pseudomonas aeruginosa PA01
ucgcuccgagcaggcc

SEQ ID NO: 1409957 - RNA, 15 nt, Pseudomonas aeruginosa PA01
ucgcuccggcagcgc

SEQ ID NO: 1409958 - RNA, 23 nt, Pseudomonas aeruginosa PA01
ucgcuccucagaggcgaccagcc

SEQ ID NO: 1409959 - RNA, 14 nt, Pseudomonas aeruginosa PA01
ucgcuccuccgggc

SEQ ID NO: 1409960 - RNA, 15 nt, Pseudomonas aeruginosa PA01
ucgcuccuccgggcg

SEQ ID NO: 1409961 - RNA, 12 nt, Pseudomonas aeruginosa PA01
ucgcucgcgcag

SEQ ID NO: 1409962 - RNA, 21 nt, Pseudomonas aeruginosa PA01
ucgcuacggaaggucgccggg

SEQ ID NO: 1409963 - RNA, 13 nt, Pseudomonas aeruginosa PA01
ucgcuaccgacag

SEQ ID NO: 1409964 - RNA, 17 nt, Pseudomonas aeruginosa PA01
ucgcguugcaggcgacg

SEQ ID NO: 1409965 - RNA, 16 nt, Pseudomonas aeruginosa PA01
ucgcguucggucaggc

SEQ ID NO: 1409966 - RNA, 19 nt, Pseudomonas aeruginosa PA01
ucgcgugggccaccaucag

SEQ ID NO: 1409967 - RNA, 19 nt, Pseudomonas aeruginosa PA01
ucgcguggcccggcgcggc

SEQ ID NO: 1409968 - RNA, 16 nt, Pseudomonas aeruginosa PA01
ucgcguucaucgucgg

SEQ ID NO: 1409969 - RNA, 13 nt, Pseudomonas aeruginosa PA01
ucgcguuccagca

SEQ ID NO: 1409970 - RNA, 18 nt, Pseudomonas aeruginosa PA01
ucgcguuccagcaacggc

SEQ ID NO: 1409971 - RNA, 20 nt, Pseudomonas aeruginosa PA01
ucgcguuccagcaacggcuu

SEQ ID NO: 1409972 - RNA, 20 nt, Pseudomonas aeruginosa PA01
ucgcguuccagcaccucgcg

SEQ ID NO: 1409973 - RNA, 15 nt, Pseudomonas aeruginosa PA01
ucgcguuccagcucc

SEQ ID NO: 1409974 - RNA, 16 nt, Pseudomonas aeruginosa PA01
ucgcguuccagcuccg

SEQ ID NO: 1409975 - RNA, 15 nt, Pseudomonas aeruginosa PA01
ucgcguucgcuccgg

SEQ ID NO: 1409976 - RNA, 16 nt, Pseudomonas aeruginosa PA01
ucgcguucgcuccggg

SEQ ID NO: 1409977 - RNA, 17 nt, Pseudomonas aeruginosa PA01
ucgcguucgcuccgggc

SEQ ID NO: 1409978 - RNA, 14 nt, Pseudomonas aeruginosa PA01
ucgcgugcgcuggu

SEQ ID NO: 1409979 - RNA, 15 nt, Pseudomonas aeruginosa PA01
ucgcgugccagacgc

SEQ ID NO: 1409980 - RNA, 16 nt, Pseudomonas aeruginosa PA01
ucgcuuccggcgccaa

SEQ ID NO: 1409981 - RNA, 16 nt, Pseudomonas aeruginosa PA01
ucgcuucggccaccag

SEQ ID NO: 1409982 - RNA, 21 nt, Pseudomonas aeruginosa PA01
ucggacggcucgcgcagcggc

SEQ ID NO: 1409983 - RNA, 23 nt, Pseudomonas aeruginosa PA01
ucggacggcucgcgcagcggcgc

SEQ ID NO: 1409984 - RNA, 12 nt, Pseudomonas aeruginosa PA01
ucggaccugucc

SEQ ID NO: 1409985 - RNA, 19 nt, Pseudomonas aeruginosa PA01
ucgcugcucagggccgcgc

SEQ ID NO: 1409986 - RNA, 12 nt, Pseudomonas aeruginosa PA01
ucgcugcgcggg

SEQ ID NO: 1409987 - RNA, 18 nt, Pseudomonas aeruginosa PA01
ucgcugcgugcguugcgc

SEQ ID NO: 1409988 - RNA, 21 nt, Pseudomonas aeruginosa PA01
ucgcugcgugcguugcgcggc

SEQ ID NO: 1409989 - RNA, 13 nt, Pseudomonas aeruginosa PA01
ucgcuggaccagg

SEQ ID NO: 1409990 - RNA, 17 nt, Pseudomonas aeruginosa PA01
ucgcuggaccaggcggc

SEQ ID NO: 1409991 - RNA, 20 nt, Pseudomonas aeruginosa PA01
ucgcugaaggucgccgcgcu

SEQ ID NO: 1409992 - RNA, 14 nt, Pseudomonas aeruginosa PA01
ucgcugccgccgcg

SEQ ID NO: 1409993 - RNA, 15 nt, Pseudomonas aeruginosa PA01
ucgcugccgccgcgc

SEQ ID NO: 1409994 - RNA, 16 nt, Pseudomonas aeruginosa PA01
ucgcugccgccgcgcu

SEQ ID NO: 1409995 - RNA, 16 nt, Pseudomonas aeruginosa PA01
ucgcugccggcgcgca

SEQ ID NO: 1409996 - RNA, 23 nt, Pseudomonas aeruginosa PA01
ucgcugccggcgcgcacggaggc

SEQ ID NO: 1409997 - RNA, 24 nt, Pseudomonas aeruginosa PA01
ucgcugcgggcguagcgcggcagc

SEQ ID NO: 1409998 - RNA, 23 nt, Pseudomonas aeruginosa PA01
ucgcugcggguucagucggccag

SEQ ID NO: 1409999 - RNA, 14 nt, Pseudomonas aeruginosa PA01
ucgcugccugggga

SEQ ID NO: 1410000 - RNA, 13 nt, Pseudomonas aeruginosa PA01
ucgcugcgcgcca

SEQ ID NO: 1410001 - RNA, 18 nt, Pseudomonas aeruginosa PA01
ucgccacgcugcugccgg

SEQ ID NO: 1410002 - RNA, 19 nt, Pseudomonas aeruginosa PA01
ucgccacgcugcugccggc

SEQ ID NO: 1410003 - RNA, 20 nt, Pseudomonas aeruginosa PA01
ucgccacgcugcugccggcc

SEQ ID NO: 1410004 - RNA, 14 nt, Pseudomonas aeruginosa PA01
ucgccacgcuucug

SEQ ID NO: 1410005 - RNA, 13 nt, Pseudomonas aeruginosa PA01
ucgccaccgcgga

SEQ ID NO: 1410006 - RNA, 22 nt, Pseudomonas aeruginosa PA01
ucgccaccccgccgcuggcggc

SEQ ID NO: 1410007 - RNA, 19 nt, Pseudomonas aeruginosa PA01
ucgccaauaaauccgucau

SEQ ID NO: 1410008 - RNA, 15 nt, Pseudomonas aeruginosa PA01
ucgccaagcccggcg

SEQ ID NO: 1410009 - RNA, 20 nt, Pseudomonas aeruginosa PA01
ucgccaagguacggggcugc

SEQ ID NO: 1410010 - RNA, 13 nt, Pseudomonas aeruginosa PA01
ucgccaccagcag

SEQ ID NO: 1410011 - RNA, 14 nt, Pseudomonas aeruginosa PA01
ucgccaccagcagg

SEQ ID NO: 1410012 - RNA, 22 nt, Pseudomonas aeruginosa PA01
ucgcauagccggcgcgcccggc

SEQ ID NO: 1410013 - RNA, 15 nt, Pseudomonas aeruginosa PA01
ucgcauccaccagcg

SEQ ID NO: 1410014 - RNA, 15 nt, Pseudomonas aeruginosa PA01
ucgcaucggcgaccu

SEQ ID NO: 1410015 - RNA, 17 nt, Pseudomonas aeruginosa PA01
ucgccaacgcgccgucg

SEQ ID NO: 1410016 - RNA, 19 nt, Pseudomonas aeruginosa PA01
ucgccaacgcgccgucgcg

SEQ ID NO: 1410017 - RNA, 14 nt, Pseudomonas aeruginosa PA01
ucgccaaccaggaa

SEQ ID NO: 1410018 - RNA, 20 nt, Pseudomonas aeruginosa PA01
ucgccaaaaaaagccccggc

SEQ ID NO: 1410019 - RNA, 22 nt, Pseudomonas aeruginosa PA01
ucgccaaaaaaagccccggcau

SEQ ID NO: 1410020 - RNA, 13 nt, Pseudomonas aeruginosa PA01
ucgcagcaggccg

SEQ ID NO: 1410021 - RNA, 16 nt, Pseudomonas aeruginosa PA01
ucgcagcaggccgcug

SEQ ID NO: 1410022 - RNA, 15 nt, Pseudomonas aeruginosa PA01
ucgaugaaaccggcc

SEQ ID NO: 1410023 - RNA, 13 nt, Pseudomonas aeruginosa PA01
ucgaugaacgccc

SEQ ID NO: 1410024 - RNA, 15 nt, Pseudomonas aeruginosa PA01
ucgaugaacgcccug

SEQ ID NO: 1410025 - RNA, 16 nt, Pseudomonas aeruginosa PA01
ucgaugaacgcccuga

SEQ ID NO: 1410026 - RNA, 16 nt, Pseudomonas aeruginosa PA01
ucgaugaacgcgcgga

SEQ ID NO: 1410027 - RNA, 17 nt, Pseudomonas aeruginosa PA01
ucgaugaacgcgcggac

SEQ ID NO: 1410028 - RNA, 14 nt, Pseudomonas aeruginosa PA01
ucgaucugcucguc

SEQ ID NO: 1410029 - RNA, 17 nt, Pseudomonas aeruginosa PA01
ucgaucugcucguccag

SEQ ID NO: 1410030 - RNA, 18 nt, Pseudomonas aeruginosa PA01
ucgaucugucgcagcggg

SEQ ID NO: 1410031 - RNA, 15 nt, Pseudomonas aeruginosa PA01
ucgaucuuguagccg

SEQ ID NO: 1410032 - RNA, 21 nt, Pseudomonas aeruginosa PA01
ucgaucucaugggucgauugc

SEQ ID NO: 1410033 - RNA, 13 nt, Pseudomonas aeruginosa PA01
ucgaucuccucgc

SEQ ID NO: 1410034 - RNA, 15 nt, Pseudomonas aeruginosa PA01
ucgaucucgagcaug

SEQ ID NO: 1410035 - RNA, 18 nt, Pseudomonas aeruginosa PA01
ucgaucucguccucggcg

SEQ ID NO: 1410036 - RNA, 17 nt, Pseudomonas aeruginosa PA01
ucgcaggagucgacgaa

SEQ ID NO: 1410037 - RNA, 15 nt, Pseudomonas aeruginosa PA01
ucgcaggcagcgcgc

SEQ ID NO: 1410038 - RNA, 15 nt, Pseudomonas aeruginosa PA01
ucgcagcguuccagc

SEQ ID NO: 1410039 - RNA, 16 nt, Pseudomonas aeruginosa PA01
ucgcagcguuccagcg

SEQ ID NO: 1410040 - RNA, 17 nt, Pseudomonas aeruginosa PA01
ucgcagcguuccagcgc

SEQ ID NO: 1410041 - RNA, 24 nt, Pseudomonas aeruginosa PA01
ucgcagcguuccagcgcuggcagg

SEQ ID NO: 1410042 - RNA, 15 nt, Pseudomonas aeruginosa PA01
ucgcagcggccguag

SEQ ID NO: 1410043 - RNA, 22 nt, Pseudomonas aeruginosa PA01
ucgcagcgggcauauggaucgg

SEQ ID NO: 1410044 - RNA, 23 nt, Pseudomonas aeruginosa PA01
ucgcagccgguggucuucagcac

SEQ ID NO: 1410045 - RNA, 22 nt, Pseudomonas aeruginosa PA01
ucgcagcgcuccuuucccagcg

SEQ ID NO: 1410046 - RNA, 13 nt, Pseudomonas aeruginosa PA01
ucgcagccgcgca

SEQ ID NO: 1410047 - RNA, 15 nt, Pseudomonas aeruginosa PA01
ucgcagccgcgcaac

SEQ ID NO: 1410048 - RNA, 17 nt, Pseudomonas aeruginosa PA01
ucgcagccgcgcucggc

SEQ ID NO: 1410049 - RNA, 15 nt, Pseudomonas aeruginosa PA01
ucgcagucguagcgc

SEQ ID NO: 1410050 - RNA, 21 nt, Pseudomonas aeruginosa PA01
ucgcaguacagcucggcgccc

SEQ ID NO: 1410051 - RNA, 16 nt, Pseudomonas aeruginosa PA01
ucgcaggccaggcgca

SEQ ID NO: 1410052 - RNA, 23 nt, Pseudomonas aeruginosa PA01
ucgcaggccaggcgcagugccug

SEQ ID NO: 1410053 - RNA, 18 nt, Pseudomonas aeruginosa PA01
ucgcagguaacccgcggc

SEQ ID NO: 1410054 - RNA, 21 nt, Pseudomonas aeruginosa PA01
ucgcaggcucaguucggccag

SEQ ID NO: 1410055 - RNA, 17 nt, Pseudomonas aeruginosa PA01
ucgccgacguccuccag

SEQ ID NO: 1410056 - RNA, 17 nt, Pseudomonas aeruginosa PA01
ucgccgacuuccaggcg

SEQ ID NO: 1410057 - RNA, 19 nt, Pseudomonas aeruginosa PA01
ucgccgacuuccaggcgca

SEQ ID NO: 1410058 - RNA, 21 nt, Pseudomonas aeruginosa PA01
ucgccgacuuccaggcgcagg

SEQ ID NO: 1410059 - RNA, 23 nt, Pseudomonas aeruginosa PA01
ucgccgacuuccaggcgcaggcg

SEQ ID NO: 1410060 - RNA, 20 nt, Pseudomonas aeruginosa PA01
ucgcccuggugcacggcgac

SEQ ID NO: 1410061 - RNA, 21 nt, Pseudomonas aeruginosa PA01
ucgccgaccgccaaggucggu

SEQ ID NO: 1410062 - RNA, 20 nt, Pseudomonas aeruginosa PA01
ucgccgacggcuucgaccac

SEQ ID NO: 1410063 - RNA, 21 nt, Pseudomonas aeruginosa PA01
ucgccgacggcuucgaccacg

SEQ ID NO: 1410064 - RNA, 22 nt, Pseudomonas aeruginosa PA01
ucgccgacggcuucgaccacga

SEQ ID NO: 1410065 - RNA, 14 nt, Pseudomonas aeruginosa PA01
ucgcccugcagcgc

SEQ ID NO: 1410066 - RNA, 15 nt, Pseudomonas aeruginosa PA01
ucgcccugcagcgcg

SEQ ID NO: 1410067 - RNA, 19 nt, Pseudomonas aeruginosa PA01
ucgcccugcagcgcgcgcu

SEQ ID NO: 1410068 - RNA, 20 nt, Pseudomonas aeruginosa PA01
ucgcccugcagcgcgcgcug

SEQ ID NO: 1410069 - RNA, 12 nt, Pseudomonas aeruginosa PA01
ucgcccucggcg

SEQ ID NO: 1410070 - RNA, 16 nt, Pseudomonas aeruginosa PA01
ucgcccucggcgcugg

SEQ ID NO: 1410071 - RNA, 19 nt, Pseudomonas aeruginosa PA01
ucgcccucggcgcuggcca

SEQ ID NO: 1410072 - RNA, 19 nt, Pseudomonas aeruginosa PA01
ucgcccugcggauggcgcg

SEQ ID NO: 1410073 - RNA, 21 nt, Pseudomonas aeruginosa PA01
ucgcccugcggauggcgcggg

SEQ ID NO: 1410074 - RNA, 22 nt, Pseudomonas aeruginosa PA01
ucgcccugcguggaaccgcggc

SEQ ID NO: 1410075 - RNA, 23 nt, Pseudomonas aeruginosa PA01
ucgcccugcguggaaccgcggcg

SEQ ID NO: 1410076 - RNA, 16 nt, Pseudomonas aeruginosa PA01
ucgcccuggcgccagc

SEQ ID NO: 1410077 - RNA, 15 nt, Pseudomonas aeruginosa PA01
ucgccgaccaggcgg

SEQ ID NO: 1410078 - RNA, 16 nt, Pseudomonas aeruginosa PA01
ucgccgaccaggcggc

SEQ ID NO: 1410079 - RNA, 20 nt, Pseudomonas aeruginosa PA01
ucgccgaccaggcggccguc

SEQ ID NO: 1410080 - RNA, 17 nt, Pseudomonas aeruginosa PA01
ucgccgaccagguccgc

SEQ ID NO: 1410081 - RNA, 21 nt, Pseudomonas aeruginosa PA01
ucgcccgaccccacgccggcc

SEQ ID NO: 1410082 - RNA, 12 nt, Pseudomonas aeruginosa PA01
ucgcccgcagcc

SEQ ID NO: 1410083 - RNA, 14 nt, Pseudomonas aeruginosa PA01
ucgcccgcagccac

SEQ ID NO: 1410084 - RNA, 19 nt, Pseudomonas aeruginosa PA01
ucgcccgcagccacaggcg

SEQ ID NO: 1410085 - RNA, 21 nt, Pseudomonas aeruginosa PA01
ucgcccgucacuucacgacag

SEQ ID NO: 1410086 - RNA, 15 nt, Pseudomonas aeruginosa PA01
ucgcccuaccgccca

SEQ ID NO: 1410087 - RNA, 21 nt, Pseudomonas aeruginosa PA01
ucgcccuaccgcccacccugc

SEQ ID NO: 1410088 - RNA, 14 nt, Pseudomonas aeruginosa PA01
ucgcccuacgcggc

SEQ ID NO: 1410089 - RNA, 14 nt, Pseudomonas aeruginosa PA01
ucgcccuacggggc

SEQ ID NO: 1410090 - RNA, 16 nt, Pseudomonas aeruginosa PA01
ucgcccucagcagcgc

SEQ ID NO: 1410091 - RNA, 21 nt, Pseudomonas aeruginosa PA01
ucgcccucagcagcgccgccc

SEQ ID NO: 1410092 - RNA, 14 nt, Pseudomonas aeruginosa PA01
ucgcccucgaucuu

SEQ ID NO: 1410093 - RNA, 14 nt, Pseudomonas aeruginosa PA01
ucgcccucgcggag

SEQ ID NO: 1410094 - RNA, 22 nt, Pseudomonas aeruginosa PA01
ucgcccucgcuccaacgcaggc

SEQ ID NO: 1410095 - RNA, 13 nt, Pseudomonas aeruginosa PA01
ucgccccacagcg

SEQ ID NO: 1410096 - RNA, 16 nt, Pseudomonas aeruginosa PA01
ucgccccacagcggug

SEQ ID NO: 1410097 - RNA, 20 nt, Pseudomonas aeruginosa PA01
ucgccccagccuugcuggac

SEQ ID NO: 1410098 - RNA, 16 nt, Pseudomonas aeruginosa PA01
ucgccccggcggcgau

SEQ ID NO: 1410099 - RNA, 17 nt, Pseudomonas aeruginosa PA01
ucgccccggcggcgauc

SEQ ID NO: 1410100 - RNA, 20 nt, Pseudomonas aeruginosa PA01
ucgccccgguuggcgcccca

SEQ ID NO: 1410101 - RNA, 13 nt, Pseudomonas aeruginosa PA01
ucgccccgccgcc

SEQ ID NO: 1410102 - RNA, 14 nt, Pseudomonas aeruginosa PA01
ucgccccgccgcca

SEQ ID NO: 1410103 - RNA, 18 nt, Pseudomonas aeruginosa PA01
ucgccccgccgccaggcg

SEQ ID NO: 1410104 - RNA, 13 nt, Pseudomonas aeruginosa PA01
ucgccccgccggg

SEQ ID NO: 1410105 - RNA, 14 nt, Pseudomonas aeruginosa PA01
ucgccccgccggga

SEQ ID NO: 1410106 - RNA, 23 nt, Pseudomonas aeruginosa PA01
ucgccagcaccucguaggccgac

SEQ ID NO: 1410107 - RNA, 14 nt, Pseudomonas aeruginosa PA01
ucgccagccucggc

SEQ ID NO: 1410108 - RNA, 19 nt, Pseudomonas aeruginosa PA01
ucgccagcgccacggugau

SEQ ID NO: 1410109 - RNA, 16 nt, Pseudomonas aeruginosa PA01
ucgccagcgccagcag

SEQ ID NO: 1410110 - RNA, 17 nt, Pseudomonas aeruginosa PA01
ucgccagcgccagcagg

SEQ ID NO: 1410111 - RNA, 11 nt, Pseudomonas aeruginosa PA01
ucgccagcgcg

SEQ ID NO: 1410112 - RNA, 14 nt, Pseudomonas aeruginosa PA01
ucgccacgcccgcc

SEQ ID NO: 1410113 - RNA, 22 nt, Pseudomonas aeruginosa PA01
ucgccacugauaccgcuggcca

SEQ ID NO: 1410114 - RNA, 12 nt, Pseudomonas aeruginosa PA01
ucgccacgccgg

SEQ ID NO: 1410115 - RNA, 13 nt, Pseudomonas aeruginosa PA01
ucgccacgccggc

SEQ ID NO: 1410116 - RNA, 14 nt, Pseudomonas aeruginosa PA01
ucgccacgccggcg

SEQ ID NO: 1410117 - RNA, 21 nt, Pseudomonas aeruginosa PA01
ucgccagcaauugccgcugca

SEQ ID NO: 1410118 - RNA, 21 nt, Pseudomonas aeruginosa PA01
ucgccagcgguacccgccggc

SEQ ID NO: 1410119 - RNA, 23 nt, Pseudomonas aeruginosa PA01
ucgccagcgguacccgccggcca

SEQ ID NO: 1410120 - RNA, 14 nt, Pseudomonas aeruginosa PA01
ucgccagcucgccg

SEQ ID NO: 1410121 - RNA, 16 nt, Pseudomonas aeruginosa PA01
ucgccagcucgccgcg

SEQ ID NO: 1410122 - RNA, 15 nt, Pseudomonas aeruginosa PA01
ucgccagcggccagg

SEQ ID NO: 1410123 - RNA, 12 nt, Pseudomonas aeruginosa PA01
ucgccagcggcg

SEQ ID NO: 1410124 - RNA, 12 nt, Pseudomonas aeruginosa PA01
ucgccaggccgu

SEQ ID NO: 1410125 - RNA, 12 nt, Pseudomonas aeruginosa PA01
ucgccauggcgc

SEQ ID NO: 1410126 - RNA, 15 nt, Pseudomonas aeruginosa PA01
ucgccauggcgcugc

SEQ ID NO: 1410127 - RNA, 14 nt, Pseudomonas aeruginosa PA01
ucgccauggcggac

SEQ ID NO: 1410128 - RNA, 15 nt, Pseudomonas aeruginosa PA01
ucgccauucggcgac

SEQ ID NO: 1410129 - RNA, 17 nt, Pseudomonas aeruginosa PA01
ucgcccauugccgggcu

SEQ ID NO: 1410130 - RNA, 12 nt, Pseudomonas aeruginosa PA01
ucgcccaccagg

SEQ ID NO: 1410131 - RNA, 13 nt, Pseudomonas aeruginosa PA01
ucgcccaccaggu

SEQ ID NO: 1410132 - RNA, 15 nt, Pseudomonas aeruginosa PA01
ucgcccaccaggucg

SEQ ID NO: 1410133 - RNA, 21 nt, Pseudomonas aeruginosa PA01
ucgcccaccaggucgccguag

SEQ ID NO: 1410134 - RNA, 15 nt, Pseudomonas aeruginosa PA01
ucgccgcccgaggcg

SEQ ID NO: 1410135 - RNA, 18 nt, Pseudomonas aeruginosa PA01
ucgccgcccgaggcgacc

SEQ ID NO: 1410136 - RNA, 17 nt, Pseudomonas aeruginosa PA01
ucgccgcccggcagcgg

SEQ ID NO: 1410137 - RNA, 18 nt, Pseudomonas aeruginosa PA01
ucgccgcccggcagcggc

SEQ ID NO: 1410138 - RNA, 19 nt, Pseudomonas aeruginosa PA01
ucgccgcccggcagcggcu

SEQ ID NO: 1410139 - RNA, 20 nt, Pseudomonas aeruginosa PA01
ucgccgcccggcagcggcug

SEQ ID NO: 1410140 - RNA, 13 nt, Pseudomonas aeruginosa PA01
ucgccgcccgcgc

SEQ ID NO: 1410141 - RNA, 14 nt, Pseudomonas aeruginosa PA01
ucgccgccgaggcg

SEQ ID NO: 1410142 - RNA, 17 nt, Pseudomonas aeruginosa PA01
ucgccgccgaggcgcgc

SEQ ID NO: 1410143 - RNA, 20 nt, Pseudomonas aeruginosa PA01
ucgccgcccucgcaguacag

SEQ ID NO: 1410144 - RNA, 23 nt, Pseudomonas aeruginosa PA01
ucgccgccgacacccgcgccgcc

SEQ ID NO: 1410145 - RNA, 16 nt, Pseudomonas aeruginosa PA01
ucgccgccgaccgggc

SEQ ID NO: 1410146 - RNA, 15 nt, Pseudomonas aeruginosa PA01
ucgccgccgagcagg

SEQ ID NO: 1410147 - RNA, 17 nt, Pseudomonas aeruginosa PA01
ucgccgccgagcaggcc

SEQ ID NO: 1410148 - RNA, 20 nt, Pseudomonas aeruginosa PA01
ucgccgcgggcguugcgcgc

SEQ ID NO: 1410149 - RNA, 23 nt, Pseudomonas aeruginosa PA01
ucgccgcgggcguugcgcgccuc

SEQ ID NO: 1410150 - RNA, 15 nt, Pseudomonas aeruginosa PA01
ucgccgcggcguagg

SEQ ID NO: 1410151 - RNA, 15 nt, Pseudomonas aeruginosa PA01
ucgccgccgccggga

SEQ ID NO: 1410152 - RNA, 18 nt, Pseudomonas aeruginosa PA01
ucgccgccgcagccgugg

SEQ ID NO: 1410153 - RNA, 20 nt, Pseudomonas aeruginosa PA01
ucgccgccgcagccguggcg

SEQ ID NO: 1410154 - RNA, 23 nt, Pseudomonas aeruginosa PA01
ucgccgccgcagccguggcgcga

SEQ ID NO: 1410155 - RNA, 14 nt, Pseudomonas aeruginosa PA01
ucgccggcgcgcac

SEQ ID NO: 1410156 - RNA, 13 nt, Pseudomonas aeruginosa PA01
ucgccggccgcug

SEQ ID NO: 1410157 - RNA, 23 nt, Pseudomonas aeruginosa PA01
ucgccggaagcuucaggcucggc

SEQ ID NO: 1410158 - RNA, 19 nt, Pseudomonas aeruginosa PA01
ucgccggccuggaucucgg

SEQ ID NO: 1410159 - RNA, 23 nt, Pseudomonas aeruginosa PA01
ucgccggccuggaucucggcggc

SEQ ID NO: 1410160 - RNA, 15 nt, Pseudomonas aeruginosa PA01
ucgccggcgagccgc

SEQ ID NO: 1410161 - RNA, 17 nt, Pseudomonas aeruginosa PA01
ucgccggcgagccgcug

SEQ ID NO: 1410162 - RNA, 19 nt, Pseudomonas aeruginosa PA01
ucgccggcgagccgcuggc

SEQ ID NO: 1410163 - RNA, 13 nt, Pseudomonas aeruginosa PA01
ucgccggcgaucu

SEQ ID NO: 1410164 - RNA, 21 nt, Pseudomonas aeruginosa PA01
ucgccgcugaaguccuggccg

SEQ ID NO: 1410165 - RNA, 14 nt, Pseudomonas aeruginosa PA01
ucgccgcuccacac

SEQ ID NO: 1410166 - RNA, 18 nt, Pseudomonas aeruginosa PA01
ucgccgcuccgcgccacg

SEQ ID NO: 1410167 - RNA, 19 nt, Pseudomonas aeruginosa PA01
ucgccgcuccgcgccacgc

SEQ ID NO: 1410168 - RNA, 15 nt, Pseudomonas aeruginosa PA01
ucgccgcucauccgc

SEQ ID NO: 1410169 - RNA, 21 nt, Pseudomonas aeruginosa PA01
ucgccgcucauccgcugguag

SEQ ID NO: 1410170 - RNA, 13 nt, Pseudomonas aeruginosa PA01
ucgccgcugggca

SEQ ID NO: 1410171 - RNA, 17 nt, Pseudomonas aeruginosa PA01
ucgccgcugggcagcac

SEQ ID NO: 1410172 - RNA, 14 nt, Pseudomonas aeruginosa PA01
ucgccggcgcgggc

SEQ ID NO: 1410173 - RNA, 18 nt, Pseudomonas aeruginosa PA01
ucgccgucaucgagcagu

SEQ ID NO: 1410174 - RNA, 21 nt, Pseudomonas aeruginosa PA01
ucgccggcguccuccuccagu

SEQ ID NO: 1410175 - RNA, 16 nt, Pseudomonas aeruginosa PA01
ucgccguccaccaagc

SEQ ID NO: 1410176 - RNA, 22 nt, Pseudomonas aeruginosa PA01
ucgccguccuugucgcagcggc

SEQ ID NO: 1410177 - RNA, 23 nt, Pseudomonas aeruginosa PA01
ucgccguccuugucgcagcggcc

SEQ ID NO: 1410178 - RNA, 16 nt, Pseudomonas aeruginosa PA01
ucgccgucgagccagc

SEQ ID NO: 1410179 - RNA, 18 nt, Pseudomonas aeruginosa PA01
ucgccgucgagccagccc

SEQ ID NO: 1410180 - RNA, 22 nt, Pseudomonas aeruginosa PA01
ucgccgucgagccagcccagcg

SEQ ID NO: 1410181 - RNA, 22 nt, Pseudomonas aeruginosa PA01
ucgccgucgucgggaucgagca

SEQ ID NO: 1410182 - RNA, 11 nt, Pseudomonas aeruginosa PA01
ucgccgugggc

SEQ ID NO: 1410183 - RNA, 17 nt, Pseudomonas aeruginosa PA01
ucgccgugguggccgug

SEQ ID NO: 1410184 - RNA, 16 nt, Pseudomonas aeruginosa PA01
ucgccgucguccgggu

SEQ ID NO: 1410185 - RNA, 13 nt, Pseudomonas aeruginosa PA01
ucgccuccggcac

SEQ ID NO: 1410186 - RNA, 14 nt, Pseudomonas aeruginosa PA01
ucgccuccaccagc

SEQ ID NO: 1410187 - RNA, 18 nt, Pseudomonas aeruginosa PA01
ucgccuccaccagcgccg

SEQ ID NO: 1410188 - RNA, 20 nt, Pseudomonas aeruginosa PA01
ucgccuccaccagcgccggc

SEQ ID NO: 1410189 - RNA, 21 nt, Pseudomonas aeruginosa PA01
ucgccuccaccagcgccggcg

SEQ ID NO: 1410190 - RNA, 14 nt, Pseudomonas aeruginosa PA01
ucgccuccacggcg

SEQ ID NO: 1410191 - RNA, 16 nt, Pseudomonas aeruginosa PA01
ucgccuccacggcggc

SEQ ID NO: 1410192 - RNA, 17 nt, Pseudomonas aeruginosa PA01
ucgccuccacggcggcc

SEQ ID NO: 1410193 - RNA, 13 nt, Pseudomonas aeruginosa PA01
ucgccucgccggc

SEQ ID NO: 1410194 - RNA, 14 nt, Pseudomonas aeruginosa PA01
ucgccucgcgccag

SEQ ID NO: 1410195 - RNA, 15 nt, Pseudomonas aeruginosa PA01
ucgccucgcgccaga

SEQ ID NO: 1410196 - RNA, 13 nt, Pseudomonas aeruginosa PA01
ucgccguucagcu

SEQ ID NO: 1410197 - RNA, 14 nt, Pseudomonas aeruginosa PA01
ucgccuaccagacc

SEQ ID NO: 1410198 - RNA, 23 nt, Pseudomonas aeruginosa PA01
ucgccuaccagaccgcagccggc

SEQ ID NO: 1410199 - RNA, 24 nt, Pseudomonas aeruginosa PA01
ucgccuaccagaccgcagccggcg

SEQ ID NO: 1410200 - RNA, 13 nt, Pseudomonas aeruginosa PA01
ucgccuaccggcg

SEQ ID NO: 1410201 - RNA, 15 nt, Pseudomonas aeruginosa PA01
ucgccguugccuucg

SEQ ID NO: 1410202 - RNA, 20 nt, Pseudomonas aeruginosa PA01
ucgccguugccuucgccguc

SEQ ID NO: 1410203 - RNA, 21 nt, Pseudomonas aeruginosa PA01
ucgccguugccuucgccgucg

SEQ ID NO: 1410204 - RNA, 24 nt, Pseudomonas aeruginosa PA01
ucgccguugccuucgccgucgagc

SEQ ID NO: 1410205 - RNA, 19 nt, Pseudomonas aeruginosa PA01
ucgcgcccagugcccggca

SEQ ID NO: 1410206 - RNA, 22 nt, Pseudomonas aeruginosa PA01
ucgcgcccagugcccggcagau

SEQ ID NO: 1410207 - RNA, 14 nt, Pseudomonas aeruginosa PA01
ucgcgccaggccgc

SEQ ID NO: 1410208 - RNA, 13 nt, Pseudomonas aeruginosa PA01
ucgcgccaggcga

SEQ ID NO: 1410209 - RNA, 13 nt, Pseudomonas aeruginosa PA01
ucgcgcagccagg

SEQ ID NO: 1410210 - RNA, 14 nt, Pseudomonas aeruginosa PA01
ucgcgcagccaggc

SEQ ID NO: 1410211 - RNA, 15 nt, Pseudomonas aeruginosa PA01
ucgcgcagccaggcg

SEQ ID NO: 1410212 - RNA, 16 nt, Pseudomonas aeruginosa PA01
ucgcgcagccaggcga

SEQ ID NO: 1410213 - RNA, 13 nt, Pseudomonas aeruginosa PA01
ucgcgcagcaggc

SEQ ID NO: 1410214 - RNA, 20 nt, Pseudomonas aeruginosa PA01
ucgcgcaugaucgccucggc

SEQ ID NO: 1410215 - RNA, 21 nt, Pseudomonas aeruginosa PA01
ucgcgcaugaucgccucggcg

SEQ ID NO: 1410216 - RNA, 21 nt, Pseudomonas aeruginosa PA01
ucgcgccagagaucgcccagc

SEQ ID NO: 1410217 - RNA, 14 nt, Pseudomonas aeruginosa PA01
ucgcgccagcaccg

SEQ ID NO: 1410218 - RNA, 12 nt, Pseudomonas aeruginosa PA01
ucgcgccagccc

SEQ ID NO: 1410219 - RNA, 18 nt, Pseudomonas aeruginosa PA01
ucgcgccagccccaggcg

SEQ ID NO: 1410220 - RNA, 20 nt, Pseudomonas aeruginosa PA01
ucgcgccagccccaggcgcg

SEQ ID NO: 1410221 - RNA, 22 nt, Pseudomonas aeruginosa PA01
ucgcgccagccccaggcgcggc

SEQ ID NO: 1410222 - RNA, 21 nt, Pseudomonas aeruginosa PA01
ucgcgcaacugcggggcgcuc

SEQ ID NO: 1410223 - RNA, 20 nt, Pseudomonas aeruginosa PA01
ucgcgcaacugcucgaacug

SEQ ID NO: 1410224 - RNA, 17 nt, Pseudomonas aeruginosa PA01
ucgcgcaagcgcccggc

SEQ ID NO: 1410225 - RNA, 23 nt, Pseudomonas aeruginosa PA01
ucgcgauuggagaugcucaggcg

SEQ ID NO: 1410226 - RNA, 23 nt, Pseudomonas aeruginosa PA01
ucgcgcacuuccggacugcccag

SEQ ID NO: 1410227 - RNA, 17 nt, Pseudomonas aeruginosa PA01
ucgcgcagcaggaucca

SEQ ID NO: 1410228 - RNA, 17 nt, Pseudomonas aeruginosa PA01
ucgcgauccaccgccag

SEQ ID NO: 1410229 - RNA, 21 nt, Pseudomonas aeruginosa PA01
ucgcgauccaccgccagggcg

SEQ ID NO: 1410230 - RNA, 22 nt, Pseudomonas aeruginosa PA01
ucgcgacagguucaggacgcuc

SEQ ID NO: 1410231 - RNA, 15 nt, Pseudomonas aeruginosa PA01
ucgcgaucgaucggc

SEQ ID NO: 1410232 - RNA, 15 nt, Pseudomonas aeruginosa PA01
ucgcgaucggcgucc

SEQ ID NO: 1410233 - RNA, 18 nt, Pseudomonas aeruginosa PA01
ucgcgaucggcguccgcg

SEQ ID NO: 1410234 - RNA, 15 nt, Pseudomonas aeruginosa PA01
ucgcgcaaccagccg

SEQ ID NO: 1410235 - RNA, 16 nt, Pseudomonas aeruginosa PA01
ucgcgcaacgccgacg

SEQ ID NO: 1410236 - RNA, 19 nt, Pseudomonas aeruginosa PA01
ucgcgcaacgccgacggcg

SEQ ID NO: 1410237 - RNA, 22 nt, Pseudomonas aeruginosa PA01
ucgcgcaacgccgacggcgugc

SEQ ID NO: 1410238 - RNA, 14 nt, Pseudomonas aeruginosa PA01
ucgcgcaacgccuu

SEQ ID NO: 1410239 - RNA, 18 nt, Pseudomonas aeruginosa PA01
ucgcgcaacgccuugcca

SEQ ID NO: 1410240 - RNA, 22 nt, Pseudomonas aeruginosa PA01
ucgcgcaacgccuugccauagg

SEQ ID NO: 1410241 - RNA, 14 nt, Pseudomonas aeruginosa PA01
ucgccuuccaccac

SEQ ID NO: 1410242 - RNA, 14 nt, Pseudomonas aeruginosa PA01
ucgccugccaggcg

SEQ ID NO: 1410243 - RNA, 19 nt, Pseudomonas aeruginosa PA01
ucgccugcuuggcggcggu

SEQ ID NO: 1410244 - RNA, 14 nt, Pseudomonas aeruginosa PA01
ucgccuuccucggc

SEQ ID NO: 1410245 - RNA, 15 nt, Pseudomonas aeruginosa PA01
ucgccuuccucggcg

SEQ ID NO: 1410246 - RNA, 13 nt, Pseudomonas aeruginosa PA01
ucgccuucgcuga

SEQ ID NO: 1410247 - RNA, 15 nt, Pseudomonas aeruginosa PA01
ucgccuugaccagcg

SEQ ID NO: 1410248 - RNA, 17 nt, Pseudomonas aeruginosa PA01
ucgccuugaccagcggc

SEQ ID NO: 1410249 - RNA, 22 nt, Pseudomonas aeruginosa PA01
ucgccuugaccagcggcccggc

SEQ ID NO: 1410250 - RNA, 17 nt, Pseudomonas aeruginosa PA01
ucgccuugcccuggccg

SEQ ID NO: 1410251 - RNA, 18 nt, Pseudomonas aeruginosa PA01
ucgccuugcccuggccgg

SEQ ID NO: 1410252 - RNA, 17 nt, Pseudomonas aeruginosa PA01
ucgccuugcgcgugcug

SEQ ID NO: 1410253 - RNA, 18 nt, Pseudomonas aeruginosa PA01
ucgccuggcccuggaccu

SEQ ID NO: 1410254 - RNA, 13 nt, Pseudomonas aeruginosa PA01
ucgccuggcgcga

SEQ ID NO: 1410255 - RNA, 14 nt, Pseudomonas aeruginosa PA01
ucgccuggcgcgac

SEQ ID NO: 1410256 - RNA, 21 nt, Pseudomonas aeruginosa PA01
ucgccuggucgauauagcccu

SEQ ID NO: 1410257 - RNA, 14 nt, Pseudomonas aeruginosa PA01
ucgccugcuggccg

SEQ ID NO: 1410258 - RNA, 15 nt, Pseudomonas aeruginosa PA01
ucgccugcuggccgg

SEQ ID NO: 1410259 - RNA, 22 nt, Pseudomonas aeruginosa PA01
ucgccucguucagcagcaugcc

SEQ ID NO: 1410260 - RNA, 22 nt, Pseudomonas aeruginosa PA01
ucgccucgggggugcccaucag

SEQ ID NO: 1410261 - RNA, 20 nt, Pseudomonas aeruginosa PA01
ucgcgacacgugccccaggc

SEQ ID NO: 1410262 - RNA, 20 nt, Pseudomonas aeruginosa PA01
ucgcgacccucagucgcccc

SEQ ID NO: 1410263 - RNA, 16 nt, Pseudomonas aeruginosa PA01
ucgcgacccuggccgc

SEQ ID NO: 1410264 - RNA, 19 nt, Pseudomonas aeruginosa PA01
ucgcgacccuggccgcgcg

SEQ ID NO: 1410265 - RNA, 21 nt, Pseudomonas aeruginosa PA01
ucgcgacccuggccgcgcggc

SEQ ID NO: 1410266 - RNA, 13 nt, Pseudomonas aeruginosa PA01
ucgcgaucaccgc

SEQ ID NO: 1410267 - RNA, 21 nt, Pseudomonas aeruginosa PA01
ucgcgaccgguaacuggccag

SEQ ID NO: 1410268 - RNA, 18 nt, Pseudomonas aeruginosa PA01
ucgcgauagacgccggcg

SEQ ID NO: 1410269 - RNA, 18 nt, Pseudomonas aeruginosa PA01
ucgcgaagaccggccggc

SEQ ID NO: 1410270 - RNA, 16 nt, Pseudomonas aeruginosa PA01
ucgcgaacucggcgcc

SEQ ID NO: 1410271 - RNA, 21 nt, Pseudomonas aeruginosa PA01
ucgccuucccagacguccagc

SEQ ID NO: 1410272 - RNA, 21 nt, Pseudomonas aeruginosa PA01
ucgccuucccggucgacggcg

SEQ ID NO: 1410273 - RNA, 17 nt, Pseudomonas aeruginosa PA01
ucgcgaaaacucccggc

SEQ ID NO: 1410274 - RNA, 18 nt, Pseudomonas aeruginosa PA01
ucgagagaauccgccguu

SEQ ID NO: 1410275 - RNA, 23 nt, Pseudomonas aeruginosa PA01
ucgagauugucgcguccggccag

SEQ ID NO: 1410276 - RNA, 18 nt, Pseudomonas aeruginosa PA01
ucgagaugcugcgggcgc

SEQ ID NO: 1410277 - RNA, 22 nt, Pseudomonas aeruginosa PA01
ucgagaugcugcgggcgccgcc

SEQ ID NO: 1410278 - RNA, 16 nt, Pseudomonas aeruginosa PA01
ucgagcaacagcagga

SEQ ID NO: 1410279 - RNA, 23 nt, Pseudomonas aeruginosa PA01
ucgagcaauugccagaggcugcg

SEQ ID NO: 1410280 - RNA, 16 nt, Pseudomonas aeruginosa PA01
ucgagcaucugccggg

SEQ ID NO: 1410281 - RNA, 18 nt, Pseudomonas aeruginosa PA01
ucgagcaucugccgggcg

SEQ ID NO: 1410282 - RNA, 19 nt, Pseudomonas aeruginosa PA01
ucgagcaucugccgggcgc

SEQ ID NO: 1410283 - RNA, 20 nt, Pseudomonas aeruginosa PA01
ucgagcaucugccgggcgcg

SEQ ID NO: 1410284 - RNA, 20 nt, Pseudomonas aeruginosa PA01
ucgagcaguuccaggcgucc

SEQ ID NO: 1410285 - RNA, 21 nt, Pseudomonas aeruginosa PA01
ucgagcaguucccccagcacc

SEQ ID NO: 1410286 - RNA, 17 nt, Pseudomonas aeruginosa PA01
ucgagcaccaccacucg

SEQ ID NO: 1410287 - RNA, 19 nt, Pseudomonas aeruginosa PA01
ucgagcaccaccacucgcg

SEQ ID NO: 1410288 - RNA, 12 nt, Pseudomonas aeruginosa PA01
ucgagcccuggu

SEQ ID NO: 1410289 - RNA, 18 nt, Pseudomonas aeruginosa PA01
ucgagcccuugcgcggcg

SEQ ID NO: 1410290 - RNA, 16 nt, Pseudomonas aeruginosa PA01
ucgagccacucgugca

SEQ ID NO: 1410291 - RNA, 20 nt, Pseudomonas aeruginosa PA01
ucgagccagcccagcggcgc

SEQ ID NO: 1410292 - RNA, 13 nt, Pseudomonas aeruginosa PA01
ucgagccagcgcu

SEQ ID NO: 1410293 - RNA, 12 nt, Pseudomonas aeruginosa PA01
ucgagccgccgg

SEQ ID NO: 1410294 - RNA, 14 nt, Pseudomonas aeruginosa PA01
ucgagccgccgggg

SEQ ID NO: 1410295 - RNA, 21 nt, Pseudomonas aeruginosa PA01
ucgaggaauuccggcagcgac

SEQ ID NO: 1410296 - RNA, 19 nt, Pseudomonas aeruginosa PA01
ucgaggaccgacggcaacu

SEQ ID NO: 1410297 - RNA, 19 nt, Pseudomonas aeruginosa PA01
ucgagguagguccaggcga

SEQ ID NO: 1410298 - RNA, 22 nt, Pseudomonas aeruginosa PA01
ucgaggaucuugcgcccggcgc

SEQ ID NO: 1410299 - RNA, 19 nt, Pseudomonas aeruginosa PA01
ucgaggaacaggucgacgc

SEQ ID NO: 1410300 - RNA, 18 nt, Pseudomonas aeruginosa PA01
ucgaggaaggccagcagg

SEQ ID NO: 1410301 - RNA, 18 nt, Pseudomonas aeruginosa PA01
ucgagcuuguuggccagc

SEQ ID NO: 1410302 - RNA, 21 nt, Pseudomonas aeruginosa PA01
ucgagcuguccaucucgccgc

SEQ ID NO: 1410303 - RNA, 21 nt, Pseudomonas aeruginosa PA01
ucgagcugcucgauggcggcc

SEQ ID NO: 1410304 - RNA, 15 nt, Pseudomonas aeruginosa PA01
ucgagcuggcgcagg

SEQ ID NO: 1410305 - RNA, 15 nt, Pseudomonas aeruginosa PA01
ucgaguaccgcugcg

SEQ ID NO: 1410306 - RNA, 17 nt, Pseudomonas aeruginosa PA01
ucgaguaccgcugcggc

SEQ ID NO: 1410307 - RNA, 21 nt, Pseudomonas aeruginosa PA01
ucgaguaccgcugcggccggc

SEQ ID NO: 1410308 - RNA, 12 nt, Pseudomonas aeruginosa PA01
ucgagucgccgg

SEQ ID NO: 1410309 - RNA, 15 nt, Pseudomonas aeruginosa PA01
ucgagucgcgcagcc

SEQ ID NO: 1410310 - RNA, 19 nt, Pseudomonas aeruginosa PA01
ucgagucccguccgcugcg

SEQ ID NO: 1410311 - RNA, 14 nt, Pseudomonas aeruginosa PA01
ucgaguucgcgcgg

SEQ ID NO: 1410312 - RNA, 14 nt, Pseudomonas aeruginosa PA01
ucgaggucgagguc

SEQ ID NO: 1410313 - RNA, 17 nt, Pseudomonas aeruginosa PA01
ucgaggucgacggcggc

SEQ ID NO: 1410314 - RNA, 17 nt, Pseudomonas aeruginosa PA01
ucgagguucuccaggcu

SEQ ID NO: 1410315 - RNA, 20 nt, Pseudomonas aeruginosa PA01
ucgagguucucgacccgcuc

SEQ ID NO: 1410316 - RNA, 15 nt, Pseudomonas aeruginosa PA01
ucgaggucggcgauc

SEQ ID NO: 1410317 - RNA, 18 nt, Pseudomonas aeruginosa PA01
ucgagguugcgcggcagg

SEQ ID NO: 1410318 - RNA, 14 nt, Pseudomonas aeruginosa PA01
ucgaggucggccug

SEQ ID NO: 1410319 - RNA, 19 nt, Pseudomonas aeruginosa PA01
ucgauccccaacccggcca

SEQ ID NO: 1410320 - RNA, 20 nt, Pseudomonas aeruginosa PA01
ucgauccccaacccggccag

SEQ ID NO: 1410321 - RNA, 15 nt, Pseudomonas aeruginosa PA01
ucgaucgagcgaucg

SEQ ID NO: 1410322 - RNA, 15 nt, Pseudomonas aeruginosa PA01
ucgaucggcagggcg

SEQ ID NO: 1410323 - RNA, 17 nt, Pseudomonas aeruginosa PA01
ucgaucggcccgggcgc

SEQ ID NO: 1410324 - RNA, 13 nt, Pseudomonas aeruginosa PA01
ucgaucccggcgc

SEQ ID NO: 1410325 - RNA, 16 nt, Pseudomonas aeruginosa PA01
ucgacgguucgauccc

SEQ ID NO: 1410326 - RNA, 17 nt, Pseudomonas aeruginosa PA01
ucgacguaggcggcgag

SEQ ID NO: 1410327 - RNA, 22 nt, Pseudomonas aeruginosa PA01
ucgacguaccgccugccauccg

SEQ ID NO: 1410328 - RNA, 20 nt, Pseudomonas aeruginosa PA01
ucgacguagaggaucucgcc

SEQ ID NO: 1410329 - RNA, 15 nt, Pseudomonas aeruginosa PA01
ucgacgguuucaggc

SEQ ID NO: 1410330 - RNA, 18 nt, Pseudomonas aeruginosa PA01
ucgacggagagcagcagc

SEQ ID NO: 1410331 - RNA, 15 nt, Pseudomonas aeruginosa PA01
ucgagacgccguagc

SEQ ID NO: 1410332 - RNA, 17 nt, Pseudomonas aeruginosa PA01
ucgagacgccguagcgc

SEQ ID NO: 1410333 - RNA, 21 nt, Pseudomonas aeruginosa PA01
ucgagaaggaagucgagcugg

SEQ ID NO: 1410334 - RNA, 19 nt, Pseudomonas aeruginosa PA01
ucgagaaggcugccgggcu

SEQ ID NO: 1410335 - RNA, 14 nt, Pseudomonas aeruginosa PA01
ucgacucgauggcg

SEQ ID NO: 1410336 - RNA, 16 nt, Pseudomonas aeruginosa PA01
ucgacuucgucgaaga

SEQ ID NO: 1410337 - RNA, 20 nt, Pseudomonas aeruginosa PA01
ucgacgcucuccgucagggc

SEQ ID NO: 1410338 - RNA, 20 nt, Pseudomonas aeruginosa PA01
ucgacgcucugcucggccag

SEQ ID NO: 1410339 - RNA, 17 nt, Pseudomonas aeruginosa PA01
ucgacgcugcccagccc

SEQ ID NO: 1410340 - RNA, 18 nt, Pseudomonas aeruginosa PA01
ucgacgcugcccagcccg

SEQ ID NO: 1410341 - RNA, 19 nt, Pseudomonas aeruginosa PA01
ucgacgcugcccagcccgc

SEQ ID NO: 1410342 - RNA, 14 nt, Pseudomonas aeruginosa PA01
ucgacgcgccacgc

SEQ ID NO: 1410343 - RNA, 14 nt, Pseudomonas aeruginosa PA01
ucgacgcgccaggu

SEQ ID NO: 1410344 - RNA, 15 nt, Pseudomonas aeruginosa PA01
ucgacgcgcggcugc

SEQ ID NO: 1410345 - RNA, 20 nt, Pseudomonas aeruginosa PA01
ucgacgcgcggcugcuugcc

SEQ ID NO: 1410346 - RNA, 19 nt, Pseudomonas aeruginosa PA01
ucgacgcagagcgccauga

SEQ ID NO: 1410347 - RNA, 22 nt, Pseudomonas aeruginosa PA01
ucgacgcagccgggccgcagcg

SEQ ID NO: 1410348 - RNA, 19 nt, Pseudomonas aeruginosa PA01
ucgacgcagcgcgcgccga

SEQ ID NO: 1410349 - RNA, 21 nt, Pseudomonas aeruginosa PA01
ucgacgcagcgcgcgccgagc

SEQ ID NO: 1410350 - RNA, 12 nt, Pseudomonas aeruginosa PA01
ucgacgcagggc

SEQ ID NO: 1410351 - RNA, 15 nt, Pseudomonas aeruginosa PA01
ucgacgcagggcggc

SEQ ID NO: 1410352 - RNA, 14 nt, Pseudomonas aeruginosa PA01
ucgacgagccgcga

SEQ ID NO: 1410353 - RNA, 17 nt, Pseudomonas aeruginosa PA01
ucgacgagccgcgacgc

SEQ ID NO: 1410354 - RNA, 23 nt, Pseudomonas aeruginosa PA01
ucgacgaugcugaacuguucgau

SEQ ID NO: 1410355 - RNA, 20 nt, Pseudomonas aeruginosa PA01
ucgaccaugccguagaucag

SEQ ID NO: 1410356 - RNA, 15 nt, Pseudomonas aeruginosa PA01
ucgaccaucaccagc

SEQ ID NO: 1410357 - RNA, 15 nt, Pseudomonas aeruginosa PA01
ucgaccaucggcggc

SEQ ID NO: 1410358 - RNA, 16 nt, Pseudomonas aeruginosa PA01
ucgaccaucggcggcg

SEQ ID NO: 1410359 - RNA, 17 nt, Pseudomonas aeruginosa PA01
ucgaccaucggcggcgg

SEQ ID NO: 1410360 - RNA, 21 nt, Pseudomonas aeruginosa PA01
ucgaccagguccggcagcgcc

SEQ ID NO: 1410361 - RNA, 21 nt, Pseudomonas aeruginosa PA01
ucgaccaggucgccaugcccg

SEQ ID NO: 1410362 - RNA, 19 nt, Pseudomonas aeruginosa PA01
ucgaccagggcauccaggg

SEQ ID NO: 1410363 - RNA, 18 nt, Pseudomonas aeruginosa PA01
ucgacgacgaaaggccgc

SEQ ID NO: 1410364 - RNA, 21 nt, Pseudomonas aeruginosa PA01
ucgaccauucccacgacccgc

SEQ ID NO: 1410365 - RNA, 14 nt, Pseudomonas aeruginosa PA01
ucgaccagcggcgg

SEQ ID NO: 1410366 - RNA, 21 nt, Pseudomonas aeruginosa PA01
ucgaccaggaauuccuggccg

SEQ ID NO: 1410367 - RNA, 15 nt, Pseudomonas aeruginosa PA01
ucgaccagcgccgcg

SEQ ID NO: 1410368 - RNA, 18 nt, Pseudomonas aeruginosa PA01
ucgaccagcgccgcggcg

SEQ ID NO: 1410369 - RNA, 18 nt, Pseudomonas aeruginosa PA01
ucgaccagacgcagcagc

SEQ ID NO: 1410370 - RNA, 14 nt, Pseudomonas aeruginosa PA01
ucgaccagaucggc

SEQ ID NO: 1410371 - RNA, 16 nt, Pseudomonas aeruginosa PA01
ucgaccagcagcggcu

SEQ ID NO: 1410372 - RNA, 20 nt, Pseudomonas aeruginosa PA01
ucgaccacggccuucggcag

SEQ ID NO: 1410373 - RNA, 21 nt, Pseudomonas aeruginosa PA01
ucgaccacggccuucggcagg

SEQ ID NO: 1410374 - RNA, 12 nt, Pseudomonas aeruginosa PA01
uccgguggcgga

SEQ ID NO: 1410375 - RNA, 15 nt, Pseudomonas aeruginosa PA01
uccggugcaggccga

SEQ ID NO: 1410376 - RNA, 16 nt, Pseudomonas aeruginosa PA01
uccggugucaggccga

SEQ ID NO: 1410377 - RNA, 23 nt, Pseudomonas aeruginosa PA01
uccgguucggcaaggcgcagcug

SEQ ID NO: 1410378 - RNA, 23 nt, Pseudomonas aeruginosa PA01
uccgguugauuuccgcaccgagg

SEQ ID NO: 1410379 - RNA, 18 nt, Pseudomonas aeruginosa PA01
uccgguugcuggcacagg

SEQ ID NO: 1410380 - RNA, 18 nt, Pseudomonas aeruginosa PA01
uccggucgcaccgccagc

SEQ ID NO: 1410381 - RNA, 16 nt, Pseudomonas aeruginosa PA01
uccggucagcagcagg

SEQ ID NO: 1410382 - RNA, 17 nt, Pseudomonas aeruginosa PA01
uccguacuggcgccagg

SEQ ID NO: 1410383 - RNA, 20 nt, Pseudomonas aeruginosa PA01
uccguacuggcgccaggccg

SEQ ID NO: 1410384 - RNA, 14 nt, Pseudomonas aeruginosa PA01
uccucggcggcggu

SEQ ID NO: 1410385 - RNA, 19 nt, Pseudomonas aeruginosa PA01
uccucggcguagccggcca

SEQ ID NO: 1410386 - RNA, 15 nt, Pseudomonas aeruginosa PA01
uccucggccgccagg

SEQ ID NO: 1410387 - RNA, 22 nt, Pseudomonas aeruginosa PA01
uccucggcgaacuccgccagcu

SEQ ID NO: 1410388 - RNA, 18 nt, Pseudomonas aeruginosa PA01
uccucggcgaccaccgcg

SEQ ID NO: 1410389 - RNA, 21 nt, Pseudomonas aeruginosa PA01
uccucggucuuuuucgcgugc

SEQ ID NO: 1410390 - RNA, 18 nt, Pseudomonas aeruginosa PA01
uccucggggaagcgcggc

SEQ ID NO: 1410391 - RNA, 14 nt, Pseudomonas aeruginosa PA01
uccucguccagcag

SEQ ID NO: 1410392 - RNA, 19 nt, Pseudomonas aeruginosa PA01
uccucgucguacuggcgga

SEQ ID NO: 1410393 - RNA, 14 nt, Pseudomonas aeruginosa PA01
uccucguggcgcgc

SEQ ID NO: 1410394 - RNA, 15 nt, Pseudomonas aeruginosa PA01
uccugcggccgggug

SEQ ID NO: 1410395 - RNA, 16 nt, Pseudomonas aeruginosa PA01
uccugcggcuggcgaa

SEQ ID NO: 1410396 - RNA, 19 nt, Pseudomonas aeruginosa PA01
uccugcggcuggcgaacca

SEQ ID NO: 1410397 - RNA, 17 nt, Pseudomonas aeruginosa PA01
uccugccggugcucggc

SEQ ID NO: 1410398 - RNA, 17 nt, Pseudomonas aeruginosa PA01
uccugccccgugcaccg

SEQ ID NO: 1410399 - RNA, 22 nt, Pseudomonas aeruginosa PA01
uccugccccgugcaccgaggcg

SEQ ID NO: 1410400 - RNA, 14 nt, Pseudomonas aeruginosa PA01
uccugcccgaccgg

SEQ ID NO: 1410401 - RNA, 19 nt, Pseudomonas aeruginosa PA01
uccugcucgauccagccgg

SEQ ID NO: 1410402 - RNA, 20 nt, Pseudomonas aeruginosa PA01
uccugcucgauccagccggc

SEQ ID NO: 1410403 - RNA, 21 nt, Pseudomonas aeruginosa PA01
uccugcucgauccagccggca

SEQ ID NO: 1410404 - RNA, 15 nt, Pseudomonas aeruginosa PA01
uccugcugcuggccu

SEQ ID NO: 1410405 - RNA, 13 nt, Pseudomonas aeruginosa PA01
uccugcuggcgaa

SEQ ID NO: 1410406 - RNA, 15 nt, Pseudomonas aeruginosa PA01
uccugcucccuggcg

SEQ ID NO: 1410407 - RNA, 17 nt, Pseudomonas aeruginosa PA01
uccugcucccuggcgga

SEQ ID NO: 1410408 - RNA, 20 nt, Pseudomonas aeruginosa PA01
uccugcucccuggcggauau

SEQ ID NO: 1410409 - RNA, 19 nt, Pseudomonas aeruginosa PA01
uccuggaccccgcccuagc

SEQ ID NO: 1410410 - RNA, 23 nt, Pseudomonas aeruginosa PA01
uccuggagguagcugcgccgccu

SEQ ID NO: 1410411 - RNA, 15 nt, Pseudomonas aeruginosa PA01
uccuggauaagccgc

SEQ ID NO: 1410412 - RNA, 17 nt, Pseudomonas aeruginosa PA01
uccuggauaagccgcgc

SEQ ID NO: 1410413 - RNA, 19 nt, Pseudomonas aeruginosa PA01
uccuggauaagccgcgcca

SEQ ID NO: 1410414 - RNA, 18 nt, Pseudomonas aeruginosa PA01
uccugcugguugaccagg

SEQ ID NO: 1410415 - RNA, 18 nt, Pseudomonas aeruginosa PA01
uccuggaaagaccggcgc

SEQ ID NO: 1410416 - RNA, 20 nt, Pseudomonas aeruginosa PA01
uccuggaaagaccggcgccc

SEQ ID NO: 1410417 - RNA, 18 nt, Pseudomonas aeruginosa PA01
uccuggaacaggaagcgg

SEQ ID NO: 1410418 - RNA, 18 nt, Pseudomonas aeruginosa PA01
uccugccagcgcgucggc

SEQ ID NO: 1410419 - RNA, 17 nt, Pseudomonas aeruginosa PA01
uccugcacgcugcgccg

SEQ ID NO: 1410420 - RNA, 22 nt, Pseudomonas aeruginosa PA01
uccugcacgcugcgccggcgcu

SEQ ID NO: 1410421 - RNA, 22 nt, Pseudomonas aeruginosa PA01
uccugcaacagggcauuggcca

SEQ ID NO: 1410422 - RNA, 15 nt, Pseudomonas aeruginosa PA01
uccugaccccggccu

SEQ ID NO: 1410423 - RNA, 15 nt, Pseudomonas aeruginosa PA01
uccugaaggcgcggg

SEQ ID NO: 1410424 - RNA, 17 nt, Pseudomonas aeruginosa PA01
ucgaagcuccagcgugc

SEQ ID NO: 1410425 - RNA, 23 nt, Pseudomonas aeruginosa PA01
ucgaagcuccagcgugcccgcug

SEQ ID NO: 1410426 - RNA, 15 nt, Pseudomonas aeruginosa PA01
ucgaagcgcagcagg

SEQ ID NO: 1410427 - RNA, 24 nt, Pseudomonas aeruginosa PA01
ucgaagccggauucgcgcagcagg

SEQ ID NO: 1410428 - RNA, 14 nt, Pseudomonas aeruginosa PA01
ucgaagcucggcgc

SEQ ID NO: 1410429 - RNA, 18 nt, Pseudomonas aeruginosa PA01
ucgaagcucucgccgcgc

SEQ ID NO: 1410430 - RNA, 17 nt, Pseudomonas aeruginosa PA01
ucgaagcucuucgccag

SEQ ID NO: 1410431 - RNA, 13 nt, Pseudomonas aeruginosa PA01
ucgaagcuggcca

SEQ ID NO: 1410432 - RNA, 17 nt, Pseudomonas aeruginosa PA01
ucgaagcuggccaguug

SEQ ID NO: 1410433 - RNA, 23 nt, Pseudomonas aeruginosa PA01
ucgaagcugucguaguccugggc

SEQ ID NO: 1410434 - RNA, 21 nt, Pseudomonas aeruginosa PA01
ucgaacccgcccucguggcgg

SEQ ID NO: 1410435 - RNA, 13 nt, Pseudomonas aeruginosa PA01
ucgaaccagccgc

SEQ ID NO: 1410436 - RNA, 15 nt, Pseudomonas aeruginosa PA01
ucgaaccguggcggc

SEQ ID NO: 1410437 - RNA, 17 nt, Pseudomonas aeruginosa PA01
ucgaacaucagcagcgc

SEQ ID NO: 1410438 - RNA, 21 nt, Pseudomonas aeruginosa PA01
ucgaacaucagcagcgccagc

SEQ ID NO: 1410439 - RNA, 13 nt, Pseudomonas aeruginosa PA01
ucgaacagcagca

SEQ ID NO: 1410440 - RNA, 13 nt, Pseudomonas aeruginosa PA01
ucgaacagcagcu

SEQ ID NO: 1410441 - RNA, 18 nt, Pseudomonas aeruginosa PA01
ucgaacagcuugccgcug

SEQ ID NO: 1410442 - RNA, 21 nt, Pseudomonas aeruginosa PA01
ucgaacagcuccuccagccgc

SEQ ID NO: 1410443 - RNA, 20 nt, Pseudomonas aeruginosa PA01
ucgacaugcaccaggccgcc

SEQ ID NO: 1410444 - RNA, 21 nt, Pseudomonas aeruginosa PA01
ucgacaugcaccaggccgcca

SEQ ID NO: 1410445 - RNA, 15 nt, Pseudomonas aeruginosa PA01
ucgacaugcaggccg

SEQ ID NO: 1410446 - RNA, 16 nt, Pseudomonas aeruginosa PA01
ucgacaugcaggccgg

SEQ ID NO: 1410447 - RNA, 18 nt, Pseudomonas aeruginosa PA01
ucgacauggaucaccgcc

SEQ ID NO: 1410448 - RNA, 14 nt, Pseudomonas aeruginosa PA01
ucgaccacacaugc

SEQ ID NO: 1410449 - RNA, 16 nt, Pseudomonas aeruginosa PA01
ucgaccacacaugcag

SEQ ID NO: 1410450 - RNA, 17 nt, Pseudomonas aeruginosa PA01
ucgaccacacaugcagg

SEQ ID NO: 1410451 - RNA, 18 nt, Pseudomonas aeruginosa PA01
ucgacaucgucucgcgac

SEQ ID NO: 1410452 - RNA, 17 nt, Pseudomonas aeruginosa PA01
ucgaaguagucggcgua

SEQ ID NO: 1410453 - RNA, 19 nt, Pseudomonas aeruginosa PA01
ucgaaguagucggcguagc

SEQ ID NO: 1410454 - RNA, 23 nt, Pseudomonas aeruginosa PA01
ucgaaguccacugucucgccgau

SEQ ID NO: 1410455 - RNA, 22 nt, Pseudomonas aeruginosa PA01
ucgaaggguuggccgcagcagc

SEQ ID NO: 1410456 - RNA, 20 nt, Pseudomonas aeruginosa PA01
ucgaaggucaggucgagggu

SEQ ID NO: 1410457 - RNA, 22 nt, Pseudomonas aeruginosa PA01
ucgaaggugaagcugccgucga

SEQ ID NO: 1410458 - RNA, 23 nt, Pseudomonas aeruginosa PA01
ucgaaggcguucucguccucggc

SEQ ID NO: 1410459 - RNA, 15 nt, Pseudomonas aeruginosa PA01
ucgaaggaucgccuu

SEQ ID NO: 1410460 - RNA, 23 nt, Pseudomonas aeruginosa PA01
ucgaaggccucggucaggcgcug

SEQ ID NO: 1410461 - RNA, 20 nt, Pseudomonas aeruginosa PA01
ucgaaggccagcucgucgcc

SEQ ID NO: 1410462 - RNA, 15 nt, Pseudomonas aeruginosa PA01
ucgaaggcgccggca

SEQ ID NO: 1410463 - RNA, 15 nt, Pseudomonas aeruginosa PA01
uccuggucgcggggc

SEQ ID NO: 1410464 - RNA, 16 nt, Pseudomonas aeruginosa PA01
uccugguccagccagc

SEQ ID NO: 1410465 - RNA, 20 nt, Pseudomonas aeruginosa PA01
uccugguagaacuccuugcc

SEQ ID NO: 1410466 - RNA, 16 nt, Pseudomonas aeruginosa PA01
uccuggguggcgacgc

SEQ ID NO: 1410467 - RNA, 23 nt, Pseudomonas aeruginosa PA01
uccuggguaugcgcggucaccag

SEQ ID NO: 1410468 - RNA, 22 nt, Pseudomonas aeruginosa PA01
uccugggucgcguacagcgggc

SEQ ID NO: 1410469 - RNA, 14 nt, Pseudomonas aeruginosa PA01
uccugggccaccug

SEQ ID NO: 1410470 - RNA, 22 nt, Pseudomonas aeruginosa PA01
uccugggccgacgcuuccucgc

SEQ ID NO: 1410471 - RNA, 20 nt, Pseudomonas aeruginosa PA01
uccugggccgguugcggcgc

SEQ ID NO: 1410472 - RNA, 19 nt, Pseudomonas aeruginosa PA01
uccugggcgauuuccaccg

SEQ ID NO: 1410473 - RNA, 19 nt, Pseudomonas aeruginosa PA01
uccugggcgccagccgcca

SEQ ID NO: 1410474 - RNA, 20 nt, Pseudomonas aeruginosa PA01
uccugggcgccagccgccau

SEQ ID NO: 1410475 - RNA, 12 nt, Pseudomonas aeruginosa PA01
uccuggcgguag

SEQ ID NO: 1410476 - RNA, 19 nt, Pseudomonas aeruginosa PA01
uccuggcgguagcccggca

SEQ ID NO: 1410477 - RNA, 23 nt, Pseudomonas aeruginosa PA01
uccuggccgacccgcagcggcgc

SEQ ID NO: 1410478 - RNA, 14 nt, Pseudomonas aeruginosa PA01
uccuggccgagcau

SEQ ID NO: 1410479 - RNA, 19 nt, Pseudomonas aeruginosa PA01
uccuggccgagcaucagca

SEQ ID NO: 1410480 - RNA, 18 nt, Pseudomonas aeruginosa PA01
uccuggcgcguacgcccg

SEQ ID NO: 1410481 - RNA, 17 nt, Pseudomonas aeruginosa PA01
uccuggaucggcagcuc

SEQ ID NO: 1410482 - RNA, 11 nt, Pseudomonas aeruginosa PA01
uccuggccggc

SEQ ID NO: 1410483 - RNA, 19 nt, Pseudomonas aeruginosa PA01
uccuggccgggaaccagca

SEQ ID NO: 1410484 - RNA, 18 nt, Pseudomonas aeruginosa PA01
uccuggccggucguucgc

SEQ ID NO: 1410485 - RNA, 19 nt, Pseudomonas aeruginosa PA01
uccuggcaggcucaccgcg

SEQ ID NO: 1410486 - RNA, 17 nt, Pseudomonas aeruginosa PA01
uccuugagcgccagcag

SEQ ID NO: 1410487 - RNA, 20 nt, Pseudomonas aeruginosa PA01
uccuugaguucccagaccug

SEQ ID NO: 1410488 - RNA, 22 nt, Pseudomonas aeruginosa PA01
uccuuggcuggccagcccuggu

SEQ ID NO: 1410489 - RNA, 17 nt, Pseudomonas aeruginosa PA01
uccuugggaucggcgau

SEQ ID NO: 1410490 - RNA, 15 nt, Pseudomonas aeruginosa PA01
uccuugcgcggcagg

SEQ ID NO: 1410491 - RNA, 20 nt, Pseudomonas aeruginosa PA01
uccuuggucaggucgacgcc

SEQ ID NO: 1410492 - RNA, 23 nt, Pseudomonas aeruginosa PA01
uccuugguguuggucaggcccug

SEQ ID NO: 1410493 - RNA, 17 nt, Pseudomonas aeruginosa PA01
uccuuguucggcuggac

SEQ ID NO: 1410494 - RNA, 21 nt, Pseudomonas aeruginosa PA01
ucgaacacuugaccgucggca

SEQ ID NO: 1410495 - RNA, 23 nt, Pseudomonas aeruginosa PA01
ucgaacacuugaccgucggcaag

SEQ ID NO: 1410496 - RNA, 23 nt, Pseudomonas aeruginosa PA01
ucgaacagcaccgagcaggcacc

SEQ ID NO: 1410497 - RNA, 15 nt, Pseudomonas aeruginosa PA01
ucccuaccagcgcaa

SEQ ID NO: 1410498 - RNA, 19 nt, Pseudomonas aeruginosa PA01
ucccuaucuccgccggggg

SEQ ID NO: 1410499 - RNA, 13 nt, Pseudomonas aeruginosa PA01
ucccucaaccggc

SEQ ID NO: 1410500 - RNA, 18 nt, Pseudomonas aeruginosa PA01
ucccucagguagucggcg

SEQ ID NO: 1410501 - RNA, 22 nt, Pseudomonas aeruginosa PA01
ucccucagguagucggcgaugc

SEQ ID NO: 1410502 - RNA, 23 nt, Pseudomonas aeruginosa PA01
ucccguuggggaugcgccguacg

SEQ ID NO: 1410503 - RNA, 20 nt, Pseudomonas aeruginosa PA01
ucccguguaccacgcccgcg

SEQ ID NO: 1410504 - RNA, 16 nt, Pseudomonas aeruginosa PA01
ucccguccgcugcgcc

SEQ ID NO: 1410505 - RNA, 13 nt, Pseudomonas aeruginosa PA01
ucccguccgggca

SEQ ID NO: 1410506 - RNA, 12 nt, Pseudomonas aeruginosa PA01
ucccguccagcg

SEQ ID NO: 1410507 - RNA, 15 nt, Pseudomonas aeruginosa PA01
ucccguagaccggcu

SEQ ID NO: 1410508 - RNA, 22 nt, Pseudomonas aeruginosa PA01
ucccggaucagcucgcguagcg

SEQ ID NO: 1410509 - RNA, 17 nt, Pseudomonas aeruginosa PA01
ucccggauucgccgagg

SEQ ID NO: 1410510 - RNA, 16 nt, Pseudomonas aeruginosa PA01
ucccggagaucggcug

SEQ ID NO: 1410511 - RNA, 13 nt, Pseudomonas aeruginosa PA01
ucccggaggcggc

SEQ ID NO: 1410512 - RNA, 15 nt, Pseudomonas aeruginosa PA01
ucccggaggcggcga

SEQ ID NO: 1410513 - RNA, 15 nt, Pseudomonas aeruginosa PA01
ucccguaaggccagg

SEQ ID NO: 1410514 - RNA, 16 nt, Pseudomonas aeruginosa PA01
ucccgcuccagccggc

SEQ ID NO: 1410515 - RNA, 17 nt, Pseudomonas aeruginosa PA01
ucccgcuccagccggca

SEQ ID NO: 1410516 - RNA, 13 nt, Pseudomonas aeruginosa PA01
ucccgcuccaggc

SEQ ID NO: 1410517 - RNA, 22 nt, Pseudomonas aeruginosa PA01
ucccgcggcccgccgccggggc

SEQ ID NO: 1410518 - RNA, 18 nt, Pseudomonas aeruginosa PA01
ucccgcggcuccagccgc

SEQ ID NO: 1410519 - RNA, 15 nt, Pseudomonas aeruginosa PA01
uccccggccagcagc

SEQ ID NO: 1410520 - RNA, 21 nt, Pseudomonas aeruginosa PA01
uccccggaccagggcgccggg

SEQ ID NO: 1410521 - RNA, 22 nt, Pseudomonas aeruginosa PA01
uccccgccucgaccagcgccgc

SEQ ID NO: 1410522 - RNA, 18 nt, Pseudomonas aeruginosa PA01
uccccgccacuuccagca

SEQ ID NO: 1410523 - RNA, 19 nt, Pseudomonas aeruginosa PA01
uccccgccacuuccagcac

SEQ ID NO: 1410524 - RNA, 15 nt, Pseudomonas aeruginosa PA01
uccccgccgccaggc

SEQ ID NO: 1410525 - RNA, 16 nt, Pseudomonas aeruginosa PA01
uccccgccgccaggcg

SEQ ID NO: 1410526 - RNA, 13 nt, Pseudomonas aeruginosa PA01
ucccgccgcggcg

SEQ ID NO: 1410527 - RNA, 12 nt, Pseudomonas aeruginosa PA01
ucccgcgcgccg

SEQ ID NO: 1410528 - RNA, 12 nt, Pseudomonas aeruginosa PA01
ucccgcgcggcc

SEQ ID NO: 1410529 - RNA, 17 nt, Pseudomonas aeruginosa PA01
ucccgcgcggcccuucg

SEQ ID NO: 1410530 - RNA, 20 nt, Pseudomonas aeruginosa PA01
ucccgcgcggcccuucgacg

SEQ ID NO: 1410531 - RNA, 15 nt, Pseudomonas aeruginosa PA01
ucccgcgauucgccg

SEQ ID NO: 1410532 - RNA, 18 nt, Pseudomonas aeruginosa PA01
ucccgcgauucgccgggc

SEQ ID NO: 1410533 - RNA, 12 nt, Pseudomonas aeruginosa PA01
ucccgcgccagc

SEQ ID NO: 1410534 - RNA, 18 nt, Pseudomonas aeruginosa PA01
ucccgcgccagcgccgcc

SEQ ID NO: 1410535 - RNA, 19 nt, Pseudomonas aeruginosa PA01
ucccgcgccagcgccgcca

SEQ ID NO: 1410536 - RNA, 14 nt, Pseudomonas aeruginosa PA01
ucccgcgccagcuc

SEQ ID NO: 1410537 - RNA, 13 nt, Pseudomonas aeruginosa PA01
ucccccggccgau

SEQ ID NO: 1410538 - RNA, 13 nt, Pseudomonas aeruginosa PA01
ucccccgguccgg

SEQ ID NO: 1410539 - RNA, 12 nt, Pseudomonas aeruginosa PA01
ucccccagcacc

SEQ ID NO: 1410540 - RNA, 18 nt, Pseudomonas aeruginosa PA01
ucccccuuuuucggcgcg

SEQ ID NO: 1410541 - RNA, 13 nt, Pseudomonas aeruginosa PA01
ucccccagcgggc

SEQ ID NO: 1410542 - RNA, 15 nt, Pseudomonas aeruginosa PA01
ucccccgcgccgccg

SEQ ID NO: 1410543 - RNA, 22 nt, Pseudomonas aeruginosa PA01
uccccaguagcgcuucgcgcag

SEQ ID NO: 1410544 - RNA, 12 nt, Pseudomonas aeruginosa PA01
ucccagucggcg

SEQ ID NO: 1410545 - RNA, 21 nt, Pseudomonas aeruginosa PA01
ucccagucggcguccgccucg

SEQ ID NO: 1410546 - RNA, 15 nt, Pseudomonas aeruginosa PA01
ucccauggcgccacg

SEQ ID NO: 1410547 - RNA, 21 nt, Pseudomonas aeruginosa PA01
ucccaugaaaaauggccgcuu

SEQ ID NO: 1410548 - RNA, 13 nt, Pseudomonas aeruginosa PA01
uccccaacccggc

SEQ ID NO: 1410549 - RNA, 17 nt, Pseudomonas aeruginosa PA01
uccccaacccggccagc

SEQ ID NO: 1410550 - RNA, 16 nt, Pseudomonas aeruginosa PA01
uccccacucggccagc

SEQ ID NO: 1410551 - RNA, 21 nt, Pseudomonas aeruginosa PA01
uccccaccaacucagucgagg

SEQ ID NO: 1410552 - RNA, 22 nt, Pseudomonas aeruginosa PA01
uccccaccaacucagucgaggu

SEQ ID NO: 1410553 - RNA, 18 nt, Pseudomonas aeruginosa PA01
ucccaggcuggcggcaua

SEQ ID NO: 1410554 - RNA, 16 nt, Pseudomonas aeruginosa PA01
ucccagguagcgcugc

SEQ ID NO: 1410555 - RNA, 18 nt, Pseudomonas aeruginosa PA01
ucccaggucggcgggcac

SEQ ID NO: 1410556 - RNA, 15 nt, Pseudomonas aeruginosa PA01
ucccagcucgccgaa

SEQ ID NO: 1410557 - RNA, 19 nt, Pseudomonas aeruginosa PA01
ucccagccgugggcguaga

SEQ ID NO: 1410558 - RNA, 22 nt, Pseudomonas aeruginosa PA01
ucccagcguuguccucggcggc

SEQ ID NO: 1410559 - RNA, 22 nt, Pseudomonas aeruginosa PA01
ucccagcgaguagucgcggggc

SEQ ID NO: 1410560 - RNA, 19 nt, Pseudomonas aeruginosa PA01
ucccagcgagugcugaaca

SEQ ID NO: 1410561 - RNA, 12 nt, Pseudomonas aeruginosa PA01
ucccagccacag

SEQ ID NO: 1410562 - RNA, 16 nt, Pseudomonas aeruginosa PA01
ucccagccgacguagg

SEQ ID NO: 1410563 - RNA, 14 nt, Pseudomonas aeruginosa PA01
ucccagccgaggca

SEQ ID NO: 1410564 - RNA, 23 nt, Pseudomonas aeruginosa PA01
ucccagccgaggcagccgucggu

SEQ ID NO: 1410565 - RNA, 16 nt, Pseudomonas aeruginosa PA01
ucccagaccacccggc

SEQ ID NO: 1410566 - RNA, 20 nt, Pseudomonas aeruginosa PA01
ucccagaccagcagcggcag

SEQ ID NO: 1410567 - RNA, 16 nt, Pseudomonas aeruginosa PA01
ucccagaccuggccgc

SEQ ID NO: 1410568 - RNA, 16 nt, Pseudomonas aeruginosa PA01
ucccagaagucgcugg

SEQ ID NO: 1410569 - RNA, 14 nt, Pseudomonas aeruginosa PA01
ucccagcagcgccu

SEQ ID NO: 1410570 - RNA, 15 nt, Pseudomonas aeruginosa PA01
uccagguagcccacc

SEQ ID NO: 1410571 - RNA, 19 nt, Pseudomonas aeruginosa PA01
uccagguaaaggccaccag

SEQ ID NO: 1410572 - RNA, 19 nt, Pseudomonas aeruginosa PA01
ucccacuccagcgcgggca

SEQ ID NO: 1410573 - RNA, 15 nt, Pseudomonas aeruginosa PA01
uccagggugccgacc

SEQ ID NO: 1410574 - RNA, 16 nt, Pseudomonas aeruginosa PA01
uccagggugccgacca

SEQ ID NO: 1410575 - RNA, 17 nt, Pseudomonas aeruginosa PA01
uccagggugcugaccuu

SEQ ID NO: 1410576 - RNA, 14 nt, Pseudomonas aeruginosa PA01
uccaggguuggaag

SEQ ID NO: 1410577 - RNA, 20 nt, Pseudomonas aeruginosa PA01
uccaggguagcgccgcgggc

SEQ ID NO: 1410578 - RNA, 14 nt, Pseudomonas aeruginosa PA01
uccagggcggcccg

SEQ ID NO: 1410579 - RNA, 16 nt, Pseudomonas aeruginosa PA01
uccagggcaccacgga

SEQ ID NO: 1410580 - RNA, 13 nt, Pseudomonas aeruginosa PA01
uccagggcgaugg

SEQ ID NO: 1410581 - RNA, 14 nt, Pseudomonas aeruginosa PA01
uccagggccuggcg

SEQ ID NO: 1410582 - RNA, 15 nt, Pseudomonas aeruginosa PA01
uccagggccuggcgc

SEQ ID NO: 1410583 - RNA, 16 nt, Pseudomonas aeruginosa PA01
uccagggccuggcgca

SEQ ID NO: 1410584 - RNA, 19 nt, Pseudomonas aeruginosa PA01
uccagggcgaagucggcgc

SEQ ID NO: 1410585 - RNA, 16 nt, Pseudomonas aeruginosa PA01
uccggcaacaggucga

SEQ ID NO: 1410586 - RNA, 14 nt, Pseudomonas aeruginosa PA01
uccggcccggccag

SEQ ID NO: 1410587 - RNA, 17 nt, Pseudomonas aeruginosa PA01
uccggcccggccaggcg

SEQ ID NO: 1410588 - RNA, 15 nt, Pseudomonas aeruginosa PA01
uccggccaggcgcgg

SEQ ID NO: 1410589 - RNA, 22 nt, Pseudomonas aeruginosa PA01
uccggcaccuugcgaaaagccc

SEQ ID NO: 1410590 - RNA, 23 nt, Pseudomonas aeruginosa PA01
uccgcucuguagggucgcagcag

SEQ ID NO: 1410591 - RNA, 13 nt, Pseudomonas aeruginosa PA01
uccgcuggccugc

SEQ ID NO: 1410592 - RNA, 20 nt, Pseudomonas aeruginosa PA01
uccgcugguagcccaggccg

SEQ ID NO: 1410593 - RNA, 22 nt, Pseudomonas aeruginosa PA01
uccgcugguagcccaggccgaa

SEQ ID NO: 1410594 - RNA, 19 nt, Pseudomonas aeruginosa PA01
uccgcuguccgccgccgcg

SEQ ID NO: 1410595 - RNA, 16 nt, Pseudomonas aeruginosa PA01
uccgcuuacuggcgaa

SEQ ID NO: 1410596 - RNA, 14 nt, Pseudomonas aeruginosa PA01
uccgcgucgccuuc

SEQ ID NO: 1410597 - RNA, 15 nt, Pseudomonas aeruginosa PA01
uccgcguggcgaugc

SEQ ID NO: 1410598 - RNA, 22 nt, Pseudomonas aeruginosa PA01
uccgcguggcgaugcccuggcu

SEQ ID NO: 1410599 - RNA, 19 nt, Pseudomonas aeruginosa PA01
uccgcguggcgugcucggc

SEQ ID NO: 1410600 - RNA, 13 nt, Pseudomonas aeruginosa PA01
uccgcucaccagg

SEQ ID NO: 1410601 - RNA, 13 nt, Pseudomonas aeruginosa PA01
uccgcguguucgc

SEQ ID NO: 1410602 - RNA, 19 nt, Pseudomonas aeruginosa PA01
uccggccgaucuccuggcg

SEQ ID NO: 1410603 - RNA, 13 nt, Pseudomonas aeruginosa PA01
uccggccgcccga

SEQ ID NO: 1410604 - RNA, 17 nt, Pseudomonas aeruginosa PA01
uccggcgcgccauggcg

SEQ ID NO: 1410605 - RNA, 11 nt, Pseudomonas aeruginosa PA01
uccggcgcugc

SEQ ID NO: 1410606 - RNA, 15 nt, Pseudomonas aeruginosa PA01
uccggcgcggccugc

SEQ ID NO: 1410607 - RNA, 18 nt, Pseudomonas aeruginosa PA01
uccggcgcguuggcuggc

SEQ ID NO: 1410608 - RNA, 19 nt, Pseudomonas aeruginosa PA01
uccggcgcguuggcuggcg

SEQ ID NO: 1410609 - RNA, 22 nt, Pseudomonas aeruginosa PA01
uccggcgggcgguagcgggcca

SEQ ID NO: 1410610 - RNA, 14 nt, Pseudomonas aeruginosa PA01
uccggcggcugcug

SEQ ID NO: 1410611 - RNA, 12 nt, Pseudomonas aeruginosa PA01
uccggcggcgau

SEQ ID NO: 1410612 - RNA, 13 nt, Pseudomonas aeruginosa PA01
uccggcggcgaug

SEQ ID NO: 1410613 - RNA, 13 nt, Pseudomonas aeruginosa PA01
uccggcgucccgc

SEQ ID NO: 1410614 - RNA, 15 nt, Pseudomonas aeruginosa PA01
uccggguugaaggcg

SEQ ID NO: 1410615 - RNA, 18 nt, Pseudomonas aeruginosa PA01
uccggguugaccgccaga

SEQ ID NO: 1410616 - RNA, 14 nt, Pseudomonas aeruginosa PA01
uccggguuggcgca

SEQ ID NO: 1410617 - RNA, 19 nt, Pseudomonas aeruginosa PA01
uccggguuggcgcaggccg

SEQ ID NO: 1410618 - RNA, 15 nt, Pseudomonas aeruginosa PA01
uccggguugguggcc

SEQ ID NO: 1410619 - RNA, 14 nt, Pseudomonas aeruginosa PA01
uccgggucgcugcc

SEQ ID NO: 1410620 - RNA, 16 nt, Pseudomonas aeruginosa PA01
uccggguacuggcgcu

SEQ ID NO: 1410621 - RNA, 13 nt, Pseudomonas aeruginosa PA01
uccggguccagcg

SEQ ID NO: 1410622 - RNA, 16 nt, Pseudomonas aeruginosa PA01
uccggguccagcggcc

SEQ ID NO: 1410623 - RNA, 18 nt, Pseudomonas aeruginosa PA01
uccgggugccccaggcga

SEQ ID NO: 1410624 - RNA, 13 nt, Pseudomonas aeruginosa PA01
uccgggucgaggc

SEQ ID NO: 1410625 - RNA, 21 nt, Pseudomonas aeruginosa PA01
uccgggucaugccgccaucga

SEQ ID NO: 1410626 - RNA, 15 nt, Pseudomonas aeruginosa PA01
uccgggucauuggcg

SEQ ID NO: 1410627 - RNA, 22 nt, Pseudomonas aeruginosa PA01
uccggggucaguuccaggucgg

SEQ ID NO: 1410628 - RNA, 14 nt, Pseudomonas aeruginosa PA01
uccggggugggcau

SEQ ID NO: 1410629 - RNA, 12 nt, Pseudomonas aeruginosa PA01
uccggggcgauc

SEQ ID NO: 1410630 - RNA, 20 nt, Pseudomonas aeruginosa PA01
uccggggacgcugucccggc

SEQ ID NO: 1410631 - RNA, 21 nt, Pseudomonas aeruginosa PA01
uccggcguaccguuggcgaug

SEQ ID NO: 1410632 - RNA, 21 nt, Pseudomonas aeruginosa PA01
uccgccguggaacgcaggggc

SEQ ID NO: 1410633 - RNA, 17 nt, Pseudomonas aeruginosa PA01
uccgccugaccgcugau

SEQ ID NO: 1410634 - RNA, 20 nt, Pseudomonas aeruginosa PA01
uccgccucgcugagcaccgg

SEQ ID NO: 1410635 - RNA, 12 nt, Pseudomonas aeruginosa PA01
uccgccuggcgg

SEQ ID NO: 1410636 - RNA, 13 nt, Pseudomonas aeruginosa PA01
uccgccuggcgga

SEQ ID NO: 1410637 - RNA, 16 nt, Pseudomonas aeruginosa PA01
uccgccuggcggauau

SEQ ID NO: 1410638 - RNA, 23 nt, Pseudomonas aeruginosa PA01
uccgccugggacggaacgucggc

SEQ ID NO: 1410639 - RNA, 22 nt, Pseudomonas aeruginosa PA01
uccgcgcggcgcccugccgggc

SEQ ID NO: 1410640 - RNA, 19 nt, Pseudomonas aeruginosa PA01
uccgcgcgcuuccaggcac

SEQ ID NO: 1410641 - RNA, 20 nt, Pseudomonas aeruginosa PA01
uccgcgcgaucgaggccuac

SEQ ID NO: 1410642 - RNA, 17 nt, Pseudomonas aeruginosa PA01
uccgcgccgggcuggcc

SEQ ID NO: 1410643 - RNA, 18 nt, Pseudomonas aeruginosa PA01
uccgcgccgggcuggccg

SEQ ID NO: 1410644 - RNA, 20 nt, Pseudomonas aeruginosa PA01
uccgcgccgggcuggccguc

SEQ ID NO: 1410645 - RNA, 22 nt, Pseudomonas aeruginosa PA01
uccgccuuuuuugugcccggcg

SEQ ID NO: 1410646 - RNA, 17 nt, Pseudomonas aeruginosa PA01
uccgcgaauagggcggc

SEQ ID NO: 1410647 - RNA, 22 nt, Pseudomonas aeruginosa PA01
uccgcgccgcgucgccgccagc

SEQ ID NO: 1410648 - RNA, 14 nt, Pseudomonas aeruginosa PA01
uccgccuguccacc

SEQ ID NO: 1410649 - RNA, 16 nt, Pseudomonas aeruginosa PA01
uccgcggagucgccgg

SEQ ID NO: 1410650 - RNA, 18 nt, Pseudomonas aeruginosa PA01
uccgcggcacuccggcau

SEQ ID NO: 1410651 - RNA, 17 nt, Pseudomonas aeruginosa PA01
uccgcgcguucagccac

SEQ ID NO: 1410652 - RNA, 15 nt, Pseudomonas aeruginosa PA01
uccgcggccccggcg

SEQ ID NO: 1410653 - RNA, 17 nt, Pseudomonas aeruginosa PA01
uccgcggccccggcguc

SEQ ID NO: 1410654 - RNA, 18 nt, Pseudomonas aeruginosa PA01
uccgcggcccugcucgcc

SEQ ID NO: 1410655 - RNA, 23 nt, Pseudomonas aeruginosa PA01
uccgcggcccugcucgccggcgc

SEQ ID NO: 1410656 - RNA, 16 nt, Pseudomonas aeruginosa PA01
uccgcggccggcaggc

SEQ ID NO: 1410657 - RNA, 19 nt, Pseudomonas aeruginosa PA01
uccgcggccggcaggccga

SEQ ID NO: 1410658 - RNA, 17 nt, Pseudomonas aeruginosa PA01
uccgcggccugcucggc

SEQ ID NO: 1410659 - RNA, 19 nt, Pseudomonas aeruginosa PA01
uccgcggcguaaucgcgcc

SEQ ID NO: 1410660 - RNA, 22 nt, Pseudomonas aeruginosa PA01
uccgcgguguuuccgucguggc

SEQ ID NO: 1410661 - RNA, 18 nt, Pseudomonas aeruginosa PA01
uccgcgggacgcggcgug

SEQ ID NO: 1410662 - RNA, 21 nt, Pseudomonas aeruginosa PA01
uccgcgguagcugcgcagggc

SEQ ID NO: 1410663 - RNA, 22 nt, Pseudomonas aeruginosa PA01
uccgcgguagcugcgcagggcg

SEQ ID NO: 1410664 - RNA, 17 nt, Pseudomonas aeruginosa PA01
uccgcgucacggacccg

SEQ ID NO: 1410665 - RNA, 15 nt, Pseudomonas aeruginosa PA01
ucccuucgugcuggc

SEQ ID NO: 1410666 - RNA, 20 nt, Pseudomonas aeruginosa PA01
ucccuucuuuuuuucaccgc

SEQ ID NO: 1410667 - RNA, 17 nt, Pseudomonas aeruginosa PA01
ucccugcccgcgccucg

SEQ ID NO: 1410668 - RNA, 15 nt, Pseudomonas aeruginosa PA01
ucccugggccugcag

SEQ ID NO: 1410669 - RNA, 14 nt, Pseudomonas aeruginosa PA01
ucccuggagcaggg

SEQ ID NO: 1410670 - RNA, 20 nt, Pseudomonas aeruginosa PA01
ucccuggagcagggcgauga

SEQ ID NO: 1410671 - RNA, 20 nt, Pseudomonas aeruginosa PA01
ucccuuguuuuccuggcccu

SEQ ID NO: 1410672 - RNA, 19 nt, Pseudomonas aeruginosa PA01
uccgaauacugcacgccca

SEQ ID NO: 1410673 - RNA, 21 nt, Pseudomonas aeruginosa PA01
uccgcccuacggaccggugcc

SEQ ID NO: 1410674 - RNA, 19 nt, Pseudomonas aeruginosa PA01
uccgcccauugcccggcca

SEQ ID NO: 1410675 - RNA, 18 nt, Pseudomonas aeruginosa PA01
uccgccccaccccagggu

SEQ ID NO: 1410676 - RNA, 14 nt, Pseudomonas aeruginosa PA01
uccgccgccgacgu

SEQ ID NO: 1410677 - RNA, 13 nt, Pseudomonas aeruginosa PA01
uccgccgccgacg

SEQ ID NO: 1410678 - RNA, 13 nt, Pseudomonas aeruginosa PA01
uccgccgccaggu

SEQ ID NO: 1410679 - RNA, 23 nt, Pseudomonas aeruginosa PA01
uccgcccuuuuucgucgccagcc

SEQ ID NO: 1410680 - RNA, 13 nt, Pseudomonas aeruginosa PA01
uccgccgcagacc

SEQ ID NO: 1410681 - RNA, 16 nt, Pseudomonas aeruginosa PA01
uccgcccugcgggaug

SEQ ID NO: 1410682 - RNA, 17 nt, Pseudomonas aeruginosa PA01
uccgccgaacgccacca

SEQ ID NO: 1410683 - RNA, 19 nt, Pseudomonas aeruginosa PA01
uccgccgaacgccaccagg

SEQ ID NO: 1410684 - RNA, 21 nt, Pseudomonas aeruginosa PA01
uccgccgaacgccaccagggc

SEQ ID NO: 1410685 - RNA, 21 nt, Pseudomonas aeruginosa PA01
uccgccgacugcaacuggccg

SEQ ID NO: 1410686 - RNA, 22 nt, Pseudomonas aeruginosa PA01
uccgccgacugcaacuggccga

SEQ ID NO: 1410687 - RNA, 15 nt, Pseudomonas aeruginosa PA01
ucggcuugccggcgg

SEQ ID NO: 1410688 - RNA, 17 nt, Pseudomonas aeruginosa PA01
ucggcuugccggcggcg

SEQ ID NO: 1410689 - RNA, 15 nt, Pseudomonas aeruginosa PA01
ucggcuugggucagc

SEQ ID NO: 1410690 - RNA, 19 nt, Pseudomonas aeruginosa PA01
ucggcuguuucaggccggc

SEQ ID NO: 1410691 - RNA, 14 nt, Pseudomonas aeruginosa PA01
ucggcuuccaucac

SEQ ID NO: 1410692 - RNA, 15 nt, Pseudomonas aeruginosa PA01
ucggcuuccugggcg

SEQ ID NO: 1410693 - RNA, 24 nt, Pseudomonas aeruginosa PA01
ucggcuucgcccauggcacgcagg

SEQ ID NO: 1410694 - RNA, 19 nt, Pseudomonas aeruginosa PA01
ucggcuucugguucguccg

SEQ ID NO: 1410695 - RNA, 23 nt, Pseudomonas aeruginosa PA01
ucggcuugaagugauccaggucg

SEQ ID NO: 1410696 - RNA, 17 nt, Pseudomonas aeruginosa PA01
ucggcuugcaguucagc

SEQ ID NO: 1410697 - RNA, 20 nt, Pseudomonas aeruginosa PA01
ucggcuugcaguucagccac

SEQ ID NO: 1410698 - RNA, 20 nt, Pseudomonas aeruginosa PA01
ucgggacgcaugcgcggcgu

SEQ ID NO: 1410699 - RNA, 18 nt, Pseudomonas aeruginosa PA01
ucgggaagguccuugggc

SEQ ID NO: 1410700 - RNA, 17 nt, Pseudomonas aeruginosa PA01
ucgggaaaggccgccac

SEQ ID NO: 1410701 - RNA, 14 nt, Pseudomonas aeruginosa PA01
ucggcgcgacggcc

SEQ ID NO: 1410702 - RNA, 16 nt, Pseudomonas aeruginosa PA01
ucggcgccuuccugcu

SEQ ID NO: 1410703 - RNA, 21 nt, Pseudomonas aeruginosa PA01
ucggcgccugcggaccacagg

SEQ ID NO: 1410704 - RNA, 14 nt, Pseudomonas aeruginosa PA01
ucggcgcgcagggc

SEQ ID NO: 1410705 - RNA, 18 nt, Pseudomonas aeruginosa PA01
ucggcgcgcagggccagc

SEQ ID NO: 1410706 - RNA, 17 nt, Pseudomonas aeruginosa PA01
ucggcgcgauccuccgc

SEQ ID NO: 1410707 - RNA, 18 nt, Pseudomonas aeruginosa PA01
ucggcgcgauccuccgcc

SEQ ID NO: 1410708 - RNA, 22 nt, Pseudomonas aeruginosa PA01
ucggcgcgauccuccgccagcc

SEQ ID NO: 1410709 - RNA, 19 nt, Pseudomonas aeruginosa PA01
ucggcgcgaugaugccgcc

SEQ ID NO: 1410710 - RNA, 19 nt, Pseudomonas aeruginosa PA01
ucggcgcgccagaagcggc

SEQ ID NO: 1410711 - RNA, 14 nt, Pseudomonas aeruginosa PA01
ucggcgcgcccggc

SEQ ID NO: 1410712 - RNA, 15 nt, Pseudomonas aeruginosa PA01
ucggcgcgcccggcg

SEQ ID NO: 1410713 - RNA, 12 nt, Pseudomonas aeruginosa PA01
ucggcgcgccga

SEQ ID NO: 1410714 - RNA, 23 nt, Pseudomonas aeruginosa PA01
ucggcgcgcgacacauggucggc

SEQ ID NO: 1410715 - RNA, 14 nt, Pseudomonas aeruginosa PA01
ucggcgcggccggc

SEQ ID NO: 1410716 - RNA, 15 nt, Pseudomonas aeruginosa PA01
ucggcgcggccggcg

SEQ ID NO: 1410717 - RNA, 16 nt, Pseudomonas aeruginosa PA01
ucggcgcggccggcgc

SEQ ID NO: 1410718 - RNA, 14 nt, Pseudomonas aeruginosa PA01
ucggcgcggcgcuc

SEQ ID NO: 1410719 - RNA, 20 nt, Pseudomonas aeruginosa PA01
ucggcgcggcgcuccaggcg

SEQ ID NO: 1410720 - RNA, 21 nt, Pseudomonas aeruginosa PA01
ucggcgcggcgcuccaggcgg

SEQ ID NO: 1410721 - RNA, 15 nt, Pseudomonas aeruginosa PA01
ucggcgcgggcaugg

SEQ ID NO: 1410722 - RNA, 13 nt, Pseudomonas aeruginosa PA01
ucggcgcgccggu

SEQ ID NO: 1410723 - RNA, 15 nt, Pseudomonas aeruginosa PA01
ucggcgcgccgaagg

SEQ ID NO: 1410724 - RNA, 20 nt, Pseudomonas aeruginosa PA01
ucggcgcgccgaaggcgaua

SEQ ID NO: 1410725 - RNA, 13 nt, Pseudomonas aeruginosa PA01
ucggcgcgccggc

SEQ ID NO: 1410726 - RNA, 14 nt, Pseudomonas aeruginosa PA01
ucggcgcgcggcag

SEQ ID NO: 1410727 - RNA, 15 nt, Pseudomonas aeruginosa PA01
ucggcgcgcggcagc

SEQ ID NO: 1410728 - RNA, 18 nt, Pseudomonas aeruginosa PA01
ucggcgcgcggcagcacc

SEQ ID NO: 1410729 - RNA, 21 nt, Pseudomonas aeruginosa PA01
ucggcgcgcggcagcaccagg

SEQ ID NO: 1410730 - RNA, 21 nt, Pseudomonas aeruginosa PA01
ucgggaugccgugccguggac

SEQ ID NO: 1410731 - RNA, 18 nt, Pseudomonas aeruginosa PA01
ucgggagagcccgggcgc

SEQ ID NO: 1410732 - RNA, 17 nt, Pseudomonas aeruginosa PA01
ucgggauaccggccauc

SEQ ID NO: 1410733 - RNA, 14 nt, Pseudomonas aeruginosa PA01
ucgggcaccagcac

SEQ ID NO: 1410734 - RNA, 24 nt, Pseudomonas aeruginosa PA01
ucgggcaacggcugggucacgucc

SEQ ID NO: 1410735 - RNA, 20 nt, Pseudomonas aeruginosa PA01
ucgggccaugagcagggcgg

SEQ ID NO: 1410736 - RNA, 21 nt, Pseudomonas aeruginosa PA01
ucgggccaugagcagggcgga

SEQ ID NO: 1410737 - RNA, 15 nt, Pseudomonas aeruginosa PA01
ucgggcauggcgauc

SEQ ID NO: 1410738 - RNA, 18 nt, Pseudomonas aeruginosa PA01
ucgggcauggcgaucucc

SEQ ID NO: 1410739 - RNA, 18 nt, Pseudomonas aeruginosa PA01
ucgggcaguuccgccaga

SEQ ID NO: 1410740 - RNA, 17 nt, Pseudomonas aeruginosa PA01
ucgggcagguggacggc

SEQ ID NO: 1410741 - RNA, 17 nt, Pseudomonas aeruginosa PA01
ucgggccgaucgagcgg

SEQ ID NO: 1410742 - RNA, 18 nt, Pseudomonas aeruginosa PA01
ucgggccgaucgagcggc

SEQ ID NO: 1410743 - RNA, 21 nt, Pseudomonas aeruginosa PA01
ucgggccgaucgagcggcccg

SEQ ID NO: 1410744 - RNA, 18 nt, Pseudomonas aeruginosa PA01
ucgggccggagcaggcca

SEQ ID NO: 1410745 - RNA, 21 nt, Pseudomonas aeruginosa PA01
ucgggccggagcaggccaugg

SEQ ID NO: 1410746 - RNA, 16 nt, Pseudomonas aeruginosa PA01
ucgggcccucccaagg

SEQ ID NO: 1410747 - RNA, 19 nt, Pseudomonas aeruginosa PA01
ucgggcagauguccaggca

SEQ ID NO: 1410748 - RNA, 19 nt, Pseudomonas aeruginosa PA01
ucgggcagaguggcgcggc

SEQ ID NO: 1410749 - RNA, 14 nt, Pseudomonas aeruginosa PA01
ucgggcagggcauc

SEQ ID NO: 1410750 - RNA, 17 nt, Pseudomonas aeruginosa PA01
ucgggcggaucgagcag

SEQ ID NO: 1410751 - RNA, 15 nt, Pseudomonas aeruginosa PA01
ucgggcguagaccuu

SEQ ID NO: 1410752 - RNA, 19 nt, Pseudomonas aeruginosa PA01
ucgggcgggaucaggucgc

SEQ ID NO: 1410753 - RNA, 22 nt, Pseudomonas aeruginosa PA01
ucgggcgggaucaggucgccag

SEQ ID NO: 1410754 - RNA, 22 nt, Pseudomonas aeruginosa PA01
ucgggcucaugggcgaugcgcc

SEQ ID NO: 1410755 - RNA, 19 nt, Pseudomonas aeruginosa PA01
ucgggcgucuccugccgcc

SEQ ID NO: 1410756 - RNA, 12 nt, Pseudomonas aeruginosa PA01
ucgggcgaugcg

SEQ ID NO: 1410757 - RNA, 17 nt, Pseudomonas aeruginosa PA01
ucgggcgaaacggcagg

SEQ ID NO: 1410758 - RNA, 21 nt, Pseudomonas aeruginosa PA01
ucgggcgaaacggcaggccag

SEQ ID NO: 1410759 - RNA, 22 nt, Pseudomonas aeruginosa PA01
ucgggcgaaacggcaggccagc

SEQ ID NO: 1410760 - RNA, 13 nt, Pseudomonas aeruginosa PA01
ucgggcgccgcgc

SEQ ID NO: 1410761 - RNA, 19 nt, Pseudomonas aeruginosa PA01
ucgggggcugcgcaucgcc

SEQ ID NO: 1410762 - RNA, 21 nt, Pseudomonas aeruginosa PA01
ucgggggcugcgcaucgccug

SEQ ID NO: 1410763 - RNA, 18 nt, Pseudomonas aeruginosa PA01
ucgggggugcccaucagg

SEQ ID NO: 1410764 - RNA, 14 nt, Pseudomonas aeruginosa PA01
ucggggccgugagc

SEQ ID NO: 1410765 - RNA, 17 nt, Pseudomonas aeruginosa PA01
ucggggcccuccaggcg

SEQ ID NO: 1410766 - RNA, 18 nt, Pseudomonas aeruginosa PA01
ucggggcccuccaggcga

SEQ ID NO: 1410767 - RNA, 24 nt, Pseudomonas aeruginosa PA01
ucggggccgaggucgaccagccag

SEQ ID NO: 1410768 - RNA, 17 nt, Pseudomonas aeruginosa PA01
ucggggaacacgcgcug

SEQ ID NO: 1410769 - RNA, 16 nt, Pseudomonas aeruginosa PA01
ucggggaacagcgcca

SEQ ID NO: 1410770 - RNA, 18 nt, Pseudomonas aeruginosa PA01
ucggggaacagcgccagc

SEQ ID NO: 1410771 - RNA, 16 nt, Pseudomonas aeruginosa PA01
ucgggcuucagcgccg

SEQ ID NO: 1410772 - RNA, 14 nt, Pseudomonas aeruginosa PA01
ucggggcaggcgca

SEQ ID NO: 1410773 - RNA, 20 nt, Pseudomonas aeruginosa PA01
ucggggcauucguccagccg

SEQ ID NO: 1410774 - RNA, 21 nt, Pseudomonas aeruginosa PA01
ucggggcauucguccagccgc

SEQ ID NO: 1410775 - RNA, 21 nt, Pseudomonas aeruginosa PA01
ucggggaagggacgucgccag

SEQ ID NO: 1410776 - RNA, 13 nt, Pseudomonas aeruginosa PA01
ucgggucgagcuu

SEQ ID NO: 1410777 - RNA, 13 nt, Pseudomonas aeruginosa PA01
ucggguccaggcg

SEQ ID NO: 1410778 - RNA, 15 nt, Pseudomonas aeruginosa PA01
ucggguccaggcgcc

SEQ ID NO: 1410779 - RNA, 17 nt, Pseudomonas aeruginosa PA01
ucgggucgcccuugagg

SEQ ID NO: 1410780 - RNA, 20 nt, Pseudomonas aeruginosa PA01
ucgggucgcguucgucggcc

SEQ ID NO: 1410781 - RNA, 22 nt, Pseudomonas aeruginosa PA01
ucgggucgcguucgucggccac

SEQ ID NO: 1410782 - RNA, 13 nt, Pseudomonas aeruginosa PA01
ucgggucggcgaa

SEQ ID NO: 1410783 - RNA, 21 nt, Pseudomonas aeruginosa PA01
ucggguaguaguggaagccgu

SEQ ID NO: 1410784 - RNA, 15 nt, Pseudomonas aeruginosa PA01
ucggguagucuucga

SEQ ID NO: 1410785 - RNA, 21 nt, Pseudomonas aeruginosa PA01
ucggguagucuucgaugcgcc

SEQ ID NO: 1410786 - RNA, 14 nt, Pseudomonas aeruginosa PA01
ucggggucggccug

SEQ ID NO: 1410787 - RNA, 20 nt, Pseudomonas aeruginosa PA01
ucgggguucuugucgaccag

SEQ ID NO: 1410788 - RNA, 19 nt, Pseudomonas aeruginosa PA01
ucggguaauccacgcugug

SEQ ID NO: 1410789 - RNA, 22 nt, Pseudomonas aeruginosa PA01
ucgggguuuuuuuugccuggaa

SEQ ID NO: 1410790 - RNA, 15 nt, Pseudomonas aeruginosa PA01
ucggggugggcauag

SEQ ID NO: 1410791 - RNA, 21 nt, Pseudomonas aeruginosa PA01
ucgguaggcucugcuccagca

SEQ ID NO: 1410792 - RNA, 22 nt, Pseudomonas aeruginosa PA01
ucgggugggacauggagaccug

SEQ ID NO: 1410793 - RNA, 16 nt, Pseudomonas aeruginosa PA01
ucgguauucaucggcg

SEQ ID NO: 1410794 - RNA, 19 nt, Pseudomonas aeruginosa PA01
ucggucagcggcgcagccu

SEQ ID NO: 1410795 - RNA, 17 nt, Pseudomonas aeruginosa PA01
ucggucaggcgcuggug

SEQ ID NO: 1410796 - RNA, 17 nt, Pseudomonas aeruginosa PA01
ucggucacgaaggcgau

SEQ ID NO: 1410797 - RNA, 22 nt, Pseudomonas aeruginosa PA01
ucguccagaugcuugcacaccu

SEQ ID NO: 1410798 - RNA, 14 nt, Pseudomonas aeruginosa PA01
ucguccagcucggc

SEQ ID NO: 1410799 - RNA, 12 nt, Pseudomonas aeruginosa PA01
ucguccagcgcc

SEQ ID NO: 1410800 - RNA, 22 nt, Pseudomonas aeruginosa PA01
ucguccagcgggcccauggcgg

SEQ ID NO: 1410801 - RNA, 15 nt, Pseudomonas aeruginosa PA01
ucguccagccgccgc

SEQ ID NO: 1410802 - RNA, 17 nt, Pseudomonas aeruginosa PA01
ucguccagccgccgcug

SEQ ID NO: 1410803 - RNA, 18 nt, Pseudomonas aeruginosa PA01
ucguccagccgccgcugc

SEQ ID NO: 1410804 - RNA, 15 nt, Pseudomonas aeruginosa PA01
ucguccaggcaagcg

SEQ ID NO: 1410805 - RNA, 13 nt, Pseudomonas aeruginosa PA01
ucguccaggccgc

SEQ ID NO: 1410806 - RNA, 14 nt, Pseudomonas aeruginosa PA01
ucguccaggccgca

SEQ ID NO: 1410807 - RNA, 16 nt, Pseudomonas aeruginosa PA01
ucguccaggccgccua

SEQ ID NO: 1410808 - RNA, 15 nt, Pseudomonas aeruginosa PA01
ucguccaucgacagg

SEQ ID NO: 1410809 - RNA, 22 nt, Pseudomonas aeruginosa PA01
ucguccaucgacagggucgucu

SEQ ID NO: 1410810 - RNA, 15 nt, Pseudomonas aeruginosa PA01
ucguccaucgccgcg

SEQ ID NO: 1410811 - RNA, 17 nt, Pseudomonas aeruginosa PA01
ucguccaucgccgcggc

SEQ ID NO: 1410812 - RNA, 16 nt, Pseudomonas aeruginosa PA01
ucgucgaaacgcuggc

SEQ ID NO: 1410813 - RNA, 19 nt, Pseudomonas aeruginosa PA01
ucgucgaaacgcuggcggc

SEQ ID NO: 1410814 - RNA, 15 nt, Pseudomonas aeruginosa PA01
ucgucgaagcucggc

SEQ ID NO: 1410815 - RNA, 21 nt, Pseudomonas aeruginosa PA01
ucgucgaagcucggcgcgaug

SEQ ID NO: 1410816 - RNA, 20 nt, Pseudomonas aeruginosa PA01
ucgucgaagaccaggguggg

SEQ ID NO: 1410817 - RNA, 19 nt, Pseudomonas aeruginosa PA01
ucguccauguugcggccca

SEQ ID NO: 1410818 - RNA, 14 nt, Pseudomonas aeruginosa PA01
ucgucaaccagcac

SEQ ID NO: 1410819 - RNA, 14 nt, Pseudomonas aeruginosa PA01
ucguccagcaggcc

SEQ ID NO: 1410820 - RNA, 14 nt, Pseudomonas aeruginosa PA01
ucguaggcgcgcac

SEQ ID NO: 1410821 - RNA, 14 nt, Pseudomonas aeruginosa PA01
ucguaggcgcgggc

SEQ ID NO: 1410822 - RNA, 20 nt, Pseudomonas aeruginosa PA01
ucguaggcgcgggcggcggc

SEQ ID NO: 1410823 - RNA, 20 nt, Pseudomonas aeruginosa PA01
ucguaggucugcccgacgaa

SEQ ID NO: 1410824 - RNA, 15 nt, Pseudomonas aeruginosa PA01
ucguagucguagcgc

SEQ ID NO: 1410825 - RNA, 14 nt, Pseudomonas aeruginosa PA01
ucguauaggcgcug

SEQ ID NO: 1410826 - RNA, 15 nt, Pseudomonas aeruginosa PA01
ucguauaggcgcugg

SEQ ID NO: 1410827 - RNA, 18 nt, Pseudomonas aeruginosa PA01
ucguaugccugugcaccg

SEQ ID NO: 1410828 - RNA, 14 nt, Pseudomonas aeruginosa PA01
ucguaguccugggc

SEQ ID NO: 1410829 - RNA, 18 nt, Pseudomonas aeruginosa PA01
ucguauuccacgucgccg

SEQ ID NO: 1410830 - RNA, 21 nt, Pseudomonas aeruginosa PA01
ucguagagcgugcggccgauc

SEQ ID NO: 1410831 - RNA, 19 nt, Pseudomonas aeruginosa PA01
ucguagcagguccgcgccu

SEQ ID NO: 1410832 - RNA, 17 nt, Pseudomonas aeruginosa PA01
ucgguugccaggccggc

SEQ ID NO: 1410833 - RNA, 22 nt, Pseudomonas aeruginosa PA01
ucgguucugcgcaccaugcccg

SEQ ID NO: 1410834 - RNA, 14 nt, Pseudomonas aeruginosa PA01
ucguagccgcgcgc

SEQ ID NO: 1410835 - RNA, 13 nt, Pseudomonas aeruginosa PA01
ucguagcagccac

SEQ ID NO: 1410836 - RNA, 16 nt, Pseudomonas aeruginosa PA01
ucgguuuccggccagg

SEQ ID NO: 1410837 - RNA, 16 nt, Pseudomonas aeruginosa PA01
ucguagccggcgcggc

SEQ ID NO: 1410838 - RNA, 19 nt, Pseudomonas aeruginosa PA01
ucguagccggcgcggcgca

SEQ ID NO: 1410839 - RNA, 21 nt, Pseudomonas aeruginosa PA01
ucguagcgacccuucaacggc

SEQ ID NO: 1410840 - RNA, 15 nt, Pseudomonas aeruginosa PA01
ucguagcgcagcggc

SEQ ID NO: 1410841 - RNA, 18 nt, Pseudomonas aeruginosa PA01
ucguagcgcagcggcagg

SEQ ID NO: 1410842 - RNA, 20 nt, Pseudomonas aeruginosa PA01
ucguagcgcaugccguuggc

SEQ ID NO: 1410843 - RNA, 15 nt, Pseudomonas aeruginosa PA01
ucguagcgcgcggcg

SEQ ID NO: 1410844 - RNA, 17 nt, Pseudomonas aeruginosa PA01
ucguagcgcgcggcgag

SEQ ID NO: 1410845 - RNA, 21 nt, Pseudomonas aeruginosa PA01
ucguaggaacgugcggccugc

SEQ ID NO: 1410846 - RNA, 15 nt, Pseudomonas aeruginosa PA01
ucguaggcaggcgcg

SEQ ID NO: 1410847 - RNA, 21 nt, Pseudomonas aeruginosa PA01
ucguagcggucgugcagcagc

SEQ ID NO: 1410848 - RNA, 22 nt, Pseudomonas aeruginosa PA01
ucguagcggucgugcagcagcg

SEQ ID NO: 1410849 - RNA, 18 nt, Pseudomonas aeruginosa PA01
ucggugguguagcgaucc

SEQ ID NO: 1410850 - RNA, 18 nt, Pseudomonas aeruginosa PA01
ucgguguaucggcggaua

SEQ ID NO: 1410851 - RNA, 19 nt, Pseudomonas aeruginosa PA01
ucgguccccuccagguagg

SEQ ID NO: 1410852 - RNA, 21 nt, Pseudomonas aeruginosa PA01
ucggucagguauucgccggcc

SEQ ID NO: 1410853 - RNA, 14 nt, Pseudomonas aeruginosa PA01
ucgguccgccgaug

SEQ ID NO: 1410854 - RNA, 15 nt, Pseudomonas aeruginosa PA01
ucggucgcccucggc

SEQ ID NO: 1410855 - RNA, 16 nt, Pseudomonas aeruginosa PA01
ucggucgcccucggcc

SEQ ID NO: 1410856 - RNA, 23 nt, Pseudomonas aeruginosa PA01
ucgucugcgcggcguucgcccug

SEQ ID NO: 1410857 - RNA, 16 nt, Pseudomonas aeruginosa PA01
ucgucucagaccuucc

SEQ ID NO: 1410858 - RNA, 14 nt, Pseudomonas aeruginosa PA01
ucgucuucggccag

SEQ ID NO: 1410859 - RNA, 22 nt, Pseudomonas aeruginosa PA01
ucgucuuccagcggccacggcg

SEQ ID NO: 1410860 - RNA, 19 nt, Pseudomonas aeruginosa PA01
ucgucuggcgccuggccug

SEQ ID NO: 1410861 - RNA, 19 nt, Pseudomonas aeruginosa PA01
ucgucggggugccgccagu

SEQ ID NO: 1410862 - RNA, 17 nt, Pseudomonas aeruginosa PA01
ucgucguaguggccguc

SEQ ID NO: 1410863 - RNA, 15 nt, Pseudomonas aeruginosa PA01
ucgucguggccauag

SEQ ID NO: 1410864 - RNA, 13 nt, Pseudomonas aeruginosa PA01
ucgucguccagcg

SEQ ID NO: 1410865 - RNA, 15 nt, Pseudomonas aeruginosa PA01
ucgucguccagcggc

SEQ ID NO: 1410866 - RNA, 16 nt, Pseudomonas aeruginosa PA01
ucgucguccagcgggc

SEQ ID NO: 1410867 - RNA, 22 nt, Pseudomonas aeruginosa PA01
ucgucgcaccuguuccagcaac

SEQ ID NO: 1410868 - RNA, 20 nt, Pseudomonas aeruginosa PA01
ucgucgaugaggucgcagcg

SEQ ID NO: 1410869 - RNA, 14 nt, Pseudomonas aeruginosa PA01
ucgucgaucucgcc

SEQ ID NO: 1410870 - RNA, 19 nt, Pseudomonas aeruginosa PA01
ucgucgaucucgccgaagg

SEQ ID NO: 1410871 - RNA, 18 nt, Pseudomonas aeruginosa PA01
ucgucgaugaacagcgac

SEQ ID NO: 1410872 - RNA, 20 nt, Pseudomonas aeruginosa PA01
ucgucgaaggugaagcugcc

SEQ ID NO: 1410873 - RNA, 19 nt, Pseudomonas aeruginosa PA01
ucgucgccacgcccgccgu

SEQ ID NO: 1410874 - RNA, 19 nt, Pseudomonas aeruginosa PA01
ucgucgccaucgcucaccg

SEQ ID NO: 1410875 - RNA, 13 nt, Pseudomonas aeruginosa PA01
ucgucggcgcggc

SEQ ID NO: 1410876 - RNA, 15 nt, Pseudomonas aeruginosa PA01
ucgucggcgcggccg

SEQ ID NO: 1410877 - RNA, 15 nt, Pseudomonas aeruginosa PA01
ucgucggcggggcgc

SEQ ID NO: 1410878 - RNA, 21 nt, Pseudomonas aeruginosa PA01
ucgucgggacgcaugcgcggc

SEQ ID NO: 1410879 - RNA, 22 nt, Pseudomonas aeruginosa PA01
ucgucgggacgcaugcgcggcg

SEQ ID NO: 1410880 - RNA, 12 nt, Pseudomonas aeruginosa PA01
ucgucgggcaga

SEQ ID NO: 1410881 - RNA, 22 nt, Pseudomonas aeruginosa PA01
ucgucgggcagaguggcgcggc

SEQ ID NO: 1410882 - RNA, 17 nt, Pseudomonas aeruginosa PA01
ucugccuguccgcugcg

SEQ ID NO: 1410883 - RNA, 16 nt, Pseudomonas aeruginosa PA01
ucugccucgccgaggc

SEQ ID NO: 1410884 - RNA, 20 nt, Pseudomonas aeruginosa PA01
ucugccucgccgaggcggaa

SEQ ID NO: 1410885 - RNA, 19 nt, Pseudomonas aeruginosa PA01
ucugcgacaucuccaggcc

SEQ ID NO: 1410886 - RNA, 20 nt, Pseudomonas aeruginosa PA01
ucugcgacgagccggacggc

SEQ ID NO: 1410887 - RNA, 15 nt, Pseudomonas aeruginosa PA01
ucugcgagccgcgcg

SEQ ID NO: 1410888 - RNA, 23 nt, Pseudomonas aeruginosa PA01
ucugcgaguugaucggcguggcg

SEQ ID NO: 1410889 - RNA, 14 nt, Pseudomonas aeruginosa PA01
ucugccgcuggcgg

SEQ ID NO: 1410890 - RNA, 21 nt, Pseudomonas aeruginosa PA01
ucugccggucggaacgaccac

SEQ ID NO: 1410891 - RNA, 22 nt, Pseudomonas aeruginosa PA01
ucugccggucggaacgaccacg

SEQ ID NO: 1410892 - RNA, 21 nt, Pseudomonas aeruginosa PA01
ucugccgguaauuggccaggc

SEQ ID NO: 1410893 - RNA, 23 nt, Pseudomonas aeruginosa PA01
ucugccgcagcgccucccgggcc

SEQ ID NO: 1410894 - RNA, 14 nt, Pseudomonas aeruginosa PA01
ucugcccgccggcg

SEQ ID NO: 1410895 - RNA, 12 nt, Pseudomonas aeruginosa PA01
ucugcccggcca

SEQ ID NO: 1410896 - RNA, 14 nt, Pseudomonas aeruginosa PA01
ucugccccggcuug

SEQ ID NO: 1410897 - RNA, 20 nt, Pseudomonas aeruginosa PA01
ucugcaggacgaagucgccg

SEQ ID NO: 1410898 - RNA, 19 nt, Pseudomonas aeruginosa PA01
ucugccagagcgcugccug

SEQ ID NO: 1410899 - RNA, 14 nt, Pseudomonas aeruginosa PA01
ucugccacccggcg

SEQ ID NO: 1410900 - RNA, 16 nt, Pseudomonas aeruginosa PA01
ucugcaacgcggcguc

SEQ ID NO: 1410901 - RNA, 19 nt, Pseudomonas aeruginosa PA01
ucugcaacgcggcgucagg

SEQ ID NO: 1410902 - RNA, 24 nt, Pseudomonas aeruginosa PA01
ucugcaauugcuugcgcucgagcc

SEQ ID NO: 1410903 - RNA, 17 nt, Pseudomonas aeruginosa PA01
ucugcaccacguucggc

SEQ ID NO: 1410904 - RNA, 19 nt, Pseudomonas aeruginosa PA01
ucugcagcuugcgcgccag

SEQ ID NO: 1410905 - RNA, 23 nt, Pseudomonas aeruginosa PA01
ucugcaccaggcucgccccggcg

SEQ ID NO: 1410906 - RNA, 19 nt, Pseudomonas aeruginosa PA01
ucugcaccccgucgacgcc

SEQ ID NO: 1410907 - RNA, 19 nt, Pseudomonas aeruginosa PA01
ucugagggacacggcgacc

SEQ ID NO: 1410908 - RNA, 17 nt, Pseudomonas aeruginosa PA01
ucucuacuaccgccagc

SEQ ID NO: 1410909 - RNA, 22 nt, Pseudomonas aeruginosa PA01
ucucugucggagagggagcgcc

SEQ ID NO: 1410910 - RNA, 15 nt, Pseudomonas aeruginosa PA01
ucucucgccucggcg

SEQ ID NO: 1410911 - RNA, 20 nt, Pseudomonas aeruginosa PA01
ucucggugcucaggcggccg

SEQ ID NO: 1410912 - RNA, 16 nt, Pseudomonas aeruginosa PA01
ucucggugaccaccag

SEQ ID NO: 1410913 - RNA, 14 nt, Pseudomonas aeruginosa PA01
ucucguccggcgug

SEQ ID NO: 1410914 - RNA, 23 nt, Pseudomonas aeruginosa PA01
ucucguccucggcguagccggcc

SEQ ID NO: 1410915 - RNA, 15 nt, Pseudomonas aeruginosa PA01
ucucgugggccagca

SEQ ID NO: 1410916 - RNA, 16 nt, Pseudomonas aeruginosa PA01
ucucgugggccagcag

SEQ ID NO: 1410917 - RNA, 20 nt, Pseudomonas aeruginosa PA01
ucucaaagggcagcggcgag

SEQ ID NO: 1410918 - RNA, 12 nt, Pseudomonas aeruginosa PA01
ucguggccgcga

SEQ ID NO: 1410919 - RNA, 15 nt, Pseudomonas aeruginosa PA01
ucuccgccaggcggc

SEQ ID NO: 1410920 - RNA, 23 nt, Pseudomonas aeruginosa PA01
ucuccgccggggguguugaaagc

SEQ ID NO: 1410921 - RNA, 19 nt, Pseudomonas aeruginosa PA01
ucucccgcgauucgccggg

SEQ ID NO: 1410922 - RNA, 21 nt, Pseudomonas aeruginosa PA01
ucucccgaggcgaucgccgcg

SEQ ID NO: 1410923 - RNA, 22 nt, Pseudomonas aeruginosa PA01
ucucccaggaguggugaagcgc

SEQ ID NO: 1410924 - RNA, 20 nt, Pseudomonas aeruginosa PA01
ucuccccgcucccgcggccc

SEQ ID NO: 1410925 - RNA, 20 nt, Pseudomonas aeruginosa PA01
ucucaccgcccugcgcgauc

SEQ ID NO: 1410926 - RNA, 14 nt, Pseudomonas aeruginosa PA01
ucucagccggcgcu

SEQ ID NO: 1410927 - RNA, 23 nt, Pseudomonas aeruginosa PA01
ucucagccggcgcuacgccaauc

SEQ ID NO: 1410928 - RNA, 15 nt, Pseudomonas aeruginosa PA01
ucucaggagcgccgc

SEQ ID NO: 1410929 - RNA, 20 nt, Pseudomonas aeruginosa PA01
ucucaggaccuuccgccagc

SEQ ID NO: 1410930 - RNA, 22 nt, Pseudomonas aeruginosa PA01
ucucaggaccuuccgccagcag

SEQ ID NO: 1410931 - RNA, 14 nt, Pseudomonas aeruginosa PA01
ucucauugcgccgc

SEQ ID NO: 1410932 - RNA, 19 nt, Pseudomonas aeruginosa PA01
ucucgccaccccgcuccgc

SEQ ID NO: 1410933 - RNA, 21 nt, Pseudomonas aeruginosa PA01
ucucgcagcaggcguucggcg

SEQ ID NO: 1410934 - RNA, 15 nt, Pseudomonas aeruginosa PA01
ucuccggggcccggc

SEQ ID NO: 1410935 - RNA, 17 nt, Pseudomonas aeruginosa PA01
ucuccggcaccguggug

SEQ ID NO: 1410936 - RNA, 16 nt, Pseudomonas aeruginosa PA01
ucuccgcgccacgcgc

SEQ ID NO: 1410937 - RNA, 18 nt, Pseudomonas aeruginosa PA01
ucuccgcgccgggcuggc

SEQ ID NO: 1410938 - RNA, 22 nt, Pseudomonas aeruginosa PA01
ucuccgcucgggguucgacccg

SEQ ID NO: 1410939 - RNA, 20 nt, Pseudomonas aeruginosa PA01
ucuccgucaaugcggccugc

SEQ ID NO: 1410940 - RNA, 14 nt, Pseudomonas aeruginosa PA01
ucucgaucaucgcc

SEQ ID NO: 1410941 - RNA, 21 nt, Pseudomonas aeruginosa PA01
ucucgaucaucgccagcggcg

SEQ ID NO: 1410942 - RNA, 18 nt, Pseudomonas aeruginosa PA01
ucucggcgaacgacagca

SEQ ID NO: 1410943 - RNA, 17 nt, Pseudomonas aeruginosa PA01
ucucggucgccgccagc

SEQ ID NO: 1410944 - RNA, 14 nt, Pseudomonas aeruginosa PA01
ucucggcugccgcc

SEQ ID NO: 1410945 - RNA, 18 nt, Pseudomonas aeruginosa PA01
ucucggcugccgccagcu

SEQ ID NO: 1410946 - RNA, 15 nt, Pseudomonas aeruginosa PA01
ucucgcccagggcgu

SEQ ID NO: 1410947 - RNA, 22 nt, Pseudomonas aeruginosa PA01
ucucgccgaaggugcaggccgc

SEQ ID NO: 1410948 - RNA, 15 nt, Pseudomonas aeruginosa PA01
ucucgccgcgcucgc

SEQ ID NO: 1410949 - RNA, 14 nt, Pseudomonas aeruginosa PA01
ucucgccgccgagc

SEQ ID NO: 1410950 - RNA, 14 nt, Pseudomonas aeruginosa PA01
ucucgccgccggag

SEQ ID NO: 1410951 - RNA, 14 nt, Pseudomonas aeruginosa PA01
ucucgccgucggcg

SEQ ID NO: 1410952 - RNA, 20 nt, Pseudomonas aeruginosa PA01
ucucgccucccggcucgccg

SEQ ID NO: 1410953 - RNA, 14 nt, Pseudomonas aeruginosa PA01
ucucgcugguggcg

SEQ ID NO: 1410954 - RNA, 16 nt, Pseudomonas aeruginosa PA01
ucucgcguuccagcac

SEQ ID NO: 1410955 - RNA, 23 nt, Pseudomonas aeruginosa PA01
ucucgcgcacgcuguagaccagc

SEQ ID NO: 1410956 - RNA, 18 nt, Pseudomonas aeruginosa PA01
ucucgcgcagcggcggau

SEQ ID NO: 1410957 - RNA, 13 nt, Pseudomonas aeruginosa PA01
ucucgcgccccgg

SEQ ID NO: 1410958 - RNA, 16 nt, Pseudomonas aeruginosa PA01
ugaaauggcggacgau

SEQ ID NO: 1410959 - RNA, 23 nt, Pseudomonas aeruginosa PA01
ugaacaccguguugaucgccgcg

SEQ ID NO: 1410960 - RNA, 19 nt, Pseudomonas aeruginosa PA01
ugaacaccucuucgccauc

SEQ ID NO: 1410961 - RNA, 20 nt, Pseudomonas aeruginosa PA01
ugaacagcgacucgaugcgc

SEQ ID NO: 1410962 - RNA, 15 nt, Pseudomonas aeruginosa PA01
ugaacagcgccacca

SEQ ID NO: 1410963 - RNA, 17 nt, Pseudomonas aeruginosa PA01
ugaacgaaaacgccgcu

SEQ ID NO: 1410964 - RNA, 17 nt, Pseudomonas aeruginosa PA01
ugaacgaagaagccggc

SEQ ID NO: 1410965 - RNA, 16 nt, Pseudomonas aeruginosa PA01
ugaaagggcggcagca

SEQ ID NO: 1410966 - RNA, 22 nt, Pseudomonas aeruginosa PA01
ugaaagccagcaaacccgggcc

SEQ ID NO: 1410967 - RNA, 18 nt, Pseudomonas aeruginosa PA01
ugaaauagcucugccgau

SEQ ID NO: 1410968 - RNA, 14 nt, Pseudomonas aeruginosa PA01
ugaaacugcgcagg

SEQ ID NO: 1410969 - RNA, 20 nt, Pseudomonas aeruginosa PA01
ucuuucauuuucgcgcucag

SEQ ID NO: 1410970 - RNA, 23 nt, Pseudomonas aeruginosa PA01
ucuucaggcaaggucgucucaga

SEQ ID NO: 1410971 - RNA, 20 nt, Pseudomonas aeruginosa PA01
ucuucaggcugucggccauc

SEQ ID NO: 1410972 - RNA, 14 nt, Pseudomonas aeruginosa PA01
ucuucagcacgccc

SEQ ID NO: 1410973 - RNA, 16 nt, Pseudomonas aeruginosa PA01
ucuucagcacuucggc

SEQ ID NO: 1410974 - RNA, 22 nt, Pseudomonas aeruginosa PA01
ucuucacgacgaacucaacgaa

SEQ ID NO: 1410975 - RNA, 15 nt, Pseudomonas aeruginosa PA01
ucuucacccgcagcg

SEQ ID NO: 1410976 - RNA, 23 nt, Pseudomonas aeruginosa PA01
ucuucaguaggccagcggcuccu

SEQ ID NO: 1410977 - RNA, 15 nt, Pseudomonas aeruginosa PA01
ucuucacgccuugcu

SEQ ID NO: 1410978 - RNA, 17 nt, Pseudomonas aeruginosa PA01
ucuuccaguuggccggg

SEQ ID NO: 1410979 - RNA, 12 nt, Pseudomonas aeruginosa PA01
ucuucgauggcg

SEQ ID NO: 1410980 - RNA, 18 nt, Pseudomonas aeruginosa PA01
ucuucgauggcggccgcc

SEQ ID NO: 1410981 - RNA, 17 nt, Pseudomonas aeruginosa PA01
ucuucggcggccagcgg

SEQ ID NO: 1410982 - RNA, 15 nt, Pseudomonas aeruginosa PA01
ucuucggcggcgccg

SEQ ID NO: 1410983 - RNA, 15 nt, Pseudomonas aeruginosa PA01
ucuucgccgcggcgu

SEQ ID NO: 1410984 - RNA, 18 nt, Pseudomonas aeruginosa PA01
ucuugcgcuugccggccg

SEQ ID NO: 1410985 - RNA, 22 nt, Pseudomonas aeruginosa PA01
ucuugcgcauuuugccggagau

SEQ ID NO: 1410986 - RNA, 14 nt, Pseudomonas aeruginosa PA01
ucuugcgcccggcg

SEQ ID NO: 1410987 - RNA, 16 nt, Pseudomonas aeruginosa PA01
ucuugccuuccaccgg

SEQ ID NO: 1410988 - RNA, 17 nt, Pseudomonas aeruginosa PA01
ucuugccgcuguuggcg

SEQ ID NO: 1410989 - RNA, 15 nt, Pseudomonas aeruginosa PA01
ucuucgguggcggcg

SEQ ID NO: 1410990 - RNA, 12 nt, Pseudomonas aeruginosa PA01
ucuucgucggcg

SEQ ID NO: 1410991 - RNA, 16 nt, Pseudomonas aeruginosa PA01
ucugcgccuccucggc

SEQ ID NO: 1410992 - RNA, 17 nt, Pseudomonas aeruginosa PA01
ucugcgccucgcuggcg

SEQ ID NO: 1410993 - RNA, 12 nt, Pseudomonas aeruginosa PA01
ucugcgcggcgu

SEQ ID NO: 1410994 - RNA, 17 nt, Pseudomonas aeruginosa PA01
ucugcugaauucccgcu

SEQ ID NO: 1410995 - RNA, 15 nt, Pseudomonas aeruginosa PA01
ucugcgagacgggcg

SEQ ID NO: 1410996 - RNA, 19 nt, Pseudomonas aeruginosa PA01
ucugcgaucagggccucgc

SEQ ID NO: 1410997 - RNA, 20 nt, Pseudomonas aeruginosa PA01
ucugcgaucagggccucgcc

SEQ ID NO: 1410998 - RNA, 13 nt, Pseudomonas aeruginosa PA01
ucugcgccgcggc

SEQ ID NO: 1410999 - RNA, 14 nt, Pseudomonas aeruginosa PA01
ucugcgccgcggcg

SEQ ID NO: 1411000 - RNA, 17 nt, Pseudomonas aeruginosa PA01
ucugcgccgcggcguug

SEQ ID NO: 1411001 - RNA, 17 nt, Pseudomonas aeruginosa PA01
ucuggaugcggcgcugc

SEQ ID NO: 1411002 - RNA, 17 nt, Pseudomonas aeruginosa PA01
ucuggaauucgccgcgc

SEQ ID NO: 1411003 - RNA, 12 nt, Pseudomonas aeruginosa PA01
ucugcuggccac

SEQ ID NO: 1411004 - RNA, 16 nt, Pseudomonas aeruginosa PA01
ucugcuggccgcccuu

SEQ ID NO: 1411005 - RNA, 17 nt, Pseudomonas aeruginosa PA01
ucugcuggauccucgcc

SEQ ID NO: 1411006 - RNA, 19 nt, Pseudomonas aeruginosa PA01
ucugcugguugaggccguc

SEQ ID NO: 1411007 - RNA, 18 nt, Pseudomonas aeruginosa PA01
ucugcuguggagccggug

SEQ ID NO: 1411008 - RNA, 13 nt, Pseudomonas aeruginosa PA01
ugccacugcgcgc

SEQ ID NO: 1411009 - RNA, 21 nt, Pseudomonas aeruginosa PA01
ugccacuugcgggugcgcagg

SEQ ID NO: 1411010 - RNA, 14 nt, Pseudomonas aeruginosa PA01
ugccagagcgcugc

SEQ ID NO: 1411011 - RNA, 21 nt, Pseudomonas aeruginosa PA01
ugccagaggcugcgcuccagg

SEQ ID NO: 1411012 - RNA, 22 nt, Pseudomonas aeruginosa PA01
ugccagaccgagauuggccgcc

SEQ ID NO: 1411013 - RNA, 19 nt, Pseudomonas aeruginosa PA01
ugccagaccguggcgcuac

SEQ ID NO: 1411014 - RNA, 16 nt, Pseudomonas aeruginosa PA01
ugccagaaugugccgg

SEQ ID NO: 1411015 - RNA, 17 nt, Pseudomonas aeruginosa PA01
ugccagaaugugccggu

SEQ ID NO: 1411016 - RNA, 14 nt, Pseudomonas aeruginosa PA01
ugccagacgcucgg

SEQ ID NO: 1411017 - RNA, 15 nt, Pseudomonas aeruginosa PA01
ugccagacgcucggc

SEQ ID NO: 1411018 - RNA, 13 nt, Pseudomonas aeruginosa PA01
ugcaggccagcgc

SEQ ID NO: 1411019 - RNA, 14 nt, Pseudomonas aeruginosa PA01
ugcaguucgaccuc

SEQ ID NO: 1411020 - RNA, 14 nt, Pseudomonas aeruginosa PA01
ugccacgcaccacc

SEQ ID NO: 1411021 - RNA, 17 nt, Pseudomonas aeruginosa PA01
ugccacgcaccaccagg

SEQ ID NO: 1411022 - RNA, 19 nt, Pseudomonas aeruginosa PA01
ugcaucaccggcagcagcg

SEQ ID NO: 1411023 - RNA, 17 nt, Pseudomonas aeruginosa PA01
ugcccagcaggcugcug

SEQ ID NO: 1411024 - RNA, 23 nt, Pseudomonas aeruginosa PA01
ugccauuccuugauuugcccggc

SEQ ID NO: 1411025 - RNA, 13 nt, Pseudomonas aeruginosa PA01
ugccauggcggcg

SEQ ID NO: 1411026 - RNA, 16 nt, Pseudomonas aeruginosa PA01
ugccauggcggcggau

SEQ ID NO: 1411027 - RNA, 14 nt, Pseudomonas aeruginosa PA01
ugcccagccagggc

SEQ ID NO: 1411028 - RNA, 17 nt, Pseudomonas aeruginosa PA01
ugcccagcgccgccagc

SEQ ID NO: 1411029 - RNA, 18 nt, Pseudomonas aeruginosa PA01
ugcccagcgccgccagca

SEQ ID NO: 1411030 - RNA, 12 nt, Pseudomonas aeruginosa PA01
ugcccagcgccg

SEQ ID NO: 1411031 - RNA, 17 nt, Pseudomonas aeruginosa PA01
ugcccagcggcgccucg

SEQ ID NO: 1411032 - RNA, 18 nt, Pseudomonas aeruginosa PA01
ugcccagcggcgccucga

SEQ ID NO: 1411033 - RNA, 21 nt, Pseudomonas aeruginosa PA01
ugcccagcgccgccugcuggc

SEQ ID NO: 1411034 - RNA, 20 nt, Pseudomonas aeruginosa PA01
ugccagcgcgucggcacgcc

SEQ ID NO: 1411035 - RNA, 16 nt, Pseudomonas aeruginosa PA01
ugccauccagcgccug

SEQ ID NO: 1411036 - RNA, 21 nt, Pseudomonas aeruginosa PA01
ugccauccgcgccgaccagcc

SEQ ID NO: 1411037 - RNA, 18 nt, Pseudomonas aeruginosa PA01
ugccagcaguaucgacga

SEQ ID NO: 1411038 - RNA, 19 nt, Pseudomonas aeruginosa PA01
ugccagcaguaucgacgau

SEQ ID NO: 1411039 - RNA, 16 nt, Pseudomonas aeruginosa PA01
ugccauccuccagcac

SEQ ID NO: 1411040 - RNA, 20 nt, Pseudomonas aeruginosa PA01
ugcccgcgucgcgcgcggca

SEQ ID NO: 1411041 - RNA, 18 nt, Pseudomonas aeruginosa PA01
ugcccgcugggcaggugg

SEQ ID NO: 1411042 - RNA, 12 nt, Pseudomonas aeruginosa PA01
ugcccgcgccuc

SEQ ID NO: 1411043 - RNA, 14 nt, Pseudomonas aeruginosa PA01
ugcccgcgccuggg

SEQ ID NO: 1411044 - RNA, 15 nt, Pseudomonas aeruginosa PA01
ugcccgcgccugggc

SEQ ID NO: 1411045 - RNA, 20 nt, Pseudomonas aeruginosa PA01
ugcccggaccugggcaccag

SEQ ID NO: 1411046 - RNA, 20 nt, Pseudomonas aeruginosa PA01
ugcccggcagaucucccugu

SEQ ID NO: 1411047 - RNA, 17 nt, Pseudomonas aeruginosa PA01
ugcccggcagcgccggg

SEQ ID NO: 1411048 - RNA, 18 nt, Pseudomonas aeruginosa PA01
ugcccggcauaggcgcca

SEQ ID NO: 1411049 - RNA, 12 nt, Pseudomonas aeruginosa PA01
ugcccggccugg

SEQ ID NO: 1411050 - RNA, 19 nt, Pseudomonas aeruginosa PA01
ugcccggccuggcgucccg

SEQ ID NO: 1411051 - RNA, 14 nt, Pseudomonas aeruginosa PA01
ugcccggccgcagg

SEQ ID NO: 1411052 - RNA, 19 nt, Pseudomonas aeruginosa PA01
ugcccggccaggcgcggcg

SEQ ID NO: 1411053 - RNA, 12 nt, Pseudomonas aeruginosa PA01
ugcccggcgcga

SEQ ID NO: 1411054 - RNA, 22 nt, Pseudomonas aeruginosa PA01
ugcccggcugguugccagcagc

SEQ ID NO: 1411055 - RNA, 18 nt, Pseudomonas aeruginosa PA01
ugcccgguauucagccag

SEQ ID NO: 1411056 - RNA, 19 nt, Pseudomonas aeruginosa PA01
ugcccuggaagccggcagg

SEQ ID NO: 1411057 - RNA, 12 nt, Pseudomonas aeruginosa PA01
ugcccuggccga

SEQ ID NO: 1411058 - RNA, 15 nt, Pseudomonas aeruginosa PA01
ugcccuggccgcugc

SEQ ID NO: 1411059 - RNA, 12 nt, Pseudomonas aeruginosa PA01
ugcccuggcgcg

SEQ ID NO: 1411060 - RNA, 16 nt, Pseudomonas aeruginosa PA01
ugcccuggcgcgcgcc

SEQ ID NO: 1411061 - RNA, 16 nt, Pseudomonas aeruginosa PA01
ugcccgucgaccauca

SEQ ID NO: 1411062 - RNA, 18 nt, Pseudomonas aeruginosa PA01
ugcccaggcgcuggcgcc

SEQ ID NO: 1411063 - RNA, 19 nt, Pseudomonas aeruginosa PA01
ugcccaggcugaggucgcg

SEQ ID NO: 1411064 - RNA, 23 nt, Pseudomonas aeruginosa PA01
ugcccaggcugaggucgcgggcg

SEQ ID NO: 1411065 - RNA, 15 nt, Pseudomonas aeruginosa PA01
ugcccaggccgaagu

SEQ ID NO: 1411066 - RNA, 23 nt, Pseudomonas aeruginosa PA01
ugcccaggccgaaguagccggcg

SEQ ID NO: 1411067 - RNA, 13 nt, Pseudomonas aeruginosa PA01
ugcccaggccgcc

SEQ ID NO: 1411068 - RNA, 19 nt, Pseudomonas aeruginosa PA01
ugcccagguagccggcgag

SEQ ID NO: 1411069 - RNA, 23 nt, Pseudomonas aeruginosa PA01
ugcccagguagucgcccagcgcc

SEQ ID NO: 1411070 - RNA, 15 nt, Pseudomonas aeruginosa PA01
ugcccagggccagca

SEQ ID NO: 1411071 - RNA, 17 nt, Pseudomonas aeruginosa PA01
ugcccagggccagcagc

SEQ ID NO: 1411072 - RNA, 20 nt, Pseudomonas aeruginosa PA01
ugcccagggccagcagcggc

SEQ ID NO: 1411073 - RNA, 14 nt, Pseudomonas aeruginosa PA01
ugcccaugaucgcc

SEQ ID NO: 1411074 - RNA, 18 nt, Pseudomonas aeruginosa PA01
ugcccgaugccgcgccgg

SEQ ID NO: 1411075 - RNA, 19 nt, Pseudomonas aeruginosa PA01
ugcccauccgcucggcgag

SEQ ID NO: 1411076 - RNA, 19 nt, Pseudomonas aeruginosa PA01
ugcccaucgccuccacggc

SEQ ID NO: 1411077 - RNA, 13 nt, Pseudomonas aeruginosa PA01
ugcccgccucgcg

SEQ ID NO: 1411078 - RNA, 13 nt, Pseudomonas aeruginosa PA01
ugcccgccggcgc

SEQ ID NO: 1411079 - RNA, 20 nt, Pseudomonas aeruginosa PA01
ugcccgccggcgcccugggc

SEQ ID NO: 1411080 - RNA, 19 nt, Pseudomonas aeruginosa PA01
ugcccgccccgcaccagcc

SEQ ID NO: 1411081 - RNA, 22 nt, Pseudomonas aeruginosa PA01
ugcccgccccgcaccagccagc

SEQ ID NO: 1411082 - RNA, 15 nt, Pseudomonas aeruginosa PA01
ugcccgccagcaggc

SEQ ID NO: 1411083 - RNA, 22 nt, Pseudomonas aeruginosa PA01
ugcccgccagcaggcgccggcg

SEQ ID NO: 1411084 - RNA, 17 nt, Pseudomonas aeruginosa PA01
ugauggugaccggcuug

SEQ ID NO: 1411085 - RNA, 18 nt, Pseudomonas aeruginosa PA01
ugcaccagccaguccggc

SEQ ID NO: 1411086 - RNA, 22 nt, Pseudomonas aeruginosa PA01
ugcaccagccaguccggcagca

SEQ ID NO: 1411087 - RNA, 13 nt, Pseudomonas aeruginosa PA01
ugcaccaggcccu

SEQ ID NO: 1411088 - RNA, 15 nt, Pseudomonas aeruginosa PA01
ugcaccaggccgcca

SEQ ID NO: 1411089 - RNA, 17 nt, Pseudomonas aeruginosa PA01
ugcaccaggccgccaug

SEQ ID NO: 1411090 - RNA, 17 nt, Pseudomonas aeruginosa PA01
ugcaccaggcgaugcgc

SEQ ID NO: 1411091 - RNA, 16 nt, Pseudomonas aeruginosa PA01
ugcaccccgucgacgc

SEQ ID NO: 1411092 - RNA, 21 nt, Pseudomonas aeruginosa PA01
ugcaccccgucgacgcccugg

SEQ ID NO: 1411093 - RNA, 14 nt, Pseudomonas aeruginosa PA01
ugcacccgccgacc

SEQ ID NO: 1411094 - RNA, 22 nt, Pseudomonas aeruginosa PA01
ugcacccagaccuuccagccgc

SEQ ID NO: 1411095 - RNA, 16 nt, Pseudomonas aeruginosa PA01
ugcaccacgucggaaa

SEQ ID NO: 1411096 - RNA, 15 nt, Pseudomonas aeruginosa PA01
ugcacgugcagcucg

SEQ ID NO: 1411097 - RNA, 16 nt, Pseudomonas aeruginosa PA01
ugcacgugcagcucgg

SEQ ID NO: 1411098 - RNA, 18 nt, Pseudomonas aeruginosa PA01
ugcacguggaguucaccg

SEQ ID NO: 1411099 - RNA, 13 nt, Pseudomonas aeruginosa PA01
ugcacggcgaccc

SEQ ID NO: 1411100 - RNA, 15 nt, Pseudomonas aeruginosa PA01
ugcacggcgacccgc

SEQ ID NO: 1411101 - RNA, 12 nt, Pseudomonas aeruginosa PA01
ugcacggccggu

SEQ ID NO: 1411102 - RNA, 13 nt, Pseudomonas aeruginosa PA01
ugcacggccggua

SEQ ID NO: 1411103 - RNA, 17 nt, Pseudomonas aeruginosa PA01
ugcacguuccagcucgg

SEQ ID NO: 1411104 - RNA, 22 nt, Pseudomonas aeruginosa PA01
ugcacgaacaggugcugguggc

SEQ ID NO: 1411105 - RNA, 15 nt, Pseudomonas aeruginosa PA01
ugcacgcaggccgcu

SEQ ID NO: 1411106 - RNA, 20 nt, Pseudomonas aeruginosa PA01
ugcacgccgugcaucaccgg

SEQ ID NO: 1411107 - RNA, 21 nt, Pseudomonas aeruginosa PA01
ugcacgccgugcaucaccggc

SEQ ID NO: 1411108 - RNA, 20 nt, Pseudomonas aeruginosa PA01
ugcacgcccaucgccaccag

SEQ ID NO: 1411109 - RNA, 21 nt, Pseudomonas aeruginosa PA01
ugcacgcccaucgccaccagc

SEQ ID NO: 1411110 - RNA, 22 nt, Pseudomonas aeruginosa PA01
ugcacgcugaagaucgccacga

SEQ ID NO: 1411111 - RNA, 20 nt, Pseudomonas aeruginosa PA01
ugcacgcugcgccggcgcug

SEQ ID NO: 1411112 - RNA, 12 nt, Pseudomonas aeruginosa PA01
ugcacgcgccgg

SEQ ID NO: 1411113 - RNA, 14 nt, Pseudomonas aeruginosa PA01
ugcacgcgccgggu

SEQ ID NO: 1411114 - RNA, 15 nt, Pseudomonas aeruginosa PA01
ugcacgcgccggguc

SEQ ID NO: 1411115 - RNA, 18 nt, Pseudomonas aeruginosa PA01
ugcacggcaacgucgcgg

SEQ ID NO: 1411116 - RNA, 15 nt, Pseudomonas aeruginosa PA01
ugcagcaccgccugg

SEQ ID NO: 1411117 - RNA, 17 nt, Pseudomonas aeruginosa PA01
ugcagcaccgccugguc

SEQ ID NO: 1411118 - RNA, 24 nt, Pseudomonas aeruginosa PA01
ugcagcaccgccuggucgaucucg

SEQ ID NO: 1411119 - RNA, 16 nt, Pseudomonas aeruginosa PA01
ugcagcacccccagca

SEQ ID NO: 1411120 - RNA, 21 nt, Pseudomonas aeruginosa PA01
ugcagcacccccagcaggcca

SEQ ID NO: 1411121 - RNA, 15 nt, Pseudomonas aeruginosa PA01
ugcagcaagccgcag

SEQ ID NO: 1411122 - RNA, 17 nt, Pseudomonas aeruginosa PA01
ugcagcaacucgccgcc

SEQ ID NO: 1411123 - RNA, 19 nt, Pseudomonas aeruginosa PA01
ugcagcaacucgccgccga

SEQ ID NO: 1411124 - RNA, 18 nt, Pseudomonas aeruginosa PA01
ugcagaugaccagcgcau

SEQ ID NO: 1411125 - RNA, 17 nt, Pseudomonas aeruginosa PA01
ugcagauggucgccgga

SEQ ID NO: 1411126 - RNA, 19 nt, Pseudomonas aeruginosa PA01
ugcagagaaaaggccgcuu

SEQ ID NO: 1411127 - RNA, 18 nt, Pseudomonas aeruginosa PA01
ugcagagaggcuggcgcu

SEQ ID NO: 1411128 - RNA, 16 nt, Pseudomonas aeruginosa PA01
ugcagauccagcggca

SEQ ID NO: 1411129 - RNA, 21 nt, Pseudomonas aeruginosa PA01
ugcagauccagcggcaggugg

SEQ ID NO: 1411130 - RNA, 21 nt, Pseudomonas aeruginosa PA01
ugcagagcggccaggucgagg

SEQ ID NO: 1411131 - RNA, 12 nt, Pseudomonas aeruginosa PA01
ugcagcagcacg

SEQ ID NO: 1411132 - RNA, 15 nt, Pseudomonas aeruginosa PA01
ugcagcagcgaccug

SEQ ID NO: 1411133 - RNA, 13 nt, Pseudomonas aeruginosa PA01
ugcagcagcgccu

SEQ ID NO: 1411134 - RNA, 21 nt, Pseudomonas aeruginosa PA01
ugcagcaggguaccgcuggcg

SEQ ID NO: 1411135 - RNA, 21 nt, Pseudomonas aeruginosa PA01
ugcagcagguuccuccugggc

SEQ ID NO: 1411136 - RNA, 17 nt, Pseudomonas aeruginosa PA01
ugcagcaucaggcgcuc

SEQ ID NO: 1411137 - RNA, 15 nt, Pseudomonas aeruginosa PA01
ugcagccagccgucg

SEQ ID NO: 1411138 - RNA, 20 nt, Pseudomonas aeruginosa PA01
ugcagcccggucacgccggg

SEQ ID NO: 1411139 - RNA, 22 nt, Pseudomonas aeruginosa PA01
ugcagcccuggcguggccggcg

SEQ ID NO: 1411140 - RNA, 21 nt, Pseudomonas aeruginosa PA01
ugcagcgacuccagccaggcg

SEQ ID NO: 1411141 - RNA, 14 nt, Pseudomonas aeruginosa PA01
ugcagcgccccagc

SEQ ID NO: 1411142 - RNA, 19 nt, Pseudomonas aeruginosa PA01
ugcagcgccccagcaccuc

SEQ ID NO: 1411143 - RNA, 16 nt, Pseudomonas aeruginosa PA01
ugcagccgauggcgaa

SEQ ID NO: 1411144 - RNA, 20 nt, Pseudomonas aeruginosa PA01
ugcagcgccucguggaacag

SEQ ID NO: 1411145 - RNA, 19 nt, Pseudomonas aeruginosa PA01
ugcagcgccuguuccaggg

SEQ ID NO: 1411146 - RNA, 21 nt, Pseudomonas aeruginosa PA01
ugcagcgcuuguagcagccgc

SEQ ID NO: 1411147 - RNA, 19 nt, Pseudomonas aeruginosa PA01
ugcagcggaagcccugcug

SEQ ID NO: 1411148 - RNA, 24 nt, Pseudomonas aeruginosa PA01
ugcagcggaagcccugcuggcgca

SEQ ID NO: 1411149 - RNA, 15 nt, Pseudomonas aeruginosa PA01
ugcagcgucgacgcc

SEQ ID NO: 1411150 - RNA, 21 nt, Pseudomonas aeruginosa PA01
ugcagcgucgcgcguccagcc

SEQ ID NO: 1411151 - RNA, 23 nt, Pseudomonas aeruginosa PA01
ugcagcgccauggggaucaccgg

SEQ ID NO: 1411152 - RNA, 20 nt, Pseudomonas aeruginosa PA01
ugcaggcacggaagcgcugc

SEQ ID NO: 1411153 - RNA, 16 nt, Pseudomonas aeruginosa PA01
ugcaggcccggccgcc

SEQ ID NO: 1411154 - RNA, 15 nt, Pseudomonas aeruginosa PA01
ugcaggccagggcgg

SEQ ID NO: 1411155 - RNA, 22 nt, Pseudomonas aeruginosa PA01
ugcagcuccaccgauggcgcgc

SEQ ID NO: 1411156 - RNA, 15 nt, Pseudomonas aeruginosa PA01
ugcaggaaggcgacg

SEQ ID NO: 1411157 - RNA, 13 nt, Pseudomonas aeruginosa PA01
ugcaggaacagcc

SEQ ID NO: 1411158 - RNA, 17 nt, Pseudomonas aeruginosa PA01
ugcaggaacagguucgg

SEQ ID NO: 1411159 - RNA, 23 nt, Pseudomonas aeruginosa PA01
ugcaggaagcgccgggccgcauc

SEQ ID NO: 1411160 - RNA, 24 nt, Pseudomonas aeruginosa PA01
ugcaggaagcgccgggccgcaucg

SEQ ID NO: 1411161 - RNA, 19 nt, Pseudomonas aeruginosa PA01
ugacggcggaaggcggcga

SEQ ID NO: 1411162 - RNA, 12 nt, Pseudomonas aeruginosa PA01
ugacgguccgcg

SEQ ID NO: 1411163 - RNA, 16 nt, Pseudomonas aeruginosa PA01
ugacgguccgcgccac

SEQ ID NO: 1411164 - RNA, 23 nt, Pseudomonas aeruginosa PA01
ugacggcaaggaccugcugcccg

SEQ ID NO: 1411165 - RNA, 13 nt, Pseudomonas aeruginosa PA01
ugacgcuggcgaa

SEQ ID NO: 1411166 - RNA, 23 nt, Pseudomonas aeruginosa PA01
ugacgcuggcgaaggcgcuccgg

SEQ ID NO: 1411167 - RNA, 13 nt, Pseudomonas aeruginosa PA01
ugacgcgcagcgc

SEQ ID NO: 1411168 - RNA, 19 nt, Pseudomonas aeruginosa PA01
ugacgaucuucugcacccc

SEQ ID NO: 1411169 - RNA, 19 nt, Pseudomonas aeruginosa PA01
ugacgauaucggcgccggc

SEQ ID NO: 1411170 - RNA, 16 nt, Pseudomonas aeruginosa PA01
ugacgaugcggcccgc

SEQ ID NO: 1411171 - RNA, 21 nt, Pseudomonas aeruginosa PA01
ugacgaugcggcccgccggcg

SEQ ID NO: 1411172 - RNA, 17 nt, Pseudomonas aeruginosa PA01
ugacgaggcccgcccag

SEQ ID NO: 1411173 - RNA, 16 nt, Pseudomonas aeruginosa PA01
ugacgaggggcugcgg

SEQ ID NO: 1411174 - RNA, 16 nt, Pseudomonas aeruginosa PA01
ugacgauacgcucggc

SEQ ID NO: 1411175 - RNA, 17 nt, Pseudomonas aeruginosa PA01
ugacgauacgcucggcg

SEQ ID NO: 1411176 - RNA, 22 nt, Pseudomonas aeruginosa PA01
ugaccuucagcaccugcgccga

SEQ ID NO: 1411177 - RNA, 23 nt, Pseudomonas aeruginosa PA01
ugacgacugcacgcagacgucga

SEQ ID NO: 1411178 - RNA, 20 nt, Pseudomonas aeruginosa PA01
ugacgaggacgccgccgguc

SEQ ID NO: 1411179 - RNA, 18 nt, Pseudomonas aeruginosa PA01
ugacgauggccgccgccg

SEQ ID NO: 1411180 - RNA, 14 nt, Pseudomonas aeruginosa PA01
ugacgauggcgcca

SEQ ID NO: 1411181 - RNA, 17 nt, Pseudomonas aeruginosa PA01
ugacgauggccagcccg

SEQ ID NO: 1411182 - RNA, 15 nt, Pseudomonas aeruginosa PA01
ugacgauggccgccg

SEQ ID NO: 1411183 - RNA, 15 nt, Pseudomonas aeruginosa PA01
ugacgccauccuucg

SEQ ID NO: 1411184 - RNA, 23 nt, Pseudomonas aeruginosa PA01
ugacgccggcaccgucgagcacc

SEQ ID NO: 1411185 - RNA, 13 nt, Pseudomonas aeruginosa PA01
ugaccugcagcgc

SEQ ID NO: 1411186 - RNA, 14 nt, Pseudomonas aeruginosa PA01
ugaccugcgaggcg

SEQ ID NO: 1411187 - RNA, 20 nt, Pseudomonas aeruginosa PA01
ugaccuuguccuggccggcg

SEQ ID NO: 1411188 - RNA, 16 nt, Pseudomonas aeruginosa PA01
ugaccuugucggccga

SEQ ID NO: 1411189 - RNA, 19 nt, Pseudomonas aeruginosa PA01
ugaccuggucguugcgcgc

SEQ ID NO: 1411190 - RNA, 13 nt, Pseudomonas aeruginosa PA01
ugaccuggccgcc

SEQ ID NO: 1411191 - RNA, 14 nt, Pseudomonas aeruginosa PA01
ugaccuggccgccg

SEQ ID NO: 1411192 - RNA, 23 nt, Pseudomonas aeruginosa PA01
ugacgaacugcacgcccaucgcc

SEQ ID NO: 1411193 - RNA, 18 nt, Pseudomonas aeruginosa PA01
ugacgaaaaagccggaag

SEQ ID NO: 1411194 - RNA, 22 nt, Pseudomonas aeruginosa PA01
ugacgaacaucgccagcgccac

SEQ ID NO: 1411195 - RNA, 22 nt, Pseudomonas aeruginosa PA01
ugacgaagugauggaagagcgc

SEQ ID NO: 1411196 - RNA, 14 nt, Pseudomonas aeruginosa PA01
ugacgaagccggcg

SEQ ID NO: 1411197 - RNA, 19 nt, Pseudomonas aeruginosa PA01
ugacgaaggcggcagcggu

SEQ ID NO: 1411198 - RNA, 18 nt, Pseudomonas aeruginosa PA01
ugacgaaggcuggagcgc

SEQ ID NO: 1411199 - RNA, 23 nt, Pseudomonas aeruginosa PA01
ugaccgugcgggucgaggccgaa

SEQ ID NO: 1411200 - RNA, 21 nt, Pseudomonas aeruginosa PA01
ugaccguccacggcgcgucgg

SEQ ID NO: 1411201 - RNA, 16 nt, Pseudomonas aeruginosa PA01
ugaccguccagcgcgc

SEQ ID NO: 1411202 - RNA, 15 nt, Pseudomonas aeruginosa PA01
ugaccguuucgccgc

SEQ ID NO: 1411203 - RNA, 18 nt, Pseudomonas aeruginosa PA01
ugaccguuucgccgccgg

SEQ ID NO: 1411204 - RNA, 19 nt, Pseudomonas aeruginosa PA01
ugaccguuucgccgccggc

SEQ ID NO: 1411205 - RNA, 20 nt, Pseudomonas aeruginosa PA01
ugaccguuucgccgccggcc

SEQ ID NO: 1411206 - RNA, 21 nt, Pseudomonas aeruginosa PA01
ugaccguuucgccgccggcca

SEQ ID NO: 1411207 - RNA, 18 nt, Pseudomonas aeruginosa PA01
ugaccucccgcgccagcu

SEQ ID NO: 1411208 - RNA, 13 nt, Pseudomonas aeruginosa PA01
ugaccucgacgcc

SEQ ID NO: 1411209 - RNA, 23 nt, Pseudomonas aeruginosa PA01
ugaccucgacgccgagccagccg

SEQ ID NO: 1411210 - RNA, 13 nt, Pseudomonas aeruginosa PA01
ugaccucggccag

SEQ ID NO: 1411211 - RNA, 18 nt, Pseudomonas aeruginosa PA01
ugaccucggccagccagg

SEQ ID NO: 1411212 - RNA, 13 nt, Pseudomonas aeruginosa PA01
ugaccucgauggc

SEQ ID NO: 1411213 - RNA, 14 nt, Pseudomonas aeruginosa PA01
ugaccucgauggcg

SEQ ID NO: 1411214 - RNA, 14 nt, Pseudomonas aeruginosa PA01
ugaccgucggcaag

SEQ ID NO: 1411215 - RNA, 19 nt, Pseudomonas aeruginosa PA01
ugaccgucggcaagcaggc

SEQ ID NO: 1411216 - RNA, 19 nt, Pseudomonas aeruginosa PA01
ugaccgagcaugcgcggca

SEQ ID NO: 1411217 - RNA, 22 nt, Pseudomonas aeruginosa PA01
ugacccggguuuccugcccgac

SEQ ID NO: 1411218 - RNA, 18 nt, Pseudomonas aeruginosa PA01
ugacccgguacagcgccu

SEQ ID NO: 1411219 - RNA, 16 nt, Pseudomonas aeruginosa PA01
ugacccgcucgccggg

SEQ ID NO: 1411220 - RNA, 16 nt, Pseudomonas aeruginosa PA01
ugacccgcugcaccag

SEQ ID NO: 1411221 - RNA, 16 nt, Pseudomonas aeruginosa PA01
ugaccgcgugggccgg

SEQ ID NO: 1411222 - RNA, 20 nt, Pseudomonas aeruginosa PA01
ugaccgcucccaggcaacgg

SEQ ID NO: 1411223 - RNA, 18 nt, Pseudomonas aeruginosa PA01
ugaccgcugaugaucgcg

SEQ ID NO: 1411224 - RNA, 19 nt, Pseudomonas aeruginosa PA01
ugaccggcaucgaccagca

SEQ ID NO: 1411225 - RNA, 14 nt, Pseudomonas aeruginosa PA01
ugaccgccgccgcc

SEQ ID NO: 1411226 - RNA, 20 nt, Pseudomonas aeruginosa PA01
ugaccgccagacaggccagc

SEQ ID NO: 1411227 - RNA, 23 nt, Pseudomonas aeruginosa PA01
ugaccgccccggcagccaccagg

SEQ ID NO: 1411228 - RNA, 22 nt, Pseudomonas aeruginosa PA01
ugaccgccgcucaucugcacca

SEQ ID NO: 1411229 - RNA, 17 nt, Pseudomonas aeruginosa PA01
ugaccgcgagcgccgcc

SEQ ID NO: 1411230 - RNA, 20 nt, Pseudomonas aeruginosa PA01
ugaccgcgagcgccgccuug

SEQ ID NO: 1411231 - RNA, 21 nt, Pseudomonas aeruginosa PA01
ugaccgcgaauggcagcaggc

SEQ ID NO: 1411232 - RNA, 13 nt, Pseudomonas aeruginosa PA01
ugaugaagcgcug

SEQ ID NO: 1411233 - RNA, 14 nt, Pseudomonas aeruginosa PA01
ugaugaagucggcg

SEQ ID NO: 1411234 - RNA, 14 nt, Pseudomonas aeruginosa PA01
ugaucuuguccggg

SEQ ID NO: 1411235 - RNA, 16 nt, Pseudomonas aeruginosa PA01
ugaucuuuuccucguc

SEQ ID NO: 1411236 - RNA, 23 nt, Pseudomonas aeruginosa PA01
ugaucuccgcgccgggcuggccg

SEQ ID NO: 1411237 - RNA, 23 nt, Pseudomonas aeruginosa PA01
ugaucggcuccagcuugucgucg

SEQ ID NO: 1411238 - RNA, 15 nt, Pseudomonas aeruginosa PA01
ugaucgagacgccgu

SEQ ID NO: 1411239 - RNA, 19 nt, Pseudomonas aeruginosa PA01
ugaucgacucgauggcgcg

SEQ ID NO: 1411240 - RNA, 17 nt, Pseudomonas aeruginosa PA01
ugaucgagucgccggcg

SEQ ID NO: 1411241 - RNA, 17 nt, Pseudomonas aeruginosa PA01
ugaucgccgcgccgccg

SEQ ID NO: 1411242 - RNA, 18 nt, Pseudomonas aeruginosa PA01
ugaucgccgcgccgccga

SEQ ID NO: 1411243 - RNA, 19 nt, Pseudomonas aeruginosa PA01
ugaucgccaccgggugcag

SEQ ID NO: 1411244 - RNA, 20 nt, Pseudomonas aeruginosa PA01
ugaucgccagcccguagucg

SEQ ID NO: 1411245 - RNA, 18 nt, Pseudomonas aeruginosa PA01
ugaucgcgugggccacca

SEQ ID NO: 1411246 - RNA, 20 nt, Pseudomonas aeruginosa PA01
ugauacgcacgcuggugccg

SEQ ID NO: 1411247 - RNA, 13 nt, Pseudomonas aeruginosa PA01
ugaucacgucggc

SEQ ID NO: 1411248 - RNA, 15 nt, Pseudomonas aeruginosa PA01
ugaucgaagcccauc

SEQ ID NO: 1411249 - RNA, 15 nt, Pseudomonas aeruginosa PA01
ugaucgacgccagcu

SEQ ID NO: 1411250 - RNA, 21 nt, Pseudomonas aeruginosa PA01
ugaucgacgccagcucggccg

SEQ ID NO: 1411251 - RNA, 16 nt, Pseudomonas aeruginosa PA01
ugaucgaccucgcggg

SEQ ID NO: 1411252 - RNA, 17 nt, Pseudomonas aeruginosa PA01
ugaucaccgccuuggca

SEQ ID NO: 1411253 - RNA, 17 nt, Pseudomonas aeruginosa PA01
ugaucaccgcggugcgg

SEQ ID NO: 1411254 - RNA, 14 nt, Pseudomonas aeruginosa PA01
ugaucaccuugcca

SEQ ID NO: 1411255 - RNA, 20 nt, Pseudomonas aeruginosa PA01
ugaucaccuuguacggcagc

SEQ ID NO: 1411256 - RNA, 22 nt, Pseudomonas aeruginosa PA01
ugaucaccuuguacggcagcgg

SEQ ID NO: 1411257 - RNA, 13 nt, Pseudomonas aeruginosa PA01
ugaucacgaacag

SEQ ID NO: 1411258 - RNA, 23 nt, Pseudomonas aeruginosa PA01
ugaucacgaacagcuugccguug

SEQ ID NO: 1411259 - RNA, 21 nt, Pseudomonas aeruginosa PA01
ugaggaagagcagcgcggcgg

SEQ ID NO: 1411260 - RNA, 22 nt, Pseudomonas aeruginosa PA01
ugaggaagagcagcgcggcggc

SEQ ID NO: 1411261 - RNA, 22 nt, Pseudomonas aeruginosa PA01
ugaggaacuugucgaccacgcu

SEQ ID NO: 1411262 - RNA, 18 nt, Pseudomonas aeruginosa PA01
ugagcuugaugaagcccg

SEQ ID NO: 1411263 - RNA, 12 nt, Pseudomonas aeruginosa PA01
ugagcgccagca

SEQ ID NO: 1411264 - RNA, 18 nt, Pseudomonas aeruginosa PA01
ugagcgaucccaggucgg

SEQ ID NO: 1411265 - RNA, 20 nt, Pseudomonas aeruginosa PA01
ugagcgaucccaggucggcg

SEQ ID NO: 1411266 - RNA, 17 nt, Pseudomonas aeruginosa PA01
ugagcgauguccaggcc

SEQ ID NO: 1411267 - RNA, 17 nt, Pseudomonas aeruginosa PA01
ugagcgacccgcugaag

SEQ ID NO: 1411268 - RNA, 19 nt, Pseudomonas aeruginosa PA01
ugagcgacccgcugaagga

SEQ ID NO: 1411269 - RNA, 14 nt, Pseudomonas aeruginosa PA01
ugacguugccgcgc

SEQ ID NO: 1411270 - RNA, 20 nt, Pseudomonas aeruginosa PA01
ugacguucugcccgccggcg

SEQ ID NO: 1411271 - RNA, 21 nt, Pseudomonas aeruginosa PA01
ugacguucugcccgccggcgc

SEQ ID NO: 1411272 - RNA, 17 nt, Pseudomonas aeruginosa PA01
ugacguucccguccggg

SEQ ID NO: 1411273 - RNA, 14 nt, Pseudomonas aeruginosa PA01
ugacguucaggcug

SEQ ID NO: 1411274 - RNA, 20 nt, Pseudomonas aeruginosa PA01
ugacggugcagccacccagc

SEQ ID NO: 1411275 - RNA, 17 nt, Pseudomonas aeruginosa PA01
ugacuaucgucgagggu

SEQ ID NO: 1411276 - RNA, 17 nt, Pseudomonas aeruginosa PA01
ugacguugcgccgcagc

SEQ ID NO: 1411277 - RNA, 14 nt, Pseudomonas aeruginosa PA01
ugaggcgcaggggc

SEQ ID NO: 1411278 - RNA, 18 nt, Pseudomonas aeruginosa PA01
ugaggcgcgcgccgaacu

SEQ ID NO: 1411279 - RNA, 12 nt, Pseudomonas aeruginosa PA01
ugaggccgacga

SEQ ID NO: 1411280 - RNA, 14 nt, Pseudomonas aeruginosa PA01
ugaggccgcccugg

SEQ ID NO: 1411281 - RNA, 19 nt, Pseudomonas aeruginosa PA01
ugaggccuuucuucugcug

SEQ ID NO: 1411282 - RNA, 14 nt, Pseudomonas aeruginosa PA01
ugaggaucagccag

SEQ ID NO: 1411283 - RNA, 21 nt, Pseudomonas aeruginosa PA01
ugaggaucagccagccggcga

SEQ ID NO: 1411284 - RNA, 14 nt, Pseudomonas aeruginosa PA01
ugaggcccaucagg

SEQ ID NO: 1411285 - RNA, 15 nt, Pseudomonas aeruginosa PA01
ugaggaugcugauca

SEQ ID NO: 1411286 - RNA, 19 nt, Pseudomonas aeruginosa PA01
ugaggauuuucuccggcgc

SEQ ID NO: 1411287 - RNA, 21 nt, Pseudomonas aeruginosa PA01
ugaggauuuucuccggcgccg

SEQ ID NO: 1411288 - RNA, 20 nt, Pseudomonas aeruginosa PA01
ugaguuugcccagcgccgcc

SEQ ID NO: 1411289 - RNA, 20 nt, Pseudomonas aeruginosa PA01
ugaguucgaagcgccaggcg

SEQ ID NO: 1411290 - RNA, 18 nt, Pseudomonas aeruginosa PA01
ugauaccgccggcggcga

SEQ ID NO: 1411291 - RNA, 15 nt, Pseudomonas aeruginosa PA01
ugauaccgcuggcca

SEQ ID NO: 1411292 - RNA, 13 nt, Pseudomonas aeruginosa PA01
uaugcgccgggcc

SEQ ID NO: 1411293 - RNA, 21 nt, Pseudomonas aeruginosa PA01
uaugcgcccuaccugucccgg

SEQ ID NO: 1411294 - RNA, 13 nt, Pseudomonas aeruginosa PA01
uaugcgccgccac

SEQ ID NO: 1411295 - RNA, 13 nt, Pseudomonas aeruginosa PA01
uaucgcccuggcc

SEQ ID NO: 1411296 - RNA, 17 nt, Pseudomonas aeruginosa PA01
uauucgcgcucggcgag

SEQ ID NO: 1411297 - RNA, 16 nt, Pseudomonas aeruginosa PA01
uauggcgggccuugcg

SEQ ID NO: 1411298 - RNA, 18 nt, Pseudomonas aeruginosa PA01
ucaacagcgaagcuggcg

SEQ ID NO: 1411299 - RNA, 22 nt, Pseudomonas aeruginosa PA01
uagucggcagucgccgcaccgg

SEQ ID NO: 1411300 - RNA, 18 nt, Pseudomonas aeruginosa PA01
uagucggugaagcgcggc

SEQ ID NO: 1411301 - RNA, 19 nt, Pseudomonas aeruginosa PA01
uagucggugaagcgcggcg

SEQ ID NO: 1411302 - RNA, 12 nt, Pseudomonas aeruginosa PA01
uaguccagccag

SEQ ID NO: 1411303 - RNA, 13 nt, Pseudomonas aeruginosa PA01
uagucgccccggu

SEQ ID NO: 1411304 - RNA, 22 nt, Pseudomonas aeruginosa PA01
uaguggcguuccaggcggcgga

SEQ ID NO: 1411305 - RNA, 16 nt, Pseudomonas aeruginosa PA01
uagugcucggccaguu

SEQ ID NO: 1411306 - RNA, 12 nt, Pseudomonas aeruginosa PA01
uagugcuggcgc

SEQ ID NO: 1411307 - RNA, 16 nt, Pseudomonas aeruginosa PA01
uaguugacgucgccga

SEQ ID NO: 1411308 - RNA, 14 nt, Pseudomonas aeruginosa PA01
uagcguccagcucg

SEQ ID NO: 1411309 - RNA, 24 nt, Pseudomonas aeruginosa PA01
uaggugaagcccaggcgcucggcg

SEQ ID NO: 1411310 - RNA, 18 nt, Pseudomonas aeruginosa PA01
uagguggcgccgccggcg

SEQ ID NO: 1411311 - RNA, 17 nt, Pseudomonas aeruginosa PA01
uagguuuccccguggcg

SEQ ID NO: 1411312 - RNA, 18 nt, Pseudomonas aeruginosa PA01
uagguuuccccguggcgc

SEQ ID NO: 1411313 - RNA, 21 nt, Pseudomonas aeruginosa PA01
uauagcccugggcgccgccgg

SEQ ID NO: 1411314 - RNA, 18 nt, Pseudomonas aeruginosa PA01
uauaacgcgagccacauc

SEQ ID NO: 1411315 - RNA, 17 nt, Pseudomonas aeruginosa PA01
uauccuccaggccgccg

SEQ ID NO: 1411316 - RNA, 22 nt, Pseudomonas aeruginosa PA01
uauccucgcggaagucggcggg

SEQ ID NO: 1411317 - RNA, 13 nt, Pseudomonas aeruginosa PA01
uauccagcggccg

SEQ ID NO: 1411318 - RNA, 14 nt, Pseudomonas aeruginosa PA01
uauccagcacccgc

SEQ ID NO: 1411319 - RNA, 13 nt, Pseudomonas aeruginosa PA01
uacuucgccgggu

SEQ ID NO: 1411320 - RNA, 19 nt, Pseudomonas aeruginosa PA01
uacuggcggaucaccggcu

SEQ ID NO: 1411321 - RNA, 15 nt, Pseudomonas aeruginosa PA01
uacucgugggccggu

SEQ ID NO: 1411322 - RNA, 22 nt, Pseudomonas aeruginosa PA01
uacucaugcaggcgucggucca

SEQ ID NO: 1411323 - RNA, 15 nt, Pseudomonas aeruginosa PA01
uacuccagcagcgca

SEQ ID NO: 1411324 - RNA, 20 nt, Pseudomonas aeruginosa PA01
uacggauucucucccaggag

SEQ ID NO: 1411325 - RNA, 20 nt, Pseudomonas aeruginosa PA01
uacuccgccgcuuccgccgg

SEQ ID NO: 1411326 - RNA, 12 nt, Pseudomonas aeruginosa PA01
uacuccgcgacg

SEQ ID NO: 1411327 - RNA, 13 nt, Pseudomonas aeruginosa PA01
uacucgccgggcg

SEQ ID NO: 1411328 - RNA, 14 nt, Pseudomonas aeruginosa PA01
uacggcaccaccac

SEQ ID NO: 1411329 - RNA, 19 nt, Pseudomonas aeruginosa PA01
uacggcaggguagccacgc

SEQ ID NO: 1411330 - RNA, 19 nt, Pseudomonas aeruginosa PA01
uacggaaggucgccgggcu

SEQ ID NO: 1411331 - RNA, 19 nt, Pseudomonas aeruginosa PA01
uacggagaagggcgcgccc

SEQ ID NO: 1411332 - RNA, 20 nt, Pseudomonas aeruginosa PA01
uagaaggcguccaccggcgc

SEQ ID NO: 1411333 - RNA, 19 nt, Pseudomonas aeruginosa PA01
uagaaggugcccagcggcg

SEQ ID NO: 1411334 - RNA, 20 nt, Pseudomonas aeruginosa PA01
uagaaggugcccagcggcgc

SEQ ID NO: 1411335 - RNA, 15 nt, Pseudomonas aeruginosa PA01
uagaagcgcgcggua

SEQ ID NO: 1411336 - RNA, 15 nt, Pseudomonas aeruginosa PA01
uagaucugcaccgcc

SEQ ID NO: 1411337 - RNA, 21 nt, Pseudomonas aeruginosa PA01
uagaguugcuuggcgcgcugg

SEQ ID NO: 1411338 - RNA, 15 nt, Pseudomonas aeruginosa PA01
uagagaugcaccggc

SEQ ID NO: 1411339 - RNA, 15 nt, Pseudomonas aeruginosa PA01
uagagaugcagcagg

SEQ ID NO: 1411340 - RNA, 14 nt, Pseudomonas aeruginosa PA01
uagagauucuuccg

SEQ ID NO: 1411341 - RNA, 16 nt, Pseudomonas aeruginosa PA01
uagagcuucccgcaug

SEQ ID NO: 1411342 - RNA, 17 nt, Pseudomonas aeruginosa PA01
uagaggaugccggccuc

SEQ ID NO: 1411343 - RNA, 21 nt, Pseudomonas aeruginosa PA01
uagccggcgaucauccagccc

SEQ ID NO: 1411344 - RNA, 22 nt, Pseudomonas aeruginosa PA01
uagccggcgaaccaggcggccg

SEQ ID NO: 1411345 - RNA, 12 nt, Pseudomonas aeruginosa PA01
uagccggccagg

SEQ ID NO: 1411346 - RNA, 14 nt, Pseudomonas aeruginosa PA01
uagccggcgcgccc

SEQ ID NO: 1411347 - RNA, 19 nt, Pseudomonas aeruginosa PA01
uagccggcgcggcgcagcg

SEQ ID NO: 1411348 - RNA, 17 nt, Pseudomonas aeruginosa PA01
uagccggcgccgucgac

SEQ ID NO: 1411349 - RNA, 22 nt, Pseudomonas aeruginosa PA01
uagcgcaugccguuggccgagc

SEQ ID NO: 1411350 - RNA, 23 nt, Pseudomonas aeruginosa PA01
uagcgcaugccguuggccgagcg

SEQ ID NO: 1411351 - RNA, 14 nt, Pseudomonas aeruginosa PA01
uagcgcagccgcuc

SEQ ID NO: 1411352 - RNA, 17 nt, Pseudomonas aeruginosa PA01
uagcgcagccgcucggc

SEQ ID NO: 1411353 - RNA, 13 nt, Pseudomonas aeruginosa PA01
uagcgcagcggca

SEQ ID NO: 1411354 - RNA, 20 nt, Pseudomonas aeruginosa PA01
uagcgcagguugcgcuggcg

SEQ ID NO: 1411355 - RNA, 19 nt, Pseudomonas aeruginosa PA01
uagccgucaagcaacggcg

SEQ ID NO: 1411356 - RNA, 21 nt, Pseudomonas aeruginosa PA01
uagccgucaagcaacggcgaa

SEQ ID NO: 1411357 - RNA, 20 nt, Pseudomonas aeruginosa PA01
uagcgucgcgcggccagcgu

SEQ ID NO: 1411358 - RNA, 16 nt, Pseudomonas aeruginosa PA01
uagcgggcauccagcg

SEQ ID NO: 1411359 - RNA, 17 nt, Pseudomonas aeruginosa PA01
uagcgggccagcagcuc

SEQ ID NO: 1411360 - RNA, 14 nt, Pseudomonas aeruginosa PA01
uagcgccgcgggcg

SEQ ID NO: 1411361 - RNA, 21 nt, Pseudomonas aeruginosa PA01
uagcgcaguucgccgccgagc

SEQ ID NO: 1411362 - RNA, 22 nt, Pseudomonas aeruginosa PA01
uagcgcaguucgccgccgagcg

SEQ ID NO: 1411363 - RNA, 17 nt, Pseudomonas aeruginosa PA01
uagcgccccggccgcgc

SEQ ID NO: 1411364 - RNA, 14 nt, Pseudomonas aeruginosa PA01
uagcgcccgacggc

SEQ ID NO: 1411365 - RNA, 14 nt, Pseudomonas aeruginosa PA01
uagcgccgcaggcg

SEQ ID NO: 1411366 - RNA, 13 nt, Pseudomonas aeruginosa PA01
uagcgcgccgagg

SEQ ID NO: 1411367 - RNA, 13 nt, Pseudomonas aeruginosa PA01
uagcgcgccgggu

SEQ ID NO: 1411368 - RNA, 18 nt, Pseudomonas aeruginosa PA01
uagcggcucgccgaaagg

SEQ ID NO: 1411369 - RNA, 16 nt, Pseudomonas aeruginosa PA01
uagccaggggucaggc

SEQ ID NO: 1411370 - RNA, 18 nt, Pseudomonas aeruginosa PA01
uagccauggcggaucugg

SEQ ID NO: 1411371 - RNA, 19 nt, Pseudomonas aeruginosa PA01
uagccaugcacacgcuccc

SEQ ID NO: 1411372 - RNA, 14 nt, Pseudomonas aeruginosa PA01
uagccccucgcgca

SEQ ID NO: 1411373 - RNA, 16 nt, Pseudomonas aeruginosa PA01
uagccccggcccggcg

SEQ ID NO: 1411374 - RNA, 16 nt, Pseudomonas aeruginosa PA01
uagccgcguacggucu

SEQ ID NO: 1411375 - RNA, 16 nt, Pseudomonas aeruginosa PA01
uagccggacuccgacg

SEQ ID NO: 1411376 - RNA, 12 nt, Pseudomonas aeruginosa PA01
uagccgcgccgg

SEQ ID NO: 1411377 - RNA, 19 nt, Pseudomonas aeruginosa PA01
uagccaaccagauccggga

SEQ ID NO: 1411378 - RNA, 17 nt, Pseudomonas aeruginosa PA01
uagcaggccuggagcgc

SEQ ID NO: 1411379 - RNA, 20 nt, Pseudomonas aeruginosa PA01
uagauguggguauccagcgg

SEQ ID NO: 1411380 - RNA, 14 nt, Pseudomonas aeruginosa PA01
uagaugccgcccug

SEQ ID NO: 1411381 - RNA, 17 nt, Pseudomonas aeruginosa PA01
uagaugccggugcuggu

SEQ ID NO: 1411382 - RNA, 22 nt, Pseudomonas aeruginosa PA01
uaccuccagccagcagcccggc

SEQ ID NO: 1411383 - RNA, 13 nt, Pseudomonas aeruginosa PA01
uaccuggcgcuga

SEQ ID NO: 1411384 - RNA, 14 nt, Pseudomonas aeruginosa PA01
uaccuggcgcugaa

SEQ ID NO: 1411385 - RNA, 16 nt, Pseudomonas aeruginosa PA01
uaccuggcgcugaaca

SEQ ID NO: 1411386 - RNA, 17 nt, Pseudomonas aeruginosa PA01
uaccuugccggugcggu

SEQ ID NO: 1411387 - RNA, 15 nt, Pseudomonas aeruginosa PA01
uacgcccuccagcac

SEQ ID NO: 1411388 - RNA, 13 nt, Pseudomonas aeruginosa PA01
uacgcccgcagcc

SEQ ID NO: 1411389 - RNA, 20 nt, Pseudomonas aeruginosa PA01
uacgccccguuugccgucgg

SEQ ID NO: 1411390 - RNA, 22 nt, Pseudomonas aeruginosa PA01
uacgccccguuugccgucggcg

SEQ ID NO: 1411391 - RNA, 11 nt, Pseudomonas aeruginosa PA01
uacgccuugca

SEQ ID NO: 1411392 - RNA, 20 nt, Pseudomonas aeruginosa PA01
uacgcucggggugcgcggcg

SEQ ID NO: 1411393 - RNA, 21 nt, Pseudomonas aeruginosa PA01
uacgccggguuucacggcgga

SEQ ID NO: 1411394 - RNA, 17 nt, Pseudomonas aeruginosa PA01
uacgccggauuucacgg

SEQ ID NO: 1411395 - RNA, 19 nt, Pseudomonas aeruginosa PA01
uacgccggauuucacggcg

SEQ ID NO: 1411396 - RNA, 16 nt, Pseudomonas aeruginosa PA01
uaccgcucucggugac

SEQ ID NO: 1411397 - RNA, 14 nt, Pseudomonas aeruginosa PA01
uaccgcugcgcggg

SEQ ID NO: 1411398 - RNA, 14 nt, Pseudomonas aeruginosa PA01
uaccgcugcggccg

SEQ ID NO: 1411399 - RNA, 18 nt, Pseudomonas aeruginosa PA01
uaccgcugggacggcggc

SEQ ID NO: 1411400 - RNA, 16 nt, Pseudomonas aeruginosa PA01
uaccggcaaggcgcug

SEQ ID NO: 1411401 - RNA, 17 nt, Pseudomonas aeruginosa PA01
uaccggcaaggcgcuga

SEQ ID NO: 1411402 - RNA, 21 nt, Pseudomonas aeruginosa PA01
uaccggcaaggcgcugaagcg

SEQ ID NO: 1411403 - RNA, 18 nt, Pseudomonas aeruginosa PA01
uaccgccgagggcgccag

SEQ ID NO: 1411404 - RNA, 14 nt, Pseudomonas aeruginosa PA01
uaccgccggcggcg

SEQ ID NO: 1411405 - RNA, 18 nt, Pseudomonas aeruginosa PA01
uaccgccggcggcgauga

SEQ ID NO: 1411406 - RNA, 21 nt, Pseudomonas aeruginosa PA01
uaccgccggcagugugccgcc

SEQ ID NO: 1411407 - RNA, 20 nt, Pseudomonas aeruginosa PA01
uaccgcccacccugcgcgag

SEQ ID NO: 1411408 - RNA, 19 nt, Pseudomonas aeruginosa PA01
uaccguggaaccgauggcc

SEQ ID NO: 1411409 - RNA, 17 nt, Pseudomonas aeruginosa PA01
uaccggcgaccaccgcc

SEQ ID NO: 1411410 - RNA, 14 nt, Pseudomonas aeruginosa PA01
uaccggcgaccuca

SEQ ID NO: 1411411 - RNA, 19 nt, Pseudomonas aeruginosa PA01
uaccggcggauaacgccug

SEQ ID NO: 1411412 - RNA, 20 nt, Pseudomonas aeruginosa PA01
uaccggccaucagcaccagg

SEQ ID NO: 1411413 - RNA, 23 nt, Pseudomonas aeruginosa PA01
uaccaggguguugucgcggcuga

SEQ ID NO: 1411414 - RNA, 16 nt, Pseudomonas aeruginosa PA01
uaccagggaagcgcgc

SEQ ID NO: 1411415 - RNA, 13 nt, Pseudomonas aeruginosa PA01
uacccagcgggca

SEQ ID NO: 1411416 - RNA, 23 nt, Pseudomonas aeruginosa PA01
uaccccacgguagagacggcggc

SEQ ID NO: 1411417 - RNA, 15 nt, Pseudomonas aeruginosa PA01
uacccaggccgucga

SEQ ID NO: 1411418 - RNA, 21 nt, Pseudomonas aeruginosa PA01
uacccagguggucgaccaggc

SEQ ID NO: 1411419 - RNA, 14 nt, Pseudomonas aeruginosa PA01
uacccgccggccau

SEQ ID NO: 1411420 - RNA, 24 nt, Pseudomonas aeruginosa PA01
uacccgagacuugaucgcacggcg

SEQ ID NO: 1411421 - RNA, 19 nt, Pseudomonas aeruginosa PA01
uaccccguuguacccggcg

SEQ ID NO: 1411422 - RNA, 13 nt, Pseudomonas aeruginosa PA01
uaccccgggucgc

SEQ ID NO: 1411423 - RNA, 19 nt, Pseudomonas aeruginosa PA01
uaccccgggucgcgcagcg

SEQ ID NO: 1411424 - RNA, 17 nt, Pseudomonas aeruginosa PA01
uaccccgguugugcgcc

SEQ ID NO: 1411425 - RNA, 19 nt, Pseudomonas aeruginosa PA01
uacccgacaggcagcgccg

SEQ ID NO: 1411426 - RNA, 21 nt, Pseudomonas aeruginosa PA01
uacccgacaggcagcgccgcc

SEQ ID NO: 1411427 - RNA, 22 nt, Pseudomonas aeruginosa PA01
uacccgacaggcagcgccgccc

SEQ ID NO: 1411428 - RNA, 11 nt, Pseudomonas aeruginosa PA01
uaccccagggg

SEQ ID NO: 1411429 - RNA, 12 nt, Pseudomonas aeruginosa PA01
uacccggcgccc

SEQ ID NO: 1411430 - RNA, 13 nt, Pseudomonas aeruginosa PA01
uacccggcgcccc

SEQ ID NO: 1411431 - RNA, 19 nt, Pseudomonas aeruginosa PA01
uacccgcgaccacaggcgg

SEQ ID NO: 1411432 - RNA, 14 nt, Pseudomonas aeruginosa PA01
uacccuggccggcc

SEQ ID NO: 1411433 - RNA, 17 nt, Pseudomonas aeruginosa PA01
uacccuucaucccuucu

SEQ ID NO: 1411434 - RNA, 22 nt, Pseudomonas aeruginosa PA01
uacccgugggggggaagggccg

SEQ ID NO: 1411435 - RNA, 23 nt, Pseudomonas aeruginosa PA01
uacccgugggggggaagggccgg

SEQ ID NO: 1411436 - RNA, 21 nt, Pseudomonas aeruginosa PA01
uaccgacaagcauucagcgcg

SEQ ID NO: 1411437 - RNA, 15 nt, Pseudomonas aeruginosa PA01
uaccgacggucggca

SEQ ID NO: 1411438 - RNA, 14 nt, Pseudomonas aeruginosa PA01
uaccgaaacagggc

SEQ ID NO: 1411439 - RNA, 13 nt, Pseudomonas aeruginosa PA01
uaccgaucggcug

SEQ ID NO: 1411440 - RNA, 19 nt, Pseudomonas aeruginosa PA01
uaccgccacguacagcgcg

SEQ ID NO: 1411441 - RNA, 16 nt, Pseudomonas aeruginosa PA01
uaccgccagcgcaccu

SEQ ID NO: 1411442 - RNA, 23 nt, Pseudomonas aeruginosa PA01
ucaggcugacgucgacgcagcgc

SEQ ID NO: 1411443 - RNA, 22 nt, Pseudomonas aeruginosa PA01
ucagggaagaugcacaccagcu

SEQ ID NO: 1411444 - RNA, 21 nt, Pseudomonas aeruginosa PA01
ucagggaauggaugcgcggca

SEQ ID NO: 1411445 - RNA, 22 nt, Pseudomonas aeruginosa PA01
ucagggacaccccgucucgcug

SEQ ID NO: 1411446 - RNA, 19 nt, Pseudomonas aeruginosa PA01
ucagggacaugucgagggc

SEQ ID NO: 1411447 - RNA, 15 nt, Pseudomonas aeruginosa PA01
ucagggcgagcaggg

SEQ ID NO: 1411448 - RNA, 12 nt, Pseudomonas aeruginosa PA01
ucagggccgcgc

SEQ ID NO: 1411449 - RNA, 12 nt, Pseudomonas aeruginosa PA01
ucagggccacgc

SEQ ID NO: 1411450 - RNA, 19 nt, Pseudomonas aeruginosa PA01
ucagguaaggcaccaccgc

SEQ ID NO: 1411451 - RNA, 23 nt, Pseudomonas aeruginosa PA01
ucagguaaggcaccaccgccgcc

SEQ ID NO: 1411452 - RNA, 23 nt, Pseudomonas aeruginosa PA01
ucagggugaucuguucgaccagu

SEQ ID NO: 1411453 - RNA, 14 nt, Pseudomonas aeruginosa PA01
ucaggguggcgacc

SEQ ID NO: 1411454 - RNA, 17 nt, Pseudomonas aeruginosa PA01
ucaggguggcgaccgcc

SEQ ID NO: 1411455 - RNA, 15 nt, Pseudomonas aeruginosa PA01
ucaggguggcgauca

SEQ ID NO: 1411456 - RNA, 21 nt, Pseudomonas aeruginosa PA01
ucaggguggcgcugccuucga

SEQ ID NO: 1411457 - RNA, 18 nt, Pseudomonas aeruginosa PA01
ucagggcuugcgcgccac

SEQ ID NO: 1411458 - RNA, 14 nt, Pseudomonas aeruginosa PA01
ucagggucggcccg

SEQ ID NO: 1411459 - RNA, 16 nt, Pseudomonas aeruginosa PA01
ucaggugcuggacucg

SEQ ID NO: 1411460 - RNA, 16 nt, Pseudomonas aeruginosa PA01
ucaggucgucgggcag

SEQ ID NO: 1411461 - RNA, 15 nt, Pseudomonas aeruginosa PA01
ucagguucggcagcg

SEQ ID NO: 1411462 - RNA, 23 nt, Pseudomonas aeruginosa PA01
ucagguucggcagcgccucggcg

SEQ ID NO: 1411463 - RNA, 14 nt, Pseudomonas aeruginosa PA01
ucagguugccggcg

SEQ ID NO: 1411464 - RNA, 13 nt, Pseudomonas aeruginosa PA01
ucaggucggccgc

SEQ ID NO: 1411465 - RNA, 14 nt, Pseudomonas aeruginosa PA01
ucaggucggccgcc

SEQ ID NO: 1411466 - RNA, 18 nt, Pseudomonas aeruginosa PA01
ucaggucggucuggcggc

SEQ ID NO: 1411467 - RNA, 12 nt, Pseudomonas aeruginosa PA01
ucaggucgccgc

SEQ ID NO: 1411468 - RNA, 13 nt, Pseudomonas aeruginosa PA01
ucaggucgccgcc

SEQ ID NO: 1411469 - RNA, 15 nt, Pseudomonas aeruginosa PA01
ucaggucgccgccgc

SEQ ID NO: 1411470 - RNA, 14 nt, Pseudomonas aeruginosa PA01
ucaggucgccgcug

SEQ ID NO: 1411471 - RNA, 16 nt, Pseudomonas aeruginosa PA01
ucagguaggcgcgggc

SEQ ID NO: 1411472 - RNA, 17 nt, Pseudomonas aeruginosa PA01
ucagguagucgcccggc

SEQ ID NO: 1411473 - RNA, 15 nt, Pseudomonas aeruginosa PA01
ucagguagugcaaca

SEQ ID NO: 1411474 - RNA, 17 nt, Pseudomonas aeruginosa PA01
ucagguccuugaucacg

SEQ ID NO: 1411475 - RNA, 15 nt, Pseudomonas aeruginosa PA01
ucagcgggccgaucc

SEQ ID NO: 1411476 - RNA, 22 nt, Pseudomonas aeruginosa PA01
ucagcgggcgcuugaagccggc

SEQ ID NO: 1411477 - RNA, 19 nt, Pseudomonas aeruginosa PA01
ucagcggcggugcgccggc

SEQ ID NO: 1411478 - RNA, 22 nt, Pseudomonas aeruginosa PA01
ucagcggcggugcgccggcggg

SEQ ID NO: 1411479 - RNA, 15 nt, Pseudomonas aeruginosa PA01
ucagcggcggggcca

SEQ ID NO: 1411480 - RNA, 20 nt, Pseudomonas aeruginosa PA01
ucaggccgagaaaccgccau

SEQ ID NO: 1411481 - RNA, 19 nt, Pseudomonas aeruginosa PA01
ucaggccgaggcgcuucug

SEQ ID NO: 1411482 - RNA, 21 nt, Pseudomonas aeruginosa PA01
ucaggcccuuuuccaccggcc

SEQ ID NO: 1411483 - RNA, 17 nt, Pseudomonas aeruginosa PA01
ucaggccgaagcugucg

SEQ ID NO: 1411484 - RNA, 22 nt, Pseudomonas aeruginosa PA01
ucaggccgaagcugucgagcac

SEQ ID NO: 1411485 - RNA, 22 nt, Pseudomonas aeruginosa PA01
ucaggcccuugagggccucggc

SEQ ID NO: 1411486 - RNA, 23 nt, Pseudomonas aeruginosa PA01
ucaggcccuugagggccucggcg

SEQ ID NO: 1411487 - RNA, 17 nt, Pseudomonas aeruginosa PA01
ucagcggcuggcgaugc

SEQ ID NO: 1411488 - RNA, 19 nt, Pseudomonas aeruginosa PA01
ucagcggcuggcgaugcug

SEQ ID NO: 1411489 - RNA, 21 nt, Pseudomonas aeruginosa PA01
ucaggccgaucaccaccagcg

SEQ ID NO: 1411490 - RNA, 13 nt, Pseudomonas aeruginosa PA01
ucaggccgccgcg

SEQ ID NO: 1411491 - RNA, 13 nt, Pseudomonas aeruginosa PA01
ucaggccgcggcc

SEQ ID NO: 1411492 - RNA, 18 nt, Pseudomonas aeruginosa PA01
ucaggccgcggcccugcg

SEQ ID NO: 1411493 - RNA, 16 nt, Pseudomonas aeruginosa PA01
ucaggccggcgccgcc

SEQ ID NO: 1411494 - RNA, 19 nt, Pseudomonas aeruginosa PA01
ucaggccggcgccgccgaa

SEQ ID NO: 1411495 - RNA, 22 nt, Pseudomonas aeruginosa PA01
ucaggccggcgcgauccuggcg

SEQ ID NO: 1411496 - RNA, 13 nt, Pseudomonas aeruginosa PA01
ucaggccggcguc

SEQ ID NO: 1411497 - RNA, 23 nt, Pseudomonas aeruginosa PA01
ucaggccgggcaccccgagcggc

SEQ ID NO: 1411498 - RNA, 17 nt, Pseudomonas aeruginosa PA01
ucaggcgggcgucgucg

SEQ ID NO: 1411499 - RNA, 18 nt, Pseudomonas aeruginosa PA01
ucaggcgggcuccgccgc

SEQ ID NO: 1411500 - RNA, 17 nt, Pseudomonas aeruginosa PA01
ucaggcguacgucgaua

SEQ ID NO: 1411501 - RNA, 17 nt, Pseudomonas aeruginosa PA01
ucaggcguaggccgucg

SEQ ID NO: 1411502 - RNA, 18 nt, Pseudomonas aeruginosa PA01
ucaggcguaggccgucgc

SEQ ID NO: 1411503 - RNA, 20 nt, Pseudomonas aeruginosa PA01
ucaggcgucccgcuccagcc

SEQ ID NO: 1411504 - RNA, 14 nt, Pseudomonas aeruginosa PA01
ucaggcucaggccg

SEQ ID NO: 1411505 - RNA, 13 nt, Pseudomonas aeruginosa PA01
ucaggcgcgcggc

SEQ ID NO: 1411506 - RNA, 16 nt, Pseudomonas aeruginosa PA01
ucaggcgugggccagc

SEQ ID NO: 1411507 - RNA, 20 nt, Pseudomonas aeruginosa PA01
ucaggcgugggccagcccag

SEQ ID NO: 1411508 - RNA, 14 nt, Pseudomonas aeruginosa PA01
ucaggcucggccug

SEQ ID NO: 1411509 - RNA, 18 nt, Pseudomonas aeruginosa PA01
ucaggcugaagcggccgc

SEQ ID NO: 1411510 - RNA, 15 nt, Pseudomonas aeruginosa PA01
ucaggcugccgagca

SEQ ID NO: 1411511 - RNA, 17 nt, Pseudomonas aeruginosa PA01
ucaggcugccgagcagg

SEQ ID NO: 1411512 - RNA, 18 nt, Pseudomonas aeruginosa PA01
ucaggcugccgagcaggg

SEQ ID NO: 1411513 - RNA, 14 nt, Pseudomonas aeruginosa PA01
ucaggcugcgcacc

SEQ ID NO: 1411514 - RNA, 22 nt, Pseudomonas aeruginosa PA01
ucaggcugcgcaccucggccag

SEQ ID NO: 1411515 - RNA, 14 nt, Pseudomonas aeruginosa PA01
ucaggcugcgcgca

SEQ ID NO: 1411516 - RNA, 15 nt, Pseudomonas aeruginosa PA01
ucaggcugcggcgga

SEQ ID NO: 1411517 - RNA, 17 nt, Pseudomonas aeruginosa PA01
ucaggcugcggcggaag

SEQ ID NO: 1411518 - RNA, 13 nt, Pseudomonas aeruginosa PA01
ucaggcuggcccc

SEQ ID NO: 1411519 - RNA, 23 nt, Pseudomonas aeruginosa PA01
ucaggcugggguugcggcgcccg

SEQ ID NO: 1411520 - RNA, 17 nt, Pseudomonas aeruginosa PA01
ucaggcuggugccgcug

SEQ ID NO: 1411521 - RNA, 22 nt, Pseudomonas aeruginosa PA01
ucaggcugguggucaccgccag

SEQ ID NO: 1411522 - RNA, 20 nt, Pseudomonas aeruginosa PA01
ucaggcuguagccucccgcc

SEQ ID NO: 1411523 - RNA, 15 nt, Pseudomonas aeruginosa PA01
ucaggcuguccacgc

SEQ ID NO: 1411524 - RNA, 18 nt, Pseudomonas aeruginosa PA01
ucaggcggcacucggcga

SEQ ID NO: 1411525 - RNA, 20 nt, Pseudomonas aeruginosa PA01
ucaggcggcacucggcgacc

SEQ ID NO: 1411526 - RNA, 12 nt, Pseudomonas aeruginosa PA01
ucaggcgcuggu

SEQ ID NO: 1411527 - RNA, 13 nt, Pseudomonas aeruginosa PA01
ucaggcgcugcug

SEQ ID NO: 1411528 - RNA, 23 nt, Pseudomonas aeruginosa PA01
ucaggcgcuccuggagguucggc

SEQ ID NO: 1411529 - RNA, 15 nt, Pseudomonas aeruginosa PA01
ucaggcgcgcggcca

SEQ ID NO: 1411530 - RNA, 16 nt, Pseudomonas aeruginosa PA01
ucaggcgcgcggccag

SEQ ID NO: 1411531 - RNA, 13 nt, Pseudomonas aeruginosa PA01
ucaggcgccgcug

SEQ ID NO: 1411532 - RNA, 19 nt, Pseudomonas aeruginosa PA01
ucaggcgccaggccucaga

SEQ ID NO: 1411533 - RNA, 17 nt, Pseudomonas aeruginosa PA01
ucaggcgacgccgcgcu

SEQ ID NO: 1411534 - RNA, 18 nt, Pseudomonas aeruginosa PA01
ucaggcgacgccgcgcug

SEQ ID NO: 1411535 - RNA, 21 nt, Pseudomonas aeruginosa PA01
ucaggcgcagcguccugcccu

SEQ ID NO: 1411536 - RNA, 19 nt, Pseudomonas aeruginosa PA01
ucaggcgcaguaacgccug

SEQ ID NO: 1411537 - RNA, 22 nt, Pseudomonas aeruginosa PA01
ucagugagccccggcgucggcg

SEQ ID NO: 1411538 - RNA, 15 nt, Pseudomonas aeruginosa PA01
ucagucccgcggcgc

SEQ ID NO: 1411539 - RNA, 17 nt, Pseudomonas aeruginosa PA01
ucagucgucguccagcg

SEQ ID NO: 1411540 - RNA, 13 nt, Pseudomonas aeruginosa PA01
ucagugcgccggg

SEQ ID NO: 1411541 - RNA, 21 nt, Pseudomonas aeruginosa PA01
ucagugcgggcaguccuggcg

SEQ ID NO: 1411542 - RNA, 23 nt, Pseudomonas aeruginosa PA01
ucagugcgggcaguccuggcggu

SEQ ID NO: 1411543 - RNA, 15 nt, Pseudomonas aeruginosa PA01
ucagugcaucggccg

SEQ ID NO: 1411544 - RNA, 19 nt, Pseudomonas aeruginosa PA01
ucagugcaucggccgccag

SEQ ID NO: 1411545 - RNA, 17 nt, Pseudomonas aeruginosa PA01
ucagugccagcagacgc

SEQ ID NO: 1411546 - RNA, 13 nt, Pseudomonas aeruginosa PA01
ucaguuccucgcg

SEQ ID NO: 1411547 - RNA, 16 nt, Pseudomonas aeruginosa PA01
ucaguggucgcagcuc

SEQ ID NO: 1411548 - RNA, 14 nt, Pseudomonas aeruginosa PA01
ucaguucagccggu

SEQ ID NO: 1411549 - RNA, 21 nt, Pseudomonas aeruginosa PA01
ucaucccguagaugugcuggg

SEQ ID NO: 1411550 - RNA, 16 nt, Pseudomonas aeruginosa PA01
ucauccgcaccauccg

SEQ ID NO: 1411551 - RNA, 20 nt, Pseudomonas aeruginosa PA01
ucauccgcaccauccgccgc

SEQ ID NO: 1411552 - RNA, 21 nt, Pseudomonas aeruginosa PA01
ucauccgcccugcgucgcaga

SEQ ID NO: 1411553 - RNA, 13 nt, Pseudomonas aeruginosa PA01
ucauccgccggcg

SEQ ID NO: 1411554 - RNA, 18 nt, Pseudomonas aeruginosa PA01
ucauccgcguggcgaugc

SEQ ID NO: 1411555 - RNA, 21 nt, Pseudomonas aeruginosa PA01
ucauccgcugguagcccaggc

SEQ ID NO: 1411556 - RNA, 15 nt, Pseudomonas aeruginosa PA01
ucaucggcccgacgc

SEQ ID NO: 1411557 - RNA, 19 nt, Pseudomonas aeruginosa PA01
ucaucggcccgacgccgcc

SEQ ID NO: 1411558 - RNA, 23 nt, Pseudomonas aeruginosa PA01
ucaucggcccgacgccgcccggc

SEQ ID NO: 1411559 - RNA, 21 nt, Pseudomonas aeruginosa PA01
ucaucggcggcaggcgcauca

SEQ ID NO: 1411560 - RNA, 23 nt, Pseudomonas aeruginosa PA01
ucaucgcgccaaugccgucgauc

SEQ ID NO: 1411561 - RNA, 14 nt, Pseudomonas aeruginosa PA01
ucaucgccgccagg

SEQ ID NO: 1411562 - RNA, 24 nt, Pseudomonas aeruginosa PA01
ucaucgcguagguggcgccgccgg

SEQ ID NO: 1411563 - RNA, 17 nt, Pseudomonas aeruginosa PA01
ucaucgcgucgccgaac

SEQ ID NO: 1411564 - RNA, 19 nt, Pseudomonas aeruginosa PA01
uccaaagccuggagcaggg

SEQ ID NO: 1411565 - RNA, 21 nt, Pseudomonas aeruginosa PA01
ucauggcggcaucaguagcgg

SEQ ID NO: 1411566 - RNA, 22 nt, Pseudomonas aeruginosa PA01
ucauggccaggucagccaccug

SEQ ID NO: 1411567 - RNA, 18 nt, Pseudomonas aeruginosa PA01
ucauggaaaccccggccu

SEQ ID NO: 1411568 - RNA, 22 nt, Pseudomonas aeruginosa PA01
ucauggaaaccccggccuggcg

SEQ ID NO: 1411569 - RNA, 18 nt, Pseudomonas aeruginosa PA01
ucaugcccuggccgacgc

SEQ ID NO: 1411570 - RNA, 19 nt, Pseudomonas aeruginosa PA01
ucaugccgccaucgaccag

SEQ ID NO: 1411571 - RNA, 20 nt, Pseudomonas aeruginosa PA01
ucaugccgccaucgaccagg

SEQ ID NO: 1411572 - RNA, 21 nt, Pseudomonas aeruginosa PA01
ucaugccgccaucgaccagga

SEQ ID NO: 1411573 - RNA, 16 nt, Pseudomonas aeruginosa PA01
ucaugccgccgucgcg

SEQ ID NO: 1411574 - RNA, 23 nt, Pseudomonas aeruginosa PA01
ucaugccgccgucgcggccaucg

SEQ ID NO: 1411575 - RNA, 21 nt, Pseudomonas aeruginosa PA01
ucaugagguucaggccgggca

SEQ ID NO: 1411576 - RNA, 17 nt, Pseudomonas aeruginosa PA01
ucaugagauccgccagc

SEQ ID NO: 1411577 - RNA, 19 nt, Pseudomonas aeruginosa PA01
ucaugagauccgccagcag

SEQ ID NO: 1411578 - RNA, 17 nt, Pseudomonas aeruginosa PA01
ucaugcacuucgaccag

SEQ ID NO: 1411579 - RNA, 16 nt, Pseudomonas aeruginosa PA01
ucaugcaggccgaagc

SEQ ID NO: 1411580 - RNA, 20 nt, Pseudomonas aeruginosa PA01
ucaugaugcgcccggagcuu

SEQ ID NO: 1411581 - RNA, 16 nt, Pseudomonas aeruginosa PA01
uccaccggaucgcccu

SEQ ID NO: 1411582 - RNA, 20 nt, Pseudomonas aeruginosa PA01
uccaccggaucgcccuggcg

SEQ ID NO: 1411583 - RNA, 21 nt, Pseudomonas aeruginosa PA01
uccaccggaucgcccuggcgc

SEQ ID NO: 1411584 - RNA, 17 nt, Pseudomonas aeruginosa PA01
uccaccggcguccacuc

SEQ ID NO: 1411585 - RNA, 22 nt, Pseudomonas aeruginosa PA01
uccaccggcguccacuccggca

SEQ ID NO: 1411586 - RNA, 16 nt, Pseudomonas aeruginosa PA01
uccaccggcuggccgc

SEQ ID NO: 1411587 - RNA, 19 nt, Pseudomonas aeruginosa PA01
uccaccggcuugccgggug

SEQ ID NO: 1411588 - RNA, 14 nt, Pseudomonas aeruginosa PA01
uccaccgccagcac

SEQ ID NO: 1411589 - RNA, 16 nt, Pseudomonas aeruginosa PA01
uccaccgcuccggcgc

SEQ ID NO: 1411590 - RNA, 19 nt, Pseudomonas aeruginosa PA01
uccaccgcggccucgcugg

SEQ ID NO: 1411591 - RNA, 18 nt, Pseudomonas aeruginosa PA01
uccacgaggaugucggcg

SEQ ID NO: 1411592 - RNA, 15 nt, Pseudomonas aeruginosa PA01
uccacgacgaacggc

SEQ ID NO: 1411593 - RNA, 17 nt, Pseudomonas aeruginosa PA01
uccaccuugccgcgccc

SEQ ID NO: 1411594 - RNA, 18 nt, Pseudomonas aeruginosa PA01
uccaccuugccgcgcccg

SEQ ID NO: 1411595 - RNA, 20 nt, Pseudomonas aeruginosa PA01
uccaccuugccgcgcccggc

SEQ ID NO: 1411596 - RNA, 18 nt, Pseudomonas aeruginosa PA01
uccacgaaaaagcccggc

SEQ ID NO: 1411597 - RNA, 23 nt, Pseudomonas aeruginosa PA01
uccaccgucgcggucaucgccgg

SEQ ID NO: 1411598 - RNA, 19 nt, Pseudomonas aeruginosa PA01
uccaccguuccgacccggc

SEQ ID NO: 1411599 - RNA, 13 nt, Pseudomonas aeruginosa PA01
uccaccucgcccu

SEQ ID NO: 1411600 - RNA, 15 nt, Pseudomonas aeruginosa PA01
uccaccucgcccucg

SEQ ID NO: 1411601 - RNA, 13 nt, Pseudomonas aeruginosa PA01
uccaccagcccgc

SEQ ID NO: 1411602 - RNA, 15 nt, Pseudomonas aeruginosa PA01
uccaccagcccgcag

SEQ ID NO: 1411603 - RNA, 13 nt, Pseudomonas aeruginosa PA01
uccaccagccagc

SEQ ID NO: 1411604 - RNA, 23 nt, Pseudomonas aeruginosa PA01
uccaccagcgcccguagcacaug

SEQ ID NO: 1411605 - RNA, 22 nt, Pseudomonas aeruginosa PA01
uccaccagcgccggcggcgcgu

SEQ ID NO: 1411606 - RNA, 20 nt, Pseudomonas aeruginosa PA01
uccaccaggccauagcgcgc

SEQ ID NO: 1411607 - RNA, 20 nt, Pseudomonas aeruginosa PA01
uccaccaggcgucgcaccug

SEQ ID NO: 1411608 - RNA, 22 nt, Pseudomonas aeruginosa PA01
uccaccagggucgguucgcggc

SEQ ID NO: 1411609 - RNA, 20 nt, Pseudomonas aeruginosa PA01
uccaccgaguggcgcagcgc

SEQ ID NO: 1411610 - RNA, 13 nt, Pseudomonas aeruginosa PA01
uccaccaccagca

SEQ ID NO: 1411611 - RNA, 14 nt, Pseudomonas aeruginosa PA01
uccacccgcagccg

SEQ ID NO: 1411612 - RNA, 12 nt, Pseudomonas aeruginosa PA01
uccagcuggcgc

SEQ ID NO: 1411613 - RNA, 13 nt, Pseudomonas aeruginosa PA01
uccagcuggcgca

SEQ ID NO: 1411614 - RNA, 13 nt, Pseudomonas aeruginosa PA01
uccagcuggcgcg

SEQ ID NO: 1411615 - RNA, 13 nt, Pseudomonas aeruginosa PA01
uccagcuugucca

SEQ ID NO: 1411616 - RNA, 14 nt, Pseudomonas aeruginosa PA01
uccagcucggucag

SEQ ID NO: 1411617 - RNA, 18 nt, Pseudomonas aeruginosa PA01
uccagcugccagugcucg

SEQ ID NO: 1411618 - RNA, 19 nt, Pseudomonas aeruginosa PA01
uccagcggacgcuuguccu

SEQ ID NO: 1411619 - RNA, 20 nt, Pseudomonas aeruginosa PA01
uccagcgcgccgcgcaguuc

SEQ ID NO: 1411620 - RNA, 20 nt, Pseudomonas aeruginosa PA01
uccaggaucgccuccaccag

SEQ ID NO: 1411621 - RNA, 22 nt, Pseudomonas aeruginosa PA01
uccaggaccaguucgccgccgc

SEQ ID NO: 1411622 - RNA, 16 nt, Pseudomonas aeruginosa PA01
uccaggaauccuccgc

SEQ ID NO: 1411623 - RNA, 19 nt, Pseudomonas aeruginosa PA01
uccaggaauccuccgccag

SEQ ID NO: 1411624 - RNA, 21 nt, Pseudomonas aeruginosa PA01
uccaggaauccuccgccagcg

SEQ ID NO: 1411625 - RNA, 22 nt, Pseudomonas aeruginosa PA01
uccaggcccauccuggcgauca

SEQ ID NO: 1411626 - RNA, 18 nt, Pseudomonas aeruginosa PA01
uccaggcccgccgcggcg

SEQ ID NO: 1411627 - RNA, 21 nt, Pseudomonas aeruginosa PA01
uccaggccgccuauggcggau

SEQ ID NO: 1411628 - RNA, 21 nt, Pseudomonas aeruginosa PA01
uccaggccgcucaccgccacc

SEQ ID NO: 1411629 - RNA, 21 nt, Pseudomonas aeruginosa PA01
uccaggcacgaauuuccuggc

SEQ ID NO: 1411630 - RNA, 19 nt, Pseudomonas aeruginosa PA01
uccaggcgaaagucggcgc

SEQ ID NO: 1411631 - RNA, 19 nt, Pseudomonas aeruginosa PA01
uccaggcgaaggucgaagg

SEQ ID NO: 1411632 - RNA, 17 nt, Pseudomonas aeruginosa PA01
uccaggcgcgcuggaug

SEQ ID NO: 1411633 - RNA, 18 nt, Pseudomonas aeruginosa PA01
uccaggcgcugcucgaug

SEQ ID NO: 1411634 - RNA, 16 nt, Pseudomonas aeruginosa PA01
uccaggccgaagccgc

SEQ ID NO: 1411635 - RNA, 21 nt, Pseudomonas aeruginosa PA01
uccaggccgaagccgccggga

SEQ ID NO: 1411636 - RNA, 13 nt, Pseudomonas aeruginosa PA01
uccaggcuggccu

SEQ ID NO: 1411637 - RNA, 18 nt, Pseudomonas aeruginosa PA01
uccaggcuuuccaccgcc

SEQ ID NO: 1411638 - RNA, 21 nt, Pseudomonas aeruginosa PA01
uccaggcuuuccaccgccagc

SEQ ID NO: 1411639 - RNA, 15 nt, Pseudomonas aeruginosa PA01
uccagggagcgcucg

SEQ ID NO: 1411640 - RNA, 18 nt, Pseudomonas aeruginosa PA01
uccaggcggggucagagg

SEQ ID NO: 1411641 - RNA, 15 nt, Pseudomonas aeruginosa PA01
uccaggcgucggcgc

SEQ ID NO: 1411642 - RNA, 17 nt, Pseudomonas aeruginosa PA01
uccaggcgucggcgccu

SEQ ID NO: 1411643 - RNA, 14 nt, Pseudomonas aeruginosa PA01
uccaggcggcggua

SEQ ID NO: 1411644 - RNA, 22 nt, Pseudomonas aeruginosa PA01
uccaggcggcgguagccgaggc

SEQ ID NO: 1411645 - RNA, 14 nt, Pseudomonas aeruginosa PA01
uccagcgccgcgcu

SEQ ID NO: 1411646 - RNA, 24 nt, Pseudomonas aeruginosa PA01
uccagcgccuggaugaucgcgugg

SEQ ID NO: 1411647 - RNA, 15 nt, Pseudomonas aeruginosa PA01
uccagcgccuggcgc

SEQ ID NO: 1411648 - RNA, 20 nt, Pseudomonas aeruginosa PA01
uccagcgccuggcgcaguuc

SEQ ID NO: 1411649 - RNA, 15 nt, Pseudomonas aeruginosa PA01
uccagcgccucgggc

SEQ ID NO: 1411650 - RNA, 21 nt, Pseudomonas aeruginosa PA01
uccagcgccucgggccggagc

SEQ ID NO: 1411651 - RNA, 15 nt, Pseudomonas aeruginosa PA01
uccagccaggcgcuc

SEQ ID NO: 1411652 - RNA, 18 nt, Pseudomonas aeruginosa PA01
uccagccaggcgcucucg

SEQ ID NO: 1411653 - RNA, 13 nt, Pseudomonas aeruginosa PA01
uccagcgcccagg

SEQ ID NO: 1411654 - RNA, 17 nt, Pseudomonas aeruginosa PA01
uccagccaguggcuggc

SEQ ID NO: 1411655 - RNA, 18 nt, Pseudomonas aeruginosa PA01
uccagccagcagcccggc

SEQ ID NO: 1411656 - RNA, 16 nt, Pseudomonas aeruginosa PA01
uccagccagcccucgg

SEQ ID NO: 1411657 - RNA, 15 nt, Pseudomonas aeruginosa PA01
uccagccagccgccu

SEQ ID NO: 1411658 - RNA, 21 nt, Pseudomonas aeruginosa PA01
uccagcauuaccccgaccagg

SEQ ID NO: 1411659 - RNA, 20 nt, Pseudomonas aeruginosa PA01
uccagcaucaccuugcggaa

SEQ ID NO: 1411660 - RNA, 22 nt, Pseudomonas aeruginosa PA01
uccagcaguucgucgccacgcc

SEQ ID NO: 1411661 - RNA, 23 nt, Pseudomonas aeruginosa PA01
uccagcauccagcgauacaccug

SEQ ID NO: 1411662 - RNA, 18 nt, Pseudomonas aeruginosa PA01
uccagcagucgcacagcc

SEQ ID NO: 1411663 - RNA, 17 nt, Pseudomonas aeruginosa PA01
uccagcagucgcggccc

SEQ ID NO: 1411664 - RNA, 19 nt, Pseudomonas aeruginosa PA01
uccagcagucgcggcccug

SEQ ID NO: 1411665 - RNA, 13 nt, Pseudomonas aeruginosa PA01
uccagcaggucga

SEQ ID NO: 1411666 - RNA, 13 nt, Pseudomonas aeruginosa PA01
uccagcaggucgg

SEQ ID NO: 1411667 - RNA, 18 nt, Pseudomonas aeruginosa PA01
uccagcagguacagcgac

SEQ ID NO: 1411668 - RNA, 11 nt, Pseudomonas aeruginosa PA01
uccagcaggca

SEQ ID NO: 1411669 - RNA, 17 nt, Pseudomonas aeruginosa PA01
uccagcaggcaggcgcg

SEQ ID NO: 1411670 - RNA, 19 nt, Pseudomonas aeruginosa PA01
uccagcagggucgccuggg

SEQ ID NO: 1411671 - RNA, 14 nt, Pseudomonas aeruginosa PA01
uccacgucgccgac

SEQ ID NO: 1411672 - RNA, 15 nt, Pseudomonas aeruginosa PA01
uccacgucgccgacc

SEQ ID NO: 1411673 - RNA, 17 nt, Pseudomonas aeruginosa PA01
uccacguccuccaggcu

SEQ ID NO: 1411674 - RNA, 16 nt, Pseudomonas aeruginosa PA01
uccacgggucgcagcc

SEQ ID NO: 1411675 - RNA, 17 nt, Pseudomonas aeruginosa PA01
uccacgggucgcagccg

SEQ ID NO: 1411676 - RNA, 19 nt, Pseudomonas aeruginosa PA01
uccacgggucgcagccgag

SEQ ID NO: 1411677 - RNA, 22 nt, Pseudomonas aeruginosa PA01
uccacgcugugcggcagcaggc

SEQ ID NO: 1411678 - RNA, 17 nt, Pseudomonas aeruginosa PA01
uccacgccgaagucggc

SEQ ID NO: 1411679 - RNA, 20 nt, Pseudomonas aeruginosa PA01
uccacgccgaagucggcgag

SEQ ID NO: 1411680 - RNA, 13 nt, Pseudomonas aeruginosa PA01
uccacgccccagu

SEQ ID NO: 1411681 - RNA, 22 nt, Pseudomonas aeruginosa PA01
uccacgccauaggcggcgcaga

SEQ ID NO: 1411682 - RNA, 17 nt, Pseudomonas aeruginosa PA01
ucaaccacuccagcggg

SEQ ID NO: 1411683 - RNA, 18 nt, Pseudomonas aeruginosa PA01
ucaacgccuggccacgcc

SEQ ID NO: 1411684 - RNA, 16 nt, Pseudomonas aeruginosa PA01
ucaacgcggccagcag

SEQ ID NO: 1411685 - RNA, 14 nt, Pseudomonas aeruginosa PA01
ucaacggcgaccgc

SEQ ID NO: 1411686 - RNA, 23 nt, Pseudomonas aeruginosa PA01
ucaacggcgauuccacgggccug

SEQ ID NO: 1411687 - RNA, 22 nt, Pseudomonas aeruginosa PA01
ucaacggugacguuggccgggg

SEQ ID NO: 1411688 - RNA, 14 nt, Pseudomonas aeruginosa PA01
ucaacgucggcguc

SEQ ID NO: 1411689 - RNA, 12 nt, Pseudomonas aeruginosa PA01
ucacaugguggg

SEQ ID NO: 1411690 - RNA, 18 nt, Pseudomonas aeruginosa PA01
ucacauggugggcgccgc

SEQ ID NO: 1411691 - RNA, 20 nt, Pseudomonas aeruginosa PA01
ucacauggugggcgccgcug

SEQ ID NO: 1411692 - RNA, 14 nt, Pseudomonas aeruginosa PA01
ucacaugcaccagg

SEQ ID NO: 1411693 - RNA, 18 nt, Pseudomonas aeruginosa PA01
ucacaccgaagucgcccg

SEQ ID NO: 1411694 - RNA, 18 nt, Pseudomonas aeruginosa PA01
ucacaucguugaacucgc

SEQ ID NO: 1411695 - RNA, 22 nt, Pseudomonas aeruginosa PA01
ucacauacaccuugcgacaggc

SEQ ID NO: 1411696 - RNA, 17 nt, Pseudomonas aeruginosa PA01
ucaccaggaucgccggg

SEQ ID NO: 1411697 - RNA, 16 nt, Pseudomonas aeruginosa PA01
ucaccaggcccgccgg

SEQ ID NO: 1411698 - RNA, 17 nt, Pseudomonas aeruginosa PA01
ucaccaggcugccgccg

SEQ ID NO: 1411699 - RNA, 18 nt, Pseudomonas aeruginosa PA01
ucaccaggcugccgccgu

SEQ ID NO: 1411700 - RNA, 19 nt, Pseudomonas aeruginosa PA01
ucaccagggucacgccgcg

SEQ ID NO: 1411701 - RNA, 21 nt, Pseudomonas aeruginosa PA01
ucaccagggucacgccgcggc

SEQ ID NO: 1411702 - RNA, 15 nt, Pseudomonas aeruginosa PA01
ucaccagggucgcca

SEQ ID NO: 1411703 - RNA, 17 nt, Pseudomonas aeruginosa PA01
ucaccagggucgccagg

SEQ ID NO: 1411704 - RNA, 20 nt, Pseudomonas aeruginosa PA01
ucaccagggucggcaccugc

SEQ ID NO: 1411705 - RNA, 23 nt, Pseudomonas aeruginosa PA01
ucaccagggucggcaccugcaga

SEQ ID NO: 1411706 - RNA, 12 nt, Pseudomonas aeruginosa PA01
ucaccagcagcc

SEQ ID NO: 1411707 - RNA, 19 nt, Pseudomonas aeruginosa PA01
ucaccagcaauugccggcg

SEQ ID NO: 1411708 - RNA, 12 nt, Pseudomonas aeruginosa PA01
ucaccagcgccg

SEQ ID NO: 1411709 - RNA, 14 nt, Pseudomonas aeruginosa PA01
ucaccagcgccggg

SEQ ID NO: 1411710 - RNA, 16 nt, Pseudomonas aeruginosa PA01
ucaccagcgcugccuc

SEQ ID NO: 1411711 - RNA, 17 nt, Pseudomonas aeruginosa PA01
ucaccagguugcccggc

SEQ ID NO: 1411712 - RNA, 20 nt, Pseudomonas aeruginosa PA01
ucaccagguugcccggcuug

SEQ ID NO: 1411713 - RNA, 19 nt, Pseudomonas aeruginosa PA01
ucaccagguugugaucgac

SEQ ID NO: 1411714 - RNA, 20 nt, Pseudomonas aeruginosa PA01
ucaccagguugugaucgacc

SEQ ID NO: 1411715 - RNA, 12 nt, Pseudomonas aeruginosa PA01
ucaccaccggcu

SEQ ID NO: 1411716 - RNA, 17 nt, Pseudomonas aeruginosa PA01
ucaccacguugcgccgc

SEQ ID NO: 1411717 - RNA, 16 nt, Pseudomonas aeruginosa PA01
ucaccacucgccagcg

SEQ ID NO: 1411718 - RNA, 21 nt, Pseudomonas aeruginosa PA01
ucaccacgcgauauccgccag

SEQ ID NO: 1411719 - RNA, 15 nt, Pseudomonas aeruginosa PA01
ucaccacccagccgc

SEQ ID NO: 1411720 - RNA, 15 nt, Pseudomonas aeruginosa PA01
ucaccaccacgccgu

SEQ ID NO: 1411721 - RNA, 17 nt, Pseudomonas aeruginosa PA01
ucaccaccacgccgucg

SEQ ID NO: 1411722 - RNA, 14 nt, Pseudomonas aeruginosa PA01
ucacgacaggcggc

SEQ ID NO: 1411723 - RNA, 16 nt, Pseudomonas aeruginosa PA01
ucacgacaggcggcgg

SEQ ID NO: 1411724 - RNA, 16 nt, Pseudomonas aeruginosa PA01
ucacgaacagcuugcc

SEQ ID NO: 1411725 - RNA, 12 nt, Pseudomonas aeruginosa PA01
ucacgaagcggu

SEQ ID NO: 1411726 - RNA, 19 nt, Pseudomonas aeruginosa PA01
ucacgaagcggucgccggc

SEQ ID NO: 1411727 - RNA, 12 nt, Pseudomonas aeruginosa PA01
ucaccuugucgu

SEQ ID NO: 1411728 - RNA, 13 nt, Pseudomonas aeruginosa PA01
ucaccuugucguu

SEQ ID NO: 1411729 - RNA, 20 nt, Pseudomonas aeruginosa PA01
ucaccguucuugaucaccgc

SEQ ID NO: 1411730 - RNA, 23 nt, Pseudomonas aeruginosa PA01
ucaccguucuugaucaccgcggu

SEQ ID NO: 1411731 - RNA, 16 nt, Pseudomonas aeruginosa PA01
ucaccguggagagguc

SEQ ID NO: 1411732 - RNA, 22 nt, Pseudomonas aeruginosa PA01
ucaccguggagaggucgccgac

SEQ ID NO: 1411733 - RNA, 19 nt, Pseudomonas aeruginosa PA01
ucaccguggucauggcgca

SEQ ID NO: 1411734 - RNA, 16 nt, Pseudomonas aeruginosa PA01
ucaccggcuggcccuc

SEQ ID NO: 1411735 - RNA, 13 nt, Pseudomonas aeruginosa PA01
ucaccggcagggc

SEQ ID NO: 1411736 - RNA, 23 nt, Pseudomonas aeruginosa PA01
ucaccggcaggaucggcgcgguc

SEQ ID NO: 1411737 - RNA, 11 nt, Pseudomonas aeruginosa PA01
ucaccggcgga

SEQ ID NO: 1411738 - RNA, 18 nt, Pseudomonas aeruginosa PA01
ucacccgcgaggccggcc

SEQ ID NO: 1411739 - RNA, 12 nt, Pseudomonas aeruginosa PA01
ucacccgcccgc

SEQ ID NO: 1411740 - RNA, 17 nt, Pseudomonas aeruginosa PA01
ucacccgcccgccgucg

SEQ ID NO: 1411741 - RNA, 14 nt, Pseudomonas aeruginosa PA01
ucacccgcagcggc

SEQ ID NO: 1411742 - RNA, 19 nt, Pseudomonas aeruginosa PA01
ucacccauucgaugccgcg

SEQ ID NO: 1411743 - RNA, 22 nt, Pseudomonas aeruginosa PA01
ucacccauucgaugccgcgcgc

SEQ ID NO: 1411744 - RNA, 15 nt, Pseudomonas aeruginosa PA01
ucacccccagcgagc

SEQ ID NO: 1411745 - RNA, 16 nt, Pseudomonas aeruginosa PA01
ucaccccgcaaccgca

SEQ ID NO: 1411746 - RNA, 15 nt, Pseudomonas aeruginosa PA01
ucaccgcgccgaagg

SEQ ID NO: 1411747 - RNA, 13 nt, Pseudomonas aeruginosa PA01
ucaccgcgccgcg

SEQ ID NO: 1411748 - RNA, 12 nt, Pseudomonas aeruginosa PA01
ucaccgcgccgg

SEQ ID NO: 1411749 - RNA, 20 nt, Pseudomonas aeruginosa PA01
ucaccgcgcaaaccggcagc

SEQ ID NO: 1411750 - RNA, 22 nt, Pseudomonas aeruginosa PA01
ucaccgccuuggcaucgccgcc

SEQ ID NO: 1411751 - RNA, 14 nt, Pseudomonas aeruginosa PA01
ucaccgccaucagc

SEQ ID NO: 1411752 - RNA, 19 nt, Pseudomonas aeruginosa PA01
ucacccuggcaccgauggc

SEQ ID NO: 1411753 - RNA, 16 nt, Pseudomonas aeruginosa PA01
ucacccugcugggcgg

SEQ ID NO: 1411754 - RNA, 22 nt, Pseudomonas aeruginosa PA01
ucagcacgcccaguugcgccgc

SEQ ID NO: 1411755 - RNA, 14 nt, Pseudomonas aeruginosa PA01
ucagcacggcgcgg

SEQ ID NO: 1411756 - RNA, 16 nt, Pseudomonas aeruginosa PA01
ucagcaccgccaccag

SEQ ID NO: 1411757 - RNA, 13 nt, Pseudomonas aeruginosa PA01
ucagcagcgggcg

SEQ ID NO: 1411758 - RNA, 16 nt, Pseudomonas aeruginosa PA01
ucagcagcgggcgucc

SEQ ID NO: 1411759 - RNA, 20 nt, Pseudomonas aeruginosa PA01
ucagcagcgggcguccggcg

SEQ ID NO: 1411760 - RNA, 22 nt, Pseudomonas aeruginosa PA01
ucagcagcgggcguccggcgag

SEQ ID NO: 1411761 - RNA, 14 nt, Pseudomonas aeruginosa PA01
ucagcagcggcacc

SEQ ID NO: 1411762 - RNA, 19 nt, Pseudomonas aeruginosa PA01
ucagcagcaugucgccggg

SEQ ID NO: 1411763 - RNA, 16 nt, Pseudomonas aeruginosa PA01
ucagcagcgccacgcu

SEQ ID NO: 1411764 - RNA, 17 nt, Pseudomonas aeruginosa PA01
ucagcagcgccgcccug

SEQ ID NO: 1411765 - RNA, 18 nt, Pseudomonas aeruginosa PA01
ucagcagcgccgcccugu

SEQ ID NO: 1411766 - RNA, 18 nt, Pseudomonas aeruginosa PA01
ucagcagcaccgcgagca

SEQ ID NO: 1411767 - RNA, 17 nt, Pseudomonas aeruginosa PA01
ucagcagcaccgcgcgc

SEQ ID NO: 1411768 - RNA, 16 nt, Pseudomonas aeruginosa PA01
ucagcagugcggggcg

SEQ ID NO: 1411769 - RNA, 18 nt, Pseudomonas aeruginosa PA01
ucagcaggucgcggcccc

SEQ ID NO: 1411770 - RNA, 19 nt, Pseudomonas aeruginosa PA01
ucagcaggucgcggugcag

SEQ ID NO: 1411771 - RNA, 20 nt, Pseudomonas aeruginosa PA01
ucagcaggccgaggucggcg

SEQ ID NO: 1411772 - RNA, 23 nt, Pseudomonas aeruginosa PA01
ucagcaggccgaggucggcggcg

SEQ ID NO: 1411773 - RNA, 19 nt, Pseudomonas aeruginosa PA01
ucagcccuucgcgcucgac

SEQ ID NO: 1411774 - RNA, 20 nt, Pseudomonas aeruginosa PA01
ucagcccuucgcgcucgacg

SEQ ID NO: 1411775 - RNA, 20 nt, Pseudomonas aeruginosa PA01
ucagccgagguucuugccca

SEQ ID NO: 1411776 - RNA, 22 nt, Pseudomonas aeruginosa PA01
ucagccgaugcucgcgccagcc

SEQ ID NO: 1411777 - RNA, 21 nt, Pseudomonas aeruginosa PA01
ucagccgaccguccgccugcg

SEQ ID NO: 1411778 - RNA, 15 nt, Pseudomonas aeruginosa PA01
ucagccgcaggcaga

SEQ ID NO: 1411779 - RNA, 14 nt, Pseudomonas aeruginosa PA01
ucagccgcaggccg

SEQ ID NO: 1411780 - RNA, 15 nt, Pseudomonas aeruginosa PA01
ucagccgcaggccgu

SEQ ID NO: 1411781 - RNA, 20 nt, Pseudomonas aeruginosa PA01
ucagccgcgacgacugcggc

SEQ ID NO: 1411782 - RNA, 16 nt, Pseudomonas aeruginosa PA01
ucagccgcgacucggc

SEQ ID NO: 1411783 - RNA, 14 nt, Pseudomonas aeruginosa PA01
ucagcggcgcagcc

SEQ ID NO: 1411784 - RNA, 18 nt, Pseudomonas aeruginosa PA01
ucagcggcgcagccucgc

SEQ ID NO: 1411785 - RNA, 20 nt, Pseudomonas aeruginosa PA01
ucagcggcccagcgccccgc

SEQ ID NO: 1411786 - RNA, 16 nt, Pseudomonas aeruginosa PA01
ucagcggcccgagcag

SEQ ID NO: 1411787 - RNA, 17 nt, Pseudomonas aeruginosa PA01
ucagcggcccgagcagg

SEQ ID NO: 1411788 - RNA, 13 nt, Pseudomonas aeruginosa PA01
ucagcgcggccac

SEQ ID NO: 1411789 - RNA, 23 nt, Pseudomonas aeruginosa PA01
ucagcgcggccacuucguccggc

SEQ ID NO: 1411790 - RNA, 14 nt, Pseudomonas aeruginosa PA01
ucagcgcgcucggc

SEQ ID NO: 1411791 - RNA, 15 nt, Pseudomonas aeruginosa PA01
ucagcgccgccucgc

SEQ ID NO: 1411792 - RNA, 21 nt, Pseudomonas aeruginosa PA01
ucagcgccgccucgcugggcg

SEQ ID NO: 1411793 - RNA, 13 nt, Pseudomonas aeruginosa PA01
ucagcgccgcucg

SEQ ID NO: 1411794 - RNA, 14 nt, Pseudomonas aeruginosa PA01
ucagcgcccggcac

SEQ ID NO: 1411795 - RNA, 16 nt, Pseudomonas aeruginosa PA01
ucagcgcaugcggaag

SEQ ID NO: 1411796 - RNA, 20 nt, Pseudomonas aeruginosa PA01
ucagcgccagcaacccgccc

SEQ ID NO: 1411797 - RNA, 15 nt, Pseudomonas aeruginosa PA01
ucagcgccaggccga

SEQ ID NO: 1411798 - RNA, 20 nt, Pseudomonas aeruginosa PA01
ucagccggcccauccgccgc

SEQ ID NO: 1411799 - RNA, 15 nt, Pseudomonas aeruginosa PA01
ucagccggccgaucu

SEQ ID NO: 1411800 - RNA, 12 nt, Pseudomonas aeruginosa PA01
ucagccgcgcgc

SEQ ID NO: 1411801 - RNA, 13 nt, Pseudomonas aeruginosa PA01
ucagccgcuggcg

SEQ ID NO: 1411802 - RNA, 16 nt, Pseudomonas aeruginosa PA01
ucagccgcuggcgucg

SEQ ID NO: 1411803 - RNA, 14 nt, Pseudomonas aeruginosa PA01
ucagacgcaccgag

SEQ ID NO: 1411804 - RNA, 17 nt, Pseudomonas aeruginosa PA01
ucagaccagcccuggcg

SEQ ID NO: 1411805 - RNA, 21 nt, Pseudomonas aeruginosa PA01
ucagaccagcccuggcgcggc

SEQ ID NO: 1411806 - RNA, 22 nt, Pseudomonas aeruginosa PA01
ucacugcgagcaccaugccgau

SEQ ID NO: 1411807 - RNA, 16 nt, Pseudomonas aeruginosa PA01
ucagcacauggaucgg

SEQ ID NO: 1411808 - RNA, 19 nt, Pseudomonas aeruginosa PA01
ucagcaccagcggaccguc

SEQ ID NO: 1411809 - RNA, 20 nt, Pseudomonas aeruginosa PA01
ucagcaccagggccagggcg

SEQ ID NO: 1411810 - RNA, 15 nt, Pseudomonas aeruginosa PA01
ucacguagcccccgc

SEQ ID NO: 1411811 - RNA, 18 nt, Pseudomonas aeruginosa PA01
ucacguagcccccgccgc

SEQ ID NO: 1411812 - RNA, 18 nt, Pseudomonas aeruginosa PA01
ucacguaggagccggcca

SEQ ID NO: 1411813 - RNA, 14 nt, Pseudomonas aeruginosa PA01
ucacguaguucugg

SEQ ID NO: 1411814 - RNA, 22 nt, Pseudomonas aeruginosa PA01
ucacggugaugguaucgccguc

SEQ ID NO: 1411815 - RNA, 20 nt, Pseudomonas aeruginosa PA01
ucacggugccauccgcaguc

SEQ ID NO: 1411816 - RNA, 17 nt, Pseudomonas aeruginosa PA01
ucacggucuuggcggcg

SEQ ID NO: 1411817 - RNA, 18 nt, Pseudomonas aeruginosa PA01
ucacggucuuggcggcga

SEQ ID NO: 1411818 - RNA, 20 nt, Pseudomonas aeruginosa PA01
ucacggucuuggcggcgauc

SEQ ID NO: 1411819 - RNA, 21 nt, Pseudomonas aeruginosa PA01
ucacggucuuggcggcgaucg

SEQ ID NO: 1411820 - RNA, 23 nt, Pseudomonas aeruginosa PA01
ucacggucuuggcggcgaucgcc

SEQ ID NO: 1411821 - RNA, 21 nt, Pseudomonas aeruginosa PA01
ucacggugaggaccuggccgc

SEQ ID NO: 1411822 - RNA, 12 nt, Pseudomonas aeruginosa PA01
ucacucgccgcc

SEQ ID NO: 1411823 - RNA, 20 nt, Pseudomonas aeruginosa PA01
ucacucccaggcuggcggca

SEQ ID NO: 1411824 - RNA, 15 nt, Pseudomonas aeruginosa PA01
ucacgucggcgucca

SEQ ID NO: 1411825 - RNA, 13 nt, Pseudomonas aeruginosa PA01
ucacgucgcgcac

SEQ ID NO: 1411826 - RNA, 14 nt, Pseudomonas aeruginosa PA01
ucacgucgcgcacc

SEQ ID NO: 1411827 - RNA, 21 nt, Pseudomonas aeruginosa PA01
ucacgucgcgcaccuggcggu

SEQ ID NO: 1411828 - RNA, 20 nt, Pseudomonas aeruginosa PA01
ucacgccccagcgcaucgcg

SEQ ID NO: 1411829 - RNA, 23 nt, Pseudomonas aeruginosa PA01
ucacgccgaaggugaaguccggc

SEQ ID NO: 1411830 - RNA, 18 nt, Pseudomonas aeruginosa PA01
ucacgccgagggcgcggc

SEQ ID NO: 1411831 - RNA, 21 nt, Pseudomonas aeruginosa PA01
ucacgccgaucccggcggcga

SEQ ID NO: 1411832 - RNA, 22 nt, Pseudomonas aeruginosa PA01
ucacgccgaucccggcggcgac

SEQ ID NO: 1411833 - RNA, 14 nt, Pseudomonas aeruginosa PA01
ucacgccggugaug

SEQ ID NO: 1411834 - RNA, 19 nt, Pseudomonas aeruginosa PA01
ucacgccgggaauccccag

SEQ ID NO: 1411835 - RNA, 14 nt, Pseudomonas aeruginosa PA01
gugaucaggcuguc

SEQ ID NO: 1411836 - RNA, 14 nt, Pseudomonas aeruginosa PA01
gugaucccgcgcgg

SEQ ID NO: 1411837 - RNA, 19 nt, Pseudomonas aeruginosa PA01
gugaucccgcgcgggccga

SEQ ID NO: 1411838 - RNA, 15 nt, Pseudomonas aeruginosa PA01
gugauccagcuggcg

SEQ ID NO: 1411839 - RNA, 20 nt, Pseudomonas aeruginosa PA01
gugauccaggucgaucagca

SEQ ID NO: 1411840 - RNA, 14 nt, Pseudomonas aeruginosa PA01
gugauccugcuggu

SEQ ID NO: 1411841 - RNA, 19 nt, Pseudomonas aeruginosa PA01
gugaucgaaaaaaggcgcc

SEQ ID NO: 1411842 - RNA, 14 nt, Pseudomonas aeruginosa PA01
gugaucgagccgcc

SEQ ID NO: 1411843 - RNA, 13 nt, Pseudomonas aeruginosa PA01
gugaucgaccaca

SEQ ID NO: 1411844 - RNA, 15 nt, Pseudomonas aeruginosa PA01
gugaucgaccucgcg

SEQ ID NO: 1411845 - RNA, 20 nt, Pseudomonas aeruginosa PA01
gugaucgaccucgcgggcga

SEQ ID NO: 1411846 - RNA, 13 nt, Pseudomonas aeruginosa PA01
gugaucgccgcga

SEQ ID NO: 1411847 - RNA, 15 nt, Pseudomonas aeruginosa PA01
gucggcguccgccuc

SEQ ID NO: 1411848 - RNA, 22 nt, Pseudomonas aeruginosa PA01
gucggcgucggcugcgcugggc

SEQ ID NO: 1411849 - RNA, 14 nt, Pseudomonas aeruginosa PA01
gucggcggcacgcu

SEQ ID NO: 1411850 - RNA, 12 nt, Pseudomonas aeruginosa PA01
gucggcggcagc

SEQ ID NO: 1411851 - RNA, 20 nt, Pseudomonas aeruginosa PA01
gucggcggcagcugcggcgg

SEQ ID NO: 1411852 - RNA, 13 nt, Pseudomonas aeruginosa PA01
gucggcggccgcc

SEQ ID NO: 1411853 - RNA, 21 nt, Pseudomonas aeruginosa PA01
gucggcguagcgcagggucgc

SEQ ID NO: 1411854 - RNA, 14 nt, Pseudomonas aeruginosa PA01
gucggcguccaugg

SEQ ID NO: 1411855 - RNA, 18 nt, Pseudomonas aeruginosa PA01
gucggcguccauggcggc

SEQ ID NO: 1411856 - RNA, 13 nt, Pseudomonas aeruginosa PA01
gugaucacaccga

SEQ ID NO: 1411857 - RNA, 14 nt, Pseudomonas aeruginosa PA01
gugaucaccagcca

SEQ ID NO: 1411858 - RNA, 22 nt, Pseudomonas aeruginosa PA01
gugaucaccuuguacggcagcg

SEQ ID NO: 1411859 - RNA, 22 nt, Pseudomonas aeruginosa PA01
gucggcgucuuccggcucgccg

SEQ ID NO: 1411860 - RNA, 23 nt, Pseudomonas aeruginosa PA01
gucggcgucuuccggcucgccgc

SEQ ID NO: 1411861 - RNA, 18 nt, Pseudomonas aeruginosa PA01
gugaucuguucgaccagu

SEQ ID NO: 1411862 - RNA, 20 nt, Pseudomonas aeruginosa PA01
gugaucuugaucugcaugcc

SEQ ID NO: 1411863 - RNA, 21 nt, Pseudomonas aeruginosa PA01
gugaucuggaaauucagcgcu

SEQ ID NO: 1411864 - RNA, 18 nt, Pseudomonas aeruginosa PA01
gugaugccgcggacggca

SEQ ID NO: 1411865 - RNA, 18 nt, Pseudomonas aeruginosa PA01
gugaugcccagcggcgcc

SEQ ID NO: 1411866 - RNA, 15 nt, Pseudomonas aeruginosa PA01
gugaugaccccggcg

SEQ ID NO: 1411867 - RNA, 16 nt, Pseudomonas aeruginosa PA01
gugauguugcggucga

SEQ ID NO: 1411868 - RNA, 19 nt, Pseudomonas aeruginosa PA01
gugauguugcggucgaugu

SEQ ID NO: 1411869 - RNA, 13 nt, Pseudomonas aeruginosa PA01
gugauggcgaucg

SEQ ID NO: 1411870 - RNA, 21 nt, Pseudomonas aeruginosa PA01
gugauguaagacuggugaucg

SEQ ID NO: 1411871 - RNA, 17 nt, Pseudomonas aeruginosa PA01
gugcacggucugcucgg

SEQ ID NO: 1411872 - RNA, 14 nt, Pseudomonas aeruginosa PA01
gugcacgccgugca

SEQ ID NO: 1411873 - RNA, 23 nt, Pseudomonas aeruginosa PA01
gugcacgccgugcaucaccggca

SEQ ID NO: 1411874 - RNA, 13 nt, Pseudomonas aeruginosa PA01
gugcacggccagg

SEQ ID NO: 1411875 - RNA, 18 nt, Pseudomonas aeruginosa PA01
gugcacggccaggccacg

SEQ ID NO: 1411876 - RNA, 12 nt, Pseudomonas aeruginosa PA01
gugcacgcgccg

SEQ ID NO: 1411877 - RNA, 17 nt, Pseudomonas aeruginosa PA01
gugcacgcgccgggucg

SEQ ID NO: 1411878 - RNA, 18 nt, Pseudomonas aeruginosa PA01
gugcacgcgccgggucgg

SEQ ID NO: 1411879 - RNA, 15 nt, Pseudomonas aeruginosa PA01
gugcacgccgauggc

SEQ ID NO: 1411880 - RNA, 16 nt, Pseudomonas aeruginosa PA01
gugcacgccgauggcg

SEQ ID NO: 1411881 - RNA, 16 nt, Pseudomonas aeruginosa PA01
gugcaacaccuggcgc

SEQ ID NO: 1411882 - RNA, 19 nt, Pseudomonas aeruginosa PA01
gugcaacaccuggcgcucg

SEQ ID NO: 1411883 - RNA, 18 nt, Pseudomonas aeruginosa PA01
gugcagcaagccgcagcg

SEQ ID NO: 1411884 - RNA, 23 nt, Pseudomonas aeruginosa PA01
gugcagcaggguaccgcuggcgc

SEQ ID NO: 1411885 - RNA, 14 nt, Pseudomonas aeruginosa PA01
gugcagcagcgccu

SEQ ID NO: 1411886 - RNA, 17 nt, Pseudomonas aeruginosa PA01
gugcagcagcacggugu

SEQ ID NO: 1411887 - RNA, 18 nt, Pseudomonas aeruginosa PA01
gugcagagaggcuggcgc

SEQ ID NO: 1411888 - RNA, 18 nt, Pseudomonas aeruginosa PA01
gugcacguuccagcucgg

SEQ ID NO: 1411889 - RNA, 21 nt, Pseudomonas aeruginosa PA01
gugcacguuccagcucggugc

SEQ ID NO: 1411890 - RNA, 15 nt, Pseudomonas aeruginosa PA01
gugcagaagacgccc

SEQ ID NO: 1411891 - RNA, 16 nt, Pseudomonas aeruginosa PA01
gugcagaagacgccca

SEQ ID NO: 1411892 - RNA, 16 nt, Pseudomonas aeruginosa PA01
gugccagaaaaucgac

SEQ ID NO: 1411893 - RNA, 18 nt, Pseudomonas aeruginosa PA01
gugccagaaaaucgacaa

SEQ ID NO: 1411894 - RNA, 21 nt, Pseudomonas aeruginosa PA01
gugcccauuuuccaacuccac

SEQ ID NO: 1411895 - RNA, 13 nt, Pseudomonas aeruginosa PA01
gugcccagcggcg

SEQ ID NO: 1411896 - RNA, 16 nt, Pseudomonas aeruginosa PA01
gugcccaggcgcuggc

SEQ ID NO: 1411897 - RNA, 12 nt, Pseudomonas aeruginosa PA01
gugccccaggca

SEQ ID NO: 1411898 - RNA, 16 nt, Pseudomonas aeruginosa PA01
gugccccaggcacggc

SEQ ID NO: 1411899 - RNA, 17 nt, Pseudomonas aeruginosa PA01
gugccccaggcacggcu

SEQ ID NO: 1411900 - RNA, 14 nt, Pseudomonas aeruginosa PA01
gugccccaggccga

SEQ ID NO: 1411901 - RNA, 21 nt, Pseudomonas aeruginosa PA01
gugccccgcuggcccaacagc

SEQ ID NO: 1411902 - RNA, 12 nt, Pseudomonas aeruginosa PA01
gugccccgcugg

SEQ ID NO: 1411903 - RNA, 17 nt, Pseudomonas aeruginosa PA01
gugcagggucaggucgu

SEQ ID NO: 1411904 - RNA, 18 nt, Pseudomonas aeruginosa PA01
gugcagguacggcgccgc

SEQ ID NO: 1411905 - RNA, 18 nt, Pseudomonas aeruginosa PA01
gugcagguagcagccguc

SEQ ID NO: 1411906 - RNA, 20 nt, Pseudomonas aeruginosa PA01
gugcagguagcagccgucca

SEQ ID NO: 1411907 - RNA, 19 nt, Pseudomonas aeruginosa PA01
gugcagguagccgcgccgg

SEQ ID NO: 1411908 - RNA, 20 nt, Pseudomonas aeruginosa PA01
gugcagguagccgcgccggc

SEQ ID NO: 1411909 - RNA, 18 nt, Pseudomonas aeruginosa PA01
gugcaggucgcgcggcgc

SEQ ID NO: 1411910 - RNA, 21 nt, Pseudomonas aeruginosa PA01
gugcaggcgcccuggccgucg

SEQ ID NO: 1411911 - RNA, 14 nt, Pseudomonas aeruginosa PA01
gugcaggggcgcag

SEQ ID NO: 1411912 - RNA, 14 nt, Pseudomonas aeruginosa PA01
gugcagguguucgg

SEQ ID NO: 1411913 - RNA, 23 nt, Pseudomonas aeruginosa PA01
gugcagguguucggcggcgugca

SEQ ID NO: 1411914 - RNA, 18 nt, Pseudomonas aeruginosa PA01
gugcagguucaccgccuc

SEQ ID NO: 1411915 - RNA, 18 nt, Pseudomonas aeruginosa PA01
gugcaguacuuggccagc

SEQ ID NO: 1411916 - RNA, 21 nt, Pseudomonas aeruginosa PA01
gugcaguacuuggccagcagc

SEQ ID NO: 1411917 - RNA, 22 nt, Pseudomonas aeruginosa PA01
gugcaguucgaccuccaggccg

SEQ ID NO: 1411918 - RNA, 16 nt, Pseudomonas aeruginosa PA01
gugcaucagccuggcc

SEQ ID NO: 1411919 - RNA, 18 nt, Pseudomonas aeruginosa PA01
gugcaucagccuggccag

SEQ ID NO: 1411920 - RNA, 14 nt, Pseudomonas aeruginosa PA01
aagugggucgccgu

SEQ ID NO: 1411921 - RNA, 14 nt, Pseudomonas aeruginosa PA01
gugccucccggcca

SEQ ID NO: 1411922 - RNA, 17 nt, Pseudomonas aeruginosa PA01
aagugcagggcguccag

SEQ ID NO: 1411923 - RNA, 12 nt, Pseudomonas aeruginosa PA01
gugccggcggcg

SEQ ID NO: 1411924 - RNA, 14 nt, Pseudomonas aeruginosa PA01
gugccgggaagcgc

SEQ ID NO: 1411925 - RNA, 15 nt, Pseudomonas aeruginosa PA01
gugccguuccagcgg

SEQ ID NO: 1411926 - RNA, 17 nt, Pseudomonas aeruginosa PA01
gugccguuccagcggca

SEQ ID NO: 1411927 - RNA, 15 nt, Pseudomonas aeruginosa PA01
gugccguggcucggc

SEQ ID NO: 1411928 - RNA, 19 nt, Pseudomonas aeruginosa PA01
gugccguggcucggcggca

SEQ ID NO: 1411929 - RNA, 16 nt, Pseudomonas aeruginosa PA01
gugccguggaccaaca

SEQ ID NO: 1411930 - RNA, 17 nt, Pseudomonas aeruginosa PA01
gugccguugcuaccggc

SEQ ID NO: 1411931 - RNA, 23 nt, Pseudomonas aeruginosa PA01
gugccuggaaguauucggcggga

SEQ ID NO: 1411932 - RNA, 14 nt, Pseudomonas aeruginosa PA01
gugccugagcuggc

SEQ ID NO: 1411933 - RNA, 15 nt, Pseudomonas aeruginosa PA01
gugccugcaccacgc

SEQ ID NO: 1411934 - RNA, 18 nt, Pseudomonas aeruginosa PA01
gugccccguggcgggcca

SEQ ID NO: 1411935 - RNA, 21 nt, Pseudomonas aeruginosa PA01
gugcccucgcggacgcuggcg

SEQ ID NO: 1411936 - RNA, 22 nt, Pseudomonas aeruginosa PA01
gugcccucgcggacgcuggcga

SEQ ID NO: 1411937 - RNA, 16 nt, Pseudomonas aeruginosa PA01
gugcccgaugccgcgc

SEQ ID NO: 1411938 - RNA, 15 nt, Pseudomonas aeruginosa PA01
gugcccuggcagacg

SEQ ID NO: 1411939 - RNA, 19 nt, Pseudomonas aeruginosa PA01
gugcccuggcagacgcugc

SEQ ID NO: 1411940 - RNA, 13 nt, Pseudomonas aeruginosa PA01
gugcccugggcgg

SEQ ID NO: 1411941 - RNA, 22 nt, Pseudomonas aeruginosa PA01
gugcccuugaugaucaggucgg

SEQ ID NO: 1411942 - RNA, 19 nt, Pseudomonas aeruginosa PA01
gugccgaccuucaccacca

SEQ ID NO: 1411943 - RNA, 21 nt, Pseudomonas aeruginosa PA01
gugccgaccuucaccaccagc

SEQ ID NO: 1411944 - RNA, 13 nt, Pseudomonas aeruginosa PA01
gugccgcggugcg

SEQ ID NO: 1411945 - RNA, 14 nt, Pseudomonas aeruginosa PA01
gugccgcuggccga

SEQ ID NO: 1411946 - RNA, 20 nt, Pseudomonas aeruginosa PA01
gugccggccaugcaggccag

SEQ ID NO: 1411947 - RNA, 19 nt, Pseudomonas aeruginosa PA01
gugccggagaacgccgcca

SEQ ID NO: 1411948 - RNA, 17 nt, Pseudomonas aeruginosa PA01
gugcgcgguccgcgugg

SEQ ID NO: 1411949 - RNA, 18 nt, Pseudomonas aeruginosa PA01
gugcgcgcccucggugau

SEQ ID NO: 1411950 - RNA, 16 nt, Pseudomonas aeruginosa PA01
gugcgcuccgccaggc

SEQ ID NO: 1411951 - RNA, 19 nt, Pseudomonas aeruginosa PA01
gugcgcuccgccaggccgc

SEQ ID NO: 1411952 - RNA, 22 nt, Pseudomonas aeruginosa PA01
gugcgcuccuguugcuggccgg

SEQ ID NO: 1411953 - RNA, 22 nt, Pseudomonas aeruginosa PA01
gugcgcucguugauccgcgugg

SEQ ID NO: 1411954 - RNA, 21 nt, Pseudomonas aeruginosa PA01
gugcgcugguaccugccggca

SEQ ID NO: 1411955 - RNA, 14 nt, Pseudomonas aeruginosa PA01
gugcggggcgcucg

SEQ ID NO: 1411956 - RNA, 13 nt, Pseudomonas aeruginosa PA01
gugcgccguagca

SEQ ID NO: 1411957 - RNA, 14 nt, Pseudomonas aeruginosa PA01
gugcgccggcggga

SEQ ID NO: 1411958 - RNA, 18 nt, Pseudomonas aeruginosa PA01
gugcgccggcgggaucga

SEQ ID NO: 1411959 - RNA, 14 nt, Pseudomonas aeruginosa PA01
gugcgcgccaccug

SEQ ID NO: 1411960 - RNA, 21 nt, Pseudomonas aeruginosa PA01
gugcgcgcaacuggucgcggc

SEQ ID NO: 1411961 - RNA, 17 nt, Pseudomonas aeruginosa PA01
gugcgcgccgccgggcg

SEQ ID NO: 1411962 - RNA, 21 nt, Pseudomonas aeruginosa PA01
gugcgcgccgccgggcgcccg

SEQ ID NO: 1411963 - RNA, 22 nt, Pseudomonas aeruginosa PA01
gugcgcgcgcagauaaggcgug

SEQ ID NO: 1411964 - RNA, 16 nt, Pseudomonas aeruginosa PA01
gugcgcaggcuggccg

SEQ ID NO: 1411965 - RNA, 13 nt, Pseudomonas aeruginosa PA01
gugcgcaggcgcu

SEQ ID NO: 1411966 - RNA, 14 nt, Pseudomonas aeruginosa PA01
gugcgcaggcgcuc

SEQ ID NO: 1411967 - RNA, 21 nt, Pseudomonas aeruginosa PA01
gugcgcacgcaauggcgcagc

SEQ ID NO: 1411968 - RNA, 22 nt, Pseudomonas aeruginosa PA01
gugcgccgcgggucaccagcgc

SEQ ID NO: 1411969 - RNA, 23 nt, Pseudomonas aeruginosa PA01
gugcgccgcgggucaccagcgcc

SEQ ID NO: 1411970 - RNA, 12 nt, Pseudomonas aeruginosa PA01
gugcgccgcucg

SEQ ID NO: 1411971 - RNA, 15 nt, Pseudomonas aeruginosa PA01
gugcgcaugcccgcg

SEQ ID NO: 1411972 - RNA, 20 nt, Pseudomonas aeruginosa PA01
gugcugaccuucacuucgcg

SEQ ID NO: 1411973 - RNA, 13 nt, Pseudomonas aeruginosa PA01
gugcugcaccagc

SEQ ID NO: 1411974 - RNA, 14 nt, Pseudomonas aeruginosa PA01
gugcugcaccagca

SEQ ID NO: 1411975 - RNA, 17 nt, Pseudomonas aeruginosa PA01
gugcugcaccagcaggu

SEQ ID NO: 1411976 - RNA, 13 nt, Pseudomonas aeruginosa PA01
gugcucaggcggc

SEQ ID NO: 1411977 - RNA, 16 nt, Pseudomonas aeruginosa PA01
gugcucaggcggccga

SEQ ID NO: 1411978 - RNA, 20 nt, Pseudomonas aeruginosa PA01
gugcucagcgauucccgagg

SEQ ID NO: 1411979 - RNA, 22 nt, Pseudomonas aeruginosa PA01
gugcguggugcauccgccgcag

SEQ ID NO: 1411980 - RNA, 16 nt, Pseudomonas aeruginosa PA01
gugcguguucggcggc

SEQ ID NO: 1411981 - RNA, 16 nt, Pseudomonas aeruginosa PA01
gugcguucgcgggcgc

SEQ ID NO: 1411982 - RNA, 18 nt, Pseudomonas aeruginosa PA01
gugcggguaucgaucucg

SEQ ID NO: 1411983 - RNA, 13 nt, Pseudomonas aeruginosa PA01
gugcgcuggcgcc

SEQ ID NO: 1411984 - RNA, 14 nt, Pseudomonas aeruginosa PA01
guggcgacgcgcag

SEQ ID NO: 1411985 - RNA, 19 nt, Pseudomonas aeruginosa PA01
guggcgacgcgcaggccgg

SEQ ID NO: 1411986 - RNA, 23 nt, Pseudomonas aeruginosa PA01
guggcgaucaggcagcgcgcggc

SEQ ID NO: 1411987 - RNA, 14 nt, Pseudomonas aeruginosa PA01
guggcgcaacaccu

SEQ ID NO: 1411988 - RNA, 18 nt, Pseudomonas aeruginosa PA01
guggcgccagccagcccg

SEQ ID NO: 1411989 - RNA, 15 nt, Pseudomonas aeruginosa PA01
guggcgccccaggcg

SEQ ID NO: 1411990 - RNA, 18 nt, Pseudomonas aeruginosa PA01
guggcgcccaugccgccc

SEQ ID NO: 1411991 - RNA, 21 nt, Pseudomonas aeruginosa PA01
guggcgcccaugccgcccggc

SEQ ID NO: 1411992 - RNA, 19 nt, Pseudomonas aeruginosa PA01
guggcgcccagccagagcg

SEQ ID NO: 1411993 - RNA, 16 nt, Pseudomonas aeruginosa PA01
guggcgcagcgcccga

SEQ ID NO: 1411994 - RNA, 13 nt, Pseudomonas aeruginosa PA01
guggcgccgagca

SEQ ID NO: 1411995 - RNA, 14 nt, Pseudomonas aeruginosa PA01
guggcgccgccaug

SEQ ID NO: 1411996 - RNA, 13 nt, Pseudomonas aeruginosa PA01
guggcgccggcgc

SEQ ID NO: 1411997 - RNA, 14 nt, Pseudomonas aeruginosa PA01
guggcggcgcgcgu

SEQ ID NO: 1411998 - RNA, 13 nt, Pseudomonas aeruginosa PA01
guggcggcggcga

SEQ ID NO: 1411999 - RNA, 13 nt, Pseudomonas aeruginosa PA01
guggcggccgccg

SEQ ID NO: 1412000 - RNA, 14 nt, Pseudomonas aeruginosa PA01
guggcggccgccgg

SEQ ID NO: 1412001 - RNA, 17 nt, Pseudomonas aeruginosa PA01
guggcggccgccggcgc

SEQ ID NO: 1412002 - RNA, 18 nt, Pseudomonas aeruginosa PA01
guggcgcugucgccgguc

SEQ ID NO: 1412003 - RNA, 22 nt, Pseudomonas aeruginosa PA01
guggcgcuugagcagccaggcg

SEQ ID NO: 1412004 - RNA, 14 nt, Pseudomonas aeruginosa PA01
guggcgcugccuuc

SEQ ID NO: 1412005 - RNA, 16 nt, Pseudomonas aeruginosa PA01
guggcgcuggccgaau

SEQ ID NO: 1412006 - RNA, 23 nt, Pseudomonas aeruginosa PA01
guggcgcuacgcucgccgacggc

SEQ ID NO: 1412007 - RNA, 13 nt, Pseudomonas aeruginosa PA01
guggcgccgccgg

SEQ ID NO: 1412008 - RNA, 14 nt, Pseudomonas aeruginosa PA01
guggcgccggcgcg

SEQ ID NO: 1412009 - RNA, 16 nt, Pseudomonas aeruginosa PA01
guggcgcgcaccaccu

SEQ ID NO: 1412010 - RNA, 22 nt, Pseudomonas aeruginosa PA01
guggcgcgcaucggugccggca

SEQ ID NO: 1412011 - RNA, 19 nt, Pseudomonas aeruginosa PA01
guggcucgaucagccggcg

SEQ ID NO: 1412012 - RNA, 23 nt, Pseudomonas aeruginosa PA01
guggcguucucgaucaucgccag

SEQ ID NO: 1412013 - RNA, 14 nt, Pseudomonas aeruginosa PA01
guggcucggcggca

SEQ ID NO: 1412014 - RNA, 16 nt, Pseudomonas aeruginosa PA01
guggcucggcggcagg

SEQ ID NO: 1412015 - RNA, 22 nt, Pseudomonas aeruginosa PA01
gugggcacgagucgaggcgaug

SEQ ID NO: 1412016 - RNA, 21 nt, Pseudomonas aeruginosa PA01
gugggaucgccacgccggcgc

SEQ ID NO: 1412017 - RNA, 18 nt, Pseudomonas aeruginosa PA01
gugggcagcagcgaacgc

SEQ ID NO: 1412018 - RNA, 15 nt, Pseudomonas aeruginosa PA01
gugggcaugcucggc

SEQ ID NO: 1412019 - RNA, 19 nt, Pseudomonas aeruginosa PA01
gugggcaugcucggccagg

SEQ ID NO: 1412020 - RNA, 14 nt, Pseudomonas aeruginosa PA01
guggcgucggcgcu

SEQ ID NO: 1412021 - RNA, 17 nt, Pseudomonas aeruginosa PA01
guggcguuauucgcccu

SEQ ID NO: 1412022 - RNA, 17 nt, Pseudomonas aeruginosa PA01
guggcguuccaggcggc

SEQ ID NO: 1412023 - RNA, 16 nt, Pseudomonas aeruginosa PA01
guggcgugcucggcga

SEQ ID NO: 1412024 - RNA, 17 nt, Pseudomonas aeruginosa PA01
guggcgugcucggcgau

SEQ ID NO: 1412025 - RNA, 16 nt, Pseudomonas aeruginosa PA01
guggcgggccagcagg

SEQ ID NO: 1412026 - RNA, 17 nt, Pseudomonas aeruginosa PA01
guggcgggccagcaggc

SEQ ID NO: 1412027 - RNA, 13 nt, Pseudomonas aeruginosa PA01
guggcgggccaug

SEQ ID NO: 1412028 - RNA, 15 nt, Pseudomonas aeruginosa PA01
guggcgggccaugcg

SEQ ID NO: 1412029 - RNA, 19 nt, Pseudomonas aeruginosa PA01
guggcggggaacagcaugg

SEQ ID NO: 1412030 - RNA, 21 nt, Pseudomonas aeruginosa PA01
guggccuuuuucauuggcgcg

SEQ ID NO: 1412031 - RNA, 19 nt, Pseudomonas aeruginosa PA01
guggcgaaacuccagcagg

SEQ ID NO: 1412032 - RNA, 16 nt, Pseudomonas aeruginosa PA01
guggcgaacgcccggc

SEQ ID NO: 1412033 - RNA, 14 nt, Pseudomonas aeruginosa PA01
guggcgacgcagca

SEQ ID NO: 1412034 - RNA, 15 nt, Pseudomonas aeruginosa PA01
guggcgacgaagacg

SEQ ID NO: 1412035 - RNA, 24 nt, Pseudomonas aeruginosa PA01
guggccgucgaagggcacgccgcu

SEQ ID NO: 1412036 - RNA, 15 nt, Pseudomonas aeruginosa PA01
guggccuccugcaac

SEQ ID NO: 1412037 - RNA, 22 nt, Pseudomonas aeruginosa PA01
guggccuccugcaacgccuggu

SEQ ID NO: 1412038 - RNA, 13 nt, Pseudomonas aeruginosa PA01
guggccguggcgc

SEQ ID NO: 1412039 - RNA, 15 nt, Pseudomonas aeruginosa PA01
guggccguggcgccc

SEQ ID NO: 1412040 - RNA, 19 nt, Pseudomonas aeruginosa PA01
guggccguggcgccccagg

SEQ ID NO: 1412041 - RNA, 15 nt, Pseudomonas aeruginosa PA01
guggccgugggccgc

SEQ ID NO: 1412042 - RNA, 18 nt, Pseudomonas aeruginosa PA01
guggccgugggccgccga

SEQ ID NO: 1412043 - RNA, 17 nt, Pseudomonas aeruginosa PA01
guggccgcgggaggccg

SEQ ID NO: 1412044 - RNA, 18 nt, Pseudomonas aeruginosa PA01
guggccgcgggaggccgc

SEQ ID NO: 1412045 - RNA, 13 nt, Pseudomonas aeruginosa PA01
guggccgcugagc

SEQ ID NO: 1412046 - RNA, 18 nt, Pseudomonas aeruginosa PA01
guggccggucugguagcg

SEQ ID NO: 1412047 - RNA, 19 nt, Pseudomonas aeruginosa PA01
guggccggcgaccagcucg

SEQ ID NO: 1412048 - RNA, 13 nt, Pseudomonas aeruginosa PA01
guggccgccaggg

SEQ ID NO: 1412049 - RNA, 13 nt, Pseudomonas aeruginosa PA01
guggccgaaggcg

SEQ ID NO: 1412050 - RNA, 14 nt, Pseudomonas aeruginosa PA01
guggcccugggcgg

SEQ ID NO: 1412051 - RNA, 21 nt, Pseudomonas aeruginosa PA01
guggcccggcgcggcggccgc

SEQ ID NO: 1412052 - RNA, 18 nt, Pseudomonas aeruginosa PA01
guggccauagagccgcug

SEQ ID NO: 1412053 - RNA, 20 nt, Pseudomonas aeruginosa PA01
guggccauagagccgcuggg

SEQ ID NO: 1412054 - RNA, 14 nt, Pseudomonas aeruginosa PA01
guggccagcgaacc

SEQ ID NO: 1412055 - RNA, 22 nt, Pseudomonas aeruginosa PA01
guggccagcgaacccaggccgc

SEQ ID NO: 1412056 - RNA, 12 nt, Pseudomonas aeruginosa PA01
guggccagcgcc

SEQ ID NO: 1412057 - RNA, 13 nt, Pseudomonas aeruginosa PA01
guggccagcgccc

SEQ ID NO: 1412058 - RNA, 20 nt, Pseudomonas aeruginosa PA01
guggccagcgcccaggccgg

SEQ ID NO: 1412059 - RNA, 19 nt, Pseudomonas aeruginosa PA01
guggccacgucgccccagg

SEQ ID NO: 1412060 - RNA, 14 nt, Pseudomonas aeruginosa PA01
guggccccagcgcg

SEQ ID NO: 1412061 - RNA, 13 nt, Pseudomonas aeruginosa PA01
guggccaggcgca

SEQ ID NO: 1412062 - RNA, 23 nt, Pseudomonas aeruginosa PA01
gugcugggcgaccuucagcgggu

SEQ ID NO: 1412063 - RNA, 20 nt, Pseudomonas aeruginosa PA01
gugcugguagggcuucgccc

SEQ ID NO: 1412064 - RNA, 21 nt, Pseudomonas aeruginosa PA01
gugcugguggcccugggcggc

SEQ ID NO: 1412065 - RNA, 13 nt, Pseudomonas aeruginosa PA01
gugcugcgcgcgg

SEQ ID NO: 1412066 - RNA, 17 nt, Pseudomonas aeruginosa PA01
gugcugcgcgcggccca

SEQ ID NO: 1412067 - RNA, 23 nt, Pseudomonas aeruginosa PA01
gugcuggcggauguaguccagcg

SEQ ID NO: 1412068 - RNA, 17 nt, Pseudomonas aeruginosa PA01
guguagcgacggaaggu

SEQ ID NO: 1412069 - RNA, 23 nt, Pseudomonas aeruginosa PA01
guguagcgauccugaccguccug

SEQ ID NO: 1412070 - RNA, 14 nt, Pseudomonas aeruginosa PA01
guguagaucaggcu

SEQ ID NO: 1412071 - RNA, 18 nt, Pseudomonas aeruginosa PA01
guguagcugaggccguag

SEQ ID NO: 1412072 - RNA, 17 nt, Pseudomonas aeruginosa PA01
guguagcugcagcgccc

SEQ ID NO: 1412073 - RNA, 22 nt, Pseudomonas aeruginosa PA01
gugugccggccaugcaggccag

SEQ ID NO: 1412074 - RNA, 22 nt, Pseudomonas aeruginosa PA01
gugugccgucaggcaccucguc

SEQ ID NO: 1412075 - RNA, 22 nt, Pseudomonas aeruginosa PA01
gugugcaccgaguugaccagca

SEQ ID NO: 1412076 - RNA, 13 nt, Pseudomonas aeruginosa PA01
gugugcagcaggg

SEQ ID NO: 1412077 - RNA, 14 nt, Pseudomonas aeruginosa PA01
guguaccacgcccg

SEQ ID NO: 1412078 - RNA, 19 nt, Pseudomonas aeruginosa PA01
guggguauccagcggccgc

SEQ ID NO: 1412079 - RNA, 20 nt, Pseudomonas aeruginosa PA01
guggugccacagguggaucg

SEQ ID NO: 1412080 - RNA, 12 nt, Pseudomonas aeruginosa PA01
guggggccgccg

SEQ ID NO: 1412081 - RNA, 14 nt, Pseudomonas aeruginosa PA01
guggggccgccgau

SEQ ID NO: 1412082 - RNA, 13 nt, Pseudomonas aeruginosa PA01
guggugauccgca

SEQ ID NO: 1412083 - RNA, 19 nt, Pseudomonas aeruginosa PA01
guggugaucagcggccgag

SEQ ID NO: 1412084 - RNA, 20 nt, Pseudomonas aeruginosa PA01
guggugaucagcggccgagc

SEQ ID NO: 1412085 - RNA, 21 nt, Pseudomonas aeruginosa PA01
guggugacauggaugaccacg

SEQ ID NO: 1412086 - RNA, 15 nt, Pseudomonas aeruginosa PA01
guggguagccauggc

SEQ ID NO: 1412087 - RNA, 15 nt, Pseudomonas aeruginosa PA01
gugggccaccaucag

SEQ ID NO: 1412088 - RNA, 23 nt, Pseudomonas aeruginosa PA01
gugggccaccaucagguagauga

SEQ ID NO: 1412089 - RNA, 16 nt, Pseudomonas aeruginosa PA01
gugggccagcaggccg

SEQ ID NO: 1412090 - RNA, 20 nt, Pseudomonas aeruginosa PA01
gugggccagcaggccgauca

SEQ ID NO: 1412091 - RNA, 14 nt, Pseudomonas aeruginosa PA01
gugggcggucggcg

SEQ ID NO: 1412092 - RNA, 15 nt, Pseudomonas aeruginosa PA01
gugggcggucggcga

SEQ ID NO: 1412093 - RNA, 21 nt, Pseudomonas aeruginosa PA01
guggggaaaucgguugccgcg

SEQ ID NO: 1412094 - RNA, 21 nt, Pseudomonas aeruginosa PA01
gugggcucuaugcaauggggc

SEQ ID NO: 1412095 - RNA, 13 nt, Pseudomonas aeruginosa PA01
guuaccguccgcg

SEQ ID NO: 1412096 - RNA, 17 nt, Pseudomonas aeruginosa PA01
guuaccggcgaccaccg

SEQ ID NO: 1412097 - RNA, 13 nt, Pseudomonas aeruginosa PA01
guuauggccgacc

SEQ ID NO: 1412098 - RNA, 20 nt, Pseudomonas aeruginosa PA01
guuauuccgcgggacgcggc

SEQ ID NO: 1412099 - RNA, 12 nt, Pseudomonas aeruginosa PA01
guuauucgcccu

SEQ ID NO: 1412100 - RNA, 19 nt, Pseudomonas aeruginosa PA01
aaguucgcauaggcggcca

SEQ ID NO: 1412101 - RNA, 14 nt, Pseudomonas aeruginosa PA01
guguugaucaccgc

SEQ ID NO: 1412102 - RNA, 16 nt, Pseudomonas aeruginosa PA01
guguugaucaccgcgg

SEQ ID NO: 1412103 - RNA, 21 nt, Pseudomonas aeruginosa PA01
guguucggccagccggcgccg

SEQ ID NO: 1412104 - RNA, 23 nt, Pseudomonas aeruginosa PA01
guguucgucgaucagguccuggc

SEQ ID NO: 1412105 - RNA, 14 nt, Pseudomonas aeruginosa PA01
guugaagccgccau

SEQ ID NO: 1412106 - RNA, 20 nt, Pseudomonas aeruginosa PA01
guugaagaacggcccgcucu

SEQ ID NO: 1412107 - RNA, 14 nt, Pseudomonas aeruginosa PA01
guugaagccgaucg

SEQ ID NO: 1412108 - RNA, 14 nt, Pseudomonas aeruginosa PA01
guugaaggcgcggu

SEQ ID NO: 1412109 - RNA, 15 nt, Pseudomonas aeruginosa PA01
guugaaggcgcgguc

SEQ ID NO: 1412110 - RNA, 13 nt, Pseudomonas aeruginosa PA01
guugaccagcgcg

SEQ ID NO: 1412111 - RNA, 14 nt, Pseudomonas aeruginosa PA01
guugaccagcgcgu

SEQ ID NO: 1412112 - RNA, 15 nt, Pseudomonas aeruginosa PA01
guugacgucgccgau

SEQ ID NO: 1412113 - RNA, 17 nt, Pseudomonas aeruginosa PA01
guugacgucgccgaugc

SEQ ID NO: 1412114 - RNA, 19 nt, Pseudomonas aeruginosa PA01
guugacccagagccgcucg

SEQ ID NO: 1412115 - RNA, 21 nt, Pseudomonas aeruginosa PA01
guucuccucccgccccuccag

SEQ ID NO: 1412116 - RNA, 22 nt, Pseudomonas aeruginosa PA01
guucuccucccgccccuccagu

SEQ ID NO: 1412117 - RNA, 14 nt, Pseudomonas aeruginosa PA01
guucuccagcaagc

SEQ ID NO: 1412118 - RNA, 18 nt, Pseudomonas aeruginosa PA01
guucucgacccgcucgag

SEQ ID NO: 1412119 - RNA, 17 nt, Pseudomonas aeruginosa PA01
guucucggugaccaccu

SEQ ID NO: 1412120 - RNA, 16 nt, Pseudomonas aeruginosa PA01
guucucguccaggucc

SEQ ID NO: 1412121 - RNA, 17 nt, Pseudomonas aeruginosa PA01
guucucguccucggcgu

SEQ ID NO: 1412122 - RNA, 15 nt, Pseudomonas aeruginosa PA01
guucucggccaccac

SEQ ID NO: 1412123 - RNA, 14 nt, Pseudomonas aeruginosa PA01
guucugggcggcca

SEQ ID NO: 1412124 - RNA, 16 nt, Pseudomonas aeruginosa PA01
guucugcuucucggcu

SEQ ID NO: 1412125 - RNA, 21 nt, Pseudomonas aeruginosa PA01
guucugcgcaccaugcccgcu

SEQ ID NO: 1412126 - RNA, 22 nt, Pseudomonas aeruginosa PA01
guucugcgacaucuccaggccg

SEQ ID NO: 1412127 - RNA, 16 nt, Pseudomonas aeruginosa PA01
guucugcccgccggcg

SEQ ID NO: 1412128 - RNA, 18 nt, Pseudomonas aeruginosa PA01
guucugcccgccggcgcc

SEQ ID NO: 1412129 - RNA, 19 nt, Pseudomonas aeruginosa PA01
guucugcccgccggcgccc

SEQ ID NO: 1412130 - RNA, 13 nt, Pseudomonas aeruginosa PA01
guucugccgcagc

SEQ ID NO: 1412131 - RNA, 17 nt, Pseudomonas aeruginosa PA01
guucugccgcagcgccu

SEQ ID NO: 1412132 - RNA, 14 nt, Pseudomonas aeruginosa PA01
guucguugaccacg

SEQ ID NO: 1412133 - RNA, 19 nt, Pseudomonas aeruginosa PA01
guucgugccaggcggcagc

SEQ ID NO: 1412134 - RNA, 19 nt, Pseudomonas aeruginosa PA01
guucucccugagccugucg

SEQ ID NO: 1412135 - RNA, 17 nt, Pseudomonas aeruginosa PA01
guucgucaccggcgcca

SEQ ID NO: 1412136 - RNA, 20 nt, Pseudomonas aeruginosa PA01
guucgucccgagcaccggcc

SEQ ID NO: 1412137 - RNA, 16 nt, Pseudomonas aeruginosa PA01
guucgucgccacgccc

SEQ ID NO: 1412138 - RNA, 16 nt, Pseudomonas aeruginosa PA01
guucgucuggcgccug

SEQ ID NO: 1412139 - RNA, 19 nt, Pseudomonas aeruginosa PA01
guucgucuggcgccuggcc

SEQ ID NO: 1412140 - RNA, 20 nt, Pseudomonas aeruginosa PA01
guucgucuggcgccuggccu

SEQ ID NO: 1412141 - RNA, 17 nt, Pseudomonas aeruginosa PA01
guucggcgaggaucgcc

SEQ ID NO: 1412142 - RNA, 22 nt, Pseudomonas aeruginosa PA01
guucggcgaugaccagcucggc

SEQ ID NO: 1412143 - RNA, 15 nt, Pseudomonas aeruginosa PA01
guucggcugggccag

SEQ ID NO: 1412144 - RNA, 20 nt, Pseudomonas aeruginosa PA01
guucggcuguuucaggccgg

SEQ ID NO: 1412145 - RNA, 23 nt, Pseudomonas aeruginosa PA01
guucggcuguuucaggccggcgu

SEQ ID NO: 1412146 - RNA, 19 nt, Pseudomonas aeruginosa PA01
guucggcgucuucggcggc

SEQ ID NO: 1412147 - RNA, 23 nt, Pseudomonas aeruginosa PA01
guucggcgucuucggcggcgccg

SEQ ID NO: 1412148 - RNA, 23 nt, Pseudomonas aeruginosa PA01
guucggcgagaggucggcgcgcc

SEQ ID NO: 1412149 - RNA, 13 nt, Pseudomonas aeruginosa PA01
guucggugccgcc

SEQ ID NO: 1412150 - RNA, 15 nt, Pseudomonas aeruginosa PA01
guucggugccgccgg

SEQ ID NO: 1412151 - RNA, 18 nt, Pseudomonas aeruginosa PA01
guucggugccgccggcgc

SEQ ID NO: 1412152 - RNA, 20 nt, Pseudomonas aeruginosa PA01
guucggugccgccggcgccg

SEQ ID NO: 1412153 - RNA, 15 nt, Pseudomonas aeruginosa PA01
guucggucaggcuga

SEQ ID NO: 1412154 - RNA, 13 nt, Pseudomonas aeruginosa PA01
guucggcagcgcc

SEQ ID NO: 1412155 - RNA, 18 nt, Pseudomonas aeruginosa PA01
guucggcagcgccucggc

SEQ ID NO: 1412156 - RNA, 20 nt, Pseudomonas aeruginosa PA01
guucggcagguugcucgccu

SEQ ID NO: 1412157 - RNA, 21 nt, Pseudomonas aeruginosa PA01
guucggcauuggugcugccga

SEQ ID NO: 1412158 - RNA, 23 nt, Pseudomonas aeruginosa PA01
guucggccagggagucgcuggcc

SEQ ID NO: 1412159 - RNA, 17 nt, Pseudomonas aeruginosa PA01
guucggcccagcagcgc

SEQ ID NO: 1412160 - RNA, 19 nt, Pseudomonas aeruginosa PA01
guucggcccagcagcgcuc

SEQ ID NO: 1412161 - RNA, 14 nt, Pseudomonas aeruginosa PA01
guucggccccggcc

SEQ ID NO: 1412162 - RNA, 15 nt, Pseudomonas aeruginosa PA01
guucgcugccgccgc

SEQ ID NO: 1412163 - RNA, 12 nt, Pseudomonas aeruginosa PA01
guucgcugcgcg

SEQ ID NO: 1412164 - RNA, 19 nt, Pseudomonas aeruginosa PA01
guucgcuggacaggcgcag

SEQ ID NO: 1412165 - RNA, 20 nt, Pseudomonas aeruginosa PA01
guucgcugacccagcgcacg

SEQ ID NO: 1412166 - RNA, 17 nt, Pseudomonas aeruginosa PA01
guucgcguggcccggcg

SEQ ID NO: 1412167 - RNA, 18 nt, Pseudomonas aeruginosa PA01
guucgcguggcccggcgc

SEQ ID NO: 1412168 - RNA, 15 nt, Pseudomonas aeruginosa PA01
guucgcggcucuggc

SEQ ID NO: 1412169 - RNA, 14 nt, Pseudomonas aeruginosa PA01
guucgccgcgggcg

SEQ ID NO: 1412170 - RNA, 16 nt, Pseudomonas aeruginosa PA01
guucgcgcgccucgcg

SEQ ID NO: 1412171 - RNA, 19 nt, Pseudomonas aeruginosa PA01
guucgcgcaggugcuuggc

SEQ ID NO: 1412172 - RNA, 18 nt, Pseudomonas aeruginosa PA01
guucgcgggccgcggcga

SEQ ID NO: 1412173 - RNA, 15 nt, Pseudomonas aeruginosa PA01
guucgcgggcgccgu

SEQ ID NO: 1412174 - RNA, 14 nt, Pseudomonas aeruginosa PA01
guucgcggcgcagc

SEQ ID NO: 1412175 - RNA, 17 nt, Pseudomonas aeruginosa PA01
guucgcggcgaugcgca

SEQ ID NO: 1412176 - RNA, 15 nt, Pseudomonas aeruginosa PA01
guucgcgcaggcgcu

SEQ ID NO: 1412177 - RNA, 17 nt, Pseudomonas aeruginosa PA01
guucgcgcaggcgcugg

SEQ ID NO: 1412178 - RNA, 14 nt, Pseudomonas aeruginosa PA01
guucgcgcaggacc

SEQ ID NO: 1412179 - RNA, 15 nt, Pseudomonas aeruginosa PA01
guucgcgcaggaccu

SEQ ID NO: 1412180 - RNA, 22 nt, Pseudomonas aeruginosa PA01
guucgccuucaccucguuuucc

SEQ ID NO: 1412181 - RNA, 20 nt, Pseudomonas aeruginosa PA01
guucgaucucgcguuccagc

SEQ ID NO: 1412182 - RNA, 17 nt, Pseudomonas aeruginosa PA01
guucacauuggcuuccg

SEQ ID NO: 1412183 - RNA, 15 nt, Pseudomonas aeruginosa PA01
guucgccacgcugcu

SEQ ID NO: 1412184 - RNA, 21 nt, Pseudomonas aeruginosa PA01
guucgccacgcugcugccggc

SEQ ID NO: 1412185 - RNA, 21 nt, Pseudomonas aeruginosa PA01
guucgcccaaggccaggucga

SEQ ID NO: 1412186 - RNA, 23 nt, Pseudomonas aeruginosa PA01
guucgcccaaggccaggucgacg

SEQ ID NO: 1412187 - RNA, 15 nt, Pseudomonas aeruginosa PA01
guucgcccgcggcgg

SEQ ID NO: 1412188 - RNA, 20 nt, Pseudomonas aeruginosa PA01
guucgcccgcggcggcgacg

SEQ ID NO: 1412189 - RNA, 22 nt, Pseudomonas aeruginosa PA01
guucgccacugaacuggaucgg

SEQ ID NO: 1412190 - RNA, 18 nt, Pseudomonas aeruginosa PA01
guucgccccgccgccagg

SEQ ID NO: 1412191 - RNA, 22 nt, Pseudomonas aeruginosa PA01
guucgccccgccgccaggcggc

SEQ ID NO: 1412192 - RNA, 13 nt, Pseudomonas aeruginosa PA01
guucgccgccacc

SEQ ID NO: 1412193 - RNA, 14 nt, Pseudomonas aeruginosa PA01
guucgccgccgagc

SEQ ID NO: 1412194 - RNA, 17 nt, Pseudomonas aeruginosa PA01
guucgccgccgagcgcc

SEQ ID NO: 1412195 - RNA, 12 nt, Pseudomonas aeruginosa PA01
guucgccgccgc

SEQ ID NO: 1412196 - RNA, 17 nt, Pseudomonas aeruginosa PA01
guucgccgaggcggcgc

SEQ ID NO: 1412197 - RNA, 18 nt, Pseudomonas aeruginosa PA01
guucgccgaggcggcgca

SEQ ID NO: 1412198 - RNA, 20 nt, Pseudomonas aeruginosa PA01
guucgccgaggcggcgcagc

SEQ ID NO: 1412199 - RNA, 20 nt, Pseudomonas aeruginosa PA01
guucgccgagcgccgccagg

SEQ ID NO: 1412200 - RNA, 19 nt, Pseudomonas aeruginosa PA01
guucgccgaaauagcgcgc

SEQ ID NO: 1412201 - RNA, 14 nt, Pseudomonas aeruginosa PA01
guucgcccugcgga

SEQ ID NO: 1412202 - RNA, 14 nt, Pseudomonas aeruginosa PA01
guucgaggcgccga

SEQ ID NO: 1412203 - RNA, 20 nt, Pseudomonas aeruginosa PA01
guucgaggguacuccuggca

SEQ ID NO: 1412204 - RNA, 19 nt, Pseudomonas aeruginosa PA01
guucgacgaagggcucagc

SEQ ID NO: 1412205 - RNA, 21 nt, Pseudomonas aeruginosa PA01
guuggaauaguggaucgcccg

SEQ ID NO: 1412206 - RNA, 19 nt, Pseudomonas aeruginosa PA01
guugcuuguguccgccgag

SEQ ID NO: 1412207 - RNA, 21 nt, Pseudomonas aeruginosa PA01
guugcuuguguccgccgaggu

SEQ ID NO: 1412208 - RNA, 16 nt, Pseudomonas aeruginosa PA01
guugcugugcugcacc

SEQ ID NO: 1412209 - RNA, 14 nt, Pseudomonas aeruginosa PA01
guugcuuccaggca

SEQ ID NO: 1412210 - RNA, 21 nt, Pseudomonas aeruginosa PA01
guugcgcuaucggcccggggc

SEQ ID NO: 1412211 - RNA, 22 nt, Pseudomonas aeruginosa PA01
guugcgcggcgaguugcgcgag

SEQ ID NO: 1412212 - RNA, 19 nt, Pseudomonas aeruginosa PA01
guugcgcuccacccaggcg

SEQ ID NO: 1412213 - RNA, 12 nt, Pseudomonas aeruginosa PA01
guugcgcuccgg

SEQ ID NO: 1412214 - RNA, 16 nt, Pseudomonas aeruginosa PA01
guugcgcuccgguggc

SEQ ID NO: 1412215 - RNA, 13 nt, Pseudomonas aeruginosa PA01
guugcgccgcaag

SEQ ID NO: 1412216 - RNA, 13 nt, Pseudomonas aeruginosa PA01
guugcgccggccc

SEQ ID NO: 1412217 - RNA, 18 nt, Pseudomonas aeruginosa PA01
guugcgccggcccagcag

SEQ ID NO: 1412218 - RNA, 19 nt, Pseudomonas aeruginosa PA01
guugcgccggcccagcagg

SEQ ID NO: 1412219 - RNA, 23 nt, Pseudomonas aeruginosa PA01
guugcgcgagcaccgcgcagacc

SEQ ID NO: 1412220 - RNA, 23 nt, Pseudomonas aeruginosa PA01
guugcgcgaggcguucgucgacc

SEQ ID NO: 1412221 - RNA, 14 nt, Pseudomonas aeruginosa PA01
guugcgcgccagcg

SEQ ID NO: 1412222 - RNA, 16 nt, Pseudomonas aeruginosa PA01
guugcgcgccagcgcc

SEQ ID NO: 1412223 - RNA, 16 nt, Pseudomonas aeruginosa PA01
guugcgccgccugcgg

SEQ ID NO: 1412224 - RNA, 16 nt, Pseudomonas aeruginosa PA01
guugcgcggcaggugg

SEQ ID NO: 1412225 - RNA, 22 nt, Pseudomonas aeruginosa PA01
guugcgccauugccgccaggug

SEQ ID NO: 1412226 - RNA, 23 nt, Pseudomonas aeruginosa PA01
guugcgcccgucgaagaucaccg

SEQ ID NO: 1412227 - RNA, 20 nt, Pseudomonas aeruginosa PA01
guugcgcaucugcgcguagc

SEQ ID NO: 1412228 - RNA, 20 nt, Pseudomonas aeruginosa PA01
guugcgcauuugcacgucgg

SEQ ID NO: 1412229 - RNA, 18 nt, Pseudomonas aeruginosa PA01
guugcgcaggggcgcggc

SEQ ID NO: 1412230 - RNA, 14 nt, Pseudomonas aeruginosa PA01
guuggcauccggcu

SEQ ID NO: 1412231 - RNA, 14 nt, Pseudomonas aeruginosa PA01
guuggacgcggccu

SEQ ID NO: 1412232 - RNA, 16 nt, Pseudomonas aeruginosa PA01
guuggcaaagcccgcu

SEQ ID NO: 1412233 - RNA, 22 nt, Pseudomonas aeruginosa PA01
guuggcacgacgcucggacagc

SEQ ID NO: 1412234 - RNA, 17 nt, Pseudomonas aeruginosa PA01
guuggccagcaggcgcc

SEQ ID NO: 1412235 - RNA, 17 nt, Pseudomonas aeruginosa PA01
guuggccaggaccaucg

SEQ ID NO: 1412236 - RNA, 18 nt, Pseudomonas aeruginosa PA01
guuggccaggcgcgacag

SEQ ID NO: 1412237 - RNA, 18 nt, Pseudomonas aeruginosa PA01
guuggcccaauccgcgcc

SEQ ID NO: 1412238 - RNA, 19 nt, Pseudomonas aeruginosa PA01
guuggcccaauccgcgccg

SEQ ID NO: 1412239 - RNA, 20 nt, Pseudomonas aeruginosa PA01
guuggcccaauccgcgccgg

SEQ ID NO: 1412240 - RNA, 21 nt, Pseudomonas aeruginosa PA01
guuggcccaauccgcgccggu

SEQ ID NO: 1412241 - RNA, 16 nt, Pseudomonas aeruginosa PA01
guuggccagcgaacgc

SEQ ID NO: 1412242 - RNA, 15 nt, Pseudomonas aeruginosa PA01
guuggccgagcgcga

SEQ ID NO: 1412243 - RNA, 19 nt, Pseudomonas aeruginosa PA01
guuggccgaggaggccagc

SEQ ID NO: 1412244 - RNA, 13 nt, Pseudomonas aeruginosa PA01
guugccgugccgg

SEQ ID NO: 1412245 - RNA, 16 nt, Pseudomonas aeruginosa PA01
guugcgcaaccagcgc

SEQ ID NO: 1412246 - RNA, 17 nt, Pseudomonas aeruginosa PA01
guugcgcaaccagcgcu

SEQ ID NO: 1412247 - RNA, 22 nt, Pseudomonas aeruginosa PA01
guugccguggucgcgcaggcgg

SEQ ID NO: 1412248 - RNA, 13 nt, Pseudomonas aeruginosa PA01
guugccguggcgg

SEQ ID NO: 1412249 - RNA, 21 nt, Pseudomonas aeruginosa PA01
guugccggagacgauggcgac

SEQ ID NO: 1412250 - RNA, 17 nt, Pseudomonas aeruginosa PA01
guugccggaaucacgcu

SEQ ID NO: 1412251 - RNA, 19 nt, Pseudomonas aeruginosa PA01
guugccggaaucacgcugc

SEQ ID NO: 1412252 - RNA, 17 nt, Pseudomonas aeruginosa PA01
guugccgcugcaggcca

SEQ ID NO: 1412253 - RNA, 18 nt, Pseudomonas aeruginosa PA01
guugccgcugcggcgguc

SEQ ID NO: 1412254 - RNA, 14 nt, Pseudomonas aeruginosa PA01
guugccgcuggccu

SEQ ID NO: 1412255 - RNA, 20 nt, Pseudomonas aeruginosa PA01
guugccgcgcgggccggcga

SEQ ID NO: 1412256 - RNA, 14 nt, Pseudomonas aeruginosa PA01
guugccgcgcuugc

SEQ ID NO: 1412257 - RNA, 20 nt, Pseudomonas aeruginosa PA01
guugccggcaaacgccgcca

SEQ ID NO: 1412258 - RNA, 23 nt, Pseudomonas aeruginosa PA01
guugccgguacucgccgggcguc

SEQ ID NO: 1412259 - RNA, 17 nt, Pseudomonas aeruginosa PA01
guugccggucuugccgg

SEQ ID NO: 1412260 - RNA, 19 nt, Pseudomonas aeruginosa PA01
guugccggugugacggccg

SEQ ID NO: 1412261 - RNA, 20 nt, Pseudomonas aeruginosa PA01
guugccggugugacggccgg

SEQ ID NO: 1412262 - RNA, 22 nt, Pseudomonas aeruginosa PA01
guugccggugugacggccgggg

SEQ ID NO: 1412263 - RNA, 17 nt, Pseudomonas aeruginosa PA01
guugccgcgcaccaccg

SEQ ID NO: 1412264 - RNA, 12 nt, Pseudomonas aeruginosa PA01
guugccgcgcca

SEQ ID NO: 1412265 - RNA, 20 nt, Pseudomonas aeruginosa PA01
guugccgccagcgcggcgcu

SEQ ID NO: 1412266 - RNA, 12 nt, Pseudomonas aeruginosa PA01
guugccgccgau

SEQ ID NO: 1412267 - RNA, 13 nt, Pseudomonas aeruginosa PA01
guugagcuggccg

SEQ ID NO: 1412268 - RNA, 14 nt, Pseudomonas aeruginosa PA01
guugagcuggccga

SEQ ID NO: 1412269 - RNA, 19 nt, Pseudomonas aeruginosa PA01
guugagcaccucgaccugg

SEQ ID NO: 1412270 - RNA, 16 nt, Pseudomonas aeruginosa PA01
guugagauccuggccg

SEQ ID NO: 1412271 - RNA, 21 nt, Pseudomonas aeruginosa PA01
guugagauccuggccggcggc

SEQ ID NO: 1412272 - RNA, 14 nt, Pseudomonas aeruginosa PA01
guugucgcggcuga

SEQ ID NO: 1412273 - RNA, 13 nt, Pseudomonas aeruginosa PA01
guuguccaggcga

SEQ ID NO: 1412274 - RNA, 14 nt, Pseudomonas aeruginosa PA01
guuguccucggcgg

SEQ ID NO: 1412275 - RNA, 15 nt, Pseudomonas aeruginosa PA01
guuguccucggcggc

SEQ ID NO: 1412276 - RNA, 21 nt, Pseudomonas aeruginosa PA01
guugucugggaguuccgcgca

SEQ ID NO: 1412277 - RNA, 19 nt, Pseudomonas aeruginosa PA01
guugugaucgaccucgcgg

SEQ ID NO: 1412278 - RNA, 21 nt, Pseudomonas aeruginosa PA01
guugugaucgaccucgcgggc

SEQ ID NO: 1412279 - RNA, 17 nt, Pseudomonas aeruginosa PA01
guuggcgucgcgcacga

SEQ ID NO: 1412280 - RNA, 21 nt, Pseudomonas aeruginosa PA01
guuggcgucgcgcacgaggau

SEQ ID NO: 1412281 - RNA, 18 nt, Pseudomonas aeruginosa PA01
guuggcguuaugcgcccu

SEQ ID NO: 1412282 - RNA, 18 nt, Pseudomonas aeruginosa PA01
guuggcuccgggccgagg

SEQ ID NO: 1412283 - RNA, 16 nt, Pseudomonas aeruginosa PA01
guuggcuuccagccag

SEQ ID NO: 1412284 - RNA, 11 nt, Pseudomonas aeruginosa PA01
guuggcggcca

SEQ ID NO: 1412285 - RNA, 15 nt, Pseudomonas aeruginosa PA01
guuggcggccaucag

SEQ ID NO: 1412286 - RNA, 17 nt, Pseudomonas aeruginosa PA01
guuggcggccaucaggc

SEQ ID NO: 1412287 - RNA, 20 nt, Pseudomonas aeruginosa PA01
guuggcggccaucaggcgcu

SEQ ID NO: 1412288 - RNA, 16 nt, Pseudomonas aeruginosa PA01
guuggcggugccgcag

SEQ ID NO: 1412289 - RNA, 17 nt, Pseudomonas aeruginosa PA01
guuggcggugccgcaga

SEQ ID NO: 1412290 - RNA, 14 nt, Pseudomonas aeruginosa PA01
guuggccgccuggc

SEQ ID NO: 1412291 - RNA, 11 nt, Pseudomonas aeruginosa PA01
guuggcgcggg

SEQ ID NO: 1412292 - RNA, 18 nt, Pseudomonas aeruginosa PA01
guuggcgcgggcgaaggc

SEQ ID NO: 1412293 - RNA, 13 nt, Pseudomonas aeruginosa PA01
guuggcgcucggc

SEQ ID NO: 1412294 - RNA, 18 nt, Pseudomonas aeruginosa PA01
guuggcgccuucggcgac

SEQ ID NO: 1412295 - RNA, 19 nt, Pseudomonas aeruginosa PA01
guuggcgccuucggcgaca

SEQ ID NO: 1412296 - RNA, 23 nt, Pseudomonas aeruginosa PA01
guuguuauggccgacccgugcgc

SEQ ID NO: 1412297 - RNA, 14 nt, Pseudomonas aeruginosa PA01
guuguggcggcgcu

SEQ ID NO: 1412298 - RNA, 15 nt, Pseudomonas aeruginosa PA01
guuguggcuggccuc

SEQ ID NO: 1412299 - RNA, 17 nt, Pseudomonas aeruginosa PA01
guuguggcuggccucgg

SEQ ID NO: 1412300 - RNA, 17 nt, Pseudomonas aeruginosa PA01
guuguucaggcgcgcgg

SEQ ID NO: 1412301 - RNA, 19 nt, Pseudomonas aeruginosa PA01
guuguugccggucuugccg

SEQ ID NO: 1412302 - RNA, 14 nt, Pseudomonas aeruginosa PA01
guuguucgcgcacc

SEQ ID NO: 1412303 - RNA, 13 nt, Pseudomonas aeruginosa PA01
guuguucggcgag

SEQ ID NO: 1412304 - RNA, 14 nt, Pseudomonas aeruginosa PA01
guuuagccgccagu

SEQ ID NO: 1412305 - RNA, 15 nt, Pseudomonas aeruginosa PA01
guuuagccgccagug

SEQ ID NO: 1412306 - RNA, 15 nt, Pseudomonas aeruginosa PA01
uaaucgcagcgcggu

SEQ ID NO: 1412307 - RNA, 13 nt, Pseudomonas aeruginosa PA01
uaaccgucgcugg

SEQ ID NO: 1412308 - RNA, 14 nt, Pseudomonas aeruginosa PA01
uaaaggccaccaga

SEQ ID NO: 1412309 - RNA, 23 nt, Pseudomonas aeruginosa PA01
guuucagcccacgcgccuggccg

SEQ ID NO: 1412310 - RNA, 21 nt, Pseudomonas aeruginosa PA01
guuucacggcggauaaccgcg

SEQ ID NO: 1412311 - RNA, 16 nt, Pseudomonas aeruginosa PA01
guuucaucucggcgca

SEQ ID NO: 1412312 - RNA, 20 nt, Pseudomonas aeruginosa PA01
guuucagcgcuugcuggcgc

SEQ ID NO: 1412313 - RNA, 11 nt, Pseudomonas aeruginosa PA01
guuucagcggg

SEQ ID NO: 1412314 - RNA, 20 nt, Pseudomonas aeruginosa PA01
guuuccaggaugcaaccgcc

SEQ ID NO: 1412315 - RNA, 16 nt, Pseudomonas aeruginosa PA01
guuuccagcagcaccc

SEQ ID NO: 1412316 - RNA, 18 nt, Pseudomonas aeruginosa PA01
guuuccccguggcgccgc

SEQ ID NO: 1412317 - RNA, 20 nt, Pseudomonas aeruginosa PA01
agccuggcgcgcugcggcag

SEQ ID NO: 1412318 - RNA, 18 nt, Pseudomonas aeruginosa PA01
agccuggcgucgcacugc

SEQ ID NO: 1412319 - RNA, 14 nt, Pseudomonas aeruginosa PA01
agccuggccagcgc

SEQ ID NO: 1412320 - RNA, 22 nt, Pseudomonas aeruginosa PA01
agccuggccagcgcuucgcgau

SEQ ID NO: 1412321 - RNA, 14 nt, Pseudomonas aeruginosa PA01
agccuggccaggcg

SEQ ID NO: 1412322 - RNA, 16 nt, Pseudomonas aeruginosa PA01
agccuggccaggcgcu

SEQ ID NO: 1412323 - RNA, 14 nt, Pseudomonas aeruginosa PA01
agccuggagcaggg

SEQ ID NO: 1412324 - RNA, 20 nt, Pseudomonas aeruginosa PA01
agccuggauacgggcgccag

SEQ ID NO: 1412325 - RNA, 22 nt, Pseudomonas aeruginosa PA01
agccuggauacgggcgccaggg

SEQ ID NO: 1412326 - RNA, 18 nt, Pseudomonas aeruginosa PA01
agccugcggccagcgcca

SEQ ID NO: 1412327 - RNA, 20 nt, Pseudomonas aeruginosa PA01
agccugcggccagcgccagg

SEQ ID NO: 1412328 - RNA, 13 nt, Pseudomonas aeruginosa PA01
agccugcggcgag

SEQ ID NO: 1412329 - RNA, 16 nt, Pseudomonas aeruginosa PA01
agccugccgggcaagc

SEQ ID NO: 1412330 - RNA, 23 nt, Pseudomonas aeruginosa PA01
agccugccgggcaagcucgacga

SEQ ID NO: 1412331 - RNA, 14 nt, Pseudomonas aeruginosa PA01
agccugcagccagc

SEQ ID NO: 1412332 - RNA, 18 nt, Pseudomonas aeruginosa PA01
agccucggcagggcgccc

SEQ ID NO: 1412333 - RNA, 17 nt, Pseudomonas aeruginosa PA01
agccucgcgcucggcgg

SEQ ID NO: 1412334 - RNA, 18 nt, Pseudomonas aeruginosa PA01
agccucgcgcucggcggc

SEQ ID NO: 1412335 - RNA, 20 nt, Pseudomonas aeruginosa PA01
agccucgcgcucggcggccu

SEQ ID NO: 1412336 - RNA, 23 nt, Pseudomonas aeruginosa PA01
agccucgcguucgcggucgguga

SEQ ID NO: 1412337 - RNA, 14 nt, Pseudomonas aeruginosa PA01
agccuccagcagcu

SEQ ID NO: 1412338 - RNA, 15 nt, Pseudomonas aeruginosa PA01
agccuccagcagcuc

SEQ ID NO: 1412339 - RNA, 17 nt, Pseudomonas aeruginosa PA01
agccucccgccgcggcg

SEQ ID NO: 1412340 - RNA, 23 nt, Pseudomonas aeruginosa PA01
agccguagauggucagcaacugc

SEQ ID NO: 1412341 - RNA, 18 nt, Pseudomonas aeruginosa PA01
agccguagaacgccagga

SEQ ID NO: 1412342 - RNA, 16 nt, Pseudomonas aeruginosa PA01
agccucacccugcugg

SEQ ID NO: 1412343 - RNA, 20 nt, Pseudomonas aeruginosa PA01
agccucacccugcugggcgg

SEQ ID NO: 1412344 - RNA, 19 nt, Pseudomonas aeruginosa PA01
agccgucaagcaacggcga

SEQ ID NO: 1412345 - RNA, 16 nt, Pseudomonas aeruginosa PA01
agcgaccggauggcuc

SEQ ID NO: 1412346 - RNA, 13 nt, Pseudomonas aeruginosa PA01
agcgaagcuggcg

SEQ ID NO: 1412347 - RNA, 12 nt, Pseudomonas aeruginosa PA01
agcgaaccaggc

SEQ ID NO: 1412348 - RNA, 19 nt, Pseudomonas aeruginosa PA01
agcgaacccaggccgcgca

SEQ ID NO: 1412349 - RNA, 21 nt, Pseudomonas aeruginosa PA01
agcgaacgggcguugccggca

SEQ ID NO: 1412350 - RNA, 13 nt, Pseudomonas aeruginosa PA01
agcgaaccgccgg

SEQ ID NO: 1412351 - RNA, 14 nt, Pseudomonas aeruginosa PA01
agcgaaccgccggc

SEQ ID NO: 1412352 - RNA, 22 nt, Pseudomonas aeruginosa PA01
agcgaaacucgugcuccaccuc

SEQ ID NO: 1412353 - RNA, 19 nt, Pseudomonas aeruginosa PA01
agccuuuuuugugcccgcc

SEQ ID NO: 1412354 - RNA, 17 nt, Pseudomonas aeruginosa PA01
agcgacgccgcgauggc

SEQ ID NO: 1412355 - RNA, 17 nt, Pseudomonas aeruginosa PA01
agcgacucguagucgau

SEQ ID NO: 1412356 - RNA, 11 nt, Pseudomonas aeruginosa PA01
agcgacucgcu

SEQ ID NO: 1412357 - RNA, 21 nt, Pseudomonas aeruginosa PA01
agcgacucgcugccggcgcgc

SEQ ID NO: 1412358 - RNA, 15 nt, Pseudomonas aeruginosa PA01
agcgacuccgccagu

SEQ ID NO: 1412359 - RNA, 13 nt, Pseudomonas aeruginosa PA01
agcgacucgaugc

SEQ ID NO: 1412360 - RNA, 13 nt, Pseudomonas aeruginosa PA01
agcgacuccagcc

SEQ ID NO: 1412361 - RNA, 18 nt, Pseudomonas aeruginosa PA01
agcgacuccagccaggcg

SEQ ID NO: 1412362 - RNA, 16 nt, Pseudomonas aeruginosa PA01
agcgagaacuugccgg

SEQ ID NO: 1412363 - RNA, 18 nt, Pseudomonas aeruginosa PA01
agcgagaacuugccggcg

SEQ ID NO: 1412364 - RNA, 23 nt, Pseudomonas aeruginosa PA01
agcgagaacuugccggcgccauc

SEQ ID NO: 1412365 - RNA, 14 nt, Pseudomonas aeruginosa PA01
agcgagaccucgcc

SEQ ID NO: 1412366 - RNA, 19 nt, Pseudomonas aeruginosa PA01
agcgagacgccgccccagc

SEQ ID NO: 1412367 - RNA, 21 nt, Pseudomonas aeruginosa PA01
agcgagacgccgccccagccu

SEQ ID NO: 1412368 - RNA, 21 nt, Pseudomonas aeruginosa PA01
agccggcgaucauccagcccc

SEQ ID NO: 1412369 - RNA, 18 nt, Pseudomonas aeruginosa PA01
agccggcgaugccgccca

SEQ ID NO: 1412370 - RNA, 23 nt, Pseudomonas aeruginosa PA01
agccggcgaugugcggcguggcg

SEQ ID NO: 1412371 - RNA, 13 nt, Pseudomonas aeruginosa PA01
agccggcgagcgc

SEQ ID NO: 1412372 - RNA, 20 nt, Pseudomonas aeruginosa PA01
agccggcgaacagguagccc

SEQ ID NO: 1412373 - RNA, 16 nt, Pseudomonas aeruginosa PA01
agccggcauccagcau

SEQ ID NO: 1412374 - RNA, 12 nt, Pseudomonas aeruginosa PA01
agccggccaggg

SEQ ID NO: 1412375 - RNA, 15 nt, Pseudomonas aeruginosa PA01
agccggccagggcgc

SEQ ID NO: 1412376 - RNA, 19 nt, Pseudomonas aeruginosa PA01
agccggccagggcgcggua

SEQ ID NO: 1412377 - RNA, 21 nt, Pseudomonas aeruginosa PA01
agccggccauccagccaggcg

SEQ ID NO: 1412378 - RNA, 20 nt, Pseudomonas aeruginosa PA01
agccggcccauccgccgcag

SEQ ID NO: 1412379 - RNA, 17 nt, Pseudomonas aeruginosa PA01
agccggccccugggccg

SEQ ID NO: 1412380 - RNA, 20 nt, Pseudomonas aeruginosa PA01
agccggcgcgcccggcgccc

SEQ ID NO: 1412381 - RNA, 15 nt, Pseudomonas aeruginosa PA01
agccggcgccgucga

SEQ ID NO: 1412382 - RNA, 16 nt, Pseudomonas aeruginosa PA01
agccggcgcaucagcg

SEQ ID NO: 1412383 - RNA, 19 nt, Pseudomonas aeruginosa PA01
agccggcgcaucagcgccg

SEQ ID NO: 1412384 - RNA, 13 nt, Pseudomonas aeruginosa PA01
agccggcgcaugc

SEQ ID NO: 1412385 - RNA, 17 nt, Pseudomonas aeruginosa PA01
agccggcgcaugcgccg

SEQ ID NO: 1412386 - RNA, 20 nt, Pseudomonas aeruginosa PA01
agccggcgcaugcgccggcu

SEQ ID NO: 1412387 - RNA, 14 nt, Pseudomonas aeruginosa PA01
agccggcggcgaac

SEQ ID NO: 1412388 - RNA, 20 nt, Pseudomonas aeruginosa PA01
agccggcuuccucgcccuca

SEQ ID NO: 1412389 - RNA, 14 nt, Pseudomonas aeruginosa PA01
agccgggaagccgc

SEQ ID NO: 1412390 - RNA, 14 nt, Pseudomonas aeruginosa PA01
agccggcggcgcgg

SEQ ID NO: 1412391 - RNA, 15 nt, Pseudomonas aeruginosa PA01
agccggcggcgcggc

SEQ ID NO: 1412392 - RNA, 13 nt, Pseudomonas aeruginosa PA01
agccggcugccga

SEQ ID NO: 1412393 - RNA, 20 nt, Pseudomonas aeruginosa PA01
agccggcugccgaagaucga

SEQ ID NO: 1412394 - RNA, 19 nt, Pseudomonas aeruginosa PA01
agccggugaaacggaucac

SEQ ID NO: 1412395 - RNA, 19 nt, Pseudomonas aeruginosa PA01
agccgguaggggccgacga

SEQ ID NO: 1412396 - RNA, 15 nt, Pseudomonas aeruginosa PA01
agccggugccggcgg

SEQ ID NO: 1412397 - RNA, 19 nt, Pseudomonas aeruginosa PA01
agccgggguugaguugcag

SEQ ID NO: 1412398 - RNA, 23 nt, Pseudomonas aeruginosa PA01
agccgggguugaguugcaggccg

SEQ ID NO: 1412399 - RNA, 14 nt, Pseudomonas aeruginosa PA01
agccgggcgugucg

SEQ ID NO: 1412400 - RNA, 22 nt, Pseudomonas aeruginosa PA01
agccggggcucaggccuuggcu

SEQ ID NO: 1412401 - RNA, 19 nt, Pseudomonas aeruginosa PA01
agccggguucccaguugcu

SEQ ID NO: 1412402 - RNA, 16 nt, Pseudomonas aeruginosa PA01
agccgguacugcgcca

SEQ ID NO: 1412403 - RNA, 16 nt, Pseudomonas aeruginosa PA01
agcccuuucagcggcu

SEQ ID NO: 1412404 - RNA, 20 nt, Pseudomonas aeruginosa PA01
agcccuuuucaauuccgccg

SEQ ID NO: 1412405 - RNA, 21 nt, Pseudomonas aeruginosa PA01
agcccuuuucaauuccgccgc

SEQ ID NO: 1412406 - RNA, 22 nt, Pseudomonas aeruginosa PA01
agcccuuuucaauuccgccgcg

SEQ ID NO: 1412407 - RNA, 23 nt, Pseudomonas aeruginosa PA01
agccgaacggguagagcgggccg

SEQ ID NO: 1412408 - RNA, 14 nt, Pseudomonas aeruginosa PA01
agccgaagucggcg

SEQ ID NO: 1412409 - RNA, 13 nt, Pseudomonas aeruginosa PA01
agccgacuggcgg

SEQ ID NO: 1412410 - RNA, 18 nt, Pseudomonas aeruginosa PA01
agccgacuggcgguacgc

SEQ ID NO: 1412411 - RNA, 19 nt, Pseudomonas aeruginosa PA01
agccgagcaacucggcggc

SEQ ID NO: 1412412 - RNA, 13 nt, Pseudomonas aeruginosa PA01
agccgaucggcau

SEQ ID NO: 1412413 - RNA, 19 nt, Pseudomonas aeruginosa PA01
agccgagcccccauaccgc

SEQ ID NO: 1412414 - RNA, 19 nt, Pseudomonas aeruginosa PA01
agccgagcggcaaggccaa

SEQ ID NO: 1412415 - RNA, 15 nt, Pseudomonas aeruginosa PA01
agccgcaaggccagg

SEQ ID NO: 1412416 - RNA, 20 nt, Pseudomonas aeruginosa PA01
agccgcaaggccagggcggc

SEQ ID NO: 1412417 - RNA, 17 nt, Pseudomonas aeruginosa PA01
agccgaugcucgcgcca

SEQ ID NO: 1412418 - RNA, 20 nt, Pseudomonas aeruginosa PA01
agccgaugaaauagccggcg

SEQ ID NO: 1412419 - RNA, 22 nt, Pseudomonas aeruginosa PA01
agcccggguugcccucgcagcc

SEQ ID NO: 1412420 - RNA, 23 nt, Pseudomonas aeruginosa PA01
agcccgguccguccagcgcgccc

SEQ ID NO: 1412421 - RNA, 20 nt, Pseudomonas aeruginosa PA01
agcccguugcgguagugccc

SEQ ID NO: 1412422 - RNA, 23 nt, Pseudomonas aeruginosa PA01
agcccguugcgguagugcccggu

SEQ ID NO: 1412423 - RNA, 15 nt, Pseudomonas aeruginosa PA01
agcccuucuccgcca

SEQ ID NO: 1412424 - RNA, 17 nt, Pseudomonas aeruginosa PA01
agcccuucuccgccagc

SEQ ID NO: 1412425 - RNA, 16 nt, Pseudomonas aeruginosa PA01
agcccuugcaaccgcc

SEQ ID NO: 1412426 - RNA, 18 nt, Pseudomonas aeruginosa PA01
agcccguguucggccagc

SEQ ID NO: 1412427 - RNA, 20 nt, Pseudomonas aeruginosa PA01
agcccguguucggccagccg

SEQ ID NO: 1412428 - RNA, 13 nt, Pseudomonas aeruginosa PA01
agccaccgccgac

SEQ ID NO: 1412429 - RNA, 14 nt, Pseudomonas aeruginosa PA01
agccaccgccgaca

SEQ ID NO: 1412430 - RNA, 16 nt, Pseudomonas aeruginosa PA01
agccacccgcucgacc

SEQ ID NO: 1412431 - RNA, 15 nt, Pseudomonas aeruginosa PA01
agccaccagccgaac

SEQ ID NO: 1412432 - RNA, 15 nt, Pseudomonas aeruginosa PA01
agccacccagcagca

SEQ ID NO: 1412433 - RNA, 12 nt, Pseudomonas aeruginosa PA01
agcccggccugg

SEQ ID NO: 1412434 - RNA, 21 nt, Pseudomonas aeruginosa PA01
agcccggccuggaucucugcg

SEQ ID NO: 1412435 - RNA, 14 nt, Pseudomonas aeruginosa PA01
agcccggccuggug

SEQ ID NO: 1412436 - RNA, 19 nt, Pseudomonas aeruginosa PA01
agccaccgggaucuggccc

SEQ ID NO: 1412437 - RNA, 16 nt, Pseudomonas aeruginosa PA01
agccaccuucgaucac

SEQ ID NO: 1412438 - RNA, 17 nt, Pseudomonas aeruginosa PA01
agcccggcggugaugcc

SEQ ID NO: 1412439 - RNA, 20 nt, Pseudomonas aeruginosa PA01
agcccggcgugggcggucgg

SEQ ID NO: 1412440 - RNA, 18 nt, Pseudomonas aeruginosa PA01
agcccgggcaacugccga

SEQ ID NO: 1412441 - RNA, 23 nt, Pseudomonas aeruginosa PA01
agccgcuuggagcgggcgccgga

SEQ ID NO: 1412442 - RNA, 18 nt, Pseudomonas aeruginosa PA01
agccggaaaacagcgagc

SEQ ID NO: 1412443 - RNA, 13 nt, Pseudomonas aeruginosa PA01
agccggaagcgcu

SEQ ID NO: 1412444 - RNA, 13 nt, Pseudomonas aeruginosa PA01
agccgcuggcguc

SEQ ID NO: 1412445 - RNA, 15 nt, Pseudomonas aeruginosa PA01
agccgcuggcgucga

SEQ ID NO: 1412446 - RNA, 20 nt, Pseudomonas aeruginosa PA01
agccgcugguccagcuggcg

SEQ ID NO: 1412447 - RNA, 22 nt, Pseudomonas aeruginosa PA01
agccgcugguccagcuggcgca

SEQ ID NO: 1412448 - RNA, 22 nt, Pseudomonas aeruginosa PA01
agccgcuggcauacacaugcag

SEQ ID NO: 1412449 - RNA, 13 nt, Pseudomonas aeruginosa PA01
agccggaggcagc

SEQ ID NO: 1412450 - RNA, 21 nt, Pseudomonas aeruginosa PA01
agccggaccucucucgcugcg

SEQ ID NO: 1412451 - RNA, 21 nt, Pseudomonas aeruginosa PA01
agccggaccagccguccgcgg

SEQ ID NO: 1412452 - RNA, 13 nt, Pseudomonas aeruginosa PA01
agccggacggcgg

SEQ ID NO: 1412453 - RNA, 16 nt, Pseudomonas aeruginosa PA01
agccggacggcggcgu

SEQ ID NO: 1412454 - RNA, 18 nt, Pseudomonas aeruginosa PA01
agccggauucgcgcagca

SEQ ID NO: 1412455 - RNA, 21 nt, Pseudomonas aeruginosa PA01
agccggauagaucaggccggc

SEQ ID NO: 1412456 - RNA, 19 nt, Pseudomonas aeruginosa PA01
agccgcucggccgccagca

SEQ ID NO: 1412457 - RNA, 13 nt, Pseudomonas aeruginosa PA01
agccgcucggcgg

SEQ ID NO: 1412458 - RNA, 17 nt, Pseudomonas aeruginosa PA01
agccgcugcagggcggc

SEQ ID NO: 1412459 - RNA, 17 nt, Pseudomonas aeruginosa PA01
agccgcugcggcucgcc

SEQ ID NO: 1412460 - RNA, 18 nt, Pseudomonas aeruginosa PA01
agccgcugcggcucgccg

SEQ ID NO: 1412461 - RNA, 14 nt, Pseudomonas aeruginosa PA01
agccgcgcgccgca

SEQ ID NO: 1412462 - RNA, 15 nt, Pseudomonas aeruginosa PA01
agccgcgcgccagca

SEQ ID NO: 1412463 - RNA, 18 nt, Pseudomonas aeruginosa PA01
agccgccguugaugacga

SEQ ID NO: 1412464 - RNA, 18 nt, Pseudomonas aeruginosa PA01
agccgccggggaagcugc

SEQ ID NO: 1412465 - RNA, 17 nt, Pseudomonas aeruginosa PA01
agccgcggcgccacgcu

SEQ ID NO: 1412466 - RNA, 18 nt, Pseudomonas aeruginosa PA01
agccgcggcgccacgcuc

SEQ ID NO: 1412467 - RNA, 14 nt, Pseudomonas aeruginosa PA01
agccgcgugcgcgc

SEQ ID NO: 1412468 - RNA, 18 nt, Pseudomonas aeruginosa PA01
agccgcgugcgcgccgcc

SEQ ID NO: 1412469 - RNA, 19 nt, Pseudomonas aeruginosa PA01
agccgcgugcgcgccgccg

SEQ ID NO: 1412470 - RNA, 23 nt, Pseudomonas aeruginosa PA01
agccgcgugcgcgccgccgggcg

SEQ ID NO: 1412471 - RNA, 19 nt, Pseudomonas aeruginosa PA01
agccgccgggaaucuggcc

SEQ ID NO: 1412472 - RNA, 20 nt, Pseudomonas aeruginosa PA01
agccgccgggaaucuggccg

SEQ ID NO: 1412473 - RNA, 20 nt, Pseudomonas aeruginosa PA01
agccgccgggacccugguag

SEQ ID NO: 1412474 - RNA, 20 nt, Pseudomonas aeruginosa PA01
agccgcagcgccccucccag

SEQ ID NO: 1412475 - RNA, 19 nt, Pseudomonas aeruginosa PA01
agccgcacuuccaggcgcc

SEQ ID NO: 1412476 - RNA, 14 nt, Pseudomonas aeruginosa PA01
agccgcagaugcuc

SEQ ID NO: 1412477 - RNA, 18 nt, Pseudomonas aeruginosa PA01
agccgcaguccagggcga

SEQ ID NO: 1412478 - RNA, 20 nt, Pseudomonas aeruginosa PA01
agccgcaggaugccgccugc

SEQ ID NO: 1412479 - RNA, 15 nt, Pseudomonas aeruginosa PA01
agccgcaggcugccg

SEQ ID NO: 1412480 - RNA, 15 nt, Pseudomonas aeruginosa PA01
agcgaugggcgagac

SEQ ID NO: 1412481 - RNA, 21 nt, Pseudomonas aeruginosa PA01
agcgaugcgguuccuggcugg

SEQ ID NO: 1412482 - RNA, 19 nt, Pseudomonas aeruginosa PA01
agcgcaacgaaaagccgcc

SEQ ID NO: 1412483 - RNA, 23 nt, Pseudomonas aeruginosa PA01
agcgcaacgaaaagccgccccga

SEQ ID NO: 1412484 - RNA, 18 nt, Pseudomonas aeruginosa PA01
agcgcaacgcgcgcagga

SEQ ID NO: 1412485 - RNA, 14 nt, Pseudomonas aeruginosa PA01
agcgcaagucggcc

SEQ ID NO: 1412486 - RNA, 15 nt, Pseudomonas aeruginosa PA01
agcgcaagcggcggc

SEQ ID NO: 1412487 - RNA, 14 nt, Pseudomonas aeruginosa PA01
agcgccaggagcag

SEQ ID NO: 1412488 - RNA, 16 nt, Pseudomonas aeruginosa PA01
agcgccaggagcaggg

SEQ ID NO: 1412489 - RNA, 17 nt, Pseudomonas aeruginosa PA01
agcgccaggagcagggc

SEQ ID NO: 1412490 - RNA, 12 nt, Pseudomonas aeruginosa PA01
agcgccaggaac

SEQ ID NO: 1412491 - RNA, 21 nt, Pseudomonas aeruginosa PA01
agcgccaggaacgccucugcg

SEQ ID NO: 1412492 - RNA, 20 nt, Pseudomonas aeruginosa PA01
agcgccaggaagccgcgccc

SEQ ID NO: 1412493 - RNA, 22 nt, Pseudomonas aeruginosa PA01
agcgccgaacaggguugggcga

SEQ ID NO: 1412494 - RNA, 15 nt, Pseudomonas aeruginosa PA01
agcgcccucgcugag

SEQ ID NO: 1412495 - RNA, 20 nt, Pseudomonas aeruginosa PA01
agcgccaugacccgcggcag

SEQ ID NO: 1412496 - RNA, 18 nt, Pseudomonas aeruginosa PA01
agcgccaggccgaucagc

SEQ ID NO: 1412497 - RNA, 11 nt, Pseudomonas aeruginosa PA01
agcgccaggcg

SEQ ID NO: 1412498 - RNA, 14 nt, Pseudomonas aeruginosa PA01
agcgccaggcgcaa

SEQ ID NO: 1412499 - RNA, 12 nt, Pseudomonas aeruginosa PA01
agcgccagggcc

SEQ ID NO: 1412500 - RNA, 19 nt, Pseudomonas aeruginosa PA01
agcgccagguaguccagcg

SEQ ID NO: 1412501 - RNA, 14 nt, Pseudomonas aeruginosa PA01
agcgccaucaggcc

SEQ ID NO: 1412502 - RNA, 21 nt, Pseudomonas aeruginosa PA01
agcgccaguuggacgcggccu

SEQ ID NO: 1412503 - RNA, 14 nt, Pseudomonas aeruginosa PA01
agcgccgccgcguc

SEQ ID NO: 1412504 - RNA, 19 nt, Pseudomonas aeruginosa PA01
agcgccgccgcgucgucgg

SEQ ID NO: 1412505 - RNA, 20 nt, Pseudomonas aeruginosa PA01
agcgccgccgcgucgucggc

SEQ ID NO: 1412506 - RNA, 22 nt, Pseudomonas aeruginosa PA01
agcgccgccgcgucgucggcga

SEQ ID NO: 1412507 - RNA, 23 nt, Pseudomonas aeruginosa PA01
agcgccgccgcgugggcuucgcc

SEQ ID NO: 1412508 - RNA, 15 nt, Pseudomonas aeruginosa PA01
agcgccgcgccaacu

SEQ ID NO: 1412509 - RNA, 21 nt, Pseudomonas aeruginosa PA01
agcgccgcgccaacuggcgca

SEQ ID NO: 1412510 - RNA, 17 nt, Pseudomonas aeruginosa PA01
agcgccgcgcagcgcgg

SEQ ID NO: 1412511 - RNA, 15 nt, Pseudomonas aeruginosa PA01
agcgccgccuugagc

SEQ ID NO: 1412512 - RNA, 13 nt, Pseudomonas aeruginosa PA01
agcgccgcgaaca

SEQ ID NO: 1412513 - RNA, 22 nt, Pseudomonas aeruginosa PA01
agcgccgcgaacacacccugcg

SEQ ID NO: 1412514 - RNA, 13 nt, Pseudomonas aeruginosa PA01
agcgccgccggua

SEQ ID NO: 1412515 - RNA, 23 nt, Pseudomonas aeruginosa PA01
agcgccgccucgaaggccggcaa

SEQ ID NO: 1412516 - RNA, 13 nt, Pseudomonas aeruginosa PA01
agcgccgccucgc

SEQ ID NO: 1412517 - RNA, 15 nt, Pseudomonas aeruginosa PA01
agcgccgccugcugg

SEQ ID NO: 1412518 - RNA, 17 nt, Pseudomonas aeruginosa PA01
agcgccgccugcuggcu

SEQ ID NO: 1412519 - RNA, 17 nt, Pseudomonas aeruginosa PA01
agcgccgccagcaggau

SEQ ID NO: 1412520 - RNA, 23 nt, Pseudomonas aeruginosa PA01
agcgccgcccuguucgucuggcg

SEQ ID NO: 1412521 - RNA, 13 nt, Pseudomonas aeruginosa PA01
agcgccgccaggc

SEQ ID NO: 1412522 - RNA, 15 nt, Pseudomonas aeruginosa PA01
agcgccgccaggcag

SEQ ID NO: 1412523 - RNA, 23 nt, Pseudomonas aeruginosa PA01
agcgccgccaggcagaccaggcc

SEQ ID NO: 1412524 - RNA, 15 nt, Pseudomonas aeruginosa PA01
agcgccgcaggcgcu

SEQ ID NO: 1412525 - RNA, 16 nt, Pseudomonas aeruginosa PA01
agcgccgcaggcgcua

SEQ ID NO: 1412526 - RNA, 21 nt, Pseudomonas aeruginosa PA01
agcgccgcauuggccaggccc

SEQ ID NO: 1412527 - RNA, 13 nt, Pseudomonas aeruginosa PA01
agcgccgccaacc

SEQ ID NO: 1412528 - RNA, 19 nt, Pseudomonas aeruginosa PA01
agcgccgggccgcaucgcg

SEQ ID NO: 1412529 - RNA, 11 nt, Pseudomonas aeruginosa PA01
agcgccggcgg

SEQ ID NO: 1412530 - RNA, 15 nt, Pseudomonas aeruginosa PA01
agcgccggcggccug

SEQ ID NO: 1412531 - RNA, 19 nt, Pseudomonas aeruginosa PA01
agcgccucgaccucggccg

SEQ ID NO: 1412532 - RNA, 17 nt, Pseudomonas aeruginosa PA01
agcgccuccaucgacuc

SEQ ID NO: 1412533 - RNA, 13 nt, Pseudomonas aeruginosa PA01
agcgccuccagca

SEQ ID NO: 1412534 - RNA, 21 nt, Pseudomonas aeruginosa PA01
agcgccgucaccagcagcccc

SEQ ID NO: 1412535 - RNA, 18 nt, Pseudomonas aeruginosa PA01
agcgccguucacgccugg

SEQ ID NO: 1412536 - RNA, 21 nt, Pseudomonas aeruginosa PA01
agcgccguucacgccuggcgg

SEQ ID NO: 1412537 - RNA, 21 nt, Pseudomonas aeruginosa PA01
agcgccguugccgaugccgga

SEQ ID NO: 1412538 - RNA, 16 nt, Pseudomonas aeruginosa PA01
agcgccguugcggcag

SEQ ID NO: 1412539 - RNA, 18 nt, Pseudomonas aeruginosa PA01
agcgccguugcggcagca

SEQ ID NO: 1412540 - RNA, 17 nt, Pseudomonas aeruginosa PA01
agcgccuggucggcggc

SEQ ID NO: 1412541 - RNA, 19 nt, Pseudomonas aeruginosa PA01
agcgccuucugcgugggca

SEQ ID NO: 1412542 - RNA, 23 nt, Pseudomonas aeruginosa PA01
agcgccuucaccguucccagcag

SEQ ID NO: 1412543 - RNA, 23 nt, Pseudomonas aeruginosa PA01
agcgcgcccggcgccaccccgcc

SEQ ID NO: 1412544 - RNA, 17 nt, Pseudomonas aeruginosa PA01
agcgcgccgagccaggu

SEQ ID NO: 1412545 - RNA, 14 nt, Pseudomonas aeruginosa PA01
agcgcgcccagguc

SEQ ID NO: 1412546 - RNA, 18 nt, Pseudomonas aeruginosa PA01
agcgcgccaucggcggua

SEQ ID NO: 1412547 - RNA, 17 nt, Pseudomonas aeruginosa PA01
agcgcgaaagcgccccg

SEQ ID NO: 1412548 - RNA, 18 nt, Pseudomonas aeruginosa PA01
agcgcgaaggcgccuucc

SEQ ID NO: 1412549 - RNA, 22 nt, Pseudomonas aeruginosa PA01
agcgcgaaggcgccuuccaggc

SEQ ID NO: 1412550 - RNA, 15 nt, Pseudomonas aeruginosa PA01
agcgcgcaggcgcua

SEQ ID NO: 1412551 - RNA, 16 nt, Pseudomonas aeruginosa PA01
agcgcgacaucggcga

SEQ ID NO: 1412552 - RNA, 20 nt, Pseudomonas aeruginosa PA01
agcgcgcucggccuggugca

SEQ ID NO: 1412553 - RNA, 21 nt, Pseudomonas aeruginosa PA01
agcgcgcuguagccggcgccg

SEQ ID NO: 1412554 - RNA, 22 nt, Pseudomonas aeruginosa PA01
agcgcggaaaaucaaaaccagc

SEQ ID NO: 1412555 - RNA, 17 nt, Pseudomonas aeruginosa PA01
agcgcggcaacgaaaac

SEQ ID NO: 1412556 - RNA, 23 nt, Pseudomonas aeruginosa PA01
agcgcggaucagucaggaucggc

SEQ ID NO: 1412557 - RNA, 24 nt, Pseudomonas aeruginosa PA01
agcgcggccacuucguccggccgc

SEQ ID NO: 1412558 - RNA, 16 nt, Pseudomonas aeruginosa PA01
agcgcggugagcaggg

SEQ ID NO: 1412559 - RNA, 18 nt, Pseudomonas aeruginosa PA01
agcgcgucggcacgccga

SEQ ID NO: 1412560 - RNA, 19 nt, Pseudomonas aeruginosa PA01
agcgcgucggcacgccgaa

SEQ ID NO: 1412561 - RNA, 21 nt, Pseudomonas aeruginosa PA01
agcgcggugcgguuguucgcc

SEQ ID NO: 1412562 - RNA, 22 nt, Pseudomonas aeruginosa PA01
agcgcggcuucagagcuggacg

SEQ ID NO: 1412563 - RNA, 16 nt, Pseudomonas aeruginosa PA01
agcgcggucauccgcc

SEQ ID NO: 1412564 - RNA, 15 nt, Pseudomonas aeruginosa PA01
agcgcggucacccau

SEQ ID NO: 1412565 - RNA, 22 nt, Pseudomonas aeruginosa PA01
agcgcggucacccauucgaugc

SEQ ID NO: 1412566 - RNA, 16 nt, Pseudomonas aeruginosa PA01
agcgcugcgccaggcu

SEQ ID NO: 1412567 - RNA, 12 nt, Pseudomonas aeruginosa PA01
agcgcugcgccc

SEQ ID NO: 1412568 - RNA, 17 nt, Pseudomonas aeruginosa PA01
agcgcugcgcccgcucg

SEQ ID NO: 1412569 - RNA, 22 nt, Pseudomonas aeruginosa PA01
agcgcugcgcccgcucgacccg

SEQ ID NO: 1412570 - RNA, 17 nt, Pseudomonas aeruginosa PA01
agcgcguucaccccgcc

SEQ ID NO: 1412571 - RNA, 14 nt, Pseudomonas aeruginosa PA01
agcgcugcugggcg

SEQ ID NO: 1412572 - RNA, 18 nt, Pseudomonas aeruginosa PA01
agcgcugcugggcggcga

SEQ ID NO: 1412573 - RNA, 22 nt, Pseudomonas aeruginosa PA01
agcgcuucauccugcgcgccuc

SEQ ID NO: 1412574 - RNA, 19 nt, Pseudomonas aeruginosa PA01
agcgcuuccaccgccugcc

SEQ ID NO: 1412575 - RNA, 22 nt, Pseudomonas aeruginosa PA01
agcgcuuccaccgccugcccca

SEQ ID NO: 1412576 - RNA, 15 nt, Pseudomonas aeruginosa PA01
agcgcugaucacgau

SEQ ID NO: 1412577 - RNA, 23 nt, Pseudomonas aeruginosa PA01
agcgcgugcaggcgcccuggccg

SEQ ID NO: 1412578 - RNA, 17 nt, Pseudomonas aeruginosa PA01
agcguagggcgaauaac

SEQ ID NO: 1412579 - RNA, 17 nt, Pseudomonas aeruginosa PA01
agcguaucgaugcgcgc

SEQ ID NO: 1412580 - RNA, 15 nt, Pseudomonas aeruginosa PA01
agcgucaccgcgccg

SEQ ID NO: 1412581 - RNA, 23 nt, Pseudomonas aeruginosa PA01
agcgucaccgcgucgggaaaggc

SEQ ID NO: 1412582 - RNA, 16 nt, Pseudomonas aeruginosa PA01
agcgucacucccaggc

SEQ ID NO: 1412583 - RNA, 16 nt, Pseudomonas aeruginosa PA01
agcguccaggugcggc

SEQ ID NO: 1412584 - RNA, 16 nt, Pseudomonas aeruginosa PA01
agcguccaccagcgcc

SEQ ID NO: 1412585 - RNA, 17 nt, Pseudomonas aeruginosa PA01
agcguccaccagcgccc

SEQ ID NO: 1412586 - RNA, 18 nt, Pseudomonas aeruginosa PA01
agcgucagcgcgccagca

SEQ ID NO: 1412587 - RNA, 18 nt, Pseudomonas aeruginosa PA01
agcgggcgagggcggcgc

SEQ ID NO: 1412588 - RNA, 20 nt, Pseudomonas aeruginosa PA01
agcgggcgagggcggcgcgg

SEQ ID NO: 1412589 - RNA, 14 nt, Pseudomonas aeruginosa PA01
agcgggcgccgccg

SEQ ID NO: 1412590 - RNA, 23 nt, Pseudomonas aeruginosa PA01
agcgggcgcuugaagccggcgua

SEQ ID NO: 1412591 - RNA, 15 nt, Pseudomonas aeruginosa PA01
agcggcggcgccggc

SEQ ID NO: 1412592 - RNA, 19 nt, Pseudomonas aeruginosa PA01
agcggcggauacaggcgca

SEQ ID NO: 1412593 - RNA, 14 nt, Pseudomonas aeruginosa PA01
agcggcggccgucg

SEQ ID NO: 1412594 - RNA, 17 nt, Pseudomonas aeruginosa PA01
agcggcgguacauggcc

SEQ ID NO: 1412595 - RNA, 17 nt, Pseudomonas aeruginosa PA01
agcggcgguagcuccag

SEQ ID NO: 1412596 - RNA, 14 nt, Pseudomonas aeruginosa PA01
agcggcggugcgcc

SEQ ID NO: 1412597 - RNA, 15 nt, Pseudomonas aeruginosa PA01
agcggcggugcgccg

SEQ ID NO: 1412598 - RNA, 13 nt, Pseudomonas aeruginosa PA01
agcgggccucggc

SEQ ID NO: 1412599 - RNA, 18 nt, Pseudomonas aeruginosa PA01
agcgguucaggucgaggc

SEQ ID NO: 1412600 - RNA, 18 nt, Pseudomonas aeruginosa PA01
agcgguauugucgauggg

SEQ ID NO: 1412601 - RNA, 19 nt, Pseudomonas aeruginosa PA01
agcgguauugucgaugggc

SEQ ID NO: 1412602 - RNA, 21 nt, Pseudomonas aeruginosa PA01
agcgguauugucgaugggcag

SEQ ID NO: 1412603 - RNA, 18 nt, Pseudomonas aeruginosa PA01
agcgguaguucagucggu

SEQ ID NO: 1412604 - RNA, 19 nt, Pseudomonas aeruginosa PA01
agcgguagugggcgaggcg

SEQ ID NO: 1412605 - RNA, 23 nt, Pseudomonas aeruginosa PA01
agcggggcuuuuuccaacgcgcg

SEQ ID NO: 1412606 - RNA, 15 nt, Pseudomonas aeruginosa PA01
agcgguacaggcgga

SEQ ID NO: 1412607 - RNA, 16 nt, Pseudomonas aeruginosa PA01
agcgguaccagcagcg

SEQ ID NO: 1412608 - RNA, 17 nt, Pseudomonas aeruginosa PA01
agcgguaccagcagcgc

SEQ ID NO: 1412609 - RNA, 22 nt, Pseudomonas aeruginosa PA01
agcgguaccagcagcgccgaac

SEQ ID NO: 1412610 - RNA, 17 nt, Pseudomonas aeruginosa PA01
agcgguacccgccggcc

SEQ ID NO: 1412611 - RNA, 22 nt, Pseudomonas aeruginosa PA01
agcgguacuaucccggucgggu

SEQ ID NO: 1412612 - RNA, 17 nt, Pseudomonas aeruginosa PA01
agcgguagaacaggcga

SEQ ID NO: 1412613 - RNA, 16 nt, Pseudomonas aeruginosa PA01
agcgggcguccggcga

SEQ ID NO: 1412614 - RNA, 23 nt, Pseudomonas aeruginosa PA01
agcggggaaaccuucgguggcga

SEQ ID NO: 1412615 - RNA, 17 nt, Pseudomonas aeruginosa PA01
agcggcccggcaggcgc

SEQ ID NO: 1412616 - RNA, 23 nt, Pseudomonas aeruginosa PA01
agcggcccuugucgccgcugggc

SEQ ID NO: 1412617 - RNA, 18 nt, Pseudomonas aeruginosa PA01
agcggccgaccaggccgu

SEQ ID NO: 1412618 - RNA, 15 nt, Pseudomonas aeruginosa PA01
agcggcccgaggguc

SEQ ID NO: 1412619 - RNA, 16 nt, Pseudomonas aeruginosa PA01
agcggccaggucgagg

SEQ ID NO: 1412620 - RNA, 15 nt, Pseudomonas aeruginosa PA01
agcggccacggcgga

SEQ ID NO: 1412621 - RNA, 14 nt, Pseudomonas aeruginosa PA01
agcggcccagcgcc

SEQ ID NO: 1412622 - RNA, 19 nt, Pseudomonas aeruginosa PA01
agcggcccagcgccccgcc

SEQ ID NO: 1412623 - RNA, 23 nt, Pseudomonas aeruginosa PA01
agcggcccgcggucacucggccu

SEQ ID NO: 1412624 - RNA, 22 nt, Pseudomonas aeruginosa PA01
agcggcgcggcguaccagccgc

SEQ ID NO: 1412625 - RNA, 18 nt, Pseudomonas aeruginosa PA01
agcggcgcgucgaccacg

SEQ ID NO: 1412626 - RNA, 18 nt, Pseudomonas aeruginosa PA01
agcggcggcacgaccaca

SEQ ID NO: 1412627 - RNA, 20 nt, Pseudomonas aeruginosa PA01
agcggcgcuugcgggcgcgc

SEQ ID NO: 1412628 - RNA, 17 nt, Pseudomonas aeruginosa PA01
agcggcgacaccgccag

SEQ ID NO: 1412629 - RNA, 18 nt, Pseudomonas aeruginosa PA01
agcggcgacaccgccagc

SEQ ID NO: 1412630 - RNA, 15 nt, Pseudomonas aeruginosa PA01
agcggcgaagcgcag

SEQ ID NO: 1412631 - RNA, 16 nt, Pseudomonas aeruginosa PA01
agcggcgacgccaccc

SEQ ID NO: 1412632 - RNA, 23 nt, Pseudomonas aeruginosa PA01
agcggccgugcaugccgacgagc

SEQ ID NO: 1412633 - RNA, 20 nt, Pseudomonas aeruginosa PA01
agcggccgcgagcgcggccg

SEQ ID NO: 1412634 - RNA, 17 nt, Pseudomonas aeruginosa PA01
agcggccgagcaggcgc

SEQ ID NO: 1412635 - RNA, 18 nt, Pseudomonas aeruginosa PA01
agcggccgagcaggcgcg

SEQ ID NO: 1412636 - RNA, 14 nt, Pseudomonas aeruginosa PA01
agcggccggcgcgg

SEQ ID NO: 1412637 - RNA, 17 nt, Pseudomonas aeruginosa PA01
agcggcacgcucuggcc

SEQ ID NO: 1412638 - RNA, 17 nt, Pseudomonas aeruginosa PA01
agcggcacggucauggc

SEQ ID NO: 1412639 - RNA, 22 nt, Pseudomonas aeruginosa PA01
agcggcacggucauggccagcu

SEQ ID NO: 1412640 - RNA, 15 nt, Pseudomonas aeruginosa PA01
agcggcagauccgcc

SEQ ID NO: 1412641 - RNA, 18 nt, Pseudomonas aeruginosa PA01
agcggcagauccgccgug

SEQ ID NO: 1412642 - RNA, 14 nt, Pseudomonas aeruginosa PA01
agcggcagaucggu

SEQ ID NO: 1412643 - RNA, 12 nt, Pseudomonas aeruginosa PA01
agcggcagcgcc

SEQ ID NO: 1412644 - RNA, 13 nt, Pseudomonas aeruginosa PA01
agcggcagcgcca

SEQ ID NO: 1412645 - RNA, 20 nt, Pseudomonas aeruginosa PA01
agcggcagcgucucggcugc

SEQ ID NO: 1412646 - RNA, 12 nt, Pseudomonas aeruginosa PA01
agcggcagcggc

SEQ ID NO: 1412647 - RNA, 14 nt, Pseudomonas aeruginosa PA01
agcggcagccacuc

SEQ ID NO: 1412648 - RNA, 20 nt, Pseudomonas aeruginosa PA01
agcggcagccccuugcgcuc

SEQ ID NO: 1412649 - RNA, 13 nt, Pseudomonas aeruginosa PA01
agcggcaggagca

SEQ ID NO: 1412650 - RNA, 23 nt, Pseudomonas aeruginosa PA01
agcggcaggagcguugcgggcag

SEQ ID NO: 1412651 - RNA, 20 nt, Pseudomonas aeruginosa PA01
agcggcaggccacggccgcu

SEQ ID NO: 1412652 - RNA, 15 nt, Pseudomonas aeruginosa PA01
agcggcagcucggcg

SEQ ID NO: 1412653 - RNA, 17 nt, Pseudomonas aeruginosa PA01
agcggcaggugguaagc

SEQ ID NO: 1412654 - RNA, 17 nt, Pseudomonas aeruginosa PA01
agcggcauccgccgcug

SEQ ID NO: 1412655 - RNA, 18 nt, Pseudomonas aeruginosa PA01
agcggcauccgccgcugg

SEQ ID NO: 1412656 - RNA, 17 nt, Pseudomonas aeruginosa PA01
agcggcaugcccugccg

SEQ ID NO: 1412657 - RNA, 22 nt, Pseudomonas aeruginosa PA01
agcggcaugcccugccggcgca

SEQ ID NO: 1412658 - RNA, 23 nt, Pseudomonas aeruginosa PA01
agcggacgcagcgggucgaucag

SEQ ID NO: 1412659 - RNA, 20 nt, Pseudomonas aeruginosa PA01
agcggaguucgucaaccagc

SEQ ID NO: 1412660 - RNA, 23 nt, Pseudomonas aeruginosa PA01
agcggaguucgucaaccagcacc

SEQ ID NO: 1412661 - RNA, 23 nt, Pseudomonas aeruginosa PA01
agcggauauucgacgcgcggcug

SEQ ID NO: 1412662 - RNA, 14 nt, Pseudomonas aeruginosa PA01
agcggaucagccgg

SEQ ID NO: 1412663 - RNA, 17 nt, Pseudomonas aeruginosa PA01
agcggaucagccggccc

SEQ ID NO: 1412664 - RNA, 18 nt, Pseudomonas aeruginosa PA01
agcggcacccggcugggu

SEQ ID NO: 1412665 - RNA, 14 nt, Pseudomonas aeruginosa PA01
agcgcuucgcgauc

SEQ ID NO: 1412666 - RNA, 22 nt, Pseudomonas aeruginosa PA01
agcgcuucgcgcagcucggcca

SEQ ID NO: 1412667 - RNA, 22 nt, Pseudomonas aeruginosa PA01
agcggaccccggccuccaggcu

SEQ ID NO: 1412668 - RNA, 23 nt, Pseudomonas aeruginosa PA01
agcggaccccggccuccaggcug

SEQ ID NO: 1412669 - RNA, 22 nt, Pseudomonas aeruginosa PA01
agcaaagcgcagguagcggcga

SEQ ID NO: 1412670 - RNA, 17 nt, Pseudomonas aeruginosa PA01
agcaagccgcagcgccc

SEQ ID NO: 1412671 - RNA, 17 nt, Pseudomonas aeruginosa PA01
agcaauaccgguuggcu

SEQ ID NO: 1412672 - RNA, 21 nt, Pseudomonas aeruginosa PA01
agaucauguagagcaggcugc

SEQ ID NO: 1412673 - RNA, 17 nt, Pseudomonas aeruginosa PA01
agaucagcggaccggug

SEQ ID NO: 1412674 - RNA, 17 nt, Pseudomonas aeruginosa PA01
agaucaggccggcgucg

SEQ ID NO: 1412675 - RNA, 24 nt, Pseudomonas aeruginosa PA01
agauccgccgugaggcgcgcgccg

SEQ ID NO: 1412676 - RNA, 15 nt, Pseudomonas aeruginosa PA01
agauccgcuccaggc

SEQ ID NO: 1412677 - RNA, 17 nt, Pseudomonas aeruginosa PA01
agauccgcuccaggcug

SEQ ID NO: 1412678 - RNA, 15 nt, Pseudomonas aeruginosa PA01
agcagaaccgccagc

SEQ ID NO: 1412679 - RNA, 18 nt, Pseudomonas aeruginosa PA01
agcacuucccaggugccc

SEQ ID NO: 1412680 - RNA, 17 nt, Pseudomonas aeruginosa PA01
agcacuucggcgcgcgg

SEQ ID NO: 1412681 - RNA, 22 nt, Pseudomonas aeruginosa PA01
agcacuucggcgcgcggcagca

SEQ ID NO: 1412682 - RNA, 15 nt, Pseudomonas aeruginosa PA01
agcacugguggacgg

SEQ ID NO: 1412683 - RNA, 16 nt, Pseudomonas aeruginosa PA01
agcacugguggacggu

SEQ ID NO: 1412684 - RNA, 16 nt, Pseudomonas aeruginosa PA01
agcacgccuuccagau

SEQ ID NO: 1412685 - RNA, 20 nt, Pseudomonas aeruginosa PA01
agcacgccuuccagaucguc

SEQ ID NO: 1412686 - RNA, 20 nt, Pseudomonas aeruginosa PA01
agcacgcucaggcagcgauc

SEQ ID NO: 1412687 - RNA, 15 nt, Pseudomonas aeruginosa PA01
agcacgcguccgacc

SEQ ID NO: 1412688 - RNA, 16 nt, Pseudomonas aeruginosa PA01
agcacgaaagccaugc

SEQ ID NO: 1412689 - RNA, 22 nt, Pseudomonas aeruginosa PA01
agcaccuucaucaccaggucgc

SEQ ID NO: 1412690 - RNA, 21 nt, Pseudomonas aeruginosa PA01
agcaccuugagggccuuggcc

SEQ ID NO: 1412691 - RNA, 22 nt, Pseudomonas aeruginosa PA01
agcacgcccugggacaggcguc

SEQ ID NO: 1412692 - RNA, 17 nt, Pseudomonas aeruginosa PA01
agcacgccgaucccgau

SEQ ID NO: 1412693 - RNA, 14 nt, Pseudomonas aeruginosa PA01
agcacgccgcgacc

SEQ ID NO: 1412694 - RNA, 22 nt, Pseudomonas aeruginosa PA01
agcacgccgcgaccgaagccgc

SEQ ID NO: 1412695 - RNA, 21 nt, Pseudomonas aeruginosa PA01
agcacgcccaguugcgccgcc

SEQ ID NO: 1412696 - RNA, 22 nt, Pseudomonas aeruginosa PA01
agcacgcccaguugcgccgccu

SEQ ID NO: 1412697 - RNA, 17 nt, Pseudomonas aeruginosa PA01
agcacgaugaggcgugg

SEQ ID NO: 1412698 - RNA, 17 nt, Pseudomonas aeruginosa PA01
agcaccgggacgaagcg

SEQ ID NO: 1412699 - RNA, 15 nt, Pseudomonas aeruginosa PA01
agcaccguggcgcca

SEQ ID NO: 1412700 - RNA, 20 nt, Pseudomonas aeruginosa PA01
agcaccucguaggccgacuc

SEQ ID NO: 1412701 - RNA, 21 nt, Pseudomonas aeruginosa PA01
agcaccuggcagugcgccggc

SEQ ID NO: 1412702 - RNA, 17 nt, Pseudomonas aeruginosa PA01
agcaccacgaugcugau

SEQ ID NO: 1412703 - RNA, 13 nt, Pseudomonas aeruginosa PA01
agcaccacgcgca

SEQ ID NO: 1412704 - RNA, 13 nt, Pseudomonas aeruginosa PA01
agcaccacggcga

SEQ ID NO: 1412705 - RNA, 12 nt, Pseudomonas aeruginosa PA01
agcaccacagca

SEQ ID NO: 1412706 - RNA, 23 nt, Pseudomonas aeruginosa PA01
agcaccaccacucgcgagcuggc

SEQ ID NO: 1412707 - RNA, 13 nt, Pseudomonas aeruginosa PA01
agcaccgcgccuu

SEQ ID NO: 1412708 - RNA, 11 nt, Pseudomonas aeruginosa PA01
agcaccggcag

SEQ ID NO: 1412709 - RNA, 17 nt, Pseudomonas aeruginosa PA01
agcaccgcuuucaccag

SEQ ID NO: 1412710 - RNA, 21 nt, Pseudomonas aeruginosa PA01
agcaccgcuuucaccaggguc

SEQ ID NO: 1412711 - RNA, 17 nt, Pseudomonas aeruginosa PA01
agcaccggaaaggcguc

SEQ ID NO: 1412712 - RNA, 18 nt, Pseudomonas aeruginosa PA01
agcaccggaaaggcgucg

SEQ ID NO: 1412713 - RNA, 19 nt, Pseudomonas aeruginosa PA01
agcaccggaaaggcgucgu

SEQ ID NO: 1412714 - RNA, 23 nt, Pseudomonas aeruginosa PA01
agcaccggcggcgccaggccggc

SEQ ID NO: 1412715 - RNA, 14 nt, Pseudomonas aeruginosa PA01
agcaguucgucgau

SEQ ID NO: 1412716 - RNA, 21 nt, Pseudomonas aeruginosa PA01
agcaguugcaacagcgcggcg

SEQ ID NO: 1412717 - RNA, 19 nt, Pseudomonas aeruginosa PA01
agcaguugcgggcgcaggu

SEQ ID NO: 1412718 - RNA, 22 nt, Pseudomonas aeruginosa PA01
agcaguugcuggaugucggcga

SEQ ID NO: 1412719 - RNA, 18 nt, Pseudomonas aeruginosa PA01
agcaguuccaggcguccg

SEQ ID NO: 1412720 - RNA, 14 nt, Pseudomonas aeruginosa PA01
agcaggucgcgcag

SEQ ID NO: 1412721 - RNA, 19 nt, Pseudomonas aeruginosa PA01
agcaggucgcgcugggcga

SEQ ID NO: 1412722 - RNA, 14 nt, Pseudomonas aeruginosa PA01
agcaggucgcggaa

SEQ ID NO: 1412723 - RNA, 23 nt, Pseudomonas aeruginosa PA01
agcaggucgcggugcaguucgcc

SEQ ID NO: 1412724 - RNA, 21 nt, Pseudomonas aeruginosa PA01
agcaggucggcagcgucgagc

SEQ ID NO: 1412725 - RNA, 15 nt, Pseudomonas aeruginosa PA01
agcaggucggcgcga

SEQ ID NO: 1412726 - RNA, 12 nt, Pseudomonas aeruginosa PA01
agcaggccgcgg

SEQ ID NO: 1412727 - RNA, 14 nt, Pseudomonas aeruginosa PA01
agcaggccgcuggc

SEQ ID NO: 1412728 - RNA, 19 nt, Pseudomonas aeruginosa PA01
agcaggccgcuggcgacgc

SEQ ID NO: 1412729 - RNA, 13 nt, Pseudomonas aeruginosa PA01
agcaggccggcga

SEQ ID NO: 1412730 - RNA, 15 nt, Pseudomonas aeruginosa PA01
agcaggccggcgacc

SEQ ID NO: 1412731 - RNA, 20 nt, Pseudomonas aeruginosa PA01
agcaggccggcgaccagcgu

SEQ ID NO: 1412732 - RNA, 13 nt, Pseudomonas aeruginosa PA01
agcaggcgccgcg

SEQ ID NO: 1412733 - RNA, 22 nt, Pseudomonas aeruginosa PA01
agcaggccgugggccggcgcgc

SEQ ID NO: 1412734 - RNA, 14 nt, Pseudomonas aeruginosa PA01
agcaggccuggagc

SEQ ID NO: 1412735 - RNA, 21 nt, Pseudomonas aeruginosa PA01
agcaggccuggagcgccucga

SEQ ID NO: 1412736 - RNA, 21 nt, Pseudomonas aeruginosa PA01
agcaggcgacaaaucggcauc

SEQ ID NO: 1412737 - RNA, 21 nt, Pseudomonas aeruginosa PA01
agcaggcgauacaggcgguga

SEQ ID NO: 1412738 - RNA, 16 nt, Pseudomonas aeruginosa PA01
agcaggcccgagccgg

SEQ ID NO: 1412739 - RNA, 14 nt, Pseudomonas aeruginosa PA01
agcaggccgccgcg

SEQ ID NO: 1412740 - RNA, 16 nt, Pseudomonas aeruginosa PA01
agcaggccgccgcgug

SEQ ID NO: 1412741 - RNA, 19 nt, Pseudomonas aeruginosa PA01
agcaggccgccgcgugccg

SEQ ID NO: 1412742 - RNA, 14 nt, Pseudomonas aeruginosa PA01
agcaggccgaaggc

SEQ ID NO: 1412743 - RNA, 22 nt, Pseudomonas aeruginosa PA01
agcaggccgacggcgcgcugcg

SEQ ID NO: 1412744 - RNA, 13 nt, Pseudomonas aeruginosa PA01
agcaggccgagcc

SEQ ID NO: 1412745 - RNA, 22 nt, Pseudomonas aeruginosa PA01
agcaggccgaggaggacgucgc

SEQ ID NO: 1412746 - RNA, 21 nt, Pseudomonas aeruginosa PA01
agcaggccgaggucggcggcg

SEQ ID NO: 1412747 - RNA, 15 nt, Pseudomonas aeruginosa PA01
agcaggccgaucacc

SEQ ID NO: 1412748 - RNA, 21 nt, Pseudomonas aeruginosa PA01
agcaggccgaucaccagcgcc

SEQ ID NO: 1412749 - RNA, 22 nt, Pseudomonas aeruginosa PA01
agcaggccgaucaccagcgcca

SEQ ID NO: 1412750 - RNA, 18 nt, Pseudomonas aeruginosa PA01
agcaggccgaucagcggc

SEQ ID NO: 1412751 - RNA, 22 nt, Pseudomonas aeruginosa PA01
agcaggccaugggugucggcga

SEQ ID NO: 1412752 - RNA, 12 nt, Pseudomonas aeruginosa PA01
agcagggcgucg

SEQ ID NO: 1412753 - RNA, 22 nt, Pseudomonas aeruginosa PA01
agcagggcgucgcccucggcgc

SEQ ID NO: 1412754 - RNA, 15 nt, Pseudomonas aeruginosa PA01
agcaggguaccgcug

SEQ ID NO: 1412755 - RNA, 16 nt, Pseudomonas aeruginosa PA01
agcagggucagcagcg

SEQ ID NO: 1412756 - RNA, 17 nt, Pseudomonas aeruginosa PA01
agcagggucagcagcgc

SEQ ID NO: 1412757 - RNA, 20 nt, Pseudomonas aeruginosa PA01
agcagggucagcagcgccag

SEQ ID NO: 1412758 - RNA, 21 nt, Pseudomonas aeruginosa PA01
agcagggucgcuuccucggca

SEQ ID NO: 1412759 - RNA, 18 nt, Pseudomonas aeruginosa PA01
agcagggucucgcugcug

SEQ ID NO: 1412760 - RNA, 19 nt, Pseudomonas aeruginosa PA01
agcagggucuucaggcgcc

SEQ ID NO: 1412761 - RNA, 21 nt, Pseudomonas aeruginosa PA01
agcagggugcgggcgcgggcg

SEQ ID NO: 1412762 - RNA, 15 nt, Pseudomonas aeruginosa PA01
agcagguagccaggg

SEQ ID NO: 1412763 - RNA, 12 nt, Pseudomonas aeruginosa PA01
agcagguagccu

SEQ ID NO: 1412764 - RNA, 12 nt, Pseudomonas aeruginosa PA01
agcaggucgagg

SEQ ID NO: 1412765 - RNA, 20 nt, Pseudomonas aeruginosa PA01
agcaggucgagggcguccuu

SEQ ID NO: 1412766 - RNA, 17 nt, Pseudomonas aeruginosa PA01
agcauuccucagcgccg

SEQ ID NO: 1412767 - RNA, 20 nt, Pseudomonas aeruginosa PA01
agcauuccucagcgccggua

SEQ ID NO: 1412768 - RNA, 13 nt, Pseudomonas aeruginosa PA01
agcaugucggcgg

SEQ ID NO: 1412769 - RNA, 20 nt, Pseudomonas aeruginosa PA01
agcauguuguuauggccgac

SEQ ID NO: 1412770 - RNA, 23 nt, Pseudomonas aeruginosa PA01
agcauguuguuauggccgacccg

SEQ ID NO: 1412771 - RNA, 14 nt, Pseudomonas aeruginosa PA01
agcauucagcgcgc

SEQ ID NO: 1412772 - RNA, 22 nt, Pseudomonas aeruginosa PA01
agcauuaccccgaccaggucgc

SEQ ID NO: 1412773 - RNA, 13 nt, Pseudomonas aeruginosa PA01
agccacaggcgcc

SEQ ID NO: 1412774 - RNA, 17 nt, Pseudomonas aeruginosa PA01
agcaucucggccaggcc

SEQ ID NO: 1412775 - RNA, 23 nt, Pseudomonas aeruginosa PA01
agcaucugccgggcgcgcugguc

SEQ ID NO: 1412776 - RNA, 15 nt, Pseudomonas aeruginosa PA01
agcaucugcuggucc

SEQ ID NO: 1412777 - RNA, 21 nt, Pseudomonas aeruginosa PA01
agcauguccugcaggcucagc

SEQ ID NO: 1412778 - RNA, 15 nt, Pseudomonas aeruginosa PA01
agcauggcguuccag

SEQ ID NO: 1412779 - RNA, 14 nt, Pseudomonas aeruginosa PA01
agcauggcguugag

SEQ ID NO: 1412780 - RNA, 15 nt, Pseudomonas aeruginosa PA01
agcaugggauggcgc

SEQ ID NO: 1412781 - RNA, 14 nt, Pseudomonas aeruginosa PA01
agcaucggcgcggc

SEQ ID NO: 1412782 - RNA, 20 nt, Pseudomonas aeruginosa PA01
agcaucgccggcagcgccgc

SEQ ID NO: 1412783 - RNA, 14 nt, Pseudomonas aeruginosa PA01
agcagccguauggc

SEQ ID NO: 1412784 - RNA, 16 nt, Pseudomonas aeruginosa PA01
agcagccguauggccc

SEQ ID NO: 1412785 - RNA, 19 nt, Pseudomonas aeruginosa PA01
agcagcgaacgccgcagcu

SEQ ID NO: 1412786 - RNA, 12 nt, Pseudomonas aeruginosa PA01
agcagcgccgcg

SEQ ID NO: 1412787 - RNA, 15 nt, Pseudomonas aeruginosa PA01
agcagcgccgcgccu

SEQ ID NO: 1412788 - RNA, 22 nt, Pseudomonas aeruginosa PA01
agcagcgccagcaggucgcgcu

SEQ ID NO: 1412789 - RNA, 13 nt, Pseudomonas aeruginosa PA01
agcagcgccaggg

SEQ ID NO: 1412790 - RNA, 19 nt, Pseudomonas aeruginosa PA01
agcagcgacucgcugggcg

SEQ ID NO: 1412791 - RNA, 20 nt, Pseudomonas aeruginosa PA01
agcagcgacucgcugggcgc

SEQ ID NO: 1412792 - RNA, 15 nt, Pseudomonas aeruginosa PA01
agcagcgccacgcug

SEQ ID NO: 1412793 - RNA, 13 nt, Pseudomonas aeruginosa PA01
agcagcgccgccc

SEQ ID NO: 1412794 - RNA, 22 nt, Pseudomonas aeruginosa PA01
agcagacacaaaaaacccggcg

SEQ ID NO: 1412795 - RNA, 13 nt, Pseudomonas aeruginosa PA01
agcagagcgccac

SEQ ID NO: 1412796 - RNA, 18 nt, Pseudomonas aeruginosa PA01
agcagagggucgccagcg

SEQ ID NO: 1412797 - RNA, 15 nt, Pseudomonas aeruginosa PA01
agcagcaccagcacc

SEQ ID NO: 1412798 - RNA, 17 nt, Pseudomonas aeruginosa PA01
agcagcaccagcaccag

SEQ ID NO: 1412799 - RNA, 16 nt, Pseudomonas aeruginosa PA01
agcagcaccacggcga

SEQ ID NO: 1412800 - RNA, 18 nt, Pseudomonas aeruginosa PA01
agcagcaacagcgccgcg

SEQ ID NO: 1412801 - RNA, 19 nt, Pseudomonas aeruginosa PA01
agcagcaacggacguucca

SEQ ID NO: 1412802 - RNA, 14 nt, Pseudomonas aeruginosa PA01
agcagccgcaggau

SEQ ID NO: 1412803 - RNA, 20 nt, Pseudomonas aeruginosa PA01
agcagccgcaggaugccgcc

SEQ ID NO: 1412804 - RNA, 19 nt, Pseudomonas aeruginosa PA01
agcagcaccaucagccagc

SEQ ID NO: 1412805 - RNA, 21 nt, Pseudomonas aeruginosa PA01
agcagcaccaucagccagccc

SEQ ID NO: 1412806 - RNA, 14 nt, Pseudomonas aeruginosa PA01
agcagcaccaggcu

SEQ ID NO: 1412807 - RNA, 23 nt, Pseudomonas aeruginosa PA01
agcagcgcgcggcucggcgggcu

SEQ ID NO: 1412808 - RNA, 15 nt, Pseudomonas aeruginosa PA01
agcagcgcggcggcg

SEQ ID NO: 1412809 - RNA, 19 nt, Pseudomonas aeruginosa PA01
agcagcgcggcggcggcca

SEQ ID NO: 1412810 - RNA, 23 nt, Pseudomonas aeruginosa PA01
agcagcgcuucgggagucaacgc

SEQ ID NO: 1412811 - RNA, 20 nt, Pseudomonas aeruginosa PA01
agcagcggaaaugcucgccg

SEQ ID NO: 1412812 - RNA, 23 nt, Pseudomonas aeruginosa PA01
agcagcggaaaugcucgccgucc

SEQ ID NO: 1412813 - RNA, 16 nt, Pseudomonas aeruginosa PA01
agcagcggcaaaggcc

SEQ ID NO: 1412814 - RNA, 21 nt, Pseudomonas aeruginosa PA01
agcagcggcaaaggcccggcg

SEQ ID NO: 1412815 - RNA, 14 nt, Pseudomonas aeruginosa PA01
agcagcggcaccag

SEQ ID NO: 1412816 - RNA, 13 nt, Pseudomonas aeruginosa PA01
agcagcggcacgc

SEQ ID NO: 1412817 - RNA, 13 nt, Pseudomonas aeruginosa PA01
agcagcggcggcg

SEQ ID NO: 1412818 - RNA, 23 nt, Pseudomonas aeruginosa PA01
agcagcggcgacaccgccagcac

SEQ ID NO: 1412819 - RNA, 13 nt, Pseudomonas aeruginosa PA01
agcagcggcgcca

SEQ ID NO: 1412820 - RNA, 15 nt, Pseudomonas aeruginosa PA01
agcagcucgccggcg

SEQ ID NO: 1412821 - RNA, 14 nt, Pseudomonas aeruginosa PA01
agcagcucgccggc

SEQ ID NO: 1412822 - RNA, 12 nt, Pseudomonas aeruginosa PA01
agcagcucgccg

SEQ ID NO: 1412823 - RNA, 17 nt, Pseudomonas aeruginosa PA01
agcaggaugcugcacag

SEQ ID NO: 1412824 - RNA, 15 nt, Pseudomonas aeruginosa PA01
agcaggaugcagucg

SEQ ID NO: 1412825 - RNA, 17 nt, Pseudomonas aeruginosa PA01
agcaggaugcagucggc

SEQ ID NO: 1412826 - RNA, 16 nt, Pseudomonas aeruginosa PA01
agcaggaugccgcugu

SEQ ID NO: 1412827 - RNA, 16 nt, Pseudomonas aeruginosa PA01
agcaggagaagcgccu

SEQ ID NO: 1412828 - RNA, 20 nt, Pseudomonas aeruginosa PA01
agcaggagaagcgccucgcc

SEQ ID NO: 1412829 - RNA, 13 nt, Pseudomonas aeruginosa PA01
agcaggagcgcca

SEQ ID NO: 1412830 - RNA, 17 nt, Pseudomonas aeruginosa PA01
agcaggaggauacggcg

SEQ ID NO: 1412831 - RNA, 22 nt, Pseudomonas aeruginosa PA01
agcaggaucggagagacccgcc

SEQ ID NO: 1412832 - RNA, 15 nt, Pseudomonas aeruginosa PA01
agcaggacagcaggg

SEQ ID NO: 1412833 - RNA, 13 nt, Pseudomonas aeruginosa PA01
agcaggacggcga

SEQ ID NO: 1412834 - RNA, 15 nt, Pseudomonas aeruginosa PA01
agcaggacggcgacc

SEQ ID NO: 1412835 - RNA, 22 nt, Pseudomonas aeruginosa PA01
agcaggaacucgaucagcgcgg

SEQ ID NO: 1412836 - RNA, 13 nt, Pseudomonas aeruginosa PA01
agcaggaagccga

SEQ ID NO: 1412837 - RNA, 18 nt, Pseudomonas aeruginosa PA01
agaccuugaacucgcccg

SEQ ID NO: 1412838 - RNA, 19 nt, Pseudomonas aeruginosa PA01
agacgaaagagcccggcaa

SEQ ID NO: 1412839 - RNA, 17 nt, Pseudomonas aeruginosa PA01
agaccuugccguugcuc

SEQ ID NO: 1412840 - RNA, 13 nt, Pseudomonas aeruginosa PA01
agaccuggccgcu

SEQ ID NO: 1412841 - RNA, 17 nt, Pseudomonas aeruginosa PA01
agaccuuccagccgcgc

SEQ ID NO: 1412842 - RNA, 13 nt, Pseudomonas aeruginosa PA01
agacgauggcgac

SEQ ID NO: 1412843 - RNA, 17 nt, Pseudomonas aeruginosa PA01
agacgaucuccugcugg

SEQ ID NO: 1412844 - RNA, 12 nt, Pseudomonas aeruginosa PA01
agacgcaccgag

SEQ ID NO: 1412845 - RNA, 15 nt, Pseudomonas aeruginosa PA01
agacgcaccgagggc

SEQ ID NO: 1412846 - RNA, 16 nt, Pseudomonas aeruginosa PA01
agacgaucagcaggau

SEQ ID NO: 1412847 - RNA, 20 nt, Pseudomonas aeruginosa PA01
agacgaucagcaggaugcag

SEQ ID NO: 1412848 - RNA, 16 nt, Pseudomonas aeruginosa PA01
agacgauugaccuccc

SEQ ID NO: 1412849 - RNA, 15 nt, Pseudomonas aeruginosa PA01
agacgccagccgccc

SEQ ID NO: 1412850 - RNA, 14 nt, Pseudomonas aeruginosa PA01
agacgcaggcaggu

SEQ ID NO: 1412851 - RNA, 17 nt, Pseudomonas aeruginosa PA01
agacgcaggugcccugg

SEQ ID NO: 1412852 - RNA, 21 nt, Pseudomonas aeruginosa PA01
agacgccguccaccagccagc

SEQ ID NO: 1412853 - RNA, 23 nt, Pseudomonas aeruginosa PA01
agacgccguccaccagccagcuc

SEQ ID NO: 1412854 - RNA, 17 nt, Pseudomonas aeruginosa PA01
agacccccugccgcccu

SEQ ID NO: 1412855 - RNA, 18 nt, Pseudomonas aeruginosa PA01
agaccgagauuggccgcc

SEQ ID NO: 1412856 - RNA, 14 nt, Pseudomonas aeruginosa PA01
agaccgauccagca

SEQ ID NO: 1412857 - RNA, 15 nt, Pseudomonas aeruginosa PA01
agaccgcagccggcg

SEQ ID NO: 1412858 - RNA, 14 nt, Pseudomonas aeruginosa PA01
agaccagucggccg

SEQ ID NO: 1412859 - RNA, 14 nt, Pseudomonas aeruginosa PA01
agaccagcgaaccg

SEQ ID NO: 1412860 - RNA, 19 nt, Pseudomonas aeruginosa PA01
agaccaggaaggccgggcc

SEQ ID NO: 1412861 - RNA, 20 nt, Pseudomonas aeruginosa PA01
agaccaggaaggccgggccc

SEQ ID NO: 1412862 - RNA, 19 nt, Pseudomonas aeruginosa PA01
agaccaggccgagcaggaa

SEQ ID NO: 1412863 - RNA, 19 nt, Pseudomonas aeruginosa PA01
agaccaucgccggcgagcc

SEQ ID NO: 1412864 - RNA, 12 nt, Pseudomonas aeruginosa PA01
agaccagcagga

SEQ ID NO: 1412865 - RNA, 22 nt, Pseudomonas aeruginosa PA01
agaccagcagcggcagccacuc

SEQ ID NO: 1412866 - RNA, 17 nt, Pseudomonas aeruginosa PA01
agaccacgcaggccagc

SEQ ID NO: 1412867 - RNA, 13 nt, Pseudomonas aeruginosa PA01
agaccaccagcgu

SEQ ID NO: 1412868 - RNA, 14 nt, Pseudomonas aeruginosa PA01
agaccaccaugguc

SEQ ID NO: 1412869 - RNA, 19 nt, Pseudomonas aeruginosa PA01
agaccaccgacggcuccgg

SEQ ID NO: 1412870 - RNA, 22 nt, Pseudomonas aeruginosa PA01
agaccggcgccccugcggcgcc

SEQ ID NO: 1412871 - RNA, 15 nt, Pseudomonas aeruginosa PA01
agaccggcuccaggg

SEQ ID NO: 1412872 - RNA, 16 nt, Pseudomonas aeruginosa PA01
agaccggcagccgggu

SEQ ID NO: 1412873 - RNA, 17 nt, Pseudomonas aeruginosa PA01
agaccggcagcgccgcc

SEQ ID NO: 1412874 - RNA, 20 nt, Pseudomonas aeruginosa PA01
agaccuccagguaggcgccc

SEQ ID NO: 1412875 - RNA, 19 nt, Pseudomonas aeruginosa PA01
agaccucgcugacuuccau

SEQ ID NO: 1412876 - RNA, 14 nt, Pseudomonas aeruginosa PA01
agaccguggcgcua

SEQ ID NO: 1412877 - RNA, 16 nt, Pseudomonas aeruginosa PA01
agaccuguucgcgccc

SEQ ID NO: 1412878 - RNA, 19 nt, Pseudomonas aeruginosa PA01
agaccuguugcagagcggc

SEQ ID NO: 1412879 - RNA, 17 nt, Pseudomonas aeruginosa PA01
agaguuugccgaacugc

SEQ ID NO: 1412880 - RNA, 15 nt, Pseudomonas aeruginosa PA01
agaguucgcugcgcg

SEQ ID NO: 1412881 - RNA, 19 nt, Pseudomonas aeruginosa PA01
agagugcccaggcgcuggc

SEQ ID NO: 1412882 - RNA, 20 nt, Pseudomonas aeruginosa PA01
agagugcccaggcgcuggcg

SEQ ID NO: 1412883 - RNA, 17 nt, Pseudomonas aeruginosa PA01
agagcgccagccagcgc

SEQ ID NO: 1412884 - RNA, 18 nt, Pseudomonas aeruginosa PA01
agagcgccagccagcgcg

SEQ ID NO: 1412885 - RNA, 14 nt, Pseudomonas aeruginosa PA01
agagcggccagguc

SEQ ID NO: 1412886 - RNA, 17 nt, Pseudomonas aeruginosa PA01
agagcggguagcgccgg

SEQ ID NO: 1412887 - RNA, 16 nt, Pseudomonas aeruginosa PA01
agauagggcaucagcc

SEQ ID NO: 1412888 - RNA, 18 nt, Pseudomonas aeruginosa PA01
agauagggcaucagcccc

SEQ ID NO: 1412889 - RNA, 13 nt, Pseudomonas aeruginosa PA01
agauagucgccgu

SEQ ID NO: 1412890 - RNA, 21 nt, Pseudomonas aeruginosa PA01
agacgcugcucgacggcacca

SEQ ID NO: 1412891 - RNA, 22 nt, Pseudomonas aeruginosa PA01
agacggcggcgaccccgaucac

SEQ ID NO: 1412892 - RNA, 16 nt, Pseudomonas aeruginosa PA01
agacgcucggccagcg

SEQ ID NO: 1412893 - RNA, 23 nt, Pseudomonas aeruginosa PA01
agacggaaacgcgcgcucucgcc

SEQ ID NO: 1412894 - RNA, 15 nt, Pseudomonas aeruginosa PA01
agacgcugcaccgcg

SEQ ID NO: 1412895 - RNA, 18 nt, Pseudomonas aeruginosa PA01
agacgcugcgaccuggcg

SEQ ID NO: 1412896 - RNA, 21 nt, Pseudomonas aeruginosa PA01
agacgcugcgaccuggcgccg

SEQ ID NO: 1412897 - RNA, 14 nt, Pseudomonas aeruginosa PA01
agacguccagcgcc

SEQ ID NO: 1412898 - RNA, 15 nt, Pseudomonas aeruginosa PA01
agacguccagcgcca

SEQ ID NO: 1412899 - RNA, 17 nt, Pseudomonas aeruginosa PA01
agacgguucagcagcgg

SEQ ID NO: 1412900 - RNA, 22 nt, Pseudomonas aeruginosa PA01
agacgguucagcagcggcaccc

SEQ ID NO: 1412901 - RNA, 14 nt, Pseudomonas aeruginosa PA01
agacgggcgacgcc

SEQ ID NO: 1412902 - RNA, 14 nt, Pseudomonas aeruginosa PA01
agacggggccucgc

SEQ ID NO: 1412903 - RNA, 12 nt, Pseudomonas aeruginosa PA01
agagccgcucgg

SEQ ID NO: 1412904 - RNA, 17 nt, Pseudomonas aeruginosa PA01
agagcagggccuggccc

SEQ ID NO: 1412905 - RNA, 17 nt, Pseudomonas aeruginosa PA01
agagcagggugaagcug

SEQ ID NO: 1412906 - RNA, 20 nt, Pseudomonas aeruginosa PA01
agagcagggugaagcugcgg

SEQ ID NO: 1412907 - RNA, 15 nt, Pseudomonas aeruginosa PA01
agaccaacugcgccc

SEQ ID NO: 1412908 - RNA, 22 nt, Pseudomonas aeruginosa PA01
agaccaacugcgcccccagcgc

SEQ ID NO: 1412909 - RNA, 18 nt, Pseudomonas aeruginosa PA01
agacagguacucggcccg

SEQ ID NO: 1412910 - RNA, 22 nt, Pseudomonas aeruginosa PA01
agacaggaaucgacccagccgc

SEQ ID NO: 1412911 - RNA, 18 nt, Pseudomonas aeruginosa PA01
agacacgaaaaagccggc

SEQ ID NO: 1412912 - RNA, 14 nt, Pseudomonas aeruginosa PA01
agaauaccgccagc

SEQ ID NO: 1412913 - RNA, 16 nt, Pseudomonas aeruginosa PA01
agaaggcgaucaucgc

SEQ ID NO: 1412914 - RNA, 13 nt, Pseudomonas aeruginosa PA01
agaaggugcccag

SEQ ID NO: 1412915 - RNA, 18 nt, Pseudomonas aeruginosa PA01
agaaggugcccagcggcg

SEQ ID NO: 1412916 - RNA, 20 nt, Pseudomonas aeruginosa PA01
agaaggugcccagcggcgcc

SEQ ID NO: 1412917 - RNA, 22 nt, Pseudomonas aeruginosa PA01
agaagguaucggccauggccga

SEQ ID NO: 1412918 - RNA, 13 nt, Pseudomonas aeruginosa PA01
agaaggucaccgc

SEQ ID NO: 1412919 - RNA, 21 nt, Pseudomonas aeruginosa PA01
agaaguaaucaccuuccucgc

SEQ ID NO: 1412920 - RNA, 21 nt, Pseudomonas aeruginosa PA01
agaaggcguccaccggcgccc

SEQ ID NO: 1412921 - RNA, 17 nt, Pseudomonas aeruginosa PA01
agaaggcugccgggcuc

SEQ ID NO: 1412922 - RNA, 17 nt, Pseudomonas aeruginosa PA01
agaagcguucgccgagg

SEQ ID NO: 1412923 - RNA, 13 nt, Pseudomonas aeruginosa PA01
agaaguugcuggc

SEQ ID NO: 1412924 - RNA, 17 nt, Pseudomonas aeruginosa PA01
agaacuugccggcgcca

SEQ ID NO: 1412925 - RNA, 16 nt, Pseudomonas aeruginosa PA01
agaacuuuucccagcg

SEQ ID NO: 1412926 - RNA, 17 nt, Pseudomonas aeruginosa PA01
agaagaucagcgcggug

SEQ ID NO: 1412927 - RNA, 16 nt, Pseudomonas aeruginosa PA01
agaagccgaccuugcg

SEQ ID NO: 1412928 - RNA, 22 nt, Pseudomonas aeruginosa PA01
agaagccgaucaccaccagcau

SEQ ID NO: 1412929 - RNA, 21 nt, Pseudomonas aeruginosa PA01
agaagccgcacuuccaggcgc

SEQ ID NO: 1412930 - RNA, 18 nt, Pseudomonas aeruginosa PA01
agaagccggggcaggcau

SEQ ID NO: 1412931 - RNA, 14 nt, Pseudomonas aeruginosa PA01
agaagcggccgacc

SEQ ID NO: 1412932 - RNA, 16 nt, Pseudomonas aeruginosa PA01
agaagccagccagguc

SEQ ID NO: 1412933 - RNA, 14 nt, Pseudomonas aeruginosa PA01
agaacuccuugccg

SEQ ID NO: 1412934 - RNA, 21 nt, Pseudomonas aeruginosa PA01
agaacucguccggucgcaccg

SEQ ID NO: 1412935 - RNA, 14 nt, Pseudomonas aeruginosa PA01
agaacgccgacccu

SEQ ID NO: 1412936 - RNA, 21 nt, Pseudomonas aeruginosa PA01
agaacgcguaggggaccaccc

SEQ ID NO: 1412937 - RNA, 22 nt, Pseudomonas aeruginosa PA01
agaacggguugaucagguucgg

SEQ ID NO: 1412938 - RNA, 14 nt, Pseudomonas aeruginosa PA01
agaacgccaggauc

SEQ ID NO: 1412939 - RNA, 13 nt, Pseudomonas aeruginosa PA01
agaaccccggcuc

SEQ ID NO: 1412940 - RNA, 19 nt, Pseudomonas aeruginosa PA01
agaaauccggcuggcgccg

SEQ ID NO: 1412941 - RNA, 19 nt, Pseudomonas aeruginosa PA01
agaaauccuccggacgccg

SEQ ID NO: 1412942 - RNA, 22 nt, Pseudomonas aeruginosa PA01
agaaauccuccggacgccgaac

SEQ ID NO: 1412943 - RNA, 12 nt, Pseudomonas aeruginosa PA01
agaacagcagcg

SEQ ID NO: 1412944 - RNA, 18 nt, Pseudomonas aeruginosa PA01
agaacagcagcggcacca

SEQ ID NO: 1412945 - RNA, 21 nt, Pseudomonas aeruginosa PA01
agaacagcagcggcaccagca

SEQ ID NO: 1412946 - RNA, 16 nt, Pseudomonas aeruginosa PA01
acuggaagaaggcgau

SEQ ID NO: 1412947 - RNA, 13 nt, Pseudomonas aeruginosa PA01
acuggaaacgccc

SEQ ID NO: 1412948 - RNA, 19 nt, Pseudomonas aeruginosa PA01
acugcuuggccaggcgcuu

SEQ ID NO: 1412949 - RNA, 22 nt, Pseudomonas aeruginosa PA01
acuggaagccugccagaccgag

SEQ ID NO: 1412950 - RNA, 13 nt, Pseudomonas aeruginosa PA01
acuggaaggccgc

SEQ ID NO: 1412951 - RNA, 20 nt, Pseudomonas aeruginosa PA01
acugcucgguauggcugcug

SEQ ID NO: 1412952 - RNA, 16 nt, Pseudomonas aeruginosa PA01
acugcuggacggcgga

SEQ ID NO: 1412953 - RNA, 13 nt, Pseudomonas aeruginosa PA01
acugcugcugcgg

SEQ ID NO: 1412954 - RNA, 17 nt, Pseudomonas aeruginosa PA01
agugggucgaugcccuc

SEQ ID NO: 1412955 - RNA, 13 nt, Pseudomonas aeruginosa PA01
agugggucgccgu

SEQ ID NO: 1412956 - RNA, 17 nt, Pseudomonas aeruginosa PA01
aguggguaggccaggca

SEQ ID NO: 1412957 - RNA, 15 nt, Pseudomonas aeruginosa PA01
aguggcgaagccagc

SEQ ID NO: 1412958 - RNA, 12 nt, Pseudomonas aeruginosa PA01
aguggcgccagc

SEQ ID NO: 1412959 - RNA, 13 nt, Pseudomonas aeruginosa PA01
aguggcgccgcca

SEQ ID NO: 1412960 - RNA, 14 nt, Pseudomonas aeruginosa PA01
aguggcgccgccau

SEQ ID NO: 1412961 - RNA, 19 nt, Pseudomonas aeruginosa PA01
aguggcguuccaggcggcg

SEQ ID NO: 1412962 - RNA, 16 nt, Pseudomonas aeruginosa PA01
agugggcgaggcgcuc

SEQ ID NO: 1412963 - RNA, 16 nt, Pseudomonas aeruginosa PA01
aguuucaucucggcgc

SEQ ID NO: 1412964 - RNA, 16 nt, Pseudomonas aeruginosa PA01
aguuucccggcgcggc

SEQ ID NO: 1412965 - RNA, 19 nt, Pseudomonas aeruginosa PA01
aguuuccgggaaauuucgc

SEQ ID NO: 1412966 - RNA, 17 nt, Pseudomonas aeruginosa PA01
aguugcuuggcgcgcug

SEQ ID NO: 1412967 - RNA, 19 nt, Pseudomonas aeruginosa PA01
aguugcuuggcgcgcuggc

SEQ ID NO: 1412968 - RNA, 22 nt, Pseudomonas aeruginosa PA01
aguuggaaccaguugccgagcu

SEQ ID NO: 1412969 - RNA, 20 nt, Pseudomonas aeruginosa PA01
aguuggcccaauccgcgccg

SEQ ID NO: 1412970 - RNA, 13 nt, Pseudomonas aeruginosa PA01
aguuggccgaacu

SEQ ID NO: 1412971 - RNA, 13 nt, Pseudomonas aeruginosa PA01
aguuggacgcggc

SEQ ID NO: 1412972 - RNA, 14 nt, Pseudomonas aeruginosa PA01
aguugcgccgccug

SEQ ID NO: 1412973 - RNA, 19 nt, Pseudomonas aeruginosa PA01
aguucgcgcaggaccuggc

SEQ ID NO: 1412974 - RNA, 17 nt, Pseudomonas aeruginosa PA01
aguucgcgcaggcgcug

SEQ ID NO: 1412975 - RNA, 20 nt, Pseudomonas aeruginosa PA01
aguucgcgcgggucgucgau

SEQ ID NO: 1412976 - RNA, 16 nt, Pseudomonas aeruginosa PA01
aguucgcgggccgcgg

SEQ ID NO: 1412977 - RNA, 17 nt, Pseudomonas aeruginosa PA01
aguucgcguagccccuc

SEQ ID NO: 1412978 - RNA, 22 nt, Pseudomonas aeruginosa PA01
aguucgccgccgagcgccuggc

SEQ ID NO: 1412979 - RNA, 14 nt, Pseudomonas aeruginosa PA01
aguucgcugccgcc

SEQ ID NO: 1412980 - RNA, 11 nt, Pseudomonas aeruginosa PA01
aguucgcugcg

SEQ ID NO: 1412981 - RNA, 14 nt, Pseudomonas aeruginosa PA01
aguucgcugcgcgc

SEQ ID NO: 1412982 - RNA, 14 nt, Pseudomonas aeruginosa PA01
aguucgcugaaggu

SEQ ID NO: 1412983 - RNA, 17 nt, Pseudomonas aeruginosa PA01
aguucggccgcggcugg

SEQ ID NO: 1412984 - RNA, 14 nt, Pseudomonas aeruginosa PA01
aguucggcgagcag

SEQ ID NO: 1412985 - RNA, 19 nt, Pseudomonas aeruginosa PA01
aguucggcgagcagguaga

SEQ ID NO: 1412986 - RNA, 24 nt, Pseudomonas aeruginosa PA01
aguucggcgaugaccagcucggcg

SEQ ID NO: 1412987 - RNA, 13 nt, Pseudomonas aeruginosa PA01
aguugccgccgcu

SEQ ID NO: 1412988 - RNA, 23 nt, Pseudomonas aeruginosa PA01
aguucggccaucagcacgucguc

SEQ ID NO: 1412989 - RNA, 14 nt, Pseudomonas aeruginosa PA01
aguucggcccagca

SEQ ID NO: 1412990 - RNA, 17 nt, Pseudomonas aeruginosa PA01
aguucggcccagcagcg

SEQ ID NO: 1412991 - RNA, 20 nt, Pseudomonas aeruginosa PA01
aguucggcccagcagcgcuc

SEQ ID NO: 1412992 - RNA, 19 nt, Pseudomonas aeruginosa PA01
aguucacguaggagccggc

SEQ ID NO: 1412993 - RNA, 23 nt, Pseudomonas aeruginosa PA01
aguucacguaggagccggccagg

SEQ ID NO: 1412994 - RNA, 20 nt, Pseudomonas aeruginosa PA01
aguucgaccuccaggccgaa

SEQ ID NO: 1412995 - RNA, 14 nt, Pseudomonas aeruginosa PA01
aguucgaaccgugg

SEQ ID NO: 1412996 - RNA, 16 nt, Pseudomonas aeruginosa PA01
aguucgaaccguggcg

SEQ ID NO: 1412997 - RNA, 18 nt, Pseudomonas aeruginosa PA01
aguucgaagcgccaggcg

SEQ ID NO: 1412998 - RNA, 22 nt, Pseudomonas aeruginosa PA01
aguucgaagcgccaggcgugca

SEQ ID NO: 1412999 - RNA, 16 nt, Pseudomonas aeruginosa PA01
agugcgagucggcgac

SEQ ID NO: 1413000 - RNA, 13 nt, Pseudomonas aeruginosa PA01
agugcgcagcagc

SEQ ID NO: 1413001 - RNA, 17 nt, Pseudomonas aeruginosa PA01
agugcgcagcagcgucg

SEQ ID NO: 1413002 - RNA, 20 nt, Pseudomonas aeruginosa PA01
agugccggcgcgucgcugcg

SEQ ID NO: 1413003 - RNA, 12 nt, Pseudomonas aeruginosa PA01
agugccugcacc

SEQ ID NO: 1413004 - RNA, 13 nt, Pseudomonas aeruginosa PA01
agugccucgcgcg

SEQ ID NO: 1413005 - RNA, 20 nt, Pseudomonas aeruginosa PA01
agugcgccauauuucgaagg

SEQ ID NO: 1413006 - RNA, 21 nt, Pseudomonas aeruginosa PA01
agugcgcccagcagcaggccg

SEQ ID NO: 1413007 - RNA, 17 nt, Pseudomonas aeruginosa PA01
agugcgccgggugccgg

SEQ ID NO: 1413008 - RNA, 20 nt, Pseudomonas aeruginosa PA01
agugcgccgcagcgcaaguc

SEQ ID NO: 1413009 - RNA, 21 nt, Pseudomonas aeruginosa PA01
aguggaucgcccgaacgccga

SEQ ID NO: 1413010 - RNA, 19 nt, Pseudomonas aeruginosa PA01
aguggcagcgccguugccg

SEQ ID NO: 1413011 - RNA, 19 nt, Pseudomonas aeruginosa PA01
aguggccggugugcgacug

SEQ ID NO: 1413012 - RNA, 20 nt, Pseudomonas aeruginosa PA01
agugcugaguuucacgucga

SEQ ID NO: 1413013 - RNA, 21 nt, Pseudomonas aeruginosa PA01
agugcugaguuucacgucgag

SEQ ID NO: 1413014 - RNA, 13 nt, Pseudomonas aeruginosa PA01
agugcuugagcgg

SEQ ID NO: 1413015 - RNA, 24 nt, Pseudomonas aeruginosa PA01
agugacauccucccugcccgcucg

SEQ ID NO: 1413016 - RNA, 16 nt, Pseudomonas aeruginosa PA01
agugagccccggcguc

SEQ ID NO: 1413017 - RNA, 14 nt, Pseudomonas aeruginosa PA01
agugaggccgagcc

SEQ ID NO: 1413018 - RNA, 13 nt, Pseudomonas aeruginosa PA01
agugcaacaccug

SEQ ID NO: 1413019 - RNA, 15 nt, Pseudomonas aeruginosa PA01
agugcaacaccuggc

SEQ ID NO: 1413020 - RNA, 19 nt, Pseudomonas aeruginosa PA01
agugcaacaccuggcgcuc

SEQ ID NO: 1413021 - RNA, 14 nt, Pseudomonas aeruginosa PA01
agugcagcugcgag

SEQ ID NO: 1413022 - RNA, 18 nt, Pseudomonas aeruginosa PA01
agugcaucagccuggcca

SEQ ID NO: 1413023 - RNA, 18 nt, Pseudomonas aeruginosa PA01
agugcaucggccgccagg

SEQ ID NO: 1413024 - RNA, 19 nt, Pseudomonas aeruginosa PA01
agugcaugcguucgccgaa

SEQ ID NO: 1413025 - RNA, 20 nt, Pseudomonas aeruginosa PA01
agugcccaggcgcuggcgcc

SEQ ID NO: 1413026 - RNA, 23 nt, Pseudomonas aeruginosa PA01
agugcccaggcgcuggcgccgau

SEQ ID NO: 1413027 - RNA, 15 nt, Pseudomonas aeruginosa PA01
agugccaggcucgcc

SEQ ID NO: 1413028 - RNA, 17 nt, Pseudomonas aeruginosa PA01
agugccagcagacgcuc

SEQ ID NO: 1413029 - RNA, 20 nt, Pseudomonas aeruginosa PA01
agugccgaccacaugggcga

SEQ ID NO: 1413030 - RNA, 19 nt, Pseudomonas aeruginosa PA01
agucugccuguccgcugcg

SEQ ID NO: 1413031 - RNA, 14 nt, Pseudomonas aeruginosa PA01
agucuucgaugcgc

SEQ ID NO: 1413032 - RNA, 19 nt, Pseudomonas aeruginosa PA01
agugaagagcucccugccg

SEQ ID NO: 1413033 - RNA, 22 nt, Pseudomonas aeruginosa PA01
agucgguuagaauaccggccug

SEQ ID NO: 1413034 - RNA, 16 nt, Pseudomonas aeruginosa PA01
agucggggcaggcgca

SEQ ID NO: 1413035 - RNA, 19 nt, Pseudomonas aeruginosa PA01
agucggggcaggcgcaggc

SEQ ID NO: 1413036 - RNA, 18 nt, Pseudomonas aeruginosa PA01
agucggcgagccggcgca

SEQ ID NO: 1413037 - RNA, 16 nt, Pseudomonas aeruginosa PA01
agucggcgaugcgcug

SEQ ID NO: 1413038 - RNA, 16 nt, Pseudomonas aeruginosa PA01
agucguucagcgccuc

SEQ ID NO: 1413039 - RNA, 19 nt, Pseudomonas aeruginosa PA01
agucguucagcgccucgcg

SEQ ID NO: 1413040 - RNA, 23 nt, Pseudomonas aeruginosa PA01
agucguucccggccuggcgcgcg

SEQ ID NO: 1413041 - RNA, 19 nt, Pseudomonas aeruginosa PA01
agucgucgcgcagcuccuc

SEQ ID NO: 1413042 - RNA, 16 nt, Pseudomonas aeruginosa PA01
agucgcgcagcgccuc

SEQ ID NO: 1413043 - RNA, 18 nt, Pseudomonas aeruginosa PA01
agucgcucauggcgccgc

SEQ ID NO: 1413044 - RNA, 21 nt, Pseudomonas aeruginosa PA01
agucgcuucacucauccucgc

SEQ ID NO: 1413045 - RNA, 18 nt, Pseudomonas aeruginosa PA01
agucgcugcucggccuug

SEQ ID NO: 1413046 - RNA, 16 nt, Pseudomonas aeruginosa PA01
agucgcugcuggcgcc

SEQ ID NO: 1413047 - RNA, 18 nt, Pseudomonas aeruginosa PA01
agucgcugcuggcgccgc

SEQ ID NO: 1413048 - RNA, 22 nt, Pseudomonas aeruginosa PA01
agucgcugcuggcgccgcuggc

SEQ ID NO: 1413049 - RNA, 17 nt, Pseudomonas aeruginosa PA01
agucggccugcaccagc

SEQ ID NO: 1413050 - RNA, 17 nt, Pseudomonas aeruginosa PA01
agucggcggguccgcgu

SEQ ID NO: 1413051 - RNA, 22 nt, Pseudomonas aeruginosa PA01
agucggcggucuugaucacguc

SEQ ID NO: 1413052 - RNA, 16 nt, Pseudomonas aeruginosa PA01
agucggcguaggccag

SEQ ID NO: 1413053 - RNA, 21 nt, Pseudomonas aeruginosa PA01
agucggcguaggccaguucgc

SEQ ID NO: 1413054 - RNA, 15 nt, Pseudomonas aeruginosa PA01
agucggccaggcgcc

SEQ ID NO: 1413055 - RNA, 13 nt, Pseudomonas aeruginosa PA01
agucggccgccca

SEQ ID NO: 1413056 - RNA, 18 nt, Pseudomonas aeruginosa PA01
agucccagaccacccggc

SEQ ID NO: 1413057 - RNA, 18 nt, Pseudomonas aeruginosa PA01
aguccgguagcgcgccug

SEQ ID NO: 1413058 - RNA, 22 nt, Pseudomonas aeruginosa PA01
aguccuccgcgcccaggcgcac

SEQ ID NO: 1413059 - RNA, 21 nt, Pseudomonas aeruginosa PA01
agucgcccggcucgcccaugc

SEQ ID NO: 1413060 - RNA, 18 nt, Pseudomonas aeruginosa PA01
agucgcccugcccggugg

SEQ ID NO: 1413061 - RNA, 15 nt, Pseudomonas aeruginosa PA01
agucgccccgguugg

SEQ ID NO: 1413062 - RNA, 14 nt, Pseudomonas aeruginosa PA01
agucgccggcgaac

SEQ ID NO: 1413063 - RNA, 14 nt, Pseudomonas aeruginosa PA01
aguccaggcgggcc

SEQ ID NO: 1413064 - RNA, 13 nt, Pseudomonas aeruginosa PA01
aguccagcgccgc

SEQ ID NO: 1413065 - RNA, 19 nt, Pseudomonas aeruginosa PA01
aguccagcgguaccagcag

SEQ ID NO: 1413066 - RNA, 23 nt, Pseudomonas aeruginosa PA01
aguccacggugauccgguaaugc

SEQ ID NO: 1413067 - RNA, 19 nt, Pseudomonas aeruginosa PA01
aguccgcugcgagcagguc

SEQ ID NO: 1413068 - RNA, 21 nt, Pseudomonas aeruginosa PA01
agucccauugcaucugcgccg

SEQ ID NO: 1413069 - RNA, 11 nt, Pseudomonas aeruginosa PA01
aguccaugcuc

SEQ ID NO: 1413070 - RNA, 18 nt, Pseudomonas aeruginosa PA01
aguccaugcucaggucga

SEQ ID NO: 1413071 - RNA, 23 nt, Pseudomonas aeruginosa PA01
aguccaugcucaggucgaacugc

SEQ ID NO: 1413072 - RNA, 14 nt, Pseudomonas aeruginosa PA01
agucccagcgagug

SEQ ID NO: 1413073 - RNA, 15 nt, Pseudomonas aeruginosa PA01
agucaacgccuggcc

SEQ ID NO: 1413074 - RNA, 16 nt, Pseudomonas aeruginosa PA01
aguagggacggugcag

SEQ ID NO: 1413075 - RNA, 22 nt, Pseudomonas aeruginosa PA01
aguauuucucgacuuccgccuu

SEQ ID NO: 1413076 - RNA, 17 nt, Pseudomonas aeruginosa PA01
aguaggguucgccgacg

SEQ ID NO: 1413077 - RNA, 14 nt, Pseudomonas aeruginosa PA01
aguaggcgcugcaa

SEQ ID NO: 1413078 - RNA, 14 nt, Pseudomonas aeruginosa PA01
aguaggcgcugccg

SEQ ID NO: 1413079 - RNA, 15 nt, Pseudomonas aeruginosa PA01
aguaggccuggccgc

SEQ ID NO: 1413080 - RNA, 14 nt, Pseudomonas aeruginosa PA01
aguagcucgccgag

SEQ ID NO: 1413081 - RNA, 14 nt, Pseudomonas aeruginosa PA01
aguagcuggcgcag

SEQ ID NO: 1413082 - RNA, 19 nt, Pseudomonas aeruginosa PA01
aguacuugaacagcaggau

SEQ ID NO: 1413083 - RNA, 18 nt, Pseudomonas aeruginosa PA01
aguacuuggccagcagca

SEQ ID NO: 1413084 - RNA, 13 nt, Pseudomonas aeruginosa PA01
aguacucuggcca

SEQ ID NO: 1413085 - RNA, 17 nt, Pseudomonas aeruginosa PA01
aguagaagcgcgcggua

SEQ ID NO: 1413086 - RNA, 16 nt, Pseudomonas aeruginosa PA01
aguacgaucagccagg

SEQ ID NO: 1413087 - RNA, 19 nt, Pseudomonas aeruginosa PA01
aguaccugcucacggccga

SEQ ID NO: 1413088 - RNA, 22 nt, Pseudomonas aeruginosa PA01
aggucgcugcugaaaaacgccu

SEQ ID NO: 1413089 - RNA, 17 nt, Pseudomonas aeruginosa PA01
aggucgcuggcaccggc

SEQ ID NO: 1413090 - RNA, 16 nt, Pseudomonas aeruginosa PA01
aggucgcuuucgcgca

SEQ ID NO: 1413091 - RNA, 17 nt, Pseudomonas aeruginosa PA01
aggucgcuuucgcgcag

SEQ ID NO: 1413092 - RNA, 15 nt, Pseudomonas aeruginosa PA01
aggucgcuggcgucg

SEQ ID NO: 1413093 - RNA, 16 nt, Pseudomonas aeruginosa PA01
aggucgcuggcgucga

SEQ ID NO: 1413094 - RNA, 22 nt, Pseudomonas aeruginosa PA01
aggucgcuguccuccagcggcg

SEQ ID NO: 1413095 - RNA, 22 nt, Pseudomonas aeruginosa PA01
aggucggagugcucgaucaggu

SEQ ID NO: 1413096 - RNA, 23 nt, Pseudomonas aeruginosa PA01
aggucgcugaccacccggugcag

SEQ ID NO: 1413097 - RNA, 13 nt, Pseudomonas aeruginosa PA01
aggucggcagcgu

SEQ ID NO: 1413098 - RNA, 18 nt, Pseudomonas aeruginosa PA01
aggucggccuggcugccg

SEQ ID NO: 1413099 - RNA, 16 nt, Pseudomonas aeruginosa PA01
aggucgcgcggcgccu

SEQ ID NO: 1413100 - RNA, 20 nt, Pseudomonas aeruginosa PA01
aggucgcgauguuggcgucg

SEQ ID NO: 1413101 - RNA, 23 nt, Pseudomonas aeruginosa PA01
aggucgcgcagggccagggcggc

SEQ ID NO: 1413102 - RNA, 15 nt, Pseudomonas aeruginosa PA01
agguccuggccgaag

SEQ ID NO: 1413103 - RNA, 19 nt, Pseudomonas aeruginosa PA01
aggucgaaagcuucgucgc

SEQ ID NO: 1413104 - RNA, 14 nt, Pseudomonas aeruginosa PA01
aggucgaacagcgg

SEQ ID NO: 1413105 - RNA, 18 nt, Pseudomonas aeruginosa PA01
aggucgaacagcggcugg

SEQ ID NO: 1413106 - RNA, 23 nt, Pseudomonas aeruginosa PA01
aggucgccgccagcuaccggcag

SEQ ID NO: 1413107 - RNA, 15 nt, Pseudomonas aeruginosa PA01
aggucgccgccgccg

SEQ ID NO: 1413108 - RNA, 18 nt, Pseudomonas aeruginosa PA01
auacgcuccggugccagg

SEQ ID NO: 1413109 - RNA, 15 nt, Pseudomonas aeruginosa PA01
auacgcucggcgucg

SEQ ID NO: 1413110 - RNA, 17 nt, Pseudomonas aeruginosa PA01
auacgcaucugcucgag

SEQ ID NO: 1413111 - RNA, 13 nt, Pseudomonas aeruginosa PA01
auaccggccuguc

SEQ ID NO: 1413112 - RNA, 23 nt, Pseudomonas aeruginosa PA01
auaccggccaucagcaccaggaa

SEQ ID NO: 1413113 - RNA, 23 nt, Pseudomonas aeruginosa PA01
auaccuccagccagcagcccggc

SEQ ID NO: 1413114 - RNA, 19 nt, Pseudomonas aeruginosa PA01
auaccucguuucccggcgc

SEQ ID NO: 1413115 - RNA, 19 nt, Pseudomonas aeruginosa PA01
auacgaaaaaaaggcgcug

SEQ ID NO: 1413116 - RNA, 20 nt, Pseudomonas aeruginosa PA01
auacgaaaaaaaggcgcugc

SEQ ID NO: 1413117 - RNA, 16 nt, Pseudomonas aeruginosa PA01
auacaccgcugcgccg

SEQ ID NO: 1413118 - RNA, 19 nt, Pseudomonas aeruginosa PA01
auacaccugcaacucggcg

SEQ ID NO: 1413119 - RNA, 20 nt, Pseudomonas aeruginosa PA01
auacaccaggccggcggccg

SEQ ID NO: 1413120 - RNA, 12 nt, Pseudomonas aeruginosa PA01
auaccagcgccg

SEQ ID NO: 1413121 - RNA, 12 nt, Pseudomonas aeruginosa PA01
auaccagcggcu

SEQ ID NO: 1413122 - RNA, 16 nt, Pseudomonas aeruginosa PA01
auaccacguggccggc

SEQ ID NO: 1413123 - RNA, 19 nt, Pseudomonas aeruginosa PA01
auaccacguggccggcgcg

SEQ ID NO: 1413124 - RNA, 18 nt, Pseudomonas aeruginosa PA01
auaccggcaaggcggccu

SEQ ID NO: 1413125 - RNA, 19 nt, Pseudomonas aeruginosa PA01
auaaccccuuugccgagcg

SEQ ID NO: 1413126 - RNA, 20 nt, Pseudomonas aeruginosa PA01
auaaccgcgagcgguuauuc

SEQ ID NO: 1413127 - RNA, 21 nt, Pseudomonas aeruginosa PA01
auaaccgcguugcgguuauuc

SEQ ID NO: 1413128 - RNA, 16 nt, Pseudomonas aeruginosa PA01
auaaccgcucgcgguu

SEQ ID NO: 1413129 - RNA, 17 nt, Pseudomonas aeruginosa PA01
auaaccgcaucgcgguu

SEQ ID NO: 1413130 - RNA, 20 nt, Pseudomonas aeruginosa PA01
auaaccgcaucgcgguuauc

SEQ ID NO: 1413131 - RNA, 21 nt, Pseudomonas aeruginosa PA01
auaacgccgcaggcguuaucc

SEQ ID NO: 1413132 - RNA, 20 nt, Pseudomonas aeruginosa PA01
auaacgccuguggcguuauu

SEQ ID NO: 1413133 - RNA, 21 nt, Pseudomonas aeruginosa PA01
auaacgccacaggcguuaucc

SEQ ID NO: 1413134 - RNA, 23 nt, Pseudomonas aeruginosa PA01
auacgguuugaggcguugggguu

SEQ ID NO: 1413135 - RNA, 17 nt, Pseudomonas aeruginosa PA01
auacggcaggguagcca

SEQ ID NO: 1413136 - RNA, 14 nt, Pseudomonas aeruginosa PA01
auagaccaaggcau

SEQ ID NO: 1413137 - RNA, 13 nt, Pseudomonas aeruginosa PA01
auagacgccggcg

SEQ ID NO: 1413138 - RNA, 12 nt, Pseudomonas aeruginosa PA01
auagaccagcac

SEQ ID NO: 1413139 - RNA, 20 nt, Pseudomonas aeruginosa PA01
auagaccagcaccgccugca

SEQ ID NO: 1413140 - RNA, 13 nt, Pseudomonas aeruginosa PA01
auagcgccgcggg

SEQ ID NO: 1413141 - RNA, 11 nt, Pseudomonas aeruginosa PA01
auagcgcgccg

SEQ ID NO: 1413142 - RNA, 13 nt, Pseudomonas aeruginosa PA01
auagcgcgccggg

SEQ ID NO: 1413143 - RNA, 17 nt, Pseudomonas aeruginosa PA01
auagcgcggccuucagc

SEQ ID NO: 1413144 - RNA, 14 nt, Pseudomonas aeruginosa PA01
auagcguccagcuc

SEQ ID NO: 1413145 - RNA, 17 nt, Pseudomonas aeruginosa PA01
auagugcggccaggcgu

SEQ ID NO: 1413146 - RNA, 22 nt, Pseudomonas aeruginosa PA01
auagugcugggcgaccuucagc

SEQ ID NO: 1413147 - RNA, 17 nt, Pseudomonas aeruginosa PA01
auaggcgaagcggcucg

SEQ ID NO: 1413148 - RNA, 15 nt, Pseudomonas aeruginosa PA01
auagggcggcgccac

SEQ ID NO: 1413149 - RNA, 23 nt, Pseudomonas aeruginosa PA01
auaucgcggcgcgauauccgcca

SEQ ID NO: 1413150 - RNA, 12 nt, Pseudomonas aeruginosa PA01
agcuucgucgcg

SEQ ID NO: 1413151 - RNA, 22 nt, Pseudomonas aeruginosa PA01
agcuucgucgcgcaggcgggcg

SEQ ID NO: 1413152 - RNA, 17 nt, Pseudomonas aeruginosa PA01
agcuucuacuucggcuu

SEQ ID NO: 1413153 - RNA, 15 nt, Pseudomonas aeruginosa PA01
agcuucgccgcgcaa

SEQ ID NO: 1413154 - RNA, 18 nt, Pseudomonas aeruginosa PA01
agcuucucgucgccgccg

SEQ ID NO: 1413155 - RNA, 14 nt, Pseudomonas aeruginosa PA01
agcuugccgcugcg

SEQ ID NO: 1413156 - RNA, 16 nt, Pseudomonas aeruginosa PA01
agcuugcgccagagca

SEQ ID NO: 1413157 - RNA, 18 nt, Pseudomonas aeruginosa PA01
agcuugcgucccuuggcg

SEQ ID NO: 1413158 - RNA, 21 nt, Pseudomonas aeruginosa PA01
agcuugcgucccuuggcgucg

SEQ ID NO: 1413159 - RNA, 17 nt, Pseudomonas aeruginosa PA01
agcuucuucagcagcgg

SEQ ID NO: 1413160 - RNA, 19 nt, Pseudomonas aeruginosa PA01
agcuucuucagcagcgggc

SEQ ID NO: 1413161 - RNA, 22 nt, Pseudomonas aeruginosa PA01
aggaaaacgcucaggccaagca

SEQ ID NO: 1413162 - RNA, 20 nt, Pseudomonas aeruginosa PA01
agcuuggcgaauagccggcg

SEQ ID NO: 1413163 - RNA, 17 nt, Pseudomonas aeruginosa PA01
agcuugggauggccagc

SEQ ID NO: 1413164 - RNA, 22 nt, Pseudomonas aeruginosa PA01
agcuugcuggcguucucggcca

SEQ ID NO: 1413165 - RNA, 17 nt, Pseudomonas aeruginosa PA01
agcuuguugcgcaggcg

SEQ ID NO: 1413166 - RNA, 15 nt, Pseudomonas aeruginosa PA01
agcuuguuggccagc

SEQ ID NO: 1413167 - RNA, 21 nt, Pseudomonas aeruginosa PA01
agcuuguuggccagcagccag

SEQ ID NO: 1413168 - RNA, 22 nt, Pseudomonas aeruginosa PA01
agcuugugggcaugcucggcca

SEQ ID NO: 1413169 - RNA, 17 nt, Pseudomonas aeruginosa PA01
agcuuguggucguggcg

SEQ ID NO: 1413170 - RNA, 14 nt, Pseudomonas aeruginosa PA01
aggacagcaggguc

SEQ ID NO: 1413171 - RNA, 22 nt, Pseudomonas aeruginosa PA01
aggaauucgggaagggaucgac

SEQ ID NO: 1413172 - RNA, 15 nt, Pseudomonas aeruginosa PA01
aggaagcgccgggcc

SEQ ID NO: 1413173 - RNA, 13 nt, Pseudomonas aeruginosa PA01
aggaaggcgacga

SEQ ID NO: 1413174 - RNA, 17 nt, Pseudomonas aeruginosa PA01
aggaaggccaggucgcc

SEQ ID NO: 1413175 - RNA, 17 nt, Pseudomonas aeruginosa PA01
aggaagugcagggcguc

SEQ ID NO: 1413176 - RNA, 21 nt, Pseudomonas aeruginosa PA01
aggaagugcagggcguccagu

SEQ ID NO: 1413177 - RNA, 22 nt, Pseudomonas aeruginosa PA01
aggaaguggccggugugcgacu

SEQ ID NO: 1413178 - RNA, 22 nt, Pseudomonas aeruginosa PA01
aggaaucaccacucgccagcgc

SEQ ID NO: 1413179 - RNA, 14 nt, Pseudomonas aeruginosa PA01
aggaacagguucgg

SEQ ID NO: 1413180 - RNA, 20 nt, Pseudomonas aeruginosa PA01
aggaacagguucggcaggcc

SEQ ID NO: 1413181 - RNA, 15 nt, Pseudomonas aeruginosa PA01
aggaaaugccuggcu

SEQ ID NO: 1413182 - RNA, 17 nt, Pseudomonas aeruginosa PA01
aggaacacccagaagcc

SEQ ID NO: 1413183 - RNA, 13 nt, Pseudomonas aeruginosa PA01
aggaacacccggu

SEQ ID NO: 1413184 - RNA, 23 nt, Pseudomonas aeruginosa PA01
aggaaaucaccgcugcgcaggug

SEQ ID NO: 1413185 - RNA, 18 nt, Pseudomonas aeruginosa PA01
aggaacgcccgcggcagc

SEQ ID NO: 1413186 - RNA, 22 nt, Pseudomonas aeruginosa PA01
aggaacgcccgcggcagcagcc

SEQ ID NO: 1413187 - RNA, 23 nt, Pseudomonas aeruginosa PA01
aggaaccggccauuacgccgagc

SEQ ID NO: 1413188 - RNA, 13 nt, Pseudomonas aeruginosa PA01
aggaacuggaagc

SEQ ID NO: 1413189 - RNA, 14 nt, Pseudomonas aeruginosa PA01
aggaacucgcgguc

SEQ ID NO: 1413190 - RNA, 19 nt, Pseudomonas aeruginosa PA01
aggaagccgaccggcgccg

SEQ ID NO: 1413191 - RNA, 20 nt, Pseudomonas aeruginosa PA01
aggaagccgcgccccagcgg

SEQ ID NO: 1413192 - RNA, 14 nt, Pseudomonas aeruginosa PA01
aggaagagcccgcc

SEQ ID NO: 1413193 - RNA, 21 nt, Pseudomonas aeruginosa PA01
agcugcucgaagcaauaccgg

SEQ ID NO: 1413194 - RNA, 14 nt, Pseudomonas aeruginosa PA01
agcugcucgauggc

SEQ ID NO: 1413195 - RNA, 16 nt, Pseudomonas aeruginosa PA01
agcugcuccagcccgg

SEQ ID NO: 1413196 - RNA, 14 nt, Pseudomonas aeruginosa PA01
agcgucucagcccu

SEQ ID NO: 1413197 - RNA, 22 nt, Pseudomonas aeruginosa PA01
agcgucugcagcuugcgcgcca

SEQ ID NO: 1413198 - RNA, 17 nt, Pseudomonas aeruginosa PA01
agcgucugccgcuggcg

SEQ ID NO: 1413199 - RNA, 16 nt, Pseudomonas aeruginosa PA01
agcgucgugcgccggc

SEQ ID NO: 1413200 - RNA, 22 nt, Pseudomonas aeruginosa PA01
agcgucgugcgccggccucucc

SEQ ID NO: 1413201 - RNA, 18 nt, Pseudomonas aeruginosa PA01
agcgucguagagcgugcg

SEQ ID NO: 1413202 - RNA, 20 nt, Pseudomonas aeruginosa PA01
agcuggacgacgcuggccug

SEQ ID NO: 1413203 - RNA, 19 nt, Pseudomonas aeruginosa PA01
agcuggaagucguccagca

SEQ ID NO: 1413204 - RNA, 16 nt, Pseudomonas aeruginosa PA01
agcuggagcagcagcg

SEQ ID NO: 1413205 - RNA, 21 nt, Pseudomonas aeruginosa PA01
agcuggauccgugccaggcgc

SEQ ID NO: 1413206 - RNA, 23 nt, Pseudomonas aeruginosa PA01
agcuggaucugguggaacagcau

SEQ ID NO: 1413207 - RNA, 13 nt, Pseudomonas aeruginosa PA01
agcuggccgagcg

SEQ ID NO: 1413208 - RNA, 15 nt, Pseudomonas aeruginosa PA01
agcuggccgagcgac

SEQ ID NO: 1413209 - RNA, 22 nt, Pseudomonas aeruginosa PA01
agcuggcgccgucaucgcugac

SEQ ID NO: 1413210 - RNA, 14 nt, Pseudomonas aeruginosa PA01
agcuggcgcgccuc

SEQ ID NO: 1413211 - RNA, 16 nt, Pseudomonas aeruginosa PA01
agcuggcgcgcgucga

SEQ ID NO: 1413212 - RNA, 19 nt, Pseudomonas aeruginosa PA01
agcuggcgcgucgcugccg

SEQ ID NO: 1413213 - RNA, 22 nt, Pseudomonas aeruginosa PA01
agcuggcgcgucgcugccgccg

SEQ ID NO: 1413214 - RNA, 22 nt, Pseudomonas aeruginosa PA01
agcuggcgcguugugccgccac

SEQ ID NO: 1413215 - RNA, 19 nt, Pseudomonas aeruginosa PA01
agcuggcgcaacugcgcca

SEQ ID NO: 1413216 - RNA, 21 nt, Pseudomonas aeruginosa PA01
agcugguaggagccgucgccg

SEQ ID NO: 1413217 - RNA, 16 nt, Pseudomonas aeruginosa PA01
agcuguccgcgccgcg

SEQ ID NO: 1413218 - RNA, 16 nt, Pseudomonas aeruginosa PA01
agcugucgcccucgcg

SEQ ID NO: 1413219 - RNA, 17 nt, Pseudomonas aeruginosa PA01
agcugucgcccucgcgg

SEQ ID NO: 1413220 - RNA, 15 nt, Pseudomonas aeruginosa PA01
agcuguuucagccca

SEQ ID NO: 1413221 - RNA, 22 nt, Pseudomonas aeruginosa PA01
agcugucguaguccugggccgg

SEQ ID NO: 1413222 - RNA, 20 nt, Pseudomonas aeruginosa PA01
agcuucaggcgcacuacgcc

SEQ ID NO: 1413223 - RNA, 15 nt, Pseudomonas aeruginosa PA01
agcuucagccgaccg

SEQ ID NO: 1413224 - RNA, 14 nt, Pseudomonas aeruginosa PA01
agcuuccaggcgcg

SEQ ID NO: 1413225 - RNA, 17 nt, Pseudomonas aeruginosa PA01
agcuuccaggcgcgcug

SEQ ID NO: 1413226 - RNA, 22 nt, Pseudomonas aeruginosa PA01
aggcauccccggaccagggcgc

SEQ ID NO: 1413227 - RNA, 15 nt, Pseudomonas aeruginosa PA01
aggcauccagcaccg

SEQ ID NO: 1413228 - RNA, 17 nt, Pseudomonas aeruginosa PA01
aggcauccagcaccgcu

SEQ ID NO: 1413229 - RNA, 15 nt, Pseudomonas aeruginosa PA01
aggcaggcgcggguc

SEQ ID NO: 1413230 - RNA, 16 nt, Pseudomonas aeruginosa PA01
aggcaggccgggcugg

SEQ ID NO: 1413231 - RNA, 21 nt, Pseudomonas aeruginosa PA01
aggcagucguaggucugcccg

SEQ ID NO: 1413232 - RNA, 22 nt, Pseudomonas aeruginosa PA01
aggcagucguaggucugcccga

SEQ ID NO: 1413233 - RNA, 20 nt, Pseudomonas aeruginosa PA01
aggcaguggcgccagccagc

SEQ ID NO: 1413234 - RNA, 14 nt, Pseudomonas aeruginosa PA01
aggccacccgccuc

SEQ ID NO: 1413235 - RNA, 20 nt, Pseudomonas aeruginosa PA01
aggccaccagagccagccgc

SEQ ID NO: 1413236 - RNA, 21 nt, Pseudomonas aeruginosa PA01
aggccaccagagccagccgcg

SEQ ID NO: 1413237 - RNA, 13 nt, Pseudomonas aeruginosa PA01
aggccaccggugg

SEQ ID NO: 1413238 - RNA, 16 nt, Pseudomonas aeruginosa PA01
aggccacgccgccguc

SEQ ID NO: 1413239 - RNA, 13 nt, Pseudomonas aeruginosa PA01
aggccacggccgg

SEQ ID NO: 1413240 - RNA, 15 nt, Pseudomonas aeruginosa PA01
aggccacggccggcg

SEQ ID NO: 1413241 - RNA, 17 nt, Pseudomonas aeruginosa PA01
aggcccgcaaucagcgg

SEQ ID NO: 1413242 - RNA, 12 nt, Pseudomonas aeruginosa PA01
aggccagcgcca

SEQ ID NO: 1413243 - RNA, 16 nt, Pseudomonas aeruginosa PA01
aggccagcaccucgac

SEQ ID NO: 1413244 - RNA, 23 nt, Pseudomonas aeruginosa PA01
aggcccggcgcgguuucgcagcg

SEQ ID NO: 1413245 - RNA, 22 nt, Pseudomonas aeruginosa PA01
aggccgagaagguucucggcca

SEQ ID NO: 1413246 - RNA, 13 nt, Pseudomonas aeruginosa PA01
aggccgagcagga

SEQ ID NO: 1413247 - RNA, 14 nt, Pseudomonas aeruginosa PA01
aggccgagcaggaa

SEQ ID NO: 1413248 - RNA, 19 nt, Pseudomonas aeruginosa PA01
aggccgagcccgagugcgc

SEQ ID NO: 1413249 - RNA, 21 nt, Pseudomonas aeruginosa PA01
aggccgagcccgagugcgccc

SEQ ID NO: 1413250 - RNA, 16 nt, Pseudomonas aeruginosa PA01
aggcccggccgccugc

SEQ ID NO: 1413251 - RNA, 18 nt, Pseudomonas aeruginosa PA01
aggcccgcgccgccggua

SEQ ID NO: 1413252 - RNA, 15 nt, Pseudomonas aeruginosa PA01
aggcccgccgcggcg

SEQ ID NO: 1413253 - RNA, 17 nt, Pseudomonas aeruginosa PA01
aggcccgcgagccgcgc

SEQ ID NO: 1413254 - RNA, 18 nt, Pseudomonas aeruginosa PA01
aggcaacagcccgcgccg

SEQ ID NO: 1413255 - RNA, 13 nt, Pseudomonas aeruginosa PA01
aggcaaccgggua

SEQ ID NO: 1413256 - RNA, 15 nt, Pseudomonas aeruginosa PA01
aggaugaccaggcug

SEQ ID NO: 1413257 - RNA, 15 nt, Pseudomonas aeruginosa PA01
aggcaauggccggcg

SEQ ID NO: 1413258 - RNA, 16 nt, Pseudomonas aeruginosa PA01
aggcaauggccggcgg

SEQ ID NO: 1413259 - RNA, 19 nt, Pseudomonas aeruginosa PA01
aggcagaccagcgcaagcg

SEQ ID NO: 1413260 - RNA, 16 nt, Pseudomonas aeruginosa PA01
aggcagaccaggccga

SEQ ID NO: 1413261 - RNA, 17 nt, Pseudomonas aeruginosa PA01
aggcagcgaucgccgcc

SEQ ID NO: 1413262 - RNA, 13 nt, Pseudomonas aeruginosa PA01
aggcagcgaugcc

SEQ ID NO: 1413263 - RNA, 11 nt, Pseudomonas aeruginosa PA01
aggcagcgccg

SEQ ID NO: 1413264 - RNA, 14 nt, Pseudomonas aeruginosa PA01
aggcagcgccgccc

SEQ ID NO: 1413265 - RNA, 17 nt, Pseudomonas aeruginosa PA01
aggcagcguccgaacgc

SEQ ID NO: 1413266 - RNA, 16 nt, Pseudomonas aeruginosa PA01
aggaucucgcgccccg

SEQ ID NO: 1413267 - RNA, 16 nt, Pseudomonas aeruginosa PA01
aggaugcaaccgcccu

SEQ ID NO: 1413268 - RNA, 18 nt, Pseudomonas aeruginosa PA01
aggaugcagucggcaccg

SEQ ID NO: 1413269 - RNA, 22 nt, Pseudomonas aeruginosa PA01
aggaugcagucggcaccgaucg

SEQ ID NO: 1413270 - RNA, 18 nt, Pseudomonas aeruginosa PA01
aggaucuugcgcccggcg

SEQ ID NO: 1413271 - RNA, 15 nt, Pseudomonas aeruginosa PA01
aggaucgucggcccg

SEQ ID NO: 1413272 - RNA, 16 nt, Pseudomonas aeruginosa PA01
aggaucgcgcuggcca

SEQ ID NO: 1413273 - RNA, 17 nt, Pseudomonas aeruginosa PA01
aggaucgcgcuggccag

SEQ ID NO: 1413274 - RNA, 22 nt, Pseudomonas aeruginosa PA01
aggaucgcuauccaccgucgcg

SEQ ID NO: 1413275 - RNA, 21 nt, Pseudomonas aeruginosa PA01
aggaucgcucccaggcucacg

SEQ ID NO: 1413276 - RNA, 21 nt, Pseudomonas aeruginosa PA01
aggaucggcauggccacgcuc

SEQ ID NO: 1413277 - RNA, 24 nt, Pseudomonas aeruginosa PA01
aggaucggccaacugagcggcggc

SEQ ID NO: 1413278 - RNA, 13 nt, Pseudomonas aeruginosa PA01
aggaucggcgccc

SEQ ID NO: 1413279 - RNA, 18 nt, Pseudomonas aeruginosa PA01
aggaucggcgcccagcac

SEQ ID NO: 1413280 - RNA, 15 nt, Pseudomonas aeruginosa PA01
aggaucggcgcgguc

SEQ ID NO: 1413281 - RNA, 23 nt, Pseudomonas aeruginosa PA01
aggaucaguucgugccaggcgac

SEQ ID NO: 1413282 - RNA, 14 nt, Pseudomonas aeruginosa PA01
aggaucgccaggac

SEQ ID NO: 1413283 - RNA, 16 nt, Pseudomonas aeruginosa PA01
aggaucgccaggacgc

SEQ ID NO: 1413284 - RNA, 19 nt, Pseudomonas aeruginosa PA01
aggaucgccuccaccagcg

SEQ ID NO: 1413285 - RNA, 21 nt, Pseudomonas aeruginosa PA01
aggaucgccuccaccagcgcc

SEQ ID NO: 1413286 - RNA, 15 nt, Pseudomonas aeruginosa PA01
aggaucgacagcagc

SEQ ID NO: 1413287 - RNA, 16 nt, Pseudomonas aeruginosa PA01
aggaucgacagcagcg

SEQ ID NO: 1413288 - RNA, 16 nt, Pseudomonas aeruginosa PA01
aggaucgagccagcgc

SEQ ID NO: 1413289 - RNA, 18 nt, Pseudomonas aeruginosa PA01
aggaucgagccagcgcuc

SEQ ID NO: 1413290 - RNA, 14 nt, Pseudomonas aeruginosa PA01
aggaucgagcccug

SEQ ID NO: 1413291 - RNA, 13 nt, Pseudomonas aeruginosa PA01
aggaucagccagc

SEQ ID NO: 1413292 - RNA, 19 nt, Pseudomonas aeruginosa PA01
aggaucacgcagcaggcga

SEQ ID NO: 1413293 - RNA, 20 nt, Pseudomonas aeruginosa PA01
aggaucacgcagcaggcgac

SEQ ID NO: 1413294 - RNA, 22 nt, Pseudomonas aeruginosa PA01
aggaucacgcagcaggcgacgg

SEQ ID NO: 1413295 - RNA, 14 nt, Pseudomonas aeruginosa PA01
aggagccuuucacu

SEQ ID NO: 1413296 - RNA, 20 nt, Pseudomonas aeruginosa PA01
aggagcgccagcaccagcag

SEQ ID NO: 1413297 - RNA, 21 nt, Pseudomonas aeruginosa PA01
aggagcacgccgugcaggguc

SEQ ID NO: 1413298 - RNA, 12 nt, Pseudomonas aeruginosa PA01
aggagcacggcc

SEQ ID NO: 1413299 - RNA, 20 nt, Pseudomonas aeruginosa PA01
aggagcaugucuucgucgcg

SEQ ID NO: 1413300 - RNA, 19 nt, Pseudomonas aeruginosa PA01
aggaggauucgccagccuc

SEQ ID NO: 1413301 - RNA, 20 nt, Pseudomonas aeruginosa PA01
aggagucgacgaaaagcggu

SEQ ID NO: 1413302 - RNA, 17 nt, Pseudomonas aeruginosa PA01
aggagguuggucugcuc

SEQ ID NO: 1413303 - RNA, 17 nt, Pseudomonas aeruginosa PA01
aggauaccgcacggccg

SEQ ID NO: 1413304 - RNA, 13 nt, Pseudomonas aeruginosa PA01
aggauagccggcg

SEQ ID NO: 1413305 - RNA, 14 nt, Pseudomonas aeruginosa PA01
aggauagccggcgc

SEQ ID NO: 1413306 - RNA, 15 nt, Pseudomonas aeruginosa PA01
aggacgagcguccgc

SEQ ID NO: 1413307 - RNA, 17 nt, Pseudomonas aeruginosa PA01
aggacgagcguccgccg

SEQ ID NO: 1413308 - RNA, 19 nt, Pseudomonas aeruginosa PA01
aggacgaugaagaguucgc

SEQ ID NO: 1413309 - RNA, 17 nt, Pseudomonas aeruginosa PA01
aggacgaugaucaccag

SEQ ID NO: 1413310 - RNA, 17 nt, Pseudomonas aeruginosa PA01
aggaccucgaagcuggc

SEQ ID NO: 1413311 - RNA, 16 nt, Pseudomonas aeruginosa PA01
aggacgaagucgccgg

SEQ ID NO: 1413312 - RNA, 18 nt, Pseudomonas aeruginosa PA01
aggacgaagucgccggca

SEQ ID NO: 1413313 - RNA, 19 nt, Pseudomonas aeruginosa PA01
aggacgaagucgccggcau

SEQ ID NO: 1413314 - RNA, 16 nt, Pseudomonas aeruginosa PA01
aggacgccaccaggcc

SEQ ID NO: 1413315 - RNA, 19 nt, Pseudomonas aeruginosa PA01
aggacgcuccugcgccggc

SEQ ID NO: 1413316 - RNA, 22 nt, Pseudomonas aeruginosa PA01
aggacgcuccugcgccggcucg

SEQ ID NO: 1413317 - RNA, 22 nt, Pseudomonas aeruginosa PA01
aggacgcuggcgauaucgaagg

SEQ ID NO: 1413318 - RNA, 14 nt, Pseudomonas aeruginosa PA01
aggacccagaugau

SEQ ID NO: 1413319 - RNA, 23 nt, Pseudomonas aeruginosa PA01
aggaccuggcugaggcguuccag

SEQ ID NO: 1413320 - RNA, 16 nt, Pseudomonas aeruginosa PA01
aggaccuugucgcgca

SEQ ID NO: 1413321 - RNA, 20 nt, Pseudomonas aeruginosa PA01
aggacgaacaaccgcuugcg

SEQ ID NO: 1413322 - RNA, 16 nt, Pseudomonas aeruginosa PA01
aggaccagggcgggcc

SEQ ID NO: 1413323 - RNA, 17 nt, Pseudomonas aeruginosa PA01
aggaccagggcgggccg

SEQ ID NO: 1413324 - RNA, 18 nt, Pseudomonas aeruginosa PA01
aggacaggccgacgucca

SEQ ID NO: 1413325 - RNA, 15 nt, Pseudomonas aeruginosa PA01
aggacagguucaggu

SEQ ID NO: 1413326 - RNA, 14 nt, Pseudomonas aeruginosa PA01
aggacggcaggguc

SEQ ID NO: 1413327 - RNA, 14 nt, Pseudomonas aeruginosa PA01
aggacguccuggcc

SEQ ID NO: 1413328 - RNA, 19 nt, Pseudomonas aeruginosa PA01
aggacugccaacuggcguc

SEQ ID NO: 1413329 - RNA, 21 nt, Pseudomonas aeruginosa PA01
aggagaugcagcgucgcgcgu

SEQ ID NO: 1413330 - RNA, 22 nt, Pseudomonas aeruginosa PA01
aggcugucgcggacccgcgccg

SEQ ID NO: 1413331 - RNA, 15 nt, Pseudomonas aeruginosa PA01
agggccaucagggcg

SEQ ID NO: 1413332 - RNA, 22 nt, Pseudomonas aeruginosa PA01
agggcccauuccacgugcucgc

SEQ ID NO: 1413333 - RNA, 20 nt, Pseudomonas aeruginosa PA01
agggcccacagugccaggcu

SEQ ID NO: 1413334 - RNA, 21 nt, Pseudomonas aeruginosa PA01
agggcccacagugccaggcuc

SEQ ID NO: 1413335 - RNA, 19 nt, Pseudomonas aeruginosa PA01
agggccgagcgcagcgcca

SEQ ID NO: 1413336 - RNA, 15 nt, Pseudomonas aeruginosa PA01
agggccgcgccgacc

SEQ ID NO: 1413337 - RNA, 17 nt, Pseudomonas aeruginosa PA01
agggccgccgaggucag

SEQ ID NO: 1413338 - RNA, 21 nt, Pseudomonas aeruginosa PA01
agggccggaucggccuuggcg

SEQ ID NO: 1413339 - RNA, 23 nt, Pseudomonas aeruginosa PA01
agggccggaugccaccgcucgag

SEQ ID NO: 1413340 - RNA, 13 nt, Pseudomonas aeruginosa PA01
agggccgcucgag

SEQ ID NO: 1413341 - RNA, 15 nt, Pseudomonas aeruginosa PA01
agggccgccagccgc

SEQ ID NO: 1413342 - RNA, 21 nt, Pseudomonas aeruginosa PA01
agggccgccagccgccaggac

SEQ ID NO: 1413343 - RNA, 21 nt, Pseudomonas aeruginosa PA01
agggccuuaccagaagccggc

SEQ ID NO: 1413344 - RNA, 17 nt, Pseudomonas aeruginosa PA01
agggccuugagcacggu

SEQ ID NO: 1413345 - RNA, 23 nt, Pseudomonas aeruginosa PA01
agggccuugagcacgguccgcga

SEQ ID NO: 1413346 - RNA, 15 nt, Pseudomonas aeruginosa PA01
agggccugggcgccg

SEQ ID NO: 1413347 - RNA, 22 nt, Pseudomonas aeruginosa PA01
agggccucuucgcaacggccgu

SEQ ID NO: 1413348 - RNA, 14 nt, Pseudomonas aeruginosa PA01
agggccucgccacg

SEQ ID NO: 1413349 - RNA, 21 nt, Pseudomonas aeruginosa PA01
agggccucggcgaagucgccg

SEQ ID NO: 1413350 - RNA, 14 nt, Pseudomonas aeruginosa PA01
agggcgacgccgau

SEQ ID NO: 1413351 - RNA, 13 nt, Pseudomonas aeruginosa PA01
agggcgaccgcca

SEQ ID NO: 1413352 - RNA, 18 nt, Pseudomonas aeruginosa PA01
agggcgagcagggcgcug

SEQ ID NO: 1413353 - RNA, 15 nt, Pseudomonas aeruginosa PA01
agggccuugccgcga

SEQ ID NO: 1413354 - RNA, 20 nt, Pseudomonas aeruginosa PA01
agggcgaacaaccgcucgcg

SEQ ID NO: 1413355 - RNA, 19 nt, Pseudomonas aeruginosa PA01
agggcgaacaacgccgccg

SEQ ID NO: 1413356 - RNA, 22 nt, Pseudomonas aeruginosa PA01
agggcgaacagcgccgcggcug

SEQ ID NO: 1413357 - RNA, 23 nt, Pseudomonas aeruginosa PA01
agggcgaacagcgccgcggcugg

SEQ ID NO: 1413358 - RNA, 15 nt, Pseudomonas aeruginosa PA01
agggcgaaggucugc

SEQ ID NO: 1413359 - RNA, 15 nt, Pseudomonas aeruginosa PA01
agggcgaagucggcg

SEQ ID NO: 1413360 - RNA, 16 nt, Pseudomonas aeruginosa PA01
agggcgaagucggcgc

SEQ ID NO: 1413361 - RNA, 21 nt, Pseudomonas aeruginosa PA01
agggcgaagucggcgcgccag

SEQ ID NO: 1413362 - RNA, 21 nt, Pseudomonas aeruginosa PA01
agggcgaauaaccgcaucgcg

SEQ ID NO: 1413363 - RNA, 22 nt, Pseudomonas aeruginosa PA01
agggcgaauaaccgcaucgcgg

SEQ ID NO: 1413364 - RNA, 17 nt, Pseudomonas aeruginosa PA01
agggcgaauaacgccac

SEQ ID NO: 1413365 - RNA, 18 nt, Pseudomonas aeruginosa PA01
agggcgaauaacgccacc

SEQ ID NO: 1413366 - RNA, 19 nt, Pseudomonas aeruginosa PA01
agggcgaauaacgccgcag

SEQ ID NO: 1413367 - RNA, 19 nt, Pseudomonas aeruginosa PA01
agggcgaauaccagugccg

SEQ ID NO: 1413368 - RNA, 17 nt, Pseudomonas aeruginosa PA01
agggcgaauagcgccgc

SEQ ID NO: 1413369 - RNA, 14 nt, Pseudomonas aeruginosa PA01
agggcggcgccacc

SEQ ID NO: 1413370 - RNA, 15 nt, Pseudomonas aeruginosa PA01
agggcggcgccgaac

SEQ ID NO: 1413371 - RNA, 14 nt, Pseudomonas aeruginosa PA01
agggcggcgaccgg

SEQ ID NO: 1413372 - RNA, 15 nt, Pseudomonas aeruginosa PA01
agggcggauagcgcg

SEQ ID NO: 1413373 - RNA, 22 nt, Pseudomonas aeruginosa PA01
agggcggauagcgcgcaggcgc

SEQ ID NO: 1413374 - RNA, 22 nt, Pseudomonas aeruginosa PA01
agggcgauccagaagaucagcg

SEQ ID NO: 1413375 - RNA, 18 nt, Pseudomonas aeruginosa PA01
agggcgccaggugcagga

SEQ ID NO: 1413376 - RNA, 12 nt, Pseudomonas aeruginosa PA01
agggcgcugccg

SEQ ID NO: 1413377 - RNA, 13 nt, Pseudomonas aeruginosa PA01
agggcgcugccga

SEQ ID NO: 1413378 - RNA, 19 nt, Pseudomonas aeruginosa PA01
agggcgcugccgaucagcc

SEQ ID NO: 1413379 - RNA, 14 nt, Pseudomonas aeruginosa PA01
agggcgcggcgcca

SEQ ID NO: 1413380 - RNA, 15 nt, Pseudomonas aeruginosa PA01
agggcgcggcgccag

SEQ ID NO: 1413381 - RNA, 16 nt, Pseudomonas aeruginosa PA01
agggcgcguccagcuc

SEQ ID NO: 1413382 - RNA, 19 nt, Pseudomonas aeruginosa PA01
agggcgccgaucaggcgua

SEQ ID NO: 1413383 - RNA, 15 nt, Pseudomonas aeruginosa PA01
agggcgccgccgagg

SEQ ID NO: 1413384 - RNA, 16 nt, Pseudomonas aeruginosa PA01
agggcgccgccgagga

SEQ ID NO: 1413385 - RNA, 18 nt, Pseudomonas aeruginosa PA01
agggcgcaauugcaccgc

SEQ ID NO: 1413386 - RNA, 20 nt, Pseudomonas aeruginosa PA01
agggcgcauaaccgcucgcg

SEQ ID NO: 1413387 - RNA, 14 nt, Pseudomonas aeruginosa PA01
agggcgaggagguu

SEQ ID NO: 1413388 - RNA, 18 nt, Pseudomonas aeruginosa PA01
agggcgaguaagcgcggu

SEQ ID NO: 1413389 - RNA, 19 nt, Pseudomonas aeruginosa PA01
agggcgaguucggcgagca

SEQ ID NO: 1413390 - RNA, 18 nt, Pseudomonas aeruginosa PA01
agggcgacuaccagguuc

SEQ ID NO: 1413391 - RNA, 19 nt, Pseudomonas aeruginosa PA01
agggcgauggccagcgcgu

SEQ ID NO: 1413392 - RNA, 14 nt, Pseudomonas aeruginosa PA01
agggcgaugccgau

SEQ ID NO: 1413393 - RNA, 21 nt, Pseudomonas aeruginosa PA01
agggcgaugccgauggcgccg

SEQ ID NO: 1413394 - RNA, 13 nt, Pseudomonas aeruginosa PA01
agggcgucggcgu

SEQ ID NO: 1413395 - RNA, 22 nt, Pseudomonas aeruginosa PA01
agggcgucgcccucggcgcugg

SEQ ID NO: 1413396 - RNA, 23 nt, Pseudomonas aeruginosa PA01
agggcgucgcccucggcgcuggc

SEQ ID NO: 1413397 - RNA, 17 nt, Pseudomonas aeruginosa PA01
agggcgucgaaggcggc

SEQ ID NO: 1413398 - RNA, 19 nt, Pseudomonas aeruginosa PA01
agggcgucgaaggcggcgc

SEQ ID NO: 1413399 - RNA, 21 nt, Pseudomonas aeruginosa PA01
agggcggcuuccagguacggc

SEQ ID NO: 1413400 - RNA, 17 nt, Pseudomonas aeruginosa PA01
agggcgggccgcucgcg

SEQ ID NO: 1413401 - RNA, 18 nt, Pseudomonas aeruginosa PA01
agggcggcgcggagcugc

SEQ ID NO: 1413402 - RNA, 19 nt, Pseudomonas aeruginosa PA01
agggcggcggcucaggccg

SEQ ID NO: 1413403 - RNA, 16 nt, Pseudomonas aeruginosa PA01
agggcggugagguugc

SEQ ID NO: 1413404 - RNA, 23 nt, Pseudomonas aeruginosa PA01
agggcggugagguugccgccgau

SEQ ID NO: 1413405 - RNA, 18 nt, Pseudomonas aeruginosa PA01
agggcuauguauucggcg

SEQ ID NO: 1413406 - RNA, 20 nt, Pseudomonas aeruginosa PA01
agggcucagcccaggcgccg

SEQ ID NO: 1413407 - RNA, 20 nt, Pseudomonas aeruginosa PA01
agggcugccaccgagggcag

SEQ ID NO: 1413408 - RNA, 21 nt, Pseudomonas aeruginosa PA01
agggcucgugccaucaggccg

SEQ ID NO: 1413409 - RNA, 15 nt, Pseudomonas aeruginosa PA01
agggcugagacgcug

SEQ ID NO: 1413410 - RNA, 22 nt, Pseudomonas aeruginosa PA01
agggcugagacgcugccguucg

SEQ ID NO: 1413411 - RNA, 16 nt, Pseudomonas aeruginosa PA01
agggcguggucggcgg

SEQ ID NO: 1413412 - RNA, 17 nt, Pseudomonas aeruginosa PA01
agggcguggucggcggc

SEQ ID NO: 1413413 - RNA, 23 nt, Pseudomonas aeruginosa PA01
agggcguuucagaacgucggcgg

SEQ ID NO: 1413414 - RNA, 18 nt, Pseudomonas aeruginosa PA01
agggcgucugggacggca

SEQ ID NO: 1413415 - RNA, 20 nt, Pseudomonas aeruginosa PA01
agggcgucugggacggcagc

SEQ ID NO: 1413416 - RNA, 22 nt, Pseudomonas aeruginosa PA01
aggguuucucgcuccccugccg

SEQ ID NO: 1413417 - RNA, 18 nt, Pseudomonas aeruginosa PA01
aggguuggccgcagcagc

SEQ ID NO: 1413418 - RNA, 13 nt, Pseudomonas aeruginosa PA01
aggguucgccgac

SEQ ID NO: 1413419 - RNA, 14 nt, Pseudomonas aeruginosa PA01
aggguucgcugccc

SEQ ID NO: 1413420 - RNA, 18 nt, Pseudomonas aeruginosa PA01
agguagucgcccagcgcc

SEQ ID NO: 1413421 - RNA, 15 nt, Pseudomonas aeruginosa PA01
agguagucgcccggc

SEQ ID NO: 1413422 - RNA, 16 nt, Pseudomonas aeruginosa PA01
agguagugcucggcca

SEQ ID NO: 1413423 - RNA, 13 nt, Pseudomonas aeruginosa PA01
agguagucggcga

SEQ ID NO: 1413424 - RNA, 22 nt, Pseudomonas aeruginosa PA01
agguagucggugaagcgcggcg

SEQ ID NO: 1413425 - RNA, 15 nt, Pseudomonas aeruginosa PA01
agguagugccgcccu

SEQ ID NO: 1413426 - RNA, 20 nt, Pseudomonas aeruginosa PA01
agguagugccgcccuugcca

SEQ ID NO: 1413427 - RNA, 22 nt, Pseudomonas aeruginosa PA01
agguccgccugguccagcaggu

SEQ ID NO: 1413428 - RNA, 23 nt, Pseudomonas aeruginosa PA01
agguccgccugguccagcagguu

SEQ ID NO: 1413429 - RNA, 22 nt, Pseudomonas aeruginosa PA01
agguccgcgccaugccggcgcc

SEQ ID NO: 1413430 - RNA, 15 nt, Pseudomonas aeruginosa PA01
agguccgcgccucgc

SEQ ID NO: 1413431 - RNA, 16 nt, Pseudomonas aeruginosa PA01
agguccgcgccucgcg

SEQ ID NO: 1413432 - RNA, 16 nt, Pseudomonas aeruginosa PA01
agguccggcagcgccu

SEQ ID NO: 1413433 - RNA, 20 nt, Pseudomonas aeruginosa PA01
agguccggguugucguugcg

SEQ ID NO: 1413434 - RNA, 20 nt, Pseudomonas aeruginosa PA01
agguaucggccauggccgag

SEQ ID NO: 1413435 - RNA, 16 nt, Pseudomonas aeruginosa PA01
agguauccgccggccg

SEQ ID NO: 1413436 - RNA, 17 nt, Pseudomonas aeruginosa PA01
agguauccgccggccgg

SEQ ID NO: 1413437 - RNA, 14 nt, Pseudomonas aeruginosa PA01
agguauugcgcgug

SEQ ID NO: 1413438 - RNA, 23 nt, Pseudomonas aeruginosa PA01
agguauugcgcguggcgucggcg

SEQ ID NO: 1413439 - RNA, 14 nt, Pseudomonas aeruginosa PA01
agguauucgcgcuc

SEQ ID NO: 1413440 - RNA, 15 nt, Pseudomonas aeruginosa PA01
agguccaggcgucgg

SEQ ID NO: 1413441 - RNA, 13 nt, Pseudomonas aeruginosa PA01
agggucgcgccgu

SEQ ID NO: 1413442 - RNA, 22 nt, Pseudomonas aeruginosa PA01
agggucgcguagaccaucgccg

SEQ ID NO: 1413443 - RNA, 23 nt, Pseudomonas aeruginosa PA01
agggucgcguagaccaucgccgg

SEQ ID NO: 1413444 - RNA, 22 nt, Pseudomonas aeruginosa PA01
agggucgcguuggcgugcucgc

SEQ ID NO: 1413445 - RNA, 11 nt, Pseudomonas aeruginosa PA01
agggucgcccg

SEQ ID NO: 1413446 - RNA, 17 nt, Pseudomonas aeruginosa PA01
agggucgcagcaggccg

SEQ ID NO: 1413447 - RNA, 18 nt, Pseudomonas aeruginosa PA01
agggucgcagcaggccgc

SEQ ID NO: 1413448 - RNA, 21 nt, Pseudomonas aeruginosa PA01
agggucgcagcaggccgcugg

SEQ ID NO: 1413449 - RNA, 17 nt, Pseudomonas aeruginosa PA01
agggucagcucgacagc

SEQ ID NO: 1413450 - RNA, 21 nt, Pseudomonas aeruginosa PA01
agggucagcucgacagcgucg

SEQ ID NO: 1413451 - RNA, 17 nt, Pseudomonas aeruginosa PA01
agggucagcuggcgcgc

SEQ ID NO: 1413452 - RNA, 17 nt, Pseudomonas aeruginosa PA01
agggucaggccuugacg

SEQ ID NO: 1413453 - RNA, 16 nt, Pseudomonas aeruginosa PA01
aggguguugcgaugga

SEQ ID NO: 1413454 - RNA, 16 nt, Pseudomonas aeruginosa PA01
aggguuccggucggga

SEQ ID NO: 1413455 - RNA, 21 nt, Pseudomonas aeruginosa PA01
agggucuucaggcgugggcca

SEQ ID NO: 1413456 - RNA, 23 nt, Pseudomonas aeruginosa PA01
agggucuugccgguaucgcgcuu

SEQ ID NO: 1413457 - RNA, 16 nt, Pseudomonas aeruginosa PA01
agggugaacuggccgu

SEQ ID NO: 1413458 - RNA, 14 nt, Pseudomonas aeruginosa PA01
agggugaagcugcg

SEQ ID NO: 1413459 - RNA, 21 nt, Pseudomonas aeruginosa PA01
agggugacggugaucgccgcg

SEQ ID NO: 1413460 - RNA, 19 nt, Pseudomonas aeruginosa PA01
agggugacgucgaaaccga

SEQ ID NO: 1413461 - RNA, 17 nt, Pseudomonas aeruginosa PA01
agggcugggcagcgccg

SEQ ID NO: 1413462 - RNA, 17 nt, Pseudomonas aeruginosa PA01
aggggaccaccccgguc

SEQ ID NO: 1413463 - RNA, 15 nt, Pseudomonas aeruginosa PA01
agggcuucccaggcc

SEQ ID NO: 1413464 - RNA, 17 nt, Pseudomonas aeruginosa PA01
agggcuucccaggccag

SEQ ID NO: 1413465 - RNA, 14 nt, Pseudomonas aeruginosa PA01
agggcuucgcgcag

SEQ ID NO: 1413466 - RNA, 22 nt, Pseudomonas aeruginosa PA01
aggggcagaccuggugggcggc

SEQ ID NO: 1413467 - RNA, 15 nt, Pseudomonas aeruginosa PA01
aggggcggcucggcu

SEQ ID NO: 1413468 - RNA, 21 nt, Pseudomonas aeruginosa PA01
aggggcgagagacugaacucg

SEQ ID NO: 1413469 - RNA, 14 nt, Pseudomonas aeruginosa PA01
aggggcgcgccggc

SEQ ID NO: 1413470 - RNA, 15 nt, Pseudomonas aeruginosa PA01
aggggagcgccggcg

SEQ ID NO: 1413471 - RNA, 15 nt, Pseudomonas aeruginosa PA01
aggggcccgaaggcc

SEQ ID NO: 1413472 - RNA, 16 nt, Pseudomonas aeruginosa PA01
aggggccgacgcgcug

SEQ ID NO: 1413473 - RNA, 19 nt, Pseudomonas aeruginosa PA01
aggggcauguccaccgccg

SEQ ID NO: 1413474 - RNA, 14 nt, Pseudomonas aeruginosa PA01
aggcggauggcguu

SEQ ID NO: 1413475 - RNA, 15 nt, Pseudomonas aeruginosa PA01
aggcggauuugccgc

SEQ ID NO: 1413476 - RNA, 16 nt, Pseudomonas aeruginosa PA01
aggcggaucgcccggc

SEQ ID NO: 1413477 - RNA, 17 nt, Pseudomonas aeruginosa PA01
aggcggaucgccgccuu

SEQ ID NO: 1413478 - RNA, 16 nt, Pseudomonas aeruginosa PA01
aggcggcacucggcga

SEQ ID NO: 1413479 - RNA, 21 nt, Pseudomonas aeruginosa PA01
aggcggcacucggcgaccacc

SEQ ID NO: 1413480 - RNA, 16 nt, Pseudomonas aeruginosa PA01
aggcgcgcaccagcgg

SEQ ID NO: 1413481 - RNA, 15 nt, Pseudomonas aeruginosa PA01
aggcgcgcagggccg

SEQ ID NO: 1413482 - RNA, 18 nt, Pseudomonas aeruginosa PA01
aggcgcgccaaggccgcc

SEQ ID NO: 1413483 - RNA, 15 nt, Pseudomonas aeruginosa PA01
aggcgcgcggccagc

SEQ ID NO: 1413484 - RNA, 21 nt, Pseudomonas aeruginosa PA01
aggcggaguagccggcggcga

SEQ ID NO: 1413485 - RNA, 12 nt, Pseudomonas aeruginosa PA01
aggcgcgcgccg

SEQ ID NO: 1413486 - RNA, 15 nt, Pseudomonas aeruginosa PA01
aggcgcgcgccgaac

SEQ ID NO: 1413487 - RNA, 21 nt, Pseudomonas aeruginosa PA01
aggcgcgcgccgaacucgaac

SEQ ID NO: 1413488 - RNA, 13 nt, Pseudomonas aeruginosa PA01
aggcgcgccgguu

SEQ ID NO: 1413489 - RNA, 22 nt, Pseudomonas aeruginosa PA01
aggcgcgccuggaucagcgccu

SEQ ID NO: 1413490 - RNA, 14 nt, Pseudomonas aeruginosa PA01
aggcgcgccuggcc

SEQ ID NO: 1413491 - RNA, 19 nt, Pseudomonas aeruginosa PA01
aggcgcgccuggcccuggc

SEQ ID NO: 1413492 - RNA, 15 nt, Pseudomonas aeruginosa PA01
aggcggcgcagcaac

SEQ ID NO: 1413493 - RNA, 16 nt, Pseudomonas aeruginosa PA01
aggcggcgaaggccgc

SEQ ID NO: 1413494 - RNA, 13 nt, Pseudomonas aeruginosa PA01
aggcggccgcugg

SEQ ID NO: 1413495 - RNA, 14 nt, Pseudomonas aeruginosa PA01
aggcggccgcuggc

SEQ ID NO: 1413496 - RNA, 15 nt, Pseudomonas aeruginosa PA01
aggcggccgcuggcg

SEQ ID NO: 1413497 - RNA, 17 nt, Pseudomonas aeruginosa PA01
aggcggccagccuuccu

SEQ ID NO: 1413498 - RNA, 21 nt, Pseudomonas aeruginosa PA01
aggcggccgaagaacaccacg

SEQ ID NO: 1413499 - RNA, 18 nt, Pseudomonas aeruginosa PA01
aggcggcgucgucgcugc

SEQ ID NO: 1413500 - RNA, 23 nt, Pseudomonas aeruginosa PA01
aggcggcucccuuuuuucauggg

SEQ ID NO: 1413501 - RNA, 19 nt, Pseudomonas aeruginosa PA01
aggcggcgcggcggguggc

SEQ ID NO: 1413502 - RNA, 23 nt, Pseudomonas aeruginosa PA01
aggcggcgcggcggguggcgcug

SEQ ID NO: 1413503 - RNA, 20 nt, Pseudomonas aeruginosa PA01
aggcggcggucaucgcgccg

SEQ ID NO: 1413504 - RNA, 22 nt, Pseudomonas aeruginosa PA01
aggcggcggucaucgcgccgcc

SEQ ID NO: 1413505 - RNA, 22 nt, Pseudomonas aeruginosa PA01
aggcggcgcuguuugcggcgca

SEQ ID NO: 1413506 - RNA, 20 nt, Pseudomonas aeruginosa PA01
aggcggcggaagaagcccuu

SEQ ID NO: 1413507 - RNA, 20 nt, Pseudomonas aeruginosa PA01
aggcuggcggcaucggcgcc

SEQ ID NO: 1413508 - RNA, 23 nt, Pseudomonas aeruginosa PA01
aggcugggguugcggcgcccgcc

SEQ ID NO: 1413509 - RNA, 18 nt, Pseudomonas aeruginosa PA01
aggcugguaugcagcaac

SEQ ID NO: 1413510 - RNA, 21 nt, Pseudomonas aeruginosa PA01
aggcugguggucaccgccagc

SEQ ID NO: 1413511 - RNA, 16 nt, Pseudomonas aeruginosa PA01
aggcuggcgucgacgc

SEQ ID NO: 1413512 - RNA, 19 nt, Pseudomonas aeruginosa PA01
aggcugugcgccaggccgg

SEQ ID NO: 1413513 - RNA, 13 nt, Pseudomonas aeruginosa PA01
aggcuguggcgcg

SEQ ID NO: 1413514 - RNA, 17 nt, Pseudomonas aeruginosa PA01
aggcuguggcgcggcug

SEQ ID NO: 1413515 - RNA, 22 nt, Pseudomonas aeruginosa PA01
aggcuguugcccugggccggcg

SEQ ID NO: 1413516 - RNA, 14 nt, Pseudomonas aeruginosa PA01
aggcugucgucgag

SEQ ID NO: 1413517 - RNA, 21 nt, Pseudomonas aeruginosa PA01
aggcugucgucgaggguggcg

SEQ ID NO: 1413518 - RNA, 17 nt, Pseudomonas aeruginosa PA01
aggcugugccccaggca

SEQ ID NO: 1413519 - RNA, 15 nt, Pseudomonas aeruginosa PA01
aggcuguagccggcg

SEQ ID NO: 1413520 - RNA, 19 nt, Pseudomonas aeruginosa PA01
aggcuguagccucccgccg

SEQ ID NO: 1413521 - RNA, 21 nt, Pseudomonas aeruginosa PA01
aggcuguagccucccgccgcg

SEQ ID NO: 1413522 - RNA, 12 nt, Pseudomonas aeruginosa PA01
aggcugucaggg

SEQ ID NO: 1413523 - RNA, 18 nt, Pseudomonas aeruginosa PA01
aggcuguccacgccgaag

SEQ ID NO: 1413524 - RNA, 13 nt, Pseudomonas aeruginosa PA01
aggcucugcucca

SEQ ID NO: 1413525 - RNA, 13 nt, Pseudomonas aeruginosa PA01
aggcucuucucga

SEQ ID NO: 1413526 - RNA, 10 nt, Pseudomonas aeruginosa PA01
aggcuggccu

SEQ ID NO: 1413527 - RNA, 23 nt, Pseudomonas aeruginosa PA01
aggcugaaaaaaggggaugccau

SEQ ID NO: 1413528 - RNA, 19 nt, Pseudomonas aeruginosa PA01
aggcucgccccggcggcga

SEQ ID NO: 1413529 - RNA, 19 nt, Pseudomonas aeruginosa PA01
aggcucgacaggucggcga

SEQ ID NO: 1413530 - RNA, 20 nt, Pseudomonas aeruginosa PA01
aggcucgacaggucggcgaa

SEQ ID NO: 1413531 - RNA, 20 nt, Pseudomonas aeruginosa PA01
aggcucgagccgaacuccgg

SEQ ID NO: 1413532 - RNA, 19 nt, Pseudomonas aeruginosa PA01
aggcucgguucugcgcacc

SEQ ID NO: 1413533 - RNA, 13 nt, Pseudomonas aeruginosa PA01
aggcucgccgcca

SEQ ID NO: 1413534 - RNA, 13 nt, Pseudomonas aeruginosa PA01
aggcucggccugu

SEQ ID NO: 1413535 - RNA, 12 nt, Pseudomonas aeruginosa PA01
aggcucggcggc

SEQ ID NO: 1413536 - RNA, 14 nt, Pseudomonas aeruginosa PA01
aggcucggcggcca

SEQ ID NO: 1413537 - RNA, 15 nt, Pseudomonas aeruginosa PA01
aggcucggcggccau

SEQ ID NO: 1413538 - RNA, 16 nt, Pseudomonas aeruginosa PA01
aggcucccccgcgccg

SEQ ID NO: 1413539 - RNA, 20 nt, Pseudomonas aeruginosa PA01
aggcucccccgcgccgccgg

SEQ ID NO: 1413540 - RNA, 22 nt, Pseudomonas aeruginosa PA01
aggcucccccgcgccgccggau

SEQ ID NO: 1413541 - RNA, 14 nt, Pseudomonas aeruginosa PA01
aggcgucgcgccag

SEQ ID NO: 1413542 - RNA, 16 nt, Pseudomonas aeruginosa PA01
aggcgucgcgccagca

SEQ ID NO: 1413543 - RNA, 18 nt, Pseudomonas aeruginosa PA01
aggcgucgcgccagcacc

SEQ ID NO: 1413544 - RNA, 21 nt, Pseudomonas aeruginosa PA01
aggcgucgcgccagcaccgug

SEQ ID NO: 1413545 - RNA, 11 nt, Pseudomonas aeruginosa PA01
aggcgucggcu

SEQ ID NO: 1413546 - RNA, 22 nt, Pseudomonas aeruginosa PA01
aggcgucguccucgaaagccgc

SEQ ID NO: 1413547 - RNA, 17 nt, Pseudomonas aeruginosa PA01
aggcgucgucgaccucg

SEQ ID NO: 1413548 - RNA, 14 nt, Pseudomonas aeruginosa PA01
aggcguacgucgau

SEQ ID NO: 1413549 - RNA, 18 nt, Pseudomonas aeruginosa PA01
aggcgucccauggcgcca

SEQ ID NO: 1413550 - RNA, 18 nt, Pseudomonas aeruginosa PA01
aggcgucccgcuccagcc

SEQ ID NO: 1413551 - RNA, 19 nt, Pseudomonas aeruginosa PA01
aggcgucccuggagcaggg

SEQ ID NO: 1413552 - RNA, 13 nt, Pseudomonas aeruginosa PA01
aggcguccgcugg

SEQ ID NO: 1413553 - RNA, 15 nt, Pseudomonas aeruginosa PA01
aggcguccaccggcg

SEQ ID NO: 1413554 - RNA, 13 nt, Pseudomonas aeruginosa PA01
aggcgucgccgac

SEQ ID NO: 1413555 - RNA, 14 nt, Pseudomonas aeruginosa PA01
aggcgucgccgucg

SEQ ID NO: 1413556 - RNA, 21 nt, Pseudomonas aeruginosa PA01
aggcgaaccuggagaaauccg

SEQ ID NO: 1413557 - RNA, 20 nt, Pseudomonas aeruginosa PA01
aggcgacccgggucaggccg

SEQ ID NO: 1413558 - RNA, 19 nt, Pseudomonas aeruginosa PA01
aggcgaaccacaccagguc

SEQ ID NO: 1413559 - RNA, 16 nt, Pseudomonas aeruginosa PA01
aggcgaacugccgacg

SEQ ID NO: 1413560 - RNA, 22 nt, Pseudomonas aeruginosa PA01
aggcgaacugccgacggcggcg

SEQ ID NO: 1413561 - RNA, 16 nt, Pseudomonas aeruginosa PA01
aggcgaccuuggccag

SEQ ID NO: 1413562 - RNA, 17 nt, Pseudomonas aeruginosa PA01
aggcgaguaccaccgug

SEQ ID NO: 1413563 - RNA, 13 nt, Pseudomonas aeruginosa PA01
aggcgagcagcgg

SEQ ID NO: 1413564 - RNA, 15 nt, Pseudomonas aeruginosa PA01
aggcgagcagcggca

SEQ ID NO: 1413565 - RNA, 13 nt, Pseudomonas aeruginosa PA01
aggcgaggauggc

SEQ ID NO: 1413566 - RNA, 21 nt, Pseudomonas aeruginosa PA01
aggcgacguuuuucccguggg

SEQ ID NO: 1413567 - RNA, 15 nt, Pseudomonas aeruginosa PA01
aggcgacgaucagcc

SEQ ID NO: 1413568 - RNA, 18 nt, Pseudomonas aeruginosa PA01
aggcgacgaucagcccgc

SEQ ID NO: 1413569 - RNA, 20 nt, Pseudomonas aeruginosa PA01
aggcgacgaucagcccgccg

SEQ ID NO: 1413570 - RNA, 12 nt, Pseudomonas aeruginosa PA01
aggcgacgaaac

SEQ ID NO: 1413571 - RNA, 16 nt, Pseudomonas aeruginosa PA01
aggcgacgccgcgcug

SEQ ID NO: 1413572 - RNA, 19 nt, Pseudomonas aeruginosa PA01
aggcgcagcagcaugaugc

SEQ ID NO: 1413573 - RNA, 20 nt, Pseudomonas aeruginosa PA01
aggcgcagcagcaugaugcc

SEQ ID NO: 1413574 - RNA, 15 nt, Pseudomonas aeruginosa PA01
aggcgcagcagcgac

SEQ ID NO: 1413575 - RNA, 15 nt, Pseudomonas aeruginosa PA01
aggcgcagcuguuca

SEQ ID NO: 1413576 - RNA, 18 nt, Pseudomonas aeruginosa PA01
aggcgcaccagcaggcgc

SEQ ID NO: 1413577 - RNA, 18 nt, Pseudomonas aeruginosa PA01
aggcgcaaccagaccagc

SEQ ID NO: 1413578 - RNA, 20 nt, Pseudomonas aeruginosa PA01
aggcgcaccaggccaggcug

SEQ ID NO: 1413579 - RNA, 18 nt, Pseudomonas aeruginosa PA01
aggcgcaggucggccucg

SEQ ID NO: 1413580 - RNA, 22 nt, Pseudomonas aeruginosa PA01
aggcgcaggucggccucggcga

SEQ ID NO: 1413581 - RNA, 16 nt, Pseudomonas aeruginosa PA01
aggcgcaguaggccug

SEQ ID NO: 1413582 - RNA, 22 nt, Pseudomonas aeruginosa PA01
aggcgccgcuugagaccuucgc

SEQ ID NO: 1413583 - RNA, 22 nt, Pseudomonas aeruginosa PA01
aggcgccggaccaacugcgaac

SEQ ID NO: 1413584 - RNA, 22 nt, Pseudomonas aeruginosa PA01
aggcgccuuccaggcgugccug

SEQ ID NO: 1413585 - RNA, 12 nt, Pseudomonas aeruginosa PA01
aggcgccggcgg

SEQ ID NO: 1413586 - RNA, 18 nt, Pseudomonas aeruginosa PA01
aggccucggcauccucgc

SEQ ID NO: 1413587 - RNA, 20 nt, Pseudomonas aeruginosa PA01
aggccucggcgaugccggag

SEQ ID NO: 1413588 - RNA, 19 nt, Pseudomonas aeruginosa PA01
aggccucggucaggcgcug

SEQ ID NO: 1413589 - RNA, 14 nt, Pseudomonas aeruginosa PA01
aggccucgguggcc

SEQ ID NO: 1413590 - RNA, 19 nt, Pseudomonas aeruginosa PA01
aggccucgucgaucucgcc

SEQ ID NO: 1413591 - RNA, 13 nt, Pseudomonas aeruginosa PA01
aggccucgucguu

SEQ ID NO: 1413592 - RNA, 19 nt, Pseudomonas aeruginosa PA01
aggccuccucguaggcguc

SEQ ID NO: 1413593 - RNA, 23 nt, Pseudomonas aeruginosa PA01
aggccuccucguaggcguccugg

SEQ ID NO: 1413594 - RNA, 18 nt, Pseudomonas aeruginosa PA01
aggccucgagguucucga

SEQ ID NO: 1413595 - RNA, 19 nt, Pseudomonas aeruginosa PA01
aggccgaucagcggcgguc

SEQ ID NO: 1413596 - RNA, 16 nt, Pseudomonas aeruginosa PA01
aggccgauguccucga

SEQ ID NO: 1413597 - RNA, 14 nt, Pseudomonas aeruginosa PA01
aggccgaucgccuc

SEQ ID NO: 1413598 - RNA, 21 nt, Pseudomonas aeruginosa PA01
aggccgaucucgugggccagc

SEQ ID NO: 1413599 - RNA, 18 nt, Pseudomonas aeruginosa PA01
aggccgaugaacgccgcg

SEQ ID NO: 1413600 - RNA, 19 nt, Pseudomonas aeruginosa PA01
aggccgaugaacgccgcga

SEQ ID NO: 1413601 - RNA, 12 nt, Pseudomonas aeruginosa PA01
aggccgauggcc

SEQ ID NO: 1413602 - RNA, 15 nt, Pseudomonas aeruginosa PA01
aggccgagcgcgccg

SEQ ID NO: 1413603 - RNA, 17 nt, Pseudomonas aeruginosa PA01
aggccgagcgcgccgcc

SEQ ID NO: 1413604 - RNA, 19 nt, Pseudomonas aeruginosa PA01
aggccgagcgcgccgccga

SEQ ID NO: 1413605 - RNA, 23 nt, Pseudomonas aeruginosa PA01
aggccgagcgugcgcaugcccgc

SEQ ID NO: 1413606 - RNA, 19 nt, Pseudomonas aeruginosa PA01
aggccgagcugcucgaagc

SEQ ID NO: 1413607 - RNA, 21 nt, Pseudomonas aeruginosa PA01
aggccgaggaggacgucgcgg

SEQ ID NO: 1413608 - RNA, 20 nt, Pseudomonas aeruginosa PA01
aggccgaggaugcucgccug

SEQ ID NO: 1413609 - RNA, 21 nt, Pseudomonas aeruginosa PA01
aggccgaggaugcucgccugg

SEQ ID NO: 1413610 - RNA, 23 nt, Pseudomonas aeruginosa PA01
aggcccgguugagauccuggccg

SEQ ID NO: 1413611 - RNA, 15 nt, Pseudomonas aeruginosa PA01
aggcccucagcggcg

SEQ ID NO: 1413612 - RNA, 24 nt, Pseudomonas aeruginosa PA01
aggcccucagcggcggugcgccgg

SEQ ID NO: 1413613 - RNA, 19 nt, Pseudomonas aeruginosa PA01
aggccgaucaccagcgcca

SEQ ID NO: 1413614 - RNA, 15 nt, Pseudomonas aeruginosa PA01
aggccgaguccgcgc

SEQ ID NO: 1413615 - RNA, 22 nt, Pseudomonas aeruginosa PA01
aggccgaucaccaccagcgccg

SEQ ID NO: 1413616 - RNA, 17 nt, Pseudomonas aeruginosa PA01
aggccgaggucggcggc

SEQ ID NO: 1413617 - RNA, 14 nt, Pseudomonas aeruginosa PA01
aggccgaggcgcuu

SEQ ID NO: 1413618 - RNA, 23 nt, Pseudomonas aeruginosa PA01
aggcgaaaaaaagccccgccgaa

SEQ ID NO: 1413619 - RNA, 23 nt, Pseudomonas aeruginosa PA01
aggccuucggcgccggagcuggu

SEQ ID NO: 1413620 - RNA, 16 nt, Pseudomonas aeruginosa PA01
aggcgaaagucggcgc

SEQ ID NO: 1413621 - RNA, 16 nt, Pseudomonas aeruginosa PA01
aggcgaacacgucggc

SEQ ID NO: 1413622 - RNA, 18 nt, Pseudomonas aeruginosa PA01
aggcgaacacgucggcgc

SEQ ID NO: 1413623 - RNA, 21 nt, Pseudomonas aeruginosa PA01
aggcgaacagggccaucaggg

SEQ ID NO: 1413624 - RNA, 16 nt, Pseudomonas aeruginosa PA01
aggccugggucaccag

SEQ ID NO: 1413625 - RNA, 17 nt, Pseudomonas aeruginosa PA01
aggccuuccagaacgcc

SEQ ID NO: 1413626 - RNA, 22 nt, Pseudomonas aeruginosa PA01
aggccuucgacgguucgcgaac

SEQ ID NO: 1413627 - RNA, 14 nt, Pseudomonas aeruginosa PA01
aggccuucgccgac

SEQ ID NO: 1413628 - RNA, 19 nt, Pseudomonas aeruginosa PA01
aggccuugcgcggcgccgg

SEQ ID NO: 1413629 - RNA, 20 nt, Pseudomonas aeruginosa PA01
aggccuggcgcaacaggcgc

SEQ ID NO: 1413630 - RNA, 16 nt, Pseudomonas aeruginosa PA01
aggccuggccguugcg

SEQ ID NO: 1413631 - RNA, 16 nt, Pseudomonas aeruginosa PA01
aggccuggagcgccuc

SEQ ID NO: 1413632 - RNA, 16 nt, Pseudomonas aeruginosa PA01
aggccuggaacaccag

SEQ ID NO: 1413633 - RNA, 17 nt, Pseudomonas aeruginosa PA01
aggccuggaacaccagg

SEQ ID NO: 1413634 - RNA, 19 nt, Pseudomonas aeruginosa PA01
aggccuggaacaccaggcc

SEQ ID NO: 1413635 - RNA, 21 nt, Pseudomonas aeruginosa PA01
aggccuggaacaccaggccgc

SEQ ID NO: 1413636 - RNA, 23 nt, Pseudomonas aeruginosa PA01
cacagguugacgaugcggcccgc

SEQ ID NO: 1413637 - RNA, 18 nt, Pseudomonas aeruginosa PA01
cacaggcguuauccgccg

SEQ ID NO: 1413638 - RNA, 19 nt, Pseudomonas aeruginosa PA01
cacaggcguuauccgccga

SEQ ID NO: 1413639 - RNA, 19 nt, Pseudomonas aeruginosa PA01
cacaggcguuauccgccgc

SEQ ID NO: 1413640 - RNA, 19 nt, Pseudomonas aeruginosa PA01
cacagggucggcaggaccg

SEQ ID NO: 1413641 - RNA, 17 nt, Pseudomonas aeruginosa PA01
cacagcugccagccccg

SEQ ID NO: 1413642 - RNA, 16 nt, Pseudomonas aeruginosa PA01
cacagcguggccagcg

SEQ ID NO: 1413643 - RNA, 17 nt, Pseudomonas aeruginosa PA01
cacagcguggccagcgc

SEQ ID NO: 1413644 - RNA, 21 nt, Pseudomonas aeruginosa PA01
cacaggccggcuaaccgcgaa

SEQ ID NO: 1413645 - RNA, 23 nt, Pseudomonas aeruginosa PA01
cacaggccggcuaaccgcgaagc

SEQ ID NO: 1413646 - RNA, 17 nt, Pseudomonas aeruginosa PA01
cacaggcccuggaucac

SEQ ID NO: 1413647 - RNA, 19 nt, Pseudomonas aeruginosa PA01
cacaggacgagacgccgag

SEQ ID NO: 1413648 - RNA, 22 nt, Pseudomonas aeruginosa PA01
cacauagagggucagccggccg

SEQ ID NO: 1413649 - RNA, 17 nt, Pseudomonas aeruginosa PA01
cacaucaccuucgcccu

SEQ ID NO: 1413650 - RNA, 19 nt, Pseudomonas aeruginosa PA01
cacaucgcccggcagcagg

SEQ ID NO: 1413651 - RNA, 17 nt, Pseudomonas aeruginosa PA01
cacaucgaccaggucgc

SEQ ID NO: 1413652 - RNA, 22 nt, Pseudomonas aeruginosa PA01
cacaucgaccaggucgccaugc

SEQ ID NO: 1413653 - RNA, 15 nt, Pseudomonas aeruginosa PA01
cacauccuugccgua

SEQ ID NO: 1413654 - RNA, 19 nt, Pseudomonas aeruginosa PA01
cacauccaguguggcggcg

SEQ ID NO: 1413655 - RNA, 21 nt, Pseudomonas aeruginosa PA01
cacauccaguguggcggcgug

SEQ ID NO: 1413656 - RNA, 13 nt, Pseudomonas aeruginosa PA01
cacaugcaccacc

SEQ ID NO: 1413657 - RNA, 15 nt, Pseudomonas aeruginosa PA01
cacaugcaccaccug

SEQ ID NO: 1413658 - RNA, 14 nt, Pseudomonas aeruginosa PA01
cacaugcaccaggc

SEQ ID NO: 1413659 - RNA, 20 nt, Pseudomonas aeruginosa PA01
cacaugcaggucgugcagcc

SEQ ID NO: 1413660 - RNA, 22 nt, Pseudomonas aeruginosa PA01
cacaugcaggucgugcagcccg

SEQ ID NO: 1413661 - RNA, 15 nt, Pseudomonas aeruginosa PA01
caccacgcggugcca

SEQ ID NO: 1413662 - RNA, 20 nt, Pseudomonas aeruginosa PA01
caccacgguguugccguggu

SEQ ID NO: 1413663 - RNA, 16 nt, Pseudomonas aeruginosa PA01
caccacgcaggcgcgu

SEQ ID NO: 1413664 - RNA, 18 nt, Pseudomonas aeruginosa PA01
caccacgcauugucgggc

SEQ ID NO: 1413665 - RNA, 15 nt, Pseudomonas aeruginosa PA01
caccacgccgucgcc

SEQ ID NO: 1413666 - RNA, 20 nt, Pseudomonas aeruginosa PA01
caccacgccgucgccgcuga

SEQ ID NO: 1413667 - RNA, 14 nt, Pseudomonas aeruginosa PA01
caccaccgcgccga

SEQ ID NO: 1413668 - RNA, 16 nt, Pseudomonas aeruginosa PA01
caccaccgcgccgaug

SEQ ID NO: 1413669 - RNA, 13 nt, Pseudomonas aeruginosa PA01
caccaccgccgcc

SEQ ID NO: 1413670 - RNA, 15 nt, Pseudomonas aeruginosa PA01
caccaccgccgccag

SEQ ID NO: 1413671 - RNA, 17 nt, Pseudomonas aeruginosa PA01
caccaccgccgccagca

SEQ ID NO: 1413672 - RNA, 16 nt, Pseudomonas aeruginosa PA01
caccacaaggugggca

SEQ ID NO: 1413673 - RNA, 13 nt, Pseudomonas aeruginosa PA01
cacaugcgcucgu

SEQ ID NO: 1413674 - RNA, 16 nt, Pseudomonas aeruginosa PA01
cacaugggcgaccggu

SEQ ID NO: 1413675 - RNA, 12 nt, Pseudomonas aeruginosa PA01
cacauggcgguc

SEQ ID NO: 1413676 - RNA, 19 nt, Pseudomonas aeruginosa PA01
cacaaagccuugacccgca

SEQ ID NO: 1413677 - RNA, 16 nt, Pseudomonas aeruginosa PA01
cacaaaaaacccggcg

SEQ ID NO: 1413678 - RNA, 13 nt, Pseudomonas aeruginosa PA01
cacaccaggucgc

SEQ ID NO: 1413679 - RNA, 14 nt, Pseudomonas aeruginosa PA01
cacaccaggucgcc

SEQ ID NO: 1413680 - RNA, 15 nt, Pseudomonas aeruginosa PA01
cacacaugcaggucg

SEQ ID NO: 1413681 - RNA, 20 nt, Pseudomonas aeruginosa PA01
cacacaugcaggucgugcag

SEQ ID NO: 1413682 - RNA, 17 nt, Pseudomonas aeruginosa PA01
cacaccacgcauugucg

SEQ ID NO: 1413683 - RNA, 16 nt, Pseudomonas aeruginosa PA01
cacaccuccagcggcu

SEQ ID NO: 1413684 - RNA, 19 nt, Pseudomonas aeruginosa PA01
cacagccauagcgccggca

SEQ ID NO: 1413685 - RNA, 12 nt, Pseudomonas aeruginosa PA01
cacagacgcagc

SEQ ID NO: 1413686 - RNA, 18 nt, Pseudomonas aeruginosa PA01
cacagaggucgcugacca

SEQ ID NO: 1413687 - RNA, 21 nt, Pseudomonas aeruginosa PA01
cacagaggucgcugaccaccc

SEQ ID NO: 1413688 - RNA, 14 nt, Pseudomonas aeruginosa PA01
cacagaucgccagc

SEQ ID NO: 1413689 - RNA, 16 nt, Pseudomonas aeruginosa PA01
cacagaucgccagcuc

SEQ ID NO: 1413690 - RNA, 16 nt, Pseudomonas aeruginosa PA01
caaugaaaaaggcgau

SEQ ID NO: 1413691 - RNA, 15 nt, Pseudomonas aeruginosa PA01
caaugaaaaagggau

SEQ ID NO: 1413692 - RNA, 21 nt, Pseudomonas aeruginosa PA01
caaugaaaaagggaugccgcc

SEQ ID NO: 1413693 - RNA, 23 nt, Pseudomonas aeruginosa PA01
caaugaaaaagggaugccgccgg

SEQ ID NO: 1413694 - RNA, 20 nt, Pseudomonas aeruginosa PA01
caaggugccgaggucgucgc

SEQ ID NO: 1413695 - RNA, 14 nt, Pseudomonas aeruginosa PA01
caaggugaagugau

SEQ ID NO: 1413696 - RNA, 21 nt, Pseudomonas aeruginosa PA01
caaggucgucucagaccuucc

SEQ ID NO: 1413697 - RNA, 23 nt, Pseudomonas aeruginosa PA01
caaggucggucucgccaccccgc

SEQ ID NO: 1413698 - RNA, 15 nt, Pseudomonas aeruginosa PA01
caaggccgccaggcc

SEQ ID NO: 1413699 - RNA, 15 nt, Pseudomonas aeruginosa PA01
caagggccugggcgc

SEQ ID NO: 1413700 - RNA, 20 nt, Pseudomonas aeruginosa PA01
caagggccugggcgccgcca

SEQ ID NO: 1413701 - RNA, 13 nt, Pseudomonas aeruginosa PA01
caagggcgccgcc

SEQ ID NO: 1413702 - RNA, 23 nt, Pseudomonas aeruginosa PA01
caaggguuucgugaaacgccaga

SEQ ID NO: 1413703 - RNA, 19 nt, Pseudomonas aeruginosa PA01
caaugcggggcguucugcu

SEQ ID NO: 1413704 - RNA, 18 nt, Pseudomonas aeruginosa PA01
caaugcaccugcgccccg

SEQ ID NO: 1413705 - RNA, 13 nt, Pseudomonas aeruginosa PA01
caauuccgccgcg

SEQ ID NO: 1413706 - RNA, 13 nt, Pseudomonas aeruginosa PA01
caauucgucggcc

SEQ ID NO: 1413707 - RNA, 16 nt, Pseudomonas aeruginosa PA01
caauucgcggacgccg

SEQ ID NO: 1413708 - RNA, 23 nt, Pseudomonas aeruginosa PA01
caaugcguuccuguccauuucca

SEQ ID NO: 1413709 - RNA, 15 nt, Pseudomonas aeruginosa PA01
caauggccggcgggc

SEQ ID NO: 1413710 - RNA, 19 nt, Pseudomonas aeruginosa PA01
caauggauguugccgccgc

SEQ ID NO: 1413711 - RNA, 18 nt, Pseudomonas aeruginosa PA01
caccacucgccagcgcgc

SEQ ID NO: 1413712 - RNA, 16 nt, Pseudomonas aeruginosa PA01
caccacuggaaacgcc

SEQ ID NO: 1413713 - RNA, 20 nt, Pseudomonas aeruginosa PA01
caccacguugcgccgcagca

SEQ ID NO: 1413714 - RNA, 21 nt, Pseudomonas aeruginosa PA01
caccacguugcgccgcagcaa

SEQ ID NO: 1413715 - RNA, 13 nt, Pseudomonas aeruginosa PA01
caccacguugcgc

SEQ ID NO: 1413716 - RNA, 17 nt, Pseudomonas aeruginosa PA01
caccacguucggcgcgg

SEQ ID NO: 1413717 - RNA, 19 nt, Pseudomonas aeruginosa PA01
caccacguucggcgcgggu

SEQ ID NO: 1413718 - RNA, 15 nt, Pseudomonas aeruginosa PA01
caccaggcgucgcac

SEQ ID NO: 1413719 - RNA, 16 nt, Pseudomonas aeruginosa PA01
caccaggcgucgcacc

SEQ ID NO: 1413720 - RNA, 17 nt, Pseudomonas aeruginosa PA01
caccaggcucgccccgg

SEQ ID NO: 1413721 - RNA, 23 nt, Pseudomonas aeruginosa PA01
caccaggcucgccccggcggcga

SEQ ID NO: 1413722 - RNA, 15 nt, Pseudomonas aeruginosa PA01
caccaggcucggacu

SEQ ID NO: 1413723 - RNA, 15 nt, Pseudomonas aeruginosa PA01
caccaggcgaugcgc

SEQ ID NO: 1413724 - RNA, 15 nt, Pseudomonas aeruginosa PA01
caccaggccgcugcc

SEQ ID NO: 1413725 - RNA, 14 nt, Pseudomonas aeruginosa PA01
caccaggcgccggg

SEQ ID NO: 1413726 - RNA, 17 nt, Pseudomonas aeruginosa PA01
caccaggcgccgggucg

SEQ ID NO: 1413727 - RNA, 13 nt, Pseudomonas aeruginosa PA01
caccacuucgcgg

SEQ ID NO: 1413728 - RNA, 20 nt, Pseudomonas aeruginosa PA01
caccacuucgcggaccacgu

SEQ ID NO: 1413729 - RNA, 16 nt, Pseudomonas aeruginosa PA01
caccagucccuggccg

SEQ ID NO: 1413730 - RNA, 17 nt, Pseudomonas aeruginosa PA01
caccagguugcccggcu

SEQ ID NO: 1413731 - RNA, 19 nt, Pseudomonas aeruginosa PA01
caccagggccucggggccg

SEQ ID NO: 1413732 - RNA, 15 nt, Pseudomonas aeruginosa PA01
caccaggcugccgcc

SEQ ID NO: 1413733 - RNA, 17 nt, Pseudomonas aeruginosa PA01
caccaggcugccgccgu

SEQ ID NO: 1413734 - RNA, 21 nt, Pseudomonas aeruginosa PA01
caccagggccuugccgcgacc

SEQ ID NO: 1413735 - RNA, 14 nt, Pseudomonas aeruginosa PA01
caccagggcgaugg

SEQ ID NO: 1413736 - RNA, 18 nt, Pseudomonas aeruginosa PA01
caccaggucgucgucacg

SEQ ID NO: 1413737 - RNA, 16 nt, Pseudomonas aeruginosa PA01
caccaguggcgccgcc

SEQ ID NO: 1413738 - RNA, 17 nt, Pseudomonas aeruginosa PA01
caccaguggcgccgcca

SEQ ID NO: 1413739 - RNA, 13 nt, Pseudomonas aeruginosa PA01
caccauaccgaca

SEQ ID NO: 1413740 - RNA, 18 nt, Pseudomonas aeruginosa PA01
caccauagcgagccgcgc

SEQ ID NO: 1413741 - RNA, 14 nt, Pseudomonas aeruginosa PA01
caccauccgccgca

SEQ ID NO: 1413742 - RNA, 14 nt, Pseudomonas aeruginosa PA01
caccaucagccagc

SEQ ID NO: 1413743 - RNA, 16 nt, Pseudomonas aeruginosa PA01
caccaucacgucgcgc

SEQ ID NO: 1413744 - RNA, 14 nt, Pseudomonas aeruginosa PA01
caccaucaccgcca

SEQ ID NO: 1413745 - RNA, 14 nt, Pseudomonas aeruginosa PA01
caccaucgcggcga

SEQ ID NO: 1413746 - RNA, 15 nt, Pseudomonas aeruginosa PA01
caccaucgcggcgau

SEQ ID NO: 1413747 - RNA, 17 nt, Pseudomonas aeruginosa PA01
caccaucgcggcgaugg

SEQ ID NO: 1413748 - RNA, 21 nt, Pseudomonas aeruginosa PA01
caccaucgcggcgauggccgc

SEQ ID NO: 1413749 - RNA, 16 nt, Pseudomonas aeruginosa PA01
caccaugcccgcuggg

SEQ ID NO: 1413750 - RNA, 14 nt, Pseudomonas aeruginosa PA01
caccaugaucaucg

SEQ ID NO: 1413751 - RNA, 20 nt, Pseudomonas aeruginosa PA01
caccaugaucaucggcuggc

SEQ ID NO: 1413752 - RNA, 15 nt, Pseudomonas aeruginosa PA01
cacccgcagcggcag

SEQ ID NO: 1413753 - RNA, 16 nt, Pseudomonas aeruginosa PA01
cacccgcagcggcagc

SEQ ID NO: 1413754 - RNA, 17 nt, Pseudomonas aeruginosa PA01
cacccgcagcggcagcg

SEQ ID NO: 1413755 - RNA, 22 nt, Pseudomonas aeruginosa PA01
cacccgcagccgcgugcgcgcc

SEQ ID NO: 1413756 - RNA, 18 nt, Pseudomonas aeruginosa PA01
cacccgaagguguccgcc

SEQ ID NO: 1413757 - RNA, 18 nt, Pseudomonas aeruginosa PA01
cacccgcaccagccggcg

SEQ ID NO: 1413758 - RNA, 19 nt, Pseudomonas aeruginosa PA01
cacccgcaccagccggcgc

SEQ ID NO: 1413759 - RNA, 23 nt, Pseudomonas aeruginosa PA01
cacccggccgcgcucgacgguca

SEQ ID NO: 1413760 - RNA, 17 nt, Pseudomonas aeruginosa PA01
cacccggcccauggcga

SEQ ID NO: 1413761 - RNA, 18 nt, Pseudomonas aeruginosa PA01
cacccggcccauggcgac

SEQ ID NO: 1413762 - RNA, 17 nt, Pseudomonas aeruginosa PA01
cacccggcugcaugccg

SEQ ID NO: 1413763 - RNA, 19 nt, Pseudomonas aeruginosa PA01
cacccggcgguccgccgcg

SEQ ID NO: 1413764 - RNA, 12 nt, Pseudomonas aeruginosa PA01
cacccggcucgg

SEQ ID NO: 1413765 - RNA, 14 nt, Pseudomonas aeruginosa PA01
cacccggcgcacgc

SEQ ID NO: 1413766 - RNA, 16 nt, Pseudomonas aeruginosa PA01
cacccggcgcacgccg

SEQ ID NO: 1413767 - RNA, 19 nt, Pseudomonas aeruginosa PA01
cacccggcgcacgccggcc

SEQ ID NO: 1413768 - RNA, 21 nt, Pseudomonas aeruginosa PA01
cacccggcgcacgccggccuc

SEQ ID NO: 1413769 - RNA, 17 nt, Pseudomonas aeruginosa PA01
cacccggcgcccggcgc

SEQ ID NO: 1413770 - RNA, 21 nt, Pseudomonas aeruginosa PA01
cacccggcgcccggcgcaugc

SEQ ID NO: 1413771 - RNA, 14 nt, Pseudomonas aeruginosa PA01
caccccacgggcga

SEQ ID NO: 1413772 - RNA, 21 nt, Pseudomonas aeruginosa PA01
caccccacgggcgacccaggc

SEQ ID NO: 1413773 - RNA, 22 nt, Pseudomonas aeruginosa PA01
caccccacgggcgacccaggcc

SEQ ID NO: 1413774 - RNA, 13 nt, Pseudomonas aeruginosa PA01
cacccaucugccg

SEQ ID NO: 1413775 - RNA, 15 nt, Pseudomonas aeruginosa PA01
cacccaucugccggc

SEQ ID NO: 1413776 - RNA, 19 nt, Pseudomonas aeruginosa PA01
cacccauucgaugccgcgc

SEQ ID NO: 1413777 - RNA, 15 nt, Pseudomonas aeruginosa PA01
caccauuuccagcaa

SEQ ID NO: 1413778 - RNA, 17 nt, Pseudomonas aeruginosa PA01
caccccgccgcgcauca

SEQ ID NO: 1413779 - RNA, 22 nt, Pseudomonas aeruginosa PA01
caccccgccgcgcaucaccccg

SEQ ID NO: 1413780 - RNA, 19 nt, Pseudomonas aeruginosa PA01
caccccaggguuggcggca

SEQ ID NO: 1413781 - RNA, 20 nt, Pseudomonas aeruginosa PA01
caccccgucgacgcccuggg

SEQ ID NO: 1413782 - RNA, 16 nt, Pseudomonas aeruginosa PA01
caccccuucgagcaac

SEQ ID NO: 1413783 - RNA, 14 nt, Pseudomonas aeruginosa PA01
cacccgguagccga

SEQ ID NO: 1413784 - RNA, 19 nt, Pseudomonas aeruginosa PA01
cacccgggcgaccugcucg

SEQ ID NO: 1413785 - RNA, 14 nt, Pseudomonas aeruginosa PA01
cacccucggcuucg

SEQ ID NO: 1413786 - RNA, 14 nt, Pseudomonas aeruginosa PA01
cacccugaccgcga

SEQ ID NO: 1413787 - RNA, 11 nt, Pseudomonas aeruginosa PA01
cacccugcgcg

SEQ ID NO: 1413788 - RNA, 17 nt, Pseudomonas aeruginosa PA01
cacccugccgcgccgga

SEQ ID NO: 1413789 - RNA, 15 nt, Pseudomonas aeruginosa PA01
cacccuggacccggg

SEQ ID NO: 1413790 - RNA, 18 nt, Pseudomonas aeruginosa PA01
cacccuuggagccgcccu

SEQ ID NO: 1413791 - RNA, 14 nt, Pseudomonas aeruginosa PA01
cacccuuggcgcag

SEQ ID NO: 1413792 - RNA, 17 nt, Pseudomonas aeruginosa PA01
cacccuuggcgcaggua

SEQ ID NO: 1413793 - RNA, 14 nt, Pseudomonas aeruginosa PA01
caccgagccguugu

SEQ ID NO: 1413794 - RNA, 13 nt, Pseudomonas aeruginosa PA01
caccgagcaggca

SEQ ID NO: 1413795 - RNA, 12 nt, Pseudomonas aeruginosa PA01
caccgaggcgcg

SEQ ID NO: 1413796 - RNA, 21 nt, Pseudomonas aeruginosa PA01
caccgaggcgcgccgacagca

SEQ ID NO: 1413797 - RNA, 13 nt, Pseudomonas aeruginosa PA01
caccgauggcgcg

SEQ ID NO: 1413798 - RNA, 19 nt, Pseudomonas aeruginosa PA01
caccgagcgcaguucgucg

SEQ ID NO: 1413799 - RNA, 16 nt, Pseudomonas aeruginosa PA01
caccgccaccgccgga

SEQ ID NO: 1413800 - RNA, 15 nt, Pseudomonas aeruginosa PA01
caccgccagcaccug

SEQ ID NO: 1413801 - RNA, 17 nt, Pseudomonas aeruginosa PA01
caccgccagcaccuggc

SEQ ID NO: 1413802 - RNA, 14 nt, Pseudomonas aeruginosa PA01
caccgccagcaccc

SEQ ID NO: 1413803 - RNA, 14 nt, Pseudomonas aeruginosa PA01
caccgccaccuugc

SEQ ID NO: 1413804 - RNA, 13 nt, Pseudomonas aeruginosa PA01
caccgccaccccg

SEQ ID NO: 1413805 - RNA, 18 nt, Pseudomonas aeruginosa PA01
caccgcauaggucaugcc

SEQ ID NO: 1413806 - RNA, 12 nt, Pseudomonas aeruginosa PA01
caccgcaucgaa

SEQ ID NO: 1413807 - RNA, 19 nt, Pseudomonas aeruginosa PA01
caccgcaucgaaggcgccg

SEQ ID NO: 1413808 - RNA, 17 nt, Pseudomonas aeruginosa PA01
caccgcaagggugcuca

SEQ ID NO: 1413809 - RNA, 14 nt, Pseudomonas aeruginosa PA01
caccgauuucccca

SEQ ID NO: 1413810 - RNA, 15 nt, Pseudomonas aeruginosa PA01
caccgauucgccggc

SEQ ID NO: 1413811 - RNA, 16 nt, Pseudomonas aeruginosa PA01
caccgauucgccggcc

SEQ ID NO: 1413812 - RNA, 14 nt, Pseudomonas aeruginosa PA01
caccgcgacgcgcu

SEQ ID NO: 1413813 - RNA, 18 nt, Pseudomonas aeruginosa PA01
caccgcgacgcgcuggac

SEQ ID NO: 1413814 - RNA, 19 nt, Pseudomonas aeruginosa PA01
caccgcgcaaaccggcagc

SEQ ID NO: 1413815 - RNA, 14 nt, Pseudomonas aeruginosa PA01
caccgcgcagcguc

SEQ ID NO: 1413816 - RNA, 15 nt, Pseudomonas aeruginosa PA01
caccgcgcagcguca

SEQ ID NO: 1413817 - RNA, 16 nt, Pseudomonas aeruginosa PA01
caccgcgcgcgccugc

SEQ ID NO: 1413818 - RNA, 19 nt, Pseudomonas aeruginosa PA01
caccgcgcgcgccugcaac

SEQ ID NO: 1413819 - RNA, 20 nt, Pseudomonas aeruginosa PA01
caccgcgcagaccaucagcu

SEQ ID NO: 1413820 - RNA, 17 nt, Pseudomonas aeruginosa PA01
caccgcggauccacgcc

SEQ ID NO: 1413821 - RNA, 19 nt, Pseudomonas aeruginosa PA01
caccgcggauccacgccug

SEQ ID NO: 1413822 - RNA, 22 nt, Pseudomonas aeruginosa PA01
caccgcgcgcuuuuccggcgcc

SEQ ID NO: 1413823 - RNA, 23 nt, Pseudomonas aeruginosa PA01
caccgcgcggcacagcguggcca

SEQ ID NO: 1413824 - RNA, 14 nt, Pseudomonas aeruginosa PA01
caccgccuggucgc

SEQ ID NO: 1413825 - RNA, 18 nt, Pseudomonas aeruginosa PA01
caccgccuggaccagguc

SEQ ID NO: 1413826 - RNA, 19 nt, Pseudomonas aeruginosa PA01
caccgccuggaccaggucg

SEQ ID NO: 1413827 - RNA, 13 nt, Pseudomonas aeruginosa PA01
caccgccuggcgc

SEQ ID NO: 1413828 - RNA, 15 nt, Pseudomonas aeruginosa PA01
caccgcccugcgcga

SEQ ID NO: 1413829 - RNA, 14 nt, Pseudomonas aeruginosa PA01
caccgccaucagca

SEQ ID NO: 1413830 - RNA, 15 nt, Pseudomonas aeruginosa PA01
caccgccaucagcac

SEQ ID NO: 1413831 - RNA, 14 nt, Pseudomonas aeruginosa PA01
caccgccagcgucg

SEQ ID NO: 1413832 - RNA, 19 nt, Pseudomonas aeruginosa PA01
caccgccagcgucgccgcc

SEQ ID NO: 1413833 - RNA, 17 nt, Pseudomonas aeruginosa PA01
caccgccaggaccucga

SEQ ID NO: 1413834 - RNA, 14 nt, Pseudomonas aeruginosa PA01
caccgccagggcgc

SEQ ID NO: 1413835 - RNA, 16 nt, Pseudomonas aeruginosa PA01
caccgccagcccgcca

SEQ ID NO: 1413836 - RNA, 16 nt, Pseudomonas aeruginosa PA01
caccgcccccggcgcc

SEQ ID NO: 1413837 - RNA, 19 nt, Pseudomonas aeruginosa PA01
caccgcccccggcgccacc

SEQ ID NO: 1413838 - RNA, 16 nt, Pseudomonas aeruginosa PA01
caccgcccccgcaucc

SEQ ID NO: 1413839 - RNA, 20 nt, Pseudomonas aeruginosa PA01
caccgcccccgcauccucca

SEQ ID NO: 1413840 - RNA, 16 nt, Pseudomonas aeruginosa PA01
caccgccgccagcaac

SEQ ID NO: 1413841 - RNA, 16 nt, Pseudomonas aeruginosa PA01
caacgcggccagcagc

SEQ ID NO: 1413842 - RNA, 17 nt, Pseudomonas aeruginosa PA01
caacgcggccagcagca

SEQ ID NO: 1413843 - RNA, 19 nt, Pseudomonas aeruginosa PA01
caacgcggccagcagcacg

SEQ ID NO: 1413844 - RNA, 13 nt, Pseudomonas aeruginosa PA01
caacgcggcguca

SEQ ID NO: 1413845 - RNA, 22 nt, Pseudomonas aeruginosa PA01
caacggacguuccaccuggcgc

SEQ ID NO: 1413846 - RNA, 16 nt, Pseudomonas aeruginosa PA01
caacggaaaaaggcgc

SEQ ID NO: 1413847 - RNA, 18 nt, Pseudomonas aeruginosa PA01
caacggaaacacagcacg

SEQ ID NO: 1413848 - RNA, 23 nt, Pseudomonas aeruginosa PA01
caacgccgacggcgugccguggc

SEQ ID NO: 1413849 - RNA, 16 nt, Pseudomonas aeruginosa PA01
caacgcccgcgagccg

SEQ ID NO: 1413850 - RNA, 14 nt, Pseudomonas aeruginosa PA01
caacgccgccggcg

SEQ ID NO: 1413851 - RNA, 12 nt, Pseudomonas aeruginosa PA01
caacgccgccgg

SEQ ID NO: 1413852 - RNA, 18 nt, Pseudomonas aeruginosa PA01
caacgccgcccccagcgc

SEQ ID NO: 1413853 - RNA, 21 nt, Pseudomonas aeruginosa PA01
caacgccgcccccagcgcgcc

SEQ ID NO: 1413854 - RNA, 23 nt, Pseudomonas aeruginosa PA01
caacgccucgcggcuaucgauca

SEQ ID NO: 1413855 - RNA, 17 nt, Pseudomonas aeruginosa PA01
caacgccuggccacgcc

SEQ ID NO: 1413856 - RNA, 22 nt, Pseudomonas aeruginosa PA01
caacgccuuccuugucgaucag

SEQ ID NO: 1413857 - RNA, 17 nt, Pseudomonas aeruginosa PA01
caacccuugcucccgcc

SEQ ID NO: 1413858 - RNA, 21 nt, Pseudomonas aeruginosa PA01
caacccuuugauggcgcugcc

SEQ ID NO: 1413859 - RNA, 23 nt, Pseudomonas aeruginosa PA01
caaccuguggaauguccugccgc

SEQ ID NO: 1413860 - RNA, 17 nt, Pseudomonas aeruginosa PA01
caaccuugcacauccag

SEQ ID NO: 1413861 - RNA, 21 nt, Pseudomonas aeruginosa PA01
caacgaaaaagggcggccacc

SEQ ID NO: 1413862 - RNA, 19 nt, Pseudomonas aeruginosa PA01
caacgaaaagagccgcgcc

SEQ ID NO: 1413863 - RNA, 21 nt, Pseudomonas aeruginosa PA01
caacgaaguguuacagcagga

SEQ ID NO: 1413864 - RNA, 17 nt, Pseudomonas aeruginosa PA01
caacgccagcaggcgca

SEQ ID NO: 1413865 - RNA, 22 nt, Pseudomonas aeruginosa PA01
caacgccagcaggcgcaggucg

SEQ ID NO: 1413866 - RNA, 23 nt, Pseudomonas aeruginosa PA01
caacgccagcaggcgcaggucgg

SEQ ID NO: 1413867 - RNA, 15 nt, Pseudomonas aeruginosa PA01
caacgccagcaggcg

SEQ ID NO: 1413868 - RNA, 23 nt, Pseudomonas aeruginosa PA01
caacgaccgcccaggcugccgcc

SEQ ID NO: 1413869 - RNA, 12 nt, Pseudomonas aeruginosa PA01
caacgcaggcgc

SEQ ID NO: 1413870 - RNA, 19 nt, Pseudomonas aeruginosa PA01
caacgcaggcgcauggcgu

SEQ ID NO: 1413871 - RNA, 14 nt, Pseudomonas aeruginosa PA01
caacagcagguaga

SEQ ID NO: 1413872 - RNA, 17 nt, Pseudomonas aeruginosa PA01
caacagcagguagacca

SEQ ID NO: 1413873 - RNA, 16 nt, Pseudomonas aeruginosa PA01
caacagcgcggcggug

SEQ ID NO: 1413874 - RNA, 23 nt, Pseudomonas aeruginosa PA01
caacagcgcggcggugcagaacg

SEQ ID NO: 1413875 - RNA, 18 nt, Pseudomonas aeruginosa PA01
caacagcccgcgccgcga

SEQ ID NO: 1413876 - RNA, 17 nt, Pseudomonas aeruginosa PA01
caacagcgaagcuggcg

SEQ ID NO: 1413877 - RNA, 18 nt, Pseudomonas aeruginosa PA01
caacacuuccuucucccg

SEQ ID NO: 1413878 - RNA, 12 nt, Pseudomonas aeruginosa PA01
caacaggccggg

SEQ ID NO: 1413879 - RNA, 14 nt, Pseudomonas aeruginosa PA01
caacaggccgggcg

SEQ ID NO: 1413880 - RNA, 23 nt, Pseudomonas aeruginosa PA01
caacagggcauuggccaucagcg

SEQ ID NO: 1413881 - RNA, 14 nt, Pseudomonas aeruginosa PA01
caacagggcgucgu

SEQ ID NO: 1413882 - RNA, 19 nt, Pseudomonas aeruginosa PA01
caacaguugccgcagcagc

SEQ ID NO: 1413883 - RNA, 23 nt, Pseudomonas aeruginosa PA01
caacaguugccgcagcagcggcg

SEQ ID NO: 1413884 - RNA, 18 nt, Pseudomonas aeruginosa PA01
caacaguucugccgcaga

SEQ ID NO: 1413885 - RNA, 22 nt, Pseudomonas aeruginosa PA01
caaccaggcgauaucccgccgc

SEQ ID NO: 1413886 - RNA, 23 nt, Pseudomonas aeruginosa PA01
caaccaggcgauaucccgccgcc

SEQ ID NO: 1413887 - RNA, 17 nt, Pseudomonas aeruginosa PA01
caacccggcgcuggccg

SEQ ID NO: 1413888 - RNA, 20 nt, Pseudomonas aeruginosa PA01
caacccggcgcuggccgcgc

SEQ ID NO: 1413889 - RNA, 17 nt, Pseudomonas aeruginosa PA01
caaccaguaggcguggu

SEQ ID NO: 1413890 - RNA, 15 nt, Pseudomonas aeruginosa PA01
caaccagcccuggcg

SEQ ID NO: 1413891 - RNA, 14 nt, Pseudomonas aeruginosa PA01
caaccagaccagca

SEQ ID NO: 1413892 - RNA, 16 nt, Pseudomonas aeruginosa PA01
caaccagaccagcagg

SEQ ID NO: 1413893 - RNA, 14 nt, Pseudomonas aeruginosa PA01
caaccacuccagcg

SEQ ID NO: 1413894 - RNA, 16 nt, Pseudomonas aeruginosa PA01
caaccacuccgccacc

SEQ ID NO: 1413895 - RNA, 15 nt, Pseudomonas aeruginosa PA01
caagaacgccgaccc

SEQ ID NO: 1413896 - RNA, 15 nt, Pseudomonas aeruginosa PA01
caagagagcgccagc

SEQ ID NO: 1413897 - RNA, 19 nt, Pseudomonas aeruginosa PA01
caagacggcccgcagaucu

SEQ ID NO: 1413898 - RNA, 17 nt, Pseudomonas aeruginosa PA01
caacugguuggccgccu

SEQ ID NO: 1413899 - RNA, 19 nt, Pseudomonas aeruginosa PA01
caacuggcguagggcgaau

SEQ ID NO: 1413900 - RNA, 15 nt, Pseudomonas aeruginosa PA01
caacuggucgccgca

SEQ ID NO: 1413901 - RNA, 19 nt, Pseudomonas aeruginosa PA01
caacuggucgccgcagguc

SEQ ID NO: 1413902 - RNA, 15 nt, Pseudomonas aeruginosa PA01
caacugagcgcaacu

SEQ ID NO: 1413903 - RNA, 21 nt, Pseudomonas aeruginosa PA01
caacugcucuuuaacaagucg

SEQ ID NO: 1413904 - RNA, 14 nt, Pseudomonas aeruginosa PA01
caacugcuucaggc

SEQ ID NO: 1413905 - RNA, 18 nt, Pseudomonas aeruginosa PA01
caacugcuucaggcgcgc

SEQ ID NO: 1413906 - RNA, 15 nt, Pseudomonas aeruginosa PA01
caacuggaaggccgc

SEQ ID NO: 1413907 - RNA, 23 nt, Pseudomonas aeruginosa PA01
caacuggaaggccgcgccgagau

SEQ ID NO: 1413908 - RNA, 20 nt, Pseudomonas aeruginosa PA01
caacuggauuuccuucggca

SEQ ID NO: 1413909 - RNA, 21 nt, Pseudomonas aeruginosa PA01
caacuggauuuccuucggcac

SEQ ID NO: 1413910 - RNA, 16 nt, Pseudomonas aeruginosa PA01
caacugaucagccggg

SEQ ID NO: 1413911 - RNA, 19 nt, Pseudomonas aeruginosa PA01
caacugaucagccgggcgu

SEQ ID NO: 1413912 - RNA, 17 nt, Pseudomonas aeruginosa PA01
caacugcggggcgcuca

SEQ ID NO: 1413913 - RNA, 24 nt, Pseudomonas aeruginosa PA01
caacugcgaaccgagacccuggcg

SEQ ID NO: 1413914 - RNA, 12 nt, Pseudomonas aeruginosa PA01
caacucggcgcc

SEQ ID NO: 1413915 - RNA, 19 nt, Pseudomonas aeruginosa PA01
caacucggcggcgagcgcc

SEQ ID NO: 1413916 - RNA, 22 nt, Pseudomonas aeruginosa PA01
caacucggcggcgagcgccgcg

SEQ ID NO: 1413917 - RNA, 16 nt, Pseudomonas aeruginosa PA01
caacggcgcaucgucg

SEQ ID NO: 1413918 - RNA, 16 nt, Pseudomonas aeruginosa PA01
caacggcagcgcuucg

SEQ ID NO: 1413919 - RNA, 22 nt, Pseudomonas aeruginosa PA01
caacggcccuuccacuucgaag

SEQ ID NO: 1413920 - RNA, 15 nt, Pseudomonas aeruginosa PA01
caacgguagcggauc

SEQ ID NO: 1413921 - RNA, 20 nt, Pseudomonas aeruginosa PA01
caacgggcucgugcccucgc

SEQ ID NO: 1413922 - RNA, 15 nt, Pseudomonas aeruginosa PA01
caagccgcagcgccc

SEQ ID NO: 1413923 - RNA, 23 nt, Pseudomonas aeruginosa PA01
caagccggcgcgccccugcgccc

SEQ ID NO: 1413924 - RNA, 22 nt, Pseudomonas aeruginosa PA01
caagccgaugaaauagccggcg

SEQ ID NO: 1413925 - RNA, 24 nt, Pseudomonas aeruginosa PA01
caagcccggcgagagcguccggca

SEQ ID NO: 1413926 - RNA, 19 nt, Pseudomonas aeruginosa PA01
caagcccgugggaucgcca

SEQ ID NO: 1413927 - RNA, 21 nt, Pseudomonas aeruginosa PA01
caagcgcucggccugcgucgc

SEQ ID NO: 1413928 - RNA, 21 nt, Pseudomonas aeruginosa PA01
caaggaugcgccagcggcccg

SEQ ID NO: 1413929 - RNA, 22 nt, Pseudomonas aeruginosa PA01
caagcgguauugucgaugggca

SEQ ID NO: 1413930 - RNA, 22 nt, Pseudomonas aeruginosa PA01
caagcgguuauucgccccagcg

SEQ ID NO: 1413931 - RNA, 15 nt, Pseudomonas aeruginosa PA01
caaggcacacgcccg

SEQ ID NO: 1413932 - RNA, 17 nt, Pseudomonas aeruginosa PA01
caaggcacacgcccggc

SEQ ID NO: 1413933 - RNA, 13 nt, Pseudomonas aeruginosa PA01
caaggcacgcccc

SEQ ID NO: 1413934 - RNA, 17 nt, Pseudomonas aeruginosa PA01
caaggcagcguccgaac

SEQ ID NO: 1413935 - RNA, 19 nt, Pseudomonas aeruginosa PA01
caaggcauucaccagcgac

SEQ ID NO: 1413936 - RNA, 16 nt, Pseudomonas aeruginosa PA01
caaggcauugcgcuug

SEQ ID NO: 1413937 - RNA, 17 nt, Pseudomonas aeruginosa PA01
caaggccaagucggccg

SEQ ID NO: 1413938 - RNA, 18 nt, Pseudomonas aeruginosa PA01
caaggccaagucggccgc

SEQ ID NO: 1413939 - RNA, 19 nt, Pseudomonas aeruginosa PA01
caaggccaagucggccgcc

SEQ ID NO: 1413940 - RNA, 18 nt, Pseudomonas aeruginosa PA01
caaggcccugcugcaggg

SEQ ID NO: 1413941 - RNA, 23 nt, Pseudomonas aeruginosa PA01
caaggcccugcugcagggccucg

SEQ ID NO: 1413942 - RNA, 19 nt, Pseudomonas aeruginosa PA01
caaggccgaagaggcccuc

SEQ ID NO: 1413943 - RNA, 22 nt, Pseudomonas aeruginosa PA01
caagcccaagggcuccgcaagg

SEQ ID NO: 1413944 - RNA, 15 nt, Pseudomonas aeruginosa PA01
caagccaccagcgac

SEQ ID NO: 1413945 - RNA, 21 nt, Pseudomonas aeruginosa PA01
caagcauucagcgcgccccgg

SEQ ID NO: 1413946 - RNA, 22 nt, Pseudomonas aeruginosa PA01
caagcauucuggaugcagccgg

SEQ ID NO: 1413947 - RNA, 14 nt, Pseudomonas aeruginosa PA01
caagcaggccgcgg

SEQ ID NO: 1413948 - RNA, 17 nt, Pseudomonas aeruginosa PA01
caaagccuggagcaggg

SEQ ID NO: 1413949 - RNA, 19 nt, Pseudomonas aeruginosa PA01
caaagccgcaauccgccgc

SEQ ID NO: 1413950 - RNA, 12 nt, Pseudomonas aeruginosa PA01
caaacgccgcca

SEQ ID NO: 1413951 - RNA, 17 nt, Pseudomonas aeruginosa PA01
auuuucgcgcucagcgc

SEQ ID NO: 1413952 - RNA, 13 nt, Pseudomonas aeruginosa PA01
auuuucuccggcg

SEQ ID NO: 1413953 - RNA, 14 nt, Pseudomonas aeruginosa PA01
caaaaaaggcggau

SEQ ID NO: 1413954 - RNA, 17 nt, Pseudomonas aeruginosa PA01
caaaaaccaugcgguuc

SEQ ID NO: 1413955 - RNA, 21 nt, Pseudomonas aeruginosa PA01
auuugcgccucgucgacgccc

SEQ ID NO: 1413956 - RNA, 20 nt, Pseudomonas aeruginosa PA01
auuucgcggaaguaggcggc

SEQ ID NO: 1413957 - RNA, 16 nt, Pseudomonas aeruginosa PA01
auuuccucgcgcaccg

SEQ ID NO: 1413958 - RNA, 20 nt, Pseudomonas aeruginosa PA01
auuucucgacuuccgccuug

SEQ ID NO: 1413959 - RNA, 13 nt, Pseudomonas aeruginosa PA01
auuucacgccgaa

SEQ ID NO: 1413960 - RNA, 13 nt, Pseudomonas aeruginosa PA01
auuuccgcgcccg

SEQ ID NO: 1413961 - RNA, 15 nt, Pseudomonas aeruginosa PA01
auuuccgcgcccggc

SEQ ID NO: 1413962 - RNA, 21 nt, Pseudomonas aeruginosa PA01
auuuccgcgcccggcuggcca

SEQ ID NO: 1413963 - RNA, 13 nt, Pseudomonas aeruginosa PA01
auuuccgcggccg

SEQ ID NO: 1413964 - RNA, 17 nt, Pseudomonas aeruginosa PA01
auuuccgcggccggcag

SEQ ID NO: 1413965 - RNA, 17 nt, Pseudomonas aeruginosa PA01
auucccgcgacaacggc

SEQ ID NO: 1413966 - RNA, 21 nt, Pseudomonas aeruginosa PA01
auucccgaggguggcgcuggc

SEQ ID NO: 1413967 - RNA, 14 nt, Pseudomonas aeruginosa PA01
aucccaggucggcg

SEQ ID NO: 1413968 - RNA, 22 nt, Pseudomonas aeruginosa PA01
aucccaggucggcgggcaccgc

SEQ ID NO: 1413969 - RNA, 23 nt, Pseudomonas aeruginosa PA01
aucccaggucggcgggcaccgcc

SEQ ID NO: 1413970 - RNA, 19 nt, Pseudomonas aeruginosa PA01
auccccccacccgucccgc

SEQ ID NO: 1413971 - RNA, 17 nt, Pseudomonas aeruginosa PA01
auccaguguggcggcgu

SEQ ID NO: 1413972 - RNA, 23 nt, Pseudomonas aeruginosa PA01
auccagguucgcguggcccggcg

SEQ ID NO: 1413973 - RNA, 16 nt, Pseudomonas aeruginosa PA01
auccagucggcgcugg

SEQ ID NO: 1413974 - RNA, 17 nt, Pseudomonas aeruginosa PA01
auccagucuucgccggc

SEQ ID NO: 1413975 - RNA, 18 nt, Pseudomonas aeruginosa PA01
auccagucuucgccggcc

SEQ ID NO: 1413976 - RNA, 15 nt, Pseudomonas aeruginosa PA01
auccacuugccgucc

SEQ ID NO: 1413977 - RNA, 13 nt, Pseudomonas aeruginosa PA01
auccagcccugga

SEQ ID NO: 1413978 - RNA, 19 nt, Pseudomonas aeruginosa PA01
auccagccaggcgcucucg

SEQ ID NO: 1413979 - RNA, 18 nt, Pseudomonas aeruginosa PA01
auccagggagaacagcag

SEQ ID NO: 1413980 - RNA, 14 nt, Pseudomonas aeruginosa PA01
auccagggccgagc

SEQ ID NO: 1413981 - RNA, 12 nt, Pseudomonas aeruginosa PA01
auccagcgccug

SEQ ID NO: 1413982 - RNA, 14 nt, Pseudomonas aeruginosa PA01
auccagcuggcgcg

SEQ ID NO: 1413983 - RNA, 20 nt, Pseudomonas aeruginosa PA01
auccguacuggcgccaggcc

SEQ ID NO: 1413984 - RNA, 20 nt, Pseudomonas aeruginosa PA01
auccgguugauuuccgcacc

SEQ ID NO: 1413985 - RNA, 15 nt, Pseudomonas aeruginosa PA01
auccgcggccccggc

SEQ ID NO: 1413986 - RNA, 20 nt, Pseudomonas aeruginosa PA01
auccgcggcccugcucgccg

SEQ ID NO: 1413987 - RNA, 12 nt, Pseudomonas aeruginosa PA01
auccgcgcggca

SEQ ID NO: 1413988 - RNA, 16 nt, Pseudomonas aeruginosa PA01
auccgcgccgaccagc

SEQ ID NO: 1413989 - RNA, 20 nt, Pseudomonas aeruginosa PA01
auccgcgccgaccagccgca

SEQ ID NO: 1413990 - RNA, 23 nt, Pseudomonas aeruginosa PA01
auccgccuucuuuucuuccgccu

SEQ ID NO: 1413991 - RNA, 23 nt, Pseudomonas aeruginosa PA01
auccgccuuuuuugugcccggcg

SEQ ID NO: 1413992 - RNA, 17 nt, Pseudomonas aeruginosa PA01
auccgcgacaguucgcc

SEQ ID NO: 1413993 - RNA, 21 nt, Pseudomonas aeruginosa PA01
auccgcgacaguucgccgccc

SEQ ID NO: 1413994 - RNA, 12 nt, Pseudomonas aeruginosa PA01
auccgccgucgg

SEQ ID NO: 1413995 - RNA, 18 nt, Pseudomonas aeruginosa PA01
auccgccgugaggcgcgc

SEQ ID NO: 1413996 - RNA, 22 nt, Pseudomonas aeruginosa PA01
auccgccgugaggcgcgcgccg

SEQ ID NO: 1413997 - RNA, 22 nt, Pseudomonas aeruginosa PA01
auccgccguuccuccucgccgc

SEQ ID NO: 1413998 - RNA, 22 nt, Pseudomonas aeruginosa PA01
auccgccggccggggcgcgccc

SEQ ID NO: 1413999 - RNA, 12 nt, Pseudomonas aeruginosa PA01
auccgccgggcc

SEQ ID NO: 1414000 - RNA, 18 nt, Pseudomonas aeruginosa PA01
aucccgguuuccgcagcg

SEQ ID NO: 1414001 - RNA, 21 nt, Pseudomonas aeruginosa PA01
auccgccgcuacugcgcgggc

SEQ ID NO: 1414002 - RNA, 23 nt, Pseudomonas aeruginosa PA01
auccgccgcucccggcuugcuga

SEQ ID NO: 1414003 - RNA, 12 nt, Pseudomonas aeruginosa PA01
auccgccgcugu

SEQ ID NO: 1414004 - RNA, 19 nt, Pseudomonas aeruginosa PA01
auccgccgcugugcagggu

SEQ ID NO: 1414005 - RNA, 12 nt, Pseudomonas aeruginosa PA01
auccgccggccg

SEQ ID NO: 1414006 - RNA, 13 nt, Pseudomonas aeruginosa PA01
auccgccgcagga

SEQ ID NO: 1414007 - RNA, 20 nt, Pseudomonas aeruginosa PA01
auccgccgcaggaaggcgaa

SEQ ID NO: 1414008 - RNA, 21 nt, Pseudomonas aeruginosa PA01
auccgccgcaggaaggcgaag

SEQ ID NO: 1414009 - RNA, 23 nt, Pseudomonas aeruginosa PA01
aucccgcccggucucagccggcg

SEQ ID NO: 1414010 - RNA, 19 nt, Pseudomonas aeruginosa PA01
aucccgggguugcccagca

SEQ ID NO: 1414011 - RNA, 23 nt, Pseudomonas aeruginosa PA01
aucccgggguugcccagcaggcu

SEQ ID NO: 1414012 - RNA, 22 nt, Pseudomonas aeruginosa PA01
aucccggcugagcgccaggcgc

SEQ ID NO: 1414013 - RNA, 23 nt, Pseudomonas aeruginosa PA01
aucccggcugagcgccaggcgca

SEQ ID NO: 1414014 - RNA, 19 nt, Pseudomonas aeruginosa PA01
auccccggaccagggcgcc

SEQ ID NO: 1414015 - RNA, 22 nt, Pseudomonas aeruginosa PA01
auccccggaccagggcgccggg

SEQ ID NO: 1414016 - RNA, 23 nt, Pseudomonas aeruginosa PA01
auccccucccgcgccagcgccgc

SEQ ID NO: 1414017 - RNA, 15 nt, Pseudomonas aeruginosa PA01
aucccgcgcgggccg

SEQ ID NO: 1414018 - RNA, 22 nt, Pseudomonas aeruginosa PA01
aucccgcgcgggccgaggucgc

SEQ ID NO: 1414019 - RNA, 17 nt, Pseudomonas aeruginosa PA01
aucagcuccacgucggc

SEQ ID NO: 1414020 - RNA, 14 nt, Pseudomonas aeruginosa PA01
aucagcucgcggua

SEQ ID NO: 1414021 - RNA, 21 nt, Pseudomonas aeruginosa PA01
aucagcuuguggucguggcgg

SEQ ID NO: 1414022 - RNA, 22 nt, Pseudomonas aeruginosa PA01
aucagcuuguggucguggcgga

SEQ ID NO: 1414023 - RNA, 17 nt, Pseudomonas aeruginosa PA01
aucaggccaaagccgca

SEQ ID NO: 1414024 - RNA, 15 nt, Pseudomonas aeruginosa PA01
aucaggaggaucgcc

SEQ ID NO: 1414025 - RNA, 19 nt, Pseudomonas aeruginosa PA01
aucaggaggaucgccagga

SEQ ID NO: 1414026 - RNA, 23 nt, Pseudomonas aeruginosa PA01
aucaggaggaucgccaggacgcu

SEQ ID NO: 1414027 - RNA, 14 nt, Pseudomonas aeruginosa PA01
aucaggcagcgcgc

SEQ ID NO: 1414028 - RNA, 15 nt, Pseudomonas aeruginosa PA01
aucaggcugaagcgg

SEQ ID NO: 1414029 - RNA, 16 nt, Pseudomonas aeruginosa PA01
aucagggcaccgccga

SEQ ID NO: 1414030 - RNA, 19 nt, Pseudomonas aeruginosa PA01
aucagggcaccgccgagga

SEQ ID NO: 1414031 - RNA, 19 nt, Pseudomonas aeruginosa PA01
aucagucaggaucggcgcc

SEQ ID NO: 1414032 - RNA, 14 nt, Pseudomonas aeruginosa PA01
aucagguagucgcc

SEQ ID NO: 1414033 - RNA, 21 nt, Pseudomonas aeruginosa PA01
aucagggucuucaggcguggg

SEQ ID NO: 1414034 - RNA, 17 nt, Pseudomonas aeruginosa PA01
aucagggccucgccacg

SEQ ID NO: 1414035 - RNA, 15 nt, Pseudomonas aeruginosa PA01
aucaggucgccagcg

SEQ ID NO: 1414036 - RNA, 16 nt, Pseudomonas aeruginosa PA01
aucaggucgccagcgc

SEQ ID NO: 1414037 - RNA, 18 nt, Pseudomonas aeruginosa PA01
aucaggucgccagcgccu

SEQ ID NO: 1414038 - RNA, 18 nt, Pseudomonas aeruginosa PA01
aucagugcaucggccgcc

SEQ ID NO: 1414039 - RNA, 22 nt, Pseudomonas aeruginosa PA01
aucagugcaucggccgccaggc

SEQ ID NO: 1414040 - RNA, 19 nt, Pseudomonas aeruginosa PA01
aucagucgcugcucggccu

SEQ ID NO: 1414041 - RNA, 16 nt, Pseudomonas aeruginosa PA01
aucaguugcgcgcggg

SEQ ID NO: 1414042 - RNA, 17 nt, Pseudomonas aeruginosa PA01
aucaguggucgcagcuc

SEQ ID NO: 1414043 - RNA, 16 nt, Pseudomonas aeruginosa PA01
auccaagagagcgcca

SEQ ID NO: 1414044 - RNA, 14 nt, Pseudomonas aeruginosa PA01
auccaccgccaggg

SEQ ID NO: 1414045 - RNA, 13 nt, Pseudomonas aeruginosa PA01
auccacaggcggc

SEQ ID NO: 1414046 - RNA, 23 nt, Pseudomonas aeruginosa PA01
auccacagcagguugcuggcgag

SEQ ID NO: 1414047 - RNA, 13 nt, Pseudomonas aeruginosa PA01
aucaugccgagca

SEQ ID NO: 1414048 - RNA, 13 nt, Pseudomonas aeruginosa PA01
aucaucugggcca

SEQ ID NO: 1414049 - RNA, 21 nt, Pseudomonas aeruginosa PA01
aucaucugggccaucgccggc

SEQ ID NO: 1414050 - RNA, 22 nt, Pseudomonas aeruginosa PA01
aucaucugggccaucgccggcc

SEQ ID NO: 1414051 - RNA, 15 nt, Pseudomonas aeruginosa PA01
aucaucggcuggccg

SEQ ID NO: 1414052 - RNA, 13 nt, Pseudomonas aeruginosa PA01
aucauccagcccc

SEQ ID NO: 1414053 - RNA, 13 nt, Pseudomonas aeruginosa PA01
aucaucagcaggg

SEQ ID NO: 1414054 - RNA, 23 nt, Pseudomonas aeruginosa PA01
aucgucacggcgugccgcaggcc

SEQ ID NO: 1414055 - RNA, 17 nt, Pseudomonas aeruginosa PA01
aucguccagcucggcca

SEQ ID NO: 1414056 - RNA, 19 nt, Pseudomonas aeruginosa PA01
aucgucgaagcucggcgcg

SEQ ID NO: 1414057 - RNA, 18 nt, Pseudomonas aeruginosa PA01
aucgucgccaagcccggc

SEQ ID NO: 1414058 - RNA, 20 nt, Pseudomonas aeruginosa PA01
aucgucgaugcguccgcgca

SEQ ID NO: 1414059 - RNA, 11 nt, Pseudomonas aeruginosa PA01
aucgucgccaa

SEQ ID NO: 1414060 - RNA, 13 nt, Pseudomonas aeruginosa PA01
aucgucgccggag

SEQ ID NO: 1414061 - RNA, 14 nt, Pseudomonas aeruginosa PA01
aucgucgcggcgcg

SEQ ID NO: 1414062 - RNA, 22 nt, Pseudomonas aeruginosa PA01
aucgucgggacgcaugcgcggc

SEQ ID NO: 1414063 - RNA, 11 nt, Pseudomonas aeruginosa PA01
aucucgucgcc

SEQ ID NO: 1414064 - RNA, 14 nt, Pseudomonas aeruginosa PA01
aucucgucgccgac

SEQ ID NO: 1414065 - RNA, 22 nt, Pseudomonas aeruginosa PA01
aucucggugcgccccaggugca

SEQ ID NO: 1414066 - RNA, 23 nt, Pseudomonas aeruginosa PA01
aucucgguguccaccaccagcag

SEQ ID NO: 1414067 - RNA, 20 nt, Pseudomonas aeruginosa PA01
aucuccacccguucgccggc

SEQ ID NO: 1414068 - RNA, 21 nt, Pseudomonas aeruginosa PA01
aucuccacccguucgccggcc

SEQ ID NO: 1414069 - RNA, 18 nt, Pseudomonas aeruginosa PA01
aucuccaacuggcggcug

SEQ ID NO: 1414070 - RNA, 23 nt, Pseudomonas aeruginosa PA01
aucucaggaccuuccgccagcag

SEQ ID NO: 1414071 - RNA, 18 nt, Pseudomonas aeruginosa PA01
aucguugccagccggccu

SEQ ID NO: 1414072 - RNA, 14 nt, Pseudomonas aeruginosa PA01
aucguugaucggcu

SEQ ID NO: 1414073 - RNA, 15 nt, Pseudomonas aeruginosa PA01
aucggacagguuggc

SEQ ID NO: 1414074 - RNA, 17 nt, Pseudomonas aeruginosa PA01
aucggaagaugguuuga

SEQ ID NO: 1414075 - RNA, 18 nt, Pseudomonas aeruginosa PA01
aucggaagaucgcccgcc

SEQ ID NO: 1414076 - RNA, 20 nt, Pseudomonas aeruginosa PA01
aucggcaggcugcaucggcu

SEQ ID NO: 1414077 - RNA, 20 nt, Pseudomonas aeruginosa PA01
aucggcaucaaucgcuggcg

SEQ ID NO: 1414078 - RNA, 21 nt, Pseudomonas aeruginosa PA01
aucgggcagggcagccgccgc

SEQ ID NO: 1414079 - RNA, 13 nt, Pseudomonas aeruginosa PA01
aucgggauaccgg

SEQ ID NO: 1414080 - RNA, 16 nt, Pseudomonas aeruginosa PA01
aucggccacuccagcc

SEQ ID NO: 1414081 - RNA, 20 nt, Pseudomonas aeruginosa PA01
aucggccaccgaaucgaugc

SEQ ID NO: 1414082 - RNA, 14 nt, Pseudomonas aeruginosa PA01
aucggcuugccggc

SEQ ID NO: 1414083 - RNA, 18 nt, Pseudomonas aeruginosa PA01
aucggcuugccggcggcg

SEQ ID NO: 1414084 - RNA, 20 nt, Pseudomonas aeruginosa PA01
aucggucgugaucuucgagu

SEQ ID NO: 1414085 - RNA, 22 nt, Pseudomonas aeruginosa PA01
aucgguuggggaggugcggcgg

SEQ ID NO: 1414086 - RNA, 16 nt, Pseudomonas aeruginosa PA01
aucggucaccgugguc

SEQ ID NO: 1414087 - RNA, 17 nt, Pseudomonas aeruginosa PA01
aucggucaccgugguca

SEQ ID NO: 1414088 - RNA, 18 nt, Pseudomonas aeruginosa PA01
aucggucgcccucggcca

SEQ ID NO: 1414089 - RNA, 15 nt, Pseudomonas aeruginosa PA01
aucgaugaugaucgc

SEQ ID NO: 1414090 - RNA, 13 nt, Pseudomonas aeruginosa PA01
aucgaucggcugg

SEQ ID NO: 1414091 - RNA, 17 nt, Pseudomonas aeruginosa PA01
aucgaucucgucggcgg

SEQ ID NO: 1414092 - RNA, 24 nt, Pseudomonas aeruginosa PA01
aucgaucacugccuggcagguccg

SEQ ID NO: 1414093 - RNA, 16 nt, Pseudomonas aeruginosa PA01
aucgaucacuucaccu

SEQ ID NO: 1414094 - RNA, 12 nt, Pseudomonas aeruginosa PA01
aucgaucagcag

SEQ ID NO: 1414095 - RNA, 14 nt, Pseudomonas aeruginosa PA01
aucgaucagcagca

SEQ ID NO: 1414096 - RNA, 17 nt, Pseudomonas aeruginosa PA01
aucgauggucaggcugg

SEQ ID NO: 1414097 - RNA, 18 nt, Pseudomonas aeruginosa PA01
aucgauguuuccgacccg

SEQ ID NO: 1414098 - RNA, 20 nt, Pseudomonas aeruginosa PA01
aucgauguuuccgacccgga

SEQ ID NO: 1414099 - RNA, 19 nt, Pseudomonas aeruginosa PA01
aucgaguaagugccgacca

SEQ ID NO: 1414100 - RNA, 16 nt, Pseudomonas aeruginosa PA01
auccgugacgucggcg

SEQ ID NO: 1414101 - RNA, 17 nt, Pseudomonas aeruginosa PA01
auccgugacgucggcgg

SEQ ID NO: 1414102 - RNA, 19 nt, Pseudomonas aeruginosa PA01
auccguccuacgcgaccgg

SEQ ID NO: 1414103 - RNA, 13 nt, Pseudomonas aeruginosa PA01
aucgaggccgccc

SEQ ID NO: 1414104 - RNA, 23 nt, Pseudomonas aeruginosa PA01
aucgaggccgcccagcgcagccu

SEQ ID NO: 1414105 - RNA, 22 nt, Pseudomonas aeruginosa PA01
aucgaggccuacccgcgcuucu

SEQ ID NO: 1414106 - RNA, 19 nt, Pseudomonas aeruginosa PA01
aucgaggccaggccgagcg

SEQ ID NO: 1414107 - RNA, 14 nt, Pseudomonas aeruginosa PA01
aucgagucgccggc

SEQ ID NO: 1414108 - RNA, 16 nt, Pseudomonas aeruginosa PA01
aucgccaccccgccgc

SEQ ID NO: 1414109 - RNA, 21 nt, Pseudomonas aeruginosa PA01
aucgccaccgguacgcucacc

SEQ ID NO: 1414110 - RNA, 20 nt, Pseudomonas aeruginosa PA01
aucgccagcccguagucguu

SEQ ID NO: 1414111 - RNA, 14 nt, Pseudomonas aeruginosa PA01
aucgccagcgccag

SEQ ID NO: 1414112 - RNA, 15 nt, Pseudomonas aeruginosa PA01
aucgccagcgccagc

SEQ ID NO: 1414113 - RNA, 16 nt, Pseudomonas aeruginosa PA01
aucgccagcgccagca

SEQ ID NO: 1414114 - RNA, 15 nt, Pseudomonas aeruginosa PA01
aucgccacgccggcg

SEQ ID NO: 1414115 - RNA, 12 nt, Pseudomonas aeruginosa PA01
aucgccaggcga

SEQ ID NO: 1414116 - RNA, 18 nt, Pseudomonas aeruginosa PA01
aucgccaggcgauccagc

SEQ ID NO: 1414117 - RNA, 22 nt, Pseudomonas aeruginosa PA01
aucgccagggucuugccgaccu

SEQ ID NO: 1414118 - RNA, 24 nt, Pseudomonas aeruginosa PA01
aucgccagggucuugccgaccuuc

SEQ ID NO: 1414119 - RNA, 15 nt, Pseudomonas aeruginosa PA01
aucgcacggucgucc

SEQ ID NO: 1414120 - RNA, 11 nt, Pseudomonas aeruginosa PA01
aucgcacggcg

SEQ ID NO: 1414121 - RNA, 22 nt, Pseudomonas aeruginosa PA01
aucgcaggccaggccccagggc

SEQ ID NO: 1414122 - RNA, 15 nt, Pseudomonas aeruginosa PA01
aucgcauagccggcg

SEQ ID NO: 1414123 - RNA, 17 nt, Pseudomonas aeruginosa PA01
aucgcauagccggcgcg

SEQ ID NO: 1414124 - RNA, 21 nt, Pseudomonas aeruginosa PA01
aucgcauagccggcgcgcccg

SEQ ID NO: 1414125 - RNA, 23 nt, Pseudomonas aeruginosa PA01
aucgcauagccggcgcgcccggc

SEQ ID NO: 1414126 - RNA, 20 nt, Pseudomonas aeruginosa PA01
aucgccaaccaguagggggu

SEQ ID NO: 1414127 - RNA, 20 nt, Pseudomonas aeruginosa PA01
aucgccucgggcgagcgcag

SEQ ID NO: 1414128 - RNA, 12 nt, Pseudomonas aeruginosa PA01
aucgccucggcg

SEQ ID NO: 1414129 - RNA, 14 nt, Pseudomonas aeruginosa PA01
aucgccucggcgcg

SEQ ID NO: 1414130 - RNA, 24 nt, Pseudomonas aeruginosa PA01
aucgccuccggcacgcugccgccg

SEQ ID NO: 1414131 - RNA, 16 nt, Pseudomonas aeruginosa PA01
aucgccucgccggcca

SEQ ID NO: 1414132 - RNA, 22 nt, Pseudomonas aeruginosa PA01
aucgccucgcggaccucgggca

SEQ ID NO: 1414133 - RNA, 21 nt, Pseudomonas aeruginosa PA01
aucgccuccacggcggccucg

SEQ ID NO: 1414134 - RNA, 20 nt, Pseudomonas aeruginosa PA01
aucgccgacaggucggccgg

SEQ ID NO: 1414135 - RNA, 13 nt, Pseudomonas aeruginosa PA01
aucgcccuggccu

SEQ ID NO: 1414136 - RNA, 18 nt, Pseudomonas aeruginosa PA01
aucgcccuggccucggcg

SEQ ID NO: 1414137 - RNA, 14 nt, Pseudomonas aeruginosa PA01
aucgcccuggcgcc

SEQ ID NO: 1414138 - RNA, 15 nt, Pseudomonas aeruginosa PA01
aucgcccuggcgcca

SEQ ID NO: 1414139 - RNA, 17 nt, Pseudomonas aeruginosa PA01
aucgcccuggcgccagc

SEQ ID NO: 1414140 - RNA, 14 nt, Pseudomonas aeruginosa PA01
aucgccucgucgag

SEQ ID NO: 1414141 - RNA, 13 nt, Pseudomonas aeruginosa PA01
aucgccuugcgcg

SEQ ID NO: 1414142 - RNA, 15 nt, Pseudomonas aeruginosa PA01
aucgccugggccggc

SEQ ID NO: 1414143 - RNA, 15 nt, Pseudomonas aeruginosa PA01
aucgccuuccucggc

SEQ ID NO: 1414144 - RNA, 21 nt, Pseudomonas aeruginosa PA01
aucgccuuccucggcgaucac

SEQ ID NO: 1414145 - RNA, 19 nt, Pseudomonas aeruginosa PA01
aucgccugcuuggcggcgg

SEQ ID NO: 1414146 - RNA, 15 nt, Pseudomonas aeruginosa PA01
aucgcgaagcgcagc

SEQ ID NO: 1414147 - RNA, 21 nt, Pseudomonas aeruginosa PA01
aucgcgggcgugcuccagcac

SEQ ID NO: 1414148 - RNA, 22 nt, Pseudomonas aeruginosa PA01
aucgcgggcgugcuccagcacc

SEQ ID NO: 1414149 - RNA, 15 nt, Pseudomonas aeruginosa PA01
aucgcggcgauggcc

SEQ ID NO: 1414150 - RNA, 18 nt, Pseudomonas aeruginosa PA01
aucgcggcgauggccgcc

SEQ ID NO: 1414151 - RNA, 22 nt, Pseudomonas aeruginosa PA01
aucgcggcgauggccgccagca

SEQ ID NO: 1414152 - RNA, 17 nt, Pseudomonas aeruginosa PA01
aucgcgugggccaccau

SEQ ID NO: 1414153 - RNA, 17 nt, Pseudomonas aeruginosa PA01
aucgcuuuccuggccga

SEQ ID NO: 1414154 - RNA, 20 nt, Pseudomonas aeruginosa PA01
aucgcuuuccuggccgaccc

SEQ ID NO: 1414155 - RNA, 21 nt, Pseudomonas aeruginosa PA01
aucgcuuuccuggccgacccg

SEQ ID NO: 1414156 - RNA, 22 nt, Pseudomonas aeruginosa PA01
aucgcguaggacgcauaaccgc

SEQ ID NO: 1414157 - RNA, 14 nt, Pseudomonas aeruginosa PA01
aucgcguagguggc

SEQ ID NO: 1414158 - RNA, 15 nt, Pseudomonas aeruginosa PA01
aucgcguagguggcg

SEQ ID NO: 1414159 - RNA, 20 nt, Pseudomonas aeruginosa PA01
aucgcgucguauaggcgcug

SEQ ID NO: 1414160 - RNA, 22 nt, Pseudomonas aeruginosa PA01
aucgcgucguauaggcgcuggu

SEQ ID NO: 1414161 - RNA, 13 nt, Pseudomonas aeruginosa PA01
aucgcgucgccga

SEQ ID NO: 1414162 - RNA, 14 nt, Pseudomonas aeruginosa PA01
aucgcgucgccgaa

SEQ ID NO: 1414163 - RNA, 15 nt, Pseudomonas aeruginosa PA01
aucgcgucgccgaac

SEQ ID NO: 1414164 - RNA, 15 nt, Pseudomonas aeruginosa PA01
aucgcgucgcaggcg

SEQ ID NO: 1414165 - RNA, 20 nt, Pseudomonas aeruginosa PA01
aucgcgucgcaggcgaugcc

SEQ ID NO: 1414166 - RNA, 11 nt, Pseudomonas aeruginosa PA01
auggcugccga

SEQ ID NO: 1414167 - RNA, 21 nt, Pseudomonas aeruginosa PA01
auggucacgccgaggcugcgg

SEQ ID NO: 1414168 - RNA, 17 nt, Pseudomonas aeruginosa PA01
auggucaggcuggcccc

SEQ ID NO: 1414169 - RNA, 21 nt, Pseudomonas aeruginosa PA01
auggucgagagaauccgccgu

SEQ ID NO: 1414170 - RNA, 17 nt, Pseudomonas aeruginosa PA01
augguccguucggcgcc

SEQ ID NO: 1414171 - RNA, 18 nt, Pseudomonas aeruginosa PA01
augguccguucggcgccc

SEQ ID NO: 1414172 - RNA, 16 nt, Pseudomonas aeruginosa PA01
augguggaccagcgcc

SEQ ID NO: 1414173 - RNA, 17 nt, Pseudomonas aeruginosa PA01
auggugggcgccgcugu

SEQ ID NO: 1414174 - RNA, 13 nt, Pseudomonas aeruginosa PA01
auggugccgagca

SEQ ID NO: 1414175 - RNA, 21 nt, Pseudomonas aeruginosa PA01
auggugcccagcaggcugcug

SEQ ID NO: 1414176 - RNA, 17 nt, Pseudomonas aeruginosa PA01
auggugaucacgucggc

SEQ ID NO: 1414177 - RNA, 19 nt, Pseudomonas aeruginosa PA01
auggugaucacgucggcgu

SEQ ID NO: 1414178 - RNA, 18 nt, Pseudomonas aeruginosa PA01
auggugacguugcgccgc

SEQ ID NO: 1414179 - RNA, 24 nt, Pseudomonas aeruginosa PA01
auggucgccggagucguagcgcgc

SEQ ID NO: 1414180 - RNA, 12 nt, Pseudomonas aeruginosa PA01
auguaggcgcac

SEQ ID NO: 1414181 - RNA, 17 nt, Pseudomonas aeruginosa PA01
auguagcgcgccgaggg

SEQ ID NO: 1414182 - RNA, 19 nt, Pseudomonas aeruginosa PA01
auguagcggaaguucaccu

SEQ ID NO: 1414183 - RNA, 20 nt, Pseudomonas aeruginosa PA01
auguagcguugcaggcaguc

SEQ ID NO: 1414184 - RNA, 15 nt, Pseudomonas aeruginosa PA01
auguagcugccggcg

SEQ ID NO: 1414185 - RNA, 15 nt, Pseudomonas aeruginosa PA01
auguaggucaccgcg

SEQ ID NO: 1414186 - RNA, 23 nt, Pseudomonas aeruginosa PA01
auguccgcaggcaggucgcugcc

SEQ ID NO: 1414187 - RNA, 17 nt, Pseudomonas aeruginosa PA01
auguccgagcaggucgc

SEQ ID NO: 1414188 - RNA, 13 nt, Pseudomonas aeruginosa PA01
auguccugggcca

SEQ ID NO: 1414189 - RNA, 22 nt, Pseudomonas aeruginosa PA01
augucgaacaacccgccagcaa

SEQ ID NO: 1414190 - RNA, 17 nt, Pseudomonas aeruginosa PA01
augucgaggaacagguc

SEQ ID NO: 1414191 - RNA, 17 nt, Pseudomonas aeruginosa PA01
augucgagggccggguu

SEQ ID NO: 1414192 - RNA, 22 nt, Pseudomonas aeruginosa PA01
augucgagauugucgcguccgg

SEQ ID NO: 1414193 - RNA, 23 nt, Pseudomonas aeruginosa PA01
augcucaggucgaacugcacccg

SEQ ID NO: 1414194 - RNA, 19 nt, Pseudomonas aeruginosa PA01
augcucagcacggcgacgg

SEQ ID NO: 1414195 - RNA, 16 nt, Pseudomonas aeruginosa PA01
augcucagccgcgccg

SEQ ID NO: 1414196 - RNA, 18 nt, Pseudomonas aeruginosa PA01
augcucagccgcgccggg

SEQ ID NO: 1414197 - RNA, 15 nt, Pseudomonas aeruginosa PA01
augcucagcgccggc

SEQ ID NO: 1414198 - RNA, 21 nt, Pseudomonas aeruginosa PA01
augcucggccagcucgccgaa

SEQ ID NO: 1414199 - RNA, 14 nt, Pseudomonas aeruginosa PA01
augcucggccaggu

SEQ ID NO: 1414200 - RNA, 15 nt, Pseudomonas aeruginosa PA01
augcucgcgccagcc

SEQ ID NO: 1414201 - RNA, 21 nt, Pseudomonas aeruginosa PA01
augcucgcgccagccccaggc

SEQ ID NO: 1414202 - RNA, 15 nt, Pseudomonas aeruginosa PA01
augcuccgccuggcg

SEQ ID NO: 1414203 - RNA, 18 nt, Pseudomonas aeruginosa PA01
auggccgacccgugcgcc

SEQ ID NO: 1414204 - RNA, 20 nt, Pseudomonas aeruginosa PA01
auggccgacccgugcgccgc

SEQ ID NO: 1414205 - RNA, 17 nt, Pseudomonas aeruginosa PA01
auggcccguuccaccgc

SEQ ID NO: 1414206 - RNA, 15 nt, Pseudomonas aeruginosa PA01
auggccgcagcggcu

SEQ ID NO: 1414207 - RNA, 14 nt, Pseudomonas aeruginosa PA01
augcugaacuguuc

SEQ ID NO: 1414208 - RNA, 16 nt, Pseudomonas aeruginosa PA01
auggccguagccggug

SEQ ID NO: 1414209 - RNA, 12 nt, Pseudomonas aeruginosa PA01
auggcgccggcc

SEQ ID NO: 1414210 - RNA, 18 nt, Pseudomonas aeruginosa PA01
auggcgccggccagagcu

SEQ ID NO: 1414211 - RNA, 13 nt, Pseudomonas aeruginosa PA01
auggcgccacucg

SEQ ID NO: 1414212 - RNA, 17 nt, Pseudomonas aeruginosa PA01
auggcgccacucggcgu

SEQ ID NO: 1414213 - RNA, 22 nt, Pseudomonas aeruginosa PA01
auggcgccacucggcgugccgg

SEQ ID NO: 1414214 - RNA, 16 nt, Pseudomonas aeruginosa PA01
auggccgccagcaggc

SEQ ID NO: 1414215 - RNA, 18 nt, Pseudomonas aeruginosa PA01
auggccgcucccaccgcu

SEQ ID NO: 1414216 - RNA, 19 nt, Pseudomonas aeruginosa PA01
auggccggcagcagcgcca

SEQ ID NO: 1414217 - RNA, 22 nt, Pseudomonas aeruginosa PA01
auggccggcagcagcgccagga

SEQ ID NO: 1414218 - RNA, 12 nt, Pseudomonas aeruginosa PA01
auggccgggccg

SEQ ID NO: 1414219 - RNA, 16 nt, Pseudomonas aeruginosa PA01
auggcgugggcugaca

SEQ ID NO: 1414220 - RNA, 17 nt, Pseudomonas aeruginosa PA01
auggcguguucgucgau

SEQ ID NO: 1414221 - RNA, 23 nt, Pseudomonas aeruginosa PA01
auggcguguucgucgaucagguc

SEQ ID NO: 1414222 - RNA, 13 nt, Pseudomonas aeruginosa PA01
auggcgucggcga

SEQ ID NO: 1414223 - RNA, 21 nt, Pseudomonas aeruginosa PA01
auggcgugaaguagccgccgg

SEQ ID NO: 1414224 - RNA, 23 nt, Pseudomonas aeruginosa PA01
auggcgugaaguagccgccggga

SEQ ID NO: 1414225 - RNA, 18 nt, Pseudomonas aeruginosa PA01
auggcguagaggcucggc

SEQ ID NO: 1414226 - RNA, 12 nt, Pseudomonas aeruginosa PA01
auggcgcugcca

SEQ ID NO: 1414227 - RNA, 19 nt, Pseudomonas aeruginosa PA01
auggcggauaaccgcaagc

SEQ ID NO: 1414228 - RNA, 21 nt, Pseudomonas aeruginosa PA01
auggcggauaaccgcaagcgg

SEQ ID NO: 1414229 - RNA, 19 nt, Pseudomonas aeruginosa PA01
auggcggauagccgcaagc

SEQ ID NO: 1414230 - RNA, 16 nt, Pseudomonas aeruginosa PA01
auggcggacgaucacu

SEQ ID NO: 1414231 - RNA, 12 nt, Pseudomonas aeruginosa PA01
auggcgcgccuc

SEQ ID NO: 1414232 - RNA, 20 nt, Pseudomonas aeruginosa PA01
auggcgcgaaucuucggcgc

SEQ ID NO: 1414233 - RNA, 20 nt, Pseudomonas aeruginosa PA01
auggcggcauugagcgccag

SEQ ID NO: 1414234 - RNA, 23 nt, Pseudomonas aeruginosa PA01
auggcggccugguagucgccggu

SEQ ID NO: 1414235 - RNA, 16 nt, Pseudomonas aeruginosa PA01
auuccacgucgccgac

SEQ ID NO: 1414236 - RNA, 20 nt, Pseudomonas aeruginosa PA01
auuccagaaacggcugccgg

SEQ ID NO: 1414237 - RNA, 14 nt, Pseudomonas aeruginosa PA01
auuccagcaggucg

SEQ ID NO: 1414238 - RNA, 22 nt, Pseudomonas aeruginosa PA01
auuagcgucgcgcggccagcgu

SEQ ID NO: 1414239 - RNA, 22 nt, Pseudomonas aeruginosa PA01
augucgcuggccugcagguccg

SEQ ID NO: 1414240 - RNA, 19 nt, Pseudomonas aeruginosa PA01
augucgcggcaggcggcgg

SEQ ID NO: 1414241 - RNA, 12 nt, Pseudomonas aeruginosa PA01
augucgcggccc

SEQ ID NO: 1414242 - RNA, 15 nt, Pseudomonas aeruginosa PA01
augucgccggcaugg

SEQ ID NO: 1414243 - RNA, 13 nt, Pseudomonas aeruginosa PA01
augucgcggcuga

SEQ ID NO: 1414244 - RNA, 22 nt, Pseudomonas aeruginosa PA01
augucgcgggcaugcugcucgg

SEQ ID NO: 1414245 - RNA, 17 nt, Pseudomonas aeruginosa PA01
auuaccccgcccacucu

SEQ ID NO: 1414246 - RNA, 16 nt, Pseudomonas aeruginosa PA01
augccagugccucgcg

SEQ ID NO: 1414247 - RNA, 12 nt, Pseudomonas aeruginosa PA01
augccagcgcca

SEQ ID NO: 1414248 - RNA, 19 nt, Pseudomonas aeruginosa PA01
augccagcgccacgccgcu

SEQ ID NO: 1414249 - RNA, 14 nt, Pseudomonas aeruginosa PA01
augccacugacgcg

SEQ ID NO: 1414250 - RNA, 16 nt, Pseudomonas aeruginosa PA01
augccacugacgcgca

SEQ ID NO: 1414251 - RNA, 22 nt, Pseudomonas aeruginosa PA01
augccacugacgcgcagcgccg

SEQ ID NO: 1414252 - RNA, 21 nt, Pseudomonas aeruginosa PA01
augccaaguugccuggcaggu

SEQ ID NO: 1414253 - RNA, 14 nt, Pseudomonas aeruginosa PA01
augcaaccgcccug

SEQ ID NO: 1414254 - RNA, 12 nt, Pseudomonas aeruginosa PA01
augcaacccgcc

SEQ ID NO: 1414255 - RNA, 17 nt, Pseudomonas aeruginosa PA01
augcaagaacgccgacc

SEQ ID NO: 1414256 - RNA, 22 nt, Pseudomonas aeruginosa PA01
augcaauggauguugccgccgc

SEQ ID NO: 1414257 - RNA, 19 nt, Pseudomonas aeruginosa PA01
augcaccugcgccccgguc

SEQ ID NO: 1414258 - RNA, 19 nt, Pseudomonas aeruginosa PA01
augccccauccgacgccgg

SEQ ID NO: 1414259 - RNA, 21 nt, Pseudomonas aeruginosa PA01
augcccagcgcaggccgaucu

SEQ ID NO: 1414260 - RNA, 18 nt, Pseudomonas aeruginosa PA01
augcccagccagggccgc

SEQ ID NO: 1414261 - RNA, 12 nt, Pseudomonas aeruginosa PA01
augcccagacgc

SEQ ID NO: 1414262 - RNA, 17 nt, Pseudomonas aeruginosa PA01
augcccagacgccgcuc

SEQ ID NO: 1414263 - RNA, 20 nt, Pseudomonas aeruginosa PA01
augcccaccugaacgcgccc

SEQ ID NO: 1414264 - RNA, 22 nt, Pseudomonas aeruginosa PA01
augcccaccugaacgcgcccgg

SEQ ID NO: 1414265 - RNA, 15 nt, Pseudomonas aeruginosa PA01
augcccagcguggcc

SEQ ID NO: 1414266 - RNA, 22 nt, Pseudomonas aeruginosa PA01
augcccagcguggccagcgaac

SEQ ID NO: 1414267 - RNA, 20 nt, Pseudomonas aeruginosa PA01
augcccggcagcgccgggca

SEQ ID NO: 1414268 - RNA, 15 nt, Pseudomonas aeruginosa PA01
augcccggccuggcg

SEQ ID NO: 1414269 - RNA, 20 nt, Pseudomonas aeruginosa PA01
augcccgcugggcagguggu

SEQ ID NO: 1414270 - RNA, 15 nt, Pseudomonas aeruginosa PA01
augcccgcgccuggg

SEQ ID NO: 1414271 - RNA, 17 nt, Pseudomonas aeruginosa PA01
augcccgcgccugggcc

SEQ ID NO: 1414272 - RNA, 14 nt, Pseudomonas aeruginosa PA01
augcccgccucgcg

SEQ ID NO: 1414273 - RNA, 22 nt, Pseudomonas aeruginosa PA01
augcccgccagcaggcgccggc

SEQ ID NO: 1414274 - RNA, 23 nt, Pseudomonas aeruginosa PA01
augcccgccagcaggcgccggcg

SEQ ID NO: 1414275 - RNA, 19 nt, Pseudomonas aeruginosa PA01
augcccgccccgcaccagc

SEQ ID NO: 1414276 - RNA, 23 nt, Pseudomonas aeruginosa PA01
augcccggcugguugccagcagc

SEQ ID NO: 1414277 - RNA, 19 nt, Pseudomonas aeruginosa PA01
augcccgucaggccuugcg

SEQ ID NO: 1414278 - RNA, 20 nt, Pseudomonas aeruginosa PA01
augcccuuggcuuccuggcg

SEQ ID NO: 1414279 - RNA, 22 nt, Pseudomonas aeruginosa PA01
augcccuuggcuuccuggcgcc

SEQ ID NO: 1414280 - RNA, 17 nt, Pseudomonas aeruginosa PA01
augcccuuguccggccc

SEQ ID NO: 1414281 - RNA, 15 nt, Pseudomonas aeruginosa PA01
augccgaacaccugc

SEQ ID NO: 1414282 - RNA, 23 nt, Pseudomonas aeruginosa PA01
augccgaacaccugcaucaccag

SEQ ID NO: 1414283 - RNA, 13 nt, Pseudomonas aeruginosa PA01
augcccugccggc

SEQ ID NO: 1414284 - RNA, 14 nt, Pseudomonas aeruginosa PA01
augcccugccggcg

SEQ ID NO: 1414285 - RNA, 22 nt, Pseudomonas aeruginosa PA01
augacggggaucacucgccgcc

SEQ ID NO: 1414286 - RNA, 17 nt, Pseudomonas aeruginosa PA01
aucugccgggcgcgcug

SEQ ID NO: 1414287 - RNA, 16 nt, Pseudomonas aeruginosa PA01
aucugcaacgcggcgu

SEQ ID NO: 1414288 - RNA, 17 nt, Pseudomonas aeruginosa PA01
augaucuccgcgccggg

SEQ ID NO: 1414289 - RNA, 18 nt, Pseudomonas aeruginosa PA01
augaugccgaggcggccg

SEQ ID NO: 1414290 - RNA, 22 nt, Pseudomonas aeruginosa PA01
augaggcuguccagcaggcguu

SEQ ID NO: 1414291 - RNA, 14 nt, Pseudomonas aeruginosa PA01
augaggcgugggga

SEQ ID NO: 1414292 - RNA, 16 nt, Pseudomonas aeruginosa PA01
augagcugcucuaccg

SEQ ID NO: 1414293 - RNA, 16 nt, Pseudomonas aeruginosa PA01
augagcgaucccaggu

SEQ ID NO: 1414294 - RNA, 18 nt, Pseudomonas aeruginosa PA01
augagcgauguccaggcc

SEQ ID NO: 1414295 - RNA, 14 nt, Pseudomonas aeruginosa PA01
augagaaggucggg

SEQ ID NO: 1414296 - RNA, 17 nt, Pseudomonas aeruginosa PA01
augcguggucugcccgu

SEQ ID NO: 1414297 - RNA, 17 nt, Pseudomonas aeruginosa PA01
augcgcugguagcgcuc

SEQ ID NO: 1414298 - RNA, 19 nt, Pseudomonas aeruginosa PA01
augcgcugguagcgcucca

SEQ ID NO: 1414299 - RNA, 13 nt, Pseudomonas aeruginosa PA01
augcgcuggucgu

SEQ ID NO: 1414300 - RNA, 19 nt, Pseudomonas aeruginosa PA01
augcggaacaccgccugga

SEQ ID NO: 1414301 - RNA, 13 nt, Pseudomonas aeruginosa PA01
augcgcgucgccg

SEQ ID NO: 1414302 - RNA, 15 nt, Pseudomonas aeruginosa PA01
augcgcggucaccag

SEQ ID NO: 1414303 - RNA, 13 nt, Pseudomonas aeruginosa PA01
augcgcggcagga

SEQ ID NO: 1414304 - RNA, 18 nt, Pseudomonas aeruginosa PA01
augcgcuacggcaucacc

SEQ ID NO: 1414305 - RNA, 22 nt, Pseudomonas aeruginosa PA01
augcgcuacggcaucaccggcg

SEQ ID NO: 1414306 - RNA, 18 nt, Pseudomonas aeruginosa PA01
augcgcguguugcgccgc

SEQ ID NO: 1414307 - RNA, 21 nt, Pseudomonas aeruginosa PA01
augcgcguguugcgccgcacc

SEQ ID NO: 1414308 - RNA, 14 nt, Pseudomonas aeruginosa PA01
augccuucaccggc

SEQ ID NO: 1414309 - RNA, 21 nt, Pseudomonas aeruginosa PA01
augccugcguuucgccgggca

SEQ ID NO: 1414310 - RNA, 14 nt, Pseudomonas aeruginosa PA01
augccuugaggccu

SEQ ID NO: 1414311 - RNA, 14 nt, Pseudomonas aeruginosa PA01
augccuugcagcgc

SEQ ID NO: 1414312 - RNA, 14 nt, Pseudomonas aeruginosa PA01
augccuugcggccc

SEQ ID NO: 1414313 - RNA, 19 nt, Pseudomonas aeruginosa PA01
augccguuguagcugacca

SEQ ID NO: 1414314 - RNA, 20 nt, Pseudomonas aeruginosa PA01
augccguuguggcaggcgcu

SEQ ID NO: 1414315 - RNA, 21 nt, Pseudomonas aeruginosa PA01
augccguuguggcaggcgcug

SEQ ID NO: 1414316 - RNA, 14 nt, Pseudomonas aeruginosa PA01
augccucggcggcg

SEQ ID NO: 1414317 - RNA, 15 nt, Pseudomonas aeruginosa PA01
augccucggcggcgg

SEQ ID NO: 1414318 - RNA, 18 nt, Pseudomonas aeruginosa PA01
augccucggcggcggccu

SEQ ID NO: 1414319 - RNA, 19 nt, Pseudomonas aeruginosa PA01
augcgcgcccugacgaugc

SEQ ID NO: 1414320 - RNA, 23 nt, Pseudomonas aeruginosa PA01
augccgcaagcuccccgccgcca

SEQ ID NO: 1414321 - RNA, 17 nt, Pseudomonas aeruginosa PA01
augccgauggcgccgcc

SEQ ID NO: 1414322 - RNA, 18 nt, Pseudomonas aeruginosa PA01
augccgauggcgccgccg

SEQ ID NO: 1414323 - RNA, 14 nt, Pseudomonas aeruginosa PA01
augccgaugccgcc

SEQ ID NO: 1414324 - RNA, 15 nt, Pseudomonas aeruginosa PA01
augccgaugccgccg

SEQ ID NO: 1414325 - RNA, 21 nt, Pseudomonas aeruginosa PA01
augccgaggcugugggucggg

SEQ ID NO: 1414326 - RNA, 22 nt, Pseudomonas aeruginosa PA01
augccgaucaugcucggcggug

SEQ ID NO: 1414327 - RNA, 23 nt, Pseudomonas aeruginosa PA01
augccgacgagcagcucgccggc

SEQ ID NO: 1414328 - RNA, 19 nt, Pseudomonas aeruginosa PA01
augccgacgucgaugacga

SEQ ID NO: 1414329 - RNA, 20 nt, Pseudomonas aeruginosa PA01
augccgagcgaaaucggcag

SEQ ID NO: 1414330 - RNA, 18 nt, Pseudomonas aeruginosa PA01
augccgagcaucagcgac

SEQ ID NO: 1414331 - RNA, 21 nt, Pseudomonas aeruginosa PA01
augccgaacuucuccgccacc

SEQ ID NO: 1414332 - RNA, 12 nt, Pseudomonas aeruginosa PA01
augccgaccacg

SEQ ID NO: 1414333 - RNA, 22 nt, Pseudomonas aeruginosa PA01
augccgaaggcgucauccgcca

SEQ ID NO: 1414334 - RNA, 17 nt, Pseudomonas aeruginosa PA01
augcccuugccgggaag

SEQ ID NO: 1414335 - RNA, 13 nt, Pseudomonas aeruginosa PA01
augccgccggcau

SEQ ID NO: 1414336 - RNA, 20 nt, Pseudomonas aeruginosa PA01
augccgccgggcaucaugcc

SEQ ID NO: 1414337 - RNA, 14 nt, Pseudomonas aeruginosa PA01
augccgccgucgcg

SEQ ID NO: 1414338 - RNA, 16 nt, Pseudomonas aeruginosa PA01
augccgcgccaggcgc

SEQ ID NO: 1414339 - RNA, 22 nt, Pseudomonas aeruginosa PA01
augccgcgucgaagucgaucac

SEQ ID NO: 1414340 - RNA, 13 nt, Pseudomonas aeruginosa PA01
augccgcgccgga

SEQ ID NO: 1414341 - RNA, 14 nt, Pseudomonas aeruginosa PA01
augccgcgccggaa

SEQ ID NO: 1414342 - RNA, 22 nt, Pseudomonas aeruginosa PA01
augccgcacaggcuggccagaa

SEQ ID NO: 1414343 - RNA, 23 nt, Pseudomonas aeruginosa PA01
augccgcaccccauccucgccgg

SEQ ID NO: 1414344 - RNA, 18 nt, Pseudomonas aeruginosa PA01
augccgcccggccgcugg

SEQ ID NO: 1414345 - RNA, 22 nt, Pseudomonas aeruginosa PA01
augccgcccuccaucagcgccu

SEQ ID NO: 1414346 - RNA, 14 nt, Pseudomonas aeruginosa PA01
augccgccgccgcc

SEQ ID NO: 1414347 - RNA, 13 nt, Pseudomonas aeruginosa PA01
augccgccgacgc

SEQ ID NO: 1414348 - RNA, 19 nt, Pseudomonas aeruginosa PA01
augccguacaggucggcgc

SEQ ID NO: 1414349 - RNA, 12 nt, Pseudomonas aeruginosa PA01
augccggugcug

SEQ ID NO: 1414350 - RNA, 17 nt, Pseudomonas aeruginosa PA01
augccggugcuggugcg

SEQ ID NO: 1414351 - RNA, 16 nt, Pseudomonas aeruginosa PA01
augccguagacguagu

SEQ ID NO: 1414352 - RNA, 23 nt, Pseudomonas aeruginosa PA01
augccguucucccgcgcgcugug

SEQ ID NO: 1414353 - RNA, 17 nt, Pseudomonas aeruginosa PA01
augccguucucggugac

SEQ ID NO: 1414354 - RNA, 13 nt, Pseudomonas aeruginosa PA01
augccguucacua

SEQ ID NO: 1414355 - RNA, 17 nt, Pseudomonas aeruginosa PA01
augccguucaggccggc

SEQ ID NO: 1414356 - RNA, 14 nt, Pseudomonas aeruginosa PA01
augccguucaggcg

SEQ ID NO: 1414357 - RNA, 22 nt, Pseudomonas aeruginosa PA01
augccgggguccgccggucacc

SEQ ID NO: 1414358 - RNA, 22 nt, Pseudomonas aeruginosa PA01
augccgggcuuuuucauuuccu

SEQ ID NO: 1414359 - RNA, 16 nt, Pseudomonas aeruginosa PA01
augccggcgucggcga

SEQ ID NO: 1414360 - RNA, 14 nt, Pseudomonas aeruginosa PA01
augccggccggcag

SEQ ID NO: 1414361 - RNA, 15 nt, Pseudomonas aeruginosa PA01
augccggccggggcc

SEQ ID NO: 1414362 - RNA, 16 nt, Pseudomonas aeruginosa PA01
augccggccggggccg

SEQ ID NO: 1414363 - RNA, 12 nt, Pseudomonas aeruginosa PA01
augccggccucg

SEQ ID NO: 1414364 - RNA, 23 nt, Pseudomonas aeruginosa PA01
augccggcgcugucucgccagcc

SEQ ID NO: 1414365 - RNA, 19 nt, Pseudomonas aeruginosa PA01
augccggaaagccuggccg

SEQ ID NO: 1414366 - RNA, 13 nt, Pseudomonas aeruginosa PA01
augccggccagga

SEQ ID NO: 1414367 - RNA, 20 nt, Pseudomonas aeruginosa PA01
augccggccaggaaggccgc

SEQ ID NO: 1414368 - RNA, 13 nt, Pseudomonas aeruginosa PA01
augccggccggca

SEQ ID NO: 1414369 - RNA, 20 nt, Pseudomonas aeruginosa PA01
cccguccauuuucagcggag

SEQ ID NO: 1414370 - RNA, 14 nt, Pseudomonas aeruginosa PA01
cccguccagcgcuu

SEQ ID NO: 1414371 - RNA, 24 nt, Pseudomonas aeruginosa PA01
cccgucacuucacgacaggcggcg

SEQ ID NO: 1414372 - RNA, 23 nt, Pseudomonas aeruginosa PA01
cccguagucguucagcgccucgc

SEQ ID NO: 1414373 - RNA, 23 nt, Pseudomonas aeruginosa PA01
cccgucgaccaucaccagcgccg

SEQ ID NO: 1414374 - RNA, 17 nt, Pseudomonas aeruginosa PA01
cccguauccuccgcgac

SEQ ID NO: 1414375 - RNA, 18 nt, Pseudomonas aeruginosa PA01
cccgucgccauucggcga

SEQ ID NO: 1414376 - RNA, 12 nt, Pseudomonas aeruginosa PA01
cccgucggccuc

SEQ ID NO: 1414377 - RNA, 14 nt, Pseudomonas aeruginosa PA01
cccgucgcgccggc

SEQ ID NO: 1414378 - RNA, 13 nt, Pseudomonas aeruginosa PA01
cccgucgcgcgcc

SEQ ID NO: 1414379 - RNA, 15 nt, Pseudomonas aeruginosa PA01
cccgucgggcaaggg

SEQ ID NO: 1414380 - RNA, 21 nt, Pseudomonas aeruginosa PA01
cccgggguuggcgcugaccag

SEQ ID NO: 1414381 - RNA, 22 nt, Pseudomonas aeruginosa PA01
cccggucgcgcuggaccuggcc

SEQ ID NO: 1414382 - RNA, 15 nt, Pseudomonas aeruginosa PA01
cccgggucgcgcagc

SEQ ID NO: 1414383 - RNA, 18 nt, Pseudomonas aeruginosa PA01
cccgggucgcgcagcggc

SEQ ID NO: 1414384 - RNA, 19 nt, Pseudomonas aeruginosa PA01
cccgggucgcgcagcggcu

SEQ ID NO: 1414385 - RNA, 22 nt, Pseudomonas aeruginosa PA01
cccgggucgcugcucagggccg

SEQ ID NO: 1414386 - RNA, 21 nt, Pseudomonas aeruginosa PA01
cccgggucgucggucggccag

SEQ ID NO: 1414387 - RNA, 16 nt, Pseudomonas aeruginosa PA01
cccggucuagcgcccc

SEQ ID NO: 1414388 - RNA, 22 nt, Pseudomonas aeruginosa PA01
cccggucuagcgccccggccgc

SEQ ID NO: 1414389 - RNA, 16 nt, Pseudomonas aeruginosa PA01
cccggucucgcgcagc

SEQ ID NO: 1414390 - RNA, 19 nt, Pseudomonas aeruginosa PA01
cccggucucgcgcagcggc

SEQ ID NO: 1414391 - RNA, 20 nt, Pseudomonas aeruginosa PA01
cccggucucgcgcagcggcg

SEQ ID NO: 1414392 - RNA, 17 nt, Pseudomonas aeruginosa PA01
cccggucucagccggcg

SEQ ID NO: 1414393 - RNA, 14 nt, Pseudomonas aeruginosa PA01
cccgguuggccagg

SEQ ID NO: 1414394 - RNA, 18 nt, Pseudomonas aeruginosa PA01
cccgguuggccaggacca

SEQ ID NO: 1414395 - RNA, 21 nt, Pseudomonas aeruginosa PA01
cccgguuggccaggaccaucg

SEQ ID NO: 1414396 - RNA, 14 nt, Pseudomonas aeruginosa PA01
cccguaccagcgcg

SEQ ID NO: 1414397 - RNA, 16 nt, Pseudomonas aeruginosa PA01
cccguagcgcucggug

SEQ ID NO: 1414398 - RNA, 14 nt, Pseudomonas aeruginosa PA01
cccguaaggccagg

SEQ ID NO: 1414399 - RNA, 20 nt, Pseudomonas aeruginosa PA01
cccggaaagguucacgcagu

SEQ ID NO: 1414400 - RNA, 17 nt, Pseudomonas aeruginosa PA01
cccggacugcccgacga

SEQ ID NO: 1414401 - RNA, 19 nt, Pseudomonas aeruginosa PA01
cccggacgggugcgcgcca

SEQ ID NO: 1414402 - RNA, 20 nt, Pseudomonas aeruginosa PA01
cccggacgggugcgcgccac

SEQ ID NO: 1414403 - RNA, 20 nt, Pseudomonas aeruginosa PA01
cccggagaucgccgcgccgu

SEQ ID NO: 1414404 - RNA, 21 nt, Pseudomonas aeruginosa PA01
cccggagaucggcugcaacgc

SEQ ID NO: 1414405 - RNA, 14 nt, Pseudomonas aeruginosa PA01
cccggagccaacgc

SEQ ID NO: 1414406 - RNA, 19 nt, Pseudomonas aeruginosa PA01
cccggacgacgaaagaagc

SEQ ID NO: 1414407 - RNA, 20 nt, Pseudomonas aeruginosa PA01
cccggagaccgugccgccgg

SEQ ID NO: 1414408 - RNA, 14 nt, Pseudomonas aeruginosa PA01
cccggagcggcugc

SEQ ID NO: 1414409 - RNA, 15 nt, Pseudomonas aeruginosa PA01
cccggaggcggcgag

SEQ ID NO: 1414410 - RNA, 16 nt, Pseudomonas aeruginosa PA01
cccggaguuccagcgg

SEQ ID NO: 1414411 - RNA, 14 nt, Pseudomonas aeruginosa PA01
cccggcgcggccga

SEQ ID NO: 1414412 - RNA, 13 nt, Pseudomonas aeruginosa PA01
cccggcgcggaac

SEQ ID NO: 1414413 - RNA, 15 nt, Pseudomonas aeruginosa PA01
cccggcgcacgccgg

SEQ ID NO: 1414414 - RNA, 14 nt, Pseudomonas aeruginosa PA01
cccggcgcacugcg

SEQ ID NO: 1414415 - RNA, 12 nt, Pseudomonas aeruginosa PA01
cccggcgcagag

SEQ ID NO: 1414416 - RNA, 18 nt, Pseudomonas aeruginosa PA01
cccggcgcaugccgcagg

SEQ ID NO: 1414417 - RNA, 19 nt, Pseudomonas aeruginosa PA01
cccggcgccaccccgccgc

SEQ ID NO: 1414418 - RNA, 13 nt, Pseudomonas aeruginosa PA01
cccggcgccaccg

SEQ ID NO: 1414419 - RNA, 15 nt, Pseudomonas aeruginosa PA01
cccggcgccaccgcg

SEQ ID NO: 1414420 - RNA, 13 nt, Pseudomonas aeruginosa PA01
cccggcgccgccc

SEQ ID NO: 1414421 - RNA, 13 nt, Pseudomonas aeruginosa PA01
cccggcgcccggc

SEQ ID NO: 1414422 - RNA, 15 nt, Pseudomonas aeruginosa PA01
cccgggaugcccggc

SEQ ID NO: 1414423 - RNA, 12 nt, Pseudomonas aeruginosa PA01
cccgggaucgau

SEQ ID NO: 1414424 - RNA, 21 nt, Pseudomonas aeruginosa PA01
cccggcuuuuuucgcccgugc

SEQ ID NO: 1414425 - RNA, 23 nt, Pseudomonas aeruginosa PA01
cccggcuuuuuucgcccgugccg

SEQ ID NO: 1414426 - RNA, 17 nt, Pseudomonas aeruginosa PA01
cccggcuucgcuggugc

SEQ ID NO: 1414427 - RNA, 14 nt, Pseudomonas aeruginosa PA01
cccgggccgcgcac

SEQ ID NO: 1414428 - RNA, 17 nt, Pseudomonas aeruginosa PA01
cccgggcccaagccgag

SEQ ID NO: 1414429 - RNA, 22 nt, Pseudomonas aeruginosa PA01
cccgggcccaagccgagcggca

SEQ ID NO: 1414430 - RNA, 21 nt, Pseudomonas aeruginosa PA01
cccggcugguugccagcagcg

SEQ ID NO: 1414431 - RNA, 20 nt, Pseudomonas aeruginosa PA01
cccggcugugcucgacgggc

SEQ ID NO: 1414432 - RNA, 13 nt, Pseudomonas aeruginosa PA01
cccggcuggccau

SEQ ID NO: 1414433 - RNA, 16 nt, Pseudomonas aeruginosa PA01
cccggcuuuccucggc

SEQ ID NO: 1414434 - RNA, 18 nt, Pseudomonas aeruginosa PA01
cccggcuuuccucggcca

SEQ ID NO: 1414435 - RNA, 20 nt, Pseudomonas aeruginosa PA01
cccggcuuuccucggccaug

SEQ ID NO: 1414436 - RNA, 14 nt, Pseudomonas aeruginosa PA01
cccggcuugccggc

SEQ ID NO: 1414437 - RNA, 20 nt, Pseudomonas aeruginosa PA01
cccggcuugccggcagcgac

SEQ ID NO: 1414438 - RNA, 13 nt, Pseudomonas aeruginosa PA01
cccggcuugccgu

SEQ ID NO: 1414439 - RNA, 22 nt, Pseudomonas aeruginosa PA01
cccggcuugccgucgguguccg

SEQ ID NO: 1414440 - RNA, 13 nt, Pseudomonas aeruginosa PA01
cccggcuugcuga

SEQ ID NO: 1414441 - RNA, 18 nt, Pseudomonas aeruginosa PA01
cccggcuuggcgggcucg

SEQ ID NO: 1414442 - RNA, 15 nt, Pseudomonas aeruginosa PA01
cccggcgcggcuacc

SEQ ID NO: 1414443 - RNA, 12 nt, Pseudomonas aeruginosa PA01
cccggcgcggcg

SEQ ID NO: 1414444 - RNA, 13 nt, Pseudomonas aeruginosa PA01
cccggcgcggcgc

SEQ ID NO: 1414445 - RNA, 11 nt, Pseudomonas aeruginosa PA01
cccggcgcugg

SEQ ID NO: 1414446 - RNA, 19 nt, Pseudomonas aeruginosa PA01
cccggcgcuggccgcgcga

SEQ ID NO: 1414447 - RNA, 15 nt, Pseudomonas aeruginosa PA01
cccggcgcuucgcgc

SEQ ID NO: 1414448 - RNA, 16 nt, Pseudomonas aeruginosa PA01
cccggcgcuucgcgca

SEQ ID NO: 1414449 - RNA, 17 nt, Pseudomonas aeruginosa PA01
cccuccugggccugucg

SEQ ID NO: 1414450 - RNA, 22 nt, Pseudomonas aeruginosa PA01
cccuccuucgagccuggccagg

SEQ ID NO: 1414451 - RNA, 23 nt, Pseudomonas aeruginosa PA01
cccuccuucgagccuggccaggc

SEQ ID NO: 1414452 - RNA, 13 nt, Pseudomonas aeruginosa PA01
cccucgaacggcg

SEQ ID NO: 1414453 - RNA, 13 nt, Pseudomonas aeruginosa PA01
cccucccgcgcca

SEQ ID NO: 1414454 - RNA, 16 nt, Pseudomonas aeruginosa PA01
cccucccgcgccagcg

SEQ ID NO: 1414455 - RNA, 21 nt, Pseudomonas aeruginosa PA01
cccuccaucagcgccuccauc

SEQ ID NO: 1414456 - RNA, 21 nt, Pseudomonas aeruginosa PA01
cccucauggcuguagcucugc

SEQ ID NO: 1414457 - RNA, 15 nt, Pseudomonas aeruginosa PA01
cccguguucggccag

SEQ ID NO: 1414458 - RNA, 19 nt, Pseudomonas aeruginosa PA01
cccguguaccacgcccgcg

SEQ ID NO: 1414459 - RNA, 21 nt, Pseudomonas aeruginosa PA01
cccgugucgccuuccggcagg

SEQ ID NO: 1414460 - RNA, 21 nt, Pseudomonas aeruginosa PA01
cccgugguagucgagccggau

SEQ ID NO: 1414461 - RNA, 22 nt, Pseudomonas aeruginosa PA01
cccguuccuugcgcggcaggcc

SEQ ID NO: 1414462 - RNA, 18 nt, Pseudomonas aeruginosa PA01
cccucagguagucggcga

SEQ ID NO: 1414463 - RNA, 15 nt, Pseudomonas aeruginosa PA01
cccucaggucggcgc

SEQ ID NO: 1414464 - RNA, 12 nt, Pseudomonas aeruginosa PA01
cccgugggucgu

SEQ ID NO: 1414465 - RNA, 18 nt, Pseudomonas aeruginosa PA01
cccgugggguauuccagg

SEQ ID NO: 1414466 - RNA, 11 nt, Pseudomonas aeruginosa PA01
cccguggcgcc

SEQ ID NO: 1414467 - RNA, 14 nt, Pseudomonas aeruginosa PA01
cccguggcgccgca

SEQ ID NO: 1414468 - RNA, 21 nt, Pseudomonas aeruginosa PA01
cccguggcgggccagcaggcg

SEQ ID NO: 1414469 - RNA, 21 nt, Pseudomonas aeruginosa PA01
cccguggcuggggccggccug

SEQ ID NO: 1414470 - RNA, 18 nt, Pseudomonas aeruginosa PA01
cccuggauaucugggcca

SEQ ID NO: 1414471 - RNA, 16 nt, Pseudomonas aeruginosa PA01
cccuggagcagggcga

SEQ ID NO: 1414472 - RNA, 23 nt, Pseudomonas aeruginosa PA01
cccugcgcggacguaacggcuug

SEQ ID NO: 1414473 - RNA, 12 nt, Pseudomonas aeruginosa PA01
cccuggccgcca

SEQ ID NO: 1414474 - RNA, 20 nt, Pseudomonas aeruginosa PA01
cccuggccacguccagcggc

SEQ ID NO: 1414475 - RNA, 18 nt, Pseudomonas aeruginosa PA01
cccugcgcccagggacgc

SEQ ID NO: 1414476 - RNA, 15 nt, Pseudomonas aeruginosa PA01
cccugcgccgcagcg

SEQ ID NO: 1414477 - RNA, 18 nt, Pseudomonas aeruginosa PA01
cccugcgccgcagcggcc

SEQ ID NO: 1414478 - RNA, 12 nt, Pseudomonas aeruginosa PA01
cccugcgccucg

SEQ ID NO: 1414479 - RNA, 21 nt, Pseudomonas aeruginosa PA01
cccugcgcgcgcguuucagcg

SEQ ID NO: 1414480 - RNA, 17 nt, Pseudomonas aeruginosa PA01
cccugccggcgcagauc

SEQ ID NO: 1414481 - RNA, 12 nt, Pseudomonas aeruginosa PA01
cccugccggcgg

SEQ ID NO: 1414482 - RNA, 14 nt, Pseudomonas aeruginosa PA01
cccugccggcggug

SEQ ID NO: 1414483 - RNA, 21 nt, Pseudomonas aeruginosa PA01
cccugccggcgguggacgucg

SEQ ID NO: 1414484 - RNA, 13 nt, Pseudomonas aeruginosa PA01
cccugccgcccuu

SEQ ID NO: 1414485 - RNA, 19 nt, Pseudomonas aeruginosa PA01
cccugccguauccgcggca

SEQ ID NO: 1414486 - RNA, 21 nt, Pseudomonas aeruginosa PA01
cccugccguucgucaccggcg

SEQ ID NO: 1414487 - RNA, 16 nt, Pseudomonas aeruginosa PA01
cccugcccgcgccucg

SEQ ID NO: 1414488 - RNA, 22 nt, Pseudomonas aeruginosa PA01
cccugcccagugggccaccggc

SEQ ID NO: 1414489 - RNA, 21 nt, Pseudomonas aeruginosa PA01
cccugccccagcaucgccggc

SEQ ID NO: 1414490 - RNA, 20 nt, Pseudomonas aeruginosa PA01
cccucuaucacacuguccag

SEQ ID NO: 1414491 - RNA, 14 nt, Pseudomonas aeruginosa PA01
cccucucucgccuc

SEQ ID NO: 1414492 - RNA, 18 nt, Pseudomonas aeruginosa PA01
cccucucucgccucggcg

SEQ ID NO: 1414493 - RNA, 20 nt, Pseudomonas aeruginosa PA01
cccugaccgcgagcgccgcc

SEQ ID NO: 1414494 - RNA, 19 nt, Pseudomonas aeruginosa PA01
cccucggugauaccgccgg

SEQ ID NO: 1414495 - RNA, 20 nt, Pseudomonas aeruginosa PA01
cccucggugauaccgccggc

SEQ ID NO: 1414496 - RNA, 14 nt, Pseudomonas aeruginosa PA01
cccucggugcggcc

SEQ ID NO: 1414497 - RNA, 16 nt, Pseudomonas aeruginosa PA01
cccucggugcggccga

SEQ ID NO: 1414498 - RNA, 18 nt, Pseudomonas aeruginosa PA01
cccucggugcggccgagg

SEQ ID NO: 1414499 - RNA, 19 nt, Pseudomonas aeruginosa PA01
cccucggugcggccgagga

SEQ ID NO: 1414500 - RNA, 21 nt, Pseudomonas aeruginosa PA01
cccucgagcaccgcggucuuc

SEQ ID NO: 1414501 - RNA, 22 nt, Pseudomonas aeruginosa PA01
cccuuuuucauucuccagccgc

SEQ ID NO: 1414502 - RNA, 14 nt, Pseudomonas aeruginosa PA01
cccuuuuucggcgc

SEQ ID NO: 1414503 - RNA, 19 nt, Pseudomonas aeruginosa PA01
cccuuuuucgucgccagcc

SEQ ID NO: 1414504 - RNA, 20 nt, Pseudomonas aeruginosa PA01
cccuuuuuucaugggcaucu

SEQ ID NO: 1414505 - RNA, 20 nt, Pseudomonas aeruginosa PA01
cccuguccccucacggcgcg

SEQ ID NO: 1414506 - RNA, 18 nt, Pseudomonas aeruginosa PA01
ccgaaagccgaagcgcga

SEQ ID NO: 1414507 - RNA, 22 nt, Pseudomonas aeruginosa PA01
ccgaaaucgaugucgcggcgcu

SEQ ID NO: 1414508 - RNA, 22 nt, Pseudomonas aeruginosa PA01
ccgaaauggcgguggccguggg

SEQ ID NO: 1414509 - RNA, 16 nt, Pseudomonas aeruginosa PA01
ccgaaauagcgcgccc

SEQ ID NO: 1414510 - RNA, 16 nt, Pseudomonas aeruginosa PA01
ccgaaaccggcgaugc

SEQ ID NO: 1414511 - RNA, 21 nt, Pseudomonas aeruginosa PA01
cccugggguuucugcuggcca

SEQ ID NO: 1414512 - RNA, 22 nt, Pseudomonas aeruginosa PA01
cccugggguuucugcuggccac

SEQ ID NO: 1414513 - RNA, 14 nt, Pseudomonas aeruginosa PA01
cccugguacagcgc

SEQ ID NO: 1414514 - RNA, 17 nt, Pseudomonas aeruginosa PA01
cccugguacagcgccug

SEQ ID NO: 1414515 - RNA, 22 nt, Pseudomonas aeruginosa PA01
cccugguugcggaacggcucgc

SEQ ID NO: 1414516 - RNA, 19 nt, Pseudomonas aeruginosa PA01
cccugggcgucgacgaacg

SEQ ID NO: 1414517 - RNA, 13 nt, Pseudomonas aeruginosa PA01
cccugggccaacg

SEQ ID NO: 1414518 - RNA, 14 nt, Pseudomonas aeruginosa PA01
cccugggccggcgc

SEQ ID NO: 1414519 - RNA, 13 nt, Pseudomonas aeruginosa PA01
cccugggcggcga

SEQ ID NO: 1414520 - RNA, 19 nt, Pseudomonas aeruginosa PA01
cccuggcuuuccagggccu

SEQ ID NO: 1414521 - RNA, 23 nt, Pseudomonas aeruginosa PA01
cccuggcuuuccagggccuggcg

SEQ ID NO: 1414522 - RNA, 12 nt, Pseudomonas aeruginosa PA01
cccugggaaugg

SEQ ID NO: 1414523 - RNA, 16 nt, Pseudomonas aeruginosa PA01
cccugggagccgccgg

SEQ ID NO: 1414524 - RNA, 18 nt, Pseudomonas aeruginosa PA01
cccugggagccgccggac

SEQ ID NO: 1414525 - RNA, 23 nt, Pseudomonas aeruginosa PA01
cccuggcgcugucgcccgggcgc

SEQ ID NO: 1414526 - RNA, 17 nt, Pseudomonas aeruginosa PA01
cccuggcggauaucgcg

SEQ ID NO: 1414527 - RNA, 13 nt, Pseudomonas aeruginosa PA01
cccuggcggcgaa

SEQ ID NO: 1414528 - RNA, 20 nt, Pseudomonas aeruginosa PA01
cccuggcucuugccgcgagc

SEQ ID NO: 1414529 - RNA, 21 nt, Pseudomonas aeruginosa PA01
cccuggcgcaggcggcgcugu

SEQ ID NO: 1414530 - RNA, 14 nt, Pseudomonas aeruginosa PA01
cccuggccggccuc

SEQ ID NO: 1414531 - RNA, 18 nt, Pseudomonas aeruginosa PA01
cccuggccggccucggcg

SEQ ID NO: 1414532 - RNA, 15 nt, Pseudomonas aeruginosa PA01
cccuggccgcgcggc

SEQ ID NO: 1414533 - RNA, 17 nt, Pseudomonas aeruginosa PA01
cccuggccgcgcggcuu

SEQ ID NO: 1414534 - RNA, 15 nt, Pseudomonas aeruginosa PA01
cccuggccuuggcca

SEQ ID NO: 1414535 - RNA, 21 nt, Pseudomonas aeruginosa PA01
cccuggccuuggccacgaccc

SEQ ID NO: 1414536 - RNA, 15 nt, Pseudomonas aeruginosa PA01
cccuggccgucggcc

SEQ ID NO: 1414537 - RNA, 17 nt, Pseudomonas aeruginosa PA01
cccuggccgucggccug

SEQ ID NO: 1414538 - RNA, 22 nt, Pseudomonas aeruginosa PA01
cccuggccguugaccagcgcgu

SEQ ID NO: 1414539 - RNA, 13 nt, Pseudomonas aeruginosa PA01
ccgaagccgacgc

SEQ ID NO: 1414540 - RNA, 16 nt, Pseudomonas aeruginosa PA01
ccgaagccgacgccga

SEQ ID NO: 1414541 - RNA, 19 nt, Pseudomonas aeruginosa PA01
ccgaagccgacgccgagca

SEQ ID NO: 1414542 - RNA, 12 nt, Pseudomonas aeruginosa PA01
ccgaagccgccg

SEQ ID NO: 1414543 - RNA, 16 nt, Pseudomonas aeruginosa PA01
ccgaagccgcgcagca

SEQ ID NO: 1414544 - RNA, 13 nt, Pseudomonas aeruginosa PA01
ccgaauacccggu

SEQ ID NO: 1414545 - RNA, 17 nt, Pseudomonas aeruginosa PA01
ccgaaguucuucagcag

SEQ ID NO: 1414546 - RNA, 15 nt, Pseudomonas aeruginosa PA01
ccgaagccuucgucg

SEQ ID NO: 1414547 - RNA, 17 nt, Pseudomonas aeruginosa PA01
ccgaagccuucgucgau

SEQ ID NO: 1414548 - RNA, 20 nt, Pseudomonas aeruginosa PA01
ccgaaucccuuggcugcucg

SEQ ID NO: 1414549 - RNA, 13 nt, Pseudomonas aeruginosa PA01
ccgaauccgccgg

SEQ ID NO: 1414550 - RNA, 21 nt, Pseudomonas aeruginosa PA01
ccgaauacugcacgcccaggc

SEQ ID NO: 1414551 - RNA, 17 nt, Pseudomonas aeruginosa PA01
ccgaauccuccagccgg

SEQ ID NO: 1414552 - RNA, 18 nt, Pseudomonas aeruginosa PA01
ccgaauccuccagccggc

SEQ ID NO: 1414553 - RNA, 21 nt, Pseudomonas aeruginosa PA01
ccgaauccuccagccggcgac

SEQ ID NO: 1414554 - RNA, 12 nt, Pseudomonas aeruginosa PA01
ccgaaucgccua

SEQ ID NO: 1414555 - RNA, 15 nt, Pseudomonas aeruginosa PA01
ccgaauccaggccga

SEQ ID NO: 1414556 - RNA, 16 nt, Pseudomonas aeruginosa PA01
ccgaauccaggccgac

SEQ ID NO: 1414557 - RNA, 19 nt, Pseudomonas aeruginosa PA01
cccgauugggcgcguuuuu

SEQ ID NO: 1414558 - RNA, 14 nt, Pseudomonas aeruginosa PA01
cccgauuccgcgca

SEQ ID NO: 1414559 - RNA, 12 nt, Pseudomonas aeruginosa PA01
cccgcaaccgca

SEQ ID NO: 1414560 - RNA, 14 nt, Pseudomonas aeruginosa PA01
cccgcaaccgcaga

SEQ ID NO: 1414561 - RNA, 24 nt, Pseudomonas aeruginosa PA01
cccgcaaccgcagacuccggcgca

SEQ ID NO: 1414562 - RNA, 15 nt, Pseudomonas aeruginosa PA01
cccgcaaccgcugcc

SEQ ID NO: 1414563 - RNA, 20 nt, Pseudomonas aeruginosa PA01
cccgcaaccgcugccgccgu

SEQ ID NO: 1414564 - RNA, 17 nt, Pseudomonas aeruginosa PA01
cccgaugaucgagcgca

SEQ ID NO: 1414565 - RNA, 18 nt, Pseudomonas aeruginosa PA01
cccgagugccggcgcguc

SEQ ID NO: 1414566 - RNA, 18 nt, Pseudomonas aeruginosa PA01
cccgagugcgcccagcag

SEQ ID NO: 1414567 - RNA, 19 nt, Pseudomonas aeruginosa PA01
cccgagugcgcccagcagc

SEQ ID NO: 1414568 - RNA, 22 nt, Pseudomonas aeruginosa PA01
cccgagugcgcccagcagcagg

SEQ ID NO: 1414569 - RNA, 20 nt, Pseudomonas aeruginosa PA01
cccgagucccuugcggcaga

SEQ ID NO: 1414570 - RNA, 14 nt, Pseudomonas aeruginosa PA01
cccgccaggcgccg

SEQ ID NO: 1414571 - RNA, 15 nt, Pseudomonas aeruginosa PA01
cccgccaggcgccga

SEQ ID NO: 1414572 - RNA, 16 nt, Pseudomonas aeruginosa PA01
cccgccaggucgaggg

SEQ ID NO: 1414573 - RNA, 14 nt, Pseudomonas aeruginosa PA01
cccgccagguggcg

SEQ ID NO: 1414574 - RNA, 22 nt, Pseudomonas aeruginosa PA01
cccgccauguuggccuugagca

SEQ ID NO: 1414575 - RNA, 21 nt, Pseudomonas aeruginosa PA01
cccgccacggcgcgcuccggc

SEQ ID NO: 1414576 - RNA, 19 nt, Pseudomonas aeruginosa PA01
cccgccacagaucgccagc

SEQ ID NO: 1414577 - RNA, 20 nt, Pseudomonas aeruginosa PA01
cccgccacagaucgccagcu

SEQ ID NO: 1414578 - RNA, 20 nt, Pseudomonas aeruginosa PA01
cccgccacuuccagcacgcc

SEQ ID NO: 1414579 - RNA, 22 nt, Pseudomonas aeruginosa PA01
cccgccacuuccagcacgccga

SEQ ID NO: 1414580 - RNA, 22 nt, Pseudomonas aeruginosa PA01
cccgccaggagccuacggagga

SEQ ID NO: 1414581 - RNA, 19 nt, Pseudomonas aeruginosa PA01
cccgccagcaggcgccggc

SEQ ID NO: 1414582 - RNA, 17 nt, Pseudomonas aeruginosa PA01
cccgcauugcggggcgu

SEQ ID NO: 1414583 - RNA, 17 nt, Pseudomonas aeruginosa PA01
cccgccaacguccucga

SEQ ID NO: 1414584 - RNA, 19 nt, Pseudomonas aeruginosa PA01
cccgccaaggcccugcugc

SEQ ID NO: 1414585 - RNA, 14 nt, Pseudomonas aeruginosa PA01
cccgccaaggcggg

SEQ ID NO: 1414586 - RNA, 17 nt, Pseudomonas aeruginosa PA01
cccgcagggcucgugcc

SEQ ID NO: 1414587 - RNA, 18 nt, Pseudomonas aeruginosa PA01
cccgcaaggugcgggccg

SEQ ID NO: 1414588 - RNA, 19 nt, Pseudomonas aeruginosa PA01
cccgcaucgaggccgccca

SEQ ID NO: 1414589 - RNA, 21 nt, Pseudomonas aeruginosa PA01
cccgcaucgaggccgcccagc

SEQ ID NO: 1414590 - RNA, 16 nt, Pseudomonas aeruginosa PA01
cccgcaguuccucgcc

SEQ ID NO: 1414591 - RNA, 16 nt, Pseudomonas aeruginosa PA01
cccgcaguacuucgag

SEQ ID NO: 1414592 - RNA, 19 nt, Pseudomonas aeruginosa PA01
cccgcaguagcucgccgag

SEQ ID NO: 1414593 - RNA, 21 nt, Pseudomonas aeruginosa PA01
cccgcgguauucuccagcagg

SEQ ID NO: 1414594 - RNA, 19 nt, Pseudomonas aeruginosa PA01
cccgcggucacucggccuc

SEQ ID NO: 1414595 - RNA, 14 nt, Pseudomonas aeruginosa PA01
cccgcgucgcgcgc

SEQ ID NO: 1414596 - RNA, 18 nt, Pseudomonas aeruginosa PA01
cccgcgucgcgcgcggca

SEQ ID NO: 1414597 - RNA, 11 nt, Pseudomonas aeruginosa PA01
cccgcucgccg

SEQ ID NO: 1414598 - RNA, 13 nt, Pseudomonas aeruginosa PA01
cccgcucggccuu

SEQ ID NO: 1414599 - RNA, 22 nt, Pseudomonas aeruginosa PA01
cccgcucggccuuagcgguugc

SEQ ID NO: 1414600 - RNA, 19 nt, Pseudomonas aeruginosa PA01
cccgcguccuccuggagga

SEQ ID NO: 1414601 - RNA, 15 nt, Pseudomonas aeruginosa PA01
cccgcuugcgccgcc

SEQ ID NO: 1414602 - RNA, 16 nt, Pseudomonas aeruginosa PA01
cccgcuugcgccgccu

SEQ ID NO: 1414603 - RNA, 23 nt, Pseudomonas aeruginosa PA01
cccgcuugcgccgccucgcgcaa

SEQ ID NO: 1414604 - RNA, 15 nt, Pseudomonas aeruginosa PA01
cccgcuucgagcggg

SEQ ID NO: 1414605 - RNA, 12 nt, Pseudomonas aeruginosa PA01
cccgcccgccgu

SEQ ID NO: 1414606 - RNA, 14 nt, Pseudomonas aeruginosa PA01
cccgcccgccgucc

SEQ ID NO: 1414607 - RNA, 21 nt, Pseudomonas aeruginosa PA01
cccgccccgaaaaaaaaggcc

SEQ ID NO: 1414608 - RNA, 13 nt, Pseudomonas aeruginosa PA01
cccgccccgcaag

SEQ ID NO: 1414609 - RNA, 13 nt, Pseudomonas aeruginosa PA01
cccgccggcgcgc

SEQ ID NO: 1414610 - RNA, 16 nt, Pseudomonas aeruginosa PA01
cccgccggcgcgccca

SEQ ID NO: 1414611 - RNA, 22 nt, Pseudomonas aeruginosa PA01
cccgcgaaccucgguagccggc

SEQ ID NO: 1414612 - RNA, 16 nt, Pseudomonas aeruginosa PA01
cccgccggucaaccgc

SEQ ID NO: 1414613 - RNA, 13 nt, Pseudomonas aeruginosa PA01
cccgcgaggccgg

SEQ ID NO: 1414614 - RNA, 17 nt, Pseudomonas aeruginosa PA01
cccgcgauucgccgggc

SEQ ID NO: 1414615 - RNA, 18 nt, Pseudomonas aeruginosa PA01
cccgcgauugcagcuccu

SEQ ID NO: 1414616 - RNA, 14 nt, Pseudomonas aeruginosa PA01
cccgcgcgggccga

SEQ ID NO: 1414617 - RNA, 13 nt, Pseudomonas aeruginosa PA01
cccgcgcgccgag

SEQ ID NO: 1414618 - RNA, 14 nt, Pseudomonas aeruginosa PA01
cccgcgcgccgagc

SEQ ID NO: 1414619 - RNA, 13 nt, Pseudomonas aeruginosa PA01
cccgcgcggcaac

SEQ ID NO: 1414620 - RNA, 20 nt, Pseudomonas aeruginosa PA01
cccgcgcggcaacgucaggc

SEQ ID NO: 1414621 - RNA, 17 nt, Pseudomonas aeruginosa PA01
ccccuggaaugccggcc

SEQ ID NO: 1414622 - RNA, 13 nt, Pseudomonas aeruginosa PA01
ccccuuggccagc

SEQ ID NO: 1414623 - RNA, 14 nt, Pseudomonas aeruginosa PA01
ccccuuugccgagc

SEQ ID NO: 1414624 - RNA, 21 nt, Pseudomonas aeruginosa PA01
ccccuuuuucaugcgcgggcc

SEQ ID NO: 1414625 - RNA, 19 nt, Pseudomonas aeruginosa PA01
ccccuuuuucggcgcggac

SEQ ID NO: 1414626 - RNA, 18 nt, Pseudomonas aeruginosa PA01
ccccuuuuuuugcgcgcc

SEQ ID NO: 1414627 - RNA, 19 nt, Pseudomonas aeruginosa PA01
ccccuuuuuuugcgcgcca

SEQ ID NO: 1414628 - RNA, 18 nt, Pseudomonas aeruginosa PA01
ccccuugauauguucgaa

SEQ ID NO: 1414629 - RNA, 21 nt, Pseudomonas aeruginosa PA01
ccccuguggucaggcgccagg

SEQ ID NO: 1414630 - RNA, 14 nt, Pseudomonas aeruginosa PA01
ccccugcggcgccg

SEQ ID NO: 1414631 - RNA, 20 nt, Pseudomonas aeruginosa PA01
ccccugccguauccgcggca

SEQ ID NO: 1414632 - RNA, 14 nt, Pseudomonas aeruginosa PA01
ccccuggcgcucga

SEQ ID NO: 1414633 - RNA, 14 nt, Pseudomonas aeruginosa PA01
ccccuggcgcuggg

SEQ ID NO: 1414634 - RNA, 19 nt, Pseudomonas aeruginosa PA01
ccccucuucggagcgaggc

SEQ ID NO: 1414635 - RNA, 15 nt, Pseudomonas aeruginosa PA01
ccccguggcgggcca

SEQ ID NO: 1414636 - RNA, 17 nt, Pseudomonas aeruginosa PA01
ccccucucaacaccccg

SEQ ID NO: 1414637 - RNA, 13 nt, Pseudomonas aeruginosa PA01
ccccucguggcgc

SEQ ID NO: 1414638 - RNA, 19 nt, Pseudomonas aeruginosa PA01
ccccguuugccgucggcgc

SEQ ID NO: 1414639 - RNA, 18 nt, Pseudomonas aeruginosa PA01
ccccucccagccacagag

SEQ ID NO: 1414640 - RNA, 15 nt, Pseudomonas aeruginosa PA01
ccccucacggcgcga

SEQ ID NO: 1414641 - RNA, 13 nt, Pseudomonas aeruginosa PA01
ccccucaggcgcc

SEQ ID NO: 1414642 - RNA, 15 nt, Pseudomonas aeruginosa PA01
ccccggucaggccga

SEQ ID NO: 1414643 - RNA, 22 nt, Pseudomonas aeruginosa PA01
ccccgggucgcugcucagggcc

SEQ ID NO: 1414644 - RNA, 15 nt, Pseudomonas aeruginosa PA01
cccauggcgccacgc

SEQ ID NO: 1414645 - RNA, 13 nt, Pseudomonas aeruginosa PA01
ccccggcuuggcg

SEQ ID NO: 1414646 - RNA, 19 nt, Pseudomonas aeruginosa PA01
ccccgggaugcccggccgc

SEQ ID NO: 1414647 - RNA, 14 nt, Pseudomonas aeruginosa PA01
ccccggucucgcgc

SEQ ID NO: 1414648 - RNA, 18 nt, Pseudomonas aeruginosa PA01
ccccggucucgcgcagcg

SEQ ID NO: 1414649 - RNA, 24 nt, Pseudomonas aeruginosa PA01
ccccgguccggugaaccugaccau

SEQ ID NO: 1414650 - RNA, 16 nt, Pseudomonas aeruginosa PA01
ccccguauccuccgcg

SEQ ID NO: 1414651 - RNA, 17 nt, Pseudomonas aeruginosa PA01
ccccguauccuccgcga

SEQ ID NO: 1414652 - RNA, 23 nt, Pseudomonas aeruginosa PA01
ccccguagccaugcccggcuggc

SEQ ID NO: 1414653 - RNA, 13 nt, Pseudomonas aeruginosa PA01
ccccguccuggcg

SEQ ID NO: 1414654 - RNA, 19 nt, Pseudomonas aeruginosa PA01
ccccgucgacgcaucgacg

SEQ ID NO: 1414655 - RNA, 22 nt, Pseudomonas aeruginosa PA01
ccccgucgacgcccugggcgac

SEQ ID NO: 1414656 - RNA, 23 nt, Pseudomonas aeruginosa PA01
cccauuacguuguaguucggcau

SEQ ID NO: 1414657 - RNA, 14 nt, Pseudomonas aeruginosa PA01
cccauucgaugccg

SEQ ID NO: 1414658 - RNA, 15 nt, Pseudomonas aeruginosa PA01
cccauucgaugccgc

SEQ ID NO: 1414659 - RNA, 20 nt, Pseudomonas aeruginosa PA01
cccauucgaugccgcgcgcc

SEQ ID NO: 1414660 - RNA, 22 nt, Pseudomonas aeruginosa PA01
cccaugugcuugaccgccgccu

SEQ ID NO: 1414661 - RNA, 19 nt, Pseudomonas aeruginosa PA01
cccaugauggucggcacga

SEQ ID NO: 1414662 - RNA, 20 nt, Pseudomonas aeruginosa PA01
cccaugcccgccccgcacca

SEQ ID NO: 1414663 - RNA, 18 nt, Pseudomonas aeruginosa PA01
cccaugcccggccuggcg

SEQ ID NO: 1414664 - RNA, 13 nt, Pseudomonas aeruginosa PA01
cccaugcgcggcg

SEQ ID NO: 1414665 - RNA, 15 nt, Pseudomonas aeruginosa PA01
cccgacaggcagcgc

SEQ ID NO: 1414666 - RNA, 19 nt, Pseudomonas aeruginosa PA01
cccgacaggcagcgccgcc

SEQ ID NO: 1414667 - RNA, 20 nt, Pseudomonas aeruginosa PA01
cccgacaggcagcgccgccc

SEQ ID NO: 1414668 - RNA, 16 nt, Pseudomonas aeruginosa PA01
cccgaccccacgccgg

SEQ ID NO: 1414669 - RNA, 21 nt, Pseudomonas aeruginosa PA01
cccgaccaggucgcuggcacc

SEQ ID NO: 1414670 - RNA, 12 nt, Pseudomonas aeruginosa PA01
cccgaccagcgc

SEQ ID NO: 1414671 - RNA, 14 nt, Pseudomonas aeruginosa PA01
cccgaccagcgcgc

SEQ ID NO: 1414672 - RNA, 22 nt, Pseudomonas aeruginosa PA01
cccgaccagcgcgcucuucgcc

SEQ ID NO: 1414673 - RNA, 12 nt, Pseudomonas aeruginosa PA01
cccgaacgccga

SEQ ID NO: 1414674 - RNA, 14 nt, Pseudomonas aeruginosa PA01
cccgaacgccgacc

SEQ ID NO: 1414675 - RNA, 15 nt, Pseudomonas aeruginosa PA01
cccgaaguagcgacg

SEQ ID NO: 1414676 - RNA, 19 nt, Pseudomonas aeruginosa PA01
cccgaaguagcgacggaag

SEQ ID NO: 1414677 - RNA, 22 nt, Pseudomonas aeruginosa PA01
cccgaauagaucugcaccaggc

SEQ ID NO: 1414678 - RNA, 20 nt, Pseudomonas aeruginosa PA01
cccgaaucccuuggcugcuc

SEQ ID NO: 1414679 - RNA, 12 nt, Pseudomonas aeruginosa PA01
cccgagccgcug

SEQ ID NO: 1414680 - RNA, 22 nt, Pseudomonas aeruginosa PA01
cccgagacuugaucgcacggcg

SEQ ID NO: 1414681 - RNA, 19 nt, Pseudomonas aeruginosa PA01
cccgagcggcgcgaagucg

SEQ ID NO: 1414682 - RNA, 13 nt, Pseudomonas aeruginosa PA01
cccgagcaggcug

SEQ ID NO: 1414683 - RNA, 20 nt, Pseudomonas aeruginosa PA01
cccgagcuuugcgcagccac

SEQ ID NO: 1414684 - RNA, 16 nt, Pseudomonas aeruginosa PA01
cccgaggugucgccgc

SEQ ID NO: 1414685 - RNA, 15 nt, Pseudomonas aeruginosa PA01
cccgagggcggcagg

SEQ ID NO: 1414686 - RNA, 23 nt, Pseudomonas aeruginosa PA01
cccgagggucgccuugaccagcg

SEQ ID NO: 1414687 - RNA, 21 nt, Pseudomonas aeruginosa PA01
cccgaggcguuauccgccgau

SEQ ID NO: 1414688 - RNA, 15 nt, Pseudomonas aeruginosa PA01
cccgaggcgacgccc

SEQ ID NO: 1414689 - RNA, 22 nt, Pseudomonas aeruginosa PA01
cccgaggcgacgcccuguucgg

SEQ ID NO: 1414690 - RNA, 14 nt, Pseudomonas aeruginosa PA01
cccgaggcgaucgc

SEQ ID NO: 1414691 - RNA, 21 nt, Pseudomonas aeruginosa PA01
cccgaggcgaucgccgcggcg

SEQ ID NO: 1414692 - RNA, 23 nt, Pseudomonas aeruginosa PA01
cccgaggcgaucgccgcggcgaa

SEQ ID NO: 1414693 - RNA, 22 nt, Pseudomonas aeruginosa PA01
cccgacugucgugccuccagcc

SEQ ID NO: 1414694 - RNA, 22 nt, Pseudomonas aeruginosa PA01
cccgacggguuugugccguucc

SEQ ID NO: 1414695 - RNA, 13 nt, Pseudomonas aeruginosa PA01
cccgacgccgccc

SEQ ID NO: 1414696 - RNA, 16 nt, Pseudomonas aeruginosa PA01
cccgacgcccuccagc

SEQ ID NO: 1414697 - RNA, 22 nt, Pseudomonas aeruginosa PA01
cccgacgcccuccagcaccgcc

SEQ ID NO: 1414698 - RNA, 19 nt, Pseudomonas aeruginosa PA01
cccagaagccgaccuugcg

SEQ ID NO: 1414699 - RNA, 16 nt, Pseudomonas aeruginosa PA01
cccagaaaccgaucag

SEQ ID NO: 1414700 - RNA, 15 nt, Pseudomonas aeruginosa PA01
cccaccaccaucgcc

SEQ ID NO: 1414701 - RNA, 18 nt, Pseudomonas aeruginosa PA01
cccaccaccaucgccgcg

SEQ ID NO: 1414702 - RNA, 22 nt, Pseudomonas aeruginosa PA01
cccaccaccaucgccgcggaaa

SEQ ID NO: 1414703 - RNA, 14 nt, Pseudomonas aeruginosa PA01
cccacaggcccugc

SEQ ID NO: 1414704 - RNA, 13 nt, Pseudomonas aeruginosa PA01
cccacaggccggc

SEQ ID NO: 1414705 - RNA, 13 nt, Pseudomonas aeruginosa PA01
cccagcccggcca

SEQ ID NO: 1414706 - RNA, 13 nt, Pseudomonas aeruginosa PA01
cccagcccgccuu

SEQ ID NO: 1414707 - RNA, 17 nt, Pseudomonas aeruginosa PA01
cccagccgacgcgcagc

SEQ ID NO: 1414708 - RNA, 14 nt, Pseudomonas aeruginosa PA01
cccagcgacuccgc

SEQ ID NO: 1414709 - RNA, 18 nt, Pseudomonas aeruginosa PA01
cccagcgacuccgccagu

SEQ ID NO: 1414710 - RNA, 21 nt, Pseudomonas aeruginosa PA01
cccagcgagccgaucaccagc

SEQ ID NO: 1414711 - RNA, 14 nt, Pseudomonas aeruginosa PA01
cccagccgcacgcc

SEQ ID NO: 1414712 - RNA, 18 nt, Pseudomonas aeruginosa PA01
cccagcgaagcuucuucg

SEQ ID NO: 1414713 - RNA, 16 nt, Pseudomonas aeruginosa PA01
cccagccagggccgcg

SEQ ID NO: 1414714 - RNA, 18 nt, Pseudomonas aeruginosa PA01
cccagcaucgccggcagc

SEQ ID NO: 1414715 - RNA, 22 nt, Pseudomonas aeruginosa PA01
cccagcaucgccggcagcgccg

SEQ ID NO: 1414716 - RNA, 18 nt, Pseudomonas aeruginosa PA01
cccagaccagcagcggca

SEQ ID NO: 1414717 - RNA, 20 nt, Pseudomonas aeruginosa PA01
cccagaccagcagcggcagc

SEQ ID NO: 1414718 - RNA, 18 nt, Pseudomonas aeruginosa PA01
cccagcaggccagccaac

SEQ ID NO: 1414719 - RNA, 13 nt, Pseudomonas aeruginosa PA01
cccagcaggcugc

SEQ ID NO: 1414720 - RNA, 21 nt, Pseudomonas aeruginosa PA01
cccaugaaaaaggcgcccgcg

SEQ ID NO: 1414721 - RNA, 18 nt, Pseudomonas aeruginosa PA01
cccaucgccuccacggcg

SEQ ID NO: 1414722 - RNA, 19 nt, Pseudomonas aeruginosa PA01
cccagguaagcggcguuuc

SEQ ID NO: 1414723 - RNA, 16 nt, Pseudomonas aeruginosa PA01
cccagguagccggcga

SEQ ID NO: 1414724 - RNA, 18 nt, Pseudomonas aeruginosa PA01
cccagguagucgcccagc

SEQ ID NO: 1414725 - RNA, 21 nt, Pseudomonas aeruginosa PA01
cccaggguuggcggcaucgcg

SEQ ID NO: 1414726 - RNA, 14 nt, Pseudomonas aeruginosa PA01
cccaggggcacguc

SEQ ID NO: 1414727 - RNA, 16 nt, Pseudomonas aeruginosa PA01
cccaggugcgcaggcg

SEQ ID NO: 1414728 - RNA, 17 nt, Pseudomonas aeruginosa PA01
cccagguggucgaccag

SEQ ID NO: 1414729 - RNA, 16 nt, Pseudomonas aeruginosa PA01
cccaguugcgcggcga

SEQ ID NO: 1414730 - RNA, 14 nt, Pseudomonas aeruginosa PA01
cccaguucgccggc

SEQ ID NO: 1414731 - RNA, 19 nt, Pseudomonas aeruginosa PA01
cccaguucgcugccgccgc

SEQ ID NO: 1414732 - RNA, 21 nt, Pseudomonas aeruginosa PA01
cccaguucgcugccgccgcgc

SEQ ID NO: 1414733 - RNA, 12 nt, Pseudomonas aeruginosa PA01
cccagcgccgcc

SEQ ID NO: 1414734 - RNA, 15 nt, Pseudomonas aeruginosa PA01
cccagcgccgccagc

SEQ ID NO: 1414735 - RNA, 17 nt, Pseudomonas aeruginosa PA01
cccagcgccccgccuac

SEQ ID NO: 1414736 - RNA, 17 nt, Pseudomonas aeruginosa PA01
cccagcgcaucgcgcac

SEQ ID NO: 1414737 - RNA, 17 nt, Pseudomonas aeruginosa PA01
cccaggaaaacaucacg

SEQ ID NO: 1414738 - RNA, 15 nt, Pseudomonas aeruginosa PA01
cccagcuugcuggcg

SEQ ID NO: 1414739 - RNA, 21 nt, Pseudomonas aeruginosa PA01
cccagcuugcuggcguagaag

SEQ ID NO: 1414740 - RNA, 13 nt, Pseudomonas aeruginosa PA01
cccaggcgcggcg

SEQ ID NO: 1414741 - RNA, 19 nt, Pseudomonas aeruginosa PA01
cccaggcgcggcgucgggc

SEQ ID NO: 1414742 - RNA, 15 nt, Pseudomonas aeruginosa PA01
cccaggcgcucggcg

SEQ ID NO: 1414743 - RNA, 23 nt, Pseudomonas aeruginosa PA01
cccaggcgcucggcgaccuugcg

SEQ ID NO: 1414744 - RNA, 19 nt, Pseudomonas aeruginosa PA01
cccaggcgcucggcggcgc

SEQ ID NO: 1414745 - RNA, 18 nt, Pseudomonas aeruginosa PA01
cccaggcgucgccgacuu

SEQ ID NO: 1414746 - RNA, 14 nt, Pseudomonas aeruginosa PA01
cccaggcgucgcgc

SEQ ID NO: 1414747 - RNA, 19 nt, Pseudomonas aeruginosa PA01
cccaggcgucgcgccagca

SEQ ID NO: 1414748 - RNA, 22 nt, Pseudomonas aeruginosa PA01
cccaggcgucgcgccagcaccg

SEQ ID NO: 1414749 - RNA, 23 nt, Pseudomonas aeruginosa PA01
cccaggcgucgcgccagcaccgu

SEQ ID NO: 1414750 - RNA, 15 nt, Pseudomonas aeruginosa PA01
cccaggcuucggcgc

SEQ ID NO: 1414751 - RNA, 14 nt, Pseudomonas aeruginosa PA01
cccagggacgcgcc

SEQ ID NO: 1414752 - RNA, 20 nt, Pseudomonas aeruginosa PA01
cccagggcaguacguggcgc

SEQ ID NO: 1414753 - RNA, 17 nt, Pseudomonas aeruginosa PA01
cccagggccagcagcgg

SEQ ID NO: 1414754 - RNA, 18 nt, Pseudomonas aeruginosa PA01
cccagggccagcagcggc

SEQ ID NO: 1414755 - RNA, 19 nt, Pseudomonas aeruginosa PA01
cccaggacaacgacagccc

SEQ ID NO: 1414756 - RNA, 19 nt, Pseudomonas aeruginosa PA01
cccaggccgcuggcggcga

SEQ ID NO: 1414757 - RNA, 17 nt, Pseudomonas aeruginosa PA01
cccaggccgucgagggc

SEQ ID NO: 1414758 - RNA, 14 nt, Pseudomonas aeruginosa PA01
cccaggcgauccac

SEQ ID NO: 1414759 - RNA, 18 nt, Pseudomonas aeruginosa PA01
cccaggcgauccacagca

SEQ ID NO: 1414760 - RNA, 20 nt, Pseudomonas aeruginosa PA01
cccaggcgauccacagcagg

SEQ ID NO: 1414761 - RNA, 14 nt, Pseudomonas aeruginosa PA01
cccaggcgacgcug

SEQ ID NO: 1414762 - RNA, 18 nt, Pseudomonas aeruginosa PA01
ccaucggguugaucgacg

SEQ ID NO: 1414763 - RNA, 15 nt, Pseudomonas aeruginosa PA01
ccaucggucgcgccc

SEQ ID NO: 1414764 - RNA, 15 nt, Pseudomonas aeruginosa PA01
ccaucagcgccgccu

SEQ ID NO: 1414765 - RNA, 17 nt, Pseudomonas aeruginosa PA01
ccaucgcuuucaggcgc

SEQ ID NO: 1414766 - RNA, 21 nt, Pseudomonas aeruginosa PA01
ccaucgcuuuccuggccgacc

SEQ ID NO: 1414767 - RNA, 12 nt, Pseudomonas aeruginosa PA01
ccaucggcccca

SEQ ID NO: 1414768 - RNA, 16 nt, Pseudomonas aeruginosa PA01
ccaucggccccaccgc

SEQ ID NO: 1414769 - RNA, 14 nt, Pseudomonas aeruginosa PA01
ccaucggcggcggc

SEQ ID NO: 1414770 - RNA, 12 nt, Pseudomonas aeruginosa PA01
ccaucaccgcgu

SEQ ID NO: 1414771 - RNA, 13 nt, Pseudomonas aeruginosa PA01
ccaucaccagcgc

SEQ ID NO: 1414772 - RNA, 16 nt, Pseudomonas aeruginosa PA01
ccaucaccagcgccgu

SEQ ID NO: 1414773 - RNA, 18 nt, Pseudomonas aeruginosa PA01
ccaucaccgccaucagca

SEQ ID NO: 1414774 - RNA, 14 nt, Pseudomonas aeruginosa PA01
ccaucagccgcgcg

SEQ ID NO: 1414775 - RNA, 14 nt, Pseudomonas aeruginosa PA01
ccaucagcgaccag

SEQ ID NO: 1414776 - RNA, 11 nt, Pseudomonas aeruginosa PA01
ccaucagcgcc

SEQ ID NO: 1414777 - RNA, 17 nt, Pseudomonas aeruginosa PA01
ccaucagcgccagggca

SEQ ID NO: 1414778 - RNA, 15 nt, Pseudomonas aeruginosa PA01
ccaucagcaguccgc

SEQ ID NO: 1414779 - RNA, 22 nt, Pseudomonas aeruginosa PA01
ccaucagcaccaggaagcccca

SEQ ID NO: 1414780 - RNA, 14 nt, Pseudomonas aeruginosa PA01
ccaucagccagccc

SEQ ID NO: 1414781 - RNA, 16 nt, Pseudomonas aeruginosa PA01
ccaucagccagcccag

SEQ ID NO: 1414782 - RNA, 19 nt, Pseudomonas aeruginosa PA01
ccaucagcacgucguccag

SEQ ID NO: 1414783 - RNA, 22 nt, Pseudomonas aeruginosa PA01
ccaucagcacgucguccagcgc

SEQ ID NO: 1414784 - RNA, 23 nt, Pseudomonas aeruginosa PA01
ccaucagcacgucguccagcgcc

SEQ ID NO: 1414785 - RNA, 13 nt, Pseudomonas aeruginosa PA01
ccauggcgcgaug

SEQ ID NO: 1414786 - RNA, 17 nt, Pseudomonas aeruginosa PA01
ccaugcggcuacucgcc

SEQ ID NO: 1414787 - RNA, 20 nt, Pseudomonas aeruginosa PA01
ccauggcgcuucaucuccug

SEQ ID NO: 1414788 - RNA, 15 nt, Pseudomonas aeruginosa PA01
ccauggcggaucugg

SEQ ID NO: 1414789 - RNA, 22 nt, Pseudomonas aeruginosa PA01
ccauggcggugagcugaucgcg

SEQ ID NO: 1414790 - RNA, 17 nt, Pseudomonas aeruginosa PA01
ccauggcguagggcgaa

SEQ ID NO: 1414791 - RNA, 16 nt, Pseudomonas aeruginosa PA01
ccauggggaucaccgg

SEQ ID NO: 1414792 - RNA, 16 nt, Pseudomonas aeruginosa PA01
ccaugcgguucggcgu

SEQ ID NO: 1414793 - RNA, 14 nt, Pseudomonas aeruginosa PA01
ccaugcggcaggcc

SEQ ID NO: 1414794 - RNA, 17 nt, Pseudomonas aeruginosa PA01
ccaucguucaguugccu

SEQ ID NO: 1414795 - RNA, 21 nt, Pseudomonas aeruginosa PA01
ccaugccguucaggccggcgc

SEQ ID NO: 1414796 - RNA, 22 nt, Pseudomonas aeruginosa PA01
ccaugccguacaggucggcgcc

SEQ ID NO: 1414797 - RNA, 17 nt, Pseudomonas aeruginosa PA01
ccaugccuuccaccggc

SEQ ID NO: 1414798 - RNA, 18 nt, Pseudomonas aeruginosa PA01
ccaugcgaaaacggcgac

SEQ ID NO: 1414799 - RNA, 22 nt, Pseudomonas aeruginosa PA01
ccaugcgaaaacggcgacccug

SEQ ID NO: 1414800 - RNA, 15 nt, Pseudomonas aeruginosa PA01
ccaucucgccgcgca

SEQ ID NO: 1414801 - RNA, 13 nt, Pseudomonas aeruginosa PA01
ccaucugccggcc

SEQ ID NO: 1414802 - RNA, 14 nt, Pseudomonas aeruginosa PA01
ccaucugccggcca

SEQ ID NO: 1414803 - RNA, 16 nt, Pseudomonas aeruginosa PA01
cccaauccgcgccggu

SEQ ID NO: 1414804 - RNA, 20 nt, Pseudomonas aeruginosa PA01
cccaauugccguagggcgaa

SEQ ID NO: 1414805 - RNA, 22 nt, Pseudomonas aeruginosa PA01
cccaagggccugggcgccgcca

SEQ ID NO: 1414806 - RNA, 14 nt, Pseudomonas aeruginosa PA01
cccaacccggccag

SEQ ID NO: 1414807 - RNA, 23 nt, Pseudomonas aeruginosa PA01
cccaauacggcggggucgggcag

SEQ ID NO: 1414808 - RNA, 22 nt, Pseudomonas aeruginosa PA01
cccaacuggcggaugcguugcu

SEQ ID NO: 1414809 - RNA, 12 nt, Pseudomonas aeruginosa PA01
cccaacuggucu

SEQ ID NO: 1414810 - RNA, 17 nt, Pseudomonas aeruginosa PA01
ccauuguuggcgcucgg

SEQ ID NO: 1414811 - RNA, 14 nt, Pseudomonas aeruginosa PA01
cccaaaauccgcau

SEQ ID NO: 1414812 - RNA, 16 nt, Pseudomonas aeruginosa PA01
ccaugguuuccgccgg

SEQ ID NO: 1414813 - RNA, 22 nt, Pseudomonas aeruginosa PA01
ccauggguaucguugaucggcu

SEQ ID NO: 1414814 - RNA, 18 nt, Pseudomonas aeruginosa PA01
ccauggucguucagcggc

SEQ ID NO: 1414815 - RNA, 16 nt, Pseudomonas aeruginosa PA01
ccaggguggggaugcg

SEQ ID NO: 1414816 - RNA, 20 nt, Pseudomonas aeruginosa PA01
ccaggguggggaugcgcgag

SEQ ID NO: 1414817 - RNA, 18 nt, Pseudomonas aeruginosa PA01
ccagggcaacgccaggcu

SEQ ID NO: 1414818 - RNA, 15 nt, Pseudomonas aeruginosa PA01
ccagggacgcccgga

SEQ ID NO: 1414819 - RNA, 20 nt, Pseudomonas aeruginosa PA01
ccagggacgcccggagcgcg

SEQ ID NO: 1414820 - RNA, 16 nt, Pseudomonas aeruginosa PA01
ccagggacgcgcagcg

SEQ ID NO: 1414821 - RNA, 17 nt, Pseudomonas aeruginosa PA01
ccaggcuuugcggcaag

SEQ ID NO: 1414822 - RNA, 19 nt, Pseudomonas aeruginosa PA01
ccagggaaucgucacggcg

SEQ ID NO: 1414823 - RNA, 14 nt, Pseudomonas aeruginosa PA01
ccagggagaacagc

SEQ ID NO: 1414824 - RNA, 15 nt, Pseudomonas aeruginosa PA01
ccagggagaacagca

SEQ ID NO: 1414825 - RNA, 17 nt, Pseudomonas aeruginosa PA01
ccagggagaacagcagg

SEQ ID NO: 1414826 - RNA, 18 nt, Pseudomonas aeruginosa PA01
ccagggagaacagcaggg

SEQ ID NO: 1414827 - RNA, 20 nt, Pseudomonas aeruginosa PA01
ccagggagcgcucgcgcagc

SEQ ID NO: 1414828 - RNA, 18 nt, Pseudomonas aeruginosa PA01
ccagggaggcgcuggcca

SEQ ID NO: 1414829 - RNA, 22 nt, Pseudomonas aeruginosa PA01
ccagggaggcgcuggccagcgc

SEQ ID NO: 1414830 - RNA, 15 nt, Pseudomonas aeruginosa PA01
ccagggagucgcugg

SEQ ID NO: 1414831 - RNA, 14 nt, Pseudomonas aeruginosa PA01
ccaggcuggccagu

SEQ ID NO: 1414832 - RNA, 20 nt, Pseudomonas aeruginosa PA01
ccaggcuggcggccagggca

SEQ ID NO: 1414833 - RNA, 18 nt, Pseudomonas aeruginosa PA01
ccaggcugccgccgccgu

SEQ ID NO: 1414834 - RNA, 15 nt, Pseudomonas aeruginosa PA01
ccaggcugccgccgu

SEQ ID NO: 1414835 - RNA, 23 nt, Pseudomonas aeruginosa PA01
ccaggcugccgccuucgcgggcc

SEQ ID NO: 1414836 - RNA, 15 nt, Pseudomonas aeruginosa PA01
ccaggcugccggcca

SEQ ID NO: 1414837 - RNA, 17 nt, Pseudomonas aeruginosa PA01
ccaggcugccggccagg

SEQ ID NO: 1414838 - RNA, 16 nt, Pseudomonas aeruginosa PA01
ccaggcugucagggcg

SEQ ID NO: 1414839 - RNA, 22 nt, Pseudomonas aeruginosa PA01
ccaggcuuuccaccgccagcac

SEQ ID NO: 1414840 - RNA, 18 nt, Pseudomonas aeruginosa PA01
ccaggcuuuccgccgagc

SEQ ID NO: 1414841 - RNA, 13 nt, Pseudomonas aeruginosa PA01
ccaggucgaucag

SEQ ID NO: 1414842 - RNA, 23 nt, Pseudomonas aeruginosa PA01
ccaggucgauccccaacccggcc

SEQ ID NO: 1414843 - RNA, 19 nt, Pseudomonas aeruginosa PA01
ccagguacuuggccacgcc

SEQ ID NO: 1414844 - RNA, 17 nt, Pseudomonas aeruginosa PA01
ccaggucgccaugcccg

SEQ ID NO: 1414845 - RNA, 15 nt, Pseudomonas aeruginosa PA01
ccaggucgcgcaggg

SEQ ID NO: 1414846 - RNA, 22 nt, Pseudomonas aeruginosa PA01
ccaggucgcgcagggccagggc

SEQ ID NO: 1414847 - RNA, 22 nt, Pseudomonas aeruginosa PA01
ccagguacuggcgauggaugac

SEQ ID NO: 1414848 - RNA, 14 nt, Pseudomonas aeruginosa PA01
ccagguacggcccg

SEQ ID NO: 1414849 - RNA, 17 nt, Pseudomonas aeruginosa PA01
ccagguacggcccgcgg

SEQ ID NO: 1414850 - RNA, 23 nt, Pseudomonas aeruginosa PA01
ccagguacggcccgcggaucgcg

SEQ ID NO: 1414851 - RNA, 16 nt, Pseudomonas aeruginosa PA01
ccagguacagccgcag

SEQ ID NO: 1414852 - RNA, 18 nt, Pseudomonas aeruginosa PA01
ccaggguuggcggcaucg

SEQ ID NO: 1414853 - RNA, 19 nt, Pseudomonas aeruginosa PA01
ccagguaaaggccaccaga

SEQ ID NO: 1414854 - RNA, 14 nt, Pseudomonas aeruginosa PA01
ccagguggcaggcc

SEQ ID NO: 1414855 - RNA, 22 nt, Pseudomonas aeruginosa PA01
ccagguggcaggccuggaauac

SEQ ID NO: 1414856 - RNA, 23 nt, Pseudomonas aeruginosa PA01
ccagguguucggccccggccagg

SEQ ID NO: 1414857 - RNA, 19 nt, Pseudomonas aeruginosa PA01
ccagguucggcgccagcuc

SEQ ID NO: 1414858 - RNA, 15 nt, Pseudomonas aeruginosa PA01
ccaggucgcggguga

SEQ ID NO: 1414859 - RNA, 20 nt, Pseudomonas aeruginosa PA01
ccaggucgaacagcggcugg

SEQ ID NO: 1414860 - RNA, 13 nt, Pseudomonas aeruginosa PA01
ccaggucgccgca

SEQ ID NO: 1414861 - RNA, 17 nt, Pseudomonas aeruginosa PA01
ccaggucgcggagccaa

SEQ ID NO: 1414862 - RNA, 15 nt, Pseudomonas aeruginosa PA01
ccaggucgcggauca

SEQ ID NO: 1414863 - RNA, 21 nt, Pseudomonas aeruginosa PA01
ccaggucgcggaucaggcugg

SEQ ID NO: 1414864 - RNA, 15 nt, Pseudomonas aeruginosa PA01
ccaggucgcugcuga

SEQ ID NO: 1414865 - RNA, 19 nt, Pseudomonas aeruginosa PA01
ccaggucgcuggcaccggc

SEQ ID NO: 1414866 - RNA, 23 nt, Pseudomonas aeruginosa PA01
ccaggucgcuggcaccggccagg

SEQ ID NO: 1414867 - RNA, 14 nt, Pseudomonas aeruginosa PA01
ccaggugcccugga

SEQ ID NO: 1414868 - RNA, 21 nt, Pseudomonas aeruginosa PA01
ccaggugcccuggaagccggc

SEQ ID NO: 1414869 - RNA, 22 nt, Pseudomonas aeruginosa PA01
ccaggugcgagucaccccgacc

SEQ ID NO: 1414870 - RNA, 15 nt, Pseudomonas aeruginosa PA01
ccaggugcgcaggcg

SEQ ID NO: 1414871 - RNA, 17 nt, Pseudomonas aeruginosa PA01
ccaggugcgcaggcgcu

SEQ ID NO: 1414872 - RNA, 19 nt, Pseudomonas aeruginosa PA01
ccaggugcgcaggcgcucg

SEQ ID NO: 1414873 - RNA, 12 nt, Pseudomonas aeruginosa PA01
ccaggugcgccg

SEQ ID NO: 1414874 - RNA, 14 nt, Pseudomonas aeruginosa PA01
ccaggugcggcugg

SEQ ID NO: 1414875 - RNA, 21 nt, Pseudomonas aeruginosa PA01
ccaggugcggcugggugucga

SEQ ID NO: 1414876 - RNA, 16 nt, Pseudomonas aeruginosa PA01
ccaguacuugaacagc

SEQ ID NO: 1414877 - RNA, 23 nt, Pseudomonas aeruginosa PA01
ccaguacuccgagggccgcgccg

SEQ ID NO: 1414878 - RNA, 19 nt, Pseudomonas aeruginosa PA01
ccaguacgucacgaacggc

SEQ ID NO: 1414879 - RNA, 13 nt, Pseudomonas aeruginosa PA01
ccaguacgucgag

SEQ ID NO: 1414880 - RNA, 18 nt, Pseudomonas aeruginosa PA01
ccaguagcgacagcaucu

SEQ ID NO: 1414881 - RNA, 17 nt, Pseudomonas aeruginosa PA01
ccaguagggggugaagc

SEQ ID NO: 1414882 - RNA, 13 nt, Pseudomonas aeruginosa PA01
ccaguacacccag

SEQ ID NO: 1414883 - RNA, 14 nt, Pseudomonas aeruginosa PA01
ccaguacacccagg

SEQ ID NO: 1414884 - RNA, 17 nt, Pseudomonas aeruginosa PA01
ccaguacacccagggca

SEQ ID NO: 1414885 - RNA, 19 nt, Pseudomonas aeruginosa PA01
ccaguacacccagggcagu

SEQ ID NO: 1414886 - RNA, 22 nt, Pseudomonas aeruginosa PA01
ccagguggucguagcagguccg

SEQ ID NO: 1414887 - RNA, 15 nt, Pseudomonas aeruginosa PA01
ccagguucacccagu

SEQ ID NO: 1414888 - RNA, 15 nt, Pseudomonas aeruginosa PA01
ccaguaccacgcagc

SEQ ID NO: 1414889 - RNA, 23 nt, Pseudomonas aeruginosa PA01
ccaguaccacgcagccacccgcg

SEQ ID NO: 1414890 - RNA, 18 nt, Pseudomonas aeruginosa PA01
ccaguucguucugggucg

SEQ ID NO: 1414891 - RNA, 15 nt, Pseudomonas aeruginosa PA01
ccaguucguugacca

SEQ ID NO: 1414892 - RNA, 16 nt, Pseudomonas aeruginosa PA01
ccaguucguugaccac

SEQ ID NO: 1414893 - RNA, 14 nt, Pseudomonas aeruginosa PA01
ccauagcgcgccgg

SEQ ID NO: 1414894 - RNA, 18 nt, Pseudomonas aeruginosa PA01
ccauagggcggcgcggcg

SEQ ID NO: 1414895 - RNA, 14 nt, Pseudomonas aeruginosa PA01
ccauagcgagccgc

SEQ ID NO: 1414896 - RNA, 21 nt, Pseudomonas aeruginosa PA01
ccagugcaugcguucgccgaa

SEQ ID NO: 1414897 - RNA, 16 nt, Pseudomonas aeruginosa PA01
ccagugccucgcgcgu

SEQ ID NO: 1414898 - RNA, 18 nt, Pseudomonas aeruginosa PA01
ccagugccucgcgcgugg

SEQ ID NO: 1414899 - RNA, 17 nt, Pseudomonas aeruginosa PA01
ccaguaguccuccgcgc

SEQ ID NO: 1414900 - RNA, 20 nt, Pseudomonas aeruginosa PA01
ccaguaguccuccgcgccca

SEQ ID NO: 1414901 - RNA, 18 nt, Pseudomonas aeruginosa PA01
ccagucaccaggucgcgg

SEQ ID NO: 1414902 - RNA, 17 nt, Pseudomonas aeruginosa PA01
ccaguucgcugccgccg

SEQ ID NO: 1414903 - RNA, 14 nt, Pseudomonas aeruginosa PA01
ccaguucggccgcg

SEQ ID NO: 1414904 - RNA, 14 nt, Pseudomonas aeruginosa PA01
ccaguucgcgcgga

SEQ ID NO: 1414905 - RNA, 15 nt, Pseudomonas aeruginosa PA01
ccaguucgcggcgca

SEQ ID NO: 1414906 - RNA, 15 nt, Pseudomonas aeruginosa PA01
ccaguucgccgccgc

SEQ ID NO: 1414907 - RNA, 18 nt, Pseudomonas aeruginosa PA01
ccaguucgccgccgcgcu

SEQ ID NO: 1414908 - RNA, 20 nt, Pseudomonas aeruginosa PA01
ccaguucgccggccagcacc

SEQ ID NO: 1414909 - RNA, 21 nt, Pseudomonas aeruginosa PA01
ccaguucgagcagucgcuuca

SEQ ID NO: 1414910 - RNA, 12 nt, Pseudomonas aeruginosa PA01
ccaguuccugcu

SEQ ID NO: 1414911 - RNA, 17 nt, Pseudomonas aeruginosa PA01
ccaguuccuucgccgaa

SEQ ID NO: 1414912 - RNA, 20 nt, Pseudomonas aeruginosa PA01
ccaguuccuucgccgaaagc

SEQ ID NO: 1414913 - RNA, 18 nt, Pseudomonas aeruginosa PA01
ccaguuccaugucgcugg

SEQ ID NO: 1414914 - RNA, 13 nt, Pseudomonas aeruginosa PA01
ccaguucagcgcg

SEQ ID NO: 1414915 - RNA, 19 nt, Pseudomonas aeruginosa PA01
ccagugcgagucggcgacg

SEQ ID NO: 1414916 - RNA, 15 nt, Pseudomonas aeruginosa PA01
ccaggccguaggcga

SEQ ID NO: 1414917 - RNA, 17 nt, Pseudomonas aeruginosa PA01
ccaggccguagaccacc

SEQ ID NO: 1414918 - RNA, 23 nt, Pseudomonas aeruginosa PA01
ccaggccguucucgaagagcugg

SEQ ID NO: 1414919 - RNA, 17 nt, Pseudomonas aeruginosa PA01
ccaggccucccagccgu

SEQ ID NO: 1414920 - RNA, 17 nt, Pseudomonas aeruginosa PA01
ccaggccugggucacca

SEQ ID NO: 1414921 - RNA, 19 nt, Pseudomonas aeruginosa PA01
ccaggccgggucgcagccg

SEQ ID NO: 1414922 - RNA, 20 nt, Pseudomonas aeruginosa PA01
ccaggccgggucgcagccgg

SEQ ID NO: 1414923 - RNA, 13 nt, Pseudomonas aeruginosa PA01
ccaggccggcggc

SEQ ID NO: 1414924 - RNA, 16 nt, Pseudomonas aeruginosa PA01
ccaggccggcggccga

SEQ ID NO: 1414925 - RNA, 14 nt, Pseudomonas aeruginosa PA01
ccaggccggcgagg

SEQ ID NO: 1414926 - RNA, 13 nt, Pseudomonas aeruginosa PA01
ccaggccggcgca

SEQ ID NO: 1414927 - RNA, 14 nt, Pseudomonas aeruginosa PA01
ccaggccgcugccg

SEQ ID NO: 1414928 - RNA, 21 nt, Pseudomonas aeruginosa PA01
ccaggccgcugccgccgcgca

SEQ ID NO: 1414929 - RNA, 17 nt, Pseudomonas aeruginosa PA01
ccaggccgcuggcggcg

SEQ ID NO: 1414930 - RNA, 22 nt, Pseudomonas aeruginosa PA01
ccaggccgcuggcggcgacgaa

SEQ ID NO: 1414931 - RNA, 19 nt, Pseudomonas aeruginosa PA01
ccaggccgcuuuccacccg

SEQ ID NO: 1414932 - RNA, 23 nt, Pseudomonas aeruginosa PA01
ccaggcgacgcugaugccggcga

SEQ ID NO: 1414933 - RNA, 18 nt, Pseudomonas aeruginosa PA01
ccaggcgauaucccgccg

SEQ ID NO: 1414934 - RNA, 20 nt, Pseudomonas aeruginosa PA01
ccaggcgauccacagcaggu

SEQ ID NO: 1414935 - RNA, 14 nt, Pseudomonas aeruginosa PA01
ccaggcgauccagc

SEQ ID NO: 1414936 - RNA, 19 nt, Pseudomonas aeruginosa PA01
ccaggcgaggaacagcgag

SEQ ID NO: 1414937 - RNA, 22 nt, Pseudomonas aeruginosa PA01
ccaggcgaugcgccggaucggc

SEQ ID NO: 1414938 - RNA, 11 nt, Pseudomonas aeruginosa PA01
ccaggcgaugg

SEQ ID NO: 1414939 - RNA, 22 nt, Pseudomonas aeruginosa PA01
ccaggcgaauggagggaucgcg

SEQ ID NO: 1414940 - RNA, 23 nt, Pseudomonas aeruginosa PA01
ccaggcgaauggagggaucgcgc

SEQ ID NO: 1414941 - RNA, 21 nt, Pseudomonas aeruginosa PA01
ccaggcgaagaaagccccugc

SEQ ID NO: 1414942 - RNA, 14 nt, Pseudomonas aeruginosa PA01
ccaggcgaagcggc

SEQ ID NO: 1414943 - RNA, 20 nt, Pseudomonas aeruginosa PA01
ccaggccuugugcgccagcu

SEQ ID NO: 1414944 - RNA, 18 nt, Pseudomonas aeruginosa PA01
ccaggcgaaagucggcgc

SEQ ID NO: 1414945 - RNA, 18 nt, Pseudomonas aeruginosa PA01
ccaggccuugcagcaacu

SEQ ID NO: 1414946 - RNA, 19 nt, Pseudomonas aeruginosa PA01
ccaggcgcccaggcagcag

SEQ ID NO: 1414947 - RNA, 20 nt, Pseudomonas aeruginosa PA01
ccaggcgccaauccgggcgu

SEQ ID NO: 1414948 - RNA, 18 nt, Pseudomonas aeruginosa PA01
ccaggcgccagagcgcgc

SEQ ID NO: 1414949 - RNA, 22 nt, Pseudomonas aeruginosa PA01
ccaggcgccagggacgcgcagc

SEQ ID NO: 1414950 - RNA, 14 nt, Pseudomonas aeruginosa PA01
ccaggcgccagggc

SEQ ID NO: 1414951 - RNA, 16 nt, Pseudomonas aeruginosa PA01
ccaggcgcaccagcag

SEQ ID NO: 1414952 - RNA, 22 nt, Pseudomonas aeruginosa PA01
ccaggcgcaccagcaggcgcaa

SEQ ID NO: 1414953 - RNA, 19 nt, Pseudomonas aeruginosa PA01
ccaggcgcaguaggccugg

SEQ ID NO: 1414954 - RNA, 20 nt, Pseudomonas aeruginosa PA01
ccaggcgcgaacgcucccag

SEQ ID NO: 1414955 - RNA, 17 nt, Pseudomonas aeruginosa PA01
ccaggcgccgggucgau

SEQ ID NO: 1414956 - RNA, 21 nt, Pseudomonas aeruginosa PA01
ccaggcgccgggucgaugggc

SEQ ID NO: 1414957 - RNA, 14 nt, Pseudomonas aeruginosa PA01
ccaggcugaccgcg

SEQ ID NO: 1414958 - RNA, 15 nt, Pseudomonas aeruginosa PA01
ccaggcugaggucgc

SEQ ID NO: 1414959 - RNA, 16 nt, Pseudomonas aeruginosa PA01
ccaggcugaucagccc

SEQ ID NO: 1414960 - RNA, 17 nt, Pseudomonas aeruginosa PA01
ccaggcugaucagcccg

SEQ ID NO: 1414961 - RNA, 13 nt, Pseudomonas aeruginosa PA01
ccaggcucgcccc

SEQ ID NO: 1414962 - RNA, 22 nt, Pseudomonas aeruginosa PA01
ccaggcucgccccggcggcgau

SEQ ID NO: 1414963 - RNA, 16 nt, Pseudomonas aeruginosa PA01
ccaggcucgccgccag

SEQ ID NO: 1414964 - RNA, 17 nt, Pseudomonas aeruginosa PA01
ccaggcucgccgccagc

SEQ ID NO: 1414965 - RNA, 21 nt, Pseudomonas aeruginosa PA01
ccaggcucgccgccagcagga

SEQ ID NO: 1414966 - RNA, 21 nt, Pseudomonas aeruginosa PA01
ccaggcucuucuucgaaccgc

SEQ ID NO: 1414967 - RNA, 13 nt, Pseudomonas aeruginosa PA01
ccaggcucaccuc

SEQ ID NO: 1414968 - RNA, 16 nt, Pseudomonas aeruginosa PA01
ccaggcucagcucucc

SEQ ID NO: 1414969 - RNA, 21 nt, Pseudomonas aeruginosa PA01
ccaggcgguuggcccgcgccg

SEQ ID NO: 1414970 - RNA, 22 nt, Pseudomonas aeruginosa PA01
ccaggcgguuggcccgcgccgu

SEQ ID NO: 1414971 - RNA, 20 nt, Pseudomonas aeruginosa PA01
ccaggcgguuguucagcggg

SEQ ID NO: 1414972 - RNA, 23 nt, Pseudomonas aeruginosa PA01
ccaggcgguuguucagcgggcgc

SEQ ID NO: 1414973 - RNA, 17 nt, Pseudomonas aeruginosa PA01
ccaggcguauucggcga

SEQ ID NO: 1414974 - RNA, 21 nt, Pseudomonas aeruginosa PA01
ccaggcguauucggcgaccag

SEQ ID NO: 1414975 - RNA, 13 nt, Pseudomonas aeruginosa PA01
ccaggcguccgcu

SEQ ID NO: 1414976 - RNA, 20 nt, Pseudomonas aeruginosa PA01
ccaggcguccgcuggccugc

SEQ ID NO: 1414977 - RNA, 15 nt, Pseudomonas aeruginosa PA01
ccaggcgucgcgcca

SEQ ID NO: 1414978 - RNA, 17 nt, Pseudomonas aeruginosa PA01
ccaggcgucgcgccagc

SEQ ID NO: 1414979 - RNA, 18 nt, Pseudomonas aeruginosa PA01
ccaggcgucgcgccagca

SEQ ID NO: 1414980 - RNA, 19 nt, Pseudomonas aeruginosa PA01
ccaggcgucgcgccagcac

SEQ ID NO: 1414981 - RNA, 15 nt, Pseudomonas aeruginosa PA01
ccaggcgucggcgcc

SEQ ID NO: 1414982 - RNA, 11 nt, Pseudomonas aeruginosa PA01
ccaggcgucgu

SEQ ID NO: 1414983 - RNA, 13 nt, Pseudomonas aeruginosa PA01
ccaggcgugccug

SEQ ID NO: 1414984 - RNA, 18 nt, Pseudomonas aeruginosa PA01
ccaggcgugccuguuccu

SEQ ID NO: 1414985 - RNA, 20 nt, Pseudomonas aeruginosa PA01
ccaggcgugcagaccgucga

SEQ ID NO: 1414986 - RNA, 16 nt, Pseudomonas aeruginosa PA01
ccaggcguggggcgaa

SEQ ID NO: 1414987 - RNA, 13 nt, Pseudomonas aeruginosa PA01
ccaggcguuccag

SEQ ID NO: 1414988 - RNA, 23 nt, Pseudomonas aeruginosa PA01
ccaggcguuccagcucggcgagg

SEQ ID NO: 1414989 - RNA, 13 nt, Pseudomonas aeruginosa PA01
ccaggcgggcacg

SEQ ID NO: 1414990 - RNA, 20 nt, Pseudomonas aeruginosa PA01
ccaggcgggccagcuggcga

SEQ ID NO: 1414991 - RNA, 14 nt, Pseudomonas aeruginosa PA01
ccaggcgggccagc

SEQ ID NO: 1414992 - RNA, 15 nt, Pseudomonas aeruginosa PA01
ccaggcggccgcugg

SEQ ID NO: 1414993 - RNA, 20 nt, Pseudomonas aeruginosa PA01
ccaggcggccgcuggcgauc

SEQ ID NO: 1414994 - RNA, 15 nt, Pseudomonas aeruginosa PA01
ccaggcggccggugc

SEQ ID NO: 1414995 - RNA, 22 nt, Pseudomonas aeruginosa PA01
ccaggcggccgucggccuggcg

SEQ ID NO: 1414996 - RNA, 14 nt, Pseudomonas aeruginosa PA01
ccaggcggcggacg

SEQ ID NO: 1414997 - RNA, 15 nt, Pseudomonas aeruginosa PA01
ccaggcgcugcucga

SEQ ID NO: 1414998 - RNA, 11 nt, Pseudomonas aeruginosa PA01
ccaggcgcugg

SEQ ID NO: 1414999 - RNA, 16 nt, Pseudomonas aeruginosa PA01
ccaggcgcuggcgccg

SEQ ID NO: 1415000 - RNA, 17 nt, Pseudomonas aeruginosa PA01
ccaggcgcuggcgccga

SEQ ID NO: 1415001 - RNA, 15 nt, Pseudomonas aeruginosa PA01
ccaggcggaacggcu

SEQ ID NO: 1415002 - RNA, 14 nt, Pseudomonas aeruginosa PA01
ccaggcggagcaug

SEQ ID NO: 1415003 - RNA, 15 nt, Pseudomonas aeruginosa PA01
ccaggcggcagccgc

SEQ ID NO: 1415004 - RNA, 16 nt, Pseudomonas aeruginosa PA01
ccaggcggcagccgcg

SEQ ID NO: 1415005 - RNA, 11 nt, Pseudomonas aeruginosa PA01
ccaggcggccg

SEQ ID NO: 1415006 - RNA, 17 nt, Pseudomonas aeruginosa PA01
ccaggcggccgacgaug

SEQ ID NO: 1415007 - RNA, 24 nt, Pseudomonas aeruginosa PA01
ccaggcgcggcgccuucagcgccg

SEQ ID NO: 1415008 - RNA, 22 nt, Pseudomonas aeruginosa PA01
ccaggcgcgguugccgcugcgg

SEQ ID NO: 1415009 - RNA, 18 nt, Pseudomonas aeruginosa PA01
ccaggcgcgucgcggccu

SEQ ID NO: 1415010 - RNA, 19 nt, Pseudomonas aeruginosa PA01
ccaggcgcuccuccagcgc

SEQ ID NO: 1415011 - RNA, 21 nt, Pseudomonas aeruginosa PA01
ccaggcgcuccuccagcgccg

SEQ ID NO: 1415012 - RNA, 16 nt, Pseudomonas aeruginosa PA01
ccaggcgcucgcgcug

SEQ ID NO: 1415013 - RNA, 17 nt, Pseudomonas aeruginosa PA01
ccaggcgcucgcgcugc

SEQ ID NO: 1415014 - RNA, 19 nt, Pseudomonas aeruginosa PA01
ccaggcgcucgcgcugcaa

SEQ ID NO: 1415015 - RNA, 16 nt, Pseudomonas aeruginosa PA01
ccaggcgcucggcgac

SEQ ID NO: 1415016 - RNA, 17 nt, Pseudomonas aeruginosa PA01
ccaggcgcucggcggcg

SEQ ID NO: 1415017 - RNA, 23 nt, Pseudomonas aeruginosa PA01
ccaggcgcucggcggcgcgcagc

SEQ ID NO: 1415018 - RNA, 12 nt, Pseudomonas aeruginosa PA01
ccaggcgcgccg

SEQ ID NO: 1415019 - RNA, 13 nt, Pseudomonas aeruginosa PA01
ccaggcgcgcugg

SEQ ID NO: 1415020 - RNA, 13 nt, Pseudomonas aeruginosa PA01
ccaggcgcgccgu

SEQ ID NO: 1415021 - RNA, 17 nt, Pseudomonas aeruginosa PA01
ccaggccgagcgcgccg

SEQ ID NO: 1415022 - RNA, 11 nt, Pseudomonas aeruginosa PA01
ccaggccgagc

SEQ ID NO: 1415023 - RNA, 21 nt, Pseudomonas aeruginosa PA01
ccaggccgagcaauccggcgc

SEQ ID NO: 1415024 - RNA, 17 nt, Pseudomonas aeruginosa PA01
ccaggccgaagccgccg

SEQ ID NO: 1415025 - RNA, 18 nt, Pseudomonas aeruginosa PA01
ccaggccgaagccgccgg

SEQ ID NO: 1415026 - RNA, 21 nt, Pseudomonas aeruginosa PA01
ccaggccgaaguagccggcgu

SEQ ID NO: 1415027 - RNA, 15 nt, Pseudomonas aeruginosa PA01
ccaggccgacagcgg

SEQ ID NO: 1415028 - RNA, 19 nt, Pseudomonas aeruginosa PA01
ccaggccgacagcggcugg

SEQ ID NO: 1415029 - RNA, 17 nt, Pseudomonas aeruginosa PA01
ccaggcccugggcggcg

SEQ ID NO: 1415030 - RNA, 14 nt, Pseudomonas aeruginosa PA01
ccaggcccucggcg

SEQ ID NO: 1415031 - RNA, 15 nt, Pseudomonas aeruginosa PA01
ccaggcccucggcga

SEQ ID NO: 1415032 - RNA, 16 nt, Pseudomonas aeruginosa PA01
ccaggcccucggcgac

SEQ ID NO: 1415033 - RNA, 21 nt, Pseudomonas aeruginosa PA01
ccaggccgcaaguaccgccgg

SEQ ID NO: 1415034 - RNA, 21 nt, Pseudomonas aeruginosa PA01
ccaggccgaugaacgccgcga

SEQ ID NO: 1415035 - RNA, 20 nt, Pseudomonas aeruginosa PA01
ccaggccgccgccugcucgc

SEQ ID NO: 1415036 - RNA, 14 nt, Pseudomonas aeruginosa PA01
ccaggccgccgaag

SEQ ID NO: 1415037 - RNA, 17 nt, Pseudomonas aeruginosa PA01
ccaggccgccgauccag

SEQ ID NO: 1415038 - RNA, 15 nt, Pseudomonas aeruginosa PA01
ccaggccgccaugcu

SEQ ID NO: 1415039 - RNA, 14 nt, Pseudomonas aeruginosa PA01
ccaggccgccggcg

SEQ ID NO: 1415040 - RNA, 15 nt, Pseudomonas aeruginosa PA01
ccaggccgccggcga

SEQ ID NO: 1415041 - RNA, 18 nt, Pseudomonas aeruginosa PA01
ccaggccgccggcgaccg

SEQ ID NO: 1415042 - RNA, 12 nt, Pseudomonas aeruginosa PA01
ccaggccgcgca

SEQ ID NO: 1415043 - RNA, 14 nt, Pseudomonas aeruginosa PA01
ccaggccgcgcagu

SEQ ID NO: 1415044 - RNA, 12 nt, Pseudomonas aeruginosa PA01
ccaggccaggug

SEQ ID NO: 1415045 - RNA, 16 nt, Pseudomonas aeruginosa PA01
ccaggccauagcgcgc

SEQ ID NO: 1415046 - RNA, 18 nt, Pseudomonas aeruginosa PA01
ccaggccauagcgcgccg

SEQ ID NO: 1415047 - RNA, 19 nt, Pseudomonas aeruginosa PA01
ccaggccauagcgcgccgg

SEQ ID NO: 1415048 - RNA, 13 nt, Pseudomonas aeruginosa PA01
ccaggccaggcug

SEQ ID NO: 1415049 - RNA, 16 nt, Pseudomonas aeruginosa PA01
ccaggccaggcugcgc

SEQ ID NO: 1415050 - RNA, 14 nt, Pseudomonas aeruginosa PA01
ccaggcccagccgg

SEQ ID NO: 1415051 - RNA, 17 nt, Pseudomonas aeruginosa PA01
ccaggcccagccgguga

SEQ ID NO: 1415052 - RNA, 18 nt, Pseudomonas aeruginosa PA01
ccaggccauugaaggccg

SEQ ID NO: 1415053 - RNA, 16 nt, Pseudomonas aeruginosa PA01
ccaggcccagcgcggc

SEQ ID NO: 1415054 - RNA, 13 nt, Pseudomonas aeruginosa PA01
ccaggcccagcgc

SEQ ID NO: 1415055 - RNA, 14 nt, Pseudomonas aeruginosa PA01
ccaggcccagcgcg

SEQ ID NO: 1415056 - RNA, 18 nt, Pseudomonas aeruginosa PA01
ccaggcccauccuggcga

SEQ ID NO: 1415057 - RNA, 18 nt, Pseudomonas aeruginosa PA01
ccaggccccaggccgccg

SEQ ID NO: 1415058 - RNA, 19 nt, Pseudomonas aeruginosa PA01
ccaggccccaggccgccgc

SEQ ID NO: 1415059 - RNA, 11 nt, Pseudomonas aeruginosa PA01
ccaggcccgcc

SEQ ID NO: 1415060 - RNA, 13 nt, Pseudomonas aeruginosa PA01
ccaggcccggcag

SEQ ID NO: 1415061 - RNA, 15 nt, Pseudomonas aeruginosa PA01
ccaggcccgccgguc

SEQ ID NO: 1415062 - RNA, 14 nt, Pseudomonas aeruginosa PA01
ccaggcccggcgcu

SEQ ID NO: 1415063 - RNA, 17 nt, Pseudomonas aeruginosa PA01
ccaggcccucagcggcg

SEQ ID NO: 1415064 - RNA, 22 nt, Pseudomonas aeruginosa PA01
ccaggcccucagcggcggugcg

SEQ ID NO: 1415065 - RNA, 12 nt, Pseudomonas aeruginosa PA01
ccaggcccggcg

SEQ ID NO: 1415066 - RNA, 22 nt, Pseudomonas aeruginosa PA01
ccaggaugcccugcucuuccag

SEQ ID NO: 1415067 - RNA, 18 nt, Pseudomonas aeruginosa PA01
ccaggaugcgguugccgg

SEQ ID NO: 1415068 - RNA, 18 nt, Pseudomonas aeruginosa PA01
ccagcgugaagaccuggu

SEQ ID NO: 1415069 - RNA, 21 nt, Pseudomonas aeruginosa PA01
ccagcgugaagaccuggucca

SEQ ID NO: 1415070 - RNA, 14 nt, Pseudomonas aeruginosa PA01
ccagcguggccagc

SEQ ID NO: 1415071 - RNA, 13 nt, Pseudomonas aeruginosa PA01
ccagcguggcgcg

SEQ ID NO: 1415072 - RNA, 20 nt, Pseudomonas aeruginosa PA01
ccaggaugcaaccgcccugg

SEQ ID NO: 1415073 - RNA, 21 nt, Pseudomonas aeruginosa PA01
ccaggaugcaaccgcccuggu

SEQ ID NO: 1415074 - RNA, 17 nt, Pseudomonas aeruginosa PA01
ccaggcauuccuccagg

SEQ ID NO: 1415075 - RNA, 14 nt, Pseudomonas aeruginosa PA01
ccaggccacgccca

SEQ ID NO: 1415076 - RNA, 15 nt, Pseudomonas aeruginosa PA01
ccaggccacgcccau

SEQ ID NO: 1415077 - RNA, 18 nt, Pseudomonas aeruginosa PA01
ccaggccacggccggcga

SEQ ID NO: 1415078 - RNA, 19 nt, Pseudomonas aeruginosa PA01
ccaggccacggccggcgag

SEQ ID NO: 1415079 - RNA, 20 nt, Pseudomonas aeruginosa PA01
ccaggcaggcggucagcgcg

SEQ ID NO: 1415080 - RNA, 18 nt, Pseudomonas aeruginosa PA01
ccaggcauccagcaccgc

SEQ ID NO: 1415081 - RNA, 17 nt, Pseudomonas aeruginosa PA01
ccaggcaauggccggcg

SEQ ID NO: 1415082 - RNA, 19 nt, Pseudomonas aeruginosa PA01
ccaggcaaugucguugaug

SEQ ID NO: 1415083 - RNA, 22 nt, Pseudomonas aeruginosa PA01
ccaggcacgaauuuccuggcgc

SEQ ID NO: 1415084 - RNA, 16 nt, Pseudomonas aeruginosa PA01
ccaggcaccguaggcc

SEQ ID NO: 1415085 - RNA, 15 nt, Pseudomonas aeruginosa PA01
ccaggcagaccagcg

SEQ ID NO: 1415086 - RNA, 16 nt, Pseudomonas aeruginosa PA01
ccaggcagaccagcgc

SEQ ID NO: 1415087 - RNA, 15 nt, Pseudomonas aeruginosa PA01
ccaggcagaccaggc

SEQ ID NO: 1415088 - RNA, 16 nt, Pseudomonas aeruginosa PA01
ccaggcagaccaggcc

SEQ ID NO: 1415089 - RNA, 17 nt, Pseudomonas aeruginosa PA01
ccaggcagaccaggccg

SEQ ID NO: 1415090 - RNA, 20 nt, Pseudomonas aeruginosa PA01
ccaggcagaccugcagcagg

SEQ ID NO: 1415091 - RNA, 15 nt, Pseudomonas aeruginosa PA01
ccaggcagaucgcgc

SEQ ID NO: 1415092 - RNA, 15 nt, Pseudomonas aeruginosa PA01
ccagaccuuccagcc

SEQ ID NO: 1415093 - RNA, 17 nt, Pseudomonas aeruginosa PA01
ccagaccuuccagccgc

SEQ ID NO: 1415094 - RNA, 18 nt, Pseudomonas aeruginosa PA01
ccagaccuuccagccgcg

SEQ ID NO: 1415095 - RNA, 17 nt, Pseudomonas aeruginosa PA01
ccagacgaucagcggcc

SEQ ID NO: 1415096 - RNA, 19 nt, Pseudomonas aeruginosa PA01
ccagacgaucagcggcccg

SEQ ID NO: 1415097 - RNA, 13 nt, Pseudomonas aeruginosa PA01
ccagaccgcagcc

SEQ ID NO: 1415098 - RNA, 16 nt, Pseudomonas aeruginosa PA01
ccagacccucucccug

SEQ ID NO: 1415099 - RNA, 19 nt, Pseudomonas aeruginosa PA01
ccagaccggcagcgccgcc

SEQ ID NO: 1415100 - RNA, 21 nt, Pseudomonas aeruginosa PA01
ccagaccggcagcgccgccag

SEQ ID NO: 1415101 - RNA, 22 nt, Pseudomonas aeruginosa PA01
ccagaccguggauuucagcagg

SEQ ID NO: 1415102 - RNA, 18 nt, Pseudomonas aeruginosa PA01
ccagaccucgagcaggcc

SEQ ID NO: 1415103 - RNA, 13 nt, Pseudomonas aeruginosa PA01
ccagaccuggccg

SEQ ID NO: 1415104 - RNA, 14 nt, Pseudomonas aeruginosa PA01
ccagaccuggccgc

SEQ ID NO: 1415105 - RNA, 15 nt, Pseudomonas aeruginosa PA01
ccagaccuggccgcu

SEQ ID NO: 1415106 - RNA, 21 nt, Pseudomonas aeruginosa PA01
ccacuggauggucacgccgag

SEQ ID NO: 1415107 - RNA, 22 nt, Pseudomonas aeruginosa PA01
ccacuggauggucacgccgagg

SEQ ID NO: 1415108 - RNA, 19 nt, Pseudomonas aeruginosa PA01
ccacuggcccacggcgccu

SEQ ID NO: 1415109 - RNA, 14 nt, Pseudomonas aeruginosa PA01
ccacugcuuggcca

SEQ ID NO: 1415110 - RNA, 19 nt, Pseudomonas aeruginosa PA01
ccacugcuuggccaggcgc

SEQ ID NO: 1415111 - RNA, 20 nt, Pseudomonas aeruginosa PA01
ccacugcuuggccaggcgcu

SEQ ID NO: 1415112 - RNA, 17 nt, Pseudomonas aeruginosa PA01
ccacugcuuggcgaacu

SEQ ID NO: 1415113 - RNA, 15 nt, Pseudomonas aeruginosa PA01
ccacugucucgccga

SEQ ID NO: 1415114 - RNA, 16 nt, Pseudomonas aeruginosa PA01
ccacugucucgccgau

SEQ ID NO: 1415115 - RNA, 19 nt, Pseudomonas aeruginosa PA01
ccacugucucgccgaugcc

SEQ ID NO: 1415116 - RNA, 14 nt, Pseudomonas aeruginosa PA01
ccagacaggccagc

SEQ ID NO: 1415117 - RNA, 18 nt, Pseudomonas aeruginosa PA01
ccagacaggccagcucgc

SEQ ID NO: 1415118 - RNA, 11 nt, Pseudomonas aeruginosa PA01
ccagaccagca

SEQ ID NO: 1415119 - RNA, 12 nt, Pseudomonas aeruginosa PA01
ccagaccagccc

SEQ ID NO: 1415120 - RNA, 16 nt, Pseudomonas aeruginosa PA01
ccagaccccauccgca

SEQ ID NO: 1415121 - RNA, 12 nt, Pseudomonas aeruginosa PA01
ccagaguugccu

SEQ ID NO: 1415122 - RNA, 21 nt, Pseudomonas aeruginosa PA01
ccagaguugccuguccagcuc

SEQ ID NO: 1415123 - RNA, 18 nt, Pseudomonas aeruginosa PA01
ccagaguucgcccagcuc

SEQ ID NO: 1415124 - RNA, 23 nt, Pseudomonas aeruginosa PA01
ccagacgcggauuggccgggccg

SEQ ID NO: 1415125 - RNA, 19 nt, Pseudomonas aeruginosa PA01
ccagauagugcggccaggc

SEQ ID NO: 1415126 - RNA, 14 nt, Pseudomonas aeruginosa PA01
ccagaugaucaggc

SEQ ID NO: 1415127 - RNA, 17 nt, Pseudomonas aeruginosa PA01
ccagaugaucaggccga

SEQ ID NO: 1415128 - RNA, 18 nt, Pseudomonas aeruginosa PA01
ccagaugaucaggccgag

SEQ ID NO: 1415129 - RNA, 14 nt, Pseudomonas aeruginosa PA01
ccagaugcgcgucg

SEQ ID NO: 1415130 - RNA, 15 nt, Pseudomonas aeruginosa PA01
ccagaucggcgcgca

SEQ ID NO: 1415131 - RNA, 13 nt, Pseudomonas aeruginosa PA01
ccagaucgccacc

SEQ ID NO: 1415132 - RNA, 15 nt, Pseudomonas aeruginosa PA01
ccagaucgccagcgc

SEQ ID NO: 1415133 - RNA, 21 nt, Pseudomonas aeruginosa PA01
ccagauccccugcaggacccg

SEQ ID NO: 1415134 - RNA, 17 nt, Pseudomonas aeruginosa PA01
ccacguugagcaucacc

SEQ ID NO: 1415135 - RNA, 19 nt, Pseudomonas aeruginosa PA01
ccacguugagcaucaccgc

SEQ ID NO: 1415136 - RNA, 18 nt, Pseudomonas aeruginosa PA01
ccacguggccggcgcgga

SEQ ID NO: 1415137 - RNA, 14 nt, Pseudomonas aeruginosa PA01
ccacguugcgccgc

SEQ ID NO: 1415138 - RNA, 16 nt, Pseudomonas aeruginosa PA01
ccacguugcgccgcag

SEQ ID NO: 1415139 - RNA, 23 nt, Pseudomonas aeruginosa PA01
ccacuccagauagugcggccagg

SEQ ID NO: 1415140 - RNA, 12 nt, Pseudomonas aeruginosa PA01
ccacuccagcgg

SEQ ID NO: 1415141 - RNA, 14 nt, Pseudomonas aeruginosa PA01
ccacuccagcgggg

SEQ ID NO: 1415142 - RNA, 18 nt, Pseudomonas aeruginosa PA01
ccacggugaucaggcgcu

SEQ ID NO: 1415143 - RNA, 15 nt, Pseudomonas aeruginosa PA01
ccacgucgccccagg

SEQ ID NO: 1415144 - RNA, 18 nt, Pseudomonas aeruginosa PA01
ccacgucgccgaccaggc

SEQ ID NO: 1415145 - RNA, 19 nt, Pseudomonas aeruginosa PA01
ccacgucguuucucggcga

SEQ ID NO: 1415146 - RNA, 22 nt, Pseudomonas aeruginosa PA01
ccacgugcucgcggaccagcuc

SEQ ID NO: 1415147 - RNA, 19 nt, Pseudomonas aeruginosa PA01
ccacgucugugccgaggcc

SEQ ID NO: 1415148 - RNA, 22 nt, Pseudomonas aeruginosa PA01
ccacgucgcgaccgguaacugg

SEQ ID NO: 1415149 - RNA, 14 nt, Pseudomonas aeruginosa PA01
ccacgucggcccgg

SEQ ID NO: 1415150 - RNA, 17 nt, Pseudomonas aeruginosa PA01
ccacgcgagaagccgcc

SEQ ID NO: 1415151 - RNA, 17 nt, Pseudomonas aeruginosa PA01
ccacgcgauauccgcca

SEQ ID NO: 1415152 - RNA, 13 nt, Pseudomonas aeruginosa PA01
ccacgcgcaagcc

SEQ ID NO: 1415153 - RNA, 16 nt, Pseudomonas aeruginosa PA01
ccacgccugccaucga

SEQ ID NO: 1415154 - RNA, 23 nt, Pseudomonas aeruginosa PA01
ccacgccuugcagcaccgccugg

SEQ ID NO: 1415155 - RNA, 14 nt, Pseudomonas aeruginosa PA01
ccacgcgaccagcg

SEQ ID NO: 1415156 - RNA, 19 nt, Pseudomonas aeruginosa PA01
ccacgcgacccaucgccga

SEQ ID NO: 1415157 - RNA, 18 nt, Pseudomonas aeruginosa PA01
ccacgccuucgcggccga

SEQ ID NO: 1415158 - RNA, 15 nt, Pseudomonas aeruginosa PA01
ccacgccuggcccug

SEQ ID NO: 1415159 - RNA, 21 nt, Pseudomonas aeruginosa PA01
ccacgcggauaucgcuggcgc

SEQ ID NO: 1415160 - RNA, 16 nt, Pseudomonas aeruginosa PA01
ccacgcgccuggccgu

SEQ ID NO: 1415161 - RNA, 15 nt, Pseudomonas aeruginosa PA01
ccacggcggauugac

SEQ ID NO: 1415162 - RNA, 14 nt, Pseudomonas aeruginosa PA01
ccacggcggccucg

SEQ ID NO: 1415163 - RNA, 19 nt, Pseudomonas aeruginosa PA01
ccacggcgcgcuccggcgc

SEQ ID NO: 1415164 - RNA, 17 nt, Pseudomonas aeruginosa PA01
ccacggcgccuucccag

SEQ ID NO: 1415165 - RNA, 19 nt, Pseudomonas aeruginosa PA01
ccacgacgaacggcgcuuc

SEQ ID NO: 1415166 - RNA, 20 nt, Pseudomonas aeruginosa PA01
ccacgacgaacggcgcuuca

SEQ ID NO: 1415167 - RNA, 19 nt, Pseudomonas aeruginosa PA01
ccacgacgaagcgccggcg

SEQ ID NO: 1415168 - RNA, 20 nt, Pseudomonas aeruginosa PA01
ccacgacgaagcgccggcgg

SEQ ID NO: 1415169 - RNA, 15 nt, Pseudomonas aeruginosa PA01
ccacgacgucggcgg

SEQ ID NO: 1415170 - RNA, 17 nt, Pseudomonas aeruginosa PA01
ccacgaggaugucggcg

SEQ ID NO: 1415171 - RNA, 14 nt, Pseudomonas aeruginosa PA01
ccacgcagaaggcg

SEQ ID NO: 1415172 - RNA, 21 nt, Pseudomonas aeruginosa PA01
ccacgcagccacccgcgggca

SEQ ID NO: 1415173 - RNA, 15 nt, Pseudomonas aeruginosa PA01
ccacgcaauccucgg

SEQ ID NO: 1415174 - RNA, 16 nt, Pseudomonas aeruginosa PA01
ccacgcaauccucggu

SEQ ID NO: 1415175 - RNA, 17 nt, Pseudomonas aeruginosa PA01
ccacgcaccaccagguc

SEQ ID NO: 1415176 - RNA, 14 nt, Pseudomonas aeruginosa PA01
ccacgcaccagcuc

SEQ ID NO: 1415177 - RNA, 16 nt, Pseudomonas aeruginosa PA01
ccacgcaccagcuccc

SEQ ID NO: 1415178 - RNA, 18 nt, Pseudomonas aeruginosa PA01
ccacgcaccagcucccgg

SEQ ID NO: 1415179 - RNA, 23 nt, Pseudomonas aeruginosa PA01
ccacgaucugcuugcgcgccgcc

SEQ ID NO: 1415180 - RNA, 12 nt, Pseudomonas aeruginosa PA01
ccacgaucagcu

SEQ ID NO: 1415181 - RNA, 15 nt, Pseudomonas aeruginosa PA01
ccacgccgacgccga

SEQ ID NO: 1415182 - RNA, 13 nt, Pseudomonas aeruginosa PA01
ccacgccgucgca

SEQ ID NO: 1415183 - RNA, 12 nt, Pseudomonas aeruginosa PA01
ccacgccggccg

SEQ ID NO: 1415184 - RNA, 12 nt, Pseudomonas aeruginosa PA01
ccacgccggcgc

SEQ ID NO: 1415185 - RNA, 18 nt, Pseudomonas aeruginosa PA01
ccacgccggcgcuccucc

SEQ ID NO: 1415186 - RNA, 15 nt, Pseudomonas aeruginosa PA01
ccacgccgcuggcgu

SEQ ID NO: 1415187 - RNA, 14 nt, Pseudomonas aeruginosa PA01
ccacgcccgccgug

SEQ ID NO: 1415188 - RNA, 13 nt, Pseudomonas aeruginosa PA01
ccacgcccugcgc

SEQ ID NO: 1415189 - RNA, 22 nt, Pseudomonas aeruginosa PA01
ccacgccauaggcggcgcagac

SEQ ID NO: 1415190 - RNA, 18 nt, Pseudomonas aeruginosa PA01
ccacgccauucgaauggc

SEQ ID NO: 1415191 - RNA, 19 nt, Pseudomonas aeruginosa PA01
ccacgccauucgaauggcg

SEQ ID NO: 1415192 - RNA, 22 nt, Pseudomonas aeruginosa PA01
ccacgccauucgaauggcgccg

SEQ ID NO: 1415193 - RNA, 16 nt, Pseudomonas aeruginosa PA01
ccacgcauuggcuucg

SEQ ID NO: 1415194 - RNA, 16 nt, Pseudomonas aeruginosa PA01
ccacgcauugucgggc

SEQ ID NO: 1415195 - RNA, 16 nt, Pseudomonas aeruginosa PA01
ccacgcaggccagcgc

SEQ ID NO: 1415196 - RNA, 20 nt, Pseudomonas aeruginosa PA01
ccacgcaggccagcgccagg

SEQ ID NO: 1415197 - RNA, 14 nt, Pseudomonas aeruginosa PA01
ccacgcaggcgcgu

SEQ ID NO: 1415198 - RNA, 19 nt, Pseudomonas aeruginosa PA01
ccaccgugcccgccggcgc

SEQ ID NO: 1415199 - RNA, 20 nt, Pseudomonas aeruginosa PA01
ccaccgugaccagcauggcg

SEQ ID NO: 1415200 - RNA, 21 nt, Pseudomonas aeruginosa PA01
ccaccgugaccagcauggcgg

SEQ ID NO: 1415201 - RNA, 15 nt, Pseudomonas aeruginosa PA01
ccaccgucuggcgca

SEQ ID NO: 1415202 - RNA, 21 nt, Pseudomonas aeruginosa PA01
ccaccgucgcggucaucgccg

SEQ ID NO: 1415203 - RNA, 19 nt, Pseudomonas aeruginosa PA01
ccaccaucacgucgcgcac

SEQ ID NO: 1415204 - RNA, 21 nt, Pseudomonas aeruginosa PA01
ccaccaucacgucgcgcaccu

SEQ ID NO: 1415205 - RNA, 16 nt, Pseudomonas aeruginosa PA01
ccaccaucgccgcgga

SEQ ID NO: 1415206 - RNA, 19 nt, Pseudomonas aeruginosa PA01
ccaccucgacccuggcgcc

SEQ ID NO: 1415207 - RNA, 13 nt, Pseudomonas aeruginosa PA01
ccaccucgccaag

SEQ ID NO: 1415208 - RNA, 20 nt, Pseudomonas aeruginosa PA01
ccaccucgccaagcuggcga

SEQ ID NO: 1415209 - RNA, 15 nt, Pseudomonas aeruginosa PA01
ccaccucgcccucgc

SEQ ID NO: 1415210 - RNA, 16 nt, Pseudomonas aeruginosa PA01
ccaccucggcgucggc

SEQ ID NO: 1415211 - RNA, 18 nt, Pseudomonas aeruginosa PA01
ccaccucgacggcgaucu

SEQ ID NO: 1415212 - RNA, 22 nt, Pseudomonas aeruginosa PA01
ccaccucguauuccacgucgcc

SEQ ID NO: 1415213 - RNA, 17 nt, Pseudomonas aeruginosa PA01
ccaccguuccgacccgg

SEQ ID NO: 1415214 - RNA, 18 nt, Pseudomonas aeruginosa PA01
ccaccguuccgacccggc

SEQ ID NO: 1415215 - RNA, 14 nt, Pseudomonas aeruginosa PA01
ccaccgugcgcacc

SEQ ID NO: 1415216 - RNA, 15 nt, Pseudomonas aeruginosa PA01
ccaccgugcgcaccu

SEQ ID NO: 1415217 - RNA, 16 nt, Pseudomonas aeruginosa PA01
ccaccgugcgcaccuc

SEQ ID NO: 1415218 - RNA, 14 nt, Pseudomonas aeruginosa PA01
ccaccguggcgacg

SEQ ID NO: 1415219 - RNA, 17 nt, Pseudomonas aeruginosa PA01
ccaccguggcgccggcg

SEQ ID NO: 1415220 - RNA, 22 nt, Pseudomonas aeruginosa PA01
ccaccguggcgccggcgcgcuu

SEQ ID NO: 1415221 - RNA, 12 nt, Pseudomonas aeruginosa PA01
ccaccuggcgca

SEQ ID NO: 1415222 - RNA, 14 nt, Pseudomonas aeruginosa PA01
ccaccuggcgcagg

SEQ ID NO: 1415223 - RNA, 17 nt, Pseudomonas aeruginosa PA01
ccaccuggcgcagguag

SEQ ID NO: 1415224 - RNA, 20 nt, Pseudomonas aeruginosa PA01
ccaccuggcucuguuccucg

SEQ ID NO: 1415225 - RNA, 17 nt, Pseudomonas aeruginosa PA01
ccaccugcuugggcgcc

SEQ ID NO: 1415226 - RNA, 23 nt, Pseudomonas aeruginosa PA01
ccaccuggaacuugcuguugccg

SEQ ID NO: 1415227 - RNA, 13 nt, Pseudomonas aeruginosa PA01
ccaccuucgauca

SEQ ID NO: 1415228 - RNA, 13 nt, Pseudomonas aeruginosa PA01
ccaccuucgcccg

SEQ ID NO: 1415229 - RNA, 23 nt, Pseudomonas aeruginosa PA01
ccaccuucgcccgcugcgcugcc

SEQ ID NO: 1415230 - RNA, 12 nt, Pseudomonas aeruginosa PA01
ccaccuguuccg

SEQ ID NO: 1415231 - RNA, 17 nt, Pseudomonas aeruginosa PA01
ccaccuugauccgcgac

SEQ ID NO: 1415232 - RNA, 16 nt, Pseudomonas aeruginosa PA01
ccaccuugccgcgccc

SEQ ID NO: 1415233 - RNA, 20 nt, Pseudomonas aeruginosa PA01
ccaccuugccgcgcccggcc

SEQ ID NO: 1415234 - RNA, 19 nt, Pseudomonas aeruginosa PA01
ccaccuugcgguagcgcuc

SEQ ID NO: 1415235 - RNA, 19 nt, Pseudomonas aeruginosa PA01
ccacgaacaggcugugcgc

SEQ ID NO: 1415236 - RNA, 20 nt, Pseudomonas aeruginosa PA01
ccacgaagcgaccgaucaug

SEQ ID NO: 1415237 - RNA, 22 nt, Pseudomonas aeruginosa PA01
ccacgaagcgaccgaucaugcc

SEQ ID NO: 1415238 - RNA, 16 nt, Pseudomonas aeruginosa PA01
ccacgacccgcucuuc

SEQ ID NO: 1415239 - RNA, 21 nt, Pseudomonas aeruginosa PA01
ccacgacccugcuggccggug

SEQ ID NO: 1415240 - RNA, 22 nt, Pseudomonas aeruginosa PA01
ccagcccgcaauccgaccgggg

SEQ ID NO: 1415241 - RNA, 12 nt, Pseudomonas aeruginosa PA01
ccagcccgcagg

SEQ ID NO: 1415242 - RNA, 12 nt, Pseudomonas aeruginosa PA01
ccagcccgccuu

SEQ ID NO: 1415243 - RNA, 12 nt, Pseudomonas aeruginosa PA01
ccagcccgcgcg

SEQ ID NO: 1415244 - RNA, 21 nt, Pseudomonas aeruginosa PA01
ccagccccaggcgcggcgucg

SEQ ID NO: 1415245 - RNA, 13 nt, Pseudomonas aeruginosa PA01
ccagccccgccgg

SEQ ID NO: 1415246 - RNA, 14 nt, Pseudomonas aeruginosa PA01
ccagccccgccgga

SEQ ID NO: 1415247 - RNA, 16 nt, Pseudomonas aeruginosa PA01
ccagccccgccggaau

SEQ ID NO: 1415248 - RNA, 21 nt, Pseudomonas aeruginosa PA01
ccagccccgcgauugcagcuc

SEQ ID NO: 1415249 - RNA, 17 nt, Pseudomonas aeruginosa PA01
ccagccccaccgccagg

SEQ ID NO: 1415250 - RNA, 18 nt, Pseudomonas aeruginosa PA01
ccagccccaccgccaggu

SEQ ID NO: 1415251 - RNA, 14 nt, Pseudomonas aeruginosa PA01
ccagcccagcggcg

SEQ ID NO: 1415252 - RNA, 12 nt, Pseudomonas aeruginosa PA01
ccagcccagggc

SEQ ID NO: 1415253 - RNA, 18 nt, Pseudomonas aeruginosa PA01
ccagcccuggcgcggcaa

SEQ ID NO: 1415254 - RNA, 16 nt, Pseudomonas aeruginosa PA01
ccagccgacguagggc

SEQ ID NO: 1415255 - RNA, 20 nt, Pseudomonas aeruginosa PA01
ccagccgacguagggcaucg

SEQ ID NO: 1415256 - RNA, 18 nt, Pseudomonas aeruginosa PA01
ccagccgaacaguucggc

SEQ ID NO: 1415257 - RNA, 21 nt, Pseudomonas aeruginosa PA01
ccagcccggccucgccggucg

SEQ ID NO: 1415258 - RNA, 17 nt, Pseudomonas aeruginosa PA01
ccagccaguccggcagc

SEQ ID NO: 1415259 - RNA, 23 nt, Pseudomonas aeruginosa PA01
ccagccaugcaggcugccggacg

SEQ ID NO: 1415260 - RNA, 14 nt, Pseudomonas aeruginosa PA01
ccagccagccgccu

SEQ ID NO: 1415261 - RNA, 12 nt, Pseudomonas aeruginosa PA01
ccagccagcgcg

SEQ ID NO: 1415262 - RNA, 14 nt, Pseudomonas aeruginosa PA01
ccagccagcgcggc

SEQ ID NO: 1415263 - RNA, 16 nt, Pseudomonas aeruginosa PA01
ccagccagcgcggcuc

SEQ ID NO: 1415264 - RNA, 21 nt, Pseudomonas aeruginosa PA01
ccagccaggcgaugaacggcg

SEQ ID NO: 1415265 - RNA, 21 nt, Pseudomonas aeruginosa PA01
ccagccaggcgcucucgccgc

SEQ ID NO: 1415266 - RNA, 12 nt, Pseudomonas aeruginosa PA01
ccagccagggcc

SEQ ID NO: 1415267 - RNA, 13 nt, Pseudomonas aeruginosa PA01
ccagccagggccg

SEQ ID NO: 1415268 - RNA, 19 nt, Pseudomonas aeruginosa PA01
ccagccagacguccggcag

SEQ ID NO: 1415269 - RNA, 20 nt, Pseudomonas aeruginosa PA01
ccagccagacguccggcagg

SEQ ID NO: 1415270 - RNA, 12 nt, Pseudomonas aeruginosa PA01
ccagccagagcg

SEQ ID NO: 1415271 - RNA, 13 nt, Pseudomonas aeruginosa PA01
ccagccagccgcc

SEQ ID NO: 1415272 - RNA, 14 nt, Pseudomonas aeruginosa PA01
ccagccagcccgca

SEQ ID NO: 1415273 - RNA, 15 nt, Pseudomonas aeruginosa PA01
ccagccagcccucgg

SEQ ID NO: 1415274 - RNA, 23 nt, Pseudomonas aeruginosa PA01
ccagcauguuguuauggccgacc

SEQ ID NO: 1415275 - RNA, 21 nt, Pseudomonas aeruginosa PA01
ccagcauuaccccgaccaggu

SEQ ID NO: 1415276 - RNA, 16 nt, Pseudomonas aeruginosa PA01
ccagcauggcgggcca

SEQ ID NO: 1415277 - RNA, 18 nt, Pseudomonas aeruginosa PA01
ccagccaacugcuucagg

SEQ ID NO: 1415278 - RNA, 22 nt, Pseudomonas aeruginosa PA01
ccagccaacugcuucaggcgcg

SEQ ID NO: 1415279 - RNA, 17 nt, Pseudomonas aeruginosa PA01
ccagccacucccggccc

SEQ ID NO: 1415280 - RNA, 20 nt, Pseudomonas aeruginosa PA01
ccagccacugcuuggcgaac

SEQ ID NO: 1415281 - RNA, 23 nt, Pseudomonas aeruginosa PA01
ccagccacugcuuggcgaacucc

SEQ ID NO: 1415282 - RNA, 20 nt, Pseudomonas aeruginosa PA01
ccagcagcgcucacgcaccu

SEQ ID NO: 1415283 - RNA, 18 nt, Pseudomonas aeruginosa PA01
ccagcagcgcugaucacg

SEQ ID NO: 1415284 - RNA, 16 nt, Pseudomonas aeruginosa PA01
ccagcagcggcagcca

SEQ ID NO: 1415285 - RNA, 12 nt, Pseudomonas aeruginosa PA01
ccagcagcgccu

SEQ ID NO: 1415286 - RNA, 12 nt, Pseudomonas aeruginosa PA01
ccagcaggccca

SEQ ID NO: 1415287 - RNA, 13 nt, Pseudomonas aeruginosa PA01
ccagcaggcccag

SEQ ID NO: 1415288 - RNA, 14 nt, Pseudomonas aeruginosa PA01
ccagcaggcccagu

SEQ ID NO: 1415289 - RNA, 24 nt, Pseudomonas aeruginosa PA01
ccagcaggcccaguucgcugccgc

SEQ ID NO: 1415290 - RNA, 18 nt, Pseudomonas aeruginosa PA01
ccagcaggccgaaggcca

SEQ ID NO: 1415291 - RNA, 20 nt, Pseudomonas aeruginosa PA01
ccagcaggccgaaggccagg

SEQ ID NO: 1415292 - RNA, 21 nt, Pseudomonas aeruginosa PA01
ccagcaggccgaucaccagcg

SEQ ID NO: 1415293 - RNA, 16 nt, Pseudomonas aeruginosa PA01
ccagcaggccgaucag

SEQ ID NO: 1415294 - RNA, 14 nt, Pseudomonas aeruginosa PA01
ccagcaggccggcc

SEQ ID NO: 1415295 - RNA, 16 nt, Pseudomonas aeruginosa PA01
ccagcaggccggccag

SEQ ID NO: 1415296 - RNA, 19 nt, Pseudomonas aeruginosa PA01
ccagcaggccgugggccgg

SEQ ID NO: 1415297 - RNA, 12 nt, Pseudomonas aeruginosa PA01
ccagcaggcgca

SEQ ID NO: 1415298 - RNA, 18 nt, Pseudomonas aeruginosa PA01
ccagcaggcgcaggucgg

SEQ ID NO: 1415299 - RNA, 12 nt, Pseudomonas aeruginosa PA01
ccagcaggcgcc

SEQ ID NO: 1415300 - RNA, 17 nt, Pseudomonas aeruginosa PA01
ccagcaggcgcgcccug

SEQ ID NO: 1415301 - RNA, 18 nt, Pseudomonas aeruginosa PA01
ccagcaggcgcgcccuga

SEQ ID NO: 1415302 - RNA, 13 nt, Pseudomonas aeruginosa PA01
ccagcaggcgcgg

SEQ ID NO: 1415303 - RNA, 18 nt, Pseudomonas aeruginosa PA01
ccagcaggcgcgggcugg

SEQ ID NO: 1415304 - RNA, 21 nt, Pseudomonas aeruginosa PA01
ccagcaggcgcgggcuggcca

SEQ ID NO: 1415305 - RNA, 12 nt, Pseudomonas aeruginosa PA01
ccagcaggcgcu

SEQ ID NO: 1415306 - RNA, 19 nt, Pseudomonas aeruginosa PA01
ccagcaggcgcucgcugcg

SEQ ID NO: 1415307 - RNA, 18 nt, Pseudomonas aeruginosa PA01
ccagcaggcgcucggcga

SEQ ID NO: 1415308 - RNA, 21 nt, Pseudomonas aeruginosa PA01
ccagcaggcucuuggucgcgg

SEQ ID NO: 1415309 - RNA, 14 nt, Pseudomonas aeruginosa PA01
ccagcagggccagc

SEQ ID NO: 1415310 - RNA, 16 nt, Pseudomonas aeruginosa PA01
ccagcagggccagcgc

SEQ ID NO: 1415311 - RNA, 17 nt, Pseudomonas aeruginosa PA01
ccagcagggccagcgcc

SEQ ID NO: 1415312 - RNA, 16 nt, Pseudomonas aeruginosa PA01
ccagcagggccaggcc

SEQ ID NO: 1415313 - RNA, 17 nt, Pseudomonas aeruginosa PA01
ccagcagggccaggccg

SEQ ID NO: 1415314 - RNA, 19 nt, Pseudomonas aeruginosa PA01
ccagcagggccaggccgag

SEQ ID NO: 1415315 - RNA, 20 nt, Pseudomonas aeruginosa PA01
ccagcagggccaggccgagc

SEQ ID NO: 1415316 - RNA, 15 nt, Pseudomonas aeruginosa PA01
ccagcagggccgccg

SEQ ID NO: 1415317 - RNA, 16 nt, Pseudomonas aeruginosa PA01
ccagcagggccgccga

SEQ ID NO: 1415318 - RNA, 18 nt, Pseudomonas aeruginosa PA01
ccagcagggccgccgagg

SEQ ID NO: 1415319 - RNA, 20 nt, Pseudomonas aeruginosa PA01
ccagcaguggcuccgcgcgu

SEQ ID NO: 1415320 - RNA, 17 nt, Pseudomonas aeruginosa PA01
ccagcaguucgucgcca

SEQ ID NO: 1415321 - RNA, 19 nt, Pseudomonas aeruginosa PA01
ccagcaguucgucgccacg

SEQ ID NO: 1415322 - RNA, 23 nt, Pseudomonas aeruginosa PA01
ccagcaguucgucgccacgcccg

SEQ ID NO: 1415323 - RNA, 21 nt, Pseudomonas aeruginosa PA01
ccagcauaaccccuuugccga

SEQ ID NO: 1415324 - RNA, 16 nt, Pseudomonas aeruginosa PA01
ccagcagcacggcgac

SEQ ID NO: 1415325 - RNA, 13 nt, Pseudomonas aeruginosa PA01
ccagcagcacgcc

SEQ ID NO: 1415326 - RNA, 21 nt, Pseudomonas aeruginosa PA01
ccagcagcaccaucagccagc

SEQ ID NO: 1415327 - RNA, 14 nt, Pseudomonas aeruginosa PA01
ccagcagcacccgg

SEQ ID NO: 1415328 - RNA, 23 nt, Pseudomonas aeruginosa PA01
ccagcagcaacagcgccgcgcgc

SEQ ID NO: 1415329 - RNA, 13 nt, Pseudomonas aeruginosa PA01
ccagcagacgcuc

SEQ ID NO: 1415330 - RNA, 20 nt, Pseudomonas aeruginosa PA01
ccagcagacggcacgacgcc

SEQ ID NO: 1415331 - RNA, 16 nt, Pseudomonas aeruginosa PA01
ccagcacuacgcccau

SEQ ID NO: 1415332 - RNA, 13 nt, Pseudomonas aeruginosa PA01
ccagcacgccgag

SEQ ID NO: 1415333 - RNA, 14 nt, Pseudomonas aeruginosa PA01
ccagcacgccgagc

SEQ ID NO: 1415334 - RNA, 23 nt, Pseudomonas aeruginosa PA01
ccagcacgccgagcaacggcagc

SEQ ID NO: 1415335 - RNA, 16 nt, Pseudomonas aeruginosa PA01
ccagcaccuggcagug

SEQ ID NO: 1415336 - RNA, 13 nt, Pseudomonas aeruginosa PA01
ccagcaccucgcc

SEQ ID NO: 1415337 - RNA, 17 nt, Pseudomonas aeruginosa PA01
ccagcaccucgccgucg

SEQ ID NO: 1415338 - RNA, 14 nt, Pseudomonas aeruginosa PA01
ccagcaccucgcgg

SEQ ID NO: 1415339 - RNA, 20 nt, Pseudomonas aeruginosa PA01
ccagauggcuggucaggcug

SEQ ID NO: 1415340 - RNA, 20 nt, Pseudomonas aeruginosa PA01
ccagcaccugcgggcugcgu

SEQ ID NO: 1415341 - RNA, 14 nt, Pseudomonas aeruginosa PA01
ccagcaccuucacc

SEQ ID NO: 1415342 - RNA, 16 nt, Pseudomonas aeruginosa PA01
ccagcaccuucaucac

SEQ ID NO: 1415343 - RNA, 22 nt, Pseudomonas aeruginosa PA01
ccagcaccuucaucaccagguc

SEQ ID NO: 1415344 - RNA, 19 nt, Pseudomonas aeruginosa PA01
ccagcggcauucgaacggc

SEQ ID NO: 1415345 - RNA, 16 nt, Pseudomonas aeruginosa PA01
ccagcggcccggcagg

SEQ ID NO: 1415346 - RNA, 20 nt, Pseudomonas aeruginosa PA01
ccagcggcccggcaggcgca

SEQ ID NO: 1415347 - RNA, 17 nt, Pseudomonas aeruginosa PA01
ccagcggcauccgccgc

SEQ ID NO: 1415348 - RNA, 17 nt, Pseudomonas aeruginosa PA01
ccagcggcagggcggcg

SEQ ID NO: 1415349 - RNA, 15 nt, Pseudomonas aeruginosa PA01
ccagcggcagcucgg

SEQ ID NO: 1415350 - RNA, 21 nt, Pseudomonas aeruginosa PA01
ccagcggcaggcacgcugcca

SEQ ID NO: 1415351 - RNA, 21 nt, Pseudomonas aeruginosa PA01
ccagcggcagcgguucgcccg

SEQ ID NO: 1415352 - RNA, 21 nt, Pseudomonas aeruginosa PA01
ccagcggcuggcgggcgaccg

SEQ ID NO: 1415353 - RNA, 15 nt, Pseudomonas aeruginosa PA01
ccagcggcuccugga

SEQ ID NO: 1415354 - RNA, 13 nt, Pseudomonas aeruginosa PA01
ccagcggcucgcu

SEQ ID NO: 1415355 - RNA, 18 nt, Pseudomonas aeruginosa PA01
ccagcgggacgaugccga

SEQ ID NO: 1415356 - RNA, 21 nt, Pseudomonas aeruginosa PA01
ccagcggcuuguccuggcgca

SEQ ID NO: 1415357 - RNA, 20 nt, Pseudomonas aeruginosa PA01
ccagcgggaaggucggcagc

SEQ ID NO: 1415358 - RNA, 17 nt, Pseudomonas aeruginosa PA01
ccagcgcgcccggcgcc

SEQ ID NO: 1415359 - RNA, 23 nt, Pseudomonas aeruginosa PA01
ccagcgcgcccggcgccaccccg

SEQ ID NO: 1415360 - RNA, 16 nt, Pseudomonas aeruginosa PA01
ccagcgccucgccgag

SEQ ID NO: 1415361 - RNA, 14 nt, Pseudomonas aeruginosa PA01
ccagcgccucgacc

SEQ ID NO: 1415362 - RNA, 15 nt, Pseudomonas aeruginosa PA01
ccagcgccucgacca

SEQ ID NO: 1415363 - RNA, 23 nt, Pseudomonas aeruginosa PA01
ccagcgccucgaccagaucggca

SEQ ID NO: 1415364 - RNA, 16 nt, Pseudomonas aeruginosa PA01
ccagcgcgcgcuggcg

SEQ ID NO: 1415365 - RNA, 18 nt, Pseudomonas aeruginosa PA01
ccagcgcgcgcuggcgca

SEQ ID NO: 1415366 - RNA, 14 nt, Pseudomonas aeruginosa PA01
ccagcgcgcgccga

SEQ ID NO: 1415367 - RNA, 23 nt, Pseudomonas aeruginosa PA01
ccagcgcgcgccgacaggcaucg

SEQ ID NO: 1415368 - RNA, 13 nt, Pseudomonas aeruginosa PA01
ccagcgcgcgccg

SEQ ID NO: 1415369 - RNA, 13 nt, Pseudomonas aeruginosa PA01
ccagcgcgccgcg

SEQ ID NO: 1415370 - RNA, 12 nt, Pseudomonas aeruginosa PA01
ccagcggcagcg

SEQ ID NO: 1415371 - RNA, 15 nt, Pseudomonas aeruginosa PA01
ccagcgucgccgccg

SEQ ID NO: 1415372 - RNA, 16 nt, Pseudomonas aeruginosa PA01
ccagcgucgccgccgc

SEQ ID NO: 1415373 - RNA, 17 nt, Pseudomonas aeruginosa PA01
ccagcguccuucggcgc

SEQ ID NO: 1415374 - RNA, 21 nt, Pseudomonas aeruginosa PA01
ccagcgucgcgcgugccccgu

SEQ ID NO: 1415375 - RNA, 12 nt, Pseudomonas aeruginosa PA01
ccagcgucgcca

SEQ ID NO: 1415376 - RNA, 14 nt, Pseudomonas aeruginosa PA01
ccagcgucgccagg

SEQ ID NO: 1415377 - RNA, 16 nt, Pseudomonas aeruginosa PA01
ccagcgucgccaggcc

SEQ ID NO: 1415378 - RNA, 23 nt, Pseudomonas aeruginosa PA01
ccagcgucugccgcuggcggccu

SEQ ID NO: 1415379 - RNA, 15 nt, Pseudomonas aeruginosa PA01
ccagcgggcggauca

SEQ ID NO: 1415380 - RNA, 17 nt, Pseudomonas aeruginosa PA01
ccagcgggcggaucagc

SEQ ID NO: 1415381 - RNA, 19 nt, Pseudomonas aeruginosa PA01
ccagcgggcggaucagcuc

SEQ ID NO: 1415382 - RNA, 16 nt, Pseudomonas aeruginosa PA01
ccagcgguaccagcag

SEQ ID NO: 1415383 - RNA, 21 nt, Pseudomonas aeruginosa PA01
ccagcgguaccagcagcgccg

SEQ ID NO: 1415384 - RNA, 17 nt, Pseudomonas aeruginosa PA01
ccagcgguacccgccgg

SEQ ID NO: 1415385 - RNA, 18 nt, Pseudomonas aeruginosa PA01
ccagcgguacccgccggc

SEQ ID NO: 1415386 - RNA, 19 nt, Pseudomonas aeruginosa PA01
ccagcgguacccgccggcc

SEQ ID NO: 1415387 - RNA, 20 nt, Pseudomonas aeruginosa PA01
ccagcgguacccgccggcca

SEQ ID NO: 1415388 - RNA, 15 nt, Pseudomonas aeruginosa PA01
ccagcgggucgucga

SEQ ID NO: 1415389 - RNA, 20 nt, Pseudomonas aeruginosa PA01
ccagcgggucgucgaagcgc

SEQ ID NO: 1415390 - RNA, 19 nt, Pseudomonas aeruginosa PA01
ccagcgguacguagcgcgg

SEQ ID NO: 1415391 - RNA, 18 nt, Pseudomonas aeruginosa PA01
ccagcgguacuaucccgg

SEQ ID NO: 1415392 - RNA, 19 nt, Pseudomonas aeruginosa PA01
ccagcggccagggcgaggc

SEQ ID NO: 1415393 - RNA, 22 nt, Pseudomonas aeruginosa PA01
ccagcgguucaggucgaggccg

SEQ ID NO: 1415394 - RNA, 15 nt, Pseudomonas aeruginosa PA01
ccagccgccgcugca

SEQ ID NO: 1415395 - RNA, 20 nt, Pseudomonas aeruginosa PA01
ccagccgaggcagccgucgg

SEQ ID NO: 1415396 - RNA, 15 nt, Pseudomonas aeruginosa PA01
ccagccgcgccagug

SEQ ID NO: 1415397 - RNA, 13 nt, Pseudomonas aeruginosa PA01
ccagccgcggccg

SEQ ID NO: 1415398 - RNA, 14 nt, Pseudomonas aeruginosa PA01
ccagccgcggccgu

SEQ ID NO: 1415399 - RNA, 13 nt, Pseudomonas aeruginosa PA01
ccagccgcggcgc

SEQ ID NO: 1415400 - RNA, 14 nt, Pseudomonas aeruginosa PA01
ccagccgcgcgccg

SEQ ID NO: 1415401 - RNA, 15 nt, Pseudomonas aeruginosa PA01
ccagccgcgcgccgc

SEQ ID NO: 1415402 - RNA, 22 nt, Pseudomonas aeruginosa PA01
ccagccgcgcgccgcaucgcug

SEQ ID NO: 1415403 - RNA, 19 nt, Pseudomonas aeruginosa PA01
ccagccgcgcgcgucgagc

SEQ ID NO: 1415404 - RNA, 14 nt, Pseudomonas aeruginosa PA01
ccagccgcgcggca

SEQ ID NO: 1415405 - RNA, 15 nt, Pseudomonas aeruginosa PA01
ccagccgcgcggcau

SEQ ID NO: 1415406 - RNA, 13 nt, Pseudomonas aeruginosa PA01
ccagccgcacgcc

SEQ ID NO: 1415407 - RNA, 18 nt, Pseudomonas aeruginosa PA01
ccagccgccaggacggca

SEQ ID NO: 1415408 - RNA, 11 nt, Pseudomonas aeruginosa PA01
ccagccgccgc

SEQ ID NO: 1415409 - RNA, 12 nt, Pseudomonas aeruginosa PA01
ccagccgcagcc

SEQ ID NO: 1415410 - RNA, 17 nt, Pseudomonas aeruginosa PA01
ccagccgcaggcugccg

SEQ ID NO: 1415411 - RNA, 23 nt, Pseudomonas aeruginosa PA01
ccagccgcaggcugccguccagg

SEQ ID NO: 1415412 - RNA, 17 nt, Pseudomonas aeruginosa PA01
ccagcgacgcgacaucc

SEQ ID NO: 1415413 - RNA, 16 nt, Pseudomonas aeruginosa PA01
ccagcgacucgcucgc

SEQ ID NO: 1415414 - RNA, 21 nt, Pseudomonas aeruginosa PA01
ccagcgagaacuugccggcgc

SEQ ID NO: 1415415 - RNA, 23 nt, Pseudomonas aeruginosa PA01
ccagcgagaacuugccggcgcca

SEQ ID NO: 1415416 - RNA, 18 nt, Pseudomonas aeruginosa PA01
ccagcgagacgggcgagg

SEQ ID NO: 1415417 - RNA, 20 nt, Pseudomonas aeruginosa PA01
ccagcgagacgggcgaggcu

SEQ ID NO: 1415418 - RNA, 20 nt, Pseudomonas aeruginosa PA01
ccagccgcggaucaccuggc

SEQ ID NO: 1415419 - RNA, 14 nt, Pseudomonas aeruginosa PA01
ccagccgcucgcgu

SEQ ID NO: 1415420 - RNA, 18 nt, Pseudomonas aeruginosa PA01
ccagccgcucgcguccgc

SEQ ID NO: 1415421 - RNA, 12 nt, Pseudomonas aeruginosa PA01
ccagcgacgacu

SEQ ID NO: 1415422 - RNA, 12 nt, Pseudomonas aeruginosa PA01
ccagccgcucgc

SEQ ID NO: 1415423 - RNA, 13 nt, Pseudomonas aeruginosa PA01
ccagcgagccgag

SEQ ID NO: 1415424 - RNA, 15 nt, Pseudomonas aeruginosa PA01
ccagcgagccgagca

SEQ ID NO: 1415425 - RNA, 17 nt, Pseudomonas aeruginosa PA01
ccagcgagccgaucacc

SEQ ID NO: 1415426 - RNA, 19 nt, Pseudomonas aeruginosa PA01
ccagcgagcgggcgagggc

SEQ ID NO: 1415427 - RNA, 17 nt, Pseudomonas aeruginosa PA01
ccagcgcacgccgugga

SEQ ID NO: 1415428 - RNA, 15 nt, Pseudomonas aeruginosa PA01
ccagcgcaccgccaa

SEQ ID NO: 1415429 - RNA, 16 nt, Pseudomonas aeruginosa PA01
ccagcgcaccaggguc

SEQ ID NO: 1415430 - RNA, 15 nt, Pseudomonas aeruginosa PA01
ccagcgaguaggcga

SEQ ID NO: 1415431 - RNA, 21 nt, Pseudomonas aeruginosa PA01
ccagcgaguagucgcggggcg

SEQ ID NO: 1415432 - RNA, 12 nt, Pseudomonas aeruginosa PA01
ccagcgccgccu

SEQ ID NO: 1415433 - RNA, 19 nt, Pseudomonas aeruginosa PA01
ccagcgccgccucgaaggc

SEQ ID NO: 1415434 - RNA, 13 nt, Pseudomonas aeruginosa PA01
ccagcgccgccgc

SEQ ID NO: 1415435 - RNA, 20 nt, Pseudomonas aeruginosa PA01
ccagcgccgccgcugcgucg

SEQ ID NO: 1415436 - RNA, 14 nt, Pseudomonas aeruginosa PA01
ccagcgccgccagu

SEQ ID NO: 1415437 - RNA, 14 nt, Pseudomonas aeruginosa PA01
ccagcgccgccagc

SEQ ID NO: 1415438 - RNA, 17 nt, Pseudomonas aeruginosa PA01
ccagcgccgccagcagg

SEQ ID NO: 1415439 - RNA, 13 nt, Pseudomonas aeruginosa PA01
ccagcgccgccac

SEQ ID NO: 1415440 - RNA, 12 nt, Pseudomonas aeruginosa PA01
ccagcgccgcca

SEQ ID NO: 1415441 - RNA, 14 nt, Pseudomonas aeruginosa PA01
ccagcgccgccaac

SEQ ID NO: 1415442 - RNA, 11 nt, Pseudomonas aeruginosa PA01
ccagcgccgcc

SEQ ID NO: 1415443 - RNA, 13 nt, Pseudomonas aeruginosa PA01
ccagcgccgcgcu

SEQ ID NO: 1415444 - RNA, 15 nt, Pseudomonas aeruginosa PA01
ccagcgccgcgcugc

SEQ ID NO: 1415445 - RNA, 14 nt, Pseudomonas aeruginosa PA01
ccagcgccgcggcg

SEQ ID NO: 1415446 - RNA, 21 nt, Pseudomonas aeruginosa PA01
ccagcgccgcuccuccucgcu

SEQ ID NO: 1415447 - RNA, 15 nt, Pseudomonas aeruginosa PA01
ccagcgccgcggcga

SEQ ID NO: 1415448 - RNA, 16 nt, Pseudomonas aeruginosa PA01
ccagcgccgcggcgac

SEQ ID NO: 1415449 - RNA, 19 nt, Pseudomonas aeruginosa PA01
ccagcgccguacgcaccgc

SEQ ID NO: 1415450 - RNA, 21 nt, Pseudomonas aeruginosa PA01
ccagcgccguacgcaccgcgu

SEQ ID NO: 1415451 - RNA, 13 nt, Pseudomonas aeruginosa PA01
ccagcgccggcca

SEQ ID NO: 1415452 - RNA, 12 nt, Pseudomonas aeruginosa PA01
ccagcgccggcg

SEQ ID NO: 1415453 - RNA, 15 nt, Pseudomonas aeruginosa PA01
ccagcgccggcggcg

SEQ ID NO: 1415454 - RNA, 16 nt, Pseudomonas aeruginosa PA01
ccagcgccggcggcgc

SEQ ID NO: 1415455 - RNA, 23 nt, Pseudomonas aeruginosa PA01
ccagcgccggcggcgcguccacc

SEQ ID NO: 1415456 - RNA, 21 nt, Pseudomonas aeruginosa PA01
ccagcgccgagacgaucagca

SEQ ID NO: 1415457 - RNA, 14 nt, Pseudomonas aeruginosa PA01
ccagcgcaucggcg

SEQ ID NO: 1415458 - RNA, 20 nt, Pseudomonas aeruginosa PA01
ccagcgcagccugcuggccu

SEQ ID NO: 1415459 - RNA, 16 nt, Pseudomonas aeruginosa PA01
ccagcgcaucgaggcc

SEQ ID NO: 1415460 - RNA, 14 nt, Pseudomonas aeruginosa PA01
ccagcgcaggccga

SEQ ID NO: 1415461 - RNA, 19 nt, Pseudomonas aeruginosa PA01
ccagcgcaggccgaucucg

SEQ ID NO: 1415462 - RNA, 21 nt, Pseudomonas aeruginosa PA01
caucgucgaugcguccgcgca

SEQ ID NO: 1415463 - RNA, 14 nt, Pseudomonas aeruginosa PA01
caucggugccggca

SEQ ID NO: 1415464 - RNA, 14 nt, Pseudomonas aeruginosa PA01
caucgucugcgcgg

SEQ ID NO: 1415465 - RNA, 16 nt, Pseudomonas aeruginosa PA01
caucgucugcgcggcg

SEQ ID NO: 1415466 - RNA, 20 nt, Pseudomonas aeruginosa PA01
caucgucgaaacgcuggcgg

SEQ ID NO: 1415467 - RNA, 13 nt, Pseudomonas aeruginosa PA01
caucgucggcagc

SEQ ID NO: 1415468 - RNA, 15 nt, Pseudomonas aeruginosa PA01
cauccgggcggcggg

SEQ ID NO: 1415469 - RNA, 20 nt, Pseudomonas aeruginosa PA01
cauccggguccagcggccgc

SEQ ID NO: 1415470 - RNA, 14 nt, Pseudomonas aeruginosa PA01
cauccgugcugggg

SEQ ID NO: 1415471 - RNA, 20 nt, Pseudomonas aeruginosa PA01
cauccgccgcuggggaccgc

SEQ ID NO: 1415472 - RNA, 14 nt, Pseudomonas aeruginosa PA01
cauccgccggcgcg

SEQ ID NO: 1415473 - RNA, 22 nt, Pseudomonas aeruginosa PA01
cauccgccgcagaccagcgaac

SEQ ID NO: 1415474 - RNA, 14 nt, Pseudomonas aeruginosa PA01
cauccgccgcagga

SEQ ID NO: 1415475 - RNA, 17 nt, Pseudomonas aeruginosa PA01
cauccgcccugcgucgc

SEQ ID NO: 1415476 - RNA, 22 nt, Pseudomonas aeruginosa PA01
caucggguugaucgacgccagc

SEQ ID NO: 1415477 - RNA, 21 nt, Pseudomonas aeruginosa PA01
caucggcuggucgucgcggua

SEQ ID NO: 1415478 - RNA, 16 nt, Pseudomonas aeruginosa PA01
caucggcuggccgagg

SEQ ID NO: 1415479 - RNA, 20 nt, Pseudomonas aeruginosa PA01
caucggcuggccgagggcgc

SEQ ID NO: 1415480 - RNA, 12 nt, Pseudomonas aeruginosa PA01
caucucggcgca

SEQ ID NO: 1415481 - RNA, 16 nt, Pseudomonas aeruginosa PA01
caucucggccaggccc

SEQ ID NO: 1415482 - RNA, 16 nt, Pseudomonas aeruginosa PA01
caucucggcgcaggca

SEQ ID NO: 1415483 - RNA, 18 nt, Pseudomonas aeruginosa PA01
caucucgccgcgcacguc

SEQ ID NO: 1415484 - RNA, 13 nt, Pseudomonas aeruginosa PA01
caucucgccggca

SEQ ID NO: 1415485 - RNA, 15 nt, Pseudomonas aeruginosa PA01
caucuccucgcugau

SEQ ID NO: 1415486 - RNA, 14 nt, Pseudomonas aeruginosa PA01
caucuccgcggaga

SEQ ID NO: 1415487 - RNA, 13 nt, Pseudomonas aeruginosa PA01
caucugcgccggg

SEQ ID NO: 1415488 - RNA, 16 nt, Pseudomonas aeruginosa PA01
caucugccgggcgcgc

SEQ ID NO: 1415489 - RNA, 14 nt, Pseudomonas aeruginosa PA01
caucugccgggcgu

SEQ ID NO: 1415490 - RNA, 22 nt, Pseudomonas aeruginosa PA01
caucucgguguccaccaccagc

SEQ ID NO: 1415491 - RNA, 14 nt, Pseudomonas aeruginosa PA01
caucugcaacgcgg

SEQ ID NO: 1415492 - RNA, 19 nt, Pseudomonas aeruginosa PA01
caucugcaacgcggcguca

SEQ ID NO: 1415493 - RNA, 14 nt, Pseudomonas aeruginosa PA01
caucuggcugcgcg

SEQ ID NO: 1415494 - RNA, 16 nt, Pseudomonas aeruginosa PA01
caucuggcugcgcgcc

SEQ ID NO: 1415495 - RNA, 17 nt, Pseudomonas aeruginosa PA01
caucuggcugcgcgcca

SEQ ID NO: 1415496 - RNA, 15 nt, Pseudomonas aeruginosa PA01
caucugggccaucgc

SEQ ID NO: 1415497 - RNA, 13 nt, Pseudomonas aeruginosa PA01
caucuugaugccg

SEQ ID NO: 1415498 - RNA, 22 nt, Pseudomonas aeruginosa PA01
caucuucuggacaccgaugccg

SEQ ID NO: 1415499 - RNA, 19 nt, Pseudomonas aeruginosa PA01
caucuucuucaaccgcugg

SEQ ID NO: 1415500 - RNA, 20 nt, Pseudomonas aeruginosa PA01
caugaagacguacagcgggu

SEQ ID NO: 1415501 - RNA, 21 nt, Pseudomonas aeruginosa PA01
caugaagcuuuuccagcgcac

SEQ ID NO: 1415502 - RNA, 16 nt, Pseudomonas aeruginosa PA01
caugaauguggugucg

SEQ ID NO: 1415503 - RNA, 18 nt, Pseudomonas aeruginosa PA01
caugaauguggugucgca

SEQ ID NO: 1415504 - RNA, 16 nt, Pseudomonas aeruginosa PA01
caugaaaaagccccgc

SEQ ID NO: 1415505 - RNA, 20 nt, Pseudomonas aeruginosa PA01
caugaaaaagcccggccgcu

SEQ ID NO: 1415506 - RNA, 17 nt, Pseudomonas aeruginosa PA01
caugaaaaaggcgcccg

SEQ ID NO: 1415507 - RNA, 20 nt, Pseudomonas aeruginosa PA01
caugaaaaauggccgcuuca

SEQ ID NO: 1415508 - RNA, 20 nt, Pseudomonas aeruginosa PA01
caugaacacauagaccagca

SEQ ID NO: 1415509 - RNA, 15 nt, Pseudomonas aeruginosa PA01
caugaugcgcccgga

SEQ ID NO: 1415510 - RNA, 16 nt, Pseudomonas aeruginosa PA01
caugaucaucggcugg

SEQ ID NO: 1415511 - RNA, 20 nt, Pseudomonas aeruginosa PA01
caugauccggugcaggccga

SEQ ID NO: 1415512 - RNA, 17 nt, Pseudomonas aeruginosa PA01
caugagguucaggccgg

SEQ ID NO: 1415513 - RNA, 16 nt, Pseudomonas aeruginosa PA01
caugaccucggccagc

SEQ ID NO: 1415514 - RNA, 21 nt, Pseudomonas aeruginosa PA01
caugaccgagcaugcgcggca

SEQ ID NO: 1415515 - RNA, 17 nt, Pseudomonas aeruginosa PA01
caugacgaagcgcaccg

SEQ ID NO: 1415516 - RNA, 20 nt, Pseudomonas aeruginosa PA01
caugaccuucagcaccugcg

SEQ ID NO: 1415517 - RNA, 21 nt, Pseudomonas aeruginosa PA01
caugaccuucagcaccugcgc

SEQ ID NO: 1415518 - RNA, 22 nt, Pseudomonas aeruginosa PA01
caugaccuucagcaccugcgcc

SEQ ID NO: 1415519 - RNA, 14 nt, Pseudomonas aeruginosa PA01
caugagauccgcca

SEQ ID NO: 1415520 - RNA, 17 nt, Pseudomonas aeruginosa PA01
caugagauccgccagca

SEQ ID NO: 1415521 - RNA, 19 nt, Pseudomonas aeruginosa PA01
caugccguacaggucggcg

SEQ ID NO: 1415522 - RNA, 20 nt, Pseudomonas aeruginosa PA01
caugccguacaggucggcgc

SEQ ID NO: 1415523 - RNA, 21 nt, Pseudomonas aeruginosa PA01
caugccguacaggucggcgcc

SEQ ID NO: 1415524 - RNA, 19 nt, Pseudomonas aeruginosa PA01
caugccguuggccgagcgc

SEQ ID NO: 1415525 - RNA, 17 nt, Pseudomonas aeruginosa PA01
caugccguugggccagg

SEQ ID NO: 1415526 - RNA, 20 nt, Pseudomonas aeruginosa PA01
caugccguugggccagggcc

SEQ ID NO: 1415527 - RNA, 15 nt, Pseudomonas aeruginosa PA01
caugccuagcacccg

SEQ ID NO: 1415528 - RNA, 17 nt, Pseudomonas aeruginosa PA01
caugccuuccaccggcg

SEQ ID NO: 1415529 - RNA, 14 nt, Pseudomonas aeruginosa PA01
caugccuugcagcg

SEQ ID NO: 1415530 - RNA, 17 nt, Pseudomonas aeruginosa PA01
caugccuugcagcgcca

SEQ ID NO: 1415531 - RNA, 21 nt, Pseudomonas aeruginosa PA01
caugccguucaggccggcgcc

SEQ ID NO: 1415532 - RNA, 19 nt, Pseudomonas aeruginosa PA01
caugccgcaagcuccccgc

SEQ ID NO: 1415533 - RNA, 17 nt, Pseudomonas aeruginosa PA01
caugccgcaggaaccga

SEQ ID NO: 1415534 - RNA, 20 nt, Pseudomonas aeruginosa PA01
caugccgaggaacgccgaca

SEQ ID NO: 1415535 - RNA, 15 nt, Pseudomonas aeruginosa PA01
caugccgagcgaaau

SEQ ID NO: 1415536 - RNA, 17 nt, Pseudomonas aeruginosa PA01
caugccgagcaucagcg

SEQ ID NO: 1415537 - RNA, 20 nt, Pseudomonas aeruginosa PA01
caugccgagcaucagcgacu

SEQ ID NO: 1415538 - RNA, 20 nt, Pseudomonas aeruginosa PA01
caugcaggucgugcagcccg

SEQ ID NO: 1415539 - RNA, 18 nt, Pseudomonas aeruginosa PA01
caugcagcggcaugguca

SEQ ID NO: 1415540 - RNA, 12 nt, Pseudomonas aeruginosa PA01
caugcaggccga

SEQ ID NO: 1415541 - RNA, 13 nt, Pseudomonas aeruginosa PA01
caugcaggccggc

SEQ ID NO: 1415542 - RNA, 14 nt, Pseudomonas aeruginosa PA01
caugcaggccggcc

SEQ ID NO: 1415543 - RNA, 19 nt, Pseudomonas aeruginosa PA01
caugcaggccggccuccag

SEQ ID NO: 1415544 - RNA, 15 nt, Pseudomonas aeruginosa PA01
caugcccugccggcg

SEQ ID NO: 1415545 - RNA, 16 nt, Pseudomonas aeruginosa PA01
caugcccugccggcgc

SEQ ID NO: 1415546 - RNA, 17 nt, Pseudomonas aeruginosa PA01
caugcccugccggcgca

SEQ ID NO: 1415547 - RNA, 20 nt, Pseudomonas aeruginosa PA01
caugccacgcaccaccaggu

SEQ ID NO: 1415548 - RNA, 21 nt, Pseudomonas aeruginosa PA01
caugccaggagaaccuggcca

SEQ ID NO: 1415549 - RNA, 13 nt, Pseudomonas aeruginosa PA01
caugccgaagagc

SEQ ID NO: 1415550 - RNA, 14 nt, Pseudomonas aeruginosa PA01
caugcccuggccga

SEQ ID NO: 1415551 - RNA, 18 nt, Pseudomonas aeruginosa PA01
caugcccuuguccggccc

SEQ ID NO: 1415552 - RNA, 20 nt, Pseudomonas aeruginosa PA01
caugcccuugucgcccuucu

SEQ ID NO: 1415553 - RNA, 15 nt, Pseudomonas aeruginosa PA01
cauggaucaccaggg

SEQ ID NO: 1415554 - RNA, 21 nt, Pseudomonas aeruginosa PA01
cauggaucaccagggucggca

SEQ ID NO: 1415555 - RNA, 22 nt, Pseudomonas aeruginosa PA01
cauggagcaacagcgucgccaa

SEQ ID NO: 1415556 - RNA, 16 nt, Pseudomonas aeruginosa PA01
cauggagaccuggcug

SEQ ID NO: 1415557 - RNA, 19 nt, Pseudomonas aeruginosa PA01
cauggacaggucgacggcc

SEQ ID NO: 1415558 - RNA, 15 nt, Pseudomonas aeruginosa PA01
cauggaacagcagcc

SEQ ID NO: 1415559 - RNA, 20 nt, Pseudomonas aeruginosa PA01
cauggaacagcagccaggcg

SEQ ID NO: 1415560 - RNA, 20 nt, Pseudomonas aeruginosa PA01
caugcuuuugaacaccagcg

SEQ ID NO: 1415561 - RNA, 17 nt, Pseudomonas aeruginosa PA01
cauggaaaccccggccu

SEQ ID NO: 1415562 - RNA, 21 nt, Pseudomonas aeruginosa PA01
caugcgcggcguaccuucgag

SEQ ID NO: 1415563 - RNA, 19 nt, Pseudomonas aeruginosa PA01
caugcuguugcacuugccg

SEQ ID NO: 1415564 - RNA, 21 nt, Pseudomonas aeruginosa PA01
caugcuguugccguggcggcg

SEQ ID NO: 1415565 - RNA, 23 nt, Pseudomonas aeruginosa PA01
caugcgaaaacggcgacccuggg

SEQ ID NO: 1415566 - RNA, 17 nt, Pseudomonas aeruginosa PA01
caugcgcagcgcguuga

SEQ ID NO: 1415567 - RNA, 19 nt, Pseudomonas aeruginosa PA01
caugcgcguguugcgccgc

SEQ ID NO: 1415568 - RNA, 22 nt, Pseudomonas aeruginosa PA01
caugcgcggcaggaaauccgcc

SEQ ID NO: 1415569 - RNA, 23 nt, Pseudomonas aeruginosa PA01
cauggcgcgaugcucccgagcaa

SEQ ID NO: 1415570 - RNA, 12 nt, Pseudomonas aeruginosa PA01
cauggcgcucga

SEQ ID NO: 1415571 - RNA, 15 nt, Pseudomonas aeruginosa PA01
cauggccagcucgac

SEQ ID NO: 1415572 - RNA, 16 nt, Pseudomonas aeruginosa PA01
cauggccagcucgacc

SEQ ID NO: 1415573 - RNA, 17 nt, Pseudomonas aeruginosa PA01
cauggccgaccgccagg

SEQ ID NO: 1415574 - RNA, 18 nt, Pseudomonas aeruginosa PA01
cauggccgaccgccaggc

SEQ ID NO: 1415575 - RNA, 23 nt, Pseudomonas aeruginosa PA01
cauggccgaccgccaggccgacc

SEQ ID NO: 1415576 - RNA, 22 nt, Pseudomonas aeruginosa PA01
cauggccgagcccagcggcagg

SEQ ID NO: 1415577 - RNA, 13 nt, Pseudomonas aeruginosa PA01
cauggccgcagcg

SEQ ID NO: 1415578 - RNA, 13 nt, Pseudomonas aeruginosa PA01
cauggcgccgcca

SEQ ID NO: 1415579 - RNA, 17 nt, Pseudomonas aeruginosa PA01
caugggugucggcgauc

SEQ ID NO: 1415580 - RNA, 20 nt, Pseudomonas aeruginosa PA01
caugggugucggcgaucagg

SEQ ID NO: 1415581 - RNA, 13 nt, Pseudomonas aeruginosa PA01
cauggcgucggcg

SEQ ID NO: 1415582 - RNA, 14 nt, Pseudomonas aeruginosa PA01
cauggcgucggcga

SEQ ID NO: 1415583 - RNA, 16 nt, Pseudomonas aeruginosa PA01
cauggcgguuccucca

SEQ ID NO: 1415584 - RNA, 21 nt, Pseudomonas aeruginosa PA01
cauggcggucagaucagcggg

SEQ ID NO: 1415585 - RNA, 13 nt, Pseudomonas aeruginosa PA01
caugguccgucgc

SEQ ID NO: 1415586 - RNA, 21 nt, Pseudomonas aeruginosa PA01
cauggucucgcugacccaggc

SEQ ID NO: 1415587 - RNA, 20 nt, Pseudomonas aeruginosa PA01
cauguaggcgcaccaggcca

SEQ ID NO: 1415588 - RNA, 21 nt, Pseudomonas aeruginosa PA01
cauguaggcgcaccaggccag

SEQ ID NO: 1415589 - RNA, 20 nt, Pseudomonas aeruginosa PA01
cauggucuucccagaccccg

SEQ ID NO: 1415590 - RNA, 16 nt, Pseudomonas aeruginosa PA01
ccaacugcgcccccag

SEQ ID NO: 1415591 - RNA, 17 nt, Pseudomonas aeruginosa PA01
ccaacugcuucaggcgc

SEQ ID NO: 1415592 - RNA, 16 nt, Pseudomonas aeruginosa PA01
ccaacuggcggaugcg

SEQ ID NO: 1415593 - RNA, 14 nt, Pseudomonas aeruginosa PA01
ccaacuggcggcug

SEQ ID NO: 1415594 - RNA, 15 nt, Pseudomonas aeruginosa PA01
ccaacuggcggcugg

SEQ ID NO: 1415595 - RNA, 23 nt, Pseudomonas aeruginosa PA01
ccaacuggcguccccaugcccgg

SEQ ID NO: 1415596 - RNA, 17 nt, Pseudomonas aeruginosa PA01
ccaacuggcugucgagc

SEQ ID NO: 1415597 - RNA, 17 nt, Pseudomonas aeruginosa PA01
ccaagagagcgccagcg

SEQ ID NO: 1415598 - RNA, 19 nt, Pseudomonas aeruginosa PA01
ccaagagagcgccagcgag

SEQ ID NO: 1415599 - RNA, 19 nt, Pseudomonas aeruginosa PA01
ccaagccgagcggcaaggc

SEQ ID NO: 1415600 - RNA, 16 nt, Pseudomonas aeruginosa PA01
ccaagccaccagcgac

SEQ ID NO: 1415601 - RNA, 17 nt, Pseudomonas aeruginosa PA01
ccaagcgagacgccgcc

SEQ ID NO: 1415602 - RNA, 18 nt, Pseudomonas aeruginosa PA01
ccaagucggccgcccagc

SEQ ID NO: 1415603 - RNA, 16 nt, Pseudomonas aeruginosa PA01
ccaacguccucgaugc

SEQ ID NO: 1415604 - RNA, 16 nt, Pseudomonas aeruginosa PA01
ccaacgguagcggauc

SEQ ID NO: 1415605 - RNA, 19 nt, Pseudomonas aeruginosa PA01
ccaacgguagcggaucagc

SEQ ID NO: 1415606 - RNA, 23 nt, Pseudomonas aeruginosa PA01
ccaacgguagcggaucagccggc

SEQ ID NO: 1415607 - RNA, 20 nt, Pseudomonas aeruginosa PA01
ccaacggcguguccaggguc

SEQ ID NO: 1415608 - RNA, 19 nt, Pseudomonas aeruginosa PA01
ccaacggcguuauccgccg

SEQ ID NO: 1415609 - RNA, 20 nt, Pseudomonas aeruginosa PA01
ccaacggcguuauccgccgc

SEQ ID NO: 1415610 - RNA, 15 nt, Pseudomonas aeruginosa PA01
ccaacgggcucgugc

SEQ ID NO: 1415611 - RNA, 14 nt, Pseudomonas aeruginosa PA01
ccaacucggccugg

SEQ ID NO: 1415612 - RNA, 16 nt, Pseudomonas aeruginosa PA01
ccaacuccagcucgac

SEQ ID NO: 1415613 - RNA, 14 nt, Pseudomonas aeruginosa PA01
ccaacgcccgggcc

SEQ ID NO: 1415614 - RNA, 17 nt, Pseudomonas aeruginosa PA01
ccaacgccaccgcgcgc

SEQ ID NO: 1415615 - RNA, 12 nt, Pseudomonas aeruginosa PA01
ccaacgcaggcg

SEQ ID NO: 1415616 - RNA, 14 nt, Pseudomonas aeruginosa PA01
ccaacgcaggcgca

SEQ ID NO: 1415617 - RNA, 18 nt, Pseudomonas aeruginosa PA01
ccaacggaaaaaggcgcc

SEQ ID NO: 1415618 - RNA, 12 nt, Pseudomonas aeruginosa PA01
ccaacgcgccgu

SEQ ID NO: 1415619 - RNA, 22 nt, Pseudomonas aeruginosa PA01
ccacaccugcaacacgucggac

SEQ ID NO: 1415620 - RNA, 13 nt, Pseudomonas aeruginosa PA01
ccacaugggcgac

SEQ ID NO: 1415621 - RNA, 14 nt, Pseudomonas aeruginosa PA01
ccaccagccagcuc

SEQ ID NO: 1415622 - RNA, 18 nt, Pseudomonas aeruginosa PA01
ccaccagccagcucggcg

SEQ ID NO: 1415623 - RNA, 21 nt, Pseudomonas aeruginosa PA01
ccaccagcaucaccaccggga

SEQ ID NO: 1415624 - RNA, 11 nt, Pseudomonas aeruginosa PA01
ccaccagcccg

SEQ ID NO: 1415625 - RNA, 22 nt, Pseudomonas aeruginosa PA01
ccaccacucgcgagcuggcgcc

SEQ ID NO: 1415626 - RNA, 23 nt, Pseudomonas aeruginosa PA01
ccaccacucgcgagcuggcgccg

SEQ ID NO: 1415627 - RNA, 19 nt, Pseudomonas aeruginosa PA01
ccaccagaaggcgggcagc

SEQ ID NO: 1415628 - RNA, 12 nt, Pseudomonas aeruginosa PA01
ccaccaggucgc

SEQ ID NO: 1415629 - RNA, 13 nt, Pseudomonas aeruginosa PA01
ccaccaggucgcc

SEQ ID NO: 1415630 - RNA, 17 nt, Pseudomonas aeruginosa PA01
ccaccaggucgccguag

SEQ ID NO: 1415631 - RNA, 18 nt, Pseudomonas aeruginosa PA01
ccaccaggucggcgcgcg

SEQ ID NO: 1415632 - RNA, 22 nt, Pseudomonas aeruginosa PA01
ccaccagggucgguucgcggcg

SEQ ID NO: 1415633 - RNA, 23 nt, Pseudomonas aeruginosa PA01
ccaccagggucgguucgcggcgc

SEQ ID NO: 1415634 - RNA, 21 nt, Pseudomonas aeruginosa PA01
ccaccagggugcgauggaugc

SEQ ID NO: 1415635 - RNA, 14 nt, Pseudomonas aeruginosa PA01
ccaccaggcgccgg

SEQ ID NO: 1415636 - RNA, 14 nt, Pseudomonas aeruginosa PA01
ccaccagggccucg

SEQ ID NO: 1415637 - RNA, 18 nt, Pseudomonas aeruginosa PA01
ccaccagggccucggggc

SEQ ID NO: 1415638 - RNA, 20 nt, Pseudomonas aeruginosa PA01
ccaccagggccuugccgcga

SEQ ID NO: 1415639 - RNA, 17 nt, Pseudomonas aeruginosa PA01
ccaccaggcggucgcgg

SEQ ID NO: 1415640 - RNA, 13 nt, Pseudomonas aeruginosa PA01
ccaccaggccgcu

SEQ ID NO: 1415641 - RNA, 16 nt, Pseudomonas aeruginosa PA01
ccaccaggccgcugcc

SEQ ID NO: 1415642 - RNA, 22 nt, Pseudomonas aeruginosa PA01
ccaccaggccgcugccgccgcg

SEQ ID NO: 1415643 - RNA, 16 nt, Pseudomonas aeruginosa PA01
cauucucgcgacccug

SEQ ID NO: 1415644 - RNA, 13 nt, Pseudomonas aeruginosa PA01
cauucgucgccgc

SEQ ID NO: 1415645 - RNA, 15 nt, Pseudomonas aeruginosa PA01
cauucuccagccgca

SEQ ID NO: 1415646 - RNA, 16 nt, Pseudomonas aeruginosa PA01
cauucucccucgccga

SEQ ID NO: 1415647 - RNA, 17 nt, Pseudomonas aeruginosa PA01
cauucucccucgccgac

SEQ ID NO: 1415648 - RNA, 15 nt, Pseudomonas aeruginosa PA01
cauucguccagccgc

SEQ ID NO: 1415649 - RNA, 23 nt, Pseudomonas aeruginosa PA01
cauuccagaaacggcugccggua

SEQ ID NO: 1415650 - RNA, 19 nt, Pseudomonas aeruginosa PA01
cauuccgacaaggagcgcg

SEQ ID NO: 1415651 - RNA, 15 nt, Pseudomonas aeruginosa PA01
cauuccaccuuggca

SEQ ID NO: 1415652 - RNA, 15 nt, Pseudomonas aeruginosa PA01
cauguccucggcgcc

SEQ ID NO: 1415653 - RNA, 13 nt, Pseudomonas aeruginosa PA01
cauguccugcagg

SEQ ID NO: 1415654 - RNA, 17 nt, Pseudomonas aeruginosa PA01
cauguccugcaggcuca

SEQ ID NO: 1415655 - RNA, 19 nt, Pseudomonas aeruginosa PA01
cauguccgaacgcgagguc

SEQ ID NO: 1415656 - RNA, 20 nt, Pseudomonas aeruginosa PA01
cauguccgaacgcgaggucu

SEQ ID NO: 1415657 - RNA, 16 nt, Pseudomonas aeruginosa PA01
cauggugcccagcagg

SEQ ID NO: 1415658 - RNA, 17 nt, Pseudomonas aeruginosa PA01
cauggugcccagcaggc

SEQ ID NO: 1415659 - RNA, 17 nt, Pseudomonas aeruginosa PA01
cauguccaccgccgcca

SEQ ID NO: 1415660 - RNA, 20 nt, Pseudomonas aeruginosa PA01
cauguccagccaguggcugg

SEQ ID NO: 1415661 - RNA, 13 nt, Pseudomonas aeruginosa PA01
cauugaaggccga

SEQ ID NO: 1415662 - RNA, 21 nt, Pseudomonas aeruginosa PA01
cauucuggaugcagccggggc

SEQ ID NO: 1415663 - RNA, 17 nt, Pseudomonas aeruginosa PA01
cauugaaaacggcgccc

SEQ ID NO: 1415664 - RNA, 18 nt, Pseudomonas aeruginosa PA01
cauugccgaugugcacgc

SEQ ID NO: 1415665 - RNA, 13 nt, Pseudomonas aeruginosa PA01
cauugccgccagg

SEQ ID NO: 1415666 - RNA, 14 nt, Pseudomonas aeruginosa PA01
cauugccgccaggu

SEQ ID NO: 1415667 - RNA, 21 nt, Pseudomonas aeruginosa PA01
cauugccgggcuuccuggccg

SEQ ID NO: 1415668 - RNA, 15 nt, Pseudomonas aeruginosa PA01
cauuggccaucagcg

SEQ ID NO: 1415669 - RNA, 17 nt, Pseudomonas aeruginosa PA01
cauuggccaucagcgcc

SEQ ID NO: 1415670 - RNA, 18 nt, Pseudomonas aeruginosa PA01
cauuggccaucagcgccg

SEQ ID NO: 1415671 - RNA, 22 nt, Pseudomonas aeruginosa PA01
cauuggccaggccccaggccgc

SEQ ID NO: 1415672 - RNA, 16 nt, Pseudomonas aeruginosa PA01
cauuggcgcgucggug

SEQ ID NO: 1415673 - RNA, 20 nt, Pseudomonas aeruginosa PA01
cauuuucgcgcucagcgcga

SEQ ID NO: 1415674 - RNA, 16 nt, Pseudomonas aeruginosa PA01
ccaaagaaaaggcccg

SEQ ID NO: 1415675 - RNA, 16 nt, Pseudomonas aeruginosa PA01
cauuguugcggucgcg

SEQ ID NO: 1415676 - RNA, 23 nt, Pseudomonas aeruginosa PA01
cauuuguuuuaaaguucgacgau

SEQ ID NO: 1415677 - RNA, 19 nt, Pseudomonas aeruginosa PA01
ccaacccggccagcccggc

SEQ ID NO: 1415678 - RNA, 23 nt, Pseudomonas aeruginosa PA01
ccaacccggccagcccggccucg

SEQ ID NO: 1415679 - RNA, 15 nt, Pseudomonas aeruginosa PA01
ccaaaguucaguagc

SEQ ID NO: 1415680 - RNA, 24 nt, Pseudomonas aeruginosa PA01
ccaacccucggaugccgcacaggc

SEQ ID NO: 1415681 - RNA, 16 nt, Pseudomonas aeruginosa PA01
ccaaccgggcaucgcc

SEQ ID NO: 1415682 - RNA, 19 nt, Pseudomonas aeruginosa PA01
ccaaccgggcaucgccgac

SEQ ID NO: 1415683 - RNA, 13 nt, Pseudomonas aeruginosa PA01
ccaaccgucgccc

SEQ ID NO: 1415684 - RNA, 19 nt, Pseudomonas aeruginosa PA01
ccaaccguucugccgcagc

SEQ ID NO: 1415685 - RNA, 20 nt, Pseudomonas aeruginosa PA01
ccaaccguucugccgcagcg

SEQ ID NO: 1415686 - RNA, 16 nt, Pseudomonas aeruginosa PA01
cagcguggccagcgcc

SEQ ID NO: 1415687 - RNA, 19 nt, Pseudomonas aeruginosa PA01
cagcguggccagcgcccag

SEQ ID NO: 1415688 - RNA, 21 nt, Pseudomonas aeruginosa PA01
cagcgucguaguggcgcaaca

SEQ ID NO: 1415689 - RNA, 14 nt, Pseudomonas aeruginosa PA01
cagcgucucggcug

SEQ ID NO: 1415690 - RNA, 16 nt, Pseudomonas aeruginosa PA01
cagcgucugccgcugg

SEQ ID NO: 1415691 - RNA, 14 nt, Pseudomonas aeruginosa PA01
cagcgucaccgcgu

SEQ ID NO: 1415692 - RNA, 18 nt, Pseudomonas aeruginosa PA01
cagcgucaccgcgucggg

SEQ ID NO: 1415693 - RNA, 16 nt, Pseudomonas aeruginosa PA01
cagcgggucgcggcug

SEQ ID NO: 1415694 - RNA, 20 nt, Pseudomonas aeruginosa PA01
cagcgggucgcggcuggccg

SEQ ID NO: 1415695 - RNA, 23 nt, Pseudomonas aeruginosa PA01
cagcgggucgcggcuggccgccu

SEQ ID NO: 1415696 - RNA, 14 nt, Pseudomonas aeruginosa PA01
cagcgggucggcga

SEQ ID NO: 1415697 - RNA, 23 nt, Pseudomonas aeruginosa PA01
cagcgggucgucgaagcgcagca

SEQ ID NO: 1415698 - RNA, 18 nt, Pseudomonas aeruginosa PA01
cagcguggcgcgcaucgg

SEQ ID NO: 1415699 - RNA, 21 nt, Pseudomonas aeruginosa PA01
cagcgugggcaacaggccgau

SEQ ID NO: 1415700 - RNA, 12 nt, Pseudomonas aeruginosa PA01
cagcguggcgga

SEQ ID NO: 1415701 - RNA, 16 nt, Pseudomonas aeruginosa PA01
cagcguucacgcgacc

SEQ ID NO: 1415702 - RNA, 14 nt, Pseudomonas aeruginosa PA01
cagcucaccccagg

SEQ ID NO: 1415703 - RNA, 16 nt, Pseudomonas aeruginosa PA01
cagcuccgaagggaac

SEQ ID NO: 1415704 - RNA, 17 nt, Pseudomonas aeruginosa PA01
cagcucccuugccgccg

SEQ ID NO: 1415705 - RNA, 16 nt, Pseudomonas aeruginosa PA01
cagcucagcuccaggc

SEQ ID NO: 1415706 - RNA, 16 nt, Pseudomonas aeruginosa PA01
cagcucagcaggucgc

SEQ ID NO: 1415707 - RNA, 21 nt, Pseudomonas aeruginosa PA01
cagcggcgccaacucggccug

SEQ ID NO: 1415708 - RNA, 23 nt, Pseudomonas aeruginosa PA01
cagcggcgccagcuccagcgccc

SEQ ID NO: 1415709 - RNA, 13 nt, Pseudomonas aeruginosa PA01
cagcggcgaucgc

SEQ ID NO: 1415710 - RNA, 15 nt, Pseudomonas aeruginosa PA01
cagcggcgaucgccu

SEQ ID NO: 1415711 - RNA, 16 nt, Pseudomonas aeruginosa PA01
cagcggcgacaccgcc

SEQ ID NO: 1415712 - RNA, 23 nt, Pseudomonas aeruginosa PA01
cagcggcgacaccgccagcaccu

SEQ ID NO: 1415713 - RNA, 17 nt, Pseudomonas aeruginosa PA01
cagcggcgagcaggcga

SEQ ID NO: 1415714 - RNA, 13 nt, Pseudomonas aeruginosa PA01
cagcggccuucga

SEQ ID NO: 1415715 - RNA, 14 nt, Pseudomonas aeruginosa PA01
cagcggccuucgac

SEQ ID NO: 1415716 - RNA, 18 nt, Pseudomonas aeruginosa PA01
cagcggcgaacccucggu

SEQ ID NO: 1415717 - RNA, 22 nt, Pseudomonas aeruginosa PA01
cagcggccgagcaggcgcgcca

SEQ ID NO: 1415718 - RNA, 14 nt, Pseudomonas aeruginosa PA01
cagcggccgcgagc

SEQ ID NO: 1415719 - RNA, 22 nt, Pseudomonas aeruginosa PA01
cagcggccgcgagcgcggccgg

SEQ ID NO: 1415720 - RNA, 13 nt, Pseudomonas aeruginosa PA01
cagcggcccgagc

SEQ ID NO: 1415721 - RNA, 14 nt, Pseudomonas aeruginosa PA01
cagcggcccgagca

SEQ ID NO: 1415722 - RNA, 15 nt, Pseudomonas aeruginosa PA01
cagcggcccgagcag

SEQ ID NO: 1415723 - RNA, 23 nt, Pseudomonas aeruginosa PA01
cagcggcccgagcaggcugccga

SEQ ID NO: 1415724 - RNA, 18 nt, Pseudomonas aeruginosa PA01
cagcggcccggcaggcgc

SEQ ID NO: 1415725 - RNA, 14 nt, Pseudomonas aeruginosa PA01
cagcggccccgagc

SEQ ID NO: 1415726 - RNA, 14 nt, Pseudomonas aeruginosa PA01
cagcggccagggcg

SEQ ID NO: 1415727 - RNA, 13 nt, Pseudomonas aeruginosa PA01
cagcggcccagcg

SEQ ID NO: 1415728 - RNA, 23 nt, Pseudomonas aeruginosa PA01
cagcggcaggucguugacgaucu

SEQ ID NO: 1415729 - RNA, 14 nt, Pseudomonas aeruginosa PA01
cagcggcagggcgg

SEQ ID NO: 1415730 - RNA, 16 nt, Pseudomonas aeruginosa PA01
cagcggcagcucggcg

SEQ ID NO: 1415731 - RNA, 17 nt, Pseudomonas aeruginosa PA01
cagcggcagcucggcga

SEQ ID NO: 1415732 - RNA, 13 nt, Pseudomonas aeruginosa PA01
cagcggcagcguc

SEQ ID NO: 1415733 - RNA, 15 nt, Pseudomonas aeruginosa PA01
cagcggcaugcccug

SEQ ID NO: 1415734 - RNA, 17 nt, Pseudomonas aeruginosa PA01
cagcggcaugcccugcc

SEQ ID NO: 1415735 - RNA, 22 nt, Pseudomonas aeruginosa PA01
cagcggcaugcccugccggcgc

SEQ ID NO: 1415736 - RNA, 21 nt, Pseudomonas aeruginosa PA01
cagcggcucgucaucguccag

SEQ ID NO: 1415737 - RNA, 14 nt, Pseudomonas aeruginosa PA01
cagcggcugcccgg

SEQ ID NO: 1415738 - RNA, 22 nt, Pseudomonas aeruginosa PA01
cagcggcugcccgggguuggcg

SEQ ID NO: 1415739 - RNA, 13 nt, Pseudomonas aeruginosa PA01
cagcggcugcggg

SEQ ID NO: 1415740 - RNA, 23 nt, Pseudomonas aeruginosa PA01
cagcggcuggcccucggcguuca

SEQ ID NO: 1415741 - RNA, 13 nt, Pseudomonas aeruginosa PA01
cagcggcuggccg

SEQ ID NO: 1415742 - RNA, 16 nt, Pseudomonas aeruginosa PA01
cagcggcuggccgucg

SEQ ID NO: 1415743 - RNA, 13 nt, Pseudomonas aeruginosa PA01
cagcggcuggcga

SEQ ID NO: 1415744 - RNA, 19 nt, Pseudomonas aeruginosa PA01
cagcggcuggcgaugcuga

SEQ ID NO: 1415745 - RNA, 13 nt, Pseudomonas aeruginosa PA01
cagcggcuggcgc

SEQ ID NO: 1415746 - RNA, 22 nt, Pseudomonas aeruginosa PA01
cagcggcuggcgggcgaccgga

SEQ ID NO: 1415747 - RNA, 18 nt, Pseudomonas aeruginosa PA01
cagcggcuuguccuggcg

SEQ ID NO: 1415748 - RNA, 20 nt, Pseudomonas aeruginosa PA01
cagcggcuuguccuggcgca

SEQ ID NO: 1415749 - RNA, 23 nt, Pseudomonas aeruginosa PA01
cagcgggaaggucggcagcagcu

SEQ ID NO: 1415750 - RNA, 17 nt, Pseudomonas aeruginosa PA01
cagcggcgcuugcgggc

SEQ ID NO: 1415751 - RNA, 14 nt, Pseudomonas aeruginosa PA01
cagcggcgcgucga

SEQ ID NO: 1415752 - RNA, 22 nt, Pseudomonas aeruginosa PA01
cagcggcgcgucgaccacgaag

SEQ ID NO: 1415753 - RNA, 14 nt, Pseudomonas aeruginosa PA01
cagcggcgcgucgc

SEQ ID NO: 1415754 - RNA, 16 nt, Pseudomonas aeruginosa PA01
cagcggcggcgccggc

SEQ ID NO: 1415755 - RNA, 17 nt, Pseudomonas aeruginosa PA01
cagcggcggcgccggca

SEQ ID NO: 1415756 - RNA, 21 nt, Pseudomonas aeruginosa PA01
cagcggcggauacaggcgcag

SEQ ID NO: 1415757 - RNA, 23 nt, Pseudomonas aeruginosa PA01
cagcggcggauacaggcgcagca

SEQ ID NO: 1415758 - RNA, 20 nt, Pseudomonas aeruginosa PA01
cagcggcgguagcuccaggc

SEQ ID NO: 1415759 - RNA, 23 nt, Pseudomonas aeruginosa PA01
cagcggcgguagcuccaggccga

SEQ ID NO: 1415760 - RNA, 12 nt, Pseudomonas aeruginosa PA01
cagcggcggucc

SEQ ID NO: 1415761 - RNA, 21 nt, Pseudomonas aeruginosa PA01
cagcggcgggaaacgcagcga

SEQ ID NO: 1415762 - RNA, 18 nt, Pseudomonas aeruginosa PA01
cagcggcucacgccccag

SEQ ID NO: 1415763 - RNA, 22 nt, Pseudomonas aeruginosa PA01
cagcggcuccucggccugggcg

SEQ ID NO: 1415764 - RNA, 24 nt, Pseudomonas aeruginosa PA01
cagcggcuccucggccugggcgca

SEQ ID NO: 1415765 - RNA, 20 nt, Pseudomonas aeruginosa PA01
cagcggcgugaagccgccgc

SEQ ID NO: 1415766 - RNA, 22 nt, Pseudomonas aeruginosa PA01
cagcggcgugaagccgccgccc

SEQ ID NO: 1415767 - RNA, 23 nt, Pseudomonas aeruginosa PA01
cagcggcgugaagccgccgccca

SEQ ID NO: 1415768 - RNA, 21 nt, Pseudomonas aeruginosa PA01
cagcggcguauccucggccau

SEQ ID NO: 1415769 - RNA, 20 nt, Pseudomonas aeruginosa PA01
cagcggcguaugcgccucca

SEQ ID NO: 1415770 - RNA, 23 nt, Pseudomonas aeruginosa PA01
cagcggcguaugcgccuccaggu

SEQ ID NO: 1415771 - RNA, 14 nt, Pseudomonas aeruginosa PA01
cagcggcagcgucu

SEQ ID NO: 1415772 - RNA, 20 nt, Pseudomonas aeruginosa PA01
cagcggcagcgucucggcug

SEQ ID NO: 1415773 - RNA, 20 nt, Pseudomonas aeruginosa PA01
cagcggcagccacucggcca

SEQ ID NO: 1415774 - RNA, 22 nt, Pseudomonas aeruginosa PA01
cagcggcagccacucggccagg

SEQ ID NO: 1415775 - RNA, 14 nt, Pseudomonas aeruginosa PA01
cagcggcagcgcca

SEQ ID NO: 1415776 - RNA, 16 nt, Pseudomonas aeruginosa PA01
cagcggcagcgccagg

SEQ ID NO: 1415777 - RNA, 16 nt, Pseudomonas aeruginosa PA01
cagcggaugcuggcgg

SEQ ID NO: 1415778 - RNA, 20 nt, Pseudomonas aeruginosa PA01
cagcggcaaaggcccggcgc

SEQ ID NO: 1415779 - RNA, 13 nt, Pseudomonas aeruginosa PA01
cagcggcaccagc

SEQ ID NO: 1415780 - RNA, 17 nt, Pseudomonas aeruginosa PA01
cagcggcacccggcugg

SEQ ID NO: 1415781 - RNA, 17 nt, Pseudomonas aeruginosa PA01
cagcggaccggugagau

SEQ ID NO: 1415782 - RNA, 14 nt, Pseudomonas aeruginosa PA01
cagcggaccgucgg

SEQ ID NO: 1415783 - RNA, 14 nt, Pseudomonas aeruginosa PA01
cagcggacgcagcg

SEQ ID NO: 1415784 - RNA, 19 nt, Pseudomonas aeruginosa PA01
cagcggaggauucagcagg

SEQ ID NO: 1415785 - RNA, 20 nt, Pseudomonas aeruginosa PA01
cagcggaggauucagcagga

SEQ ID NO: 1415786 - RNA, 21 nt, Pseudomonas aeruginosa PA01
cagcggauauucgacgcgcgg

SEQ ID NO: 1415787 - RNA, 22 nt, Pseudomonas aeruginosa PA01
cagcggauauucgacgcgcggc

SEQ ID NO: 1415788 - RNA, 23 nt, Pseudomonas aeruginosa PA01
cagcggauauucgacgcgcggcu

SEQ ID NO: 1415789 - RNA, 13 nt, Pseudomonas aeruginosa PA01
cagcggaucggcg

SEQ ID NO: 1415790 - RNA, 12 nt, Pseudomonas aeruginosa PA01
cagcggaucggc

SEQ ID NO: 1415791 - RNA, 20 nt, Pseudomonas aeruginosa PA01
cagcggacaaccgccguagc

SEQ ID NO: 1415792 - RNA, 14 nt, Pseudomonas aeruginosa PA01
cagcgcuugcuggc

SEQ ID NO: 1415793 - RNA, 18 nt, Pseudomonas aeruginosa PA01
cagcgcuugcuggcgcga

SEQ ID NO: 1415794 - RNA, 20 nt, Pseudomonas aeruginosa PA01
cagcgcuuguagcagccgca

SEQ ID NO: 1415795 - RNA, 22 nt, Pseudomonas aeruginosa PA01
cagcggaagcccagcaggucga

SEQ ID NO: 1415796 - RNA, 14 nt, Pseudomonas aeruginosa PA01
cagcggaagcccug

SEQ ID NO: 1415797 - RNA, 22 nt, Pseudomonas aeruginosa PA01
cagcggaaaugcucgccguccg

SEQ ID NO: 1415798 - RNA, 16 nt, Pseudomonas aeruginosa PA01
cagcgcugaucacgau

SEQ ID NO: 1415799 - RNA, 21 nt, Pseudomonas aeruginosa PA01
cagcgcugaucacgaucggca

SEQ ID NO: 1415800 - RNA, 12 nt, Pseudomonas aeruginosa PA01
cagcgcugccuc

SEQ ID NO: 1415801 - RNA, 15 nt, Pseudomonas aeruginosa PA01
cagcgcuggcgauca

SEQ ID NO: 1415802 - RNA, 18 nt, Pseudomonas aeruginosa PA01
cagcgcuggcgaucacca

SEQ ID NO: 1415803 - RNA, 20 nt, Pseudomonas aeruginosa PA01
cagcgcuggcgaucaccagg

SEQ ID NO: 1415804 - RNA, 19 nt, Pseudomonas aeruginosa PA01
cagcgcucguagccggcgc

SEQ ID NO: 1415805 - RNA, 22 nt, Pseudomonas aeruginosa PA01
cagcgcucguagccggcgcggc

SEQ ID NO: 1415806 - RNA, 23 nt, Pseudomonas aeruginosa PA01
cagcgcucguagccggcgcggcg

SEQ ID NO: 1415807 - RNA, 19 nt, Pseudomonas aeruginosa PA01
cagcgcuccuugcgccagg

SEQ ID NO: 1415808 - RNA, 20 nt, Pseudomonas aeruginosa PA01
cagcgcuccuugcgccaggc

SEQ ID NO: 1415809 - RNA, 22 nt, Pseudomonas aeruginosa PA01
cagcgcuggcagguugcacggc

SEQ ID NO: 1415810 - RNA, 15 nt, Pseudomonas aeruginosa PA01
cagcgcuuccaccgc

SEQ ID NO: 1415811 - RNA, 18 nt, Pseudomonas aeruginosa PA01
cagcgcuuccaccgccug

SEQ ID NO: 1415812 - RNA, 21 nt, Pseudomonas aeruginosa PA01
cagcgcuucggcuccagcacc

SEQ ID NO: 1415813 - RNA, 15 nt, Pseudomonas aeruginosa PA01
cagcgcuucucggca

SEQ ID NO: 1415814 - RNA, 18 nt, Pseudomonas aeruginosa PA01
cagcgcuucucggcagcg

SEQ ID NO: 1415815 - RNA, 20 nt, Pseudomonas aeruginosa PA01
cagcgcuugaacgcgcgccu

SEQ ID NO: 1415816 - RNA, 18 nt, Pseudomonas aeruginosa PA01
cagcgcgucggcacgccg

SEQ ID NO: 1415817 - RNA, 17 nt, Pseudomonas aeruginosa PA01
cagcgcucacgcaccuc

SEQ ID NO: 1415818 - RNA, 18 nt, Pseudomonas aeruginosa PA01
cagcgcuagcgcauggcg

SEQ ID NO: 1415819 - RNA, 14 nt, Pseudomonas aeruginosa PA01
cagcgcggugagca

SEQ ID NO: 1415820 - RNA, 14 nt, Pseudomonas aeruginosa PA01
cagcgcgugcaggc

SEQ ID NO: 1415821 - RNA, 20 nt, Pseudomonas aeruginosa PA01
cagcgcguucaccccgcccu

SEQ ID NO: 1415822 - RNA, 13 nt, Pseudomonas aeruginosa PA01
cagcgcggccgcc

SEQ ID NO: 1415823 - RNA, 17 nt, Pseudomonas aeruginosa PA01
cagcgcggccgccgccg

SEQ ID NO: 1415824 - RNA, 18 nt, Pseudomonas aeruginosa PA01
cagcgcggccgccgccga

SEQ ID NO: 1415825 - RNA, 19 nt, Pseudomonas aeruginosa PA01
cagcgcggccgccgccgac

SEQ ID NO: 1415826 - RNA, 13 nt, Pseudomonas aeruginosa PA01
cagcgcggcgcgg

SEQ ID NO: 1415827 - RNA, 14 nt, Pseudomonas aeruginosa PA01
cagcgcggcgcugg

SEQ ID NO: 1415828 - RNA, 15 nt, Pseudomonas aeruginosa PA01
cagcgcggcgcuggg

SEQ ID NO: 1415829 - RNA, 11 nt, Pseudomonas aeruginosa PA01
cagcgcggcgg

SEQ ID NO: 1415830 - RNA, 20 nt, Pseudomonas aeruginosa PA01
cagcgcggcggcggccagca

SEQ ID NO: 1415831 - RNA, 16 nt, Pseudomonas aeruginosa PA01
cagcgcgucacucgac

SEQ ID NO: 1415832 - RNA, 21 nt, Pseudomonas aeruginosa PA01
cagcgcguagcuuuccgcggc

SEQ ID NO: 1415833 - RNA, 22 nt, Pseudomonas aeruginosa PA01
cagcgcguagcuuuccgcggcg

SEQ ID NO: 1415834 - RNA, 20 nt, Pseudomonas aeruginosa PA01
cagcgcgggggcucggucga

SEQ ID NO: 1415835 - RNA, 19 nt, Pseudomonas aeruginosa PA01
cagcgcggucucuucgucg

SEQ ID NO: 1415836 - RNA, 15 nt, Pseudomonas aeruginosa PA01
cagcgcgcgcuggcg

SEQ ID NO: 1415837 - RNA, 16 nt, Pseudomonas aeruginosa PA01
cagcgcgcgcuggcgc

SEQ ID NO: 1415838 - RNA, 17 nt, Pseudomonas aeruginosa PA01
cagcgcgcgcuggucgu

SEQ ID NO: 1415839 - RNA, 20 nt, Pseudomonas aeruginosa PA01
cagcgcgcgauaccgacaag

SEQ ID NO: 1415840 - RNA, 14 nt, Pseudomonas aeruginosa PA01
cagcgcgccuucga

SEQ ID NO: 1415841 - RNA, 14 nt, Pseudomonas aeruginosa PA01
cagcgcgcgccgac

SEQ ID NO: 1415842 - RNA, 18 nt, Pseudomonas aeruginosa PA01
cagcgcggaucagucagg

SEQ ID NO: 1415843 - RNA, 19 nt, Pseudomonas aeruginosa PA01
cagcgcggaucagucagga

SEQ ID NO: 1415844 - RNA, 15 nt, Pseudomonas aeruginosa PA01
cagcgcgcucgcugu

SEQ ID NO: 1415845 - RNA, 18 nt, Pseudomonas aeruginosa PA01
cagcgcgcucgcugucgc

SEQ ID NO: 1415846 - RNA, 21 nt, Pseudomonas aeruginosa PA01
cagcgcgcucgcugucgcuca

SEQ ID NO: 1415847 - RNA, 21 nt, Pseudomonas aeruginosa PA01
cagcgcgcucggccuggugca

SEQ ID NO: 1415848 - RNA, 19 nt, Pseudomonas aeruginosa PA01
cagcgcgcucuucgccgcg

SEQ ID NO: 1415849 - RNA, 19 nt, Pseudomonas aeruginosa PA01
cagcgcgcggaccgaaggc

SEQ ID NO: 1415850 - RNA, 23 nt, Pseudomonas aeruginosa PA01
cagcgcgcguagcgugccgccau

SEQ ID NO: 1415851 - RNA, 15 nt, Pseudomonas aeruginosa PA01
cagcgcgcgucgguc

SEQ ID NO: 1415852 - RNA, 13 nt, Pseudomonas aeruginosa PA01
cagcgcgccgcgc

SEQ ID NO: 1415853 - RNA, 14 nt, Pseudomonas aeruginosa PA01
cagcgcgccgccga

SEQ ID NO: 1415854 - RNA, 15 nt, Pseudomonas aeruginosa PA01
cagcgcgccgccgag

SEQ ID NO: 1415855 - RNA, 16 nt, Pseudomonas aeruginosa PA01
cagcgcgccgccgagg

SEQ ID NO: 1415856 - RNA, 17 nt, Pseudomonas aeruginosa PA01
cagcgcgccgccgaggu

SEQ ID NO: 1415857 - RNA, 21 nt, Pseudomonas aeruginosa PA01
cagcgcgccgccgaggugcgg

SEQ ID NO: 1415858 - RNA, 23 nt, Pseudomonas aeruginosa PA01
cagcgcgccgccgaggugcggcu

SEQ ID NO: 1415859 - RNA, 11 nt, Pseudomonas aeruginosa PA01
cagcgcgccgc

SEQ ID NO: 1415860 - RNA, 17 nt, Pseudomonas aeruginosa PA01
cagcgagaccucgccca

SEQ ID NO: 1415861 - RNA, 21 nt, Pseudomonas aeruginosa PA01
cagcgagaccucgcccaucgc

SEQ ID NO: 1415862 - RNA, 22 nt, Pseudomonas aeruginosa PA01
cagcgagaccucgcccaucgcc

SEQ ID NO: 1415863 - RNA, 20 nt, Pseudomonas aeruginosa PA01
cagcgacugguggucgaggg

SEQ ID NO: 1415864 - RNA, 16 nt, Pseudomonas aeruginosa PA01
cagcgacucguagucg

SEQ ID NO: 1415865 - RNA, 21 nt, Pseudomonas aeruginosa PA01
cagcgacucguagucgaucag

SEQ ID NO: 1415866 - RNA, 20 nt, Pseudomonas aeruginosa PA01
cagcgagaacuugccggcgc

SEQ ID NO: 1415867 - RNA, 22 nt, Pseudomonas aeruginosa PA01
cagcgagaacuugccggcgcca

SEQ ID NO: 1415868 - RNA, 21 nt, Pseudomonas aeruginosa PA01
caggaaaacgcucaggccaag

SEQ ID NO: 1415869 - RNA, 22 nt, Pseudomonas aeruginosa PA01
caggaaaagcggaagggccgag

SEQ ID NO: 1415870 - RNA, 16 nt, Pseudomonas aeruginosa PA01
cagcuugucgccuucc

SEQ ID NO: 1415871 - RNA, 15 nt, Pseudomonas aeruginosa PA01
cagcuuguggccggu

SEQ ID NO: 1415872 - RNA, 21 nt, Pseudomonas aeruginosa PA01
cagcuugugggcaugcucggc

SEQ ID NO: 1415873 - RNA, 23 nt, Pseudomonas aeruginosa PA01
cagcuugugggcaugcucggcca

SEQ ID NO: 1415874 - RNA, 19 nt, Pseudomonas aeruginosa PA01
caggaaccgacgcgcagga

SEQ ID NO: 1415875 - RNA, 13 nt, Pseudomonas aeruginosa PA01
caggaacgcccgc

SEQ ID NO: 1415876 - RNA, 21 nt, Pseudomonas aeruginosa PA01
caggaacgcccuuguagaucg

SEQ ID NO: 1415877 - RNA, 12 nt, Pseudomonas aeruginosa PA01
caggaacgcgcc

SEQ ID NO: 1415878 - RNA, 15 nt, Pseudomonas aeruginosa PA01
caggaaauccgccgc

SEQ ID NO: 1415879 - RNA, 15 nt, Pseudomonas aeruginosa PA01
caggaaaucgagcgc

SEQ ID NO: 1415880 - RNA, 13 nt, Pseudomonas aeruginosa PA01
caggaaaucgccg

SEQ ID NO: 1415881 - RNA, 22 nt, Pseudomonas aeruginosa PA01
caggaaaucgccguugccuucg

SEQ ID NO: 1415882 - RNA, 22 nt, Pseudomonas aeruginosa PA01
cagcuuggcgacguccugcggg

SEQ ID NO: 1415883 - RNA, 23 nt, Pseudomonas aeruginosa PA01
cagcuugggauggccagccagga

SEQ ID NO: 1415884 - RNA, 19 nt, Pseudomonas aeruginosa PA01
cagcuuggcggucagcgac

SEQ ID NO: 1415885 - RNA, 14 nt, Pseudomonas aeruginosa PA01
cagcuuggucggga

SEQ ID NO: 1415886 - RNA, 16 nt, Pseudomonas aeruginosa PA01
cagcuguccgcgccgc

SEQ ID NO: 1415887 - RNA, 14 nt, Pseudomonas aeruginosa PA01
cagcuggcgcgccu

SEQ ID NO: 1415888 - RNA, 19 nt, Pseudomonas aeruginosa PA01
cagcuggcgcguugugccg

SEQ ID NO: 1415889 - RNA, 22 nt, Pseudomonas aeruginosa PA01
cagcuggcgcgucgcugccgcc

SEQ ID NO: 1415890 - RNA, 20 nt, Pseudomonas aeruginosa PA01
cagcucauggagcaacagcg

SEQ ID NO: 1415891 - RNA, 13 nt, Pseudomonas aeruginosa PA01
cagcuccuggucg

SEQ ID NO: 1415892 - RNA, 23 nt, Pseudomonas aeruginosa PA01
cagcugcgccugcagcucgguga

SEQ ID NO: 1415893 - RNA, 21 nt, Pseudomonas aeruginosa PA01
cagcugcgagaacaggcggau

SEQ ID NO: 1415894 - RNA, 23 nt, Pseudomonas aeruginosa PA01
cagcuccggcagcagggucagca

SEQ ID NO: 1415895 - RNA, 23 nt, Pseudomonas aeruginosa PA01
cagcuccgggcuggccaccagca

SEQ ID NO: 1415896 - RNA, 19 nt, Pseudomonas aeruginosa PA01
caggacguuauccguccua

SEQ ID NO: 1415897 - RNA, 16 nt, Pseudomonas aeruginosa PA01
caggacguccuggccg

SEQ ID NO: 1415898 - RNA, 17 nt, Pseudomonas aeruginosa PA01
caggacgccaccaggcc

SEQ ID NO: 1415899 - RNA, 18 nt, Pseudomonas aeruginosa PA01
caggacgccaccaggccg

SEQ ID NO: 1415900 - RNA, 19 nt, Pseudomonas aeruginosa PA01
caggacgccaccaggccgc

SEQ ID NO: 1415901 - RNA, 17 nt, Pseudomonas aeruginosa PA01
caggacgcuccugcgcc

SEQ ID NO: 1415902 - RNA, 18 nt, Pseudomonas aeruginosa PA01
caggacgcuccugcgccg

SEQ ID NO: 1415903 - RNA, 14 nt, Pseudomonas aeruginosa PA01
caggacgcuggcga

SEQ ID NO: 1415904 - RNA, 22 nt, Pseudomonas aeruginosa PA01
caggacggauaacggcagccgc

SEQ ID NO: 1415905 - RNA, 23 nt, Pseudomonas aeruginosa PA01
caggacggauaacggcagccgcg

SEQ ID NO: 1415906 - RNA, 19 nt, Pseudomonas aeruginosa PA01
caggaagaaggcguccagg

SEQ ID NO: 1415907 - RNA, 19 nt, Pseudomonas aeruginosa PA01
caggaagagcccgccacgc

SEQ ID NO: 1415908 - RNA, 14 nt, Pseudomonas aeruginosa PA01
caggaagccgacca

SEQ ID NO: 1415909 - RNA, 20 nt, Pseudomonas aeruginosa PA01
caggaccuuccgccagcagg

SEQ ID NO: 1415910 - RNA, 23 nt, Pseudomonas aeruginosa PA01
caggaccuuccgccagcaggcgc

SEQ ID NO: 1415911 - RNA, 21 nt, Pseudomonas aeruginosa PA01
caggacgaagucgccggcauc

SEQ ID NO: 1415912 - RNA, 22 nt, Pseudomonas aeruginosa PA01
caggacgaagucgccggcaucg

SEQ ID NO: 1415913 - RNA, 18 nt, Pseudomonas aeruginosa PA01
caggacgagacgccgagg

SEQ ID NO: 1415914 - RNA, 19 nt, Pseudomonas aeruginosa PA01
caggacgagacgccgagga

SEQ ID NO: 1415915 - RNA, 16 nt, Pseudomonas aeruginosa PA01
caggacgagcguccgc

SEQ ID NO: 1415916 - RNA, 19 nt, Pseudomonas aeruginosa PA01
caggacgaggaaggcgcgc

SEQ ID NO: 1415917 - RNA, 14 nt, Pseudomonas aeruginosa PA01
caggacgaugauca

SEQ ID NO: 1415918 - RNA, 14 nt, Pseudomonas aeruginosa PA01
caggauccaggugc

SEQ ID NO: 1415919 - RNA, 22 nt, Pseudomonas aeruginosa PA01
caggauccaggugcgcggcagg

SEQ ID NO: 1415920 - RNA, 19 nt, Pseudomonas aeruginosa PA01
caggaucacaucgcccggc

SEQ ID NO: 1415921 - RNA, 13 nt, Pseudomonas aeruginosa PA01
caggagcgccgcg

SEQ ID NO: 1415922 - RNA, 18 nt, Pseudomonas aeruginosa PA01
caggagcgccgcgcagcg

SEQ ID NO: 1415923 - RNA, 23 nt, Pseudomonas aeruginosa PA01
caggagcgccagcaccagcagga

SEQ ID NO: 1415924 - RNA, 20 nt, Pseudomonas aeruginosa PA01
caggagccaucgcuccagcg

SEQ ID NO: 1415925 - RNA, 20 nt, Pseudomonas aeruginosa PA01
caggagaaccuggccaaucc

SEQ ID NO: 1415926 - RNA, 17 nt, Pseudomonas aeruginosa PA01
caggagaagcgccucgc

SEQ ID NO: 1415927 - RNA, 20 nt, Pseudomonas aeruginosa PA01
caggagauacgcuccggugc

SEQ ID NO: 1415928 - RNA, 21 nt, Pseudomonas aeruginosa PA01
caggagcaugucuucgucgcg

SEQ ID NO: 1415929 - RNA, 17 nt, Pseudomonas aeruginosa PA01
caggagcacgccgugca

SEQ ID NO: 1415930 - RNA, 18 nt, Pseudomonas aeruginosa PA01
caggagcacggccguccu

SEQ ID NO: 1415931 - RNA, 19 nt, Pseudomonas aeruginosa PA01
caggcagcgggccaggcgg

SEQ ID NO: 1415932 - RNA, 12 nt, Pseudomonas aeruginosa PA01
caggcagcgccg

SEQ ID NO: 1415933 - RNA, 17 nt, Pseudomonas aeruginosa PA01
caggcagcgccgcccac

SEQ ID NO: 1415934 - RNA, 12 nt, Pseudomonas aeruginosa PA01
caggcagcgcgc

SEQ ID NO: 1415935 - RNA, 14 nt, Pseudomonas aeruginosa PA01
caggcagcgcgcgg

SEQ ID NO: 1415936 - RNA, 16 nt, Pseudomonas aeruginosa PA01
caggcagcgcgcggcc

SEQ ID NO: 1415937 - RNA, 17 nt, Pseudomonas aeruginosa PA01
caggcagcgcgcggcca

SEQ ID NO: 1415938 - RNA, 16 nt, Pseudomonas aeruginosa PA01
caggcagcgcgcgucg

SEQ ID NO: 1415939 - RNA, 21 nt, Pseudomonas aeruginosa PA01
caggcaggcgaugaccgcccc

SEQ ID NO: 1415940 - RNA, 22 nt, Pseudomonas aeruginosa PA01
caggcaggcgaugaccgccccg

SEQ ID NO: 1415941 - RNA, 19 nt, Pseudomonas aeruginosa PA01
caggcagcgaucgccgcca

SEQ ID NO: 1415942 - RNA, 23 nt, Pseudomonas aeruginosa PA01
caggaugcgaugcugucagcgcc

SEQ ID NO: 1415943 - RNA, 17 nt, Pseudomonas aeruginosa PA01
caggcacgcugccagca

SEQ ID NO: 1415944 - RNA, 21 nt, Pseudomonas aeruginosa PA01
caggcacgcugccagcaggcc

SEQ ID NO: 1415945 - RNA, 22 nt, Pseudomonas aeruginosa PA01
caggcacggaagcgcugcucga

SEQ ID NO: 1415946 - RNA, 16 nt, Pseudomonas aeruginosa PA01
caggaugggcgaagcc

SEQ ID NO: 1415947 - RNA, 22 nt, Pseudomonas aeruginosa PA01
caggaugggcgaagccggcggc

SEQ ID NO: 1415948 - RNA, 14 nt, Pseudomonas aeruginosa PA01
caggcagaccagcg

SEQ ID NO: 1415949 - RNA, 15 nt, Pseudomonas aeruginosa PA01
caggcagaccagcgc

SEQ ID NO: 1415950 - RNA, 15 nt, Pseudomonas aeruginosa PA01
caggcagaccaggcc

SEQ ID NO: 1415951 - RNA, 18 nt, Pseudomonas aeruginosa PA01
caggcagaccaggccgag

SEQ ID NO: 1415952 - RNA, 19 nt, Pseudomonas aeruginosa PA01
caggcagaccaggccgagc

SEQ ID NO: 1415953 - RNA, 15 nt, Pseudomonas aeruginosa PA01
caggcagaccugcag

SEQ ID NO: 1415954 - RNA, 16 nt, Pseudomonas aeruginosa PA01
caggaucuccucggcc

SEQ ID NO: 1415955 - RNA, 18 nt, Pseudomonas aeruginosa PA01
caggaucuccucggccaa

SEQ ID NO: 1415956 - RNA, 14 nt, Pseudomonas aeruginosa PA01
caggaucggcaugg

SEQ ID NO: 1415957 - RNA, 17 nt, Pseudomonas aeruginosa PA01
caggaucggcgcccagc

SEQ ID NO: 1415958 - RNA, 20 nt, Pseudomonas aeruginosa PA01
caggaucggcgcccagcacc

SEQ ID NO: 1415959 - RNA, 13 nt, Pseudomonas aeruginosa PA01
caggaucggcgcg

SEQ ID NO: 1415960 - RNA, 21 nt, Pseudomonas aeruginosa PA01
caggaucgccuccaccagcgc

SEQ ID NO: 1415961 - RNA, 22 nt, Pseudomonas aeruginosa PA01
caggaucgccuccaccagcgcc

SEQ ID NO: 1415962 - RNA, 14 nt, Pseudomonas aeruginosa PA01
caggaucgacagca

SEQ ID NO: 1415963 - RNA, 18 nt, Pseudomonas aeruginosa PA01
caggaucgacagcagcgc

SEQ ID NO: 1415964 - RNA, 19 nt, Pseudomonas aeruginosa PA01
caggaucgacagcagcgcc

SEQ ID NO: 1415965 - RNA, 20 nt, Pseudomonas aeruginosa PA01
caggaucgacagcagcgcca

SEQ ID NO: 1415966 - RNA, 21 nt, Pseudomonas aeruginosa PA01
caggaucgagcccuggucgac

SEQ ID NO: 1415967 - RNA, 22 nt, Pseudomonas aeruginosa PA01
caggaucgaacuggccagcacc

SEQ ID NO: 1415968 - RNA, 23 nt, Pseudomonas aeruginosa PA01
caggaucgaacuggccagcacca

SEQ ID NO: 1415969 - RNA, 15 nt, Pseudomonas aeruginosa PA01
caggaugccgccugc

SEQ ID NO: 1415970 - RNA, 14 nt, Pseudomonas aeruginosa PA01
caggaugcaaccgc

SEQ ID NO: 1415971 - RNA, 20 nt, Pseudomonas aeruginosa PA01
caggaugcaaccgcccuggu

SEQ ID NO: 1415972 - RNA, 14 nt, Pseudomonas aeruginosa PA01
caggccgcgcagca

SEQ ID NO: 1415973 - RNA, 22 nt, Pseudomonas aeruginosa PA01
caggccgcgcagcaacggcgca

SEQ ID NO: 1415974 - RNA, 17 nt, Pseudomonas aeruginosa PA01
caggccgcgcagucccg

SEQ ID NO: 1415975 - RNA, 14 nt, Pseudomonas aeruginosa PA01
caggccgcgcgaug

SEQ ID NO: 1415976 - RNA, 18 nt, Pseudomonas aeruginosa PA01
caggccgcgcgauggccg

SEQ ID NO: 1415977 - RNA, 20 nt, Pseudomonas aeruginosa PA01
caggccgcccaggacaacga

SEQ ID NO: 1415978 - RNA, 12 nt, Pseudomonas aeruginosa PA01
caggccgccgaa

SEQ ID NO: 1415979 - RNA, 23 nt, Pseudomonas aeruginosa PA01
caggccgccgaagaacucggcgc

SEQ ID NO: 1415980 - RNA, 17 nt, Pseudomonas aeruginosa PA01
caggccgauguucaggc

SEQ ID NO: 1415981 - RNA, 20 nt, Pseudomonas aeruginosa PA01
caggccgauguucaggccgg

SEQ ID NO: 1415982 - RNA, 14 nt, Pseudomonas aeruginosa PA01
caggccgcagguga

SEQ ID NO: 1415983 - RNA, 13 nt, Pseudomonas aeruginosa PA01
caggccgcagucc

SEQ ID NO: 1415984 - RNA, 20 nt, Pseudomonas aeruginosa PA01
caggccgccgauccaggaac

SEQ ID NO: 1415985 - RNA, 12 nt, Pseudomonas aeruginosa PA01
caggccgccgua

SEQ ID NO: 1415986 - RNA, 14 nt, Pseudomonas aeruginosa PA01
caggccgccguaga

SEQ ID NO: 1415987 - RNA, 22 nt, Pseudomonas aeruginosa PA01
caggccgccggcgaccgcgcgc

SEQ ID NO: 1415988 - RNA, 17 nt, Pseudomonas aeruginosa PA01
caggccgcucaccgcca

SEQ ID NO: 1415989 - RNA, 16 nt, Pseudomonas aeruginosa PA01
caggccgcugccgccg

SEQ ID NO: 1415990 - RNA, 18 nt, Pseudomonas aeruginosa PA01
caggccgcugccgccgcg

SEQ ID NO: 1415991 - RNA, 20 nt, Pseudomonas aeruginosa PA01
caggccgcugccgccgcgca

SEQ ID NO: 1415992 - RNA, 17 nt, Pseudomonas aeruginosa PA01
caggccgcugccugucg

SEQ ID NO: 1415993 - RNA, 14 nt, Pseudomonas aeruginosa PA01
caggccgcuggcga

SEQ ID NO: 1415994 - RNA, 16 nt, Pseudomonas aeruginosa PA01
caggccugggucacca

SEQ ID NO: 1415995 - RNA, 19 nt, Pseudomonas aeruginosa PA01
caggccugggucaccagca

SEQ ID NO: 1415996 - RNA, 21 nt, Pseudomonas aeruginosa PA01
caggccuucgacuucgacgaa

SEQ ID NO: 1415997 - RNA, 14 nt, Pseudomonas aeruginosa PA01
caggccuucggcgc

SEQ ID NO: 1415998 - RNA, 15 nt, Pseudomonas aeruginosa PA01
caggccuucggcgcc

SEQ ID NO: 1415999 - RNA, 18 nt, Pseudomonas aeruginosa PA01
caggccuucggcgccgga

SEQ ID NO: 1416000 - RNA, 22 nt, Pseudomonas aeruginosa PA01
caggccuugcagcaacucgccg

SEQ ID NO: 1416001 - RNA, 14 nt, Pseudomonas aeruginosa PA01
caggccuugcaggg

SEQ ID NO: 1416002 - RNA, 19 nt, Pseudomonas aeruginosa PA01
caggccuugcagggccgcc

SEQ ID NO: 1416003 - RNA, 14 nt, Pseudomonas aeruginosa PA01
caggccuugcgcgg

SEQ ID NO: 1416004 - RNA, 16 nt, Pseudomonas aeruginosa PA01
caggccuugcgcggcg

SEQ ID NO: 1416005 - RNA, 23 nt, Pseudomonas aeruginosa PA01
caggccuuggcccgguuggccag

SEQ ID NO: 1416006 - RNA, 12 nt, Pseudomonas aeruginosa PA01
caggccuccagc

SEQ ID NO: 1416007 - RNA, 13 nt, Pseudomonas aeruginosa PA01
caggccuccagca

SEQ ID NO: 1416008 - RNA, 15 nt, Pseudomonas aeruginosa PA01
caggccuccagcaac

SEQ ID NO: 1416009 - RNA, 19 nt, Pseudomonas aeruginosa PA01
caggccuccagcaacgccg

SEQ ID NO: 1416010 - RNA, 23 nt, Pseudomonas aeruginosa PA01
caggccucccagccgugggcgua

SEQ ID NO: 1416011 - RNA, 17 nt, Pseudomonas aeruginosa PA01
caggccucggcgcgggc

SEQ ID NO: 1416012 - RNA, 17 nt, Pseudomonas aeruginosa PA01
caggcgccaaccgggca

SEQ ID NO: 1416013 - RNA, 23 nt, Pseudomonas aeruginosa PA01
caggcgcaugcccagggccagca

SEQ ID NO: 1416014 - RNA, 16 nt, Pseudomonas aeruginosa PA01
caggcgcaucaggcca

SEQ ID NO: 1416015 - RNA, 19 nt, Pseudomonas aeruginosa PA01
caggcgcaucaggccaaag

SEQ ID NO: 1416016 - RNA, 12 nt, Pseudomonas aeruginosa PA01
caggcgcagggg

SEQ ID NO: 1416017 - RNA, 16 nt, Pseudomonas aeruginosa PA01
caggcgcaggucggcc

SEQ ID NO: 1416018 - RNA, 18 nt, Pseudomonas aeruginosa PA01
caggcgcaguaacgccug

SEQ ID NO: 1416019 - RNA, 17 nt, Pseudomonas aeruginosa PA01
caggcgcaguaggccug

SEQ ID NO: 1416020 - RNA, 19 nt, Pseudomonas aeruginosa PA01
caggcgcaguaggccuggu

SEQ ID NO: 1416021 - RNA, 21 nt, Pseudomonas aeruginosa PA01
caggcgcaguaggccugguag

SEQ ID NO: 1416022 - RNA, 13 nt, Pseudomonas aeruginosa PA01
caggcgcaggcga

SEQ ID NO: 1416023 - RNA, 15 nt, Pseudomonas aeruginosa PA01
caggcgcgcucggga

SEQ ID NO: 1416024 - RNA, 15 nt, Pseudomonas aeruginosa PA01
caggcgcggcgucgg

SEQ ID NO: 1416025 - RNA, 18 nt, Pseudomonas aeruginosa PA01
caggcgcggcgucgggcg

SEQ ID NO: 1416026 - RNA, 19 nt, Pseudomonas aeruginosa PA01
caggcgcgcggccagcgcg

SEQ ID NO: 1416027 - RNA, 16 nt, Pseudomonas aeruginosa PA01
caggcgcgcggccagc

SEQ ID NO: 1416028 - RNA, 13 nt, Pseudomonas aeruginosa PA01
caggcgcgccugg

SEQ ID NO: 1416029 - RNA, 21 nt, Pseudomonas aeruginosa PA01
caggcgcgccuggaucagcgc

SEQ ID NO: 1416030 - RNA, 14 nt, Pseudomonas aeruginosa PA01
caggcgcgccuggc

SEQ ID NO: 1416031 - RNA, 17 nt, Pseudomonas aeruginosa PA01
caggcgcgccuggcccu

SEQ ID NO: 1416032 - RNA, 11 nt, Pseudomonas aeruginosa PA01
caggcgcaccu

SEQ ID NO: 1416033 - RNA, 14 nt, Pseudomonas aeruginosa PA01
caggcgcaccuggc

SEQ ID NO: 1416034 - RNA, 15 nt, Pseudomonas aeruginosa PA01
caggcgcacgcgcag

SEQ ID NO: 1416035 - RNA, 14 nt, Pseudomonas aeruginosa PA01
caggcgcagcagca

SEQ ID NO: 1416036 - RNA, 22 nt, Pseudomonas aeruginosa PA01
caggcgcagcagcgacucgcug

SEQ ID NO: 1416037 - RNA, 13 nt, Pseudomonas aeruginosa PA01
caggcgcagcagc

SEQ ID NO: 1416038 - RNA, 18 nt, Pseudomonas aeruginosa PA01
caggcgauggugcgcucg

SEQ ID NO: 1416039 - RNA, 19 nt, Pseudomonas aeruginosa PA01
caggcgauggugcgcucgc

SEQ ID NO: 1416040 - RNA, 21 nt, Pseudomonas aeruginosa PA01
caggcgauggugcgcucgcgg

SEQ ID NO: 1416041 - RNA, 19 nt, Pseudomonas aeruginosa PA01
caggcgcaaccagaccagc

SEQ ID NO: 1416042 - RNA, 20 nt, Pseudomonas aeruginosa PA01
caggcgcaaccagaccagca

SEQ ID NO: 1416043 - RNA, 23 nt, Pseudomonas aeruginosa PA01
caggcgcaaccagaccagcagga

SEQ ID NO: 1416044 - RNA, 13 nt, Pseudomonas aeruginosa PA01
caggcgcaccagc

SEQ ID NO: 1416045 - RNA, 18 nt, Pseudomonas aeruginosa PA01
caggcgcaccagcaggcg

SEQ ID NO: 1416046 - RNA, 20 nt, Pseudomonas aeruginosa PA01
caggcgcaccagcaggcgca

SEQ ID NO: 1416047 - RNA, 14 nt, Pseudomonas aeruginosa PA01
caggcgaacagggc

SEQ ID NO: 1416048 - RNA, 22 nt, Pseudomonas aeruginosa PA01
caggcgaaccuggagaaauccg

SEQ ID NO: 1416049 - RNA, 15 nt, Pseudomonas aeruginosa PA01
caggcgaacugccga

SEQ ID NO: 1416050 - RNA, 23 nt, Pseudomonas aeruginosa PA01
caggcgaacugccgacggcggcg

SEQ ID NO: 1416051 - RNA, 15 nt, Pseudomonas aeruginosa PA01
caggcgaagcggcug

SEQ ID NO: 1416052 - RNA, 20 nt, Pseudomonas aeruginosa PA01
caggcgaagcggcuggccgc

SEQ ID NO: 1416053 - RNA, 12 nt, Pseudomonas aeruginosa PA01
caggccuuccgg

SEQ ID NO: 1416054 - RNA, 14 nt, Pseudomonas aeruginosa PA01
caggccuuccggga

SEQ ID NO: 1416055 - RNA, 15 nt, Pseudomonas aeruginosa PA01
caggccuuccacgcc

SEQ ID NO: 1416056 - RNA, 16 nt, Pseudomonas aeruginosa PA01
caggccuuccacgccu

SEQ ID NO: 1416057 - RNA, 19 nt, Pseudomonas aeruginosa PA01
caggccuuccagaacgccg

SEQ ID NO: 1416058 - RNA, 18 nt, Pseudomonas aeruginosa PA01
caggcgaaagucggcgcg

SEQ ID NO: 1416059 - RNA, 20 nt, Pseudomonas aeruginosa PA01
caggcgaaagucggcgcgac

SEQ ID NO: 1416060 - RNA, 21 nt, Pseudomonas aeruginosa PA01
caggcgaaagucggcgcgacu

SEQ ID NO: 1416061 - RNA, 22 nt, Pseudomonas aeruginosa PA01
caggcgaaagucggcgcgacug

SEQ ID NO: 1416062 - RNA, 15 nt, Pseudomonas aeruginosa PA01
caggccaaccacccc

SEQ ID NO: 1416063 - RNA, 17 nt, Pseudomonas aeruginosa PA01
caggccaaccaccccga

SEQ ID NO: 1416064 - RNA, 15 nt, Pseudomonas aeruginosa PA01
caggccaagcaugaa

SEQ ID NO: 1416065 - RNA, 13 nt, Pseudomonas aeruginosa PA01
caggccaccgcgc

SEQ ID NO: 1416066 - RNA, 18 nt, Pseudomonas aeruginosa PA01
caggccaccgguggacug

SEQ ID NO: 1416067 - RNA, 14 nt, Pseudomonas aeruginosa PA01
caggccacgcacca

SEQ ID NO: 1416068 - RNA, 17 nt, Pseudomonas aeruginosa PA01
caggccacgcaccagcu

SEQ ID NO: 1416069 - RNA, 21 nt, Pseudomonas aeruginosa PA01
caggccacgcaccagcucccg

SEQ ID NO: 1416070 - RNA, 15 nt, Pseudomonas aeruginosa PA01
caggccacccgccuc

SEQ ID NO: 1416071 - RNA, 19 nt, Pseudomonas aeruginosa PA01
caggccagcagguagccug

SEQ ID NO: 1416072 - RNA, 13 nt, Pseudomonas aeruginosa PA01
caggccacggccg

SEQ ID NO: 1416073 - RNA, 14 nt, Pseudomonas aeruginosa PA01
caggccacggccgc

SEQ ID NO: 1416074 - RNA, 16 nt, Pseudomonas aeruginosa PA01
caggccacggccggcg

SEQ ID NO: 1416075 - RNA, 20 nt, Pseudomonas aeruginosa PA01
caggccacggccggcgaggc

SEQ ID NO: 1416076 - RNA, 15 nt, Pseudomonas aeruginosa PA01
caggccacggcggaa

SEQ ID NO: 1416077 - RNA, 14 nt, Pseudomonas aeruginosa PA01
caggccagcucgcc

SEQ ID NO: 1416078 - RNA, 18 nt, Pseudomonas aeruginosa PA01
caggccagcucgcccgcc

SEQ ID NO: 1416079 - RNA, 19 nt, Pseudomonas aeruginosa PA01
caggccagcuuccaggcgc

SEQ ID NO: 1416080 - RNA, 21 nt, Pseudomonas aeruginosa PA01
caggccagcuuccaggcgcgc

SEQ ID NO: 1416081 - RNA, 13 nt, Pseudomonas aeruginosa PA01
caggcagugccgg

SEQ ID NO: 1416082 - RNA, 22 nt, Pseudomonas aeruginosa PA01
caggcaguccuugagcgccagc

SEQ ID NO: 1416083 - RNA, 15 nt, Pseudomonas aeruginosa PA01
caggcauugccgucc

SEQ ID NO: 1416084 - RNA, 22 nt, Pseudomonas aeruginosa PA01
caggcauugccguccgucggca

SEQ ID NO: 1416085 - RNA, 21 nt, Pseudomonas aeruginosa PA01
caggcagcacaugccacgcac

SEQ ID NO: 1416086 - RNA, 16 nt, Pseudomonas aeruginosa PA01
caggcaugcggccccg

SEQ ID NO: 1416087 - RNA, 16 nt, Pseudomonas aeruginosa PA01
caggcaugcgggcgcg

SEQ ID NO: 1416088 - RNA, 13 nt, Pseudomonas aeruginosa PA01
caggcauccagca

SEQ ID NO: 1416089 - RNA, 16 nt, Pseudomonas aeruginosa PA01
caggcauccagcaccg

SEQ ID NO: 1416090 - RNA, 17 nt, Pseudomonas aeruginosa PA01
caggcccuugaacaggc

SEQ ID NO: 1416091 - RNA, 20 nt, Pseudomonas aeruginosa PA01
caggcccuugaacaggcugg

SEQ ID NO: 1416092 - RNA, 16 nt, Pseudomonas aeruginosa PA01
caggcccuugaggaag

SEQ ID NO: 1416093 - RNA, 17 nt, Pseudomonas aeruginosa PA01
caggcccuugauggugu

SEQ ID NO: 1416094 - RNA, 20 nt, Pseudomonas aeruginosa PA01
caggcccugcuccuccaggc

SEQ ID NO: 1416095 - RNA, 15 nt, Pseudomonas aeruginosa PA01
caggcccuggaucac

SEQ ID NO: 1416096 - RNA, 20 nt, Pseudomonas aeruginosa PA01
caggcccuggaucaccgcgg

SEQ ID NO: 1416097 - RNA, 22 nt, Pseudomonas aeruginosa PA01
caggccgaagcgugggcggccg

SEQ ID NO: 1416098 - RNA, 19 nt, Pseudomonas aeruginosa PA01
caggccgaagcugucgagc

SEQ ID NO: 1416099 - RNA, 14 nt, Pseudomonas aeruginosa PA01
caggccgaaggcca

SEQ ID NO: 1416100 - RNA, 16 nt, Pseudomonas aeruginosa PA01
caggccgaaggccagg

SEQ ID NO: 1416101 - RNA, 18 nt, Pseudomonas aeruginosa PA01
caggccgaaggccaggac

SEQ ID NO: 1416102 - RNA, 16 nt, Pseudomonas aeruginosa PA01
caggccgaaggccugg

SEQ ID NO: 1416103 - RNA, 18 nt, Pseudomonas aeruginosa PA01
caggccgaaggccuggcc

SEQ ID NO: 1416104 - RNA, 17 nt, Pseudomonas aeruginosa PA01
caggccgaauccgccgg

SEQ ID NO: 1416105 - RNA, 19 nt, Pseudomonas aeruginosa PA01
caggccgaauccgccggcg

SEQ ID NO: 1416106 - RNA, 20 nt, Pseudomonas aeruginosa PA01
caggccgaucaccagcgcca

SEQ ID NO: 1416107 - RNA, 23 nt, Pseudomonas aeruginosa PA01
caggccgaucaccagcgccaggc

SEQ ID NO: 1416108 - RNA, 23 nt, Pseudomonas aeruginosa PA01
caggccgaugcgcaacgggcggc

SEQ ID NO: 1416109 - RNA, 14 nt, Pseudomonas aeruginosa PA01
caggccgcaagcgg

SEQ ID NO: 1416110 - RNA, 20 nt, Pseudomonas aeruginosa PA01
caggccgcaaguaccgccgg

SEQ ID NO: 1416111 - RNA, 23 nt, Pseudomonas aeruginosa PA01
caggccgcaaguaccgccggcag

SEQ ID NO: 1416112 - RNA, 14 nt, Pseudomonas aeruginosa PA01
caggccgauggccc

SEQ ID NO: 1416113 - RNA, 18 nt, Pseudomonas aeruginosa PA01
caggccgauggccccggc

SEQ ID NO: 1416114 - RNA, 15 nt, Pseudomonas aeruginosa PA01
caggccgaucagcgg

SEQ ID NO: 1416115 - RNA, 17 nt, Pseudomonas aeruginosa PA01
caggccgaucagcggcg

SEQ ID NO: 1416116 - RNA, 23 nt, Pseudomonas aeruginosa PA01
caggccgaucgccucguucagca

SEQ ID NO: 1416117 - RNA, 24 nt, Pseudomonas aeruginosa PA01
caggccgaacucacggaugccggg

SEQ ID NO: 1416118 - RNA, 20 nt, Pseudomonas aeruginosa PA01
caggcccuuggucaggccga

SEQ ID NO: 1416119 - RNA, 21 nt, Pseudomonas aeruginosa PA01
caggcccuuuuccaccggccg

SEQ ID NO: 1416120 - RNA, 22 nt, Pseudomonas aeruginosa PA01
caggcccuuuuccaccggccgc

SEQ ID NO: 1416121 - RNA, 16 nt, Pseudomonas aeruginosa PA01
caggccgaacgggaag

SEQ ID NO: 1416122 - RNA, 16 nt, Pseudomonas aeruginosa PA01
caggccagcgccaggg

SEQ ID NO: 1416123 - RNA, 16 nt, Pseudomonas aeruginosa PA01
caggccagcgccaggu

SEQ ID NO: 1416124 - RNA, 23 nt, Pseudomonas aeruginosa PA01
caggccagcgccagguuggccug

SEQ ID NO: 1416125 - RNA, 14 nt, Pseudomonas aeruginosa PA01
caggccaggcgcag

SEQ ID NO: 1416126 - RNA, 20 nt, Pseudomonas aeruginosa PA01
caggccaggcgcagugccug

SEQ ID NO: 1416127 - RNA, 17 nt, Pseudomonas aeruginosa PA01
caggccauagcgcgccg

SEQ ID NO: 1416128 - RNA, 15 nt, Pseudomonas aeruginosa PA01
caggccauugaaggc

SEQ ID NO: 1416129 - RNA, 18 nt, Pseudomonas aeruginosa PA01
caggccauugaaggccga

SEQ ID NO: 1416130 - RNA, 15 nt, Pseudomonas aeruginosa PA01
caggcccacgccgaa

SEQ ID NO: 1416131 - RNA, 20 nt, Pseudomonas aeruginosa PA01
caggcccugggcggcgggcc

SEQ ID NO: 1416132 - RNA, 16 nt, Pseudomonas aeruginosa PA01
caguacagcucggcgc

SEQ ID NO: 1416133 - RNA, 16 nt, Pseudomonas aeruginosa PA01
caguacagcugcaccg

SEQ ID NO: 1416134 - RNA, 20 nt, Pseudomonas aeruginosa PA01
caguacagcugcaccgcgcg

SEQ ID NO: 1416135 - RNA, 15 nt, Pseudomonas aeruginosa PA01
cagguuucgcaaggg

SEQ ID NO: 1416136 - RNA, 23 nt, Pseudomonas aeruginosa PA01
caguaccuuccauuucgaagcug

SEQ ID NO: 1416137 - RNA, 14 nt, Pseudomonas aeruginosa PA01
caguaccggcagcg

SEQ ID NO: 1416138 - RNA, 13 nt, Pseudomonas aeruginosa PA01
caguacccggccg

SEQ ID NO: 1416139 - RNA, 17 nt, Pseudomonas aeruginosa PA01
cagguuggccccgccga

SEQ ID NO: 1416140 - RNA, 17 nt, Pseudomonas aeruginosa PA01
caggugguggcggaucu

SEQ ID NO: 1416141 - RNA, 22 nt, Pseudomonas aeruginosa PA01
cagguggugguagagcggcacc

SEQ ID NO: 1416142 - RNA, 19 nt, Pseudomonas aeruginosa PA01
caggugguaagcgagcaga

SEQ ID NO: 1416143 - RNA, 16 nt, Pseudomonas aeruginosa PA01
cagguggucgaccagg

SEQ ID NO: 1416144 - RNA, 17 nt, Pseudomonas aeruginosa PA01
cagguggucgaccaggc

SEQ ID NO: 1416145 - RNA, 20 nt, Pseudomonas aeruginosa PA01
cagguggucguugcgcgcca

SEQ ID NO: 1416146 - RNA, 19 nt, Pseudomonas aeruginosa PA01
caggugggucacgucggcg

SEQ ID NO: 1416147 - RNA, 18 nt, Pseudomonas aeruginosa PA01
cagguggcgggucggcgg

SEQ ID NO: 1416148 - RNA, 15 nt, Pseudomonas aeruginosa PA01
caggugccaauccgg

SEQ ID NO: 1416149 - RNA, 23 nt, Pseudomonas aeruginosa PA01
cagguggcgcacugccaggagca

SEQ ID NO: 1416150 - RNA, 17 nt, Pseudomonas aeruginosa PA01
cagguuggcgccgggcg

SEQ ID NO: 1416151 - RNA, 17 nt, Pseudomonas aeruginosa PA01
cagguuggccuggcccg

SEQ ID NO: 1416152 - RNA, 20 nt, Pseudomonas aeruginosa PA01
cagguuggccuggcccggcg

SEQ ID NO: 1416153 - RNA, 23 nt, Pseudomonas aeruginosa PA01
cagguuggcgaacaggcagcggg

SEQ ID NO: 1416154 - RNA, 13 nt, Pseudomonas aeruginosa PA01
cagguugugcggg

SEQ ID NO: 1416155 - RNA, 23 nt, Pseudomonas aeruginosa PA01
cagguugugguugggcaggcgca

SEQ ID NO: 1416156 - RNA, 13 nt, Pseudomonas aeruginosa PA01
cagucccuggccg

SEQ ID NO: 1416157 - RNA, 16 nt, Pseudomonas aeruginosa PA01
cagucccuggccggcg

SEQ ID NO: 1416158 - RNA, 17 nt, Pseudomonas aeruginosa PA01
cagucccuggccggcga

SEQ ID NO: 1416159 - RNA, 22 nt, Pseudomonas aeruginosa PA01
cagucccuggccggcgauggcc

SEQ ID NO: 1416160 - RNA, 16 nt, Pseudomonas aeruginosa PA01
cagucccuucagcgca

SEQ ID NO: 1416161 - RNA, 19 nt, Pseudomonas aeruginosa PA01
cagucccuucagcgcaccg

SEQ ID NO: 1416162 - RNA, 16 nt, Pseudomonas aeruginosa PA01
caguccggcaccgcuc

SEQ ID NO: 1416163 - RNA, 18 nt, Pseudomonas aeruginosa PA01
cagucccagaaggccagg

SEQ ID NO: 1416164 - RNA, 12 nt, Pseudomonas aeruginosa PA01
cagucccaggcc

SEQ ID NO: 1416165 - RNA, 13 nt, Pseudomonas aeruginosa PA01
cagucccaggcca

SEQ ID NO: 1416166 - RNA, 23 nt, Pseudomonas aeruginosa PA01
cagucccaggccaaccaccccga

SEQ ID NO: 1416167 - RNA, 12 nt, Pseudomonas aeruginosa PA01
cagucccgcaaa

SEQ ID NO: 1416168 - RNA, 21 nt, Pseudomonas aeruginosa PA01
cagucccggcuugccggcagc

SEQ ID NO: 1416169 - RNA, 17 nt, Pseudomonas aeruginosa PA01
cagucccgccaggcgcc

SEQ ID NO: 1416170 - RNA, 19 nt, Pseudomonas aeruginosa PA01
cagucccgccaggcgccga

SEQ ID NO: 1416171 - RNA, 17 nt, Pseudomonas aeruginosa PA01
caguagcucgccgaggu

SEQ ID NO: 1416172 - RNA, 13 nt, Pseudomonas aeruginosa PA01
caguagcggcagg

SEQ ID NO: 1416173 - RNA, 13 nt, Pseudomonas aeruginosa PA01
caguagcgccugg

SEQ ID NO: 1416174 - RNA, 20 nt, Pseudomonas aeruginosa PA01
caguagcgcuucgcgcagcu

SEQ ID NO: 1416175 - RNA, 13 nt, Pseudomonas aeruginosa PA01
caguccaggccgu

SEQ ID NO: 1416176 - RNA, 20 nt, Pseudomonas aeruginosa PA01
caguccaucguucaguugcc

SEQ ID NO: 1416177 - RNA, 13 nt, Pseudomonas aeruginosa PA01
cagguggcaggcc

SEQ ID NO: 1416178 - RNA, 14 nt, Pseudomonas aeruginosa PA01
cagguggcaggccu

SEQ ID NO: 1416179 - RNA, 13 nt, Pseudomonas aeruginosa PA01
cagguggcuggcc

SEQ ID NO: 1416180 - RNA, 14 nt, Pseudomonas aeruginosa PA01
cagguggcuggcca

SEQ ID NO: 1416181 - RNA, 15 nt, Pseudomonas aeruginosa PA01
cagguggcuggucag

SEQ ID NO: 1416182 - RNA, 17 nt, Pseudomonas aeruginosa PA01
cagguggcuuuccagca

SEQ ID NO: 1416183 - RNA, 14 nt, Pseudomonas aeruginosa PA01
caggugccgcucgu

SEQ ID NO: 1416184 - RNA, 20 nt, Pseudomonas aeruginosa PA01
caggugcgagucaccccgac

SEQ ID NO: 1416185 - RNA, 12 nt, Pseudomonas aeruginosa PA01
caggugcgcagg

SEQ ID NO: 1416186 - RNA, 21 nt, Pseudomonas aeruginosa PA01
caggugcccuggaagccggca

SEQ ID NO: 1416187 - RNA, 23 nt, Pseudomonas aeruginosa PA01
caggugcauguagcgcuccucgc

SEQ ID NO: 1416188 - RNA, 16 nt, Pseudomonas aeruginosa PA01
caggugcacggccagg

SEQ ID NO: 1416189 - RNA, 18 nt, Pseudomonas aeruginosa PA01
caggugcacggccaggcc

SEQ ID NO: 1416190 - RNA, 19 nt, Pseudomonas aeruginosa PA01
caggugcaggaacagccag

SEQ ID NO: 1416191 - RNA, 19 nt, Pseudomonas aeruginosa PA01
caggugcaggaagcgccgg

SEQ ID NO: 1416192 - RNA, 20 nt, Pseudomonas aeruginosa PA01
caggugcaggaagcgccggg

SEQ ID NO: 1416193 - RNA, 18 nt, Pseudomonas aeruginosa PA01
caggucgaucucgaagac

SEQ ID NO: 1416194 - RNA, 13 nt, Pseudomonas aeruginosa PA01
caggugcagcgag

SEQ ID NO: 1416195 - RNA, 15 nt, Pseudomonas aeruginosa PA01
caggucgguccgccg

SEQ ID NO: 1416196 - RNA, 16 nt, Pseudomonas aeruginosa PA01
caggucgguccgccga

SEQ ID NO: 1416197 - RNA, 14 nt, Pseudomonas aeruginosa PA01
caggucggucggcg

SEQ ID NO: 1416198 - RNA, 15 nt, Pseudomonas aeruginosa PA01
caggucggucggcgg

SEQ ID NO: 1416199 - RNA, 18 nt, Pseudomonas aeruginosa PA01
caggucggucggcggcgg

SEQ ID NO: 1416200 - RNA, 19 nt, Pseudomonas aeruginosa PA01
caggucggucggcggcggu

SEQ ID NO: 1416201 - RNA, 12 nt, Pseudomonas aeruginosa PA01
caggucgucgcg

SEQ ID NO: 1416202 - RNA, 19 nt, Pseudomonas aeruginosa PA01
caggucguugacgaucugc

SEQ ID NO: 1416203 - RNA, 14 nt, Pseudomonas aeruginosa PA01
caggucgugcagcc

SEQ ID NO: 1416204 - RNA, 21 nt, Pseudomonas aeruginosa PA01
caggucgugcagcccggucac

SEQ ID NO: 1416205 - RNA, 19 nt, Pseudomonas aeruginosa PA01
caggucgaggccgcggagc

SEQ ID NO: 1416206 - RNA, 14 nt, Pseudomonas aeruginosa PA01
caggucgaggacga

SEQ ID NO: 1416207 - RNA, 23 nt, Pseudomonas aeruginosa PA01
caggucgagggugguuuccaggc

SEQ ID NO: 1416208 - RNA, 17 nt, Pseudomonas aeruginosa PA01
caggucgaucagcagca

SEQ ID NO: 1416209 - RNA, 23 nt, Pseudomonas aeruginosa PA01
caggucgaucagcagcagcgcca

SEQ ID NO: 1416210 - RNA, 24 nt, Pseudomonas aeruginosa PA01
caggucgaucagcagcagcgccau

SEQ ID NO: 1416211 - RNA, 14 nt, Pseudomonas aeruginosa PA01
caggucgggcaacg

SEQ ID NO: 1416212 - RNA, 19 nt, Pseudomonas aeruginosa PA01
caggucgggcaacggcugg

SEQ ID NO: 1416213 - RNA, 19 nt, Pseudomonas aeruginosa PA01
caggucagccaccugcucg

SEQ ID NO: 1416214 - RNA, 16 nt, Pseudomonas aeruginosa PA01
caggucaugcccuggc

SEQ ID NO: 1416215 - RNA, 18 nt, Pseudomonas aeruginosa PA01
caggucaugcccuggccg

SEQ ID NO: 1416216 - RNA, 22 nt, Pseudomonas aeruginosa PA01
caggucaugcccuggccgacgc

SEQ ID NO: 1416217 - RNA, 23 nt, Pseudomonas aeruginosa PA01
caggucaugcccuggccgacgcu

SEQ ID NO: 1416218 - RNA, 21 nt, Pseudomonas aeruginosa PA01
cagguagugcaacaccuggcg

SEQ ID NO: 1416219 - RNA, 16 nt, Pseudomonas aeruginosa PA01
cagguagugccgcccu

SEQ ID NO: 1416220 - RNA, 17 nt, Pseudomonas aeruginosa PA01
cagguagucggcgaugc

SEQ ID NO: 1416221 - RNA, 16 nt, Pseudomonas aeruginosa PA01
cagguaggcgccgugc

SEQ ID NO: 1416222 - RNA, 13 nt, Pseudomonas aeruginosa PA01
cagguaggcgcgg

SEQ ID NO: 1416223 - RNA, 17 nt, Pseudomonas aeruginosa PA01
cagguaguucuccaggc

SEQ ID NO: 1416224 - RNA, 20 nt, Pseudomonas aeruginosa PA01
cagguaguucuccaggccca

SEQ ID NO: 1416225 - RNA, 23 nt, Pseudomonas aeruginosa PA01
cagguaguugaggucggcaaagc

SEQ ID NO: 1416226 - RNA, 15 nt, Pseudomonas aeruginosa PA01
cagguagugcggcgg

SEQ ID NO: 1416227 - RNA, 23 nt, Pseudomonas aeruginosa PA01
cagguagugcggcgggcgcccgc

SEQ ID NO: 1416228 - RNA, 16 nt, Pseudomonas aeruginosa PA01
cagguagugcucggcc

SEQ ID NO: 1416229 - RNA, 22 nt, Pseudomonas aeruginosa PA01
cagguaguggcccucgauguag

SEQ ID NO: 1416230 - RNA, 21 nt, Pseudomonas aeruginosa PA01
cagguauucgccggccaggua

SEQ ID NO: 1416231 - RNA, 19 nt, Pseudomonas aeruginosa PA01
cagguauucgcgcucggcg

SEQ ID NO: 1416232 - RNA, 13 nt, Pseudomonas aeruginosa PA01
caggucgagcagu

SEQ ID NO: 1416233 - RNA, 19 nt, Pseudomonas aeruginosa PA01
caggucgagcaguuccggc

SEQ ID NO: 1416234 - RNA, 16 nt, Pseudomonas aeruginosa PA01
caggucgacgccaugg

SEQ ID NO: 1416235 - RNA, 18 nt, Pseudomonas aeruginosa PA01
caggucgacgccgccgag

SEQ ID NO: 1416236 - RNA, 19 nt, Pseudomonas aeruginosa PA01
caggucgacgccgccgagc

SEQ ID NO: 1416237 - RNA, 17 nt, Pseudomonas aeruginosa PA01
caggucgacggcccuga

SEQ ID NO: 1416238 - RNA, 19 nt, Pseudomonas aeruginosa PA01
caggucgacaugcaccagg

SEQ ID NO: 1416239 - RNA, 20 nt, Pseudomonas aeruginosa PA01
caggucgacaugcaccaggc

SEQ ID NO: 1416240 - RNA, 21 nt, Pseudomonas aeruginosa PA01
caggucgacaugcaccaggcc

SEQ ID NO: 1416241 - RNA, 13 nt, Pseudomonas aeruginosa PA01
caggucgaacagc

SEQ ID NO: 1416242 - RNA, 19 nt, Pseudomonas aeruginosa PA01
caggucgaacagcggcugg

SEQ ID NO: 1416243 - RNA, 15 nt, Pseudomonas aeruginosa PA01
cagguccuugaucac

SEQ ID NO: 1416244 - RNA, 19 nt, Pseudomonas aeruginosa PA01
cagguccgcgccucgcgca

SEQ ID NO: 1416245 - RNA, 23 nt, Pseudomonas aeruginosa PA01
cagguccgcaccguagcggcugc

SEQ ID NO: 1416246 - RNA, 16 nt, Pseudomonas aeruginosa PA01
cagggcgggccgcucg

SEQ ID NO: 1416247 - RNA, 16 nt, Pseudomonas aeruginosa PA01
cagggcgguacgccgc

SEQ ID NO: 1416248 - RNA, 18 nt, Pseudomonas aeruginosa PA01
cagggcgguacgccgcgc

SEQ ID NO: 1416249 - RNA, 14 nt, Pseudomonas aeruginosa PA01
cagggcggucggcc

SEQ ID NO: 1416250 - RNA, 23 nt, Pseudomonas aeruginosa PA01
cagggcggugagguugccgccga

SEQ ID NO: 1416251 - RNA, 13 nt, Pseudomonas aeruginosa PA01
cagggcggcgcgg

SEQ ID NO: 1416252 - RNA, 16 nt, Pseudomonas aeruginosa PA01
cagggcggcgcggagc

SEQ ID NO: 1416253 - RNA, 14 nt, Pseudomonas aeruginosa PA01
cagggcggcggcga

SEQ ID NO: 1416254 - RNA, 18 nt, Pseudomonas aeruginosa PA01
cagggcggcuuccaggua

SEQ ID NO: 1416255 - RNA, 13 nt, Pseudomonas aeruginosa PA01
cagggcggcagcg

SEQ ID NO: 1416256 - RNA, 15 nt, Pseudomonas aeruginosa PA01
cagggcggcgccugg

SEQ ID NO: 1416257 - RNA, 13 nt, Pseudomonas aeruginosa PA01
cagggcggcgccg

SEQ ID NO: 1416258 - RNA, 16 nt, Pseudomonas aeruginosa PA01
cagggcggcgccgaac

SEQ ID NO: 1416259 - RNA, 12 nt, Pseudomonas aeruginosa PA01
cagggcgccggg

SEQ ID NO: 1416260 - RNA, 18 nt, Pseudomonas aeruginosa PA01
cagggcgccgggcugccg

SEQ ID NO: 1416261 - RNA, 19 nt, Pseudomonas aeruginosa PA01
cagggcgccgggcugccga

SEQ ID NO: 1416262 - RNA, 20 nt, Pseudomonas aeruginosa PA01
cagggcggauaaucgcagcg

SEQ ID NO: 1416263 - RNA, 23 nt, Pseudomonas aeruginosa PA01
cagggcggauaaucgcagcgcgg

SEQ ID NO: 1416264 - RNA, 11 nt, Pseudomonas aeruginosa PA01
cagggcgcuga

SEQ ID NO: 1416265 - RNA, 16 nt, Pseudomonas aeruginosa PA01
cagggcgcugaccagg

SEQ ID NO: 1416266 - RNA, 17 nt, Pseudomonas aeruginosa PA01
cagggcgcugagcgcgg

SEQ ID NO: 1416267 - RNA, 13 nt, Pseudomonas aeruginosa PA01
cagggcgcugccg

SEQ ID NO: 1416268 - RNA, 14 nt, Pseudomonas aeruginosa PA01
cagggcgcugccga

SEQ ID NO: 1416269 - RNA, 16 nt, Pseudomonas aeruginosa PA01
cagggcgcgguaggga

SEQ ID NO: 1416270 - RNA, 17 nt, Pseudomonas aeruginosa PA01
cagggcgcgguagggau

SEQ ID NO: 1416271 - RNA, 13 nt, Pseudomonas aeruginosa PA01
caggggcgcgccg

SEQ ID NO: 1416272 - RNA, 20 nt, Pseudomonas aeruginosa PA01
caggggcuagucgcgcagcg

SEQ ID NO: 1416273 - RNA, 15 nt, Pseudomonas aeruginosa PA01
caggggagcgccggc

SEQ ID NO: 1416274 - RNA, 19 nt, Pseudomonas aeruginosa PA01
caggggagcgccggcgcgg

SEQ ID NO: 1416275 - RNA, 18 nt, Pseudomonas aeruginosa PA01
caggggcauguccaccgc

SEQ ID NO: 1416276 - RNA, 21 nt, Pseudomonas aeruginosa PA01
caggggcauguccaccgccgc

SEQ ID NO: 1416277 - RNA, 22 nt, Pseudomonas aeruginosa PA01
cagggcuugcgcgccaccagcg

SEQ ID NO: 1416278 - RNA, 22 nt, Pseudomonas aeruginosa PA01
cagggcuucccaggccagcggg

SEQ ID NO: 1416279 - RNA, 16 nt, Pseudomonas aeruginosa PA01
cagggcuucgcgcaga

SEQ ID NO: 1416280 - RNA, 18 nt, Pseudomonas aeruginosa PA01
caggggccgacgcgcugc

SEQ ID NO: 1416281 - RNA, 23 nt, Pseudomonas aeruginosa PA01
cagggggaucgcgaagaacacgc

SEQ ID NO: 1416282 - RNA, 21 nt, Pseudomonas aeruginosa PA01
cagggggcgacauagcggcug

SEQ ID NO: 1416283 - RNA, 14 nt, Pseudomonas aeruginosa PA01
caggggguagggcg

SEQ ID NO: 1416284 - RNA, 20 nt, Pseudomonas aeruginosa PA01
cagggggacgaaaaccgcag

SEQ ID NO: 1416285 - RNA, 15 nt, Pseudomonas aeruginosa PA01
caggggcugaacagc

SEQ ID NO: 1416286 - RNA, 14 nt, Pseudomonas aeruginosa PA01
caggggcucggcga

SEQ ID NO: 1416287 - RNA, 19 nt, Pseudomonas aeruginosa PA01
caggguacuucgugccaca

SEQ ID NO: 1416288 - RNA, 22 nt, Pseudomonas aeruginosa PA01
caggguaccguugcgcaggcgu

SEQ ID NO: 1416289 - RNA, 14 nt, Pseudomonas aeruginosa PA01
caggguagccacgc

SEQ ID NO: 1416290 - RNA, 18 nt, Pseudomonas aeruginosa PA01
caggguagcgccgcgggc

SEQ ID NO: 1416291 - RNA, 15 nt, Pseudomonas aeruginosa PA01
caggggucaggccga

SEQ ID NO: 1416292 - RNA, 18 nt, Pseudomonas aeruginosa PA01
caggggucgacgcagggc

SEQ ID NO: 1416293 - RNA, 17 nt, Pseudomonas aeruginosa PA01
caggggucggcaucgcg

SEQ ID NO: 1416294 - RNA, 14 nt, Pseudomonas aeruginosa PA01
cagggccagcagcg

SEQ ID NO: 1416295 - RNA, 15 nt, Pseudomonas aeruginosa PA01
cagggccagcagcgc

SEQ ID NO: 1416296 - RNA, 17 nt, Pseudomonas aeruginosa PA01
cagggccagcagcggcg

SEQ ID NO: 1416297 - RNA, 18 nt, Pseudomonas aeruginosa PA01
cagggccagcagcggcgg

SEQ ID NO: 1416298 - RNA, 22 nt, Pseudomonas aeruginosa PA01
cagggccagcagcggcggcgcc

SEQ ID NO: 1416299 - RNA, 14 nt, Pseudomonas aeruginosa PA01
cagggccagccaga

SEQ ID NO: 1416300 - RNA, 19 nt, Pseudomonas aeruginosa PA01
caggcgcgggucaucggcc

SEQ ID NO: 1416301 - RNA, 21 nt, Pseudomonas aeruginosa PA01
caggcgcgggucaucggcccg

SEQ ID NO: 1416302 - RNA, 22 nt, Pseudomonas aeruginosa PA01
caggcgcgggucuucaggccgc

SEQ ID NO: 1416303 - RNA, 20 nt, Pseudomonas aeruginosa PA01
cagggcauuggccaucagcg

SEQ ID NO: 1416304 - RNA, 22 nt, Pseudomonas aeruginosa PA01
cagggcauuggccaucagcgcc

SEQ ID NO: 1416305 - RNA, 23 nt, Pseudomonas aeruginosa PA01
caggcgcgucuccagcucggcga

SEQ ID NO: 1416306 - RNA, 14 nt, Pseudomonas aeruginosa PA01
cagggcaucgauga

SEQ ID NO: 1416307 - RNA, 12 nt, Pseudomonas aeruginosa PA01
cagggccgagca

SEQ ID NO: 1416308 - RNA, 17 nt, Pseudomonas aeruginosa PA01
cagggccgagcgcagcg

SEQ ID NO: 1416309 - RNA, 23 nt, Pseudomonas aeruginosa PA01
cagggcccagagcagcaccagca

SEQ ID NO: 1416310 - RNA, 20 nt, Pseudomonas aeruginosa PA01
cagggccagcuuggucggga

SEQ ID NO: 1416311 - RNA, 19 nt, Pseudomonas aeruginosa PA01
caggcgcgguugccgcugc

SEQ ID NO: 1416312 - RNA, 14 nt, Pseudomonas aeruginosa PA01
cagggccagcgccu

SEQ ID NO: 1416313 - RNA, 16 nt, Pseudomonas aeruginosa PA01
cagggccagcgccugg

SEQ ID NO: 1416314 - RNA, 14 nt, Pseudomonas aeruginosa PA01
cagggccaggccga

SEQ ID NO: 1416315 - RNA, 23 nt, Pseudomonas aeruginosa PA01
cagggccagggaaaucaggaagg

SEQ ID NO: 1416316 - RNA, 19 nt, Pseudomonas aeruginosa PA01
cagggccagggaggcgcug

SEQ ID NO: 1416317 - RNA, 22 nt, Pseudomonas aeruginosa PA01
cagggccagggaggcgcuggcc

SEQ ID NO: 1416318 - RNA, 14 nt, Pseudomonas aeruginosa PA01
cagggccagggcgg

SEQ ID NO: 1416319 - RNA, 18 nt, Pseudomonas aeruginosa PA01
cagggccggaucggccuu

SEQ ID NO: 1416320 - RNA, 14 nt, Pseudomonas aeruginosa PA01
cagggccaggagca

SEQ ID NO: 1416321 - RNA, 16 nt, Pseudomonas aeruginosa PA01
cagggccgcgccgagc

SEQ ID NO: 1416322 - RNA, 17 nt, Pseudomonas aeruginosa PA01
cagggccgcgccgagcc

SEQ ID NO: 1416323 - RNA, 13 nt, Pseudomonas aeruginosa PA01
cagggccgcgaga

SEQ ID NO: 1416324 - RNA, 13 nt, Pseudomonas aeruginosa PA01
cagggccgccagc

SEQ ID NO: 1416325 - RNA, 14 nt, Pseudomonas aeruginosa PA01
cagggccgccagcc

SEQ ID NO: 1416326 - RNA, 15 nt, Pseudomonas aeruginosa PA01
cagggccgccagccg

SEQ ID NO: 1416327 - RNA, 16 nt, Pseudomonas aeruginosa PA01
cagggccgccagccgc

SEQ ID NO: 1416328 - RNA, 18 nt, Pseudomonas aeruginosa PA01
cagggccgccagccgcca

SEQ ID NO: 1416329 - RNA, 21 nt, Pseudomonas aeruginosa PA01
cagggccgccagccgccagga

SEQ ID NO: 1416330 - RNA, 16 nt, Pseudomonas aeruginosa PA01
cagggcgauccagaag

SEQ ID NO: 1416331 - RNA, 23 nt, Pseudomonas aeruginosa PA01
cagggcgaggaucacgcagcagg

SEQ ID NO: 1416332 - RNA, 22 nt, Pseudomonas aeruginosa PA01
cagggcgaggccgcucuucugg

SEQ ID NO: 1416333 - RNA, 16 nt, Pseudomonas aeruginosa PA01
cagggcgagcagggca

SEQ ID NO: 1416334 - RNA, 18 nt, Pseudomonas aeruginosa PA01
cagggcgagcagggcgcu

SEQ ID NO: 1416335 - RNA, 20 nt, Pseudomonas aeruginosa PA01
cagggcgagcagggcgcuga

SEQ ID NO: 1416336 - RNA, 15 nt, Pseudomonas aeruginosa PA01
cagggcgaugccgau

SEQ ID NO: 1416337 - RNA, 16 nt, Pseudomonas aeruginosa PA01
cagggcgauggccagc

SEQ ID NO: 1416338 - RNA, 19 nt, Pseudomonas aeruginosa PA01
cagggcgauggccagcgcg

SEQ ID NO: 1416339 - RNA, 14 nt, Pseudomonas aeruginosa PA01
cagggcgcccgccc

SEQ ID NO: 1416340 - RNA, 16 nt, Pseudomonas aeruginosa PA01
cagggcgcccgcccgg

SEQ ID NO: 1416341 - RNA, 18 nt, Pseudomonas aeruginosa PA01
cagggcgcccgcccggca

SEQ ID NO: 1416342 - RNA, 15 nt, Pseudomonas aeruginosa PA01
cagggcgcaaccugg

SEQ ID NO: 1416343 - RNA, 20 nt, Pseudomonas aeruginosa PA01
cagggcgcaauugcaccgcu

SEQ ID NO: 1416344 - RNA, 22 nt, Pseudomonas aeruginosa PA01
caggguguuguucgccagcagg

SEQ ID NO: 1416345 - RNA, 16 nt, Pseudomonas aeruginosa PA01
caggguuggcggcauc

SEQ ID NO: 1416346 - RNA, 21 nt, Pseudomonas aeruginosa PA01
caggguuuccagcagcacccg

SEQ ID NO: 1416347 - RNA, 16 nt, Pseudomonas aeruginosa PA01
caggguuuccugguac

SEQ ID NO: 1416348 - RNA, 18 nt, Pseudomonas aeruginosa PA01
cagguaccggccaggcgg

SEQ ID NO: 1416349 - RNA, 13 nt, Pseudomonas aeruginosa PA01
cagguacggcccg

SEQ ID NO: 1416350 - RNA, 16 nt, Pseudomonas aeruginosa PA01
cagguacggcgccgcu

SEQ ID NO: 1416351 - RNA, 14 nt, Pseudomonas aeruginosa PA01
cagguaagcggcgu

SEQ ID NO: 1416352 - RNA, 16 nt, Pseudomonas aeruginosa PA01
cagguaacccgcggcg

SEQ ID NO: 1416353 - RNA, 16 nt, Pseudomonas aeruginosa PA01
cagguagucgcccagc

SEQ ID NO: 1416354 - RNA, 19 nt, Pseudomonas aeruginosa PA01
cagguagucgcccagcgcc

SEQ ID NO: 1416355 - RNA, 14 nt, Pseudomonas aeruginosa PA01
cagguagucgcccg

SEQ ID NO: 1416356 - RNA, 15 nt, Pseudomonas aeruginosa PA01
cagguaguccagcgg

SEQ ID NO: 1416357 - RNA, 14 nt, Pseudomonas aeruginosa PA01
cagguaggcggugg

SEQ ID NO: 1416358 - RNA, 18 nt, Pseudomonas aeruginosa PA01
cagguagcgcugcgccag

SEQ ID NO: 1416359 - RNA, 15 nt, Pseudomonas aeruginosa PA01
cagguagccccggcc

SEQ ID NO: 1416360 - RNA, 17 nt, Pseudomonas aeruginosa PA01
cagguagccccggcccg

SEQ ID NO: 1416361 - RNA, 16 nt, Pseudomonas aeruginosa PA01
cagguaggcgacgaag

SEQ ID NO: 1416362 - RNA, 20 nt, Pseudomonas aeruginosa PA01
cagguaggcgaugcgcgugg

SEQ ID NO: 1416363 - RNA, 13 nt, Pseudomonas aeruginosa PA01
cagguaggcgccg

SEQ ID NO: 1416364 - RNA, 18 nt, Pseudomonas aeruginosa PA01
cagguagcucaucggcga

SEQ ID NO: 1416365 - RNA, 18 nt, Pseudomonas aeruginosa PA01
cagguagcugagcaggcc

SEQ ID NO: 1416366 - RNA, 20 nt, Pseudomonas aeruginosa PA01
cagguagcugagcaggccga

SEQ ID NO: 1416367 - RNA, 20 nt, Pseudomonas aeruginosa PA01
cagguagcugcuccagcccg

SEQ ID NO: 1416368 - RNA, 22 nt, Pseudomonas aeruginosa PA01
cagguaggagagggucagcagg

SEQ ID NO: 1416369 - RNA, 22 nt, Pseudomonas aeruginosa PA01
cagguagaagaacaucggcgcu

SEQ ID NO: 1416370 - RNA, 19 nt, Pseudomonas aeruginosa PA01
cagguagaccacgcaggcc

SEQ ID NO: 1416371 - RNA, 15 nt, Pseudomonas aeruginosa PA01
cagguacucgccggc

SEQ ID NO: 1416372 - RNA, 19 nt, Pseudomonas aeruginosa PA01
cagguacucggcccgggcc

SEQ ID NO: 1416373 - RNA, 23 nt, Pseudomonas aeruginosa PA01
cagguagccgccuuguuccaggc

SEQ ID NO: 1416374 - RNA, 16 nt, Pseudomonas aeruginosa PA01
cagguagccgcgccgg

SEQ ID NO: 1416375 - RNA, 22 nt, Pseudomonas aeruginosa PA01
cagguagccggcgagcgccugg

SEQ ID NO: 1416376 - RNA, 17 nt, Pseudomonas aeruginosa PA01
cagguagccugcggcca

SEQ ID NO: 1416377 - RNA, 20 nt, Pseudomonas aeruginosa PA01
cagguagccugcggccagcg

SEQ ID NO: 1416378 - RNA, 14 nt, Pseudomonas aeruginosa PA01
cagguagagggcgu

SEQ ID NO: 1416379 - RNA, 14 nt, Pseudomonas aeruginosa PA01
cagguagcccaccu

SEQ ID NO: 1416380 - RNA, 23 nt, Pseudomonas aeruginosa PA01
cagggucgagucgggucuucggg

SEQ ID NO: 1416381 - RNA, 14 nt, Pseudomonas aeruginosa PA01
cagggucgccagca

SEQ ID NO: 1416382 - RNA, 16 nt, Pseudomonas aeruginosa PA01
cagggucgcccgugcc

SEQ ID NO: 1416383 - RNA, 23 nt, Pseudomonas aeruginosa PA01
cagggucgcccgugccucggcgg

SEQ ID NO: 1416384 - RNA, 17 nt, Pseudomonas aeruginosa PA01
cagggucgccgggucga

SEQ ID NO: 1416385 - RNA, 22 nt, Pseudomonas aeruginosa PA01
cagggucacgccgaucaccccg

SEQ ID NO: 1416386 - RNA, 16 nt, Pseudomonas aeruginosa PA01
cagggucacgcugggc

SEQ ID NO: 1416387 - RNA, 17 nt, Pseudomonas aeruginosa PA01
cagggucacgcugggca

SEQ ID NO: 1416388 - RNA, 13 nt, Pseudomonas aeruginosa PA01
cagggucagccga

SEQ ID NO: 1416389 - RNA, 19 nt, Pseudomonas aeruginosa PA01
caggguauuuuccagcagg

SEQ ID NO: 1416390 - RNA, 22 nt, Pseudomonas aeruginosa PA01
caggguauuuuccagcaggcag

SEQ ID NO: 1416391 - RNA, 13 nt, Pseudomonas aeruginosa PA01
cagggucucgcgg

SEQ ID NO: 1416392 - RNA, 14 nt, Pseudomonas aeruginosa PA01
cagggucucgcggg

SEQ ID NO: 1416393 - RNA, 17 nt, Pseudomonas aeruginosa PA01
cagggucagguugccgg

SEQ ID NO: 1416394 - RNA, 18 nt, Pseudomonas aeruginosa PA01
cagggugaagcugcggcu

SEQ ID NO: 1416395 - RNA, 13 nt, Pseudomonas aeruginosa PA01
cagggucuucagg

SEQ ID NO: 1416396 - RNA, 16 nt, Pseudomonas aeruginosa PA01
cagggucuucaggccg

SEQ ID NO: 1416397 - RNA, 15 nt, Pseudomonas aeruginosa PA01
cagggucgggccgcg

SEQ ID NO: 1416398 - RNA, 19 nt, Pseudomonas aeruginosa PA01
cagggucgguucgcggcgc

SEQ ID NO: 1416399 - RNA, 16 nt, Pseudomonas aeruginosa PA01
cagggucgcguuggcg

SEQ ID NO: 1416400 - RNA, 16 nt, Pseudomonas aeruginosa PA01
cagggucggcaccgag

SEQ ID NO: 1416401 - RNA, 15 nt, Pseudomonas aeruginosa PA01
cagggucaggcccuu

SEQ ID NO: 1416402 - RNA, 13 nt, Pseudomonas aeruginosa PA01
cagggucgcgagc

SEQ ID NO: 1416403 - RNA, 20 nt, Pseudomonas aeruginosa PA01
cagggucgcgagcagggcga

SEQ ID NO: 1416404 - RNA, 21 nt, Pseudomonas aeruginosa PA01
caggguguagguauccgccgg

SEQ ID NO: 1416405 - RNA, 23 nt, Pseudomonas aeruginosa PA01
caggguguagguauccgccggcc

SEQ ID NO: 1416406 - RNA, 18 nt, Pseudomonas aeruginosa PA01
caggguggggaugcgcga

SEQ ID NO: 1416407 - RNA, 19 nt, Pseudomonas aeruginosa PA01
caggguggcgaccgccgua

SEQ ID NO: 1416408 - RNA, 14 nt, Pseudomonas aeruginosa PA01
caggguggcgcugc

SEQ ID NO: 1416409 - RNA, 23 nt, Pseudomonas aeruginosa PA01
caggguggcgcugccuucgaagc

SEQ ID NO: 1416410 - RNA, 13 nt, Pseudomonas aeruginosa PA01
caggguggcggcg

SEQ ID NO: 1416411 - RNA, 16 nt, Pseudomonas aeruginosa PA01
caggguggcggcggcg

SEQ ID NO: 1416412 - RNA, 23 nt, Pseudomonas aeruginosa PA01
cagggugcggauggcgaucgagc

SEQ ID NO: 1416413 - RNA, 13 nt, Pseudomonas aeruginosa PA01
cagggugcggcug

SEQ ID NO: 1416414 - RNA, 20 nt, Pseudomonas aeruginosa PA01
cagggugcguacggucaugc

SEQ ID NO: 1416415 - RNA, 23 nt, Pseudomonas aeruginosa PA01
cagggugcguacggucaugccga

SEQ ID NO: 1416416 - RNA, 21 nt, Pseudomonas aeruginosa PA01
cagggugcgccggggaucagg

SEQ ID NO: 1416417 - RNA, 15 nt, Pseudomonas aeruginosa PA01
cagggugccgaccaa

SEQ ID NO: 1416418 - RNA, 23 nt, Pseudomonas aeruginosa PA01
cagggugacggugaucgccgcga

SEQ ID NO: 1416419 - RNA, 19 nt, Pseudomonas aeruginosa PA01
caucaacgagccgagcagg

SEQ ID NO: 1416420 - RNA, 22 nt, Pseudomonas aeruginosa PA01
caucaacgagccgagcaggcca

SEQ ID NO: 1416421 - RNA, 15 nt, Pseudomonas aeruginosa PA01
caucaccacgaucag

SEQ ID NO: 1416422 - RNA, 22 nt, Pseudomonas aeruginosa PA01
caucaccacgcgauauccgcca

SEQ ID NO: 1416423 - RNA, 16 nt, Pseudomonas aeruginosa PA01
caucacguacggcgcc

SEQ ID NO: 1416424 - RNA, 13 nt, Pseudomonas aeruginosa PA01
caucacgucgcgc

SEQ ID NO: 1416425 - RNA, 21 nt, Pseudomonas aeruginosa PA01
caucacgucgcgcaccuggcg

SEQ ID NO: 1416426 - RNA, 11 nt, Pseudomonas aeruginosa PA01
caucaccggca

SEQ ID NO: 1416427 - RNA, 17 nt, Pseudomonas aeruginosa PA01
caucaccggcagcagcg

SEQ ID NO: 1416428 - RNA, 22 nt, Pseudomonas aeruginosa PA01
caucaccaggcugccgccguag

SEQ ID NO: 1416429 - RNA, 14 nt, Pseudomonas aeruginosa PA01
caucaccagcgccg

SEQ ID NO: 1416430 - RNA, 15 nt, Pseudomonas aeruginosa PA01
caucaccagcgccgu

SEQ ID NO: 1416431 - RNA, 16 nt, Pseudomonas aeruginosa PA01
caucagugccugcacg

SEQ ID NO: 1416432 - RNA, 14 nt, Pseudomonas aeruginosa PA01
caucaucggacgcc

SEQ ID NO: 1416433 - RNA, 23 nt, Pseudomonas aeruginosa PA01
caucagaggcaacaccaucggcc

SEQ ID NO: 1416434 - RNA, 14 nt, Pseudomonas aeruginosa PA01
caucagggucggcc

SEQ ID NO: 1416435 - RNA, 14 nt, Pseudomonas aeruginosa PA01
caucaggucggcgc

SEQ ID NO: 1416436 - RNA, 18 nt, Pseudomonas aeruginosa PA01
caucaggucggcgcgcac

SEQ ID NO: 1416437 - RNA, 18 nt, Pseudomonas aeruginosa PA01
caucaggucggucuggcg

SEQ ID NO: 1416438 - RNA, 22 nt, Pseudomonas aeruginosa PA01
caucaggucggucuggcggccc

SEQ ID NO: 1416439 - RNA, 15 nt, Pseudomonas aeruginosa PA01
caucaggcucaggcc

SEQ ID NO: 1416440 - RNA, 16 nt, Pseudomonas aeruginosa PA01
caucaggcugccgagc

SEQ ID NO: 1416441 - RNA, 17 nt, Pseudomonas aeruginosa PA01
caucaggcugccgagca

SEQ ID NO: 1416442 - RNA, 20 nt, Pseudomonas aeruginosa PA01
caucaggcugccgagcaggg

SEQ ID NO: 1416443 - RNA, 22 nt, Pseudomonas aeruginosa PA01
caucaggcugccgagcaggguc

SEQ ID NO: 1416444 - RNA, 20 nt, Pseudomonas aeruginosa PA01
cauccccuuuuuucagccug

SEQ ID NO: 1416445 - RNA, 18 nt, Pseudomonas aeruginosa PA01
cauccgcaccauccgccg

SEQ ID NO: 1416446 - RNA, 19 nt, Pseudomonas aeruginosa PA01
cauccgcaccauccgccgc

SEQ ID NO: 1416447 - RNA, 22 nt, Pseudomonas aeruginosa PA01
caucccguuggggaugcgccgu

SEQ ID NO: 1416448 - RNA, 20 nt, Pseudomonas aeruginosa PA01
cauacaggcgcgccuggccc

SEQ ID NO: 1416449 - RNA, 13 nt, Pseudomonas aeruginosa PA01
cauaaccgcucgc

SEQ ID NO: 1416450 - RNA, 21 nt, Pseudomonas aeruginosa PA01
cauaaccccuuugccgagcgg

SEQ ID NO: 1416451 - RNA, 19 nt, Pseudomonas aeruginosa PA01
cauaacgccccucuuccac

SEQ ID NO: 1416452 - RNA, 20 nt, Pseudomonas aeruginosa PA01
caguuggugcacgcgccggg

SEQ ID NO: 1416453 - RNA, 19 nt, Pseudomonas aeruginosa PA01
cauacguccuacgaaggca

SEQ ID NO: 1416454 - RNA, 14 nt, Pseudomonas aeruginosa PA01
cauagaaacgcagg

SEQ ID NO: 1416455 - RNA, 16 nt, Pseudomonas aeruginosa PA01
cauaggcuugcgccga

SEQ ID NO: 1416456 - RNA, 15 nt, Pseudomonas aeruginosa PA01
cauagucggugaccu

SEQ ID NO: 1416457 - RNA, 14 nt, Pseudomonas aeruginosa PA01
cagugccucccggc

SEQ ID NO: 1416458 - RNA, 19 nt, Pseudomonas aeruginosa PA01
cagugccgcggugcgggcc

SEQ ID NO: 1416459 - RNA, 16 nt, Pseudomonas aeruginosa PA01
cagugccugcaccacg

SEQ ID NO: 1416460 - RNA, 23 nt, Pseudomonas aeruginosa PA01
cagugccugcaccacgcaggcgc

SEQ ID NO: 1416461 - RNA, 16 nt, Pseudomonas aeruginosa PA01
cagugcgagucggcga

SEQ ID NO: 1416462 - RNA, 14 nt, Pseudomonas aeruginosa PA01
caguggcuccgcgc

SEQ ID NO: 1416463 - RNA, 17 nt, Pseudomonas aeruginosa PA01
caguggcgccgccaugg

SEQ ID NO: 1416464 - RNA, 13 nt, Pseudomonas aeruginosa PA01
caguggcgccagc

SEQ ID NO: 1416465 - RNA, 11 nt, Pseudomonas aeruginosa PA01
cagugcgcccu

SEQ ID NO: 1416466 - RNA, 14 nt, Pseudomonas aeruginosa PA01
cagugcgcccucga

SEQ ID NO: 1416467 - RNA, 22 nt, Pseudomonas aeruginosa PA01
cagugcgcccucgaacggcgug

SEQ ID NO: 1416468 - RNA, 19 nt, Pseudomonas aeruginosa PA01
cagugcgccggcaucgcca

SEQ ID NO: 1416469 - RNA, 13 nt, Pseudomonas aeruginosa PA01
cagugcgccgggu

SEQ ID NO: 1416470 - RNA, 21 nt, Pseudomonas aeruginosa PA01
cagucgcccccaccgcccccg

SEQ ID NO: 1416471 - RNA, 18 nt, Pseudomonas aeruginosa PA01
cagucgcggaagcggcaa

SEQ ID NO: 1416472 - RNA, 17 nt, Pseudomonas aeruginosa PA01
cagucgccgcaccggcg

SEQ ID NO: 1416473 - RNA, 17 nt, Pseudomonas aeruginosa PA01
cagucgcugcucggccu

SEQ ID NO: 1416474 - RNA, 16 nt, Pseudomonas aeruginosa PA01
caguccggcagcacgg

SEQ ID NO: 1416475 - RNA, 12 nt, Pseudomonas aeruginosa PA01
cagucgccuggc

SEQ ID NO: 1416476 - RNA, 15 nt, Pseudomonas aeruginosa PA01
cagucgccuggcccu

SEQ ID NO: 1416477 - RNA, 13 nt, Pseudomonas aeruginosa PA01
caguucagccacu

SEQ ID NO: 1416478 - RNA, 15 nt, Pseudomonas aeruginosa PA01
caguucaucgagcag

SEQ ID NO: 1416479 - RNA, 16 nt, Pseudomonas aeruginosa PA01
caguucaggcugggcc

SEQ ID NO: 1416480 - RNA, 21 nt, Pseudomonas aeruginosa PA01
caguucagggcgagcagggca

SEQ ID NO: 1416481 - RNA, 12 nt, Pseudomonas aeruginosa PA01
caguucagccgg

SEQ ID NO: 1416482 - RNA, 13 nt, Pseudomonas aeruginosa PA01
caguucagcgcgc

SEQ ID NO: 1416483 - RNA, 19 nt, Pseudomonas aeruginosa PA01
cagugguuccaggagggcu

SEQ ID NO: 1416484 - RNA, 20 nt, Pseudomonas aeruginosa PA01
caguggugauccgcacccgc

SEQ ID NO: 1416485 - RNA, 16 nt, Pseudomonas aeruginosa PA01
cagugggccaccggcu

SEQ ID NO: 1416486 - RNA, 17 nt, Pseudomonas aeruginosa PA01
caguggguaggccaggc

SEQ ID NO: 1416487 - RNA, 19 nt, Pseudomonas aeruginosa PA01
caguggguaggccaggcaa

SEQ ID NO: 1416488 - RNA, 15 nt, Pseudomonas aeruginosa PA01
caguuccugcaccac

SEQ ID NO: 1416489 - RNA, 16 nt, Pseudomonas aeruginosa PA01
caguuccugcaccacg

SEQ ID NO: 1416490 - RNA, 13 nt, Pseudomonas aeruginosa PA01
caguugcaccgca

SEQ ID NO: 1416491 - RNA, 17 nt, Pseudomonas aeruginosa PA01
caguugcaguaccugcu

SEQ ID NO: 1416492 - RNA, 23 nt, Pseudomonas aeruginosa PA01
caguugcccgagugccggcgcgu

SEQ ID NO: 1416493 - RNA, 16 nt, Pseudomonas aeruginosa PA01
caguugccgcagcagc

SEQ ID NO: 1416494 - RNA, 20 nt, Pseudomonas aeruginosa PA01
caguuccggggucagcgccu

SEQ ID NO: 1416495 - RNA, 22 nt, Pseudomonas aeruginosa PA01
caguuccucgcggaagcguugc

SEQ ID NO: 1416496 - RNA, 20 nt, Pseudomonas aeruginosa PA01
caguuccgacugcgagccga

SEQ ID NO: 1416497 - RNA, 17 nt, Pseudomonas aeruginosa PA01
caguuccgcaucggcca

SEQ ID NO: 1416498 - RNA, 22 nt, Pseudomonas aeruginosa PA01
caguugcucgcuccgagcaggc

SEQ ID NO: 1416499 - RNA, 23 nt, Pseudomonas aeruginosa PA01
caguugcucgcuccgagcaggcc

SEQ ID NO: 1416500 - RNA, 19 nt, Pseudomonas aeruginosa PA01
caguugcugaucaggccga

SEQ ID NO: 1416501 - RNA, 17 nt, Pseudomonas aeruginosa PA01
caguuggacgcggccug

SEQ ID NO: 1416502 - RNA, 14 nt, Pseudomonas aeruginosa PA01
caguugcgggcgca

SEQ ID NO: 1416503 - RNA, 16 nt, Pseudomonas aeruginosa PA01
caguugcgccgccugc

SEQ ID NO: 1416504 - RNA, 23 nt, Pseudomonas aeruginosa PA01
caguugcgccgccugcggcuugc

SEQ ID NO: 1416505 - RNA, 18 nt, Pseudomonas aeruginosa PA01
caguugcgcgccggcggg

SEQ ID NO: 1416506 - RNA, 19 nt, Pseudomonas aeruginosa PA01
cacggucuuggcggcgauc

SEQ ID NO: 1416507 - RNA, 19 nt, Pseudomonas aeruginosa PA01
cacggugaaccaggcgccg

SEQ ID NO: 1416508 - RNA, 23 nt, Pseudomonas aeruginosa PA01
cacggugaaccaggcgccgaugc

SEQ ID NO: 1416509 - RNA, 12 nt, Pseudomonas aeruginosa PA01
cacgguacacgc

SEQ ID NO: 1416510 - RNA, 14 nt, Pseudomonas aeruginosa PA01
cacgguacacgccg

SEQ ID NO: 1416511 - RNA, 22 nt, Pseudomonas aeruginosa PA01
cacgggucgucgcccuggccga

SEQ ID NO: 1416512 - RNA, 21 nt, Pseudomonas aeruginosa PA01
cacgggugccggagaacgccg

SEQ ID NO: 1416513 - RNA, 22 nt, Pseudomonas aeruginosa PA01
cacggguguuucggccgcugcc

SEQ ID NO: 1416514 - RNA, 18 nt, Pseudomonas aeruginosa PA01
cacgggucgcagccgagc

SEQ ID NO: 1416515 - RNA, 16 nt, Pseudomonas aeruginosa PA01
cacggugaggaccugg

SEQ ID NO: 1416516 - RNA, 17 nt, Pseudomonas aeruginosa PA01
cacggugacacccugcc

SEQ ID NO: 1416517 - RNA, 19 nt, Pseudomonas aeruginosa PA01
cacggugacacccugccgc

SEQ ID NO: 1416518 - RNA, 19 nt, Pseudomonas aeruginosa PA01
cacggugaugguaucgccg

SEQ ID NO: 1416519 - RNA, 13 nt, Pseudomonas aeruginosa PA01
cacggugccaucc

SEQ ID NO: 1416520 - RNA, 12 nt, Pseudomonas aeruginosa PA01
cacggcucggcg

SEQ ID NO: 1416521 - RNA, 15 nt, Pseudomonas aeruginosa PA01
cacggcucggcgagg

SEQ ID NO: 1416522 - RNA, 16 nt, Pseudomonas aeruginosa PA01
cacggcucggcgagga

SEQ ID NO: 1416523 - RNA, 16 nt, Pseudomonas aeruginosa PA01
cacggcgugccgcagg

SEQ ID NO: 1416524 - RNA, 22 nt, Pseudomonas aeruginosa PA01
cacggcgugccgcaggccgcgg

SEQ ID NO: 1416525 - RNA, 12 nt, Pseudomonas aeruginosa PA01
cacgggcggccg

SEQ ID NO: 1416526 - RNA, 22 nt, Pseudomonas aeruginosa PA01
cacggguaacgguagcggcagg

SEQ ID NO: 1416527 - RNA, 23 nt, Pseudomonas aeruginosa PA01
cacggguaacgguagcggcagga

SEQ ID NO: 1416528 - RNA, 15 nt, Pseudomonas aeruginosa PA01
cacggcuucagcgcc

SEQ ID NO: 1416529 - RNA, 19 nt, Pseudomonas aeruginosa PA01
cacggcuucagcgccaggc

SEQ ID NO: 1416530 - RNA, 20 nt, Pseudomonas aeruginosa PA01
cacggcuucagcgccaggcc

SEQ ID NO: 1416531 - RNA, 21 nt, Pseudomonas aeruginosa PA01
cacggcuucagcgccaggccg

SEQ ID NO: 1416532 - RNA, 22 nt, Pseudomonas aeruginosa PA01
cacggcuucagcgccaggccga

SEQ ID NO: 1416533 - RNA, 12 nt, Pseudomonas aeruginosa PA01
cacgucggcccg

SEQ ID NO: 1416534 - RNA, 14 nt, Pseudomonas aeruginosa PA01
cacgucgcgcaccu

SEQ ID NO: 1416535 - RNA, 17 nt, Pseudomonas aeruginosa PA01
cacggccuccgguggcg

SEQ ID NO: 1416536 - RNA, 12 nt, Pseudomonas aeruginosa PA01
cacggccucgcg

SEQ ID NO: 1416537 - RNA, 21 nt, Pseudomonas aeruginosa PA01
cacggccgucacggccuccgg

SEQ ID NO: 1416538 - RNA, 12 nt, Pseudomonas aeruginosa PA01
cacggccgaaca

SEQ ID NO: 1416539 - RNA, 23 nt, Pseudomonas aeruginosa PA01
cacggccgaacagacgcaggcag

SEQ ID NO: 1416540 - RNA, 24 nt, Pseudomonas aeruginosa PA01
cacggccgaacagacgcaggcagg

SEQ ID NO: 1416541 - RNA, 17 nt, Pseudomonas aeruginosa PA01
cacggccgcugcgcagg

SEQ ID NO: 1416542 - RNA, 19 nt, Pseudomonas aeruginosa PA01
cacggccgcugcgcaggcc

SEQ ID NO: 1416543 - RNA, 21 nt, Pseudomonas aeruginosa PA01
cacggccgcugcgcaggccga

SEQ ID NO: 1416544 - RNA, 14 nt, Pseudomonas aeruginosa PA01
cacggcgaucgccg

SEQ ID NO: 1416545 - RNA, 20 nt, Pseudomonas aeruginosa PA01
cacggcgauggucaggacgc

SEQ ID NO: 1416546 - RNA, 17 nt, Pseudomonas aeruginosa PA01
cacggcgauacccaggc

SEQ ID NO: 1416547 - RNA, 18 nt, Pseudomonas aeruginosa PA01
cacggcgauacccaggcc

SEQ ID NO: 1416548 - RNA, 20 nt, Pseudomonas aeruginosa PA01
cacggcgauacccaggccgu

SEQ ID NO: 1416549 - RNA, 22 nt, Pseudomonas aeruginosa PA01
cacggcgauacccaggccgucg

SEQ ID NO: 1416550 - RNA, 23 nt, Pseudomonas aeruginosa PA01
cacggcgauacccaggccgucga

SEQ ID NO: 1416551 - RNA, 13 nt, Pseudomonas aeruginosa PA01
cacggcgccccgg

SEQ ID NO: 1416552 - RNA, 15 nt, Pseudomonas aeruginosa PA01
cacggcgcagccgca

SEQ ID NO: 1416553 - RNA, 16 nt, Pseudomonas aeruginosa PA01
cacggcgcagccgcaa

SEQ ID NO: 1416554 - RNA, 17 nt, Pseudomonas aeruginosa PA01
cacggcgcagccgcaag

SEQ ID NO: 1416555 - RNA, 22 nt, Pseudomonas aeruginosa PA01
cacggcgccuucccagauaccg

SEQ ID NO: 1416556 - RNA, 15 nt, Pseudomonas aeruginosa PA01
cacggcgcgagaaaa

SEQ ID NO: 1416557 - RNA, 14 nt, Pseudomonas aeruginosa PA01
cacggcgcgcuccg

SEQ ID NO: 1416558 - RNA, 22 nt, Pseudomonas aeruginosa PA01
cacggcgcgcuccggcgcgcca

SEQ ID NO: 1416559 - RNA, 13 nt, Pseudomonas aeruginosa PA01
cacggcgcggaac

SEQ ID NO: 1416560 - RNA, 15 nt, Pseudomonas aeruginosa PA01
cacggcgcggccgug

SEQ ID NO: 1416561 - RNA, 23 nt, Pseudomonas aeruginosa PA01
cacggcgcggccgugccucagag

SEQ ID NO: 1416562 - RNA, 18 nt, Pseudomonas aeruginosa PA01
cacggcggauugacgaug

SEQ ID NO: 1416563 - RNA, 18 nt, Pseudomonas aeruginosa PA01
cacggcgcgucggcggug

SEQ ID NO: 1416564 - RNA, 20 nt, Pseudomonas aeruginosa PA01
cacggcgcagggcaucgacg

SEQ ID NO: 1416565 - RNA, 17 nt, Pseudomonas aeruginosa PA01
cacggaugcccagccuc

SEQ ID NO: 1416566 - RNA, 15 nt, Pseudomonas aeruginosa PA01
cacggaugccgggcg

SEQ ID NO: 1416567 - RNA, 18 nt, Pseudomonas aeruginosa PA01
cacggauaggcggcggau

SEQ ID NO: 1416568 - RNA, 16 nt, Pseudomonas aeruginosa PA01
cacggauaugcgccgc

SEQ ID NO: 1416569 - RNA, 17 nt, Pseudomonas aeruginosa PA01
cacggauaugcgccgcc

SEQ ID NO: 1416570 - RNA, 19 nt, Pseudomonas aeruginosa PA01
cacggauaugcgccgccac

SEQ ID NO: 1416571 - RNA, 16 nt, Pseudomonas aeruginosa PA01
cacggaucgcgcuggg

SEQ ID NO: 1416572 - RNA, 19 nt, Pseudomonas aeruginosa PA01
cacggaucgcgcugggcgc

SEQ ID NO: 1416573 - RNA, 20 nt, Pseudomonas aeruginosa PA01
cacggaggccuucgccgacc

SEQ ID NO: 1416574 - RNA, 14 nt, Pseudomonas aeruginosa PA01
cacggccaggccca

SEQ ID NO: 1416575 - RNA, 15 nt, Pseudomonas aeruginosa PA01
cacggcacacgucgg

SEQ ID NO: 1416576 - RNA, 18 nt, Pseudomonas aeruginosa PA01
cacggcacacgucggcau

SEQ ID NO: 1416577 - RNA, 21 nt, Pseudomonas aeruginosa PA01
cacggcacacgucggcaucga

SEQ ID NO: 1416578 - RNA, 14 nt, Pseudomonas aeruginosa PA01
cacggagugggccg

SEQ ID NO: 1416579 - RNA, 18 nt, Pseudomonas aeruginosa PA01
cacggcaacgucgcggau

SEQ ID NO: 1416580 - RNA, 21 nt, Pseudomonas aeruginosa PA01
cacgcgcaguacgaucagcca

SEQ ID NO: 1416581 - RNA, 16 nt, Pseudomonas aeruginosa PA01
cacgcgccgggucgga

SEQ ID NO: 1416582 - RNA, 14 nt, Pseudomonas aeruginosa PA01
cacgcgccuggccg

SEQ ID NO: 1416583 - RNA, 13 nt, Pseudomonas aeruginosa PA01
cacgcgaccagcg

SEQ ID NO: 1416584 - RNA, 14 nt, Pseudomonas aeruginosa PA01
cacgcgaccagcgc

SEQ ID NO: 1416585 - RNA, 16 nt, Pseudomonas aeruginosa PA01
cacgcgaccagcgcca

SEQ ID NO: 1416586 - RNA, 18 nt, Pseudomonas aeruginosa PA01
cacgcgaccagcgccagg

SEQ ID NO: 1416587 - RNA, 20 nt, Pseudomonas aeruginosa PA01
cacgcgaccagcgccaggcg

SEQ ID NO: 1416588 - RNA, 21 nt, Pseudomonas aeruginosa PA01
cacgcgaccagcgccaggcgc

SEQ ID NO: 1416589 - RNA, 17 nt, Pseudomonas aeruginosa PA01
cacgcgacccaucgccg

SEQ ID NO: 1416590 - RNA, 18 nt, Pseudomonas aeruginosa PA01
cacgcgauauccgccagg

SEQ ID NO: 1416591 - RNA, 19 nt, Pseudomonas aeruginosa PA01
cacgcgauauccgccaggc

SEQ ID NO: 1416592 - RNA, 17 nt, Pseudomonas aeruginosa PA01
cacuucaagcuggcgca

SEQ ID NO: 1416593 - RNA, 21 nt, Pseudomonas aeruginosa PA01
cacuucacgacaggcggcggg

SEQ ID NO: 1416594 - RNA, 22 nt, Pseudomonas aeruginosa PA01
cacuuaggcggauaacgccagg

SEQ ID NO: 1416595 - RNA, 15 nt, Pseudomonas aeruginosa PA01
cacugucucgccgau

SEQ ID NO: 1416596 - RNA, 12 nt, Pseudomonas aeruginosa PA01
cacuggucggcc

SEQ ID NO: 1416597 - RNA, 23 nt, Pseudomonas aeruginosa PA01
cacugguggacggucucgccgcc

SEQ ID NO: 1416598 - RNA, 19 nt, Pseudomonas aeruginosa PA01
cacugguggcgaacagcac

SEQ ID NO: 1416599 - RNA, 17 nt, Pseudomonas aeruginosa PA01
cacuggcggaccgccuc

SEQ ID NO: 1416600 - RNA, 22 nt, Pseudomonas aeruginosa PA01
cacuggcggaccgccucgacca

SEQ ID NO: 1416601 - RNA, 19 nt, Pseudomonas aeruginosa PA01
cacuggauggucacgccga

SEQ ID NO: 1416602 - RNA, 14 nt, Pseudomonas aeruginosa PA01
cacuuccagcacgc

SEQ ID NO: 1416603 - RNA, 20 nt, Pseudomonas aeruginosa PA01
cacuuccaggcgccaauccg

SEQ ID NO: 1416604 - RNA, 14 nt, Pseudomonas aeruginosa PA01
cacuuccagguagc

SEQ ID NO: 1416605 - RNA, 20 nt, Pseudomonas aeruginosa PA01
cacuuccaggugccaauccg

SEQ ID NO: 1416606 - RNA, 18 nt, Pseudomonas aeruginosa PA01
cacuuccaguucguugcu

SEQ ID NO: 1416607 - RNA, 14 nt, Pseudomonas aeruginosa PA01
cacuugcgccggcu

SEQ ID NO: 1416608 - RNA, 17 nt, Pseudomonas aeruginosa PA01
cacuugcgccggcugcc

SEQ ID NO: 1416609 - RNA, 20 nt, Pseudomonas aeruginosa PA01
cacuugcgggugcgcaggcu

SEQ ID NO: 1416610 - RNA, 17 nt, Pseudomonas aeruginosa PA01
cacuugucgacguuguc

SEQ ID NO: 1416611 - RNA, 12 nt, Pseudomonas aeruginosa PA01
cagaaggccugc

SEQ ID NO: 1416612 - RNA, 19 nt, Pseudomonas aeruginosa PA01
cagaaggcgggcagccugg

SEQ ID NO: 1416613 - RNA, 21 nt, Pseudomonas aeruginosa PA01
cagaacgaaaaaggcgcgccg

SEQ ID NO: 1416614 - RNA, 22 nt, Pseudomonas aeruginosa PA01
cagaacgaaaaaggcgcgccgg

SEQ ID NO: 1416615 - RNA, 18 nt, Pseudomonas aeruginosa PA01
cagaagcgcucguagaga

SEQ ID NO: 1416616 - RNA, 14 nt, Pseudomonas aeruginosa PA01
cacugacgcgcagc

SEQ ID NO: 1416617 - RNA, 12 nt, Pseudomonas aeruginosa PA01
cacugcggcggu

SEQ ID NO: 1416618 - RNA, 16 nt, Pseudomonas aeruginosa PA01
cacuggaacagcgcgu

SEQ ID NO: 1416619 - RNA, 13 nt, Pseudomonas aeruginosa PA01
cacugcgccaugc

SEQ ID NO: 1416620 - RNA, 21 nt, Pseudomonas aeruginosa PA01
cacucugguagcugcggccga

SEQ ID NO: 1416621 - RNA, 17 nt, Pseudomonas aeruginosa PA01
cacucgcgagcuggcgc

SEQ ID NO: 1416622 - RNA, 19 nt, Pseudomonas aeruginosa PA01
cacucgaugaacagcgcga

SEQ ID NO: 1416623 - RNA, 21 nt, Pseudomonas aeruginosa PA01
cacucgaugaacagcgcgaac

SEQ ID NO: 1416624 - RNA, 19 nt, Pseudomonas aeruginosa PA01
cacucgccagcgcgcgccg

SEQ ID NO: 1416625 - RNA, 13 nt, Pseudomonas aeruginosa PA01
cacucgcagccgc

SEQ ID NO: 1416626 - RNA, 14 nt, Pseudomonas aeruginosa PA01
cacucgccgggcgu

SEQ ID NO: 1416627 - RNA, 16 nt, Pseudomonas aeruginosa PA01
cacuccuccgccugca

SEQ ID NO: 1416628 - RNA, 18 nt, Pseudomonas aeruginosa PA01
cacgucguuucucggcga

SEQ ID NO: 1416629 - RNA, 18 nt, Pseudomonas aeruginosa PA01
cacgucgguucagcgcgg

SEQ ID NO: 1416630 - RNA, 21 nt, Pseudomonas aeruginosa PA01
cacgucgguucagcgcggagc

SEQ ID NO: 1416631 - RNA, 22 nt, Pseudomonas aeruginosa PA01
cacgucguagcccuucuccgcc

SEQ ID NO: 1416632 - RNA, 12 nt, Pseudomonas aeruginosa PA01
cacgucggcauc

SEQ ID NO: 1416633 - RNA, 16 nt, Pseudomonas aeruginosa PA01
cacgucguaggccgag

SEQ ID NO: 1416634 - RNA, 18 nt, Pseudomonas aeruginosa PA01
cacgucguaggccgagcc

SEQ ID NO: 1416635 - RNA, 14 nt, Pseudomonas aeruginosa PA01
cacgugaccgucca

SEQ ID NO: 1416636 - RNA, 20 nt, Pseudomonas aeruginosa PA01
cacgugaccguccagcgcgc

SEQ ID NO: 1416637 - RNA, 14 nt, Pseudomonas aeruginosa PA01
cacgucuugcaggc

SEQ ID NO: 1416638 - RNA, 17 nt, Pseudomonas aeruginosa PA01
cacgucuugcaggcuca

SEQ ID NO: 1416639 - RNA, 22 nt, Pseudomonas aeruginosa PA01
cacgucuugcaggcucacgcgu

SEQ ID NO: 1416640 - RNA, 20 nt, Pseudomonas aeruginosa PA01
cacgucugugccgaggccgc

SEQ ID NO: 1416641 - RNA, 23 nt, Pseudomonas aeruginosa PA01
cacgucugugccgaggccgccgc

SEQ ID NO: 1416642 - RNA, 17 nt, Pseudomonas aeruginosa PA01
cacuccgggcuggucgu

SEQ ID NO: 1416643 - RNA, 16 nt, Pseudomonas aeruginosa PA01
cacgugcacgccgugc

SEQ ID NO: 1416644 - RNA, 14 nt, Pseudomonas aeruginosa PA01
cacgaagcgaccga

SEQ ID NO: 1416645 - RNA, 16 nt, Pseudomonas aeruginosa PA01
cacgaagaacgccagc

SEQ ID NO: 1416646 - RNA, 17 nt, Pseudomonas aeruginosa PA01
cacgaacagcuugccgu

SEQ ID NO: 1416647 - RNA, 19 nt, Pseudomonas aeruginosa PA01
cacgaacagggucuucagg

SEQ ID NO: 1416648 - RNA, 24 nt, Pseudomonas aeruginosa PA01
cacgaacgaggcucggucgcgcgg

SEQ ID NO: 1416649 - RNA, 19 nt, Pseudomonas aeruginosa PA01
cacgaaccguccgcagcgc

SEQ ID NO: 1416650 - RNA, 21 nt, Pseudomonas aeruginosa PA01
cacgaaccauugcggcccgcc

SEQ ID NO: 1416651 - RNA, 15 nt, Pseudomonas aeruginosa PA01
cacgaacccaggcgc

SEQ ID NO: 1416652 - RNA, 23 nt, Pseudomonas aeruginosa PA01
cacgaagcggucgccggcgcgca

SEQ ID NO: 1416653 - RNA, 15 nt, Pseudomonas aeruginosa PA01
cacgacaggcggcgg

SEQ ID NO: 1416654 - RNA, 12 nt, Pseudomonas aeruginosa PA01
cacgaaggcgau

SEQ ID NO: 1416655 - RNA, 18 nt, Pseudomonas aeruginosa PA01
cacgacccugcuggccgg

SEQ ID NO: 1416656 - RNA, 17 nt, Pseudomonas aeruginosa PA01
cacgacgaagcgccggc

SEQ ID NO: 1416657 - RNA, 18 nt, Pseudomonas aeruginosa PA01
cacgacgaagcgccggcg

SEQ ID NO: 1416658 - RNA, 17 nt, Pseudomonas aeruginosa PA01
caccuuguacggcagcg

SEQ ID NO: 1416659 - RNA, 17 nt, Pseudomonas aeruginosa PA01
caccuuggugccgaccu

SEQ ID NO: 1416660 - RNA, 22 nt, Pseudomonas aeruginosa PA01
caccuugucgcugaccggccgc

SEQ ID NO: 1416661 - RNA, 18 nt, Pseudomonas aeruginosa PA01
cacgaaaaagccggcgca

SEQ ID NO: 1416662 - RNA, 23 nt, Pseudomonas aeruginosa PA01
caccuugucgcaccagccuuccg

SEQ ID NO: 1416663 - RNA, 16 nt, Pseudomonas aeruginosa PA01
caccuugcgcaccgcc

SEQ ID NO: 1416664 - RNA, 23 nt, Pseudomonas aeruginosa PA01
caccuugcgcaccgccugcagca

SEQ ID NO: 1416665 - RNA, 21 nt, Pseudomonas aeruginosa PA01
caccuugcgguagcgcucgcc

SEQ ID NO: 1416666 - RNA, 12 nt, Pseudomonas aeruginosa PA01
caccuugauccg

SEQ ID NO: 1416667 - RNA, 21 nt, Pseudomonas aeruginosa PA01
caccuugauccgcgacgaggg

SEQ ID NO: 1416668 - RNA, 15 nt, Pseudomonas aeruginosa PA01
caccuucgccagcag

SEQ ID NO: 1416669 - RNA, 14 nt, Pseudomonas aeruginosa PA01
caccuguagcaggg

SEQ ID NO: 1416670 - RNA, 17 nt, Pseudomonas aeruginosa PA01
caccuguagcagggugc

SEQ ID NO: 1416671 - RNA, 16 nt, Pseudomonas aeruginosa PA01
caccuggucgccgaag

SEQ ID NO: 1416672 - RNA, 19 nt, Pseudomonas aeruginosa PA01
caccugguggacacccugc

SEQ ID NO: 1416673 - RNA, 21 nt, Pseudomonas aeruginosa PA01
caccugguucaucgagcggcg

SEQ ID NO: 1416674 - RNA, 23 nt, Pseudomonas aeruginosa PA01
caccugguucaucgagcggcggc

SEQ ID NO: 1416675 - RNA, 19 nt, Pseudomonas aeruginosa PA01
caccuggccauucgcuucg

SEQ ID NO: 1416676 - RNA, 14 nt, Pseudomonas aeruginosa PA01
caccuggccgguga

SEQ ID NO: 1416677 - RNA, 16 nt, Pseudomonas aeruginosa PA01
caccuggccggugacg

SEQ ID NO: 1416678 - RNA, 17 nt, Pseudomonas aeruginosa PA01
caccuggcgcagguaga

SEQ ID NO: 1416679 - RNA, 15 nt, Pseudomonas aeruginosa PA01
caccuggcagugcgc

SEQ ID NO: 1416680 - RNA, 19 nt, Pseudomonas aeruginosa PA01
caccuggcagugcgccggc

SEQ ID NO: 1416681 - RNA, 13 nt, Pseudomonas aeruginosa PA01
caccuggcgcucg

SEQ ID NO: 1416682 - RNA, 19 nt, Pseudomonas aeruginosa PA01
caccuggcggucgccgccg

SEQ ID NO: 1416683 - RNA, 20 nt, Pseudomonas aeruginosa PA01
caccuggcggucgccgccgg

SEQ ID NO: 1416684 - RNA, 17 nt, Pseudomonas aeruginosa PA01
caccugggcguuggcca

SEQ ID NO: 1416685 - RNA, 23 nt, Pseudomonas aeruginosa PA01
caccugggcguuggccagcgcca

SEQ ID NO: 1416686 - RNA, 14 nt, Pseudomonas aeruginosa PA01
caccugcgccccgg

SEQ ID NO: 1416687 - RNA, 17 nt, Pseudomonas aeruginosa PA01
caccugcguggcgaacg

SEQ ID NO: 1416688 - RNA, 16 nt, Pseudomonas aeruginosa PA01
caccuggaucgccagg

SEQ ID NO: 1416689 - RNA, 21 nt, Pseudomonas aeruginosa PA01
caccugcuugggcgccucgcc

SEQ ID NO: 1416690 - RNA, 22 nt, Pseudomonas aeruginosa PA01
caccugcuugggcgccucgccg

SEQ ID NO: 1416691 - RNA, 23 nt, Pseudomonas aeruginosa PA01
caccugcuucugguugcucacca

SEQ ID NO: 1416692 - RNA, 15 nt, Pseudomonas aeruginosa PA01
caccugcaacgcccg

SEQ ID NO: 1416693 - RNA, 17 nt, Pseudomonas aeruginosa PA01
caccugcaacucggcgu

SEQ ID NO: 1416694 - RNA, 22 nt, Pseudomonas aeruginosa PA01
caccugcaacucggcgucgcgc

SEQ ID NO: 1416695 - RNA, 17 nt, Pseudomonas aeruginosa PA01
caccugaacgcgcccgg

SEQ ID NO: 1416696 - RNA, 16 nt, Pseudomonas aeruginosa PA01
caccucuucgccaucc

SEQ ID NO: 1416697 - RNA, 18 nt, Pseudomonas aeruginosa PA01
caccugccccgggcgccg

SEQ ID NO: 1416698 - RNA, 20 nt, Pseudomonas aeruginosa PA01
caccugccccgggcgccggg

SEQ ID NO: 1416699 - RNA, 16 nt, Pseudomonas aeruginosa PA01
caccugcagacgguuc

SEQ ID NO: 1416700 - RNA, 16 nt, Pseudomonas aeruginosa PA01
caccugcaucaccagg

SEQ ID NO: 1416701 - RNA, 17 nt, Pseudomonas aeruginosa PA01
caccugcaucaccaggc

SEQ ID NO: 1416702 - RNA, 19 nt, Pseudomonas aeruginosa PA01
caccugcaucaccaggcug

SEQ ID NO: 1416703 - RNA, 22 nt, Pseudomonas aeruginosa PA01
caccugcaucaccaggcugccg

SEQ ID NO: 1416704 - RNA, 17 nt, Pseudomonas aeruginosa PA01
caccucgaucagcgggu

SEQ ID NO: 1416705 - RNA, 22 nt, Pseudomonas aeruginosa PA01
caccucgaugaacagugcgccc

SEQ ID NO: 1416706 - RNA, 21 nt, Pseudomonas aeruginosa PA01
caccucgacccuggcgccgac

SEQ ID NO: 1416707 - RNA, 18 nt, Pseudomonas aeruginosa PA01
caccucgaccgcgccggc

SEQ ID NO: 1416708 - RNA, 11 nt, Pseudomonas aeruginosa PA01
caccucgaccu

SEQ ID NO: 1416709 - RNA, 12 nt, Pseudomonas aeruginosa PA01
caccucgaccug

SEQ ID NO: 1416710 - RNA, 16 nt, Pseudomonas aeruginosa PA01
caccucgacggcgauc

SEQ ID NO: 1416711 - RNA, 16 nt, Pseudomonas aeruginosa PA01
caccuccucgggcgga

SEQ ID NO: 1416712 - RNA, 22 nt, Pseudomonas aeruginosa PA01
caccucgaaccccuggcgcucg

SEQ ID NO: 1416713 - RNA, 22 nt, Pseudomonas aeruginosa PA01
caccucccgggccagcuccgcc

SEQ ID NO: 1416714 - RNA, 18 nt, Pseudomonas aeruginosa PA01
caccucccccagcgggcg

SEQ ID NO: 1416715 - RNA, 12 nt, Pseudomonas aeruginosa PA01
caccucgcccuc

SEQ ID NO: 1416716 - RNA, 18 nt, Pseudomonas aeruginosa PA01
caccucgcgggaacggcg

SEQ ID NO: 1416717 - RNA, 17 nt, Pseudomonas aeruginosa PA01
caccucgauggcggcgg

SEQ ID NO: 1416718 - RNA, 20 nt, Pseudomonas aeruginosa PA01
caccucgucgagcagcgcgc

SEQ ID NO: 1416719 - RNA, 19 nt, Pseudomonas aeruginosa PA01
caccucguccagcaggacg

SEQ ID NO: 1416720 - RNA, 14 nt, Pseudomonas aeruginosa PA01
caccucggccaggc

SEQ ID NO: 1416721 - RNA, 17 nt, Pseudomonas aeruginosa PA01
cacgcccggcacucgcc

SEQ ID NO: 1416722 - RNA, 17 nt, Pseudomonas aeruginosa PA01
cacgccgcucugcccga

SEQ ID NO: 1416723 - RNA, 22 nt, Pseudomonas aeruginosa PA01
cacgccgcucugcccgaccggg

SEQ ID NO: 1416724 - RNA, 23 nt, Pseudomonas aeruginosa PA01
cacgccgcucugcccgaccgggu

SEQ ID NO: 1416725 - RNA, 17 nt, Pseudomonas aeruginosa PA01
cacgccgcgcaccagca

SEQ ID NO: 1416726 - RNA, 20 nt, Pseudomonas aeruginosa PA01
cacgccgcgaccgaagccgc

SEQ ID NO: 1416727 - RNA, 17 nt, Pseudomonas aeruginosa PA01
cacgccuucgcggccga

SEQ ID NO: 1416728 - RNA, 18 nt, Pseudomonas aeruginosa PA01
cacgccuucgcggccgag

SEQ ID NO: 1416729 - RNA, 15 nt, Pseudomonas aeruginosa PA01
cacgccuucgggcga

SEQ ID NO: 1416730 - RNA, 17 nt, Pseudomonas aeruginosa PA01
cacgccuugcagcaccg

SEQ ID NO: 1416731 - RNA, 20 nt, Pseudomonas aeruginosa PA01
cacgccuugcagcaccgccu

SEQ ID NO: 1416732 - RNA, 13 nt, Pseudomonas aeruginosa PA01
cacgccuuccggg

SEQ ID NO: 1416733 - RNA, 12 nt, Pseudomonas aeruginosa PA01
cacgccuggcgg

SEQ ID NO: 1416734 - RNA, 19 nt, Pseudomonas aeruginosa PA01
cacgccgcugucguccagc

SEQ ID NO: 1416735 - RNA, 22 nt, Pseudomonas aeruginosa PA01
cacgcccugcaccuugggaucg

SEQ ID NO: 1416736 - RNA, 12 nt, Pseudomonas aeruginosa PA01
cacgcccugcgc

SEQ ID NO: 1416737 - RNA, 13 nt, Pseudomonas aeruginosa PA01
cacgcccugcgcc

SEQ ID NO: 1416738 - RNA, 16 nt, Pseudomonas aeruginosa PA01
cacgcccugcgccagc

SEQ ID NO: 1416739 - RNA, 17 nt, Pseudomonas aeruginosa PA01
cacgcccugcgccagca

SEQ ID NO: 1416740 - RNA, 16 nt, Pseudomonas aeruginosa PA01
cacgcccugggacagg

SEQ ID NO: 1416741 - RNA, 23 nt, Pseudomonas aeruginosa PA01
cacgcccuguuucggguccaggc

SEQ ID NO: 1416742 - RNA, 16 nt, Pseudomonas aeruginosa PA01
cacgccccuccuucga

SEQ ID NO: 1416743 - RNA, 22 nt, Pseudomonas aeruginosa PA01
cacgccccuccuucgagccugg

SEQ ID NO: 1416744 - RNA, 17 nt, Pseudomonas aeruginosa PA01
cacgccauaggcggcgc

SEQ ID NO: 1416745 - RNA, 18 nt, Pseudomonas aeruginosa PA01
cacgccauaggcggcgca

SEQ ID NO: 1416746 - RNA, 18 nt, Pseudomonas aeruginosa PA01
cacgcauugucgggcgua

SEQ ID NO: 1416747 - RNA, 22 nt, Pseudomonas aeruginosa PA01
cacgcagcagcuucggcgcgac

SEQ ID NO: 1416748 - RNA, 15 nt, Pseudomonas aeruginosa PA01
cacgcagcaggcgac

SEQ ID NO: 1416749 - RNA, 16 nt, Pseudomonas aeruginosa PA01
cacgcagcaggcgacg

SEQ ID NO: 1416750 - RNA, 17 nt, Pseudomonas aeruginosa PA01
cacgcagcaggcgacgg

SEQ ID NO: 1416751 - RNA, 22 nt, Pseudomonas aeruginosa PA01
cacgcagcaggcgacggucagg

SEQ ID NO: 1416752 - RNA, 14 nt, Pseudomonas aeruginosa PA01
cacgcagcgccgcg

SEQ ID NO: 1416753 - RNA, 14 nt, Pseudomonas aeruginosa PA01
cacgcagacgucga

SEQ ID NO: 1416754 - RNA, 15 nt, Pseudomonas aeruginosa PA01
cacgcagagcggcag

SEQ ID NO: 1416755 - RNA, 18 nt, Pseudomonas aeruginosa PA01
cacgcaggaacagcuccu

SEQ ID NO: 1416756 - RNA, 15 nt, Pseudomonas aeruginosa PA01
cacgcacgcgccugc

SEQ ID NO: 1416757 - RNA, 15 nt, Pseudomonas aeruginosa PA01
cacgcaggccagcgc

SEQ ID NO: 1416758 - RNA, 17 nt, Pseudomonas aeruginosa PA01
cacgcaggccagcgcca

SEQ ID NO: 1416759 - RNA, 19 nt, Pseudomonas aeruginosa PA01
cacgcaggccagcgccagg

SEQ ID NO: 1416760 - RNA, 19 nt, Pseudomonas aeruginosa PA01
cacgcaguacagcugcacc

SEQ ID NO: 1416761 - RNA, 22 nt, Pseudomonas aeruginosa PA01
cacgcaguacagcugcaccgcg

SEQ ID NO: 1416762 - RNA, 23 nt, Pseudomonas aeruginosa PA01
cacgcaguacagcugcaccgcgc

SEQ ID NO: 1416763 - RNA, 15 nt, Pseudomonas aeruginosa PA01
cacgcaggcuuucca

SEQ ID NO: 1416764 - RNA, 12 nt, Pseudomonas aeruginosa PA01
cacgcaggccgc

SEQ ID NO: 1416765 - RNA, 16 nt, Pseudomonas aeruginosa PA01
cacgcaggccgcugcc

SEQ ID NO: 1416766 - RNA, 12 nt, Pseudomonas aeruginosa PA01
cacgcaggcgcg

SEQ ID NO: 1416767 - RNA, 13 nt, Pseudomonas aeruginosa PA01
cacgcaggcgcgu

SEQ ID NO: 1416768 - RNA, 18 nt, Pseudomonas aeruginosa PA01
cacgacucacccgcugcg

SEQ ID NO: 1416769 - RNA, 14 nt, Pseudomonas aeruginosa PA01
cacgacgucggcgg

SEQ ID NO: 1416770 - RNA, 14 nt, Pseudomonas aeruginosa PA01
cacgacguugcccu

SEQ ID NO: 1416771 - RNA, 13 nt, Pseudomonas aeruginosa PA01
cacgaucaggccc

SEQ ID NO: 1416772 - RNA, 23 nt, Pseudomonas aeruginosa PA01
cacgaggauuuccgcgcccggcu

SEQ ID NO: 1416773 - RNA, 17 nt, Pseudomonas aeruginosa PA01
cacgaggcgggcuggaa

SEQ ID NO: 1416774 - RNA, 13 nt, Pseudomonas aeruginosa PA01
cacgagucgaggc

SEQ ID NO: 1416775 - RNA, 22 nt, Pseudomonas aeruginosa PA01
cacgagccgcugcggcucgccg

SEQ ID NO: 1416776 - RNA, 23 nt, Pseudomonas aeruginosa PA01
cacgagccgcugcggcucgccga

SEQ ID NO: 1416777 - RNA, 16 nt, Pseudomonas aeruginosa PA01
cacgaucugcgccgca

SEQ ID NO: 1416778 - RNA, 22 nt, Pseudomonas aeruginosa PA01
cacgaucugcuugcgcgccgcc

SEQ ID NO: 1416779 - RNA, 17 nt, Pseudomonas aeruginosa PA01
cacgcaagugcccuggg

SEQ ID NO: 1416780 - RNA, 22 nt, Pseudomonas aeruginosa PA01
cacgcaauggcgcagccgcugg

SEQ ID NO: 1416781 - RNA, 14 nt, Pseudomonas aeruginosa PA01
cacgcaccaccagg

SEQ ID NO: 1416782 - RNA, 14 nt, Pseudomonas aeruginosa PA01
cacgcaccagcucc

SEQ ID NO: 1416783 - RNA, 15 nt, Pseudomonas aeruginosa PA01
cacgaugucgcgggu

SEQ ID NO: 1416784 - RNA, 13 nt, Pseudomonas aeruginosa PA01
cacgaugcugaac

SEQ ID NO: 1416785 - RNA, 21 nt, Pseudomonas aeruginosa PA01
cacgauggccggcagcagcgc

SEQ ID NO: 1416786 - RNA, 20 nt, Pseudomonas aeruginosa PA01
cagauagugcggccaggcgu

SEQ ID NO: 1416787 - RNA, 17 nt, Pseudomonas aeruginosa PA01
cagaugcgcgucgccga

SEQ ID NO: 1416788 - RNA, 14 nt, Pseudomonas aeruginosa PA01
cagaugcggggcga

SEQ ID NO: 1416789 - RNA, 20 nt, Pseudomonas aeruginosa PA01
cagaugcuugcacaccuggu

SEQ ID NO: 1416790 - RNA, 13 nt, Pseudomonas aeruginosa PA01
cagauggucgccg

SEQ ID NO: 1416791 - RNA, 15 nt, Pseudomonas aeruginosa PA01
cagauggcuggucag

SEQ ID NO: 1416792 - RNA, 16 nt, Pseudomonas aeruginosa PA01
cagaugucggucaugc

SEQ ID NO: 1416793 - RNA, 19 nt, Pseudomonas aeruginosa PA01
cagaagguaucggccaugg

SEQ ID NO: 1416794 - RNA, 23 nt, Pseudomonas aeruginosa PA01
cagaaguauuucaaccaggcgau

SEQ ID NO: 1416795 - RNA, 17 nt, Pseudomonas aeruginosa PA01
cagaagucccagcgagu

SEQ ID NO: 1416796 - RNA, 18 nt, Pseudomonas aeruginosa PA01
cagaaguugcuggcgauc

SEQ ID NO: 1416797 - RNA, 21 nt, Pseudomonas aeruginosa PA01
cagauacuccagcagcgcacg

SEQ ID NO: 1416798 - RNA, 18 nt, Pseudomonas aeruginosa PA01
cagaauuccagcaggucg

SEQ ID NO: 1416799 - RNA, 15 nt, Pseudomonas aeruginosa PA01
cagcaacggcaucgc

SEQ ID NO: 1416800 - RNA, 19 nt, Pseudomonas aeruginosa PA01
cagcaacgccgcccccagc

SEQ ID NO: 1416801 - RNA, 23 nt, Pseudomonas aeruginosa PA01
cagcaacgccgcccccagcgcgc

SEQ ID NO: 1416802 - RNA, 15 nt, Pseudomonas aeruginosa PA01
cagcaacucgccgcc

SEQ ID NO: 1416803 - RNA, 17 nt, Pseudomonas aeruginosa PA01
cagcaacucgccgccga

SEQ ID NO: 1416804 - RNA, 18 nt, Pseudomonas aeruginosa PA01
cagcaacucgccgccgac

SEQ ID NO: 1416805 - RNA, 21 nt, Pseudomonas aeruginosa PA01
cagcaacucgccgccgacacc

SEQ ID NO: 1416806 - RNA, 17 nt, Pseudomonas aeruginosa PA01
cagcaacggcgcaucgu

SEQ ID NO: 1416807 - RNA, 23 nt, Pseudomonas aeruginosa PA01
cagcaacucuuccagggucggca

SEQ ID NO: 1416808 - RNA, 13 nt, Pseudomonas aeruginosa PA01
cagcaacuggucg

SEQ ID NO: 1416809 - RNA, 14 nt, Pseudomonas aeruginosa PA01
cagcaacuggucgc

SEQ ID NO: 1416810 - RNA, 20 nt, Pseudomonas aeruginosa PA01
cagcaacuggucgccgcagg

SEQ ID NO: 1416811 - RNA, 23 nt, Pseudomonas aeruginosa PA01
cagcaacuggucgccgcaggucc

SEQ ID NO: 1416812 - RNA, 17 nt, Pseudomonas aeruginosa PA01
cagcacauagcugccga

SEQ ID NO: 1416813 - RNA, 16 nt, Pseudomonas aeruginosa PA01
cagcaauugccggcgu

SEQ ID NO: 1416814 - RNA, 16 nt, Pseudomonas aeruginosa PA01
cagcaaugccagcgcc

SEQ ID NO: 1416815 - RNA, 13 nt, Pseudomonas aeruginosa PA01
cagcaccagcaau

SEQ ID NO: 1416816 - RNA, 16 nt, Pseudomonas aeruginosa PA01
cagcaccagcaccagc

SEQ ID NO: 1416817 - RNA, 14 nt, Pseudomonas aeruginosa PA01
cagcaccacgcucc

SEQ ID NO: 1416818 - RNA, 16 nt, Pseudomonas aeruginosa PA01
cagcaccaccucgcca

SEQ ID NO: 1416819 - RNA, 19 nt, Pseudomonas aeruginosa PA01
cagcaccacgaugcugauc

SEQ ID NO: 1416820 - RNA, 14 nt, Pseudomonas aeruginosa PA01
cagcaccacccggc

SEQ ID NO: 1416821 - RNA, 20 nt, Pseudomonas aeruginosa PA01
cagcaccacccggccgcgcu

SEQ ID NO: 1416822 - RNA, 23 nt, Pseudomonas aeruginosa PA01
cagcaccacccggccgcgcucga

SEQ ID NO: 1416823 - RNA, 17 nt, Pseudomonas aeruginosa PA01
cagcaccacccggcgca

SEQ ID NO: 1416824 - RNA, 16 nt, Pseudomonas aeruginosa PA01
cagcaccaggccaucg

SEQ ID NO: 1416825 - RNA, 17 nt, Pseudomonas aeruginosa PA01
cagcaccagucccuggc

SEQ ID NO: 1416826 - RNA, 19 nt, Pseudomonas aeruginosa PA01
cagcaccagucccuggccg

SEQ ID NO: 1416827 - RNA, 20 nt, Pseudomonas aeruginosa PA01
cagcaccagucccuggccgg

SEQ ID NO: 1416828 - RNA, 22 nt, Pseudomonas aeruginosa PA01
cagcaccagucccuggccggcg

SEQ ID NO: 1416829 - RNA, 23 nt, Pseudomonas aeruginosa PA01
cagcaccagucccuggccggcga

SEQ ID NO: 1416830 - RNA, 19 nt, Pseudomonas aeruginosa PA01
cagcacccccagcaggcca

SEQ ID NO: 1416831 - RNA, 14 nt, Pseudomonas aeruginosa PA01
cagcacccaggcga

SEQ ID NO: 1416832 - RNA, 15 nt, Pseudomonas aeruginosa PA01
cagcacccagguaga

SEQ ID NO: 1416833 - RNA, 20 nt, Pseudomonas aeruginosa PA01
cagcaccaugcgcggcagga

SEQ ID NO: 1416834 - RNA, 16 nt, Pseudomonas aeruginosa PA01
cagcaccgccugcaac

SEQ ID NO: 1416835 - RNA, 14 nt, Pseudomonas aeruginosa PA01
cagcaccgccuggc

SEQ ID NO: 1416836 - RNA, 15 nt, Pseudomonas aeruginosa PA01
cagcaccgccuggcg

SEQ ID NO: 1416837 - RNA, 17 nt, Pseudomonas aeruginosa PA01
cagcaccgccuggcgca

SEQ ID NO: 1416838 - RNA, 21 nt, Pseudomonas aeruginosa PA01
cagcaccgccuggcgcaaggu

SEQ ID NO: 1416839 - RNA, 14 nt, Pseudomonas aeruginosa PA01
cagcaccgccuggu

SEQ ID NO: 1416840 - RNA, 17 nt, Pseudomonas aeruginosa PA01
cagcaccgcuuucacca

SEQ ID NO: 1416841 - RNA, 19 nt, Pseudomonas aeruginosa PA01
cagcaccgcuuucaccagg

SEQ ID NO: 1416842 - RNA, 14 nt, Pseudomonas aeruginosa PA01
cagcaccggcggcg

SEQ ID NO: 1416843 - RNA, 17 nt, Pseudomonas aeruginosa PA01
cagcaccggcggcgcca

SEQ ID NO: 1416844 - RNA, 23 nt, Pseudomonas aeruginosa PA01
cagcaccggcggcgccaggccgg

SEQ ID NO: 1416845 - RNA, 16 nt, Pseudomonas aeruginosa PA01
cagcaccgagcaggca

SEQ ID NO: 1416846 - RNA, 20 nt, Pseudomonas aeruginosa PA01
cagcaccgagcugaucgcgc

SEQ ID NO: 1416847 - RNA, 14 nt, Pseudomonas aeruginosa PA01
cagcaccgccacca

SEQ ID NO: 1416848 - RNA, 17 nt, Pseudomonas aeruginosa PA01
cagcaccgccaccagcg

SEQ ID NO: 1416849 - RNA, 20 nt, Pseudomonas aeruginosa PA01
cagcacccgcaccagccggc

SEQ ID NO: 1416850 - RNA, 14 nt, Pseudomonas aeruginosa PA01
cagcacccgcaccg

SEQ ID NO: 1416851 - RNA, 14 nt, Pseudomonas aeruginosa PA01
cagcacccuggcca

SEQ ID NO: 1416852 - RNA, 14 nt, Pseudomonas aeruginosa PA01
cagcacccggucga

SEQ ID NO: 1416853 - RNA, 18 nt, Pseudomonas aeruginosa PA01
cagcaccgcgagcaugcu

SEQ ID NO: 1416854 - RNA, 22 nt, Pseudomonas aeruginosa PA01
cagcaccgggauggucgagggc

SEQ ID NO: 1416855 - RNA, 14 nt, Pseudomonas aeruginosa PA01
cagcaccguggcgc

SEQ ID NO: 1416856 - RNA, 17 nt, Pseudomonas aeruginosa PA01
cagcaccguggcgccau

SEQ ID NO: 1416857 - RNA, 22 nt, Pseudomonas aeruginosa PA01
cagcaccguggucagcaccagg

SEQ ID NO: 1416858 - RNA, 19 nt, Pseudomonas aeruginosa PA01
cagcaccucguaggccgac

SEQ ID NO: 1416859 - RNA, 16 nt, Pseudomonas aeruginosa PA01
cagcaccucgccgucg

SEQ ID NO: 1416860 - RNA, 17 nt, Pseudomonas aeruginosa PA01
cagcaccucgccgucgu

SEQ ID NO: 1416861 - RNA, 18 nt, Pseudomonas aeruginosa PA01
cagcacgauggcgaggau

SEQ ID NO: 1416862 - RNA, 18 nt, Pseudomonas aeruginosa PA01
cagcacgaugaggcgugg

SEQ ID NO: 1416863 - RNA, 17 nt, Pseudomonas aeruginosa PA01
cagcaccugcgccgaag

SEQ ID NO: 1416864 - RNA, 21 nt, Pseudomonas aeruginosa PA01
cagcaccugcgggcugcgugc

SEQ ID NO: 1416865 - RNA, 13 nt, Pseudomonas aeruginosa PA01
cagcaccuggacg

SEQ ID NO: 1416866 - RNA, 22 nt, Pseudomonas aeruginosa PA01
cagcaccuucaucaccaggucg

SEQ ID NO: 1416867 - RNA, 23 nt, Pseudomonas aeruginosa PA01
cagcaccuucaucaccaggucgc

SEQ ID NO: 1416868 - RNA, 20 nt, Pseudomonas aeruginosa PA01
cagcaccuugugcugccugc

SEQ ID NO: 1416869 - RNA, 15 nt, Pseudomonas aeruginosa PA01
cagcagcucgccgcu

SEQ ID NO: 1416870 - RNA, 15 nt, Pseudomonas aeruginosa PA01
cagcagcgccgcccu

SEQ ID NO: 1416871 - RNA, 20 nt, Pseudomonas aeruginosa PA01
cagcagcgccucggcaucga

SEQ ID NO: 1416872 - RNA, 14 nt, Pseudomonas aeruginosa PA01
cagcagcagcgcca

SEQ ID NO: 1416873 - RNA, 15 nt, Pseudomonas aeruginosa PA01
cagcagcagcgccau

SEQ ID NO: 1416874 - RNA, 17 nt, Pseudomonas aeruginosa PA01
cagcagcagcgccaugc

SEQ ID NO: 1416875 - RNA, 20 nt, Pseudomonas aeruginosa PA01
cagcagcaugggauggcgcg

SEQ ID NO: 1416876 - RNA, 13 nt, Pseudomonas aeruginosa PA01
cagcagcaggcgc

SEQ ID NO: 1416877 - RNA, 16 nt, Pseudomonas aeruginosa PA01
cagcagcaggcgcucg

SEQ ID NO: 1416878 - RNA, 17 nt, Pseudomonas aeruginosa PA01
cagcagcaggcgcucgg

SEQ ID NO: 1416879 - RNA, 12 nt, Pseudomonas aeruginosa PA01
cagcagcgaccu

SEQ ID NO: 1416880 - RNA, 21 nt, Pseudomonas aeruginosa PA01
cagcagcaugaugccgaggcg

SEQ ID NO: 1416881 - RNA, 17 nt, Pseudomonas aeruginosa PA01
cagcagcaugccgcucu

SEQ ID NO: 1416882 - RNA, 11 nt, Pseudomonas aeruginosa PA01
cagcagcgcca

SEQ ID NO: 1416883 - RNA, 14 nt, Pseudomonas aeruginosa PA01
cagcagcgccagua

SEQ ID NO: 1416884 - RNA, 12 nt, Pseudomonas aeruginosa PA01
cagcagcgccga

SEQ ID NO: 1416885 - RNA, 14 nt, Pseudomonas aeruginosa PA01
cagcacggcgacga

SEQ ID NO: 1416886 - RNA, 16 nt, Pseudomonas aeruginosa PA01
cagcacggcgacgaag

SEQ ID NO: 1416887 - RNA, 12 nt, Pseudomonas aeruginosa PA01
cagcacggccuc

SEQ ID NO: 1416888 - RNA, 15 nt, Pseudomonas aeruginosa PA01
cagcacggccucgcg

SEQ ID NO: 1416889 - RNA, 20 nt, Pseudomonas aeruginosa PA01
cagcacggcgaauucgucgc

SEQ ID NO: 1416890 - RNA, 14 nt, Pseudomonas aeruginosa PA01
cagcacgcuggcgu

SEQ ID NO: 1416891 - RNA, 17 nt, Pseudomonas aeruginosa PA01
cagcacgcuggcgucgg

SEQ ID NO: 1416892 - RNA, 18 nt, Pseudomonas aeruginosa PA01
cagcacgcugacgccggc

SEQ ID NO: 1416893 - RNA, 22 nt, Pseudomonas aeruginosa PA01
cagcacgcugacgccggcaccg

SEQ ID NO: 1416894 - RNA, 14 nt, Pseudomonas aeruginosa PA01
cagcacgcucaggc

SEQ ID NO: 1416895 - RNA, 17 nt, Pseudomonas aeruginosa PA01
cagcacgcucaggcagc

SEQ ID NO: 1416896 - RNA, 15 nt, Pseudomonas aeruginosa PA01
cagcagacgcuccuu

SEQ ID NO: 1416897 - RNA, 15 nt, Pseudomonas aeruginosa PA01
cagcagacggcacga

SEQ ID NO: 1416898 - RNA, 17 nt, Pseudomonas aeruginosa PA01
cagcagacggcacgacg

SEQ ID NO: 1416899 - RNA, 15 nt, Pseudomonas aeruginosa PA01
cagcacggcgcaggg

SEQ ID NO: 1416900 - RNA, 16 nt, Pseudomonas aeruginosa PA01
cagcacggcgcagggc

SEQ ID NO: 1416901 - RNA, 17 nt, Pseudomonas aeruginosa PA01
cagcagcagaagggcgg

SEQ ID NO: 1416902 - RNA, 14 nt, Pseudomonas aeruginosa PA01
cagccagcagcccg

SEQ ID NO: 1416903 - RNA, 15 nt, Pseudomonas aeruginosa PA01
cagccagcagcccgg

SEQ ID NO: 1416904 - RNA, 18 nt, Pseudomonas aeruginosa PA01
cagccagcagcccggccu

SEQ ID NO: 1416905 - RNA, 15 nt, Pseudomonas aeruginosa PA01
cagccagagcagcgu

SEQ ID NO: 1416906 - RNA, 17 nt, Pseudomonas aeruginosa PA01
cagccagagcccgucga

SEQ ID NO: 1416907 - RNA, 21 nt, Pseudomonas aeruginosa PA01
cagccagagcguaucgaugcg

SEQ ID NO: 1416908 - RNA, 17 nt, Pseudomonas aeruginosa PA01
cagccagagcuccaggg

SEQ ID NO: 1416909 - RNA, 15 nt, Pseudomonas aeruginosa PA01
cagccagaggucgag

SEQ ID NO: 1416910 - RNA, 16 nt, Pseudomonas aeruginosa PA01
cagccagaggucgagc

SEQ ID NO: 1416911 - RNA, 23 nt, Pseudomonas aeruginosa PA01
cagccaacccucggaugccgcac

SEQ ID NO: 1416912 - RNA, 21 nt, Pseudomonas aeruginosa PA01
cagccaaccgucgcccuggug

SEQ ID NO: 1416913 - RNA, 24 nt, Pseudomonas aeruginosa PA01
cagccaaccgucgcccuggugcac

SEQ ID NO: 1416914 - RNA, 13 nt, Pseudomonas aeruginosa PA01
cagccagaccggc

SEQ ID NO: 1416915 - RNA, 14 nt, Pseudomonas aeruginosa PA01
cagccagaccggca

SEQ ID NO: 1416916 - RNA, 17 nt, Pseudomonas aeruginosa PA01
cagccagaccggcagcg

SEQ ID NO: 1416917 - RNA, 19 nt, Pseudomonas aeruginosa PA01
cagccagaccggcagcgcc

SEQ ID NO: 1416918 - RNA, 20 nt, Pseudomonas aeruginosa PA01
cagccagaccggcagcgccg

SEQ ID NO: 1416919 - RNA, 12 nt, Pseudomonas aeruginosa PA01
cagccacuggcg

SEQ ID NO: 1416920 - RNA, 12 nt, Pseudomonas aeruginosa PA01
cagcaugcccag

SEQ ID NO: 1416921 - RNA, 21 nt, Pseudomonas aeruginosa PA01
cagcaugcucgggcugccgca

SEQ ID NO: 1416922 - RNA, 22 nt, Pseudomonas aeruginosa PA01
cagcaggacgucgaggucgacg

SEQ ID NO: 1416923 - RNA, 17 nt, Pseudomonas aeruginosa PA01
cagcaggagaagcgccu

SEQ ID NO: 1416924 - RNA, 18 nt, Pseudomonas aeruginosa PA01
cagcaggagcagcuugcg

SEQ ID NO: 1416925 - RNA, 20 nt, Pseudomonas aeruginosa PA01
cagcaggagcgccaucagcg

SEQ ID NO: 1416926 - RNA, 22 nt, Pseudomonas aeruginosa PA01
cagcaggagcgccaucagcgac

SEQ ID NO: 1416927 - RNA, 15 nt, Pseudomonas aeruginosa PA01
cagcagcuucggcgc

SEQ ID NO: 1416928 - RNA, 20 nt, Pseudomonas aeruginosa PA01
cagcaggaagcugacgaaca

SEQ ID NO: 1416929 - RNA, 14 nt, Pseudomonas aeruginosa PA01
cagcaggcacaggg

SEQ ID NO: 1416930 - RNA, 16 nt, Pseudomonas aeruginosa PA01
cagcaggaucagcgca

SEQ ID NO: 1416931 - RNA, 14 nt, Pseudomonas aeruginosa PA01
cagcaggccagcca

SEQ ID NO: 1416932 - RNA, 15 nt, Pseudomonas aeruginosa PA01
cagcaggccagccaa

SEQ ID NO: 1416933 - RNA, 13 nt, Pseudomonas aeruginosa PA01
cagcaggcaggca

SEQ ID NO: 1416934 - RNA, 18 nt, Pseudomonas aeruginosa PA01
cagcaggcaggcgcgggu

SEQ ID NO: 1416935 - RNA, 19 nt, Pseudomonas aeruginosa PA01
cagcaggcaggcgcggguc

SEQ ID NO: 1416936 - RNA, 14 nt, Pseudomonas aeruginosa PA01
cagcaggcccgagc

SEQ ID NO: 1416937 - RNA, 16 nt, Pseudomonas aeruginosa PA01
cagcaucuucucggcg

SEQ ID NO: 1416938 - RNA, 13 nt, Pseudomonas aeruginosa PA01
cagcauccagcga

SEQ ID NO: 1416939 - RNA, 20 nt, Pseudomonas aeruginosa PA01
cagcaucaucuccgcggaga

SEQ ID NO: 1416940 - RNA, 14 nt, Pseudomonas aeruginosa PA01
cagcaucaggcgcu

SEQ ID NO: 1416941 - RNA, 16 nt, Pseudomonas aeruginosa PA01
cagcaucaggucggcg

SEQ ID NO: 1416942 - RNA, 17 nt, Pseudomonas aeruginosa PA01
cagcaucaggucggcgc

SEQ ID NO: 1416943 - RNA, 20 nt, Pseudomonas aeruginosa PA01
cagcaucaggucggcgcgca

SEQ ID NO: 1416944 - RNA, 14 nt, Pseudomonas aeruginosa PA01
cagccagcuucagc

SEQ ID NO: 1416945 - RNA, 14 nt, Pseudomonas aeruginosa PA01
cagccaggaagagc

SEQ ID NO: 1416946 - RNA, 18 nt, Pseudomonas aeruginosa PA01
cagccaugugcuccuuga

SEQ ID NO: 1416947 - RNA, 14 nt, Pseudomonas aeruginosa PA01
cagccagccggcga

SEQ ID NO: 1416948 - RNA, 16 nt, Pseudomonas aeruginosa PA01
cagccagccgcgcgcc

SEQ ID NO: 1416949 - RNA, 13 nt, Pseudomonas aeruginosa PA01
cagccagccgccg

SEQ ID NO: 1416950 - RNA, 14 nt, Pseudomonas aeruginosa PA01
cagccagccgccga

SEQ ID NO: 1416951 - RNA, 12 nt, Pseudomonas aeruginosa PA01
cagccagcccgg

SEQ ID NO: 1416952 - RNA, 15 nt, Pseudomonas aeruginosa PA01
cagcccacgcgccug

SEQ ID NO: 1416953 - RNA, 17 nt, Pseudomonas aeruginosa PA01
cagcccacgcgccuggc

SEQ ID NO: 1416954 - RNA, 16 nt, Pseudomonas aeruginosa PA01
cagccauugagcgcgc

SEQ ID NO: 1416955 - RNA, 18 nt, Pseudomonas aeruginosa PA01
cagccauugagcgcgccc

SEQ ID NO: 1416956 - RNA, 16 nt, Pseudomonas aeruginosa PA01
cagccauugcgccagg

SEQ ID NO: 1416957 - RNA, 15 nt, Pseudomonas aeruginosa PA01
cagccauucgccgcg

SEQ ID NO: 1416958 - RNA, 17 nt, Pseudomonas aeruginosa PA01
cagccauucgccgcgac

SEQ ID NO: 1416959 - RNA, 17 nt, Pseudomonas aeruginosa PA01
cagccauuucugcugug

SEQ ID NO: 1416960 - RNA, 14 nt, Pseudomonas aeruginosa PA01
cagcccagccgcuc

SEQ ID NO: 1416961 - RNA, 15 nt, Pseudomonas aeruginosa PA01
cagcccagaacagca

SEQ ID NO: 1416962 - RNA, 21 nt, Pseudomonas aeruginosa PA01
cagcccagaacagcaaagcgc

SEQ ID NO: 1416963 - RNA, 12 nt, Pseudomonas aeruginosa PA01
cagcccaggcgc

SEQ ID NO: 1416964 - RNA, 13 nt, Pseudomonas aeruginosa PA01
cagcccaggcgcc

SEQ ID NO: 1416965 - RNA, 12 nt, Pseudomonas aeruginosa PA01
cagcccagcgcu

SEQ ID NO: 1416966 - RNA, 16 nt, Pseudomonas aeruginosa PA01
cagcccagcggcgcgg

SEQ ID NO: 1416967 - RNA, 18 nt, Pseudomonas aeruginosa PA01
cagcccagcggcgcggcg

SEQ ID NO: 1416968 - RNA, 18 nt, Pseudomonas aeruginosa PA01
cagcccgccgugcgcucc

SEQ ID NO: 1416969 - RNA, 13 nt, Pseudomonas aeruginosa PA01
cagcccgccggcg

SEQ ID NO: 1416970 - RNA, 14 nt, Pseudomonas aeruginosa PA01
cagcccgccggcga

SEQ ID NO: 1416971 - RNA, 20 nt, Pseudomonas aeruginosa PA01
cagcccgccaacguccucga

SEQ ID NO: 1416972 - RNA, 20 nt, Pseudomonas aeruginosa PA01
cagccccagccucggcaggg

SEQ ID NO: 1416973 - RNA, 12 nt, Pseudomonas aeruginosa PA01
cagccccagcac

SEQ ID NO: 1416974 - RNA, 20 nt, Pseudomonas aeruginosa PA01
cagccccagcacgccgagca

SEQ ID NO: 1416975 - RNA, 19 nt, Pseudomonas aeruginosa PA01
cagcccguagucguucagc

SEQ ID NO: 1416976 - RNA, 15 nt, Pseudomonas aeruginosa PA01
cagcccgucgcgcgc

SEQ ID NO: 1416977 - RNA, 20 nt, Pseudomonas aeruginosa PA01
cagcccgucgcgcgccggag

SEQ ID NO: 1416978 - RNA, 17 nt, Pseudomonas aeruginosa PA01
cagcccgggcaacugcc

SEQ ID NO: 1416979 - RNA, 14 nt, Pseudomonas aeruginosa PA01
cagcccggcucggc

SEQ ID NO: 1416980 - RNA, 18 nt, Pseudomonas aeruginosa PA01
cagcccggucacgccggg

SEQ ID NO: 1416981 - RNA, 19 nt, Pseudomonas aeruginosa PA01
cagcccgguccguccagcg

SEQ ID NO: 1416982 - RNA, 21 nt, Pseudomonas aeruginosa PA01
cagcccgguccguccagcgcg

SEQ ID NO: 1416983 - RNA, 20 nt, Pseudomonas aeruginosa PA01
cagcccggcggcggcaccga

SEQ ID NO: 1416984 - RNA, 21 nt, Pseudomonas aeruginosa PA01
cagcccggcggcggcaccgac

SEQ ID NO: 1416985 - RNA, 13 nt, Pseudomonas aeruginosa PA01
cagcccggcggcg

SEQ ID NO: 1416986 - RNA, 17 nt, Pseudomonas aeruginosa PA01
cagcccgcgccgcgagg

SEQ ID NO: 1416987 - RNA, 16 nt, Pseudomonas aeruginosa PA01
cagcccggccucgccg

SEQ ID NO: 1416988 - RNA, 21 nt, Pseudomonas aeruginosa PA01
cagcccggccucgccggucgc

SEQ ID NO: 1416989 - RNA, 16 nt, Pseudomonas aeruginosa PA01
cagcccguugcgguag

SEQ ID NO: 1416990 - RNA, 16 nt, Pseudomonas aeruginosa PA01
cagccgcaaggccagg

SEQ ID NO: 1416991 - RNA, 20 nt, Pseudomonas aeruginosa PA01
cagccgcaaggccagggcgg

SEQ ID NO: 1416992 - RNA, 22 nt, Pseudomonas aeruginosa PA01
cagcccucgcccaggugcgccg

SEQ ID NO: 1416993 - RNA, 22 nt, Pseudomonas aeruginosa PA01
cagcccucggggaaggucaccg

SEQ ID NO: 1416994 - RNA, 22 nt, Pseudomonas aeruginosa PA01
cagccgcaggaugccgccugcg

SEQ ID NO: 1416995 - RNA, 17 nt, Pseudomonas aeruginosa PA01
cagccgcagaugcucca

SEQ ID NO: 1416996 - RNA, 14 nt, Pseudomonas aeruginosa PA01
cagccgcagcggca

SEQ ID NO: 1416997 - RNA, 17 nt, Pseudomonas aeruginosa PA01
cagccgcagcggcaugc

SEQ ID NO: 1416998 - RNA, 18 nt, Pseudomonas aeruginosa PA01
cagccgcagcggcaugcc

SEQ ID NO: 1416999 - RNA, 18 nt, Pseudomonas aeruginosa PA01
cagccgccaucaccagcg

SEQ ID NO: 1417000 - RNA, 14 nt, Pseudomonas aeruginosa PA01
cagccgccgcggca

SEQ ID NO: 1417001 - RNA, 20 nt, Pseudomonas aeruginosa PA01
cagccgccgcggcaccggcg

SEQ ID NO: 1417002 - RNA, 22 nt, Pseudomonas aeruginosa PA01
cagccgcgacgacugcggcagc

SEQ ID NO: 1417003 - RNA, 13 nt, Pseudomonas aeruginosa PA01
cagccgccgcugc

SEQ ID NO: 1417004 - RNA, 14 nt, Pseudomonas aeruginosa PA01
cagccgccgcugca

SEQ ID NO: 1417005 - RNA, 22 nt, Pseudomonas aeruginosa PA01
cagccgccgaagggccgcaggu

SEQ ID NO: 1417006 - RNA, 18 nt, Pseudomonas aeruginosa PA01
cagccgccccaccaccau

SEQ ID NO: 1417007 - RNA, 20 nt, Pseudomonas aeruginosa PA01
cagccgccccaccaccaucg

SEQ ID NO: 1417008 - RNA, 21 nt, Pseudomonas aeruginosa PA01
cagccgccccaccaccaucgc

SEQ ID NO: 1417009 - RNA, 13 nt, Pseudomonas aeruginosa PA01
cagccgccaggac

SEQ ID NO: 1417010 - RNA, 14 nt, Pseudomonas aeruginosa PA01
cagccgccaggacg

SEQ ID NO: 1417011 - RNA, 15 nt, Pseudomonas aeruginosa PA01
cagccgccaggacgg

SEQ ID NO: 1417012 - RNA, 16 nt, Pseudomonas aeruginosa PA01
cagccgcaggcugccg

SEQ ID NO: 1417013 - RNA, 17 nt, Pseudomonas aeruginosa PA01
cagccgcaggcugccgu

SEQ ID NO: 1417014 - RNA, 23 nt, Pseudomonas aeruginosa PA01
cagccgcaggcugccguccaggc

SEQ ID NO: 1417015 - RNA, 20 nt, Pseudomonas aeruginosa PA01
cagccgcgaguccuucggcg

SEQ ID NO: 1417016 - RNA, 16 nt, Pseudomonas aeruginosa PA01
cagccgcgacucggcu

SEQ ID NO: 1417017 - RNA, 15 nt, Pseudomonas aeruginosa PA01
cagccgcgccggggc

SEQ ID NO: 1417018 - RNA, 21 nt, Pseudomonas aeruginosa PA01
cagccgcgccggggcagcagg

SEQ ID NO: 1417019 - RNA, 12 nt, Pseudomonas aeruginosa PA01
cagccgcggggc

SEQ ID NO: 1417020 - RNA, 16 nt, Pseudomonas aeruginosa PA01
cagccgcuagcgguag

SEQ ID NO: 1417021 - RNA, 18 nt, Pseudomonas aeruginosa PA01
cagccgcuagcgguagcc

SEQ ID NO: 1417022 - RNA, 20 nt, Pseudomonas aeruginosa PA01
cagccgcgccagugccugca

SEQ ID NO: 1417023 - RNA, 13 nt, Pseudomonas aeruginosa PA01
cagccgcggccgg

SEQ ID NO: 1417024 - RNA, 14 nt, Pseudomonas aeruginosa PA01
cagccgcggcgcca

SEQ ID NO: 1417025 - RNA, 15 nt, Pseudomonas aeruginosa PA01
cagccgcucggccgc

SEQ ID NO: 1417026 - RNA, 16 nt, Pseudomonas aeruginosa PA01
cagccgcucggccgcc

SEQ ID NO: 1417027 - RNA, 18 nt, Pseudomonas aeruginosa PA01
cagccgcucggccgccag

SEQ ID NO: 1417028 - RNA, 19 nt, Pseudomonas aeruginosa PA01
cagccgcucggccgccagc

SEQ ID NO: 1417029 - RNA, 20 nt, Pseudomonas aeruginosa PA01
cagccgcucggccgccagca

SEQ ID NO: 1417030 - RNA, 17 nt, Pseudomonas aeruginosa PA01
cagccgcugcagggcgg

SEQ ID NO: 1417031 - RNA, 21 nt, Pseudomonas aeruginosa PA01
cagccgcugcagggcggcgcu

SEQ ID NO: 1417032 - RNA, 14 nt, Pseudomonas aeruginosa PA01
cagccggaccagcc

SEQ ID NO: 1417033 - RNA, 16 nt, Pseudomonas aeruginosa PA01
cagccgcuggcgucga

SEQ ID NO: 1417034 - RNA, 21 nt, Pseudomonas aeruginosa PA01
cagccgcuggcgucgaaugcg

SEQ ID NO: 1417035 - RNA, 14 nt, Pseudomonas aeruginosa PA01
cagccgcuuccggc

SEQ ID NO: 1417036 - RNA, 19 nt, Pseudomonas aeruginosa PA01
cagccggcccauccgccgc

SEQ ID NO: 1417037 - RNA, 13 nt, Pseudomonas aeruginosa PA01
cagccggagagau

SEQ ID NO: 1417038 - RNA, 18 nt, Pseudomonas aeruginosa PA01
cagccggcauccagcauc

SEQ ID NO: 1417039 - RNA, 23 nt, Pseudomonas aeruginosa PA01
cagccggccauccagccaggcgc

SEQ ID NO: 1417040 - RNA, 17 nt, Pseudomonas aeruginosa PA01
cagccggcgacgcagga

SEQ ID NO: 1417041 - RNA, 18 nt, Pseudomonas aeruginosa PA01
cagccggcgacgcaggac

SEQ ID NO: 1417042 - RNA, 22 nt, Pseudomonas aeruginosa PA01
cagccggcgacgcaggacgucg

SEQ ID NO: 1417043 - RNA, 19 nt, Pseudomonas aeruginosa PA01
cagccggcgcucggccagg

SEQ ID NO: 1417044 - RNA, 23 nt, Pseudomonas aeruginosa PA01
cagccggcgcuucugcgagccgc

SEQ ID NO: 1417045 - RNA, 13 nt, Pseudomonas aeruginosa PA01
cagccguccgccc

SEQ ID NO: 1417046 - RNA, 14 nt, Pseudomonas aeruginosa PA01
cagccguccgccca

SEQ ID NO: 1417047 - RNA, 15 nt, Pseudomonas aeruginosa PA01
cagccguccgcgggc

SEQ ID NO: 1417048 - RNA, 17 nt, Pseudomonas aeruginosa PA01
cagccguccgcgggcga

SEQ ID NO: 1417049 - RNA, 14 nt, Pseudomonas aeruginosa PA01
cagccggcgccgca

SEQ ID NO: 1417050 - RNA, 17 nt, Pseudomonas aeruginosa PA01
cagccggcgccgcaggg

SEQ ID NO: 1417051 - RNA, 20 nt, Pseudomonas aeruginosa PA01
cagccggcgccgcagggugc

SEQ ID NO: 1417052 - RNA, 15 nt, Pseudomonas aeruginosa PA01
cagccgucggugauc

SEQ ID NO: 1417053 - RNA, 18 nt, Pseudomonas aeruginosa PA01
cagccgucggugaucgag

SEQ ID NO: 1417054 - RNA, 19 nt, Pseudomonas aeruginosa PA01
cagccgucggugaucgaga

SEQ ID NO: 1417055 - RNA, 18 nt, Pseudomonas aeruginosa PA01
cagccucgcgcucggcgg

SEQ ID NO: 1417056 - RNA, 19 nt, Pseudomonas aeruginosa PA01
cagccucgcgcucggcggc

SEQ ID NO: 1417057 - RNA, 22 nt, Pseudomonas aeruginosa PA01
cagccucgcgcucggcggccuc

SEQ ID NO: 1417058 - RNA, 13 nt, Pseudomonas aeruginosa PA01
cagccguggcacc

SEQ ID NO: 1417059 - RNA, 14 nt, Pseudomonas aeruginosa PA01
cagccucacccugc

SEQ ID NO: 1417060 - RNA, 18 nt, Pseudomonas aeruginosa PA01
cagccucacccugcuggg

SEQ ID NO: 1417061 - RNA, 22 nt, Pseudomonas aeruginosa PA01
cagccucacccugcugggcggg

SEQ ID NO: 1417062 - RNA, 13 nt, Pseudomonas aeruginosa PA01
cagccucagccau

SEQ ID NO: 1417063 - RNA, 13 nt, Pseudomonas aeruginosa PA01
cagccucagcgac

SEQ ID NO: 1417064 - RNA, 21 nt, Pseudomonas aeruginosa PA01
cagccugacguugccgcgcgg

SEQ ID NO: 1417065 - RNA, 23 nt, Pseudomonas aeruginosa PA01
cagccugacguugccgcgcgggc

SEQ ID NO: 1417066 - RNA, 24 nt, Pseudomonas aeruginosa PA01
cagccugacguugccgcgcgggcc

SEQ ID NO: 1417067 - RNA, 13 nt, Pseudomonas aeruginosa PA01
cagccugcuggcc

SEQ ID NO: 1417068 - RNA, 13 nt, Pseudomonas aeruginosa PA01
cagccuggccagc

SEQ ID NO: 1417069 - RNA, 19 nt, Pseudomonas aeruginosa PA01
cagccuggccagcgcuucg

SEQ ID NO: 1417070 - RNA, 17 nt, Pseudomonas aeruginosa PA01
cagccuggccagcgucg

SEQ ID NO: 1417071 - RNA, 16 nt, Pseudomonas aeruginosa PA01
cagcgaacgccgcagc

SEQ ID NO: 1417072 - RNA, 15 nt, Pseudomonas aeruginosa PA01
cagcgaaccgccggc

SEQ ID NO: 1417073 - RNA, 17 nt, Pseudomonas aeruginosa PA01
cagcgaaugcuugccgg

SEQ ID NO: 1417074 - RNA, 16 nt, Pseudomonas aeruginosa PA01
cagcgaagcuggcgca

SEQ ID NO: 1417075 - RNA, 23 nt, Pseudomonas aeruginosa PA01
cagcgaagcuggcgcaacugcgc

SEQ ID NO: 1417076 - RNA, 17 nt, Pseudomonas aeruginosa PA01
cagcgacucgcugccgg

SEQ ID NO: 1417077 - RNA, 20 nt, Pseudomonas aeruginosa PA01
cagcgacucgcugccggcgc

SEQ ID NO: 1417078 - RNA, 22 nt, Pseudomonas aeruginosa PA01
cagcgacucgcugccggcgcgc

SEQ ID NO: 1417079 - RNA, 17 nt, Pseudomonas aeruginosa PA01
cagcgacucgcugggcg

SEQ ID NO: 1417080 - RNA, 18 nt, Pseudomonas aeruginosa PA01
cagcgacucgcugggcgc

SEQ ID NO: 1417081 - RNA, 23 nt, Pseudomonas aeruginosa PA01
cagcgacucgcugggcgccggca

SEQ ID NO: 1417082 - RNA, 14 nt, Pseudomonas aeruginosa PA01
cagcgacuccagcc

SEQ ID NO: 1417083 - RNA, 16 nt, Pseudomonas aeruginosa PA01
cagcgacuccagccag

SEQ ID NO: 1417084 - RNA, 19 nt, Pseudomonas aeruginosa PA01
cgcaccuacccgagcaacu

SEQ ID NO: 1417085 - RNA, 23 nt, Pseudomonas aeruginosa PA01
cgcaccuacccgagcaacugcuc

SEQ ID NO: 1417086 - RNA, 13 nt, Pseudomonas aeruginosa PA01
cgcaccucgaccg

SEQ ID NO: 1417087 - RNA, 14 nt, Pseudomonas aeruginosa PA01
cgcaccuccucggg

SEQ ID NO: 1417088 - RNA, 16 nt, Pseudomonas aeruginosa PA01
cgcaccuccucgggcg

SEQ ID NO: 1417089 - RNA, 17 nt, Pseudomonas aeruginosa PA01
cgcaccuccucgggcgg

SEQ ID NO: 1417090 - RNA, 17 nt, Pseudomonas aeruginosa PA01
cgcaccguagcggcugc

SEQ ID NO: 1417091 - RNA, 19 nt, Pseudomonas aeruginosa PA01
cgcaccucgucgagcagcg

SEQ ID NO: 1417092 - RNA, 13 nt, Pseudomonas aeruginosa PA01
cgcaccucggcca

SEQ ID NO: 1417093 - RNA, 14 nt, Pseudomonas aeruginosa PA01
cgcaccucggccag

SEQ ID NO: 1417094 - RNA, 18 nt, Pseudomonas aeruginosa PA01
cgcaccucggccaggcgg

SEQ ID NO: 1417095 - RNA, 23 nt, Pseudomonas aeruginosa PA01
cgcaccucggccaggcgguucca

SEQ ID NO: 1417096 - RNA, 16 nt, Pseudomonas aeruginosa PA01
cgcaccuggcggucgc

SEQ ID NO: 1417097 - RNA, 21 nt, Pseudomonas aeruginosa PA01
cgcaccuggcggucgccgccg

SEQ ID NO: 1417098 - RNA, 22 nt, Pseudomonas aeruginosa PA01
cgcaccuggcggucgccgccgg

SEQ ID NO: 1417099 - RNA, 23 nt, Pseudomonas aeruginosa PA01
cgcaccuggcggucgccgccggc

SEQ ID NO: 1417100 - RNA, 21 nt, Pseudomonas aeruginosa PA01
cgcaccugggacucccgcaga

SEQ ID NO: 1417101 - RNA, 19 nt, Pseudomonas aeruginosa PA01
cgcacgaggcgggcuggaa

SEQ ID NO: 1417102 - RNA, 20 nt, Pseudomonas aeruginosa PA01
cgcaccuuggcuugcaggua

SEQ ID NO: 1417103 - RNA, 17 nt, Pseudomonas aeruginosa PA01
cgcaccucgaccgcgcc

SEQ ID NO: 1417104 - RNA, 13 nt, Pseudomonas aeruginosa PA01
cgcaccuguucca

SEQ ID NO: 1417105 - RNA, 21 nt, Pseudomonas aeruginosa PA01
cgcaccuguuccagcaacgcc

SEQ ID NO: 1417106 - RNA, 20 nt, Pseudomonas aeruginosa PA01
cgcaccugguggacacccug

SEQ ID NO: 1417107 - RNA, 13 nt, Pseudomonas aeruginosa PA01
cgcaccggcgcgc

SEQ ID NO: 1417108 - RNA, 18 nt, Pseudomonas aeruginosa PA01
cgcaccggcgcgccggac

SEQ ID NO: 1417109 - RNA, 13 nt, Pseudomonas aeruginosa PA01
cgcaccggcuucu

SEQ ID NO: 1417110 - RNA, 21 nt, Pseudomonas aeruginosa PA01
cgcaccggcuucuggaaggcg

SEQ ID NO: 1417111 - RNA, 19 nt, Pseudomonas aeruginosa PA01
cgcaccgggaggcgccgcg

SEQ ID NO: 1417112 - RNA, 20 nt, Pseudomonas aeruginosa PA01
cgcaccgggaggcgccgcgc

SEQ ID NO: 1417113 - RNA, 21 nt, Pseudomonas aeruginosa PA01
cgcaccgggaggcgccgcgcc

SEQ ID NO: 1417114 - RNA, 23 nt, Pseudomonas aeruginosa PA01
cgcaccggcauguagcgcgccga

SEQ ID NO: 1417115 - RNA, 13 nt, Pseudomonas aeruginosa PA01
cgcaccgcggcca

SEQ ID NO: 1417116 - RNA, 14 nt, Pseudomonas aeruginosa PA01
cgcaccgcggcgag

SEQ ID NO: 1417117 - RNA, 18 nt, Pseudomonas aeruginosa PA01
cgcaagcuccccgccgcc

SEQ ID NO: 1417118 - RNA, 19 nt, Pseudomonas aeruginosa PA01
cgcaagcucgucacccgcg

SEQ ID NO: 1417119 - RNA, 17 nt, Pseudomonas aeruginosa PA01
cgcaaggaacuggaagc

SEQ ID NO: 1417120 - RNA, 13 nt, Pseudomonas aeruginosa PA01
cgcaagcggcggc

SEQ ID NO: 1417121 - RNA, 14 nt, Pseudomonas aeruginosa PA01
cgcaagcggcggcu

SEQ ID NO: 1417122 - RNA, 21 nt, Pseudomonas aeruginosa PA01
cgcaagcgguuauucgcccca

SEQ ID NO: 1417123 - RNA, 20 nt, Pseudomonas aeruginosa PA01
cgcaagcgguuauucgcccu

SEQ ID NO: 1417124 - RNA, 13 nt, Pseudomonas aeruginosa PA01
cgcaccgcgccgg

SEQ ID NO: 1417125 - RNA, 17 nt, Pseudomonas aeruginosa PA01
cgcaacgggacgccagg

SEQ ID NO: 1417126 - RNA, 13 nt, Pseudomonas aeruginosa PA01
cgcaagcgcucgg

SEQ ID NO: 1417127 - RNA, 16 nt, Pseudomonas aeruginosa PA01
cgcaagcgcucggccu

SEQ ID NO: 1417128 - RNA, 18 nt, Pseudomonas aeruginosa PA01
cgcaagcgcccggcgaac

SEQ ID NO: 1417129 - RNA, 19 nt, Pseudomonas aeruginosa PA01
cgcaagcgcccggcgaaca

SEQ ID NO: 1417130 - RNA, 20 nt, Pseudomonas aeruginosa PA01
cgcacgccgcggaaggcccg

SEQ ID NO: 1417131 - RNA, 15 nt, Pseudomonas aeruginosa PA01
cgcacgccguggacc

SEQ ID NO: 1417132 - RNA, 16 nt, Pseudomonas aeruginosa PA01
cgcacgccggccucgc

SEQ ID NO: 1417133 - RNA, 20 nt, Pseudomonas aeruginosa PA01
cgcacgcgcaguacgaucag

SEQ ID NO: 1417134 - RNA, 13 nt, Pseudomonas aeruginosa PA01
cgcacgcagcgcc

SEQ ID NO: 1417135 - RNA, 14 nt, Pseudomonas aeruginosa PA01
cgcacgcagcgccg

SEQ ID NO: 1417136 - RNA, 15 nt, Pseudomonas aeruginosa PA01
cgcacgcagcgccgc

SEQ ID NO: 1417137 - RNA, 16 nt, Pseudomonas aeruginosa PA01
cgcacgcagcgccgcg

SEQ ID NO: 1417138 - RNA, 20 nt, Pseudomonas aeruginosa PA01
cgcacgcaauagugcagcuc

SEQ ID NO: 1417139 - RNA, 21 nt, Pseudomonas aeruginosa PA01
cgcacgcaauggcgcagccgc

SEQ ID NO: 1417140 - RNA, 17 nt, Pseudomonas aeruginosa PA01
cgcacggcgacgcuguc

SEQ ID NO: 1417141 - RNA, 21 nt, Pseudomonas aeruginosa PA01
cgcacggccugcaccugcucg

SEQ ID NO: 1417142 - RNA, 23 nt, Pseudomonas aeruginosa PA01
cgcacuccgggcagaccagcagc

SEQ ID NO: 1417143 - RNA, 16 nt, Pseudomonas aeruginosa PA01
cgcacuggucggccag

SEQ ID NO: 1417144 - RNA, 12 nt, Pseudomonas aeruginosa PA01
cgcacugguggc

SEQ ID NO: 1417145 - RNA, 14 nt, Pseudomonas aeruginosa PA01
cgcacugguggcga

SEQ ID NO: 1417146 - RNA, 22 nt, Pseudomonas aeruginosa PA01
cgcacugguggcgaacagcacc

SEQ ID NO: 1417147 - RNA, 23 nt, Pseudomonas aeruginosa PA01
cgcacugguggcgaacagcaccu

SEQ ID NO: 1417148 - RNA, 16 nt, Pseudomonas aeruginosa PA01
cgcacugccaggagca

SEQ ID NO: 1417149 - RNA, 21 nt, Pseudomonas aeruginosa PA01
cgcacggucuuggcguugccg

SEQ ID NO: 1417150 - RNA, 14 nt, Pseudomonas aeruginosa PA01
cgcacuuccaggcg

SEQ ID NO: 1417151 - RNA, 18 nt, Pseudomonas aeruginosa PA01
cgcacuucguccgccacc

SEQ ID NO: 1417152 - RNA, 17 nt, Pseudomonas aeruginosa PA01
cgcacuuccucggcgac

SEQ ID NO: 1417153 - RNA, 14 nt, Pseudomonas aeruginosa PA01
cgcagcacagcccc

SEQ ID NO: 1417154 - RNA, 17 nt, Pseudomonas aeruginosa PA01
cgcagcacagccccagc

SEQ ID NO: 1417155 - RNA, 19 nt, Pseudomonas aeruginosa PA01
cgcagaaccagacgcucgg

SEQ ID NO: 1417156 - RNA, 23 nt, Pseudomonas aeruginosa PA01
cgcagaaccagacgcucggccag

SEQ ID NO: 1417157 - RNA, 16 nt, Pseudomonas aeruginosa PA01
cgcagaacgcggaaac

SEQ ID NO: 1417158 - RNA, 12 nt, Pseudomonas aeruginosa PA01
cgcagcacggcg

SEQ ID NO: 1417159 - RNA, 15 nt, Pseudomonas aeruginosa PA01
cgcagcacggcggcu

SEQ ID NO: 1417160 - RNA, 16 nt, Pseudomonas aeruginosa PA01
cgcagcacuuccugaa

SEQ ID NO: 1417161 - RNA, 21 nt, Pseudomonas aeruginosa PA01
cgcagcagcaugaugccgagg

SEQ ID NO: 1417162 - RNA, 13 nt, Pseudomonas aeruginosa PA01
cgcagcagcaggu

SEQ ID NO: 1417163 - RNA, 13 nt, Pseudomonas aeruginosa PA01
cgcagcaccggcu

SEQ ID NO: 1417164 - RNA, 15 nt, Pseudomonas aeruginosa PA01
cgcagcaccggcuug

SEQ ID NO: 1417165 - RNA, 11 nt, Pseudomonas aeruginosa PA01
cgcagcaccgg

SEQ ID NO: 1417166 - RNA, 13 nt, Pseudomonas aeruginosa PA01
cgcagccugcugg

SEQ ID NO: 1417167 - RNA, 22 nt, Pseudomonas aeruginosa PA01
cgcagccuuggcaugaccgagc

SEQ ID NO: 1417168 - RNA, 23 nt, Pseudomonas aeruginosa PA01
cgcagccuuggcaugaccgagca

SEQ ID NO: 1417169 - RNA, 16 nt, Pseudomonas aeruginosa PA01
cgcagccguggcgcga

SEQ ID NO: 1417170 - RNA, 18 nt, Pseudomonas aeruginosa PA01
cgcagccguuggccagca

SEQ ID NO: 1417171 - RNA, 20 nt, Pseudomonas aeruginosa PA01
cgcagccucgcgcucggcgg

SEQ ID NO: 1417172 - RNA, 21 nt, Pseudomonas aeruginosa PA01
cgcagccucgcgcucggcggc

SEQ ID NO: 1417173 - RNA, 23 nt, Pseudomonas aeruginosa PA01
cgcagccucgcgcucggcggccu

SEQ ID NO: 1417174 - RNA, 12 nt, Pseudomonas aeruginosa PA01
cgcagccggugg

SEQ ID NO: 1417175 - RNA, 22 nt, Pseudomonas aeruginosa PA01
cgcagccgguggucuucagcac

SEQ ID NO: 1417176 - RNA, 14 nt, Pseudomonas aeruginosa PA01
cgcagccguccauc

SEQ ID NO: 1417177 - RNA, 13 nt, Pseudomonas aeruginosa PA01
cgcagccgggccg

SEQ ID NO: 1417178 - RNA, 14 nt, Pseudomonas aeruginosa PA01
cgcagccgggccgc

SEQ ID NO: 1417179 - RNA, 17 nt, Pseudomonas aeruginosa PA01
cgcagccgggccgcagc

SEQ ID NO: 1417180 - RNA, 18 nt, Pseudomonas aeruginosa PA01
cgcagccgggccgcagcg

SEQ ID NO: 1417181 - RNA, 20 nt, Pseudomonas aeruginosa PA01
cgcagccgggccgcagcgca

SEQ ID NO: 1417182 - RNA, 21 nt, Pseudomonas aeruginosa PA01
cgcagcgaacgggcguugccg

SEQ ID NO: 1417183 - RNA, 19 nt, Pseudomonas aeruginosa PA01
cgcagcgcaagucggccug

SEQ ID NO: 1417184 - RNA, 13 nt, Pseudomonas aeruginosa PA01
cgcagcgaucagc

SEQ ID NO: 1417185 - RNA, 14 nt, Pseudomonas aeruginosa PA01
cgcagcgaucagca

SEQ ID NO: 1417186 - RNA, 16 nt, Pseudomonas aeruginosa PA01
cgcagcgaucagcacc

SEQ ID NO: 1417187 - RNA, 13 nt, Pseudomonas aeruginosa PA01
cgcagccacggca

SEQ ID NO: 1417188 - RNA, 22 nt, Pseudomonas aeruginosa PA01
cgcagccacggcacacgucggc

SEQ ID NO: 1417189 - RNA, 13 nt, Pseudomonas aeruginosa PA01
cgcagccacccgc

SEQ ID NO: 1417190 - RNA, 20 nt, Pseudomonas aeruginosa PA01
cgcagccacccgcucgaccu

SEQ ID NO: 1417191 - RNA, 22 nt, Pseudomonas aeruginosa PA01
cgcagcagcuucggcgcgacgc

SEQ ID NO: 1417192 - RNA, 19 nt, Pseudomonas aeruginosa PA01
cgcagcaggcgacggucag

SEQ ID NO: 1417193 - RNA, 13 nt, Pseudomonas aeruginosa PA01
cgcagcagcgucg

SEQ ID NO: 1417194 - RNA, 13 nt, Pseudomonas aeruginosa PA01
cgcagcagcggca

SEQ ID NO: 1417195 - RNA, 13 nt, Pseudomonas aeruginosa PA01
cgcagcagcggcg

SEQ ID NO: 1417196 - RNA, 21 nt, Pseudomonas aeruginosa PA01
cgcagccaugaaaaagccggg

SEQ ID NO: 1417197 - RNA, 14 nt, Pseudomonas aeruginosa PA01
cgcagccggcggcg

SEQ ID NO: 1417198 - RNA, 15 nt, Pseudomonas aeruginosa PA01
cgcagccggcggcga

SEQ ID NO: 1417199 - RNA, 12 nt, Pseudomonas aeruginosa PA01
cgcagccaggcg

SEQ ID NO: 1417200 - RNA, 14 nt, Pseudomonas aeruginosa PA01
cgcagccacuggcg

SEQ ID NO: 1417201 - RNA, 22 nt, Pseudomonas aeruginosa PA01
cgcaggccgaucucgugggcca

SEQ ID NO: 1417202 - RNA, 15 nt, Pseudomonas aeruginosa PA01
cgcaggcccuugagg

SEQ ID NO: 1417203 - RNA, 17 nt, Pseudomonas aeruginosa PA01
cgcaggccgccggcggc

SEQ ID NO: 1417204 - RNA, 19 nt, Pseudomonas aeruginosa PA01
cgcaggccgccggcggcca

SEQ ID NO: 1417205 - RNA, 13 nt, Pseudomonas aeruginosa PA01
cgcaggccgcugc

SEQ ID NO: 1417206 - RNA, 14 nt, Pseudomonas aeruginosa PA01
cgcaggccgcugcc

SEQ ID NO: 1417207 - RNA, 15 nt, Pseudomonas aeruginosa PA01
cgcaggccgcugccu

SEQ ID NO: 1417208 - RNA, 18 nt, Pseudomonas aeruginosa PA01
cgcaggccgcugccuguc

SEQ ID NO: 1417209 - RNA, 15 nt, Pseudomonas aeruginosa PA01
cgcaggccagcgcca

SEQ ID NO: 1417210 - RNA, 17 nt, Pseudomonas aeruginosa PA01
cgcaggccagcgccagg

SEQ ID NO: 1417211 - RNA, 14 nt, Pseudomonas aeruginosa PA01
cgcaggccaggcgc

SEQ ID NO: 1417212 - RNA, 19 nt, Pseudomonas aeruginosa PA01
cgcaggcgguaggugagcg

SEQ ID NO: 1417213 - RNA, 20 nt, Pseudomonas aeruginosa PA01
cgcaggcguuccucgacgaa

SEQ ID NO: 1417214 - RNA, 16 nt, Pseudomonas aeruginosa PA01
cgcaggcugccgucca

SEQ ID NO: 1417215 - RNA, 21 nt, Pseudomonas aeruginosa PA01
cgcaggcugccguccaggcgc

SEQ ID NO: 1417216 - RNA, 22 nt, Pseudomonas aeruginosa PA01
cgcaggcugccguccaggcgcg

SEQ ID NO: 1417217 - RNA, 20 nt, Pseudomonas aeruginosa PA01
cgcaggcucaguucggccag

SEQ ID NO: 1417218 - RNA, 16 nt, Pseudomonas aeruginosa PA01
cgcaggccgggaaugg

SEQ ID NO: 1417219 - RNA, 17 nt, Pseudomonas aeruginosa PA01
cgcaggccgggcggacg

SEQ ID NO: 1417220 - RNA, 14 nt, Pseudomonas aeruginosa PA01
cgcaggccggccag

SEQ ID NO: 1417221 - RNA, 15 nt, Pseudomonas aeruginosa PA01
cgcaggcgggcggcg

SEQ ID NO: 1417222 - RNA, 13 nt, Pseudomonas aeruginosa PA01
cgcaggcggucgg

SEQ ID NO: 1417223 - RNA, 16 nt, Pseudomonas aeruginosa PA01
cgcaggcggucggaaa

SEQ ID NO: 1417224 - RNA, 17 nt, Pseudomonas aeruginosa PA01
cgcaggcgguggagcac

SEQ ID NO: 1417225 - RNA, 18 nt, Pseudomonas aeruginosa PA01
cgcaggcgguggagcacg

SEQ ID NO: 1417226 - RNA, 16 nt, Pseudomonas aeruginosa PA01
cgcaggugcaccgcgc

SEQ ID NO: 1417227 - RNA, 14 nt, Pseudomonas aeruginosa PA01
cgcaggugcccugg

SEQ ID NO: 1417228 - RNA, 21 nt, Pseudomonas aeruginosa PA01
cgcaggugcccuggcagacgc

SEQ ID NO: 1417229 - RNA, 21 nt, Pseudomonas aeruginosa PA01
cgcaggugcuuggcaccgcgc

SEQ ID NO: 1417230 - RNA, 22 nt, Pseudomonas aeruginosa PA01
cgcaggugcuuggcaccgcgca

SEQ ID NO: 1417231 - RNA, 15 nt, Pseudomonas aeruginosa PA01
cgcaggucggccucg

SEQ ID NO: 1417232 - RNA, 22 nt, Pseudomonas aeruginosa PA01
cgcaggucggccucggcgagga

SEQ ID NO: 1417233 - RNA, 13 nt, Pseudomonas aeruginosa PA01
cgcaggucggcgu

SEQ ID NO: 1417234 - RNA, 14 nt, Pseudomonas aeruginosa PA01
cgcaggucggcguc

SEQ ID NO: 1417235 - RNA, 16 nt, Pseudomonas aeruginosa PA01
cgcaggucgcuggcgu

SEQ ID NO: 1417236 - RNA, 22 nt, Pseudomonas aeruginosa PA01
cgcaggucgcuggcgucgaccg

SEQ ID NO: 1417237 - RNA, 13 nt, Pseudomonas aeruginosa PA01
cgcaggucgcugu

SEQ ID NO: 1417238 - RNA, 16 nt, Pseudomonas aeruginosa PA01
cgcagggccagcaaca

SEQ ID NO: 1417239 - RNA, 13 nt, Pseudomonas aeruginosa PA01
cgcagggagaacg

SEQ ID NO: 1417240 - RNA, 18 nt, Pseudomonas aeruginosa PA01
cgcaggcuuuccagcccg

SEQ ID NO: 1417241 - RNA, 18 nt, Pseudomonas aeruginosa PA01
cgcaggcuggccgagcgc

SEQ ID NO: 1417242 - RNA, 22 nt, Pseudomonas aeruginosa PA01
cgcaggcuggccgagcgccgcc

SEQ ID NO: 1417243 - RNA, 23 nt, Pseudomonas aeruginosa PA01
cgcaggcuggccgagcgccgccu

SEQ ID NO: 1417244 - RNA, 24 nt, Pseudomonas aeruginosa PA01
cgcaggcugguaugcagcaacccg

SEQ ID NO: 1417245 - RNA, 13 nt, Pseudomonas aeruginosa PA01
cgcaggcugucgg

SEQ ID NO: 1417246 - RNA, 16 nt, Pseudomonas aeruginosa PA01
cgcaggcugucggcca

SEQ ID NO: 1417247 - RNA, 19 nt, Pseudomonas aeruginosa PA01
cgcaggcugucggccagcc

SEQ ID NO: 1417248 - RNA, 20 nt, Pseudomonas aeruginosa PA01
cgcagguagcggcgaagcgc

SEQ ID NO: 1417249 - RNA, 18 nt, Pseudomonas aeruginosa PA01
cgcagguagcugagcagg

SEQ ID NO: 1417250 - RNA, 23 nt, Pseudomonas aeruginosa PA01
cgcagguagcugagcaggccgac

SEQ ID NO: 1417251 - RNA, 13 nt, Pseudomonas aeruginosa PA01
cgcagguagucgc

SEQ ID NO: 1417252 - RNA, 16 nt, Pseudomonas aeruginosa PA01
cgcagguagucgcuca

SEQ ID NO: 1417253 - RNA, 12 nt, Pseudomonas aeruginosa PA01
cgcagcgccucc

SEQ ID NO: 1417254 - RNA, 13 nt, Pseudomonas aeruginosa PA01
cgcagcgccucca

SEQ ID NO: 1417255 - RNA, 19 nt, Pseudomonas aeruginosa PA01
cgcagcgccucccgggccu

SEQ ID NO: 1417256 - RNA, 15 nt, Pseudomonas aeruginosa PA01
cgcagcgccgccgcg

SEQ ID NO: 1417257 - RNA, 13 nt, Pseudomonas aeruginosa PA01
cgcagcgccgcgu

SEQ ID NO: 1417258 - RNA, 14 nt, Pseudomonas aeruginosa PA01
cgcagcgccaccag

SEQ ID NO: 1417259 - RNA, 23 nt, Pseudomonas aeruginosa PA01
cgcaggaugccgccugcgucagc

SEQ ID NO: 1417260 - RNA, 17 nt, Pseudomonas aeruginosa PA01
cgcaggauagaugcguc

SEQ ID NO: 1417261 - RNA, 21 nt, Pseudomonas aeruginosa PA01
cgcaggauagaugcguccguu

SEQ ID NO: 1417262 - RNA, 21 nt, Pseudomonas aeruginosa PA01
cgcaggacggauaacggcagc

SEQ ID NO: 1417263 - RNA, 22 nt, Pseudomonas aeruginosa PA01
cgcaggaccuggcugaggcguu

SEQ ID NO: 1417264 - RNA, 18 nt, Pseudomonas aeruginosa PA01
cgcaggacgucguagcca

SEQ ID NO: 1417265 - RNA, 22 nt, Pseudomonas aeruginosa PA01
cgcaggacgucguagccaggca

SEQ ID NO: 1417266 - RNA, 18 nt, Pseudomonas aeruginosa PA01
cgcaggauguugaacagg

SEQ ID NO: 1417267 - RNA, 13 nt, Pseudomonas aeruginosa PA01
cgcaggcagcaca

SEQ ID NO: 1417268 - RNA, 17 nt, Pseudomonas aeruginosa PA01
cgcaggcauuggaagug

SEQ ID NO: 1417269 - RNA, 15 nt, Pseudomonas aeruginosa PA01
cgcaggcaguggcgc

SEQ ID NO: 1417270 - RNA, 17 nt, Pseudomonas aeruginosa PA01
cgcaggcaguggcgcca

SEQ ID NO: 1417271 - RNA, 19 nt, Pseudomonas aeruginosa PA01
cgcaggcaguggcgccagc

SEQ ID NO: 1417272 - RNA, 12 nt, Pseudomonas aeruginosa PA01
cgcaggcagcgc

SEQ ID NO: 1417273 - RNA, 13 nt, Pseudomonas aeruginosa PA01
cgcaggcagcgcg

SEQ ID NO: 1417274 - RNA, 21 nt, Pseudomonas aeruginosa PA01
cgcaggcaggucaucaggauc

SEQ ID NO: 1417275 - RNA, 14 nt, Pseudomonas aeruginosa PA01
cgcaggcaggucgc

SEQ ID NO: 1417276 - RNA, 15 nt, Pseudomonas aeruginosa PA01
cgcaggcaggucgcu

SEQ ID NO: 1417277 - RNA, 16 nt, Pseudomonas aeruginosa PA01
cgccaaggccucggca

SEQ ID NO: 1417278 - RNA, 21 nt, Pseudomonas aeruginosa PA01
cgccaaugccuuccgacgccg

SEQ ID NO: 1417279 - RNA, 20 nt, Pseudomonas aeruginosa PA01
cgccaaggcccgcaaucagc

SEQ ID NO: 1417280 - RNA, 22 nt, Pseudomonas aeruginosa PA01
cgccaaggcccgcaaucagcgg

SEQ ID NO: 1417281 - RNA, 18 nt, Pseudomonas aeruginosa PA01
cgccaaggcccugcugca

SEQ ID NO: 1417282 - RNA, 19 nt, Pseudomonas aeruginosa PA01
cgccaagcuggcgaucgac

SEQ ID NO: 1417283 - RNA, 23 nt, Pseudomonas aeruginosa PA01
cgccaagcuggcgaucgaccugc

SEQ ID NO: 1417284 - RNA, 16 nt, Pseudomonas aeruginosa PA01
cgcauuggcuucgccc

SEQ ID NO: 1417285 - RNA, 15 nt, Pseudomonas aeruginosa PA01
cgcauuggccaggcc

SEQ ID NO: 1417286 - RNA, 23 nt, Pseudomonas aeruginosa PA01
cgcauuggccaggccccaggccg

SEQ ID NO: 1417287 - RNA, 18 nt, Pseudomonas aeruginosa PA01
cgccaacuggcgcaacug

SEQ ID NO: 1417288 - RNA, 19 nt, Pseudomonas aeruginosa PA01
cgccaacuggcgcaacugc

SEQ ID NO: 1417289 - RNA, 20 nt, Pseudomonas aeruginosa PA01
cgccaacuggcugucgagcg

SEQ ID NO: 1417290 - RNA, 14 nt, Pseudomonas aeruginosa PA01
cgccaccccgccgc

SEQ ID NO: 1417291 - RNA, 15 nt, Pseudomonas aeruginosa PA01
cgccaccccgccgcg

SEQ ID NO: 1417292 - RNA, 16 nt, Pseudomonas aeruginosa PA01
cgccaccccgccgcgc

SEQ ID NO: 1417293 - RNA, 20 nt, Pseudomonas aeruginosa PA01
cgccaccccgccgcgcauca

SEQ ID NO: 1417294 - RNA, 15 nt, Pseudomonas aeruginosa PA01
cgccaccccgccgcu

SEQ ID NO: 1417295 - RNA, 17 nt, Pseudomonas aeruginosa PA01
cgccaccccgccgcugg

SEQ ID NO: 1417296 - RNA, 19 nt, Pseudomonas aeruginosa PA01
cgccaccccgccgcuggcg

SEQ ID NO: 1417297 - RNA, 20 nt, Pseudomonas aeruginosa PA01
cgccaccccgccgcuggcgg

SEQ ID NO: 1417298 - RNA, 21 nt, Pseudomonas aeruginosa PA01
cgccaccccgccgcuggcggc

SEQ ID NO: 1417299 - RNA, 22 nt, Pseudomonas aeruginosa PA01
cgccaccccgccgcuggcggca

SEQ ID NO: 1417300 - RNA, 15 nt, Pseudomonas aeruginosa PA01
cgccaccccgccggc

SEQ ID NO: 1417301 - RNA, 20 nt, Pseudomonas aeruginosa PA01
cgccaccagcagggccaggc

SEQ ID NO: 1417302 - RNA, 21 nt, Pseudomonas aeruginosa PA01
cgccaccagcagggccaggcc

SEQ ID NO: 1417303 - RNA, 22 nt, Pseudomonas aeruginosa PA01
cgccaccagcagggccaggccg

SEQ ID NO: 1417304 - RNA, 12 nt, Pseudomonas aeruginosa PA01
cgccaccagcca

SEQ ID NO: 1417305 - RNA, 16 nt, Pseudomonas aeruginosa PA01
cgccaccacggcgaag

SEQ ID NO: 1417306 - RNA, 18 nt, Pseudomonas aeruginosa PA01
cgccaccacggcgaagcc

SEQ ID NO: 1417307 - RNA, 19 nt, Pseudomonas aeruginosa PA01
cgccaccacggcgaagccg

SEQ ID NO: 1417308 - RNA, 12 nt, Pseudomonas aeruginosa PA01
cgccaccaggaa

SEQ ID NO: 1417309 - RNA, 14 nt, Pseudomonas aeruginosa PA01
cgccaccaggccgc

SEQ ID NO: 1417310 - RNA, 14 nt, Pseudomonas aeruginosa PA01
cgccaccagggccu

SEQ ID NO: 1417311 - RNA, 22 nt, Pseudomonas aeruginosa PA01
cgccaccagggccuugccgcga

SEQ ID NO: 1417312 - RNA, 12 nt, Pseudomonas aeruginosa PA01
cgccaccagcga

SEQ ID NO: 1417313 - RNA, 14 nt, Pseudomonas aeruginosa PA01
cgccaccagcgugg

SEQ ID NO: 1417314 - RNA, 16 nt, Pseudomonas aeruginosa PA01
cgccaccagcguggcg

SEQ ID NO: 1417315 - RNA, 20 nt, Pseudomonas aeruginosa PA01
cgccaccacgaucaggcccu

SEQ ID NO: 1417316 - RNA, 23 nt, Pseudomonas aeruginosa PA01
cgccaccaaccacaaccagccau

SEQ ID NO: 1417317 - RNA, 17 nt, Pseudomonas aeruginosa PA01
cgccacagaucgccagc

SEQ ID NO: 1417318 - RNA, 20 nt, Pseudomonas aeruginosa PA01
cgccacagaucgccagcucg

SEQ ID NO: 1417319 - RNA, 22 nt, Pseudomonas aeruginosa PA01
cgccacaggcguuauccgccga

SEQ ID NO: 1417320 - RNA, 22 nt, Pseudomonas aeruginosa PA01
cgccacaggcguuauccgccgc

SEQ ID NO: 1417321 - RNA, 14 nt, Pseudomonas aeruginosa PA01
cgcauugacccggg

SEQ ID NO: 1417322 - RNA, 13 nt, Pseudomonas aeruginosa PA01
cgcauggucgcgc

SEQ ID NO: 1417323 - RNA, 15 nt, Pseudomonas aeruginosa PA01
cgcauguccagccag

SEQ ID NO: 1417324 - RNA, 16 nt, Pseudomonas aeruginosa PA01
cgcauguccagccagu

SEQ ID NO: 1417325 - RNA, 18 nt, Pseudomonas aeruginosa PA01
cgcaugaacgccucgcca

SEQ ID NO: 1417326 - RNA, 17 nt, Pseudomonas aeruginosa PA01
cgcauggcguucugcga

SEQ ID NO: 1417327 - RNA, 21 nt, Pseudomonas aeruginosa PA01
cgcauggcguucugcgacauc

SEQ ID NO: 1417328 - RNA, 14 nt, Pseudomonas aeruginosa PA01
cgcauggcggcgac

SEQ ID NO: 1417329 - RNA, 15 nt, Pseudomonas aeruginosa PA01
cgcauggcggcgacc

SEQ ID NO: 1417330 - RNA, 22 nt, Pseudomonas aeruginosa PA01
cgcaugcugggucuccgcucgg

SEQ ID NO: 1417331 - RNA, 18 nt, Pseudomonas aeruginosa PA01
cgcauggagacggcccgc

SEQ ID NO: 1417332 - RNA, 19 nt, Pseudomonas aeruginosa PA01
cgcauggagacggcccgcc

SEQ ID NO: 1417333 - RNA, 22 nt, Pseudomonas aeruginosa PA01
cgcauggagacggcccgccccg

SEQ ID NO: 1417334 - RNA, 19 nt, Pseudomonas aeruginosa PA01
cgcaugaaaaagcccggca

SEQ ID NO: 1417335 - RNA, 16 nt, Pseudomonas aeruginosa PA01
cgcaucuggcugcgcg

SEQ ID NO: 1417336 - RNA, 15 nt, Pseudomonas aeruginosa PA01
cgcaucuggugcgcg

SEQ ID NO: 1417337 - RNA, 22 nt, Pseudomonas aeruginosa PA01
cgcaucuggugcgcguccaucc

SEQ ID NO: 1417338 - RNA, 17 nt, Pseudomonas aeruginosa PA01
cgcaugaccuucagcac

SEQ ID NO: 1417339 - RNA, 22 nt, Pseudomonas aeruginosa PA01
cgcaugaccuucagcaccugcg

SEQ ID NO: 1417340 - RNA, 23 nt, Pseudomonas aeruginosa PA01
cgcaucggcggauaacgccgcug

SEQ ID NO: 1417341 - RNA, 17 nt, Pseudomonas aeruginosa PA01
cgcaucggccaccuucg

SEQ ID NO: 1417342 - RNA, 21 nt, Pseudomonas aeruginosa PA01
cgcaucggccaccuucgcccg

SEQ ID NO: 1417343 - RNA, 21 nt, Pseudomonas aeruginosa PA01
cgcaucgucgaaacgcuggcg

SEQ ID NO: 1417344 - RNA, 21 nt, Pseudomonas aeruginosa PA01
cgcaucgucgaugcguccgcg

SEQ ID NO: 1417345 - RNA, 23 nt, Pseudomonas aeruginosa PA01
cgcaucgugcagccagacccagu

SEQ ID NO: 1417346 - RNA, 13 nt, Pseudomonas aeruginosa PA01
cgcaucgaaggcg

SEQ ID NO: 1417347 - RNA, 19 nt, Pseudomonas aeruginosa PA01
cgcaucgaaggcgccggca

SEQ ID NO: 1417348 - RNA, 17 nt, Pseudomonas aeruginosa PA01
cgcaucgaggccgccca

SEQ ID NO: 1417349 - RNA, 20 nt, Pseudomonas aeruginosa PA01
cgcaucgaggccgcccagcg

SEQ ID NO: 1417350 - RNA, 16 nt, Pseudomonas aeruginosa PA01
cgcaucgccaccgcgg

SEQ ID NO: 1417351 - RNA, 20 nt, Pseudomonas aeruginosa PA01
cgcaucgccugggccggcgu

SEQ ID NO: 1417352 - RNA, 16 nt, Pseudomonas aeruginosa PA01
cgcaucgcggacaccg

SEQ ID NO: 1417353 - RNA, 14 nt, Pseudomonas aeruginosa PA01
cgcaucgcgggcgu

SEQ ID NO: 1417354 - RNA, 18 nt, Pseudomonas aeruginosa PA01
cgcagguucaucgccgcc

SEQ ID NO: 1417355 - RNA, 20 nt, Pseudomonas aeruginosa PA01
cgcagguuggccccgccgag

SEQ ID NO: 1417356 - RNA, 19 nt, Pseudomonas aeruginosa PA01
cgcagguugagggccgcgc

SEQ ID NO: 1417357 - RNA, 18 nt, Pseudomonas aeruginosa PA01
cgcagguugcgcuggcgc

SEQ ID NO: 1417358 - RNA, 17 nt, Pseudomonas aeruginosa PA01
cgcaguacgaggggccg

SEQ ID NO: 1417359 - RNA, 15 nt, Pseudomonas aeruginosa PA01
cgcaguacgaucagc

SEQ ID NO: 1417360 - RNA, 21 nt, Pseudomonas aeruginosa PA01
cgcaguacgaucagccagggc

SEQ ID NO: 1417361 - RNA, 22 nt, Pseudomonas aeruginosa PA01
cgcaguacgaucagccagggca

SEQ ID NO: 1417362 - RNA, 15 nt, Pseudomonas aeruginosa PA01
cgcauccucggcauc

SEQ ID NO: 1417363 - RNA, 18 nt, Pseudomonas aeruginosa PA01
cgcaguacccggccgccu

SEQ ID NO: 1417364 - RNA, 18 nt, Pseudomonas aeruginosa PA01
cgccaggaacgccucugc

SEQ ID NO: 1417365 - RNA, 19 nt, Pseudomonas aeruginosa PA01
cgccagcuuguccgccgga

SEQ ID NO: 1417366 - RNA, 16 nt, Pseudomonas aeruginosa PA01
cgccagcggcccggca

SEQ ID NO: 1417367 - RNA, 22 nt, Pseudomonas aeruginosa PA01
cgccagcgggacgaugccgauc

SEQ ID NO: 1417368 - RNA, 14 nt, Pseudomonas aeruginosa PA01
cgccagcgucgccg

SEQ ID NO: 1417369 - RNA, 16 nt, Pseudomonas aeruginosa PA01
cgccagcgucgccgcc

SEQ ID NO: 1417370 - RNA, 17 nt, Pseudomonas aeruginosa PA01
cgccagcgucgccgccg

SEQ ID NO: 1417371 - RNA, 20 nt, Pseudomonas aeruginosa PA01
cgccagcgucgccgccgcgg

SEQ ID NO: 1417372 - RNA, 14 nt, Pseudomonas aeruginosa PA01
cgccagcgccgcca

SEQ ID NO: 1417373 - RNA, 15 nt, Pseudomonas aeruginosa PA01
cgccagcgccgccag

SEQ ID NO: 1417374 - RNA, 16 nt, Pseudomonas aeruginosa PA01
cgccagcgccgccagu

SEQ ID NO: 1417375 - RNA, 14 nt, Pseudomonas aeruginosa PA01
cgccagcggcagcg

SEQ ID NO: 1417376 - RNA, 16 nt, Pseudomonas aeruginosa PA01
cgccagcgccagcagg

SEQ ID NO: 1417377 - RNA, 13 nt, Pseudomonas aeruginosa PA01
cgccagcgccagc

SEQ ID NO: 1417378 - RNA, 14 nt, Pseudomonas aeruginosa PA01
cgccagcgccagca

SEQ ID NO: 1417379 - RNA, 13 nt, Pseudomonas aeruginosa PA01
cgccagcgccgcc

SEQ ID NO: 1417380 - RNA, 13 nt, Pseudomonas aeruginosa PA01
cgccagcgcaccu

SEQ ID NO: 1417381 - RNA, 12 nt, Pseudomonas aeruginosa PA01
cgccagccgcca

SEQ ID NO: 1417382 - RNA, 12 nt, Pseudomonas aeruginosa PA01
cgccagcgcacc

SEQ ID NO: 1417383 - RNA, 18 nt, Pseudomonas aeruginosa PA01
cgccagcgccacggcgau

SEQ ID NO: 1417384 - RNA, 19 nt, Pseudomonas aeruginosa PA01
cgccagcgccacggcgauc

SEQ ID NO: 1417385 - RNA, 20 nt, Pseudomonas aeruginosa PA01
cgccagcgccacggcgaucg

SEQ ID NO: 1417386 - RNA, 21 nt, Pseudomonas aeruginosa PA01
cgccagcgccacggcgaucgc

SEQ ID NO: 1417387 - RNA, 16 nt, Pseudomonas aeruginosa PA01
cgccagcccgguucag

SEQ ID NO: 1417388 - RNA, 19 nt, Pseudomonas aeruginosa PA01
cgccagcccgguucagcgg

SEQ ID NO: 1417389 - RNA, 18 nt, Pseudomonas aeruginosa PA01
cgccagcccggcaggucg

SEQ ID NO: 1417390 - RNA, 16 nt, Pseudomonas aeruginosa PA01
cgccagccgacuggcg

SEQ ID NO: 1417391 - RNA, 22 nt, Pseudomonas aeruginosa PA01
cgccagcgagacgggcgaggcu

SEQ ID NO: 1417392 - RNA, 16 nt, Pseudomonas aeruginosa PA01
cgccagcccagugcug

SEQ ID NO: 1417393 - RNA, 23 nt, Pseudomonas aeruginosa PA01
cgccagccccaggccgcccuuga

SEQ ID NO: 1417394 - RNA, 17 nt, Pseudomonas aeruginosa PA01
cgccagccccaggcgcg

SEQ ID NO: 1417395 - RNA, 20 nt, Pseudomonas aeruginosa PA01
cgccagccccaggcgcggcg

SEQ ID NO: 1417396 - RNA, 22 nt, Pseudomonas aeruginosa PA01
cgccagccccaggcgcggcguc

SEQ ID NO: 1417397 - RNA, 13 nt, Pseudomonas aeruginosa PA01
cgccagcccgcca

SEQ ID NO: 1417398 - RNA, 16 nt, Pseudomonas aeruginosa PA01
cgccagcccgccaccg

SEQ ID NO: 1417399 - RNA, 17 nt, Pseudomonas aeruginosa PA01
cgccagcccgccaccga

SEQ ID NO: 1417400 - RNA, 22 nt, Pseudomonas aeruginosa PA01
cgccagcaggcguugcagugcg

SEQ ID NO: 1417401 - RNA, 19 nt, Pseudomonas aeruginosa PA01
cgccagaugacgauggccg

SEQ ID NO: 1417402 - RNA, 20 nt, Pseudomonas aeruginosa PA01
cgccagaugacgauggccgc

SEQ ID NO: 1417403 - RNA, 23 nt, Pseudomonas aeruginosa PA01
cgccagaugacgauggccgccgc

SEQ ID NO: 1417404 - RNA, 14 nt, Pseudomonas aeruginosa PA01
cgccagaugcgcgu

SEQ ID NO: 1417405 - RNA, 15 nt, Pseudomonas aeruginosa PA01
cgccagaugcgcguc

SEQ ID NO: 1417406 - RNA, 17 nt, Pseudomonas aeruginosa PA01
cgccagaugcgcgucgc

SEQ ID NO: 1417407 - RNA, 19 nt, Pseudomonas aeruginosa PA01
cgccagaugcgcgucgccg

SEQ ID NO: 1417408 - RNA, 14 nt, Pseudomonas aeruginosa PA01
cgccagcaggaucg

SEQ ID NO: 1417409 - RNA, 14 nt, Pseudomonas aeruginosa PA01
cgccagcaggcgau

SEQ ID NO: 1417410 - RNA, 13 nt, Pseudomonas aeruginosa PA01
cgccagcaggcgc

SEQ ID NO: 1417411 - RNA, 20 nt, Pseudomonas aeruginosa PA01
cgccagcaggcgcagcagcg

SEQ ID NO: 1417412 - RNA, 21 nt, Pseudomonas aeruginosa PA01
cgccagcaggcgcagcagcga

SEQ ID NO: 1417413 - RNA, 22 nt, Pseudomonas aeruginosa PA01
cgccagcaggcgcagcagcgac

SEQ ID NO: 1417414 - RNA, 22 nt, Pseudomonas aeruginosa PA01
cgccagcaggcgcaggucggcc

SEQ ID NO: 1417415 - RNA, 18 nt, Pseudomonas aeruginosa PA01
cgccagcaggcgccggcg

SEQ ID NO: 1417416 - RNA, 14 nt, Pseudomonas aeruginosa PA01
cgccagcaggcgcg

SEQ ID NO: 1417417 - RNA, 19 nt, Pseudomonas aeruginosa PA01
cgccagcaggccgaaggcc

SEQ ID NO: 1417418 - RNA, 21 nt, Pseudomonas aeruginosa PA01
cgccagcaggccgaaggccag

SEQ ID NO: 1417419 - RNA, 12 nt, Pseudomonas aeruginosa PA01
cgccagcaggcg

SEQ ID NO: 1417420 - RNA, 16 nt, Pseudomonas aeruginosa PA01
cgccacggccagcagg

SEQ ID NO: 1417421 - RNA, 19 nt, Pseudomonas aeruginosa PA01
cgccacgggcagaccuucg

SEQ ID NO: 1417422 - RNA, 15 nt, Pseudomonas aeruginosa PA01
cgccacggguaacgg

SEQ ID NO: 1417423 - RNA, 20 nt, Pseudomonas aeruginosa PA01
cgccacggcgcgcuccggcg

SEQ ID NO: 1417424 - RNA, 14 nt, Pseudomonas aeruginosa PA01
cgccacggcgcgga

SEQ ID NO: 1417425 - RNA, 22 nt, Pseudomonas aeruginosa PA01
cgccacggcgguuucgucgaag

SEQ ID NO: 1417426 - RNA, 13 nt, Pseudomonas aeruginosa PA01
cgccacgcccgcc

SEQ ID NO: 1417427 - RNA, 14 nt, Pseudomonas aeruginosa PA01
cgccacgccgcugu

SEQ ID NO: 1417428 - RNA, 16 nt, Pseudomonas aeruginosa PA01
cgccacgccgcugucg

SEQ ID NO: 1417429 - RNA, 12 nt, Pseudomonas aeruginosa PA01
cgccacgccgcu

SEQ ID NO: 1417430 - RNA, 16 nt, Pseudomonas aeruginosa PA01
cgccacggcgaucgcc

SEQ ID NO: 1417431 - RNA, 19 nt, Pseudomonas aeruginosa PA01
cgccacggcgaucgccggg

SEQ ID NO: 1417432 - RNA, 14 nt, Pseudomonas aeruginosa PA01
cgccacgccggcgc

SEQ ID NO: 1417433 - RNA, 23 nt, Pseudomonas aeruginosa PA01
cgccacugcucccaugagcgacc

SEQ ID NO: 1417434 - RNA, 18 nt, Pseudomonas aeruginosa PA01
cgccacuucaagcuggcg

SEQ ID NO: 1417435 - RNA, 16 nt, Pseudomonas aeruginosa PA01
cgccacuuccagcacg

SEQ ID NO: 1417436 - RNA, 18 nt, Pseudomonas aeruginosa PA01
cgccacuuccagcacgcc

SEQ ID NO: 1417437 - RNA, 19 nt, Pseudomonas aeruginosa PA01
cgccacuuccagcacgccg

SEQ ID NO: 1417438 - RNA, 21 nt, Pseudomonas aeruginosa PA01
cgccacuuccagcacgccgau

SEQ ID NO: 1417439 - RNA, 19 nt, Pseudomonas aeruginosa PA01
cgccacuuccagcuugcgc

SEQ ID NO: 1417440 - RNA, 19 nt, Pseudomonas aeruginosa PA01
cgccagaaagccucaggcg

SEQ ID NO: 1417441 - RNA, 22 nt, Pseudomonas aeruginosa PA01
cgccagaaagccucaggcgcug

SEQ ID NO: 1417442 - RNA, 23 nt, Pseudomonas aeruginosa PA01
cgccaccgguacgcucaccacca

SEQ ID NO: 1417443 - RNA, 22 nt, Pseudomonas aeruginosa PA01
cgccaccggcguuauccgccga

SEQ ID NO: 1417444 - RNA, 21 nt, Pseudomonas aeruginosa PA01
cgccacgcaauccucggugcg

SEQ ID NO: 1417445 - RNA, 14 nt, Pseudomonas aeruginosa PA01
cgccacgcaguucg

SEQ ID NO: 1417446 - RNA, 17 nt, Pseudomonas aeruginosa PA01
cgccacgcaguucgcgg

SEQ ID NO: 1417447 - RNA, 18 nt, Pseudomonas aeruginosa PA01
cgccacgcaguucgcggg

SEQ ID NO: 1417448 - RNA, 21 nt, Pseudomonas aeruginosa PA01
cgccacgcaguucgcgggccg

SEQ ID NO: 1417449 - RNA, 14 nt, Pseudomonas aeruginosa PA01
cgccaccgauagcg

SEQ ID NO: 1417450 - RNA, 17 nt, Pseudomonas aeruginosa PA01
cgccaccgauagcggcg

SEQ ID NO: 1417451 - RNA, 18 nt, Pseudomonas aeruginosa PA01
cgccaccgauagcggcgc

SEQ ID NO: 1417452 - RNA, 22 nt, Pseudomonas aeruginosa PA01
cgccacccguuccuugcgcggc

SEQ ID NO: 1417453 - RNA, 23 nt, Pseudomonas aeruginosa PA01
cgccacccguuccuugcgcggca

SEQ ID NO: 1417454 - RNA, 18 nt, Pseudomonas aeruginosa PA01
cgccacccucggcuucgu

SEQ ID NO: 1417455 - RNA, 14 nt, Pseudomonas aeruginosa PA01
cgccaccgccaccg

SEQ ID NO: 1417456 - RNA, 15 nt, Pseudomonas aeruginosa PA01
cgccaccgccaccgc

SEQ ID NO: 1417457 - RNA, 18 nt, Pseudomonas aeruginosa PA01
cgccaccgccaccgccgg

SEQ ID NO: 1417458 - RNA, 20 nt, Pseudomonas aeruginosa PA01
cgccaccgccuggucgccgg

SEQ ID NO: 1417459 - RNA, 21 nt, Pseudomonas aeruginosa PA01
cgccaccgcggauccacgccu

SEQ ID NO: 1417460 - RNA, 13 nt, Pseudomonas aeruginosa PA01
cgccaccgcgacg

SEQ ID NO: 1417461 - RNA, 16 nt, Pseudomonas aeruginosa PA01
cgccaccgcgacgcgc

SEQ ID NO: 1417462 - RNA, 23 nt, Pseudomonas aeruginosa PA01
cgauaaaaagccccgcuucggcg

SEQ ID NO: 1417463 - RNA, 21 nt, Pseudomonas aeruginosa PA01
cgaguuuccggugcaccuggg

SEQ ID NO: 1417464 - RNA, 15 nt, Pseudomonas aeruginosa PA01
cgaguuucccggcgc

SEQ ID NO: 1417465 - RNA, 19 nt, Pseudomonas aeruginosa PA01
cgaguuucccggcgcggcc

SEQ ID NO: 1417466 - RNA, 21 nt, Pseudomonas aeruginosa PA01
cgaguugggcgaccugcucga

SEQ ID NO: 1417467 - RNA, 22 nt, Pseudomonas aeruginosa PA01
cgaguuggcccaauccgcgccg

SEQ ID NO: 1417468 - RNA, 15 nt, Pseudomonas aeruginosa PA01
cgaguucgccgcgag

SEQ ID NO: 1417469 - RNA, 18 nt, Pseudomonas aeruginosa PA01
cgaguggccgcugagcag

SEQ ID NO: 1417470 - RNA, 14 nt, Pseudomonas aeruginosa PA01
cgauacccuggccg

SEQ ID NO: 1417471 - RNA, 20 nt, Pseudomonas aeruginosa PA01
cgauacccugggagccgccg

SEQ ID NO: 1417472 - RNA, 14 nt, Pseudomonas aeruginosa PA01
cgauaccagcgccg

SEQ ID NO: 1417473 - RNA, 17 nt, Pseudomonas aeruginosa PA01
cgauaccagcgccgcuc

SEQ ID NO: 1417474 - RNA, 21 nt, Pseudomonas aeruginosa PA01
cgauacgagaucgagcgcgcc

SEQ ID NO: 1417475 - RNA, 18 nt, Pseudomonas aeruginosa PA01
cgaucacccgcgaggccg

SEQ ID NO: 1417476 - RNA, 15 nt, Pseudomonas aeruginosa PA01
cgaucaccgcaucga

SEQ ID NO: 1417477 - RNA, 23 nt, Pseudomonas aeruginosa PA01
cgaucaccgccacuaccaccacc

SEQ ID NO: 1417478 - RNA, 13 nt, Pseudomonas aeruginosa PA01
cgaucaccccgcc

SEQ ID NO: 1417479 - RNA, 14 nt, Pseudomonas aeruginosa PA01
cgaucacccccagc

SEQ ID NO: 1417480 - RNA, 18 nt, Pseudomonas aeruginosa PA01
cgaucacccccagcgagc

SEQ ID NO: 1417481 - RNA, 19 nt, Pseudomonas aeruginosa PA01
cgaucaccagcgccaggcc

SEQ ID NO: 1417482 - RNA, 20 nt, Pseudomonas aeruginosa PA01
cgaucaccagcgccaggccg

SEQ ID NO: 1417483 - RNA, 23 nt, Pseudomonas aeruginosa PA01
cgaucaccagcgccaggccgccg

SEQ ID NO: 1417484 - RNA, 14 nt, Pseudomonas aeruginosa PA01
cgauacgcucggcg

SEQ ID NO: 1417485 - RNA, 16 nt, Pseudomonas aeruginosa PA01
cgauacgcucggcguc

SEQ ID NO: 1417486 - RNA, 16 nt, Pseudomonas aeruginosa PA01
cgauacgcaucugcuc

SEQ ID NO: 1417487 - RNA, 20 nt, Pseudomonas aeruginosa PA01
cgauagaccaggaaggccgg

SEQ ID NO: 1417488 - RNA, 17 nt, Pseudomonas aeruginosa PA01
cgauauggccguagccg

SEQ ID NO: 1417489 - RNA, 16 nt, Pseudomonas aeruginosa PA01
cgauccagaagaucag

SEQ ID NO: 1417490 - RNA, 19 nt, Pseudomonas aeruginosa PA01
cgauccagaagaucagcgc

SEQ ID NO: 1417491 - RNA, 14 nt, Pseudomonas aeruginosa PA01
cgauccaccgccag

SEQ ID NO: 1417492 - RNA, 15 nt, Pseudomonas aeruginosa PA01
cgauccaccgccagg

SEQ ID NO: 1417493 - RNA, 16 nt, Pseudomonas aeruginosa PA01
cgaucagguaggcgcc

SEQ ID NO: 1417494 - RNA, 20 nt, Pseudomonas aeruginosa PA01
cgaucagguaggcgccgugc

SEQ ID NO: 1417495 - RNA, 13 nt, Pseudomonas aeruginosa PA01
cgaucaggucgcc

SEQ ID NO: 1417496 - RNA, 22 nt, Pseudomonas aeruginosa PA01
cgaucaucugcggguugccgca

SEQ ID NO: 1417497 - RNA, 21 nt, Pseudomonas aeruginosa PA01
cgaucaucugcugcagcauca

SEQ ID NO: 1417498 - RNA, 12 nt, Pseudomonas aeruginosa PA01
cgaucaugccuu

SEQ ID NO: 1417499 - RNA, 15 nt, Pseudomonas aeruginosa PA01
cgaucaugccuucga

SEQ ID NO: 1417500 - RNA, 17 nt, Pseudomonas aeruginosa PA01
cgauccgaccuggggcg

SEQ ID NO: 1417501 - RNA, 20 nt, Pseudomonas aeruginosa PA01
cgaucccggcggcgacccag

SEQ ID NO: 1417502 - RNA, 19 nt, Pseudomonas aeruginosa PA01
cgaucccggauucgccgag

SEQ ID NO: 1417503 - RNA, 14 nt, Pseudomonas aeruginosa PA01
cgaucccgaucggc

SEQ ID NO: 1417504 - RNA, 19 nt, Pseudomonas aeruginosa PA01
cgauccgcuccagcaguuc

SEQ ID NO: 1417505 - RNA, 12 nt, Pseudomonas aeruginosa PA01
cgauccgcugca

SEQ ID NO: 1417506 - RNA, 22 nt, Pseudomonas aeruginosa PA01
cgauccggccgaucuccuggcg

SEQ ID NO: 1417507 - RNA, 23 nt, Pseudomonas aeruginosa PA01
cgauccgcgcuuccgcaucggcc

SEQ ID NO: 1417508 - RNA, 13 nt, Pseudomonas aeruginosa PA01
cgaucagcgggua

SEQ ID NO: 1417509 - RNA, 20 nt, Pseudomonas aeruginosa PA01
cgaucaggaaauaaccggcg

SEQ ID NO: 1417510 - RNA, 16 nt, Pseudomonas aeruginosa PA01
cgaucaggaacacccg

SEQ ID NO: 1417511 - RNA, 22 nt, Pseudomonas aeruginosa PA01
cgaucaggaacacccgguccug

SEQ ID NO: 1417512 - RNA, 23 nt, Pseudomonas aeruginosa PA01
cgaucaggauguggccgucgcgc

SEQ ID NO: 1417513 - RNA, 14 nt, Pseudomonas aeruginosa PA01
cgaucaggcagcgc

SEQ ID NO: 1417514 - RNA, 15 nt, Pseudomonas aeruginosa PA01
cgaucaggcagcgcg

SEQ ID NO: 1417515 - RNA, 20 nt, Pseudomonas aeruginosa PA01
cgaucaggcagcgcgcggcc

SEQ ID NO: 1417516 - RNA, 14 nt, Pseudomonas aeruginosa PA01
cgaucaggccaagc

SEQ ID NO: 1417517 - RNA, 12 nt, Pseudomonas aeruginosa PA01
cgaucaggcgca

SEQ ID NO: 1417518 - RNA, 20 nt, Pseudomonas aeruginosa PA01
cgaucaggcgcaugcccagg

SEQ ID NO: 1417519 - RNA, 19 nt, Pseudomonas aeruginosa PA01
cgaucagcggcccgagcag

SEQ ID NO: 1417520 - RNA, 16 nt, Pseudomonas aeruginosa PA01
cgaucagcgcgccuuc

SEQ ID NO: 1417521 - RNA, 17 nt, Pseudomonas aeruginosa PA01
cgaucagcucguugccc

SEQ ID NO: 1417522 - RNA, 21 nt, Pseudomonas aeruginosa PA01
cgaucagcucuuccaggugau

SEQ ID NO: 1417523 - RNA, 12 nt, Pseudomonas aeruginosa PA01
cgaucagcgggc

SEQ ID NO: 1417524 - RNA, 14 nt, Pseudomonas aeruginosa PA01
cgaucagcgccggg

SEQ ID NO: 1417525 - RNA, 17 nt, Pseudomonas aeruginosa PA01
cgaucagcgccucggcg

SEQ ID NO: 1417526 - RNA, 14 nt, Pseudomonas aeruginosa PA01
cgaucagcaccagc

SEQ ID NO: 1417527 - RNA, 21 nt, Pseudomonas aeruginosa PA01
cgaucacgucguacucggcgg

SEQ ID NO: 1417528 - RNA, 22 nt, Pseudomonas aeruginosa PA01
cgaucacucccugcucgcgcag

SEQ ID NO: 1417529 - RNA, 16 nt, Pseudomonas aeruginosa PA01
cgaucacugccuggca

SEQ ID NO: 1417530 - RNA, 14 nt, Pseudomonas aeruginosa PA01
cgagggccuugucg

SEQ ID NO: 1417531 - RNA, 19 nt, Pseudomonas aeruginosa PA01
cgagggcgaacagcagcgg

SEQ ID NO: 1417532 - RNA, 18 nt, Pseudomonas aeruginosa PA01
cgagggcgaccgccaggc

SEQ ID NO: 1417533 - RNA, 19 nt, Pseudomonas aeruginosa PA01
cgagggcgaguucggcgag

SEQ ID NO: 1417534 - RNA, 20 nt, Pseudomonas aeruginosa PA01
cgagggccgcgccgacccag

SEQ ID NO: 1417535 - RNA, 14 nt, Pseudomonas aeruginosa PA01
cgagggcgcggcgc

SEQ ID NO: 1417536 - RNA, 16 nt, Pseudomonas aeruginosa PA01
cgagggcgcggcgcca

SEQ ID NO: 1417537 - RNA, 18 nt, Pseudomonas aeruginosa PA01
cgagggcgcggcgccagc

SEQ ID NO: 1417538 - RNA, 20 nt, Pseudomonas aeruginosa PA01
cgagggcgcggcgccagcgc

SEQ ID NO: 1417539 - RNA, 15 nt, Pseudomonas aeruginosa PA01
cgagggcggcagggg

SEQ ID NO: 1417540 - RNA, 12 nt, Pseudomonas aeruginosa PA01
cgagggcggcgg

SEQ ID NO: 1417541 - RNA, 13 nt, Pseudomonas aeruginosa PA01
cgagggcggcgcg

SEQ ID NO: 1417542 - RNA, 14 nt, Pseudomonas aeruginosa PA01
cgagggcggcgcgg

SEQ ID NO: 1417543 - RNA, 15 nt, Pseudomonas aeruginosa PA01
cgagggcggcgcggg

SEQ ID NO: 1417544 - RNA, 16 nt, Pseudomonas aeruginosa PA01
cgagggcggcgcgggc

SEQ ID NO: 1417545 - RNA, 18 nt, Pseudomonas aeruginosa PA01
cgagggcggcgcgggcgc

SEQ ID NO: 1417546 - RNA, 14 nt, Pseudomonas aeruginosa PA01
cgaggggaaccggg

SEQ ID NO: 1417547 - RNA, 15 nt, Pseudomonas aeruginosa PA01
cgagggcucgggcgc

SEQ ID NO: 1417548 - RNA, 18 nt, Pseudomonas aeruginosa PA01
cgagggggccucggccag

SEQ ID NO: 1417549 - RNA, 21 nt, Pseudomonas aeruginosa PA01
cgagggggccucggccagcgc

SEQ ID NO: 1417550 - RNA, 22 nt, Pseudomonas aeruginosa PA01
cgagggggccucggccagcgcc

SEQ ID NO: 1417551 - RNA, 20 nt, Pseudomonas aeruginosa PA01
cgaggggcgacggaaacgac

SEQ ID NO: 1417552 - RNA, 17 nt, Pseudomonas aeruginosa PA01
cgaggggcggagcagcc

SEQ ID NO: 1417553 - RNA, 13 nt, Pseudomonas aeruginosa PA01
cgagggucgccuu

SEQ ID NO: 1417554 - RNA, 20 nt, Pseudomonas aeruginosa PA01
cgagggucgccuugaccagc

SEQ ID NO: 1417555 - RNA, 12 nt, Pseudomonas aeruginosa PA01
cgagcgggucga

SEQ ID NO: 1417556 - RNA, 21 nt, Pseudomonas aeruginosa PA01
cgagcgggcuuuuucaugcgu

SEQ ID NO: 1417557 - RNA, 13 nt, Pseudomonas aeruginosa PA01
cgagcggucggag

SEQ ID NO: 1417558 - RNA, 21 nt, Pseudomonas aeruginosa PA01
cgagcggucggagguucgaau

SEQ ID NO: 1417559 - RNA, 22 nt, Pseudomonas aeruginosa PA01
cgagcggucuuuuuccaggcaa

SEQ ID NO: 1417560 - RNA, 15 nt, Pseudomonas aeruginosa PA01
cgaggcucggucgcg

SEQ ID NO: 1417561 - RNA, 16 nt, Pseudomonas aeruginosa PA01
cgaggcucggucgcgc

SEQ ID NO: 1417562 - RNA, 19 nt, Pseudomonas aeruginosa PA01
cgaggcucggucgcgcggg

SEQ ID NO: 1417563 - RNA, 16 nt, Pseudomonas aeruginosa PA01
cgaggcugccgaagcc

SEQ ID NO: 1417564 - RNA, 20 nt, Pseudomonas aeruginosa PA01
cgaggcugcgauauggccga

SEQ ID NO: 1417565 - RNA, 13 nt, Pseudomonas aeruginosa PA01
cgaggcuggccuc

SEQ ID NO: 1417566 - RNA, 19 nt, Pseudomonas aeruginosa PA01
cgaggcuuuccagcaggcg

SEQ ID NO: 1417567 - RNA, 21 nt, Pseudomonas aeruginosa PA01
cgaggcuuuccagcaggcgcu

SEQ ID NO: 1417568 - RNA, 22 nt, Pseudomonas aeruginosa PA01
cgagggaggucgcacgcagcgc

SEQ ID NO: 1417569 - RNA, 18 nt, Pseudomonas aeruginosa PA01
cgagggauguuccaggcc

SEQ ID NO: 1417570 - RNA, 20 nt, Pseudomonas aeruginosa PA01
cgagggauguuccaggcccg

SEQ ID NO: 1417571 - RNA, 16 nt, Pseudomonas aeruginosa PA01
cgagggcaaaggcgcg

SEQ ID NO: 1417572 - RNA, 20 nt, Pseudomonas aeruginosa PA01
cgagggcagccucagcgaca

SEQ ID NO: 1417573 - RNA, 14 nt, Pseudomonas aeruginosa PA01
cgaggucggcggcg

SEQ ID NO: 1417574 - RNA, 16 nt, Pseudomonas aeruginosa PA01
cgaggucggcggcggg

SEQ ID NO: 1417575 - RNA, 15 nt, Pseudomonas aeruginosa PA01
cgaggucgucgcuga

SEQ ID NO: 1417576 - RNA, 15 nt, Pseudomonas aeruginosa PA01
cgaggucggcgaaca

SEQ ID NO: 1417577 - RNA, 15 nt, Pseudomonas aeruginosa PA01
cgaggucggccugcg

SEQ ID NO: 1417578 - RNA, 20 nt, Pseudomonas aeruginosa PA01
cgaggucgcggacgaggaug

SEQ ID NO: 1417579 - RNA, 17 nt, Pseudomonas aeruginosa PA01
cgaggugcugcaccggg

SEQ ID NO: 1417580 - RNA, 18 nt, Pseudomonas aeruginosa PA01
cgaggugcuugacagcga

SEQ ID NO: 1417581 - RNA, 14 nt, Pseudomonas aeruginosa PA01
cgaggucgccgcca

SEQ ID NO: 1417582 - RNA, 12 nt, Pseudomonas aeruginosa PA01
cgaggucgccgg

SEQ ID NO: 1417583 - RNA, 15 nt, Pseudomonas aeruginosa PA01
cgaggucgacggcgg

SEQ ID NO: 1417584 - RNA, 21 nt, Pseudomonas aeruginosa PA01
cgaggucaguucggugccgcc

SEQ ID NO: 1417585 - RNA, 17 nt, Pseudomonas aeruginosa PA01
cgagguccggcuccggc

SEQ ID NO: 1417586 - RNA, 21 nt, Pseudomonas aeruginosa PA01
cgagguccggcuccggcugcg

SEQ ID NO: 1417587 - RNA, 23 nt, Pseudomonas aeruginosa PA01
cgagguagaacaggcugccgcag

SEQ ID NO: 1417588 - RNA, 15 nt, Pseudomonas aeruginosa PA01
cgagguacaacggca

SEQ ID NO: 1417589 - RNA, 22 nt, Pseudomonas aeruginosa PA01
cgagguagucccagaccacccg

SEQ ID NO: 1417590 - RNA, 20 nt, Pseudomonas aeruginosa PA01
cgagguagucggugaagcgc

SEQ ID NO: 1417591 - RNA, 17 nt, Pseudomonas aeruginosa PA01
cgagggugaacuggccg

SEQ ID NO: 1417592 - RNA, 18 nt, Pseudomonas aeruginosa PA01
cgaggguugggcagcguc

SEQ ID NO: 1417593 - RNA, 15 nt, Pseudomonas aeruginosa PA01
cgaggguggucagcc

SEQ ID NO: 1417594 - RNA, 22 nt, Pseudomonas aeruginosa PA01
cgaggguggucagccagccgag

SEQ ID NO: 1417595 - RNA, 22 nt, Pseudomonas aeruginosa PA01
cgagggcauuuccugggugccg

SEQ ID NO: 1417596 - RNA, 19 nt, Pseudomonas aeruginosa PA01
cgagggugaucagccgagg

SEQ ID NO: 1417597 - RNA, 12 nt, Pseudomonas aeruginosa PA01
cgagggugcaga

SEQ ID NO: 1417598 - RNA, 17 nt, Pseudomonas aeruginosa PA01
cgagugcgcccagcagc

SEQ ID NO: 1417599 - RNA, 18 nt, Pseudomonas aeruginosa PA01
cgagugcgcccagcagca

SEQ ID NO: 1417600 - RNA, 22 nt, Pseudomonas aeruginosa PA01
cgagugcgcccagcagcaggcc

SEQ ID NO: 1417601 - RNA, 20 nt, Pseudomonas aeruginosa PA01
cgagugcugaacaucagguu

SEQ ID NO: 1417602 - RNA, 14 nt, Pseudomonas aeruginosa PA01
cgagugugccggcc

SEQ ID NO: 1417603 - RNA, 20 nt, Pseudomonas aeruginosa PA01
cgagugugccggccaugcag

SEQ ID NO: 1417604 - RNA, 15 nt, Pseudomonas aeruginosa PA01
cgaguggcgcagcgc

SEQ ID NO: 1417605 - RNA, 14 nt, Pseudomonas aeruginosa PA01
cgagucgccggcga

SEQ ID NO: 1417606 - RNA, 17 nt, Pseudomonas aeruginosa PA01
cgagucgaucaggucgc

SEQ ID NO: 1417607 - RNA, 20 nt, Pseudomonas aeruginosa PA01
cgagucgaucaggucgccgc

SEQ ID NO: 1417608 - RNA, 22 nt, Pseudomonas aeruginosa PA01
cgagucgaucaggucgccgccg

SEQ ID NO: 1417609 - RNA, 23 nt, Pseudomonas aeruginosa PA01
cgagucgaucaggucgccgccgc

SEQ ID NO: 1417610 - RNA, 22 nt, Pseudomonas aeruginosa PA01
cgagucccguccgcugcgccau

SEQ ID NO: 1417611 - RNA, 18 nt, Pseudomonas aeruginosa PA01
cgagucccuugcggcaga

SEQ ID NO: 1417612 - RNA, 18 nt, Pseudomonas aeruginosa PA01
cgaguccgcgcgcgcgcu

SEQ ID NO: 1417613 - RNA, 19 nt, Pseudomonas aeruginosa PA01
cgaguccgcgcgcgcgcuc

SEQ ID NO: 1417614 - RNA, 17 nt, Pseudomonas aeruginosa PA01
cgagucaccccgaccag

SEQ ID NO: 1417615 - RNA, 18 nt, Pseudomonas aeruginosa PA01
cgagucaccccgaccagc

SEQ ID NO: 1417616 - RNA, 23 nt, Pseudomonas aeruginosa PA01
cgaguaguagcguuccuggcgcg

SEQ ID NO: 1417617 - RNA, 23 nt, Pseudomonas aeruginosa PA01
cgaguaguaggucgguucgccca

SEQ ID NO: 1417618 - RNA, 17 nt, Pseudomonas aeruginosa PA01
cgaguagucgcggggcg

SEQ ID NO: 1417619 - RNA, 18 nt, Pseudomonas aeruginosa PA01
cgaguaggcgaagcccag

SEQ ID NO: 1417620 - RNA, 13 nt, Pseudomonas aeruginosa PA01
cgaguaccgcugc

SEQ ID NO: 1417621 - RNA, 17 nt, Pseudomonas aeruginosa PA01
cgaguaccgcugcggcc

SEQ ID NO: 1417622 - RNA, 22 nt, Pseudomonas aeruginosa PA01
cgagguucuuccacuugcgccg

SEQ ID NO: 1417623 - RNA, 14 nt, Pseudomonas aeruginosa PA01
cgaggugucgccgc

SEQ ID NO: 1417624 - RNA, 16 nt, Pseudomonas aeruginosa PA01
cgagguggagaucagc

SEQ ID NO: 1417625 - RNA, 20 nt, Pseudomonas aeruginosa PA01
cgaguaccaccgugcccgcc

SEQ ID NO: 1417626 - RNA, 17 nt, Pseudomonas aeruginosa PA01
cgaguaagugccgacca

SEQ ID NO: 1417627 - RNA, 17 nt, Pseudomonas aeruginosa PA01
cgaguaagcgcggugcg

SEQ ID NO: 1417628 - RNA, 21 nt, Pseudomonas aeruginosa PA01
cgaguaagcgcggugcgguug

SEQ ID NO: 1417629 - RNA, 13 nt, Pseudomonas aeruginosa PA01
cgaguaaccaccg

SEQ ID NO: 1417630 - RNA, 16 nt, Pseudomonas aeruginosa PA01
cgagguugcccacggc

SEQ ID NO: 1417631 - RNA, 19 nt, Pseudomonas aeruginosa PA01
cgagguugcccacggccag

SEQ ID NO: 1417632 - RNA, 23 nt, Pseudomonas aeruginosa PA01
cgagguugcccacggccaggccc

SEQ ID NO: 1417633 - RNA, 21 nt, Pseudomonas aeruginosa PA01
cgagguugcucugggcauggc

SEQ ID NO: 1417634 - RNA, 18 nt, Pseudomonas aeruginosa PA01
cgagguuguagcccuggg

SEQ ID NO: 1417635 - RNA, 14 nt, Pseudomonas aeruginosa PA01
cgagguugcgcagg

SEQ ID NO: 1417636 - RNA, 21 nt, Pseudomonas aeruginosa PA01
cgauuucagcuucaucgcgcc

SEQ ID NO: 1417637 - RNA, 15 nt, Pseudomonas aeruginosa PA01
cgauuucgcugcgca

SEQ ID NO: 1417638 - RNA, 18 nt, Pseudomonas aeruginosa PA01
cgcaaaggucggcgaagg

SEQ ID NO: 1417639 - RNA, 21 nt, Pseudomonas aeruginosa PA01
cgcaacgaaaaagggcggcca

SEQ ID NO: 1417640 - RNA, 20 nt, Pseudomonas aeruginosa PA01
cgcaacaggcgcaugccauc

SEQ ID NO: 1417641 - RNA, 12 nt, Pseudomonas aeruginosa PA01
cgcaacggcagc

SEQ ID NO: 1417642 - RNA, 13 nt, Pseudomonas aeruginosa PA01
cgcaacggcagcg

SEQ ID NO: 1417643 - RNA, 17 nt, Pseudomonas aeruginosa PA01
cgcaacgcuuccagcac

SEQ ID NO: 1417644 - RNA, 21 nt, Pseudomonas aeruginosa PA01
cgauguuguugcccaccagcg

SEQ ID NO: 1417645 - RNA, 20 nt, Pseudomonas aeruginosa PA01
cgauguuggcgucgaacagc

SEQ ID NO: 1417646 - RNA, 21 nt, Pseudomonas aeruginosa PA01
cgauguugaacagcgccggaa

SEQ ID NO: 1417647 - RNA, 19 nt, Pseudomonas aeruginosa PA01
cgauguugacgauggcgcc

SEQ ID NO: 1417648 - RNA, 14 nt, Pseudomonas aeruginosa PA01
cgauguugcgcagg

SEQ ID NO: 1417649 - RNA, 18 nt, Pseudomonas aeruginosa PA01
cgauugaccucccgcgcc

SEQ ID NO: 1417650 - RNA, 21 nt, Pseudomonas aeruginosa PA01
cgauuuccccaaggcacgccc

SEQ ID NO: 1417651 - RNA, 20 nt, Pseudomonas aeruginosa PA01
cgauggagauguagucgacg

SEQ ID NO: 1417652 - RNA, 22 nt, Pseudomonas aeruginosa PA01
cgauggauaugaaccgucggca

SEQ ID NO: 1417653 - RNA, 18 nt, Pseudomonas aeruginosa PA01
cgauggcagccuuggcca

SEQ ID NO: 1417654 - RNA, 22 nt, Pseudomonas aeruginosa PA01
cgauggcgaacaugaagccgcg

SEQ ID NO: 1417655 - RNA, 20 nt, Pseudomonas aeruginosa PA01
cgauggcggcauugagcgcc

SEQ ID NO: 1417656 - RNA, 23 nt, Pseudomonas aeruginosa PA01
cgauggcggcauugagggcgagg

SEQ ID NO: 1417657 - RNA, 17 nt, Pseudomonas aeruginosa PA01
cgauggcgcaccacugc

SEQ ID NO: 1417658 - RNA, 13 nt, Pseudomonas aeruginosa PA01
cgauggcgccgcc

SEQ ID NO: 1417659 - RNA, 15 nt, Pseudomonas aeruginosa PA01
cgauggcgccgccga

SEQ ID NO: 1417660 - RNA, 14 nt, Pseudomonas aeruginosa PA01
cgauggcgccgcga

SEQ ID NO: 1417661 - RNA, 17 nt, Pseudomonas aeruginosa PA01
cgauggcgauauggccg

SEQ ID NO: 1417662 - RNA, 15 nt, Pseudomonas aeruginosa PA01
cgaugcggcccgccg

SEQ ID NO: 1417663 - RNA, 19 nt, Pseudomonas aeruginosa PA01
cgaugcggcccgccggcga

SEQ ID NO: 1417664 - RNA, 18 nt, Pseudomonas aeruginosa PA01
cgaugcgguagucgcugc

SEQ ID NO: 1417665 - RNA, 17 nt, Pseudomonas aeruginosa PA01
cgauggaaaucggccac

SEQ ID NO: 1417666 - RNA, 15 nt, Pseudomonas aeruginosa PA01
cgauggaacgaagaa

SEQ ID NO: 1417667 - RNA, 14 nt, Pseudomonas aeruginosa PA01
cgauggacaucccg

SEQ ID NO: 1417668 - RNA, 19 nt, Pseudomonas aeruginosa PA01
cgaugggugccgcgcaggu

SEQ ID NO: 1417669 - RNA, 20 nt, Pseudomonas aeruginosa PA01
cgaugggugccgcgcagguu

SEQ ID NO: 1417670 - RNA, 21 nt, Pseudomonas aeruginosa PA01
cgaugguaguccgcugcgagc

SEQ ID NO: 1417671 - RNA, 17 nt, Pseudomonas aeruginosa PA01
cgaugguggucggcagc

SEQ ID NO: 1417672 - RNA, 16 nt, Pseudomonas aeruginosa PA01
cgauggcugucggcgc

SEQ ID NO: 1417673 - RNA, 16 nt, Pseudomonas aeruginosa PA01
cgaugggccguaggug

SEQ ID NO: 1417674 - RNA, 13 nt, Pseudomonas aeruginosa PA01
cgauggcucgcgg

SEQ ID NO: 1417675 - RNA, 14 nt, Pseudomonas aeruginosa PA01
cgauggcucgcggc

SEQ ID NO: 1417676 - RNA, 16 nt, Pseudomonas aeruginosa PA01
cgauggcucgcggcgc

SEQ ID NO: 1417677 - RNA, 20 nt, Pseudomonas aeruginosa PA01
cgaugggcacgaucugcgcc

SEQ ID NO: 1417678 - RNA, 21 nt, Pseudomonas aeruginosa PA01
cgauguauccguacuggcgcc

SEQ ID NO: 1417679 - RNA, 20 nt, Pseudomonas aeruginosa PA01
cgauguaggccucggccugg

SEQ ID NO: 1417680 - RNA, 22 nt, Pseudomonas aeruginosa PA01
cgaugugcuugagucgcaggcu

SEQ ID NO: 1417681 - RNA, 17 nt, Pseudomonas aeruginosa PA01
cgaugcgacgcacaccg

SEQ ID NO: 1417682 - RNA, 15 nt, Pseudomonas aeruginosa PA01
cgaugccuugcggcc

SEQ ID NO: 1417683 - RNA, 17 nt, Pseudomonas aeruginosa PA01
cgaugccuucggcggcc

SEQ ID NO: 1417684 - RNA, 18 nt, Pseudomonas aeruginosa PA01
cgaugccuucggcggccg

SEQ ID NO: 1417685 - RNA, 20 nt, Pseudomonas aeruginosa PA01
cgaugccuucggcggccggg

SEQ ID NO: 1417686 - RNA, 17 nt, Pseudomonas aeruginosa PA01
cgaugccguucucggug

SEQ ID NO: 1417687 - RNA, 13 nt, Pseudomonas aeruginosa PA01
cgaugcgcagcuu

SEQ ID NO: 1417688 - RNA, 22 nt, Pseudomonas aeruginosa PA01
cgaugcgcagcuugcucgaugc

SEQ ID NO: 1417689 - RNA, 15 nt, Pseudomonas aeruginosa PA01
cgaugcgccgacgcc

SEQ ID NO: 1417690 - RNA, 19 nt, Pseudomonas aeruginosa PA01
cgaugcgccgacgccacca

SEQ ID NO: 1417691 - RNA, 20 nt, Pseudomonas aeruginosa PA01
cgaugcgccccagcgccugg

SEQ ID NO: 1417692 - RNA, 21 nt, Pseudomonas aeruginosa PA01
cgaugcgccccagcgccuggg

SEQ ID NO: 1417693 - RNA, 16 nt, Pseudomonas aeruginosa PA01
cgaugcgcgcggcgag

SEQ ID NO: 1417694 - RNA, 13 nt, Pseudomonas aeruginosa PA01
cgaugcgcgacuc

SEQ ID NO: 1417695 - RNA, 19 nt, Pseudomonas aeruginosa PA01
cgaugcgcgacucgaagcu

SEQ ID NO: 1417696 - RNA, 12 nt, Pseudomonas aeruginosa PA01
cgaugcgcccgc

SEQ ID NO: 1417697 - RNA, 19 nt, Pseudomonas aeruginosa PA01
cgaugcgcccgccgcgagc

SEQ ID NO: 1417698 - RNA, 17 nt, Pseudomonas aeruginosa PA01
cgaugcgccucagcggc

SEQ ID NO: 1417699 - RNA, 18 nt, Pseudomonas aeruginosa PA01
cgaugcgccucagcggcc

SEQ ID NO: 1417700 - RNA, 21 nt, Pseudomonas aeruginosa PA01
cgaugcgcgugguaucggcgc

SEQ ID NO: 1417701 - RNA, 22 nt, Pseudomonas aeruginosa PA01
cgaugccggagagcagcacggc

SEQ ID NO: 1417702 - RNA, 12 nt, Pseudomonas aeruginosa PA01
cgaugccgcgcc

SEQ ID NO: 1417703 - RNA, 15 nt, Pseudomonas aeruginosa PA01
cgaugccgcgccagg

SEQ ID NO: 1417704 - RNA, 19 nt, Pseudomonas aeruginosa PA01
cgaugccgcgccaggcgca

SEQ ID NO: 1417705 - RNA, 16 nt, Pseudomonas aeruginosa PA01
cgaugccgcgccggaa

SEQ ID NO: 1417706 - RNA, 18 nt, Pseudomonas aeruginosa PA01
cgaugccgcgcgccuggc

SEQ ID NO: 1417707 - RNA, 19 nt, Pseudomonas aeruginosa PA01
cgaugccgcgcgccuggcu

SEQ ID NO: 1417708 - RNA, 21 nt, Pseudomonas aeruginosa PA01
cgaugccgcgcgccuggcugg

SEQ ID NO: 1417709 - RNA, 15 nt, Pseudomonas aeruginosa PA01
cgaugccgccgggca

SEQ ID NO: 1417710 - RNA, 20 nt, Pseudomonas aeruginosa PA01
cgaugccgccgaccucggcc

SEQ ID NO: 1417711 - RNA, 15 nt, Pseudomonas aeruginosa PA01
cgaugccgccgccgc

SEQ ID NO: 1417712 - RNA, 13 nt, Pseudomonas aeruginosa PA01
cgaugccgccgac

SEQ ID NO: 1417713 - RNA, 17 nt, Pseudomonas aeruginosa PA01
cgaugccgcccagcacc

SEQ ID NO: 1417714 - RNA, 19 nt, Pseudomonas aeruginosa PA01
cgaugccgcccagcaccga

SEQ ID NO: 1417715 - RNA, 15 nt, Pseudomonas aeruginosa PA01
cgaugccgaugccgc

SEQ ID NO: 1417716 - RNA, 16 nt, Pseudomonas aeruginosa PA01
cgaugccgaugccgcc

SEQ ID NO: 1417717 - RNA, 16 nt, Pseudomonas aeruginosa PA01
cgaugccgauggcgcc

SEQ ID NO: 1417718 - RNA, 20 nt, Pseudomonas aeruginosa PA01
cgaugccgauggcgccgccg

SEQ ID NO: 1417719 - RNA, 22 nt, Pseudomonas aeruginosa PA01
cgaugcccuuggccagcgcggc

SEQ ID NO: 1417720 - RNA, 23 nt, Pseudomonas aeruginosa PA01
cgaugcccuuggccagcgcggcg

SEQ ID NO: 1417721 - RNA, 21 nt, Pseudomonas aeruginosa PA01
cgaugcccaccugaacgcgcc

SEQ ID NO: 1417722 - RNA, 20 nt, Pseudomonas aeruginosa PA01
cgaugcccaauacccacagg

SEQ ID NO: 1417723 - RNA, 21 nt, Pseudomonas aeruginosa PA01
cgaucugcucguccaggccgc

SEQ ID NO: 1417724 - RNA, 23 nt, Pseudomonas aeruginosa PA01
cgaucuggcagucgucgcagccg

SEQ ID NO: 1417725 - RNA, 16 nt, Pseudomonas aeruginosa PA01
cgaucugcuugcgcgc

SEQ ID NO: 1417726 - RNA, 18 nt, Pseudomonas aeruginosa PA01
cgaucugcuugcgcgccg

SEQ ID NO: 1417727 - RNA, 19 nt, Pseudomonas aeruginosa PA01
cgaucugcuugcgcgccgc

SEQ ID NO: 1417728 - RNA, 21 nt, Pseudomonas aeruginosa PA01
cgaucugcuugcgcgccgccg

SEQ ID NO: 1417729 - RNA, 22 nt, Pseudomonas aeruginosa PA01
cgaucugcuugcgcgccgccgc

SEQ ID NO: 1417730 - RNA, 23 nt, Pseudomonas aeruginosa PA01
cgaucugcuugcgcgccgccgcc

SEQ ID NO: 1417731 - RNA, 14 nt, Pseudomonas aeruginosa PA01
cgaucucgccgaag

SEQ ID NO: 1417732 - RNA, 24 nt, Pseudomonas aeruginosa PA01
cgaucugcagguuggcgugcauca

SEQ ID NO: 1417733 - RNA, 21 nt, Pseudomonas aeruginosa PA01
cgaugaccaggguggcggcgg

SEQ ID NO: 1417734 - RNA, 23 nt, Pseudomonas aeruginosa PA01
cgaugaccaggguggcggcggcg

SEQ ID NO: 1417735 - RNA, 14 nt, Pseudomonas aeruginosa PA01
cgaucuucuccgcc

SEQ ID NO: 1417736 - RNA, 14 nt, Pseudomonas aeruginosa PA01
cgaugaccgccccg

SEQ ID NO: 1417737 - RNA, 18 nt, Pseudomonas aeruginosa PA01
cgaugaccgccccggcag

SEQ ID NO: 1417738 - RNA, 17 nt, Pseudomonas aeruginosa PA01
cgaucgacgccucggcg

SEQ ID NO: 1417739 - RNA, 20 nt, Pseudomonas aeruginosa PA01
cgaucgacgccucggcgcga

SEQ ID NO: 1417740 - RNA, 13 nt, Pseudomonas aeruginosa PA01
cgaucgagcggcc

SEQ ID NO: 1417741 - RNA, 18 nt, Pseudomonas aeruginosa PA01
cgaucgagcggcccgcgg

SEQ ID NO: 1417742 - RNA, 14 nt, Pseudomonas aeruginosa PA01
cgaucgaccugccg

SEQ ID NO: 1417743 - RNA, 22 nt, Pseudomonas aeruginosa PA01
cgaucgagcuguccaucucgcc

SEQ ID NO: 1417744 - RNA, 15 nt, Pseudomonas aeruginosa PA01
cgaucgagucgccga

SEQ ID NO: 1417745 - RNA, 23 nt, Pseudomonas aeruginosa PA01
cgaucuaccugcgugcgccguag

SEQ ID NO: 1417746 - RNA, 17 nt, Pseudomonas aeruginosa PA01
cgaucguugccagccgg

SEQ ID NO: 1417747 - RNA, 18 nt, Pseudomonas aeruginosa PA01
cgaucguugccagccggc

SEQ ID NO: 1417748 - RNA, 22 nt, Pseudomonas aeruginosa PA01
cgaucguugccagccggccuug

SEQ ID NO: 1417749 - RNA, 16 nt, Pseudomonas aeruginosa PA01
cgaucuccgcuuccgc

SEQ ID NO: 1417750 - RNA, 14 nt, Pseudomonas aeruginosa PA01
cgaucuccuccgcc

SEQ ID NO: 1417751 - RNA, 22 nt, Pseudomonas aeruginosa PA01
cgaucuccuccucggcggcuuc

SEQ ID NO: 1417752 - RNA, 12 nt, Pseudomonas aeruginosa PA01
cgaucuccucgc

SEQ ID NO: 1417753 - RNA, 13 nt, Pseudomonas aeruginosa PA01
cgaucuccuggcg

SEQ ID NO: 1417754 - RNA, 14 nt, Pseudomonas aeruginosa PA01
cgaucucgaucgag

SEQ ID NO: 1417755 - RNA, 15 nt, Pseudomonas aeruginosa PA01
cgaucucgaucgagu

SEQ ID NO: 1417756 - RNA, 15 nt, Pseudomonas aeruginosa PA01
cgacgacugcggcag

SEQ ID NO: 1417757 - RNA, 22 nt, Pseudomonas aeruginosa PA01
cgacgagauugaugaagcgcug

SEQ ID NO: 1417758 - RNA, 15 nt, Pseudomonas aeruginosa PA01
cgacgagcagcucgc

SEQ ID NO: 1417759 - RNA, 17 nt, Pseudomonas aeruginosa PA01
cgacgagcagcucgccg

SEQ ID NO: 1417760 - RNA, 19 nt, Pseudomonas aeruginosa PA01
cgacgagcagcucgccggc

SEQ ID NO: 1417761 - RNA, 15 nt, Pseudomonas aeruginosa PA01
cgacgauauccacgc

SEQ ID NO: 1417762 - RNA, 23 nt, Pseudomonas aeruginosa PA01
cgacgauauccacgccgucgcac

SEQ ID NO: 1417763 - RNA, 14 nt, Pseudomonas aeruginosa PA01
cgacgaucagcccg

SEQ ID NO: 1417764 - RNA, 21 nt, Pseudomonas aeruginosa PA01
cgacgaucagcccgccggcga

SEQ ID NO: 1417765 - RNA, 22 nt, Pseudomonas aeruginosa PA01
cgacgaucacccccagcgagcc

SEQ ID NO: 1417766 - RNA, 13 nt, Pseudomonas aeruginosa PA01
cgacgaagcccag

SEQ ID NO: 1417767 - RNA, 15 nt, Pseudomonas aeruginosa PA01
cgacgaagcccucgc

SEQ ID NO: 1417768 - RNA, 19 nt, Pseudomonas aeruginosa PA01
cgacgaagcccucgcgacg

SEQ ID NO: 1417769 - RNA, 21 nt, Pseudomonas aeruginosa PA01
cgacgaagcccucgcgacggc

SEQ ID NO: 1417770 - RNA, 22 nt, Pseudomonas aeruginosa PA01
cgacgaagcccucgcgacggca

SEQ ID NO: 1417771 - RNA, 18 nt, Pseudomonas aeruginosa PA01
cgacgaagcgccggcggc

SEQ ID NO: 1417772 - RNA, 19 nt, Pseudomonas aeruginosa PA01
cgacgaagcgccggcggcc

SEQ ID NO: 1417773 - RNA, 15 nt, Pseudomonas aeruginosa PA01
cgacgaaggccgcgg

SEQ ID NO: 1417774 - RNA, 19 nt, Pseudomonas aeruginosa PA01
cgacgaaggccgcggucgg

SEQ ID NO: 1417775 - RNA, 13 nt, Pseudomonas aeruginosa PA01
cgacgaaggucgg

SEQ ID NO: 1417776 - RNA, 14 nt, Pseudomonas aeruginosa PA01
cgacgaaggucggc

SEQ ID NO: 1417777 - RNA, 23 nt, Pseudomonas aeruginosa PA01
cgacgacaccugcaacgcccgcg

SEQ ID NO: 1417778 - RNA, 20 nt, Pseudomonas aeruginosa PA01
cgacgacuugcccaccccgg

SEQ ID NO: 1417779 - RNA, 20 nt, Pseudomonas aeruginosa PA01
cgacgagaaaaagcccggca

SEQ ID NO: 1417780 - RNA, 23 nt, Pseudomonas aeruginosa PA01
cgacgaaauagucgcgggccugg

SEQ ID NO: 1417781 - RNA, 15 nt, Pseudomonas aeruginosa PA01
cgacgaaaggccgcg

SEQ ID NO: 1417782 - RNA, 17 nt, Pseudomonas aeruginosa PA01
cgacgaaaggccgcgcc

SEQ ID NO: 1417783 - RNA, 20 nt, Pseudomonas aeruginosa PA01
cgacgaaacggcucugcuuc

SEQ ID NO: 1417784 - RNA, 16 nt, Pseudomonas aeruginosa PA01
cgaccuugucgauggu

SEQ ID NO: 1417785 - RNA, 17 nt, Pseudomonas aeruginosa PA01
cgaccuuguccaggcgc

SEQ ID NO: 1417786 - RNA, 20 nt, Pseudomonas aeruginosa PA01
cgaccuuguccaggcgcugc

SEQ ID NO: 1417787 - RNA, 17 nt, Pseudomonas aeruginosa PA01
cgaccuuguccugcggc

SEQ ID NO: 1417788 - RNA, 19 nt, Pseudomonas aeruginosa PA01
cgaccuuguccugcggccg

SEQ ID NO: 1417789 - RNA, 18 nt, Pseudomonas aeruginosa PA01
cgaccuugcccucggcgc

SEQ ID NO: 1417790 - RNA, 20 nt, Pseudomonas aeruginosa PA01
cgaccuugcccucggcgccc

SEQ ID NO: 1417791 - RNA, 14 nt, Pseudomonas aeruginosa PA01
cgaccuugcccuug

SEQ ID NO: 1417792 - RNA, 15 nt, Pseudomonas aeruginosa PA01
cgaccuugccgacgc

SEQ ID NO: 1417793 - RNA, 21 nt, Pseudomonas aeruginosa PA01
cgaccugguggcgccggcuga

SEQ ID NO: 1417794 - RNA, 23 nt, Pseudomonas aeruginosa PA01
cgaccugguggcgccggcugacg

SEQ ID NO: 1417795 - RNA, 23 nt, Pseudomonas aeruginosa PA01
cgaccugguagcagagggucgcc

SEQ ID NO: 1417796 - RNA, 17 nt, Pseudomonas aeruginosa PA01
cgaccggguccugcaga

SEQ ID NO: 1417797 - RNA, 20 nt, Pseudomonas aeruginosa PA01
cgaccuguucgaaguucucc

SEQ ID NO: 1417798 - RNA, 19 nt, Pseudomonas aeruginosa PA01
cgaccuguugaaaaccggu

SEQ ID NO: 1417799 - RNA, 17 nt, Pseudomonas aeruginosa PA01
cgaccuucuccgaccag

SEQ ID NO: 1417800 - RNA, 18 nt, Pseudomonas aeruginosa PA01
cgaccuucuccgaccagg

SEQ ID NO: 1417801 - RNA, 15 nt, Pseudomonas aeruginosa PA01
cgaccuucaucaggc

SEQ ID NO: 1417802 - RNA, 19 nt, Pseudomonas aeruginosa PA01
cgaccuucaucaggcggca

SEQ ID NO: 1417803 - RNA, 18 nt, Pseudomonas aeruginosa PA01
cgaccuucaccaccagcg

SEQ ID NO: 1417804 - RNA, 13 nt, Pseudomonas aeruginosa PA01
cgaccuggcgccg

SEQ ID NO: 1417805 - RNA, 18 nt, Pseudomonas aeruginosa PA01
cgaccuggguaccgacgg

SEQ ID NO: 1417806 - RNA, 15 nt, Pseudomonas aeruginosa PA01
cgaccuggccacgcc

SEQ ID NO: 1417807 - RNA, 16 nt, Pseudomonas aeruginosa PA01
cgaccgugaggcgcag

SEQ ID NO: 1417808 - RNA, 12 nt, Pseudomonas aeruginosa PA01
cgaccgucggcc

SEQ ID NO: 1417809 - RNA, 15 nt, Pseudomonas aeruginosa PA01
cgaccgucggccggg

SEQ ID NO: 1417810 - RNA, 16 nt, Pseudomonas aeruginosa PA01
cgaccguccgccugcg

SEQ ID NO: 1417811 - RNA, 16 nt, Pseudomonas aeruginosa PA01
cgaccgucgccacgcu

SEQ ID NO: 1417812 - RNA, 13 nt, Pseudomonas aeruginosa PA01
cgacgccucggcg

SEQ ID NO: 1417813 - RNA, 14 nt, Pseudomonas aeruginosa PA01
cgacgccucggcgc

SEQ ID NO: 1417814 - RNA, 13 nt, Pseudomonas aeruginosa PA01
cgacgccgcgcug

SEQ ID NO: 1417815 - RNA, 14 nt, Pseudomonas aeruginosa PA01
cgacgccgcgcugc

SEQ ID NO: 1417816 - RNA, 19 nt, Pseudomonas aeruginosa PA01
cgacgcgaccuccggcgcc

SEQ ID NO: 1417817 - RNA, 20 nt, Pseudomonas aeruginosa PA01
cgacgcgaccuccggcgcca

SEQ ID NO: 1417818 - RNA, 13 nt, Pseudomonas aeruginosa PA01
cgacgcgcaggcc

SEQ ID NO: 1417819 - RNA, 14 nt, Pseudomonas aeruginosa PA01
cgacgcgcaggccg

SEQ ID NO: 1417820 - RNA, 15 nt, Pseudomonas aeruginosa PA01
cgacgcgcaggccgg

SEQ ID NO: 1417821 - RNA, 16 nt, Pseudomonas aeruginosa PA01
cgacgcuacguuccag

SEQ ID NO: 1417822 - RNA, 20 nt, Pseudomonas aeruginosa PA01
cgacgcuacguuccagggcc

SEQ ID NO: 1417823 - RNA, 23 nt, Pseudomonas aeruginosa PA01
cgacgcuacguuccagggccugg

SEQ ID NO: 1417824 - RNA, 14 nt, Pseudomonas aeruginosa PA01
cgacgcucgcggca

SEQ ID NO: 1417825 - RNA, 17 nt, Pseudomonas aeruginosa PA01
cgacgcucgcggcaucc

SEQ ID NO: 1417826 - RNA, 14 nt, Pseudomonas aeruginosa PA01
cgacgcucagcacc

SEQ ID NO: 1417827 - RNA, 16 nt, Pseudomonas aeruginosa PA01
cgacgcucagcacccu

SEQ ID NO: 1417828 - RNA, 23 nt, Pseudomonas aeruginosa PA01
cgacgaucugucgauaccagcgc

SEQ ID NO: 1417829 - RNA, 15 nt, Pseudomonas aeruginosa PA01
cgacgaucucaucgc

SEQ ID NO: 1417830 - RNA, 16 nt, Pseudomonas aeruginosa PA01
cgacgaucucaucgcc

SEQ ID NO: 1417831 - RNA, 14 nt, Pseudomonas aeruginosa PA01
cgacgaugccgccg

SEQ ID NO: 1417832 - RNA, 21 nt, Pseudomonas aeruginosa PA01
cgacgaugggcacgaucugcg

SEQ ID NO: 1417833 - RNA, 23 nt, Pseudomonas aeruginosa PA01
cgacgaugcucgguugccaggcc

SEQ ID NO: 1417834 - RNA, 15 nt, Pseudomonas aeruginosa PA01
cgacgccagcggcga

SEQ ID NO: 1417835 - RNA, 22 nt, Pseudomonas aeruginosa PA01
cgacgccagcggcgaucgccug

SEQ ID NO: 1417836 - RNA, 11 nt, Pseudomonas aeruginosa PA01
cgacgccagcu

SEQ ID NO: 1417837 - RNA, 18 nt, Pseudomonas aeruginosa PA01
cgacgccagcucggccgg

SEQ ID NO: 1417838 - RNA, 22 nt, Pseudomonas aeruginosa PA01
cgacgccagcucggccggcagg

SEQ ID NO: 1417839 - RNA, 14 nt, Pseudomonas aeruginosa PA01
cgacgccauggcgc

SEQ ID NO: 1417840 - RNA, 16 nt, Pseudomonas aeruginosa PA01
cgacgccauggcgcuu

SEQ ID NO: 1417841 - RNA, 17 nt, Pseudomonas aeruginosa PA01
cgacgccgaaggacagg

SEQ ID NO: 1417842 - RNA, 20 nt, Pseudomonas aeruginosa PA01
cgacgccgaaggacaggccg

SEQ ID NO: 1417843 - RNA, 17 nt, Pseudomonas aeruginosa PA01
cgacgccgagcagcacc

SEQ ID NO: 1417844 - RNA, 19 nt, Pseudomonas aeruginosa PA01
cgacgccgagcugaccacc

SEQ ID NO: 1417845 - RNA, 22 nt, Pseudomonas aeruginosa PA01
cgacgccgagcugaccaccagg

SEQ ID NO: 1417846 - RNA, 13 nt, Pseudomonas aeruginosa PA01
cgacgccgcccgg

SEQ ID NO: 1417847 - RNA, 17 nt, Pseudomonas aeruginosa PA01
cgacgccgcccggcacc

SEQ ID NO: 1417848 - RNA, 11 nt, Pseudomonas aeruginosa PA01
cgacgccgccg

SEQ ID NO: 1417849 - RNA, 14 nt, Pseudomonas aeruginosa PA01
cgacgccgccgagc

SEQ ID NO: 1417850 - RNA, 15 nt, Pseudomonas aeruginosa PA01
cgacgccgccgagca

SEQ ID NO: 1417851 - RNA, 18 nt, Pseudomonas aeruginosa PA01
cgacgccgccugcgccuc

SEQ ID NO: 1417852 - RNA, 17 nt, Pseudomonas aeruginosa PA01
cgaccgcgccggcgaua

SEQ ID NO: 1417853 - RNA, 14 nt, Pseudomonas aeruginosa PA01
cgaccgccugcucg

SEQ ID NO: 1417854 - RNA, 18 nt, Pseudomonas aeruginosa PA01
cgaccgccugcucgcggc

SEQ ID NO: 1417855 - RNA, 13 nt, Pseudomonas aeruginosa PA01
cgaccgcggcgcu

SEQ ID NO: 1417856 - RNA, 23 nt, Pseudomonas aeruginosa PA01
cgaccgcgcgcauggucgcgcug

SEQ ID NO: 1417857 - RNA, 21 nt, Pseudomonas aeruginosa PA01
cgaccgcgcgccugcaacgcc

SEQ ID NO: 1417858 - RNA, 16 nt, Pseudomonas aeruginosa PA01
cgaccgcgaguucgcc

SEQ ID NO: 1417859 - RNA, 23 nt, Pseudomonas aeruginosa PA01
cgaccgcgaguucgccggccagg

SEQ ID NO: 1417860 - RNA, 20 nt, Pseudomonas aeruginosa PA01
cgaccgcccgccucaggccg

SEQ ID NO: 1417861 - RNA, 22 nt, Pseudomonas aeruginosa PA01
cgaccgcccgccucaggccggg

SEQ ID NO: 1417862 - RNA, 20 nt, Pseudomonas aeruginosa PA01
cgaccgccaggccgacccgc

SEQ ID NO: 1417863 - RNA, 19 nt, Pseudomonas aeruginosa PA01
cgaccgccaggcggccgcu

SEQ ID NO: 1417864 - RNA, 16 nt, Pseudomonas aeruginosa PA01
cgaccgcaucguuggc

SEQ ID NO: 1417865 - RNA, 21 nt, Pseudomonas aeruginosa PA01
cgaccgcaucguuggcgccgu

SEQ ID NO: 1417866 - RNA, 16 nt, Pseudomonas aeruginosa PA01
cgaccgcccaggcugc

SEQ ID NO: 1417867 - RNA, 20 nt, Pseudomonas aeruginosa PA01
cgaccgcccaggcugccgcc

SEQ ID NO: 1417868 - RNA, 22 nt, Pseudomonas aeruginosa PA01
cgaccggguugaugccgaggcu

SEQ ID NO: 1417869 - RNA, 15 nt, Pseudomonas aeruginosa PA01
cgaccgggcaugccg

SEQ ID NO: 1417870 - RNA, 19 nt, Pseudomonas aeruginosa PA01
cgaccgggcgggucuggcg

SEQ ID NO: 1417871 - RNA, 21 nt, Pseudomonas aeruginosa PA01
cgaccggccuuuuucaugggu

SEQ ID NO: 1417872 - RNA, 12 nt, Pseudomonas aeruginosa PA01
cgaccggcgccg

SEQ ID NO: 1417873 - RNA, 14 nt, Pseudomonas aeruginosa PA01
cgaccggcgccggg

SEQ ID NO: 1417874 - RNA, 15 nt, Pseudomonas aeruginosa PA01
cgaccggcgccggga

SEQ ID NO: 1417875 - RNA, 15 nt, Pseudomonas aeruginosa PA01
cgaccggcgcgccuu

SEQ ID NO: 1417876 - RNA, 12 nt, Pseudomonas aeruginosa PA01
cgaccgguagcc

SEQ ID NO: 1417877 - RNA, 14 nt, Pseudomonas aeruginosa PA01
cgaccgguagccau

SEQ ID NO: 1417878 - RNA, 19 nt, Pseudomonas aeruginosa PA01
cgaccgguagccaugauca

SEQ ID NO: 1417879 - RNA, 19 nt, Pseudomonas aeruginosa PA01
cgaccgguaacuggccagg

SEQ ID NO: 1417880 - RNA, 17 nt, Pseudomonas aeruginosa PA01
cgaccgguuccagcggc

SEQ ID NO: 1417881 - RNA, 18 nt, Pseudomonas aeruginosa PA01
cgaccgguuccagcggcc

SEQ ID NO: 1417882 - RNA, 19 nt, Pseudomonas aeruginosa PA01
cgaccgguuccagcggccg

SEQ ID NO: 1417883 - RNA, 21 nt, Pseudomonas aeruginosa PA01
cgaccgguuccagcggccgcg

SEQ ID NO: 1417884 - RNA, 18 nt, Pseudomonas aeruginosa PA01
cgaccggauggcucaugg

SEQ ID NO: 1417885 - RNA, 20 nt, Pseudomonas aeruginosa PA01
cgaccggcagucccugccag

SEQ ID NO: 1417886 - RNA, 21 nt, Pseudomonas aeruginosa PA01
cgaccggcagucccugccagg

SEQ ID NO: 1417887 - RNA, 19 nt, Pseudomonas aeruginosa PA01
cgaccgcguccaugccgua

SEQ ID NO: 1417888 - RNA, 18 nt, Pseudomonas aeruginosa PA01
cgaccggaaucacgucga

SEQ ID NO: 1417889 - RNA, 23 nt, Pseudomonas aeruginosa PA01
cgacccgcuugagccauucggcu

SEQ ID NO: 1417890 - RNA, 14 nt, Pseudomonas aeruginosa PA01
cgacccgcaggccg

SEQ ID NO: 1417891 - RNA, 16 nt, Pseudomonas aeruginosa PA01
cgacccgcaggccggc

SEQ ID NO: 1417892 - RNA, 18 nt, Pseudomonas aeruginosa PA01
cgacccgcaggccggcca

SEQ ID NO: 1417893 - RNA, 20 nt, Pseudomonas aeruginosa PA01
cgacaucggagugcaugccg

SEQ ID NO: 1417894 - RNA, 19 nt, Pseudomonas aeruginosa PA01
cgacaucuccaggccgcuc

SEQ ID NO: 1417895 - RNA, 13 nt, Pseudomonas aeruginosa PA01
cgacccgggucag

SEQ ID NO: 1417896 - RNA, 19 nt, Pseudomonas aeruginosa PA01
cgacccgggucaggccgag

SEQ ID NO: 1417897 - RNA, 15 nt, Pseudomonas aeruginosa PA01
cgacccgguacagcc

SEQ ID NO: 1417898 - RNA, 17 nt, Pseudomonas aeruginosa PA01
cgacccgguuaccggcg

SEQ ID NO: 1417899 - RNA, 18 nt, Pseudomonas aeruginosa PA01
cgacccgguuaccggcga

SEQ ID NO: 1417900 - RNA, 20 nt, Pseudomonas aeruginosa PA01
cgacccgguuaccggcgacc

SEQ ID NO: 1417901 - RNA, 21 nt, Pseudomonas aeruginosa PA01
cgacccgguuaccggcgacca

SEQ ID NO: 1417902 - RNA, 12 nt, Pseudomonas aeruginosa PA01
cgacccucggcg

SEQ ID NO: 1417903 - RNA, 13 nt, Pseudomonas aeruginosa PA01
cgacccucggcga

SEQ ID NO: 1417904 - RNA, 19 nt, Pseudomonas aeruginosa PA01
cgacccugcuggccggugc

SEQ ID NO: 1417905 - RNA, 15 nt, Pseudomonas aeruginosa PA01
cgacccuggccgcgc

SEQ ID NO: 1417906 - RNA, 22 nt, Pseudomonas aeruginosa PA01
cgacccuggccgcgcggcuugc

SEQ ID NO: 1417907 - RNA, 13 nt, Pseudomonas aeruginosa PA01
cgacccuggcgcc

SEQ ID NO: 1417908 - RNA, 15 nt, Pseudomonas aeruginosa PA01
cgacccuggcgccga

SEQ ID NO: 1417909 - RNA, 19 nt, Pseudomonas aeruginosa PA01
cgacccuggcgccgaccuc

SEQ ID NO: 1417910 - RNA, 20 nt, Pseudomonas aeruginosa PA01
cgaccgacuggccguuggcg

SEQ ID NO: 1417911 - RNA, 17 nt, Pseudomonas aeruginosa PA01
cgaccgacuuggcaguc

SEQ ID NO: 1417912 - RNA, 22 nt, Pseudomonas aeruginosa PA01
cgaccgacuuggcagucgccgc

SEQ ID NO: 1417913 - RNA, 19 nt, Pseudomonas aeruginosa PA01
cgaccgagaugcucgcgca

SEQ ID NO: 1417914 - RNA, 12 nt, Pseudomonas aeruginosa PA01
cgaccgagcagc

SEQ ID NO: 1417915 - RNA, 15 nt, Pseudomonas aeruginosa PA01
cgaccgagcagcgga

SEQ ID NO: 1417916 - RNA, 13 nt, Pseudomonas aeruginosa PA01
cgaccgaagccgc

SEQ ID NO: 1417917 - RNA, 15 nt, Pseudomonas aeruginosa PA01
cgaccgaagccgcgc

SEQ ID NO: 1417918 - RNA, 21 nt, Pseudomonas aeruginosa PA01
cgacccuucaacggcgaccgc

SEQ ID NO: 1417919 - RNA, 15 nt, Pseudomonas aeruginosa PA01
cgaccgaacagcgcg

SEQ ID NO: 1417920 - RNA, 22 nt, Pseudomonas aeruginosa PA01
cgagagguugcuguagaaugcg

SEQ ID NO: 1417921 - RNA, 21 nt, Pseudomonas aeruginosa PA01
cgagcaccaccacucgcgagc

SEQ ID NO: 1417922 - RNA, 22 nt, Pseudomonas aeruginosa PA01
cgagcaccagcaggucggcgcg

SEQ ID NO: 1417923 - RNA, 22 nt, Pseudomonas aeruginosa PA01
cgagcaaugaaaaaggcgaucg

SEQ ID NO: 1417924 - RNA, 19 nt, Pseudomonas aeruginosa PA01
cgagacgcgggcccagcgg

SEQ ID NO: 1417925 - RNA, 18 nt, Pseudomonas aeruginosa PA01
cgagacgcugcaccgcgg

SEQ ID NO: 1417926 - RNA, 21 nt, Pseudomonas aeruginosa PA01
cgagacgcugcaccgcggcgc

SEQ ID NO: 1417927 - RNA, 22 nt, Pseudomonas aeruginosa PA01
cgagacgcugcaccgcggcgcg

SEQ ID NO: 1417928 - RNA, 15 nt, Pseudomonas aeruginosa PA01
cgagacgccagccgc

SEQ ID NO: 1417929 - RNA, 20 nt, Pseudomonas aeruginosa PA01
cgagacgccagccgcccugg

SEQ ID NO: 1417930 - RNA, 12 nt, Pseudomonas aeruginosa PA01
cgagacgccgag

SEQ ID NO: 1417931 - RNA, 14 nt, Pseudomonas aeruginosa PA01
cgagacgccgagga

SEQ ID NO: 1417932 - RNA, 16 nt, Pseudomonas aeruginosa PA01
cgagaccccggcggcg

SEQ ID NO: 1417933 - RNA, 23 nt, Pseudomonas aeruginosa PA01
cgagaccgacgcucgcggcaucc

SEQ ID NO: 1417934 - RNA, 14 nt, Pseudomonas aeruginosa PA01
cgagaccggggauc

SEQ ID NO: 1417935 - RNA, 22 nt, Pseudomonas aeruginosa PA01
cgagaccaucuggaucaggaag

SEQ ID NO: 1417936 - RNA, 18 nt, Pseudomonas aeruginosa PA01
cgagcaccccgagcccgg

SEQ ID NO: 1417937 - RNA, 22 nt, Pseudomonas aeruginosa PA01
cgagcaccccgagcccggccgg

SEQ ID NO: 1417938 - RNA, 13 nt, Pseudomonas aeruginosa PA01
cgagcaccaugcc

SEQ ID NO: 1417939 - RNA, 18 nt, Pseudomonas aeruginosa PA01
cgagcaccaugccgauga

SEQ ID NO: 1417940 - RNA, 18 nt, Pseudomonas aeruginosa PA01
cgagcaccccgaccaccc

SEQ ID NO: 1417941 - RNA, 12 nt, Pseudomonas aeruginosa PA01
cgagcaccgcgc

SEQ ID NO: 1417942 - RNA, 18 nt, Pseudomonas aeruginosa PA01
cgagcaccgcgcagacca

SEQ ID NO: 1417943 - RNA, 13 nt, Pseudomonas aeruginosa PA01
cgagcagggcgau

SEQ ID NO: 1417944 - RNA, 21 nt, Pseudomonas aeruginosa PA01
cgagcagggcgaugccgaugg

SEQ ID NO: 1417945 - RNA, 14 nt, Pseudomonas aeruginosa PA01
cgagcagcgccgcg

SEQ ID NO: 1417946 - RNA, 22 nt, Pseudomonas aeruginosa PA01
cgagcagcgcgcggcucggcgg

SEQ ID NO: 1417947 - RNA, 16 nt, Pseudomonas aeruginosa PA01
cgagcagcggacgcag

SEQ ID NO: 1417948 - RNA, 17 nt, Pseudomonas aeruginosa PA01
cgagcagcggacgcagc

SEQ ID NO: 1417949 - RNA, 14 nt, Pseudomonas aeruginosa PA01
cgagcagcgccagc

SEQ ID NO: 1417950 - RNA, 23 nt, Pseudomonas aeruginosa PA01
cgagcaggugcauguagcgcucc

SEQ ID NO: 1417951 - RNA, 12 nt, Pseudomonas aeruginosa PA01
cgagcaggucgc

SEQ ID NO: 1417952 - RNA, 13 nt, Pseudomonas aeruginosa PA01
cgagcaggucgcg

SEQ ID NO: 1417953 - RNA, 15 nt, Pseudomonas aeruginosa PA01
cgagcaggucgcgga

SEQ ID NO: 1417954 - RNA, 16 nt, Pseudomonas aeruginosa PA01
cgagcagggucacgcc

SEQ ID NO: 1417955 - RNA, 21 nt, Pseudomonas aeruginosa PA01
cgagcagggucaugaugccuu

SEQ ID NO: 1417956 - RNA, 19 nt, Pseudomonas aeruginosa PA01
cgagcagccgacgauccgg

SEQ ID NO: 1417957 - RNA, 21 nt, Pseudomonas aeruginosa PA01
cgagccaggcguauucggcga

SEQ ID NO: 1417958 - RNA, 22 nt, Pseudomonas aeruginosa PA01
cgagccaggcguauucggcgac

SEQ ID NO: 1417959 - RNA, 12 nt, Pseudomonas aeruginosa PA01
cgagccagcgcu

SEQ ID NO: 1417960 - RNA, 13 nt, Pseudomonas aeruginosa PA01
cgagccagcgcuc

SEQ ID NO: 1417961 - RNA, 20 nt, Pseudomonas aeruginosa PA01
cgagccagguuuccggcagc

SEQ ID NO: 1417962 - RNA, 16 nt, Pseudomonas aeruginosa PA01
cgagccagcccagcgg

SEQ ID NO: 1417963 - RNA, 12 nt, Pseudomonas aeruginosa PA01
cgagccagccgc

SEQ ID NO: 1417964 - RNA, 19 nt, Pseudomonas aeruginosa PA01
cgagccagccgcggaucac

SEQ ID NO: 1417965 - RNA, 21 nt, Pseudomonas aeruginosa PA01
cgagccagccgcggaucaccu

SEQ ID NO: 1417966 - RNA, 20 nt, Pseudomonas aeruginosa PA01
cgagccagccguggcaggcg

SEQ ID NO: 1417967 - RNA, 22 nt, Pseudomonas aeruginosa PA01
cgagccagccguggcaggcgcc

SEQ ID NO: 1417968 - RNA, 19 nt, Pseudomonas aeruginosa PA01
cgagcagguagaccgccuc

SEQ ID NO: 1417969 - RNA, 15 nt, Pseudomonas aeruginosa PA01
cgagcaguuccaggc

SEQ ID NO: 1417970 - RNA, 21 nt, Pseudomonas aeruginosa PA01
cgagcaguuccaggcguccgc

SEQ ID NO: 1417971 - RNA, 17 nt, Pseudomonas aeruginosa PA01
cgagcaguucccccagc

SEQ ID NO: 1417972 - RNA, 16 nt, Pseudomonas aeruginosa PA01
cgagcaguuccggcac

SEQ ID NO: 1417973 - RNA, 17 nt, Pseudomonas aeruginosa PA01
cgagcaguuccggcacg

SEQ ID NO: 1417974 - RNA, 21 nt, Pseudomonas aeruginosa PA01
cgagccacggauaugcgccgc

SEQ ID NO: 1417975 - RNA, 21 nt, Pseudomonas aeruginosa PA01
cgagccgcuuggagcgggcgc

SEQ ID NO: 1417976 - RNA, 15 nt, Pseudomonas aeruginosa PA01
cgagccgcugcggcu

SEQ ID NO: 1417977 - RNA, 20 nt, Pseudomonas aeruginosa PA01
cgagccgcugcggcucgccg

SEQ ID NO: 1417978 - RNA, 20 nt, Pseudomonas aeruginosa PA01
cgagccggacggcggcguca

SEQ ID NO: 1417979 - RNA, 15 nt, Pseudomonas aeruginosa PA01
cgagccggaucggua

SEQ ID NO: 1417980 - RNA, 17 nt, Pseudomonas aeruginosa PA01
cgagccgcgcugcuggu

SEQ ID NO: 1417981 - RNA, 12 nt, Pseudomonas aeruginosa PA01
cgagccgccggg

SEQ ID NO: 1417982 - RNA, 14 nt, Pseudomonas aeruginosa PA01
cgagcccaggcaga

SEQ ID NO: 1417983 - RNA, 16 nt, Pseudomonas aeruginosa PA01
cgagcccagcggcagg

SEQ ID NO: 1417984 - RNA, 14 nt, Pseudomonas aeruginosa PA01
cgagcgccgccagg

SEQ ID NO: 1417985 - RNA, 18 nt, Pseudomonas aeruginosa PA01
cgagcgccgccaggcagg

SEQ ID NO: 1417986 - RNA, 21 nt, Pseudomonas aeruginosa PA01
cgagcgccgccaggcaggccg

SEQ ID NO: 1417987 - RNA, 15 nt, Pseudomonas aeruginosa PA01
cgagcgccgcggcga

SEQ ID NO: 1417988 - RNA, 14 nt, Pseudomonas aeruginosa PA01
cgagcgcgaucagc

SEQ ID NO: 1417989 - RNA, 20 nt, Pseudomonas aeruginosa PA01
cgagcgcgaucagccgcucc

SEQ ID NO: 1417990 - RNA, 22 nt, Pseudomonas aeruginosa PA01
cgagcgcgaucagccgcuccag

SEQ ID NO: 1417991 - RNA, 13 nt, Pseudomonas aeruginosa PA01
cgagcgcgacucg

SEQ ID NO: 1417992 - RNA, 15 nt, Pseudomonas aeruginosa PA01
cgagcggcaaggcca

SEQ ID NO: 1417993 - RNA, 16 nt, Pseudomonas aeruginosa PA01
cgagcgccuggcaacc

SEQ ID NO: 1417994 - RNA, 17 nt, Pseudomonas aeruginosa PA01
cgagcgccuggcaaccg

SEQ ID NO: 1417995 - RNA, 21 nt, Pseudomonas aeruginosa PA01
cgagcgcuucauccugcgcgc

SEQ ID NO: 1417996 - RNA, 23 nt, Pseudomonas aeruginosa PA01
cgagcgcuucauccugcgcgccu

SEQ ID NO: 1417997 - RNA, 14 nt, Pseudomonas aeruginosa PA01
cgagcggcgcgaag

SEQ ID NO: 1417998 - RNA, 18 nt, Pseudomonas aeruginosa PA01
cgagcgggaagcguuccu

SEQ ID NO: 1417999 - RNA, 23 nt, Pseudomonas aeruginosa PA01
cgacuuggacagcgucuggguga

SEQ ID NO: 1418000 - RNA, 18 nt, Pseudomonas aeruginosa PA01
cgacuuggcagucgccgc

SEQ ID NO: 1418001 - RNA, 20 nt, Pseudomonas aeruginosa PA01
cgacuuggcagucgccgcca

SEQ ID NO: 1418002 - RNA, 17 nt, Pseudomonas aeruginosa PA01
cgacuugccgaucaugg

SEQ ID NO: 1418003 - RNA, 15 nt, Pseudomonas aeruginosa PA01
cgacuucuucgcugg

SEQ ID NO: 1418004 - RNA, 20 nt, Pseudomonas aeruginosa PA01
cgacuucgacgaacucgacg

SEQ ID NO: 1418005 - RNA, 13 nt, Pseudomonas aeruginosa PA01
cgacuucgcacca

SEQ ID NO: 1418006 - RNA, 21 nt, Pseudomonas aeruginosa PA01
cgacuucgcaccagccggccg

SEQ ID NO: 1418007 - RNA, 23 nt, Pseudomonas aeruginosa PA01
cgacuucgcaccagccggccgcg

SEQ ID NO: 1418008 - RNA, 17 nt, Pseudomonas aeruginosa PA01
cgacuuccuugcgcggg

SEQ ID NO: 1418009 - RNA, 18 nt, Pseudomonas aeruginosa PA01
cgacuuccuugcgcgggc

SEQ ID NO: 1418010 - RNA, 20 nt, Pseudomonas aeruginosa PA01
cgacuuccugggaugccggg

SEQ ID NO: 1418011 - RNA, 15 nt, Pseudomonas aeruginosa PA01
cgacuuccaggcgca

SEQ ID NO: 1418012 - RNA, 17 nt, Pseudomonas aeruginosa PA01
cgacuuccaggcgcagg

SEQ ID NO: 1418013 - RNA, 16 nt, Pseudomonas aeruginosa PA01
cgagaacgcggcgaag

SEQ ID NO: 1418014 - RNA, 15 nt, Pseudomonas aeruginosa PA01
cgagaacaggcggau

SEQ ID NO: 1418015 - RNA, 13 nt, Pseudomonas aeruginosa PA01
cgagaacccggcc

SEQ ID NO: 1418016 - RNA, 14 nt, Pseudomonas aeruginosa PA01
cgagaaagcgcagg

SEQ ID NO: 1418017 - RNA, 15 nt, Pseudomonas aeruginosa PA01
cgagaaaaagcccgg

SEQ ID NO: 1418018 - RNA, 17 nt, Pseudomonas aeruginosa PA01
cgagaacuugccggcgc

SEQ ID NO: 1418019 - RNA, 22 nt, Pseudomonas aeruginosa PA01
cgagaacuugccggcgccaucg

SEQ ID NO: 1418020 - RNA, 22 nt, Pseudomonas aeruginosa PA01
cgagaacucguccggucgcacc

SEQ ID NO: 1418021 - RNA, 23 nt, Pseudomonas aeruginosa PA01
cgagaacucguccggucgcaccg

SEQ ID NO: 1418022 - RNA, 19 nt, Pseudomonas aeruginosa PA01
cgagaagcagaacgccccg

SEQ ID NO: 1418023 - RNA, 19 nt, Pseudomonas aeruginosa PA01
cgagaagguucucggccac

SEQ ID NO: 1418024 - RNA, 22 nt, Pseudomonas aeruginosa PA01
cgagaagccgaucaggucgcgc

SEQ ID NO: 1418025 - RNA, 20 nt, Pseudomonas aeruginosa PA01
cgagaagccggggcaggcau

SEQ ID NO: 1418026 - RNA, 14 nt, Pseudomonas aeruginosa PA01
cgacuccagccagg

SEQ ID NO: 1418027 - RNA, 16 nt, Pseudomonas aeruginosa PA01
cgacuccagccaggcg

SEQ ID NO: 1418028 - RNA, 16 nt, Pseudomonas aeruginosa PA01
cgacucacccgcugcg

SEQ ID NO: 1418029 - RNA, 18 nt, Pseudomonas aeruginosa PA01
cgacuggccguuggcgaa

SEQ ID NO: 1418030 - RNA, 20 nt, Pseudomonas aeruginosa PA01
cgacuggccguuggcgaacu

SEQ ID NO: 1418031 - RNA, 20 nt, Pseudomonas aeruginosa PA01
cgacuggaugaacagcgaga

SEQ ID NO: 1418032 - RNA, 18 nt, Pseudomonas aeruginosa PA01
cgacuggaugcagccgau

SEQ ID NO: 1418033 - RNA, 21 nt, Pseudomonas aeruginosa PA01
cgacuggcagcgauaaccgcg

SEQ ID NO: 1418034 - RNA, 14 nt, Pseudomonas aeruginosa PA01
cgacugcugcugcg

SEQ ID NO: 1418035 - RNA, 19 nt, Pseudomonas aeruginosa PA01
cgacugcugcugcggggcc

SEQ ID NO: 1418036 - RNA, 14 nt, Pseudomonas aeruginosa PA01
cgacuccagcuucu

SEQ ID NO: 1418037 - RNA, 22 nt, Pseudomonas aeruginosa PA01
cgacuccagcuucuucugcagc

SEQ ID NO: 1418038 - RNA, 19 nt, Pseudomonas aeruginosa PA01
cgacuggggcaucucggcc

SEQ ID NO: 1418039 - RNA, 20 nt, Pseudomonas aeruginosa PA01
cgacugucgagcagggucgc

SEQ ID NO: 1418040 - RNA, 16 nt, Pseudomonas aeruginosa PA01
cgacguaccgccugcc

SEQ ID NO: 1418041 - RNA, 18 nt, Pseudomonas aeruginosa PA01
cgacguaccgccugccau

SEQ ID NO: 1418042 - RNA, 16 nt, Pseudomonas aeruginosa PA01
cgacgguucgaucccg

SEQ ID NO: 1418043 - RNA, 13 nt, Pseudomonas aeruginosa PA01
cgacggucaggcc

SEQ ID NO: 1418044 - RNA, 16 nt, Pseudomonas aeruginosa PA01
cgacggucaggccgag

SEQ ID NO: 1418045 - RNA, 18 nt, Pseudomonas aeruginosa PA01
cgacggucaggccgagca

SEQ ID NO: 1418046 - RNA, 20 nt, Pseudomonas aeruginosa PA01
cgacggucaggccgagcagc

SEQ ID NO: 1418047 - RNA, 14 nt, Pseudomonas aeruginosa PA01
cgacgggucgccau

SEQ ID NO: 1418048 - RNA, 22 nt, Pseudomonas aeruginosa PA01
cgacggguuugugccguuccag

SEQ ID NO: 1418049 - RNA, 18 nt, Pseudomonas aeruginosa PA01
cgacgggaagcgaaccag

SEQ ID NO: 1418050 - RNA, 23 nt, Pseudomonas aeruginosa PA01
cgacggcuucgaccacgacccgg

SEQ ID NO: 1418051 - RNA, 15 nt, Pseudomonas aeruginosa PA01
cgacggcugcuccgg

SEQ ID NO: 1418052 - RNA, 15 nt, Pseudomonas aeruginosa PA01
cgacggcucuucccc

SEQ ID NO: 1418053 - RNA, 23 nt, Pseudomonas aeruginosa PA01
cgacggcucuuccccuaccggca

SEQ ID NO: 1418054 - RNA, 17 nt, Pseudomonas aeruginosa PA01
cgacgcugaugaugccg

SEQ ID NO: 1418055 - RNA, 15 nt, Pseudomonas aeruginosa PA01
cgacgcucggacagc

SEQ ID NO: 1418056 - RNA, 14 nt, Pseudomonas aeruginosa PA01
cgacgcugaucauc

SEQ ID NO: 1418057 - RNA, 16 nt, Pseudomonas aeruginosa PA01
cgacgcugaucaucga

SEQ ID NO: 1418058 - RNA, 21 nt, Pseudomonas aeruginosa PA01
cgacgcucugcucggccagcg

SEQ ID NO: 1418059 - RNA, 11 nt, Pseudomonas aeruginosa PA01
cgacgcucuuc

SEQ ID NO: 1418060 - RNA, 18 nt, Pseudomonas aeruginosa PA01
cgacgcucuucagcgguc

SEQ ID NO: 1418061 - RNA, 18 nt, Pseudomonas aeruginosa PA01
cgacgcugaggaucacga

SEQ ID NO: 1418062 - RNA, 15 nt, Pseudomonas aeruginosa PA01
cgacguugcgcaggg

SEQ ID NO: 1418063 - RNA, 17 nt, Pseudomonas aeruginosa PA01
cgacguugcgcaggggc

SEQ ID NO: 1418064 - RNA, 23 nt, Pseudomonas aeruginosa PA01
cgacguugcgcaggggcgcggcg

SEQ ID NO: 1418065 - RNA, 14 nt, Pseudomonas aeruginosa PA01
cgacguccugcggg

SEQ ID NO: 1418066 - RNA, 17 nt, Pseudomonas aeruginosa PA01
cgacguccuccaggacc

SEQ ID NO: 1418067 - RNA, 12 nt, Pseudomonas aeruginosa PA01
cgacguagaccu

SEQ ID NO: 1418068 - RNA, 14 nt, Pseudomonas aeruginosa PA01
cgacguagccgcgu

SEQ ID NO: 1418069 - RNA, 20 nt, Pseudomonas aeruginosa PA01
ccugccguucgucaccggcg

SEQ ID NO: 1418070 - RNA, 21 nt, Pseudomonas aeruginosa PA01
ccugccguucgucaccggcgc

SEQ ID NO: 1418071 - RNA, 17 nt, Pseudomonas aeruginosa PA01
ccugccggugcucggcc

SEQ ID NO: 1418072 - RNA, 20 nt, Pseudomonas aeruginosa PA01
ccugccguauccgcggcagg

SEQ ID NO: 1418073 - RNA, 22 nt, Pseudomonas aeruginosa PA01
ccugccuuccuugaccacggcg

SEQ ID NO: 1418074 - RNA, 14 nt, Pseudomonas aeruginosa PA01
ccuggcccggcgca

SEQ ID NO: 1418075 - RNA, 16 nt, Pseudomonas aeruginosa PA01
ccuggcccucggugcg

SEQ ID NO: 1418076 - RNA, 11 nt, Pseudomonas aeruginosa PA01
ccuggcccugg

SEQ ID NO: 1418077 - RNA, 19 nt, Pseudomonas aeruginosa PA01
ccuggcccuggcgcaggcg

SEQ ID NO: 1418078 - RNA, 13 nt, Pseudomonas aeruginosa PA01
ccuggccgcgcag

SEQ ID NO: 1418079 - RNA, 14 nt, Pseudomonas aeruginosa PA01
ccuggccgcgcagg

SEQ ID NO: 1418080 - RNA, 16 nt, Pseudomonas aeruginosa PA01
ccuggccgcgcaggac

SEQ ID NO: 1418081 - RNA, 14 nt, Pseudomonas aeruginosa PA01
ccuggccgcgcggc

SEQ ID NO: 1418082 - RNA, 21 nt, Pseudomonas aeruginosa PA01
ccuggccgcgcggcuugccgg

SEQ ID NO: 1418083 - RNA, 12 nt, Pseudomonas aeruginosa PA01
ccuggccggcga

SEQ ID NO: 1418084 - RNA, 14 nt, Pseudomonas aeruginosa PA01
ccuggccggcgaac

SEQ ID NO: 1418085 - RNA, 13 nt, Pseudomonas aeruginosa PA01
ccuggccggcggc

SEQ ID NO: 1418086 - RNA, 16 nt, Pseudomonas aeruginosa PA01
ccuggccggcacccug

SEQ ID NO: 1418087 - RNA, 21 nt, Pseudomonas aeruginosa PA01
ccuggccgggggucgcggcga

SEQ ID NO: 1418088 - RNA, 19 nt, Pseudomonas aeruginosa PA01
ccuggccggucguucgccc

SEQ ID NO: 1418089 - RNA, 11 nt, Pseudomonas aeruginosa PA01
ccuggccgcca

SEQ ID NO: 1418090 - RNA, 12 nt, Pseudomonas aeruginosa PA01
ccuggccgaccc

SEQ ID NO: 1418091 - RNA, 14 nt, Pseudomonas aeruginosa PA01
ccuggccgacccgc

SEQ ID NO: 1418092 - RNA, 16 nt, Pseudomonas aeruginosa PA01
ccuggccgacccgcag

SEQ ID NO: 1418093 - RNA, 22 nt, Pseudomonas aeruginosa PA01
ccuggccgacccgcagcggcgc

SEQ ID NO: 1418094 - RNA, 12 nt, Pseudomonas aeruginosa PA01
ccuggccgacgc

SEQ ID NO: 1418095 - RNA, 22 nt, Pseudomonas aeruginosa PA01
ccuggccgacgcugaggaucac

SEQ ID NO: 1418096 - RNA, 17 nt, Pseudomonas aeruginosa PA01
ccugccggcacgcucag

SEQ ID NO: 1418097 - RNA, 14 nt, Pseudomonas aeruginosa PA01
ccugccggcgcaga

SEQ ID NO: 1418098 - RNA, 22 nt, Pseudomonas aeruginosa PA01
ccugccggcgcagaucgcggcg

SEQ ID NO: 1418099 - RNA, 18 nt, Pseudomonas aeruginosa PA01
ccugccgcaggcgggcgc

SEQ ID NO: 1418100 - RNA, 16 nt, Pseudomonas aeruginosa PA01
ccugccgcccggccag

SEQ ID NO: 1418101 - RNA, 19 nt, Pseudomonas aeruginosa PA01
ccugcccguaccacgucca

SEQ ID NO: 1418102 - RNA, 16 nt, Pseudomonas aeruginosa PA01
ccugccgaucgccgcg

SEQ ID NO: 1418103 - RNA, 15 nt, Pseudomonas aeruginosa PA01
ccuggcgucgaugcc

SEQ ID NO: 1418104 - RNA, 17 nt, Pseudomonas aeruginosa PA01
ccuggcgucgaugccga

SEQ ID NO: 1418105 - RNA, 21 nt, Pseudomonas aeruginosa PA01
ccuggcgucgaugccgaaucc

SEQ ID NO: 1418106 - RNA, 17 nt, Pseudomonas aeruginosa PA01
ccuggcgugccgccagg

SEQ ID NO: 1418107 - RNA, 16 nt, Pseudomonas aeruginosa PA01
ccuggcguggccggcg

SEQ ID NO: 1418108 - RNA, 17 nt, Pseudomonas aeruginosa PA01
ccuggcguggccggcga

SEQ ID NO: 1418109 - RNA, 17 nt, Pseudomonas aeruginosa PA01
ccuggcgguagcccggc

SEQ ID NO: 1418110 - RNA, 22 nt, Pseudomonas aeruginosa PA01
ccuggcgguagcccggcagcuc

SEQ ID NO: 1418111 - RNA, 19 nt, Pseudomonas aeruginosa PA01
ccuggcggucgccgccggc

SEQ ID NO: 1418112 - RNA, 15 nt, Pseudomonas aeruginosa PA01
ccuggcggauaucgc

SEQ ID NO: 1418113 - RNA, 18 nt, Pseudomonas aeruginosa PA01
ccuggcggauaucgcgcc

SEQ ID NO: 1418114 - RNA, 21 nt, Pseudomonas aeruginosa PA01
ccuggcggauaucgcgccgcg

SEQ ID NO: 1418115 - RNA, 22 nt, Pseudomonas aeruginosa PA01
ccuggcggauaucgcgccgcga

SEQ ID NO: 1418116 - RNA, 13 nt, Pseudomonas aeruginosa PA01
ccuggcggcgugg

SEQ ID NO: 1418117 - RNA, 14 nt, Pseudomonas aeruginosa PA01
ccuggcggcguggc

SEQ ID NO: 1418118 - RNA, 12 nt, Pseudomonas aeruginosa PA01
ccuggcggcugg

SEQ ID NO: 1418119 - RNA, 12 nt, Pseudomonas aeruginosa PA01
ccuggcuggcca

SEQ ID NO: 1418120 - RNA, 14 nt, Pseudomonas aeruginosa PA01
ccuggcuggccagc

SEQ ID NO: 1418121 - RNA, 19 nt, Pseudomonas aeruginosa PA01
ccuggcucuguuccucggc

SEQ ID NO: 1418122 - RNA, 22 nt, Pseudomonas aeruginosa PA01
ccuggcucuguuccucggcggc

SEQ ID NO: 1418123 - RNA, 20 nt, Pseudomonas aeruginosa PA01
ccuggcucaggcacucgaug

SEQ ID NO: 1418124 - RNA, 20 nt, Pseudomonas aeruginosa PA01
ccuggcucaugucguggaca

SEQ ID NO: 1418125 - RNA, 14 nt, Pseudomonas aeruginosa PA01
ccuggcucgaucgg

SEQ ID NO: 1418126 - RNA, 23 nt, Pseudomonas aeruginosa PA01
ccuggcucgaucggcagggcgcc

SEQ ID NO: 1418127 - RNA, 18 nt, Pseudomonas aeruginosa PA01
ccuggcgcaacaggcgca

SEQ ID NO: 1418128 - RNA, 22 nt, Pseudomonas aeruginosa PA01
ccuggcgcaacaggcgcaugcc

SEQ ID NO: 1418129 - RNA, 17 nt, Pseudomonas aeruginosa PA01
ccuggcgcaacgccggc

SEQ ID NO: 1418130 - RNA, 18 nt, Pseudomonas aeruginosa PA01
ccuggcgcaaggugccga

SEQ ID NO: 1418131 - RNA, 16 nt, Pseudomonas aeruginosa PA01
ccuggcgaucaggcca

SEQ ID NO: 1418132 - RNA, 17 nt, Pseudomonas aeruginosa PA01
ccuggcgaugcccuggc

SEQ ID NO: 1418133 - RNA, 23 nt, Pseudomonas aeruginosa PA01
ccuggcgaugcccuggccgcugc

SEQ ID NO: 1418134 - RNA, 21 nt, Pseudomonas aeruginosa PA01
ccuggcgacgucccuuccccg

SEQ ID NO: 1418135 - RNA, 20 nt, Pseudomonas aeruginosa PA01
ccuggcgacaggcgaucgac

SEQ ID NO: 1418136 - RNA, 15 nt, Pseudomonas aeruginosa PA01
ccuggccgugcucga

SEQ ID NO: 1418137 - RNA, 17 nt, Pseudomonas aeruginosa PA01
ccuggccgugcucgaug

SEQ ID NO: 1418138 - RNA, 17 nt, Pseudomonas aeruginosa PA01
ccuggccuuggccacga

SEQ ID NO: 1418139 - RNA, 19 nt, Pseudomonas aeruginosa PA01
ccuggccuuggccacgacc

SEQ ID NO: 1418140 - RNA, 14 nt, Pseudomonas aeruginosa PA01
ccuggccucggcgu

SEQ ID NO: 1418141 - RNA, 15 nt, Pseudomonas aeruginosa PA01
ccuggccucggcguc

SEQ ID NO: 1418142 - RNA, 18 nt, Pseudomonas aeruginosa PA01
ccuggcgcugucgcccgg

SEQ ID NO: 1418143 - RNA, 19 nt, Pseudomonas aeruginosa PA01
ccuggcgcuugggcgcgga

SEQ ID NO: 1418144 - RNA, 20 nt, Pseudomonas aeruginosa PA01
ccuggcgcgcgcgccagguc

SEQ ID NO: 1418145 - RNA, 17 nt, Pseudomonas aeruginosa PA01
ccuggcgcgcggccgcg

SEQ ID NO: 1418146 - RNA, 12 nt, Pseudomonas aeruginosa PA01
ccuggcgcggca

SEQ ID NO: 1418147 - RNA, 17 nt, Pseudomonas aeruginosa PA01
ccuggcgcguacgcccg

SEQ ID NO: 1418148 - RNA, 18 nt, Pseudomonas aeruginosa PA01
ccuggcgcguacgcccgc

SEQ ID NO: 1418149 - RNA, 20 nt, Pseudomonas aeruginosa PA01
ccuggcgcguacgcccgcag

SEQ ID NO: 1418150 - RNA, 22 nt, Pseudomonas aeruginosa PA01
ccuggcgcguacgcccgcagcc

SEQ ID NO: 1418151 - RNA, 14 nt, Pseudomonas aeruginosa PA01
ccuggcgcgucaug

SEQ ID NO: 1418152 - RNA, 17 nt, Pseudomonas aeruginosa PA01
ccuggcgcgucggccgc

SEQ ID NO: 1418153 - RNA, 17 nt, Pseudomonas aeruginosa PA01
ccuggcgcucagcgccg

SEQ ID NO: 1418154 - RNA, 24 nt, Pseudomonas aeruginosa PA01
ccuggcgcucagcgccgcuucuuc

SEQ ID NO: 1418155 - RNA, 15 nt, Pseudomonas aeruginosa PA01
ccuggcgcucgccgu

SEQ ID NO: 1418156 - RNA, 16 nt, Pseudomonas aeruginosa PA01
ccuggcgcucgccgug

SEQ ID NO: 1418157 - RNA, 23 nt, Pseudomonas aeruginosa PA01
ccuggcgcugaacaagcccuggu

SEQ ID NO: 1418158 - RNA, 13 nt, Pseudomonas aeruginosa PA01
ccuggcgcacggc

SEQ ID NO: 1418159 - RNA, 13 nt, Pseudomonas aeruginosa PA01
ccuggcgcagcgg

SEQ ID NO: 1418160 - RNA, 15 nt, Pseudomonas aeruginosa PA01
ccuggcgcagcggca

SEQ ID NO: 1418161 - RNA, 16 nt, Pseudomonas aeruginosa PA01
ccuggcgcagcggcag

SEQ ID NO: 1418162 - RNA, 18 nt, Pseudomonas aeruginosa PA01
ccuggcgcagcggcagcg

SEQ ID NO: 1418163 - RNA, 13 nt, Pseudomonas aeruginosa PA01
ccuggcgcaggua

SEQ ID NO: 1418164 - RNA, 21 nt, Pseudomonas aeruginosa PA01
ccuggcgcagguagaaggugc

SEQ ID NO: 1418165 - RNA, 22 nt, Pseudomonas aeruginosa PA01
ccuggcgcgacgaggcgcggcg

SEQ ID NO: 1418166 - RNA, 17 nt, Pseudomonas aeruginosa PA01
ccuggcgcauggcgcuc

SEQ ID NO: 1418167 - RNA, 22 nt, Pseudomonas aeruginosa PA01
ccuggcgccagcguugcagguc

SEQ ID NO: 1418168 - RNA, 12 nt, Pseudomonas aeruginosa PA01
ccuggcgccggu

SEQ ID NO: 1418169 - RNA, 21 nt, Pseudomonas aeruginosa PA01
ccugguuguaggcgccgccgu

SEQ ID NO: 1418170 - RNA, 19 nt, Pseudomonas aeruginosa PA01
ccugguucaucgagcggcg

SEQ ID NO: 1418171 - RNA, 21 nt, Pseudomonas aeruginosa PA01
ccugguucaucgagcggcggc

SEQ ID NO: 1418172 - RNA, 17 nt, Pseudomonas aeruginosa PA01
ccugguucgaguccagg

SEQ ID NO: 1418173 - RNA, 23 nt, Pseudomonas aeruginosa PA01
ccugguucugcuccggacugccg

SEQ ID NO: 1418174 - RNA, 14 nt, Pseudomonas aeruginosa PA01
ccugguggcgccgg

SEQ ID NO: 1418175 - RNA, 13 nt, Pseudomonas aeruginosa PA01
ccuggugggcggc

SEQ ID NO: 1418176 - RNA, 16 nt, Pseudomonas aeruginosa PA01
ccuggugggcggcggc

SEQ ID NO: 1418177 - RNA, 23 nt, Pseudomonas aeruginosa PA01
ccuggugcggcaccagccaggug

SEQ ID NO: 1418178 - RNA, 18 nt, Pseudomonas aeruginosa PA01
ccugguggaacagccgca

SEQ ID NO: 1418179 - RNA, 19 nt, Pseudomonas aeruginosa PA01
ccugguggacacccugcug

SEQ ID NO: 1418180 - RNA, 20 nt, Pseudomonas aeruginosa PA01
ccugguggacacccugcugc

SEQ ID NO: 1418181 - RNA, 23 nt, Pseudomonas aeruginosa PA01
ccugguccaaccgggcaucgccg

SEQ ID NO: 1418182 - RNA, 18 nt, Pseudomonas aeruginosa PA01
ccuggguugccgcgccga

SEQ ID NO: 1418183 - RNA, 15 nt, Pseudomonas aeruginosa PA01
ccugguccagccagc

SEQ ID NO: 1418184 - RNA, 20 nt, Pseudomonas aeruginosa PA01
ccugguccagccagccgccu

SEQ ID NO: 1418185 - RNA, 14 nt, Pseudomonas aeruginosa PA01
ccuggucgccggga

SEQ ID NO: 1418186 - RNA, 21 nt, Pseudomonas aeruginosa PA01
ccuggucgacauagcgcagca

SEQ ID NO: 1418187 - RNA, 20 nt, Pseudomonas aeruginosa PA01
ccugguccgucucgucgagc

SEQ ID NO: 1418188 - RNA, 21 nt, Pseudomonas aeruginosa PA01
ccugguccuuauucggcccau

SEQ ID NO: 1418189 - RNA, 22 nt, Pseudomonas aeruginosa PA01
ccuggucuucgguggcggcgac

SEQ ID NO: 1418190 - RNA, 17 nt, Pseudomonas aeruginosa PA01
ccuggugcaccuggcga

SEQ ID NO: 1418191 - RNA, 20 nt, Pseudomonas aeruginosa PA01
ccuggugcacgccgauggcg

SEQ ID NO: 1418192 - RNA, 14 nt, Pseudomonas aeruginosa PA01
ccuggugcacggcg

SEQ ID NO: 1418193 - RNA, 15 nt, Pseudomonas aeruginosa PA01
ccuggugcacggcga

SEQ ID NO: 1418194 - RNA, 19 nt, Pseudomonas aeruginosa PA01
ccuggugcacggcgacccg

SEQ ID NO: 1418195 - RNA, 21 nt, Pseudomonas aeruginosa PA01
ccuggugcaggucgcgcggcg

SEQ ID NO: 1418196 - RNA, 23 nt, Pseudomonas aeruginosa PA01
ccuggucgcugaggccgcccugg

SEQ ID NO: 1418197 - RNA, 16 nt, Pseudomonas aeruginosa PA01
ccuggucggcgcggcg

SEQ ID NO: 1418198 - RNA, 22 nt, Pseudomonas aeruginosa PA01
ccuggucggcgcggcgcuccag

SEQ ID NO: 1418199 - RNA, 20 nt, Pseudomonas aeruginosa PA01
ccuggucggggccggcgaug

SEQ ID NO: 1418200 - RNA, 19 nt, Pseudomonas aeruginosa PA01
ccugggguagccggccgau

SEQ ID NO: 1418201 - RNA, 16 nt, Pseudomonas aeruginosa PA01
ccuggggugcagcagg

SEQ ID NO: 1418202 - RNA, 18 nt, Pseudomonas aeruginosa PA01
ccugggcuucguccgccu

SEQ ID NO: 1418203 - RNA, 14 nt, Pseudomonas aeruginosa PA01
ccugggucgacugc

SEQ ID NO: 1418204 - RNA, 20 nt, Pseudomonas aeruginosa PA01
ccugggucgcguacagcggg

SEQ ID NO: 1418205 - RNA, 15 nt, Pseudomonas aeruginosa PA01
ccugguacagcaccc

SEQ ID NO: 1418206 - RNA, 16 nt, Pseudomonas aeruginosa PA01
ccugguacagcgccug

SEQ ID NO: 1418207 - RNA, 15 nt, Pseudomonas aeruginosa PA01
ccugguagucgcggu

SEQ ID NO: 1418208 - RNA, 16 nt, Pseudomonas aeruginosa PA01
ccugguaggcggcgac

SEQ ID NO: 1418209 - RNA, 19 nt, Pseudomonas aeruginosa PA01
ccugguaggcgucgucgac

SEQ ID NO: 1418210 - RNA, 17 nt, Pseudomonas aeruginosa PA01
ccugguaggugcgcugg

SEQ ID NO: 1418211 - RNA, 21 nt, Pseudomonas aeruginosa PA01
ccugguaggugcgcuggcgcc

SEQ ID NO: 1418212 - RNA, 20 nt, Pseudomonas aeruginosa PA01
ccugguagcagagggucgcc

SEQ ID NO: 1418213 - RNA, 22 nt, Pseudomonas aeruginosa PA01
ccugguagcagagggucgccag

SEQ ID NO: 1418214 - RNA, 20 nt, Pseudomonas aeruginosa PA01
ccugguacucguccucccag

SEQ ID NO: 1418215 - RNA, 22 nt, Pseudomonas aeruginosa PA01
ccugguagaaacgcuugagcug

SEQ ID NO: 1418216 - RNA, 23 nt, Pseudomonas aeruginosa PA01
ccugguagaucugugcggugccg

SEQ ID NO: 1418217 - RNA, 23 nt, Pseudomonas aeruginosa PA01
ccugggcgcaggggcgcgccggc

SEQ ID NO: 1418218 - RNA, 14 nt, Pseudomonas aeruginosa PA01
ccugggcgccagcc

SEQ ID NO: 1418219 - RNA, 19 nt, Pseudomonas aeruginosa PA01
ccugggcgccagccgccau

SEQ ID NO: 1418220 - RNA, 14 nt, Pseudomonas aeruginosa PA01
ccugggcgccgcca

SEQ ID NO: 1418221 - RNA, 21 nt, Pseudomonas aeruginosa PA01
ccugggcgccgccggugcacc

SEQ ID NO: 1418222 - RNA, 18 nt, Pseudomonas aeruginosa PA01
ccugggccugucgggggc

SEQ ID NO: 1418223 - RNA, 17 nt, Pseudomonas aeruginosa PA01
ccugggcgaagucgacg

SEQ ID NO: 1418224 - RNA, 12 nt, Pseudomonas aeruginosa PA01
ccugggcgcuca

SEQ ID NO: 1418225 - RNA, 16 nt, Pseudomonas aeruginosa PA01
ccugggcggcaacuga

SEQ ID NO: 1418226 - RNA, 13 nt, Pseudomonas aeruginosa PA01
ccugggcggcgac

SEQ ID NO: 1418227 - RNA, 15 nt, Pseudomonas aeruginosa PA01
ccuggggaaucugcg

SEQ ID NO: 1418228 - RNA, 18 nt, Pseudomonas aeruginosa PA01
ccuggggaaucugcgcca

SEQ ID NO: 1418229 - RNA, 22 nt, Pseudomonas aeruginosa PA01
ccuggggaaucugcgccaggug

SEQ ID NO: 1418230 - RNA, 13 nt, Pseudomonas aeruginosa PA01
ccuggggacggca

SEQ ID NO: 1418231 - RNA, 15 nt, Pseudomonas aeruginosa PA01
ccuggggacggcagg

SEQ ID NO: 1418232 - RNA, 14 nt, Pseudomonas aeruginosa PA01
ccugggcgucgcug

SEQ ID NO: 1418233 - RNA, 17 nt, Pseudomonas aeruginosa PA01
ccugggcguuggccagc

SEQ ID NO: 1418234 - RNA, 14 nt, Pseudomonas aeruginosa PA01
ccugggcggcgacc

SEQ ID NO: 1418235 - RNA, 22 nt, Pseudomonas aeruginosa PA01
ccugggcggcgaccugcggcaa

SEQ ID NO: 1418236 - RNA, 22 nt, Pseudomonas aeruginosa PA01
ccugggcggcgggcccguggca

SEQ ID NO: 1418237 - RNA, 19 nt, Pseudomonas aeruginosa PA01
ccugggcaagcugcacggc

SEQ ID NO: 1418238 - RNA, 23 nt, Pseudomonas aeruginosa PA01
ccugggcaagcugcacggcgacc

SEQ ID NO: 1418239 - RNA, 13 nt, Pseudomonas aeruginosa PA01
ccugggccccggc

SEQ ID NO: 1418240 - RNA, 16 nt, Pseudomonas aeruginosa PA01
ccugggccccggccag

SEQ ID NO: 1418241 - RNA, 15 nt, Pseudomonas aeruginosa PA01
ccugggccccggccg

SEQ ID NO: 1418242 - RNA, 15 nt, Pseudomonas aeruginosa PA01
ccugggccgcgcugu

SEQ ID NO: 1418243 - RNA, 12 nt, Pseudomonas aeruginosa PA01
ccugggccggcg

SEQ ID NO: 1418244 - RNA, 22 nt, Pseudomonas aeruginosa PA01
ccugggccgguugcggcgccgg

SEQ ID NO: 1418245 - RNA, 18 nt, Pseudomonas aeruginosa PA01
ccugggaauugcgcacgc

SEQ ID NO: 1418246 - RNA, 17 nt, Pseudomonas aeruginosa PA01
ccuggcucuugccgcga

SEQ ID NO: 1418247 - RNA, 20 nt, Pseudomonas aeruginosa PA01
ccugggaugccgccaagccc

SEQ ID NO: 1418248 - RNA, 22 nt, Pseudomonas aeruginosa PA01
ccugggacggaacgucggccug

SEQ ID NO: 1418249 - RNA, 16 nt, Pseudomonas aeruginosa PA01
ccuggcuuuccagggc

SEQ ID NO: 1418250 - RNA, 18 nt, Pseudomonas aeruginosa PA01
cgaaauccucgcgcaccg

SEQ ID NO: 1418251 - RNA, 20 nt, Pseudomonas aeruginosa PA01
cgaaauagucgcgggccugg

SEQ ID NO: 1418252 - RNA, 16 nt, Pseudomonas aeruginosa PA01
cgaaauacucgucgac

SEQ ID NO: 1418253 - RNA, 14 nt, Pseudomonas aeruginosa PA01
cgaaaggccgcgcc

SEQ ID NO: 1418254 - RNA, 15 nt, Pseudomonas aeruginosa PA01
cgaaagccucgacga

SEQ ID NO: 1418255 - RNA, 12 nt, Pseudomonas aeruginosa PA01
cgaaacgccccg

SEQ ID NO: 1418256 - RNA, 14 nt, Pseudomonas aeruginosa PA01
cgaaacgccgacgg

SEQ ID NO: 1418257 - RNA, 12 nt, Pseudomonas aeruginosa PA01
cgaaagcggugc

SEQ ID NO: 1418258 - RNA, 21 nt, Pseudomonas aeruginosa PA01
cgaaagcgucagcgcgccagc

SEQ ID NO: 1418259 - RNA, 17 nt, Pseudomonas aeruginosa PA01
cgaaagcuucgucgcgc

SEQ ID NO: 1418260 - RNA, 14 nt, Pseudomonas aeruginosa PA01
cgaaagucggcgcg

SEQ ID NO: 1418261 - RNA, 23 nt, Pseudomonas aeruginosa PA01
cgaaaaucgaaggguuggccgca

SEQ ID NO: 1418262 - RNA, 18 nt, Pseudomonas aeruginosa PA01
cgaaacagggcgaccaga

SEQ ID NO: 1418263 - RNA, 23 nt, Pseudomonas aeruginosa PA01
cgaaaccaggaucgaacuggcca

SEQ ID NO: 1418264 - RNA, 15 nt, Pseudomonas aeruginosa PA01
cgaaaccggccagcg

SEQ ID NO: 1418265 - RNA, 21 nt, Pseudomonas aeruginosa PA01
cgaaaccggcgaugcucagcg

SEQ ID NO: 1418266 - RNA, 17 nt, Pseudomonas aeruginosa PA01
cgaaagccuccagcagc

SEQ ID NO: 1418267 - RNA, 20 nt, Pseudomonas aeruginosa PA01
cgaaacggcaggccagcagg

SEQ ID NO: 1418268 - RNA, 15 nt, Pseudomonas aeruginosa PA01
cgaaacgggcgcucu

SEQ ID NO: 1418269 - RNA, 17 nt, Pseudomonas aeruginosa PA01
cgaaacgggcgcucugg

SEQ ID NO: 1418270 - RNA, 22 nt, Pseudomonas aeruginosa PA01
cgaaacgggcgcucuggccgcg

SEQ ID NO: 1418271 - RNA, 23 nt, Pseudomonas aeruginosa PA01
cgaaacgggcgcucuggccgcgc

SEQ ID NO: 1418272 - RNA, 15 nt, Pseudomonas aeruginosa PA01
cgaaacgcuggcggc

SEQ ID NO: 1418273 - RNA, 18 nt, Pseudomonas aeruginosa PA01
cgaaacgcuggcggccga

SEQ ID NO: 1418274 - RNA, 18 nt, Pseudomonas aeruginosa PA01
ccuuucagcggcugcccg

SEQ ID NO: 1418275 - RNA, 20 nt, Pseudomonas aeruginosa PA01
ccuuucuccccucaggcgcc

SEQ ID NO: 1418276 - RNA, 16 nt, Pseudomonas aeruginosa PA01
ccuuucgcucaggccu

SEQ ID NO: 1418277 - RNA, 18 nt, Pseudomonas aeruginosa PA01
ccuuucggaacagcgccu

SEQ ID NO: 1418278 - RNA, 13 nt, Pseudomonas aeruginosa PA01
cgaaaagccgccc

SEQ ID NO: 1418279 - RNA, 14 nt, Pseudomonas aeruginosa PA01
cgaaaagccgcccc

SEQ ID NO: 1418280 - RNA, 20 nt, Pseudomonas aeruginosa PA01
cgaaaagaagccccgcagcc

SEQ ID NO: 1418281 - RNA, 14 nt, Pseudomonas aeruginosa PA01
cgaaaagagccgcg

SEQ ID NO: 1418282 - RNA, 16 nt, Pseudomonas aeruginosa PA01
cgaaaagagccgcgcc

SEQ ID NO: 1418283 - RNA, 18 nt, Pseudomonas aeruginosa PA01
cgaaaagagccgcgccuu

SEQ ID NO: 1418284 - RNA, 15 nt, Pseudomonas aeruginosa PA01
ccuuucugcccggcu

SEQ ID NO: 1418285 - RNA, 15 nt, Pseudomonas aeruginosa PA01
cgaaaaagccccugc

SEQ ID NO: 1418286 - RNA, 18 nt, Pseudomonas aeruginosa PA01
cgaaaaagcccggcgaau

SEQ ID NO: 1418287 - RNA, 17 nt, Pseudomonas aeruginosa PA01
cgaaaaaggcgcgccgg

SEQ ID NO: 1418288 - RNA, 13 nt, Pseudomonas aeruginosa PA01
ccuugcggggcgg

SEQ ID NO: 1418289 - RNA, 23 nt, Pseudomonas aeruginosa PA01
ccuugcggggcggcgcaucggcg

SEQ ID NO: 1418290 - RNA, 19 nt, Pseudomonas aeruginosa PA01
ccuugcgguagcgcucgcc

SEQ ID NO: 1418291 - RNA, 17 nt, Pseudomonas aeruginosa PA01
ccuugcguaccagcgcg

SEQ ID NO: 1418292 - RNA, 18 nt, Pseudomonas aeruginosa PA01
ccuugcguaccagcgcgc

SEQ ID NO: 1418293 - RNA, 19 nt, Pseudomonas aeruginosa PA01
ccuugcucaggucgucgag

SEQ ID NO: 1418294 - RNA, 20 nt, Pseudomonas aeruginosa PA01
ccuugcucaggucgucgagg

SEQ ID NO: 1418295 - RNA, 23 nt, Pseudomonas aeruginosa PA01
ccuugcgguccagcgagcgggcg

SEQ ID NO: 1418296 - RNA, 14 nt, Pseudomonas aeruginosa PA01
ccuugcucccgccg

SEQ ID NO: 1418297 - RNA, 22 nt, Pseudomonas aeruginosa PA01
ccuugcugaucagguugccggc

SEQ ID NO: 1418298 - RNA, 21 nt, Pseudomonas aeruginosa PA01
ccuugcucuugaggucggcgc

SEQ ID NO: 1418299 - RNA, 23 nt, Pseudomonas aeruginosa PA01
ccuugcucuugaggucggcgcgc

SEQ ID NO: 1418300 - RNA, 20 nt, Pseudomonas aeruginosa PA01
ccuugcugaagcccaggcgu

SEQ ID NO: 1418301 - RNA, 17 nt, Pseudomonas aeruginosa PA01
ccuuggcaucgccgccc

SEQ ID NO: 1418302 - RNA, 17 nt, Pseudomonas aeruginosa PA01
ccuuggccacgacccug

SEQ ID NO: 1418303 - RNA, 14 nt, Pseudomonas aeruginosa PA01
ccuuggccacggca

SEQ ID NO: 1418304 - RNA, 17 nt, Pseudomonas aeruginosa PA01
ccugucacucaggcaug

SEQ ID NO: 1418305 - RNA, 20 nt, Pseudomonas aeruginosa PA01
ccuguaguacaugacgaagc

SEQ ID NO: 1418306 - RNA, 13 nt, Pseudomonas aeruginosa PA01
ccugucccggacg

SEQ ID NO: 1418307 - RNA, 16 nt, Pseudomonas aeruginosa PA01
ccuucaccggcacgcc

SEQ ID NO: 1418308 - RNA, 19 nt, Pseudomonas aeruginosa PA01
ccuguccauuuccacgcuc

SEQ ID NO: 1418309 - RNA, 18 nt, Pseudomonas aeruginosa PA01
ccuguccgaacagggcga

SEQ ID NO: 1418310 - RNA, 15 nt, Pseudomonas aeruginosa PA01
ccugucccaucacgg

SEQ ID NO: 1418311 - RNA, 21 nt, Pseudomonas aeruginosa PA01
ccugucccaucacggccccga

SEQ ID NO: 1418312 - RNA, 14 nt, Pseudomonas aeruginosa PA01
ccugucccgccgcg

SEQ ID NO: 1418313 - RNA, 16 nt, Pseudomonas aeruginosa PA01
ccugucccgccgcgcc

SEQ ID NO: 1418314 - RNA, 16 nt, Pseudomonas aeruginosa PA01
ccuucagcacggcgcg

SEQ ID NO: 1418315 - RNA, 17 nt, Pseudomonas aeruginosa PA01
ccuucagcacggcgcgg

SEQ ID NO: 1418316 - RNA, 19 nt, Pseudomonas aeruginosa PA01
ccuucagccccagcacgcc

SEQ ID NO: 1418317 - RNA, 14 nt, Pseudomonas aeruginosa PA01
ccuucagcgccgcc

SEQ ID NO: 1418318 - RNA, 23 nt, Pseudomonas aeruginosa PA01
ccuucagcgccgccaggcccugg

SEQ ID NO: 1418319 - RNA, 13 nt, Pseudomonas aeruginosa PA01
ccuucagcgccuc

SEQ ID NO: 1418320 - RNA, 13 nt, Pseudomonas aeruginosa PA01
ccuucaccggcgg

SEQ ID NO: 1418321 - RNA, 14 nt, Pseudomonas aeruginosa PA01
ccuucaccggcgga

SEQ ID NO: 1418322 - RNA, 15 nt, Pseudomonas aeruginosa PA01
ccuucaucaggcggc

SEQ ID NO: 1418323 - RNA, 12 nt, Pseudomonas aeruginosa PA01
ccuucaggcgcu

SEQ ID NO: 1418324 - RNA, 17 nt, Pseudomonas aeruginosa PA01
ccuucaucuuggcccau

SEQ ID NO: 1418325 - RNA, 14 nt, Pseudomonas aeruginosa PA01
ccuucaugaacaca

SEQ ID NO: 1418326 - RNA, 23 nt, Pseudomonas aeruginosa PA01
ccuucgcaaagcgagcgcccgcc

SEQ ID NO: 1418327 - RNA, 15 nt, Pseudomonas aeruginosa PA01
ccuuccaccggcguc

SEQ ID NO: 1418328 - RNA, 15 nt, Pseudomonas aeruginosa PA01
ccuucgcccucagca

SEQ ID NO: 1418329 - RNA, 17 nt, Pseudomonas aeruginosa PA01
ccuucgcccucagcagc

SEQ ID NO: 1418330 - RNA, 18 nt, Pseudomonas aeruginosa PA01
ccuucgcccucagcagcg

SEQ ID NO: 1418331 - RNA, 14 nt, Pseudomonas aeruginosa PA01
ccuucgcccugcgu

SEQ ID NO: 1418332 - RNA, 16 nt, Pseudomonas aeruginosa PA01
ccuucgcgcucgacga

SEQ ID NO: 1418333 - RNA, 15 nt, Pseudomonas aeruginosa PA01
ccuucgcggcggcgc

SEQ ID NO: 1418334 - RNA, 17 nt, Pseudomonas aeruginosa PA01
ccuucgguggcgaccag

SEQ ID NO: 1418335 - RNA, 19 nt, Pseudomonas aeruginosa PA01
ccuucggcggagccgucgg

SEQ ID NO: 1418336 - RNA, 19 nt, Pseudomonas aeruginosa PA01
ccuucguccucguggcgcg

SEQ ID NO: 1418337 - RNA, 15 nt, Pseudomonas aeruginosa PA01
ccuucgucggcuucu

SEQ ID NO: 1418338 - RNA, 13 nt, Pseudomonas aeruginosa PA01
ccuugaagcgcuu

SEQ ID NO: 1418339 - RNA, 20 nt, Pseudomonas aeruginosa PA01
ccuugaccagcggcccggcg

SEQ ID NO: 1418340 - RNA, 12 nt, Pseudomonas aeruginosa PA01
ccuugaccucga

SEQ ID NO: 1418341 - RNA, 17 nt, Pseudomonas aeruginosa PA01
ccuugacgaagccggcg

SEQ ID NO: 1418342 - RNA, 13 nt, Pseudomonas aeruginosa PA01
ccuugagcacguc

SEQ ID NO: 1418343 - RNA, 15 nt, Pseudomonas aeruginosa PA01
ccuugagcaggcggc

SEQ ID NO: 1418344 - RNA, 20 nt, Pseudomonas aeruginosa PA01
ccuugagcaggcggccgucc

SEQ ID NO: 1418345 - RNA, 23 nt, Pseudomonas aeruginosa PA01
ccuugagcaugauggugccgccg

SEQ ID NO: 1418346 - RNA, 22 nt, Pseudomonas aeruginosa PA01
ccuugagccaguccuggacccg

SEQ ID NO: 1418347 - RNA, 21 nt, Pseudomonas aeruginosa PA01
ccuugaggaaguugcgcagca

SEQ ID NO: 1418348 - RNA, 14 nt, Pseudomonas aeruginosa PA01
ccuugagcggcgcc

SEQ ID NO: 1418349 - RNA, 15 nt, Pseudomonas aeruginosa PA01
ccuugagcggcgccc

SEQ ID NO: 1418350 - RNA, 18 nt, Pseudomonas aeruginosa PA01
ccuugagcggcgcccugg

SEQ ID NO: 1418351 - RNA, 18 nt, Pseudomonas aeruginosa PA01
ccuugcagccagccgucg

SEQ ID NO: 1418352 - RNA, 20 nt, Pseudomonas aeruginosa PA01
ccuugcagggccgccagccg

SEQ ID NO: 1418353 - RNA, 20 nt, Pseudomonas aeruginosa PA01
ccuugauuugcccggcgagg

SEQ ID NO: 1418354 - RNA, 19 nt, Pseudomonas aeruginosa PA01
ccuugcaaccgccgccgca

SEQ ID NO: 1418355 - RNA, 21 nt, Pseudomonas aeruginosa PA01
ccuugcagcaacucgccgccg

SEQ ID NO: 1418356 - RNA, 14 nt, Pseudomonas aeruginosa PA01
ccuugcggcgcggc

SEQ ID NO: 1418357 - RNA, 15 nt, Pseudomonas aeruginosa PA01
ccuugcggcgcggcc

SEQ ID NO: 1418358 - RNA, 17 nt, Pseudomonas aeruginosa PA01
ccuugcgggaacuggcg

SEQ ID NO: 1418359 - RNA, 20 nt, Pseudomonas aeruginosa PA01
ccuugcgggaacuggcguug

SEQ ID NO: 1418360 - RNA, 13 nt, Pseudomonas aeruginosa PA01
ccuugcccgucgg

SEQ ID NO: 1418361 - RNA, 14 nt, Pseudomonas aeruginosa PA01
ccuugcccucggcg

SEQ ID NO: 1418362 - RNA, 19 nt, Pseudomonas aeruginosa PA01
ccuugcccuggccggcacc

SEQ ID NO: 1418363 - RNA, 22 nt, Pseudomonas aeruginosa PA01
ccuugcccuggccggcacccug

SEQ ID NO: 1418364 - RNA, 23 nt, Pseudomonas aeruginosa PA01
ccuugccgaggaagucggcggcc

SEQ ID NO: 1418365 - RNA, 22 nt, Pseudomonas aeruginosa PA01
ccuugcccgaggugucgccgcg

SEQ ID NO: 1418366 - RNA, 23 nt, Pseudomonas aeruginosa PA01
ccuugaucaccaccacgccgucg

SEQ ID NO: 1418367 - RNA, 14 nt, Pseudomonas aeruginosa PA01
ccuugaugccggcg

SEQ ID NO: 1418368 - RNA, 13 nt, Pseudomonas aeruginosa PA01
ccuugauggcggg

SEQ ID NO: 1418369 - RNA, 21 nt, Pseudomonas aeruginosa PA01
ccuugauggugugcagcagca

SEQ ID NO: 1418370 - RNA, 20 nt, Pseudomonas aeruginosa PA01
ccuugaggcgggccagcagg

SEQ ID NO: 1418371 - RNA, 19 nt, Pseudomonas aeruginosa PA01
ccuugaggcggguucggcg

SEQ ID NO: 1418372 - RNA, 20 nt, Pseudomonas aeruginosa PA01
ccuugagggccucggcgaag

SEQ ID NO: 1418373 - RNA, 19 nt, Pseudomonas aeruginosa PA01
ccuugagggccuuggccuc

SEQ ID NO: 1418374 - RNA, 20 nt, Pseudomonas aeruginosa PA01
ccuugaggucguuggccagg

SEQ ID NO: 1418375 - RNA, 23 nt, Pseudomonas aeruginosa PA01
ccuugaggucguuggccaggcgc

SEQ ID NO: 1418376 - RNA, 16 nt, Pseudomonas aeruginosa PA01
ccuugaguagcuggcg

SEQ ID NO: 1418377 - RNA, 20 nt, Pseudomonas aeruginosa PA01
ccuugaguagcuggcgcagg

SEQ ID NO: 1418378 - RNA, 22 nt, Pseudomonas aeruginosa PA01
ccuugaguagcuggcgcagggc

SEQ ID NO: 1418379 - RNA, 19 nt, Pseudomonas aeruginosa PA01
cgacagagcggccggcgcg

SEQ ID NO: 1418380 - RNA, 23 nt, Pseudomonas aeruginosa PA01
cgacacgugccccaggccgaacu

SEQ ID NO: 1418381 - RNA, 14 nt, Pseudomonas aeruginosa PA01
cgacaaucagcggc

SEQ ID NO: 1418382 - RNA, 18 nt, Pseudomonas aeruginosa PA01
cgacaagcauucagcgcg

SEQ ID NO: 1418383 - RNA, 17 nt, Pseudomonas aeruginosa PA01
cgacaagccuccagcgc

SEQ ID NO: 1418384 - RNA, 19 nt, Pseudomonas aeruginosa PA01
cgacaaggagacucagcgc

SEQ ID NO: 1418385 - RNA, 21 nt, Pseudomonas aeruginosa PA01
cgacaaggagcgcgagcggca

SEQ ID NO: 1418386 - RNA, 16 nt, Pseudomonas aeruginosa PA01
cgacaggcgaucgacg

SEQ ID NO: 1418387 - RNA, 18 nt, Pseudomonas aeruginosa PA01
cgacaggcgaucgacgcc

SEQ ID NO: 1418388 - RNA, 21 nt, Pseudomonas aeruginosa PA01
cgacaggccggugccgccggc

SEQ ID NO: 1418389 - RNA, 17 nt, Pseudomonas aeruginosa PA01
cgacagcauggccuugc

SEQ ID NO: 1418390 - RNA, 19 nt, Pseudomonas aeruginosa PA01
cgacagcacgauggcgagg

SEQ ID NO: 1418391 - RNA, 17 nt, Pseudomonas aeruginosa PA01
cgacaggucggccggca

SEQ ID NO: 1418392 - RNA, 19 nt, Pseudomonas aeruginosa PA01
cgacaggucggccggcagc

SEQ ID NO: 1418393 - RNA, 14 nt, Pseudomonas aeruginosa PA01
cgacaggucggcga

SEQ ID NO: 1418394 - RNA, 16 nt, Pseudomonas aeruginosa PA01
cgacagguucaggacg

SEQ ID NO: 1418395 - RNA, 17 nt, Pseudomonas aeruginosa PA01
cgacagguucaggacgc

SEQ ID NO: 1418396 - RNA, 22 nt, Pseudomonas aeruginosa PA01
cgacagguucaggacgcuccug

SEQ ID NO: 1418397 - RNA, 18 nt, Pseudomonas aeruginosa PA01
cgacaucgacgcccucgg

SEQ ID NO: 1418398 - RNA, 20 nt, Pseudomonas aeruginosa PA01
cgacaucgacgcccucggcg

SEQ ID NO: 1418399 - RNA, 16 nt, Pseudomonas aeruginosa PA01
cgacauccugucgagg

SEQ ID NO: 1418400 - RNA, 19 nt, Pseudomonas aeruginosa PA01
cgacauccugucgaggccu

SEQ ID NO: 1418401 - RNA, 21 nt, Pseudomonas aeruginosa PA01
cgaauauccucgucgauccgc

SEQ ID NO: 1418402 - RNA, 18 nt, Pseudomonas aeruginosa PA01
cgaauccagcaacaccgg

SEQ ID NO: 1418403 - RNA, 22 nt, Pseudomonas aeruginosa PA01
cgaauacccgguugccgaucag

SEQ ID NO: 1418404 - RNA, 17 nt, Pseudomonas aeruginosa PA01
cgaauaggcgaucuccg

SEQ ID NO: 1418405 - RNA, 14 nt, Pseudomonas aeruginosa PA01
cgaauagcgccgca

SEQ ID NO: 1418406 - RNA, 21 nt, Pseudomonas aeruginosa PA01
cgaauagcgccgcaggcgcua

SEQ ID NO: 1418407 - RNA, 14 nt, Pseudomonas aeruginosa PA01
cgaauagcgccgcg

SEQ ID NO: 1418408 - RNA, 23 nt, Pseudomonas aeruginosa PA01
cgaaggccuggccguugcgcagg

SEQ ID NO: 1418409 - RNA, 15 nt, Pseudomonas aeruginosa PA01
cgaaggcgaucccgu

SEQ ID NO: 1418410 - RNA, 17 nt, Pseudomonas aeruginosa PA01
cgaaggcgccuuccagg

SEQ ID NO: 1418411 - RNA, 15 nt, Pseudomonas aeruginosa PA01
cgaaggccucgucgc

SEQ ID NO: 1418412 - RNA, 17 nt, Pseudomonas aeruginosa PA01
cgaaggccucgucgccc

SEQ ID NO: 1418413 - RNA, 19 nt, Pseudomonas aeruginosa PA01
cgaagcuucuucggcagcc

SEQ ID NO: 1418414 - RNA, 13 nt, Pseudomonas aeruginosa PA01
cgaaggcgugccg

SEQ ID NO: 1418415 - RNA, 17 nt, Pseudomonas aeruginosa PA01
cgaaggcgugccgcugg

SEQ ID NO: 1418416 - RNA, 20 nt, Pseudomonas aeruginosa PA01
cgaaggcgugccgcuggccg

SEQ ID NO: 1418417 - RNA, 21 nt, Pseudomonas aeruginosa PA01
cgaaggcgugggcgccggcgc

SEQ ID NO: 1418418 - RNA, 20 nt, Pseudomonas aeruginosa PA01
cgaaggcgcgcucgaucagg

SEQ ID NO: 1418419 - RNA, 14 nt, Pseudomonas aeruginosa PA01
cgaaggcgcuccgg

SEQ ID NO: 1418420 - RNA, 19 nt, Pseudomonas aeruginosa PA01
cgaaggcggcagcggugaa

SEQ ID NO: 1418421 - RNA, 14 nt, Pseudomonas aeruginosa PA01
cgaaggcgcggcgg

SEQ ID NO: 1418422 - RNA, 21 nt, Pseudomonas aeruginosa PA01
cgaauaaccgcaucgcgguua

SEQ ID NO: 1418423 - RNA, 20 nt, Pseudomonas aeruginosa PA01
cgaauaaccgcucgcgguua

SEQ ID NO: 1418424 - RNA, 21 nt, Pseudomonas aeruginosa PA01
cgaauaaccgcugcgcgguua

SEQ ID NO: 1418425 - RNA, 20 nt, Pseudomonas aeruginosa PA01
cgaaggcuggagcgcugcgg

SEQ ID NO: 1418426 - RNA, 15 nt, Pseudomonas aeruginosa PA01
cgaaguuggcggccg

SEQ ID NO: 1418427 - RNA, 18 nt, Pseudomonas aeruginosa PA01
cgaaggcggcgcggcggg

SEQ ID NO: 1418428 - RNA, 15 nt, Pseudomonas aeruginosa PA01
cgaauccaggccgac

SEQ ID NO: 1418429 - RNA, 20 nt, Pseudomonas aeruginosa PA01
cgaaucccuuggcugcucgc

SEQ ID NO: 1418430 - RNA, 16 nt, Pseudomonas aeruginosa PA01
cgaauguccggcgacc

SEQ ID NO: 1418431 - RNA, 17 nt, Pseudomonas aeruginosa PA01
cgaauucgucgccgccg

SEQ ID NO: 1418432 - RNA, 17 nt, Pseudomonas aeruginosa PA01
cgaaccguggcggccgc

SEQ ID NO: 1418433 - RNA, 23 nt, Pseudomonas aeruginosa PA01
cgaaccguggcggccgccgcgca

SEQ ID NO: 1418434 - RNA, 20 nt, Pseudomonas aeruginosa PA01
cgaaccucgguagccggcca

SEQ ID NO: 1418435 - RNA, 15 nt, Pseudomonas aeruginosa PA01
cgaacaccaggcgcc

SEQ ID NO: 1418436 - RNA, 18 nt, Pseudomonas aeruginosa PA01
cgaacaccaggcgccagg

SEQ ID NO: 1418437 - RNA, 21 nt, Pseudomonas aeruginosa PA01
cgaacaccggcgagcaacgca

SEQ ID NO: 1418438 - RNA, 18 nt, Pseudomonas aeruginosa PA01
cgaacaccggcgccgccu

SEQ ID NO: 1418439 - RNA, 22 nt, Pseudomonas aeruginosa PA01
cgaaaugcucgugcagguagcc

SEQ ID NO: 1418440 - RNA, 14 nt, Pseudomonas aeruginosa PA01
cgaaaugcugcagg

SEQ ID NO: 1418441 - RNA, 15 nt, Pseudomonas aeruginosa PA01
cgaaauggcagaaca

SEQ ID NO: 1418442 - RNA, 23 nt, Pseudomonas aeruginosa PA01
cgaaauggguucccagcagcaac

SEQ ID NO: 1418443 - RNA, 14 nt, Pseudomonas aeruginosa PA01
cgaacacacccugc

SEQ ID NO: 1418444 - RNA, 15 nt, Pseudomonas aeruginosa PA01
cgaacacaccgaccg

SEQ ID NO: 1418445 - RNA, 14 nt, Pseudomonas aeruginosa PA01
cgaaauugccuccg

SEQ ID NO: 1418446 - RNA, 17 nt, Pseudomonas aeruginosa PA01
cgaacaaccgcucgcgg

SEQ ID NO: 1418447 - RNA, 18 nt, Pseudomonas aeruginosa PA01
cgaacgcucccagccgac

SEQ ID NO: 1418448 - RNA, 15 nt, Pseudomonas aeruginosa PA01
cgaacgaagcgcccu

SEQ ID NO: 1418449 - RNA, 18 nt, Pseudomonas aeruginosa PA01
cgaacgaagcgcccucgc

SEQ ID NO: 1418450 - RNA, 14 nt, Pseudomonas aeruginosa PA01
cgaacggaccgacg

SEQ ID NO: 1418451 - RNA, 23 nt, Pseudomonas aeruginosa PA01
cgaacgcuugagccccggcaggc

SEQ ID NO: 1418452 - RNA, 21 nt, Pseudomonas aeruginosa PA01
cgaacucaugcccagcuuggc

SEQ ID NO: 1418453 - RNA, 14 nt, Pseudomonas aeruginosa PA01
cgaacuccgccagc

SEQ ID NO: 1418454 - RNA, 17 nt, Pseudomonas aeruginosa PA01
cgaacucgaaggccagc

SEQ ID NO: 1418455 - RNA, 18 nt, Pseudomonas aeruginosa PA01
cgaacucgacgcgccagg

SEQ ID NO: 1418456 - RNA, 16 nt, Pseudomonas aeruginosa PA01
cgaacucuggcggcgu

SEQ ID NO: 1418457 - RNA, 13 nt, Pseudomonas aeruginosa PA01
cgaacgugcgcgc

SEQ ID NO: 1418458 - RNA, 17 nt, Pseudomonas aeruginosa PA01
cgaacucacggaugccg

SEQ ID NO: 1418459 - RNA, 20 nt, Pseudomonas aeruginosa PA01
cgaacucacggaugccgggc

SEQ ID NO: 1418460 - RNA, 15 nt, Pseudomonas aeruginosa PA01
cgaagcggcuggccg

SEQ ID NO: 1418461 - RNA, 13 nt, Pseudomonas aeruginosa PA01
cgaagcggcucgg

SEQ ID NO: 1418462 - RNA, 15 nt, Pseudomonas aeruginosa PA01
cgaagcggcucggcc

SEQ ID NO: 1418463 - RNA, 17 nt, Pseudomonas aeruginosa PA01
cgaagcggcucggccag

SEQ ID NO: 1418464 - RNA, 18 nt, Pseudomonas aeruginosa PA01
cgaagcggcucggccagg

SEQ ID NO: 1418465 - RNA, 20 nt, Pseudomonas aeruginosa PA01
cgaagcggaucucgucgccg

SEQ ID NO: 1418466 - RNA, 14 nt, Pseudomonas aeruginosa PA01
cgaagcggucgccg

SEQ ID NO: 1418467 - RNA, 13 nt, Pseudomonas aeruginosa PA01
cgaagcgucgaug

SEQ ID NO: 1418468 - RNA, 18 nt, Pseudomonas aeruginosa PA01
cgaagcgugggcggccgg

SEQ ID NO: 1418469 - RNA, 20 nt, Pseudomonas aeruginosa PA01
cgaagcgugggcggccggcc

SEQ ID NO: 1418470 - RNA, 21 nt, Pseudomonas aeruginosa PA01
cgaagcgugggcggccggcca

SEQ ID NO: 1418471 - RNA, 22 nt, Pseudomonas aeruginosa PA01
cgaagcgugggcggccggccag

SEQ ID NO: 1418472 - RNA, 16 nt, Pseudomonas aeruginosa PA01
cgaagcgcucggucag

SEQ ID NO: 1418473 - RNA, 21 nt, Pseudomonas aeruginosa PA01
cgaagcgcucggucagcuccc

SEQ ID NO: 1418474 - RNA, 17 nt, Pseudomonas aeruginosa PA01
cgaagcgcuugcccagg

SEQ ID NO: 1418475 - RNA, 18 nt, Pseudomonas aeruginosa PA01
cgaagcggaagcgcagcc

SEQ ID NO: 1418476 - RNA, 14 nt, Pseudomonas aeruginosa PA01
cgaagcgcgccugc

SEQ ID NO: 1418477 - RNA, 12 nt, Pseudomonas aeruginosa PA01
cgaagcgccagg

SEQ ID NO: 1418478 - RNA, 12 nt, Pseudomonas aeruginosa PA01
cgaagcgcgccu

SEQ ID NO: 1418479 - RNA, 21 nt, Pseudomonas aeruginosa PA01
cgaagcgauuccaugggcaga

SEQ ID NO: 1418480 - RNA, 14 nt, Pseudomonas aeruginosa PA01
cgaagcgcagcagg

SEQ ID NO: 1418481 - RNA, 16 nt, Pseudomonas aeruginosa PA01
cgaagcgcagcagguc

SEQ ID NO: 1418482 - RNA, 14 nt, Pseudomonas aeruginosa PA01
cgaagcugucgagc

SEQ ID NO: 1418483 - RNA, 19 nt, Pseudomonas aeruginosa PA01
cgaagcuguuggccaacca

SEQ ID NO: 1418484 - RNA, 21 nt, Pseudomonas aeruginosa PA01
cgaagcuguuggccaaccagg

SEQ ID NO: 1418485 - RNA, 12 nt, Pseudomonas aeruginosa PA01
cgaagcugucgg

SEQ ID NO: 1418486 - RNA, 16 nt, Pseudomonas aeruginosa PA01
cgaagcugucggcccg

SEQ ID NO: 1418487 - RNA, 16 nt, Pseudomonas aeruginosa PA01
cgaagcuccagcgugc

SEQ ID NO: 1418488 - RNA, 13 nt, Pseudomonas aeruginosa PA01
cgaagcucggcgc

SEQ ID NO: 1418489 - RNA, 16 nt, Pseudomonas aeruginosa PA01
cgaagcucucgccgcg

SEQ ID NO: 1418490 - RNA, 17 nt, Pseudomonas aeruginosa PA01
cgaagcucucgccgcgc

SEQ ID NO: 1418491 - RNA, 18 nt, Pseudomonas aeruginosa PA01
cgaagcucucgccgcgcu

SEQ ID NO: 1418492 - RNA, 19 nt, Pseudomonas aeruginosa PA01
cgaagcucucgccgcgcuc

SEQ ID NO: 1418493 - RNA, 15 nt, Pseudomonas aeruginosa PA01
cgaaggacaggccgu

SEQ ID NO: 1418494 - RNA, 20 nt, Pseudomonas aeruginosa PA01
cgaaggacaggucgcggaag

SEQ ID NO: 1418495 - RNA, 16 nt, Pseudomonas aeruginosa PA01
cgaaggcaacagcccg

SEQ ID NO: 1418496 - RNA, 16 nt, Pseudomonas aeruginosa PA01
cgaaggaucggggaag

SEQ ID NO: 1418497 - RNA, 14 nt, Pseudomonas aeruginosa PA01
cgaaggcaaugccg

SEQ ID NO: 1418498 - RNA, 16 nt, Pseudomonas aeruginosa PA01
cgaaggcaaugccgcc

SEQ ID NO: 1418499 - RNA, 14 nt, Pseudomonas aeruginosa PA01
cgaaggccagcucg

SEQ ID NO: 1418500 - RNA, 14 nt, Pseudomonas aeruginosa PA01
cgaaggccaggccg

SEQ ID NO: 1418501 - RNA, 15 nt, Pseudomonas aeruginosa PA01
cgaaggccaggccgg

SEQ ID NO: 1418502 - RNA, 12 nt, Pseudomonas aeruginosa PA01
cgaaggccacca

SEQ ID NO: 1418503 - RNA, 15 nt, Pseudomonas aeruginosa PA01
cgaaggccaccaucg

SEQ ID NO: 1418504 - RNA, 23 nt, Pseudomonas aeruginosa PA01
cgaaggccaccaucgcggcgaug

SEQ ID NO: 1418505 - RNA, 16 nt, Pseudomonas aeruginosa PA01
cgaaggccacgccgac

SEQ ID NO: 1418506 - RNA, 20 nt, Pseudomonas aeruginosa PA01
cgaagccguuguagaucggc

SEQ ID NO: 1418507 - RNA, 22 nt, Pseudomonas aeruginosa PA01
cgaagccguuguagaucggcag

SEQ ID NO: 1418508 - RNA, 23 nt, Pseudomonas aeruginosa PA01
cgaagccguuguagaucggcagc

SEQ ID NO: 1418509 - RNA, 12 nt, Pseudomonas aeruginosa PA01
cgaagccggcgg

SEQ ID NO: 1418510 - RNA, 18 nt, Pseudomonas aeruginosa PA01
cgaagccggcggcgcggc

SEQ ID NO: 1418511 - RNA, 21 nt, Pseudomonas aeruginosa PA01
cgaagccggcggcgcggcagu

SEQ ID NO: 1418512 - RNA, 23 nt, Pseudomonas aeruginosa PA01
cgaagccggcacgguagccgccc

SEQ ID NO: 1418513 - RNA, 18 nt, Pseudomonas aeruginosa PA01
cgaagccggauucgcgca

SEQ ID NO: 1418514 - RNA, 20 nt, Pseudomonas aeruginosa PA01
cgaagccggauucgcgcagc

SEQ ID NO: 1418515 - RNA, 23 nt, Pseudomonas aeruginosa PA01
cgaagccggauucgcgcagcagg

SEQ ID NO: 1418516 - RNA, 14 nt, Pseudomonas aeruginosa PA01
cgaagccggcgaug

SEQ ID NO: 1418517 - RNA, 23 nt, Pseudomonas aeruginosa PA01
cgaagccgccgggaaucuggccg

SEQ ID NO: 1418518 - RNA, 19 nt, Pseudomonas aeruginosa PA01
cgaagccgccgccgagaac

SEQ ID NO: 1418519 - RNA, 13 nt, Pseudomonas aeruginosa PA01
cgaagccgccguu

SEQ ID NO: 1418520 - RNA, 12 nt, Pseudomonas aeruginosa PA01
cgaagccgcgca

SEQ ID NO: 1418521 - RNA, 15 nt, Pseudomonas aeruginosa PA01
cgaagccgcgcccgg

SEQ ID NO: 1418522 - RNA, 19 nt, Pseudomonas aeruginosa PA01
cgaagccgcuggcauucca

SEQ ID NO: 1418523 - RNA, 13 nt, Pseudomonas aeruginosa PA01
cgaagccgccgcc

SEQ ID NO: 1418524 - RNA, 18 nt, Pseudomonas aeruginosa PA01
cgaagccgacgccgagca

SEQ ID NO: 1418525 - RNA, 20 nt, Pseudomonas aeruginosa PA01
cgaagccgacgccgagcagc

SEQ ID NO: 1418526 - RNA, 19 nt, Pseudomonas aeruginosa PA01
cgaagcccugcaaagcggc

SEQ ID NO: 1418527 - RNA, 16 nt, Pseudomonas aeruginosa PA01
cgaagcccagcgccug

SEQ ID NO: 1418528 - RNA, 17 nt, Pseudomonas aeruginosa PA01
cgaagcccagcgccugc

SEQ ID NO: 1418529 - RNA, 23 nt, Pseudomonas aeruginosa PA01
cgaagcccaucgacugcaacaga

SEQ ID NO: 1418530 - RNA, 14 nt, Pseudomonas aeruginosa PA01
cgaagaccggccgg

SEQ ID NO: 1418531 - RNA, 18 nt, Pseudomonas aeruginosa PA01
cgaagacccccugccgcc

SEQ ID NO: 1418532 - RNA, 20 nt, Pseudomonas aeruginosa PA01
cgaagacccccugccgcccu

SEQ ID NO: 1418533 - RNA, 20 nt, Pseudomonas aeruginosa PA01
cgaagacccccugcggcccg

SEQ ID NO: 1418534 - RNA, 13 nt, Pseudomonas aeruginosa PA01
cgaacugaccacc

SEQ ID NO: 1418535 - RNA, 16 nt, Pseudomonas aeruginosa PA01
cgaagaacucggcgcu

SEQ ID NO: 1418536 - RNA, 17 nt, Pseudomonas aeruginosa PA01
cgaagaaggcucaccgg

SEQ ID NO: 1418537 - RNA, 12 nt, Pseudomonas aeruginosa PA01
ccgcgaguucgc

SEQ ID NO: 1418538 - RNA, 15 nt, Pseudomonas aeruginosa PA01
ccgcgaguucgccgg

SEQ ID NO: 1418539 - RNA, 19 nt, Pseudomonas aeruginosa PA01
ccgcgagaccccggcggcg

SEQ ID NO: 1418540 - RNA, 22 nt, Pseudomonas aeruginosa PA01
ccgcgagguccggcuccggcug

SEQ ID NO: 1418541 - RNA, 18 nt, Pseudomonas aeruginosa PA01
ccgcgaguccuucggcgc

SEQ ID NO: 1418542 - RNA, 19 nt, Pseudomonas aeruginosa PA01
ccgcgaguccuucggcgca

SEQ ID NO: 1418543 - RNA, 20 nt, Pseudomonas aeruginosa PA01
ccgcgagguggaugaacagc

SEQ ID NO: 1418544 - RNA, 22 nt, Pseudomonas aeruginosa PA01
ccgcgagguggaugaacagcgg

SEQ ID NO: 1418545 - RNA, 16 nt, Pseudomonas aeruginosa PA01
ccgcgacucggcugca

SEQ ID NO: 1418546 - RNA, 21 nt, Pseudomonas aeruginosa PA01
ccgcgauauucgcccuacgaa

SEQ ID NO: 1418547 - RNA, 23 nt, Pseudomonas aeruginosa PA01
ccgcgauauucgcccuacgaaag

SEQ ID NO: 1418548 - RNA, 17 nt, Pseudomonas aeruginosa PA01
ccgcgauaucacgcccc

SEQ ID NO: 1418549 - RNA, 17 nt, Pseudomonas aeruginosa PA01
ccgcgaccacaggcggc

SEQ ID NO: 1418550 - RNA, 19 nt, Pseudomonas aeruginosa PA01
ccgcgaccacaggcggcgg

SEQ ID NO: 1418551 - RNA, 14 nt, Pseudomonas aeruginosa PA01
ccgcgacaacccug

SEQ ID NO: 1418552 - RNA, 14 nt, Pseudomonas aeruginosa PA01
ccgcgacaguucgc

SEQ ID NO: 1418553 - RNA, 15 nt, Pseudomonas aeruginosa PA01
ccgcgacaguucgcc

SEQ ID NO: 1418554 - RNA, 16 nt, Pseudomonas aeruginosa PA01
ccgcgcauaggaggcg

SEQ ID NO: 1418555 - RNA, 20 nt, Pseudomonas aeruginosa PA01
ccgcgcaugaaaaagccgcc

SEQ ID NO: 1418556 - RNA, 19 nt, Pseudomonas aeruginosa PA01
ccgcgcauggcggcgaccg

SEQ ID NO: 1418557 - RNA, 17 nt, Pseudomonas aeruginosa PA01
ccgcgccaaaaagcagg

SEQ ID NO: 1418558 - RNA, 18 nt, Pseudomonas aeruginosa PA01
ccgcgccaaaaagcagga

SEQ ID NO: 1418559 - RNA, 21 nt, Pseudomonas aeruginosa PA01
ccgcgccacgcagugggaagc

SEQ ID NO: 1418560 - RNA, 14 nt, Pseudomonas aeruginosa PA01
ccgcgccgaccagc

SEQ ID NO: 1418561 - RNA, 19 nt, Pseudomonas aeruginosa PA01
ccgcgccgaccagccgcag

SEQ ID NO: 1418562 - RNA, 15 nt, Pseudomonas aeruginosa PA01
ccgcgccacgcgcau

SEQ ID NO: 1418563 - RNA, 23 nt, Pseudomonas aeruginosa PA01
ccgcgccacgcucuccgucaaug

SEQ ID NO: 1418564 - RNA, 16 nt, Pseudomonas aeruginosa PA01
ccgcgcauccucggca

SEQ ID NO: 1418565 - RNA, 15 nt, Pseudomonas aeruginosa PA01
ccgcgcauggagacg

SEQ ID NO: 1418566 - RNA, 18 nt, Pseudomonas aeruginosa PA01
ccgcgcauggagacggcc

SEQ ID NO: 1418567 - RNA, 23 nt, Pseudomonas aeruginosa PA01
ccgcgcauggagacggcccgccc

SEQ ID NO: 1418568 - RNA, 19 nt, Pseudomonas aeruginosa PA01
ccgcgcagguucaucgccg

SEQ ID NO: 1418569 - RNA, 20 nt, Pseudomonas aeruginosa PA01
ccgcgcagguucaucgccgc

SEQ ID NO: 1418570 - RNA, 16 nt, Pseudomonas aeruginosa PA01
ccgcgcagucccgcgc

SEQ ID NO: 1418571 - RNA, 17 nt, Pseudomonas aeruginosa PA01
ccgcgcagucccgcgcg

SEQ ID NO: 1418572 - RNA, 20 nt, Pseudomonas aeruginosa PA01
ccgcgcagucccgcgcggcc

SEQ ID NO: 1418573 - RNA, 19 nt, Pseudomonas aeruginosa PA01
ccgcgcaggcggucgccga

SEQ ID NO: 1418574 - RNA, 22 nt, Pseudomonas aeruginosa PA01
ccgcgcagcuugccuuccaggc

SEQ ID NO: 1418575 - RNA, 21 nt, Pseudomonas aeruginosa PA01
ccgcgcaggaagaaggcgucc

SEQ ID NO: 1418576 - RNA, 22 nt, Pseudomonas aeruginosa PA01
ccgcgcaggaccacgcugguca

SEQ ID NO: 1418577 - RNA, 12 nt, Pseudomonas aeruginosa PA01
ccgcgcagcgcg

SEQ ID NO: 1418578 - RNA, 13 nt, Pseudomonas aeruginosa PA01
ccgcgcagcgcgg

SEQ ID NO: 1418579 - RNA, 21 nt, Pseudomonas aeruginosa PA01
ccgcgauugcagcuccugguc

SEQ ID NO: 1418580 - RNA, 22 nt, Pseudomonas aeruginosa PA01
ccgcgcaagcucgucacccgcg

SEQ ID NO: 1418581 - RNA, 22 nt, Pseudomonas aeruginosa PA01
ccgcgcagcaguaccuggcggu

SEQ ID NO: 1418582 - RNA, 15 nt, Pseudomonas aeruginosa PA01
ccgcgauggcucgcg

SEQ ID NO: 1418583 - RNA, 19 nt, Pseudomonas aeruginosa PA01
ccgcgauggcucgcggcgc

SEQ ID NO: 1418584 - RNA, 21 nt, Pseudomonas aeruginosa PA01
ccgcgaugcguuccagggcga

SEQ ID NO: 1418585 - RNA, 13 nt, Pseudomonas aeruginosa PA01
ccgcgauucgccg

SEQ ID NO: 1418586 - RNA, 15 nt, Pseudomonas aeruginosa PA01
ccgcgauucgccggg

SEQ ID NO: 1418587 - RNA, 16 nt, Pseudomonas aeruginosa PA01
ccgcgauucgccgggc

SEQ ID NO: 1418588 - RNA, 18 nt, Pseudomonas aeruginosa PA01
ccgcgauucgccgggcuc

SEQ ID NO: 1418589 - RNA, 20 nt, Pseudomonas aeruginosa PA01
ccgccuuguucgccagcacc

SEQ ID NO: 1418590 - RNA, 18 nt, Pseudomonas aeruginosa PA01
ccgccuuucugcccggcu

SEQ ID NO: 1418591 - RNA, 16 nt, Pseudomonas aeruginosa PA01
ccgccugcgucagcga

SEQ ID NO: 1418592 - RNA, 13 nt, Pseudomonas aeruginosa PA01
ccgccugcucggc

SEQ ID NO: 1418593 - RNA, 18 nt, Pseudomonas aeruginosa PA01
ccgccugcgccucggccc

SEQ ID NO: 1418594 - RNA, 20 nt, Pseudomonas aeruginosa PA01
ccgcgaacacacccugcgca

SEQ ID NO: 1418595 - RNA, 22 nt, Pseudomonas aeruginosa PA01
ccgcgaacacacccugcgcaag

SEQ ID NO: 1418596 - RNA, 14 nt, Pseudomonas aeruginosa PA01
ccgcgaaccgcugg

SEQ ID NO: 1418597 - RNA, 18 nt, Pseudomonas aeruginosa PA01
ccgcgaaccgggucguca

SEQ ID NO: 1418598 - RNA, 19 nt, Pseudomonas aeruginosa PA01
ccgccuuuuuugugcccgg

SEQ ID NO: 1418599 - RNA, 15 nt, Pseudomonas aeruginosa PA01
ccgcgaauagggcgg

SEQ ID NO: 1418600 - RNA, 20 nt, Pseudomonas aeruginosa PA01
ccgcgaauagggcggcgcca

SEQ ID NO: 1418601 - RNA, 17 nt, Pseudomonas aeruginosa PA01
ccgcgaauggcagcagg

SEQ ID NO: 1418602 - RNA, 18 nt, Pseudomonas aeruginosa PA01
ccgcgaauggcagcaggc

SEQ ID NO: 1418603 - RNA, 16 nt, Pseudomonas aeruginosa PA01
ccgcgaaugcuccggg

SEQ ID NO: 1418604 - RNA, 19 nt, Pseudomonas aeruginosa PA01
ccgcgaagcccagcgccgc

SEQ ID NO: 1418605 - RNA, 17 nt, Pseudomonas aeruginosa PA01
ccgccgguucgcaggcc

SEQ ID NO: 1418606 - RNA, 18 nt, Pseudomonas aeruginosa PA01
ccgccgguucgcaggcca

SEQ ID NO: 1418607 - RNA, 20 nt, Pseudomonas aeruginosa PA01
ccgccgguucgcaggccagg

SEQ ID NO: 1418608 - RNA, 19 nt, Pseudomonas aeruginosa PA01
ccgccguagaguucggcug

SEQ ID NO: 1418609 - RNA, 14 nt, Pseudomonas aeruginosa PA01
ccgccucgucgcca

SEQ ID NO: 1418610 - RNA, 14 nt, Pseudomonas aeruginosa PA01
ccgccucgugcagc

SEQ ID NO: 1418611 - RNA, 18 nt, Pseudomonas aeruginosa PA01
ccgccucgugcagcaagc

SEQ ID NO: 1418612 - RNA, 16 nt, Pseudomonas aeruginosa PA01
ccgccucuaugaaccg

SEQ ID NO: 1418613 - RNA, 21 nt, Pseudomonas aeruginosa PA01
ccgccugcagcaccaccucgc

SEQ ID NO: 1418614 - RNA, 23 nt, Pseudomonas aeruginosa PA01
ccgccugcagcaccaccucgcca

SEQ ID NO: 1418615 - RNA, 16 nt, Pseudomonas aeruginosa PA01
ccgccugcaacucguc

SEQ ID NO: 1418616 - RNA, 18 nt, Pseudomonas aeruginosa PA01
ccgccguuguagcggaug

SEQ ID NO: 1418617 - RNA, 22 nt, Pseudomonas aeruginosa PA01
ccgccuaccggggcgcgggcga

SEQ ID NO: 1418618 - RNA, 21 nt, Pseudomonas aeruginosa PA01
ccgccuauccacgacgucggc

SEQ ID NO: 1418619 - RNA, 23 nt, Pseudomonas aeruginosa PA01
ccgccuauccgugacgucggcgg

SEQ ID NO: 1418620 - RNA, 20 nt, Pseudomonas aeruginosa PA01
ccgccucaccccacgggcga

SEQ ID NO: 1418621 - RNA, 15 nt, Pseudomonas aeruginosa PA01
ccgccgaccgggcgg

SEQ ID NO: 1418622 - RNA, 17 nt, Pseudomonas aeruginosa PA01
ccgccgaccucggccgc

SEQ ID NO: 1418623 - RNA, 21 nt, Pseudomonas aeruginosa PA01
ccgccgaccucggccgccagg

SEQ ID NO: 1418624 - RNA, 14 nt, Pseudomonas aeruginosa PA01
ccgccgacgccgga

SEQ ID NO: 1418625 - RNA, 15 nt, Pseudomonas aeruginosa PA01
ccgccgacgccggac

SEQ ID NO: 1418626 - RNA, 16 nt, Pseudomonas aeruginosa PA01
ccgccgagcaggccca

SEQ ID NO: 1418627 - RNA, 22 nt, Pseudomonas aeruginosa PA01
ccgccgagcaugcgggcgaucu

SEQ ID NO: 1418628 - RNA, 23 nt, Pseudomonas aeruginosa PA01
ccgccgagacuccggagaaccgg

SEQ ID NO: 1418629 - RNA, 17 nt, Pseudomonas aeruginosa PA01
ccgccgagaacccggcc

SEQ ID NO: 1418630 - RNA, 20 nt, Pseudomonas aeruginosa PA01
ccgccgagaacccggccagg

SEQ ID NO: 1418631 - RNA, 15 nt, Pseudomonas aeruginosa PA01
ccgccgacugcaacu

SEQ ID NO: 1418632 - RNA, 17 nt, Pseudomonas aeruginosa PA01
ccgccgacugcaacugg

SEQ ID NO: 1418633 - RNA, 21 nt, Pseudomonas aeruginosa PA01
ccgccgacugcaacuggccga

SEQ ID NO: 1418634 - RNA, 23 nt, Pseudomonas aeruginosa PA01
ccgccgacuggcagcgauaaccg

SEQ ID NO: 1418635 - RNA, 17 nt, Pseudomonas aeruginosa PA01
ccgcccggucuagcgcc

SEQ ID NO: 1418636 - RNA, 14 nt, Pseudomonas aeruginosa PA01
ccgcccgucgcgcc

SEQ ID NO: 1418637 - RNA, 12 nt, Pseudomonas aeruginosa PA01
ccgcccgucaug

SEQ ID NO: 1418638 - RNA, 18 nt, Pseudomonas aeruginosa PA01
ccgcccgucaugaccaga

SEQ ID NO: 1418639 - RNA, 13 nt, Pseudomonas aeruginosa PA01
ccgccaucgcccg

SEQ ID NO: 1418640 - RNA, 21 nt, Pseudomonas aeruginosa PA01
ccgccaucgauggucaggcug

SEQ ID NO: 1418641 - RNA, 21 nt, Pseudomonas aeruginosa PA01
ccgccaucaccagcggcgagc

SEQ ID NO: 1418642 - RNA, 15 nt, Pseudomonas aeruginosa PA01
ccgccaucgaccagg

SEQ ID NO: 1418643 - RNA, 19 nt, Pseudomonas aeruginosa PA01
ccgccaucgacguagagga

SEQ ID NO: 1418644 - RNA, 14 nt, Pseudomonas aeruginosa PA01
ccgccgcagccgug

SEQ ID NO: 1418645 - RNA, 18 nt, Pseudomonas aeruginosa PA01
ccgccgcagccguggcgc

SEQ ID NO: 1418646 - RNA, 20 nt, Pseudomonas aeruginosa PA01
ccgccgcagccguggcgcga

SEQ ID NO: 1418647 - RNA, 17 nt, Pseudomonas aeruginosa PA01
ccgccgcaggucggcgu

SEQ ID NO: 1418648 - RNA, 13 nt, Pseudomonas aeruginosa PA01
ccgccgccgccgu

SEQ ID NO: 1418649 - RNA, 13 nt, Pseudomonas aeruginosa PA01
ccgccgccgacgu

SEQ ID NO: 1418650 - RNA, 16 nt, Pseudomonas aeruginosa PA01
ccgccgccgcaaccgc

SEQ ID NO: 1418651 - RNA, 12 nt, Pseudomonas aeruginosa PA01
ccgccgccgggc

SEQ ID NO: 1418652 - RNA, 10 nt, Pseudomonas aeruginosa PA01
ccgccgccgg

SEQ ID NO: 1418653 - RNA, 15 nt, Pseudomonas aeruginosa PA01
ccgccgccgcggcgc

SEQ ID NO: 1418654 - RNA, 13 nt, Pseudomonas aeruginosa PA01
ccgccgccgcgcc

SEQ ID NO: 1418655 - RNA, 20 nt, Pseudomonas aeruginosa PA01
ccgccgccuggguggcgacg

SEQ ID NO: 1418656 - RNA, 14 nt, Pseudomonas aeruginosa PA01
ccgccgccuaucca

SEQ ID NO: 1418657 - RNA, 14 nt, Pseudomonas aeruginosa PA01
ccgccgccuauccg

SEQ ID NO: 1418658 - RNA, 16 nt, Pseudomonas aeruginosa PA01
ccgccgccgggcuucg

SEQ ID NO: 1418659 - RNA, 14 nt, Pseudomonas aeruginosa PA01
ccgccgccggggcg

SEQ ID NO: 1418660 - RNA, 13 nt, Pseudomonas aeruginosa PA01
ccgccgccggccu

SEQ ID NO: 1418661 - RNA, 18 nt, Pseudomonas aeruginosa PA01
ccgccgcagagccagccg

SEQ ID NO: 1418662 - RNA, 20 nt, Pseudomonas aeruginosa PA01
ccgccgcagagccagccgca

SEQ ID NO: 1418663 - RNA, 15 nt, Pseudomonas aeruginosa PA01
ccgccgcagaccagc

SEQ ID NO: 1418664 - RNA, 20 nt, Pseudomonas aeruginosa PA01
ccgccgaggucaguucggug

SEQ ID NO: 1418665 - RNA, 14 nt, Pseudomonas aeruginosa PA01
ccgccgagggcgcc

SEQ ID NO: 1418666 - RNA, 15 nt, Pseudomonas aeruginosa PA01
ccgccgagggcgcca

SEQ ID NO: 1418667 - RNA, 21 nt, Pseudomonas aeruginosa PA01
ccgccgagggcgccaggugca

SEQ ID NO: 1418668 - RNA, 18 nt, Pseudomonas aeruginosa PA01
ccgccgaggugcugcacc

SEQ ID NO: 1418669 - RNA, 20 nt, Pseudomonas aeruginosa PA01
ccgccgaggugcugcaccgg

SEQ ID NO: 1418670 - RNA, 19 nt, Pseudomonas aeruginosa PA01
ccgccgagugugccggcca

SEQ ID NO: 1418671 - RNA, 16 nt, Pseudomonas aeruginosa PA01
ccgccgaggaagccga

SEQ ID NO: 1418672 - RNA, 20 nt, Pseudomonas aeruginosa PA01
ccgccgaggcgcgccacgca

SEQ ID NO: 1418673 - RNA, 11 nt, Pseudomonas aeruginosa PA01
ccgccgagggc

SEQ ID NO: 1418674 - RNA, 15 nt, Pseudomonas aeruginosa PA01
ccgccgagggcaccg

SEQ ID NO: 1418675 - RNA, 21 nt, Pseudomonas aeruginosa PA01
ccgccgagggcaccgacgaug

SEQ ID NO: 1418676 - RNA, 22 nt, Pseudomonas aeruginosa PA01
ccgccgaggaggaucucgcgcc

SEQ ID NO: 1418677 - RNA, 15 nt, Pseudomonas aeruginosa PA01
ccgccgaggauagcg

SEQ ID NO: 1418678 - RNA, 23 nt, Pseudomonas aeruginosa PA01
ccgccgaggauagcguccagcuc

SEQ ID NO: 1418679 - RNA, 19 nt, Pseudomonas aeruginosa PA01
ccgccgcgagcgccgccgg

SEQ ID NO: 1418680 - RNA, 14 nt, Pseudomonas aeruginosa PA01
ccgccgcgugcgcg

SEQ ID NO: 1418681 - RNA, 16 nt, Pseudomonas aeruginosa PA01
ccgccgcgugcgcgcc

SEQ ID NO: 1418682 - RNA, 17 nt, Pseudomonas aeruginosa PA01
ccgccgcgugccgccgg

SEQ ID NO: 1418683 - RNA, 18 nt, Pseudomonas aeruginosa PA01
ccgccgcgugccgccgga

SEQ ID NO: 1418684 - RNA, 20 nt, Pseudomonas aeruginosa PA01
ccgccgcgucgucggcgacg

SEQ ID NO: 1418685 - RNA, 13 nt, Pseudomonas aeruginosa PA01
ccgccgcgcccgg

SEQ ID NO: 1418686 - RNA, 14 nt, Pseudomonas aeruginosa PA01
ccgccgcgcaggcg

SEQ ID NO: 1418687 - RNA, 15 nt, Pseudomonas aeruginosa PA01
ccgccgcgcaggcgg

SEQ ID NO: 1418688 - RNA, 18 nt, Pseudomonas aeruginosa PA01
ccgccgcgcaucaccccg

SEQ ID NO: 1418689 - RNA, 19 nt, Pseudomonas aeruginosa PA01
ccgccgcgucgaagcuguc

SEQ ID NO: 1418690 - RNA, 15 nt, Pseudomonas aeruginosa PA01
ccgccggccaccagc

SEQ ID NO: 1418691 - RNA, 19 nt, Pseudomonas aeruginosa PA01
ccgccggccaccagcagca

SEQ ID NO: 1418692 - RNA, 23 nt, Pseudomonas aeruginosa PA01
ccgccggccaccagcagcaacgg

SEQ ID NO: 1418693 - RNA, 16 nt, Pseudomonas aeruginosa PA01
ccgccggccagccgcg

SEQ ID NO: 1418694 - RNA, 20 nt, Pseudomonas aeruginosa PA01
ccgccggccagccgcgccag

SEQ ID NO: 1418695 - RNA, 20 nt, Pseudomonas aeruginosa PA01
ccgccgcugaucaguaccgg

SEQ ID NO: 1418696 - RNA, 15 nt, Pseudomonas aeruginosa PA01
ccgccgcugcaccga

SEQ ID NO: 1418697 - RNA, 18 nt, Pseudomonas aeruginosa PA01
ccgccgcugcaccgaacg

SEQ ID NO: 1418698 - RNA, 15 nt, Pseudomonas aeruginosa PA01
ccgccgcuccggcug

SEQ ID NO: 1418699 - RNA, 19 nt, Pseudomonas aeruginosa PA01
ccgccgcuccggcugcgcg

SEQ ID NO: 1418700 - RNA, 16 nt, Pseudomonas aeruginosa PA01
ccgccgcuaucgccgc

SEQ ID NO: 1418701 - RNA, 22 nt, Pseudomonas aeruginosa PA01
ccgccgcuaucgccgccgcagc

SEQ ID NO: 1418702 - RNA, 23 nt, Pseudomonas aeruginosa PA01
ccgccgcgugggcuucgccgccg

SEQ ID NO: 1418703 - RNA, 24 nt, Pseudomonas aeruginosa PA01
ccgccgcgugggcuucgccgccgc

SEQ ID NO: 1418704 - RNA, 18 nt, Pseudomonas aeruginosa PA01
ccgccgcucugcuggccg

SEQ ID NO: 1418705 - RNA, 19 nt, Pseudomonas aeruginosa PA01
ccgccgcucugcuggccgc

SEQ ID NO: 1418706 - RNA, 22 nt, Pseudomonas aeruginosa PA01
ccgccgcucugcuggccgcccu

SEQ ID NO: 1418707 - RNA, 17 nt, Pseudomonas aeruginosa PA01
ccgccggcgccgccggg

SEQ ID NO: 1418708 - RNA, 15 nt, Pseudomonas aeruginosa PA01
ccgccggcgccgccu

SEQ ID NO: 1418709 - RNA, 21 nt, Pseudomonas aeruginosa PA01
ccgccggcgccgccucgggca

SEQ ID NO: 1418710 - RNA, 14 nt, Pseudomonas aeruginosa PA01
ccgccggcgcccug

SEQ ID NO: 1418711 - RNA, 15 nt, Pseudomonas aeruginosa PA01
ccgccggcgcccugc

SEQ ID NO: 1418712 - RNA, 19 nt, Pseudomonas aeruginosa PA01
ccgccggcgcccugggcgc

SEQ ID NO: 1418713 - RNA, 16 nt, Pseudomonas aeruginosa PA01
ccgccggcgcgcccag

SEQ ID NO: 1418714 - RNA, 19 nt, Pseudomonas aeruginosa PA01
ccgccggcgcgcccaggcc

SEQ ID NO: 1418715 - RNA, 22 nt, Pseudomonas aeruginosa PA01
ccgccggcgcgucccugggcgc

SEQ ID NO: 1418716 - RNA, 23 nt, Pseudomonas aeruginosa PA01
ccgccggcgcgucccugggcgca

SEQ ID NO: 1418717 - RNA, 17 nt, Pseudomonas aeruginosa PA01
ccgccgggcgcgcgccu

SEQ ID NO: 1418718 - RNA, 19 nt, Pseudomonas aeruginosa PA01
ccgccgggcgcccggccgg

SEQ ID NO: 1418719 - RNA, 16 nt, Pseudomonas aeruginosa PA01
ccgccgggcggcgucg

SEQ ID NO: 1418720 - RNA, 20 nt, Pseudomonas aeruginosa PA01
ccgccgggcggcgucgcgga

SEQ ID NO: 1418721 - RNA, 15 nt, Pseudomonas aeruginosa PA01
ccgccggcggcgaug

SEQ ID NO: 1418722 - RNA, 19 nt, Pseudomonas aeruginosa PA01
ccgccggcggccagggcgu

SEQ ID NO: 1418723 - RNA, 17 nt, Pseudomonas aeruginosa PA01
ccgccggguccaccgcg

SEQ ID NO: 1418724 - RNA, 13 nt, Pseudomonas aeruginosa PA01
ccgccgggcuucg

SEQ ID NO: 1418725 - RNA, 23 nt, Pseudomonas aeruginosa PA01
ccgccgggcuucgguguaucggc

SEQ ID NO: 1418726 - RNA, 21 nt, Pseudomonas aeruginosa PA01
ccgccggggaucagcgagagc

SEQ ID NO: 1418727 - RNA, 17 nt, Pseudomonas aeruginosa PA01
ccgccggugcaccaggc

SEQ ID NO: 1418728 - RNA, 16 nt, Pseudomonas aeruginosa PA01
ccgccgguagccguuc

SEQ ID NO: 1418729 - RNA, 16 nt, Pseudomonas aeruginosa PA01
ccgccgguaucccggc

SEQ ID NO: 1418730 - RNA, 18 nt, Pseudomonas aeruginosa PA01
ccgccgguaucccggcug

SEQ ID NO: 1418731 - RNA, 20 nt, Pseudomonas aeruginosa PA01
ccgccggucaccacuggaaa

SEQ ID NO: 1418732 - RNA, 21 nt, Pseudomonas aeruginosa PA01
ccgccggucaccacuggaaac

SEQ ID NO: 1418733 - RNA, 16 nt, Pseudomonas aeruginosa PA01
ccgccggugaacaggu

SEQ ID NO: 1418734 - RNA, 20 nt, Pseudomonas aeruginosa PA01
ccgccggugaacagguagcu

SEQ ID NO: 1418735 - RNA, 16 nt, Pseudomonas aeruginosa PA01
ccgcgucacggacccg

SEQ ID NO: 1418736 - RNA, 22 nt, Pseudomonas aeruginosa PA01
ccgcgucacggacccgcucggc

SEQ ID NO: 1418737 - RNA, 16 nt, Pseudomonas aeruginosa PA01
ccgcguagcgccaggc

SEQ ID NO: 1418738 - RNA, 15 nt, Pseudomonas aeruginosa PA01
ccgcguagggcgaag

SEQ ID NO: 1418739 - RNA, 16 nt, Pseudomonas aeruginosa PA01
ccgcguaguagccgga

SEQ ID NO: 1418740 - RNA, 17 nt, Pseudomonas aeruginosa PA01
ccgcggugucggcgauu

SEQ ID NO: 1418741 - RNA, 18 nt, Pseudomonas aeruginosa PA01
ccgcggugucggugcccu

SEQ ID NO: 1418742 - RNA, 12 nt, Pseudomonas aeruginosa PA01
ccgcggugggcu

SEQ ID NO: 1418743 - RNA, 22 nt, Pseudomonas aeruginosa PA01
ccgcgguggaggcggcggucau

SEQ ID NO: 1418744 - RNA, 17 nt, Pseudomonas aeruginosa PA01
ccgcggcguuauccgcc

SEQ ID NO: 1418745 - RNA, 18 nt, Pseudomonas aeruginosa PA01
ccgcggcguugucggcca

SEQ ID NO: 1418746 - RNA, 20 nt, Pseudomonas aeruginosa PA01
ccgcggcguaaucgcgccag

SEQ ID NO: 1418747 - RNA, 23 nt, Pseudomonas aeruginosa PA01
ccgcggcguaaucgcgccaggcc

SEQ ID NO: 1418748 - RNA, 21 nt, Pseudomonas aeruginosa PA01
ccgcgggaggccgccucgacc

SEQ ID NO: 1418749 - RNA, 12 nt, Pseudomonas aeruginosa PA01
ccgcgggacgcg

SEQ ID NO: 1418750 - RNA, 19 nt, Pseudomonas aeruginosa PA01
ccgcggcuggccauccgcc

SEQ ID NO: 1418751 - RNA, 22 nt, Pseudomonas aeruginosa PA01
ccgcguuaccguccgcgccgcg

SEQ ID NO: 1418752 - RNA, 20 nt, Pseudomonas aeruginosa PA01
ccgcguucagucccgcggcg

SEQ ID NO: 1418753 - RNA, 19 nt, Pseudomonas aeruginosa PA01
ccgcguucgccgagcugau

SEQ ID NO: 1418754 - RNA, 20 nt, Pseudomonas aeruginosa PA01
ccgcguucgccgaggcggcg

SEQ ID NO: 1418755 - RNA, 11 nt, Pseudomonas aeruginosa PA01
ccgcguugcgg

SEQ ID NO: 1418756 - RNA, 15 nt, Pseudomonas aeruginosa PA01
ccgcguugacgcgga

SEQ ID NO: 1418757 - RNA, 23 nt, Pseudomonas aeruginosa PA01
ccgcguggugagcacgaacaggg

SEQ ID NO: 1418758 - RNA, 20 nt, Pseudomonas aeruginosa PA01
ccgcguggcgugcucggcga

SEQ ID NO: 1418759 - RNA, 14 nt, Pseudomonas aeruginosa PA01
ccgcgugcgcgccc

SEQ ID NO: 1418760 - RNA, 19 nt, Pseudomonas aeruginosa PA01
ccgcgugcgcgccgccggg

SEQ ID NO: 1418761 - RNA, 14 nt, Pseudomonas aeruginosa PA01
ccgcgucgucggcg

SEQ ID NO: 1418762 - RNA, 15 nt, Pseudomonas aeruginosa PA01
ccgcgucgucggcga

SEQ ID NO: 1418763 - RNA, 20 nt, Pseudomonas aeruginosa PA01
ccgcgucgggaaaggccgcc

SEQ ID NO: 1418764 - RNA, 23 nt, Pseudomonas aeruginosa PA01
ccgcgucgggaaaggccgccacg

SEQ ID NO: 1418765 - RNA, 18 nt, Pseudomonas aeruginosa PA01
ccgcguccauccccgccu

SEQ ID NO: 1418766 - RNA, 20 nt, Pseudomonas aeruginosa PA01
ccgcguccauccccgccucg

SEQ ID NO: 1418767 - RNA, 19 nt, Pseudomonas aeruginosa PA01
ccgcugcgucgucgcggcg

SEQ ID NO: 1418768 - RNA, 20 nt, Pseudomonas aeruginosa PA01
ccgcugcgucgucgcggcgc

SEQ ID NO: 1418769 - RNA, 15 nt, Pseudomonas aeruginosa PA01
ccgcugcgugccagg

SEQ ID NO: 1418770 - RNA, 14 nt, Pseudomonas aeruginosa PA01
ccgcugcggccggc

SEQ ID NO: 1418771 - RNA, 15 nt, Pseudomonas aeruginosa PA01
ccgcugcggccggcg

SEQ ID NO: 1418772 - RNA, 16 nt, Pseudomonas aeruginosa PA01
ccgcugcggccggcgc

SEQ ID NO: 1418773 - RNA, 17 nt, Pseudomonas aeruginosa PA01
ccgcugcggcgguccca

SEQ ID NO: 1418774 - RNA, 16 nt, Pseudomonas aeruginosa PA01
ccgcugcggcucgccg

SEQ ID NO: 1418775 - RNA, 13 nt, Pseudomonas aeruginosa PA01
ccgcugcggcugc

SEQ ID NO: 1418776 - RNA, 14 nt, Pseudomonas aeruginosa PA01
ccgcuggaaccggc

SEQ ID NO: 1418777 - RNA, 16 nt, Pseudomonas aeruginosa PA01
ccgcuggaaccggccg

SEQ ID NO: 1418778 - RNA, 20 nt, Pseudomonas aeruginosa PA01
ccgcuggaaccggccggcag

SEQ ID NO: 1418779 - RNA, 23 nt, Pseudomonas aeruginosa PA01
ccgcuggaccaguucagcgcgcu

SEQ ID NO: 1418780 - RNA, 12 nt, Pseudomonas aeruginosa PA01
ccgcuggccagg

SEQ ID NO: 1418781 - RNA, 17 nt, Pseudomonas aeruginosa PA01
ccgcuggcccaacagcg

SEQ ID NO: 1418782 - RNA, 18 nt, Pseudomonas aeruginosa PA01
ccgcuggccugcagcagg

SEQ ID NO: 1418783 - RNA, 16 nt, Pseudomonas aeruginosa PA01
ccgcuggccuggccac

SEQ ID NO: 1418784 - RNA, 12 nt, Pseudomonas aeruginosa PA01
ccgcuggcgacg

SEQ ID NO: 1418785 - RNA, 16 nt, Pseudomonas aeruginosa PA01
ccgcucguuggcggcc

SEQ ID NO: 1418786 - RNA, 17 nt, Pseudomonas aeruginosa PA01
ccgcucguuggcggcca

SEQ ID NO: 1418787 - RNA, 19 nt, Pseudomonas aeruginosa PA01
ccgcucguuggcggccagc

SEQ ID NO: 1418788 - RNA, 21 nt, Pseudomonas aeruginosa PA01
ccgcucuugauacccaccggc

SEQ ID NO: 1418789 - RNA, 21 nt, Pseudomonas aeruginosa PA01
ccgcucucggugaccaccagg

SEQ ID NO: 1418790 - RNA, 14 nt, Pseudomonas aeruginosa PA01
ccgcucugcuggcc

SEQ ID NO: 1418791 - RNA, 16 nt, Pseudomonas aeruginosa PA01
ccgcucugcuggccac

SEQ ID NO: 1418792 - RNA, 15 nt, Pseudomonas aeruginosa PA01
ccgcucugcuggccg

SEQ ID NO: 1418793 - RNA, 17 nt, Pseudomonas aeruginosa PA01
ccgcucugcuggccgcc

SEQ ID NO: 1418794 - RNA, 16 nt, Pseudomonas aeruginosa PA01
ccgcucuggcugcugg

SEQ ID NO: 1418795 - RNA, 15 nt, Pseudomonas aeruginosa PA01
ccgcugaccgggcgg

SEQ ID NO: 1418796 - RNA, 22 nt, Pseudomonas aeruginosa PA01
ccgcugaccgggcggaucgcca

SEQ ID NO: 1418797 - RNA, 17 nt, Pseudomonas aeruginosa PA01
ccgcugaaguccuggcc

SEQ ID NO: 1418798 - RNA, 22 nt, Pseudomonas aeruginosa PA01
ccgcuagcgguagccgucaagc

SEQ ID NO: 1418799 - RNA, 23 nt, Pseudomonas aeruginosa PA01
ccgcguugucccugucccgccgc

SEQ ID NO: 1418800 - RNA, 21 nt, Pseudomonas aeruginosa PA01
ccgcguugcauguccucggcg

SEQ ID NO: 1418801 - RNA, 20 nt, Pseudomonas aeruginosa PA01
ccgcuaagcgucacucccag

SEQ ID NO: 1418802 - RNA, 18 nt, Pseudomonas aeruginosa PA01
ccgcucggggcaucggcc

SEQ ID NO: 1418803 - RNA, 19 nt, Pseudomonas aeruginosa PA01
ccgcucggggcaucggcca

SEQ ID NO: 1418804 - RNA, 21 nt, Pseudomonas aeruginosa PA01
ccgcucgucauggcgcacgcc

SEQ ID NO: 1418805 - RNA, 16 nt, Pseudomonas aeruginosa PA01
ccgcuccucgucgagu

SEQ ID NO: 1418806 - RNA, 15 nt, Pseudomonas aeruginosa PA01
ccgcucgucaggcgc

SEQ ID NO: 1418807 - RNA, 23 nt, Pseudomonas aeruginosa PA01
ccgcucggugccuucccagccga

SEQ ID NO: 1418808 - RNA, 16 nt, Pseudomonas aeruginosa PA01
ccgcuccuccgggaag

SEQ ID NO: 1418809 - RNA, 15 nt, Pseudomonas aeruginosa PA01
ccgcuccggcgccga

SEQ ID NO: 1418810 - RNA, 18 nt, Pseudomonas aeruginosa PA01
ccgcuccuggcaggcuca

SEQ ID NO: 1418811 - RNA, 18 nt, Pseudomonas aeruginosa PA01
ccgcucgaugcccgccag

SEQ ID NO: 1418812 - RNA, 22 nt, Pseudomonas aeruginosa PA01
ccgcucgaugcccgccagcagg

SEQ ID NO: 1418813 - RNA, 15 nt, Pseudomonas aeruginosa PA01
ccgcucgagggcgac

SEQ ID NO: 1418814 - RNA, 17 nt, Pseudomonas aeruginosa PA01
ccgcucgagggcgaccg

SEQ ID NO: 1418815 - RNA, 21 nt, Pseudomonas aeruginosa PA01
ccgcucgagggcgaccgccag

SEQ ID NO: 1418816 - RNA, 16 nt, Pseudomonas aeruginosa PA01
ccgcucgaucccggcg

SEQ ID NO: 1418817 - RNA, 17 nt, Pseudomonas aeruginosa PA01
ccgcucgaucccggcgc

SEQ ID NO: 1418818 - RNA, 18 nt, Pseudomonas aeruginosa PA01
ccgcucgaucccggcgcg

SEQ ID NO: 1418819 - RNA, 20 nt, Pseudomonas aeruginosa PA01
ccgcgcgauggccggcggag

SEQ ID NO: 1418820 - RNA, 21 nt, Pseudomonas aeruginosa PA01
ccgcgcgauggccggcggaga

SEQ ID NO: 1418821 - RNA, 16 nt, Pseudomonas aeruginosa PA01
ccgcgcgccauggccu

SEQ ID NO: 1418822 - RNA, 17 nt, Pseudomonas aeruginosa PA01
ccgcgcgccauggccug

SEQ ID NO: 1418823 - RNA, 19 nt, Pseudomonas aeruginosa PA01
ccgcgcgccgagcccccgg

SEQ ID NO: 1418824 - RNA, 19 nt, Pseudomonas aeruginosa PA01
ccgcgcgccagcaacgccu

SEQ ID NO: 1418825 - RNA, 15 nt, Pseudomonas aeruginosa PA01
ccgcgcgcgccugca

SEQ ID NO: 1418826 - RNA, 21 nt, Pseudomonas aeruginosa PA01
ccgcgcgccugcaacgccagc

SEQ ID NO: 1418827 - RNA, 13 nt, Pseudomonas aeruginosa PA01
ccgcgcgcgcaag

SEQ ID NO: 1418828 - RNA, 23 nt, Pseudomonas aeruginosa PA01
ccgcgcgcgcaaggccgaagagg

SEQ ID NO: 1418829 - RNA, 14 nt, Pseudomonas aeruginosa PA01
ccgcgcgccuggcu

SEQ ID NO: 1418830 - RNA, 15 nt, Pseudomonas aeruginosa PA01
ccgcgcgccuggcug

SEQ ID NO: 1418831 - RNA, 19 nt, Pseudomonas aeruginosa PA01
ccgcgcgccuggcuggcca

SEQ ID NO: 1418832 - RNA, 16 nt, Pseudomonas aeruginosa PA01
ccgcgccugcuugaaa

SEQ ID NO: 1418833 - RNA, 14 nt, Pseudomonas aeruginosa PA01
ccgcgccucgcgca

SEQ ID NO: 1418834 - RNA, 22 nt, Pseudomonas aeruginosa PA01
ccgcgccucgcgcaacgccgac

SEQ ID NO: 1418835 - RNA, 15 nt, Pseudomonas aeruginosa PA01
ccgcgccucgcuagu

SEQ ID NO: 1418836 - RNA, 15 nt, Pseudomonas aeruginosa PA01
ccgcgccucgucgcg

SEQ ID NO: 1418837 - RNA, 20 nt, Pseudomonas aeruginosa PA01
ccgcgccucgucgcgccagg

SEQ ID NO: 1418838 - RNA, 16 nt, Pseudomonas aeruginosa PA01
ccgcgccuucgagcgc

SEQ ID NO: 1418839 - RNA, 22 nt, Pseudomonas aeruginosa PA01
ccgcgccuucagcgccagcagg

SEQ ID NO: 1418840 - RNA, 23 nt, Pseudomonas aeruginosa PA01
ccgcgccuucagcgccagcaggc

SEQ ID NO: 1418841 - RNA, 18 nt, Pseudomonas aeruginosa PA01
ccgcgccuugcucagguc

SEQ ID NO: 1418842 - RNA, 23 nt, Pseudomonas aeruginosa PA01
ccgcgccuugcucaggucgucga

SEQ ID NO: 1418843 - RNA, 15 nt, Pseudomonas aeruginosa PA01
ccgcgcgaccgcggc

SEQ ID NO: 1418844 - RNA, 16 nt, Pseudomonas aeruginosa PA01
ccgcgcgaccgcggcg

SEQ ID NO: 1418845 - RNA, 18 nt, Pseudomonas aeruginosa PA01
ccgcgcgaccgcggcgcu

SEQ ID NO: 1418846 - RNA, 19 nt, Pseudomonas aeruginosa PA01
ccgcgcgaccgcggcgcuc

SEQ ID NO: 1418847 - RNA, 21 nt, Pseudomonas aeruginosa PA01
ccgcgcgaccgcggcgcucgg

SEQ ID NO: 1418848 - RNA, 12 nt, Pseudomonas aeruginosa PA01
ccgcgcgacagc

SEQ ID NO: 1418849 - RNA, 15 nt, Pseudomonas aeruginosa PA01
ccgcgccgagccggc

SEQ ID NO: 1418850 - RNA, 17 nt, Pseudomonas aeruginosa PA01
ccgcgccgagccggcug

SEQ ID NO: 1418851 - RNA, 15 nt, Pseudomonas aeruginosa PA01
ccgcgccgcaagggc

SEQ ID NO: 1418852 - RNA, 19 nt, Pseudomonas aeruginosa PA01
ccgcgccgcaagggcgucg

SEQ ID NO: 1418853 - RNA, 14 nt, Pseudomonas aeruginosa PA01
ccgcgccgaugccg

SEQ ID NO: 1418854 - RNA, 12 nt, Pseudomonas aeruginosa PA01
ccgcgccgaugu

SEQ ID NO: 1418855 - RNA, 14 nt, Pseudomonas aeruginosa PA01
ccgcgccgacccag

SEQ ID NO: 1418856 - RNA, 18 nt, Pseudomonas aeruginosa PA01
ccgcgccgacccagagcg

SEQ ID NO: 1418857 - RNA, 22 nt, Pseudomonas aeruginosa PA01
ccgcgccgacccagagcgcgcc

SEQ ID NO: 1418858 - RNA, 14 nt, Pseudomonas aeruginosa PA01
ccgcgccgccgagg

SEQ ID NO: 1418859 - RNA, 12 nt, Pseudomonas aeruginosa PA01
ccgcgccgccgg

SEQ ID NO: 1418860 - RNA, 17 nt, Pseudomonas aeruginosa PA01
ccgcgccgccgcggcca

SEQ ID NO: 1418861 - RNA, 19 nt, Pseudomonas aeruginosa PA01
ccgcgccgccucgauggcg

SEQ ID NO: 1418862 - RNA, 17 nt, Pseudomonas aeruginosa PA01
ccgcgccgcgucgccgc

SEQ ID NO: 1418863 - RNA, 17 nt, Pseudomonas aeruginosa PA01
ccgcgccgcgaggggaa

SEQ ID NO: 1418864 - RNA, 21 nt, Pseudomonas aeruginosa PA01
ccgcgccgguaaugacgaucu

SEQ ID NO: 1418865 - RNA, 17 nt, Pseudomonas aeruginosa PA01
ccgcgccgguggccagg

SEQ ID NO: 1418866 - RNA, 14 nt, Pseudomonas aeruginosa PA01
ccgcgccgggcugg

SEQ ID NO: 1418867 - RNA, 17 nt, Pseudomonas aeruginosa PA01
ccgcgccgggcuggccg

SEQ ID NO: 1418868 - RNA, 20 nt, Pseudomonas aeruginosa PA01
ccgcgccgggcuggccgucg

SEQ ID NO: 1418869 - RNA, 16 nt, Pseudomonas aeruginosa PA01
ccgcgccuccaggcgc

SEQ ID NO: 1418870 - RNA, 20 nt, Pseudomonas aeruginosa PA01
ccgcgccuccaggcgcgccu

SEQ ID NO: 1418871 - RNA, 23 nt, Pseudomonas aeruginosa PA01
ccgcgccuccaggcgcgccugga

SEQ ID NO: 1418872 - RNA, 12 nt, Pseudomonas aeruginosa PA01
ccgcgccggcga

SEQ ID NO: 1418873 - RNA, 18 nt, Pseudomonas aeruginosa PA01
ccgcgccggcagcucggc

SEQ ID NO: 1418874 - RNA, 17 nt, Pseudomonas aeruginosa PA01
ccgcgccggccguccca

SEQ ID NO: 1418875 - RNA, 22 nt, Pseudomonas aeruginosa PA01
ccgcgcgcuggauuucgccgag

SEQ ID NO: 1418876 - RNA, 23 nt, Pseudomonas aeruginosa PA01
ccgcgcgcuggauuucgccgagu

SEQ ID NO: 1418877 - RNA, 14 nt, Pseudomonas aeruginosa PA01
ccgcgcgcugugca

SEQ ID NO: 1418878 - RNA, 18 nt, Pseudomonas aeruginosa PA01
ccgcgcgcuuguggcgaa

SEQ ID NO: 1418879 - RNA, 17 nt, Pseudomonas aeruginosa PA01
ccgcgcgcuuuuccggc

SEQ ID NO: 1418880 - RNA, 22 nt, Pseudomonas aeruginosa PA01
ccgcgcggauccccucccgcgc

SEQ ID NO: 1418881 - RNA, 13 nt, Pseudomonas aeruginosa PA01
ccgcgcggcaacg

SEQ ID NO: 1418882 - RNA, 20 nt, Pseudomonas aeruginosa PA01
ccgcgcggcacaggcggcug

SEQ ID NO: 1418883 - RNA, 12 nt, Pseudomonas aeruginosa PA01
ccgcgcggcccu

SEQ ID NO: 1418884 - RNA, 13 nt, Pseudomonas aeruginosa PA01
ccgcgcucgcgca

SEQ ID NO: 1418885 - RNA, 14 nt, Pseudomonas aeruginosa PA01
ccgcgcucgcgcau

SEQ ID NO: 1418886 - RNA, 15 nt, Pseudomonas aeruginosa PA01
ccgcgcucgacgguc

SEQ ID NO: 1418887 - RNA, 17 nt, Pseudomonas aeruginosa PA01
ccgcgcucggaucaggc

SEQ ID NO: 1418888 - RNA, 13 nt, Pseudomonas aeruginosa PA01
ccgcgcucggcca

SEQ ID NO: 1418889 - RNA, 14 nt, Pseudomonas aeruginosa PA01
ccgcgcuccaguuc

SEQ ID NO: 1418890 - RNA, 14 nt, Pseudomonas aeruginosa PA01
ccgcgcuccgcugg

SEQ ID NO: 1418891 - RNA, 15 nt, Pseudomonas aeruginosa PA01
ccgcgcggcgccccg

SEQ ID NO: 1418892 - RNA, 23 nt, Pseudomonas aeruginosa PA01
ccgcgcggcgcccugccgggcuc

SEQ ID NO: 1418893 - RNA, 16 nt, Pseudomonas aeruginosa PA01
ccgcgcggcuugccgg

SEQ ID NO: 1418894 - RNA, 18 nt, Pseudomonas aeruginosa PA01
ccgcgcggcuugccggcg

SEQ ID NO: 1418895 - RNA, 19 nt, Pseudomonas aeruginosa PA01
ccgcgcggcuugccggcgc

SEQ ID NO: 1418896 - RNA, 21 nt, Pseudomonas aeruginosa PA01
ccgcgcggcuugccggcgcgc

SEQ ID NO: 1418897 - RNA, 23 nt, Pseudomonas aeruginosa PA01
ccgcgcggcuugccggcgcgcgg

SEQ ID NO: 1418898 - RNA, 17 nt, Pseudomonas aeruginosa PA01
ccgcggcccggcgcugc

SEQ ID NO: 1418899 - RNA, 13 nt, Pseudomonas aeruginosa PA01
ccgcggccccggc

SEQ ID NO: 1418900 - RNA, 17 nt, Pseudomonas aeruginosa PA01
ccgcggcccugcucgcc

SEQ ID NO: 1418901 - RNA, 12 nt, Pseudomonas aeruginosa PA01
ccgcggcggccu

SEQ ID NO: 1418902 - RNA, 21 nt, Pseudomonas aeruginosa PA01
ccgcggcggcgugcaggccga

SEQ ID NO: 1418903 - RNA, 12 nt, Pseudomonas aeruginosa PA01
ccgcgcucggcg

SEQ ID NO: 1418904 - RNA, 15 nt, Pseudomonas aeruginosa PA01
ccgcgcucggccgcc

SEQ ID NO: 1418905 - RNA, 19 nt, Pseudomonas aeruginosa PA01
ccgcgcucggccgccuggc

SEQ ID NO: 1418906 - RNA, 21 nt, Pseudomonas aeruginosa PA01
ccgcgcucggcggucaggcca

SEQ ID NO: 1418907 - RNA, 22 nt, Pseudomonas aeruginosa PA01
ccgcgcucgguccagaucgcca

SEQ ID NO: 1418908 - RNA, 18 nt, Pseudomonas aeruginosa PA01
ccgcggauccacgccugg

SEQ ID NO: 1418909 - RNA, 19 nt, Pseudomonas aeruginosa PA01
ccgcggauccacgccuggc

SEQ ID NO: 1418910 - RNA, 13 nt, Pseudomonas aeruginosa PA01
ccgcggagcaccg

SEQ ID NO: 1418911 - RNA, 18 nt, Pseudomonas aeruginosa PA01
ccgcggagcaccgcgccu

SEQ ID NO: 1418912 - RNA, 15 nt, Pseudomonas aeruginosa PA01
ccgcggcccaagggc

SEQ ID NO: 1418913 - RNA, 22 nt, Pseudomonas aeruginosa PA01
ccgcggaucgcgccgucgcugg

SEQ ID NO: 1418914 - RNA, 13 nt, Pseudomonas aeruginosa PA01
ccgcggaucgcgc

SEQ ID NO: 1418915 - RNA, 14 nt, Pseudomonas aeruginosa PA01
ccgcggaucgcgcc

SEQ ID NO: 1418916 - RNA, 19 nt, Pseudomonas aeruginosa PA01
ccgcggaugacgggcgaag

SEQ ID NO: 1418917 - RNA, 18 nt, Pseudomonas aeruginosa PA01
ccgacgggucgccauggu

SEQ ID NO: 1418918 - RNA, 20 nt, Pseudomonas aeruginosa PA01
ccgacgggucgccauggucg

SEQ ID NO: 1418919 - RNA, 21 nt, Pseudomonas aeruginosa PA01
ccgacgggucgccauggucgu

SEQ ID NO: 1418920 - RNA, 19 nt, Pseudomonas aeruginosa PA01
ccgacggcuugaucacgcc

SEQ ID NO: 1418921 - RNA, 22 nt, Pseudomonas aeruginosa PA01
ccgacggcuugaucacgccgaa

SEQ ID NO: 1418922 - RNA, 23 nt, Pseudomonas aeruginosa PA01
ccgacggcuucgaccacgacccg

SEQ ID NO: 1418923 - RNA, 15 nt, Pseudomonas aeruginosa PA01
ccgacggugcggccg

SEQ ID NO: 1418924 - RNA, 22 nt, Pseudomonas aeruginosa PA01
ccgacguagggcaucgccgaca

SEQ ID NO: 1418925 - RNA, 15 nt, Pseudomonas aeruginosa PA01
ccgacguagccgcgu

SEQ ID NO: 1418926 - RNA, 18 nt, Pseudomonas aeruginosa PA01
ccgacguagccgcguacg

SEQ ID NO: 1418927 - RNA, 13 nt, Pseudomonas aeruginosa PA01
ccgacggucggca

SEQ ID NO: 1418928 - RNA, 15 nt, Pseudomonas aeruginosa PA01
ccgacggucggcagg

SEQ ID NO: 1418929 - RNA, 21 nt, Pseudomonas aeruginosa PA01
ccgacgguaguaccucgaagc

SEQ ID NO: 1418930 - RNA, 12 nt, Pseudomonas aeruginosa PA01
ccgacggcccuc

SEQ ID NO: 1418931 - RNA, 13 nt, Pseudomonas aeruginosa PA01
ccgacggcccucc

SEQ ID NO: 1418932 - RNA, 19 nt, Pseudomonas aeruginosa PA01
ccgacggcccuccggcgcg

SEQ ID NO: 1418933 - RNA, 17 nt, Pseudomonas aeruginosa PA01
ccgacggcggcggcgga

SEQ ID NO: 1418934 - RNA, 12 nt, Pseudomonas aeruginosa PA01
ccgacggcgugc

SEQ ID NO: 1418935 - RNA, 14 nt, Pseudomonas aeruginosa PA01
ccgacgcucgcggc

SEQ ID NO: 1418936 - RNA, 22 nt, Pseudomonas aeruginosa PA01
ccgacgcucgcggcaucccgcc

SEQ ID NO: 1418937 - RNA, 15 nt, Pseudomonas aeruginosa PA01
ccgacgcgucguccg

SEQ ID NO: 1418938 - RNA, 18 nt, Pseudomonas aeruginosa PA01
ccgacgcuguugccggca

SEQ ID NO: 1418939 - RNA, 19 nt, Pseudomonas aeruginosa PA01
ccgacgcuuccucgcucgc

SEQ ID NO: 1418940 - RNA, 15 nt, Pseudomonas aeruginosa PA01
ccgacaaucgccgag

SEQ ID NO: 1418941 - RNA, 16 nt, Pseudomonas aeruginosa PA01
ccgacgaugggcacga

SEQ ID NO: 1418942 - RNA, 20 nt, Pseudomonas aeruginosa PA01
ccgacaagccuccagcgccg

SEQ ID NO: 1418943 - RNA, 21 nt, Pseudomonas aeruginosa PA01
ccgacaagccuccagcgccgc

SEQ ID NO: 1418944 - RNA, 20 nt, Pseudomonas aeruginosa PA01
ccgacaagcauucagcgcgc

SEQ ID NO: 1418945 - RNA, 21 nt, Pseudomonas aeruginosa PA01
ccgacaagcauucagcgcgcc

SEQ ID NO: 1418946 - RNA, 22 nt, Pseudomonas aeruginosa PA01
ccgacaagcauucagcgcgccc

SEQ ID NO: 1418947 - RNA, 16 nt, Pseudomonas aeruginosa PA01
ccgacgccgagcagca

SEQ ID NO: 1418948 - RNA, 13 nt, Pseudomonas aeruginosa PA01
ccgacgccgccug

SEQ ID NO: 1418949 - RNA, 15 nt, Pseudomonas aeruginosa PA01
ccgacgccgccugcg

SEQ ID NO: 1418950 - RNA, 15 nt, Pseudomonas aeruginosa PA01
ccgacgccgcggccg

SEQ ID NO: 1418951 - RNA, 16 nt, Pseudomonas aeruginosa PA01
ccgacgccgcggccgg

SEQ ID NO: 1418952 - RNA, 22 nt, Pseudomonas aeruginosa PA01
ccgacgccgaaggacaggccgu

SEQ ID NO: 1418953 - RNA, 13 nt, Pseudomonas aeruginosa PA01
ccgacgccggacg

SEQ ID NO: 1418954 - RNA, 19 nt, Pseudomonas aeruginosa PA01
ccgacugucgugccuccag

SEQ ID NO: 1418955 - RNA, 16 nt, Pseudomonas aeruginosa PA01
ccgagaaaccgccauc

SEQ ID NO: 1418956 - RNA, 23 nt, Pseudomonas aeruginosa PA01
ccgagaaaacccugggaauggcg

SEQ ID NO: 1418957 - RNA, 18 nt, Pseudomonas aeruginosa PA01
ccgacuugcucaucgcgu

SEQ ID NO: 1418958 - RNA, 15 nt, Pseudomonas aeruginosa PA01
ccgacuuccaggcgc

SEQ ID NO: 1418959 - RNA, 22 nt, Pseudomonas aeruginosa PA01
ccgacuuccaggcgcaggcgag

SEQ ID NO: 1418960 - RNA, 23 nt, Pseudomonas aeruginosa PA01
ccgacuuccaggcgcaggcgagg

SEQ ID NO: 1418961 - RNA, 18 nt, Pseudomonas aeruginosa PA01
ccgacugguccugcggcg

SEQ ID NO: 1418962 - RNA, 15 nt, Pseudomonas aeruginosa PA01
ccgacugcgagccga

SEQ ID NO: 1418963 - RNA, 21 nt, Pseudomonas aeruginosa PA01
ccgacucuccgcgccgcggcg

SEQ ID NO: 1418964 - RNA, 23 nt, Pseudomonas aeruginosa PA01
ccgacugagcuaauccggcggcg

SEQ ID NO: 1418965 - RNA, 19 nt, Pseudomonas aeruginosa PA01
ccgacguugagaaggcgcc

SEQ ID NO: 1418966 - RNA, 21 nt, Pseudomonas aeruginosa PA01
ccgacgucgaugacgauggcg

SEQ ID NO: 1418967 - RNA, 16 nt, Pseudomonas aeruginosa PA01
ccgacguccuccagga

SEQ ID NO: 1418968 - RNA, 23 nt, Pseudomonas aeruginosa PA01
ccgacgucguggauaggcggcgg

SEQ ID NO: 1418969 - RNA, 17 nt, Pseudomonas aeruginosa PA01
ccgagcaauccggcgcu

SEQ ID NO: 1418970 - RNA, 19 nt, Pseudomonas aeruginosa PA01
ccgagcaauccggcgcugc

SEQ ID NO: 1418971 - RNA, 22 nt, Pseudomonas aeruginosa PA01
ccgagcaauccggcgcugccga

SEQ ID NO: 1418972 - RNA, 14 nt, Pseudomonas aeruginosa PA01
ccgagcaccccgac

SEQ ID NO: 1418973 - RNA, 13 nt, Pseudomonas aeruginosa PA01
ccgagcaccacgc

SEQ ID NO: 1418974 - RNA, 19 nt, Pseudomonas aeruginosa PA01
ccgagcaccacgcgcaagc

SEQ ID NO: 1418975 - RNA, 16 nt, Pseudomonas aeruginosa PA01
ccgagcaacucggcgg

SEQ ID NO: 1418976 - RNA, 18 nt, Pseudomonas aeruginosa PA01
ccgagcaacucggcggcg

SEQ ID NO: 1418977 - RNA, 19 nt, Pseudomonas aeruginosa PA01
ccgagcaagccuuccaggu

SEQ ID NO: 1418978 - RNA, 15 nt, Pseudomonas aeruginosa PA01
ccgagcaacggcagc

SEQ ID NO: 1418979 - RNA, 22 nt, Pseudomonas aeruginosa PA01
ccgagcaaccgcgauggcguga

SEQ ID NO: 1418980 - RNA, 16 nt, Pseudomonas aeruginosa PA01
ccgagauccugcagca

SEQ ID NO: 1418981 - RNA, 14 nt, Pseudomonas aeruginosa PA01
ccgagaucggucac

SEQ ID NO: 1418982 - RNA, 22 nt, Pseudomonas aeruginosa PA01
ccgagaugcucgcgcagcgacu

SEQ ID NO: 1418983 - RNA, 20 nt, Pseudomonas aeruginosa PA01
ccgagauucugcaggcgcuc

SEQ ID NO: 1418984 - RNA, 16 nt, Pseudomonas aeruginosa PA01
ccgagauuggccgccu

SEQ ID NO: 1418985 - RNA, 17 nt, Pseudomonas aeruginosa PA01
ccgagauuggccgccug

SEQ ID NO: 1418986 - RNA, 18 nt, Pseudomonas aeruginosa PA01
ccgagauuggccgccugc

SEQ ID NO: 1418987 - RNA, 14 nt, Pseudomonas aeruginosa PA01
ccgagaccggcagc

SEQ ID NO: 1418988 - RNA, 15 nt, Pseudomonas aeruginosa PA01
ccgagaacgcggcga

SEQ ID NO: 1418989 - RNA, 16 nt, Pseudomonas aeruginosa PA01
ccgagaacgcggcgaa

SEQ ID NO: 1418990 - RNA, 12 nt, Pseudomonas aeruginosa PA01
ccgagaaccagu

SEQ ID NO: 1418991 - RNA, 22 nt, Pseudomonas aeruginosa PA01
ccgagaaucugcccggccaugc

SEQ ID NO: 1418992 - RNA, 15 nt, Pseudomonas aeruginosa PA01
ccgagaagccggggc

SEQ ID NO: 1418993 - RNA, 15 nt, Pseudomonas aeruginosa PA01
ccgagacgaucagca

SEQ ID NO: 1418994 - RNA, 15 nt, Pseudomonas aeruginosa PA01
ccgagacuugaucgc

SEQ ID NO: 1418995 - RNA, 19 nt, Pseudomonas aeruginosa PA01
ccgagauagcggcaacgcg

SEQ ID NO: 1418996 - RNA, 17 nt, Pseudomonas aeruginosa PA01
ccgagagcagggccugg

SEQ ID NO: 1418997 - RNA, 15 nt, Pseudomonas aeruginosa PA01
ccgagacgcccugga

SEQ ID NO: 1418998 - RNA, 20 nt, Pseudomonas aeruginosa PA01
ccgagagcggcgccaggcgu

SEQ ID NO: 1418999 - RNA, 12 nt, Pseudomonas aeruginosa PA01
ccgaguuggccc

SEQ ID NO: 1419000 - RNA, 21 nt, Pseudomonas aeruginosa PA01
ccgaguuggcccaauccgcgc

SEQ ID NO: 1419001 - RNA, 15 nt, Pseudomonas aeruginosa PA01
ccgagugccggcgcg

SEQ ID NO: 1419002 - RNA, 18 nt, Pseudomonas aeruginosa PA01
ccgagugccggcgcgucg

SEQ ID NO: 1419003 - RNA, 23 nt, Pseudomonas aeruginosa PA01
ccgagugccggcgcgucgcugcg

SEQ ID NO: 1419004 - RNA, 14 nt, Pseudomonas aeruginosa PA01
ccgagucggcaacg

SEQ ID NO: 1419005 - RNA, 13 nt, Pseudomonas aeruginosa PA01
ccgaguugaccag

SEQ ID NO: 1419006 - RNA, 13 nt, Pseudomonas aeruginosa PA01
ccgaguucgccgc

SEQ ID NO: 1419007 - RNA, 17 nt, Pseudomonas aeruginosa PA01
ccgaguucgcgcaggcg

SEQ ID NO: 1419008 - RNA, 15 nt, Pseudomonas aeruginosa PA01
ccgaguccugcugcg

SEQ ID NO: 1419009 - RNA, 12 nt, Pseudomonas aeruginosa PA01
ccgaguccgcgc

SEQ ID NO: 1419010 - RNA, 14 nt, Pseudomonas aeruginosa PA01
ccgaguccgcgcgc

SEQ ID NO: 1419011 - RNA, 20 nt, Pseudomonas aeruginosa PA01
ccgaggucuuggccagccgc

SEQ ID NO: 1419012 - RNA, 16 nt, Pseudomonas aeruginosa PA01
ccgagguugacgaacg

SEQ ID NO: 1419013 - RNA, 14 nt, Pseudomonas aeruginosa PA01
ccgaguaggcgcug

SEQ ID NO: 1419014 - RNA, 19 nt, Pseudomonas aeruginosa PA01
ccgagguggagaucagcgg

SEQ ID NO: 1419015 - RNA, 16 nt, Pseudomonas aeruginosa PA01
ccgaggugcugcaccg

SEQ ID NO: 1419016 - RNA, 18 nt, Pseudomonas aeruginosa PA01
ccgaggugcugcaccggg

SEQ ID NO: 1419017 - RNA, 14 nt, Pseudomonas aeruginosa PA01
ccgaggugucgccg

SEQ ID NO: 1419018 - RNA, 15 nt, Pseudomonas aeruginosa PA01
ccgaggugucgccgc

SEQ ID NO: 1419019 - RNA, 13 nt, Pseudomonas aeruginosa PA01
ccgaggucggcgg

SEQ ID NO: 1419020 - RNA, 12 nt, Pseudomonas aeruginosa PA01
ccgaggucgccg

SEQ ID NO: 1419021 - RNA, 16 nt, Pseudomonas aeruginosa PA01
ccgaggucgccgccag

SEQ ID NO: 1419022 - RNA, 23 nt, Pseudomonas aeruginosa PA01
ccgaggcggauuugccgccgagg

SEQ ID NO: 1419023 - RNA, 13 nt, Pseudomonas aeruginosa PA01
ccgaggcgcgcca

SEQ ID NO: 1419024 - RNA, 13 nt, Pseudomonas aeruginosa PA01
ccgaggcgcgccg

SEQ ID NO: 1419025 - RNA, 16 nt, Pseudomonas aeruginosa PA01
ccgaggcgcgccgaca

SEQ ID NO: 1419026 - RNA, 16 nt, Pseudomonas aeruginosa PA01
ccgagggcaccgacga

SEQ ID NO: 1419027 - RNA, 21 nt, Pseudomonas aeruginosa PA01
ccgagggcagccucagcgaca

SEQ ID NO: 1419028 - RNA, 19 nt, Pseudomonas aeruginosa PA01
ccgaggcuuccucgaagaa

SEQ ID NO: 1419029 - RNA, 18 nt, Pseudomonas aeruginosa PA01
ccgagggaggaggcgccg

SEQ ID NO: 1419030 - RNA, 19 nt, Pseudomonas aeruginosa PA01
ccgagggaggaggcgccgg

SEQ ID NO: 1419031 - RNA, 14 nt, Pseudomonas aeruginosa PA01
ccgaggguggcgcu

SEQ ID NO: 1419032 - RNA, 22 nt, Pseudomonas aeruginosa PA01
ccgagguccaucuugaugccga

SEQ ID NO: 1419033 - RNA, 22 nt, Pseudomonas aeruginosa PA01
ccgagguaguaggucugguagu

SEQ ID NO: 1419034 - RNA, 17 nt, Pseudomonas aeruginosa PA01
ccgagggcugccgcccg

SEQ ID NO: 1419035 - RNA, 14 nt, Pseudomonas aeruginosa PA01
ccgagggcgcggcg

SEQ ID NO: 1419036 - RNA, 21 nt, Pseudomonas aeruginosa PA01
ccgagggcgcggcgccagcgc

SEQ ID NO: 1419037 - RNA, 19 nt, Pseudomonas aeruginosa PA01
ccgagggcgaguucggcga

SEQ ID NO: 1419038 - RNA, 16 nt, Pseudomonas aeruginosa PA01
ccgagggcgccaggug

SEQ ID NO: 1419039 - RNA, 20 nt, Pseudomonas aeruginosa PA01
ccgagggcgccaggugcagg

SEQ ID NO: 1419040 - RNA, 13 nt, Pseudomonas aeruginosa PA01
ccgagggcgcgca

SEQ ID NO: 1419041 - RNA, 15 nt, Pseudomonas aeruginosa PA01
ccgagggcgcgcagu

SEQ ID NO: 1419042 - RNA, 16 nt, Pseudomonas aeruginosa PA01
ccgagggcgcgcagua

SEQ ID NO: 1419043 - RNA, 14 nt, Pseudomonas aeruginosa PA01
ccgagggccgcgcc

SEQ ID NO: 1419044 - RNA, 16 nt, Pseudomonas aeruginosa PA01
ccgagggccgcgccga

SEQ ID NO: 1419045 - RNA, 17 nt, Pseudomonas aeruginosa PA01
ccgagggccgcgccgac

SEQ ID NO: 1419046 - RNA, 12 nt, Pseudomonas aeruginosa PA01
ccgagggcgaag

SEQ ID NO: 1419047 - RNA, 13 nt, Pseudomonas aeruginosa PA01
ccgagggcgaaga

SEQ ID NO: 1419048 - RNA, 16 nt, Pseudomonas aeruginosa PA01
ccgaggaugcucgccu

SEQ ID NO: 1419049 - RNA, 16 nt, Pseudomonas aeruginosa PA01
ccgaggcccagcgacu

SEQ ID NO: 1419050 - RNA, 18 nt, Pseudomonas aeruginosa PA01
ccgaggccagcaggccgu

SEQ ID NO: 1419051 - RNA, 13 nt, Pseudomonas aeruginosa PA01
ccgaggccgccgc

SEQ ID NO: 1419052 - RNA, 12 nt, Pseudomonas aeruginosa PA01
ccgaggccggcg

SEQ ID NO: 1419053 - RNA, 20 nt, Pseudomonas aeruginosa PA01
ccgaggcgaccuuggccagc

SEQ ID NO: 1419054 - RNA, 13 nt, Pseudomonas aeruginosa PA01
ccgaggcgacgcc

SEQ ID NO: 1419055 - RNA, 12 nt, Pseudomonas aeruginosa PA01
ccgaggcgaacg

SEQ ID NO: 1419056 - RNA, 14 nt, Pseudomonas aeruginosa PA01
ccgaggcgaacggc

SEQ ID NO: 1419057 - RNA, 15 nt, Pseudomonas aeruginosa PA01
ccgaggaacgccgac

SEQ ID NO: 1419058 - RNA, 16 nt, Pseudomonas aeruginosa PA01
ccgaggaagccgaccg

SEQ ID NO: 1419059 - RNA, 21 nt, Pseudomonas aeruginosa PA01
ccgaggaaggcgcuggcgcug

SEQ ID NO: 1419060 - RNA, 23 nt, Pseudomonas aeruginosa PA01
ccgaggaaggcgcuggcgcugua

SEQ ID NO: 1419061 - RNA, 16 nt, Pseudomonas aeruginosa PA01
ccgaggaagucggcgg

SEQ ID NO: 1419062 - RNA, 18 nt, Pseudomonas aeruginosa PA01
ccgagcuugaccuugccg

SEQ ID NO: 1419063 - RNA, 20 nt, Pseudomonas aeruginosa PA01
ccgagcuugaccuugccgcc

SEQ ID NO: 1419064 - RNA, 17 nt, Pseudomonas aeruginosa PA01
ccgagcuuugcgcagcc

SEQ ID NO: 1419065 - RNA, 23 nt, Pseudomonas aeruginosa PA01
ccgaggaaaugauguugcgccag

SEQ ID NO: 1419066 - RNA, 14 nt, Pseudomonas aeruginosa PA01
ccgaggacccggcg

SEQ ID NO: 1419067 - RNA, 14 nt, Pseudomonas aeruginosa PA01
ccgaggagaaaccg

SEQ ID NO: 1419068 - RNA, 20 nt, Pseudomonas aeruginosa PA01
ccgaggauagcguccagcuc

SEQ ID NO: 1419069 - RNA, 18 nt, Pseudomonas aeruginosa PA01
ccgaggaggaucucgcgc

SEQ ID NO: 1419070 - RNA, 17 nt, Pseudomonas aeruginosa PA01
ccgaggaggaugccgau

SEQ ID NO: 1419071 - RNA, 16 nt, Pseudomonas aeruginosa PA01
ccgagcgugcgcaugc

SEQ ID NO: 1419072 - RNA, 16 nt, Pseudomonas aeruginosa PA01
ccgagcguugggccuc

SEQ ID NO: 1419073 - RNA, 19 nt, Pseudomonas aeruginosa PA01
ccgagcguugggccucgcu

SEQ ID NO: 1419074 - RNA, 22 nt, Pseudomonas aeruginosa PA01
ccgagcguugggccucgcugcg

SEQ ID NO: 1419075 - RNA, 15 nt, Pseudomonas aeruginosa PA01
ccgagcugccgggcg

SEQ ID NO: 1419076 - RNA, 18 nt, Pseudomonas aeruginosa PA01
ccgagcugccgggcgagc

SEQ ID NO: 1419077 - RNA, 13 nt, Pseudomonas aeruginosa PA01
ccgagcugaucgc

SEQ ID NO: 1419078 - RNA, 19 nt, Pseudomonas aeruginosa PA01
ccgagcugaucgcgcagau

SEQ ID NO: 1419079 - RNA, 23 nt, Pseudomonas aeruginosa PA01
ccgagcugaucgcgcagaucgcc

SEQ ID NO: 1419080 - RNA, 21 nt, Pseudomonas aeruginosa PA01
ccgagcugaccaccagggcga

SEQ ID NO: 1419081 - RNA, 12 nt, Pseudomonas aeruginosa PA01
ccgagcggcaag

SEQ ID NO: 1419082 - RNA, 16 nt, Pseudomonas aeruginosa PA01
ccgagcggcaaggcca

SEQ ID NO: 1419083 - RNA, 16 nt, Pseudomonas aeruginosa PA01
ccgagcggcgcgaagu

SEQ ID NO: 1419084 - RNA, 14 nt, Pseudomonas aeruginosa PA01
ccgagcgcucgccg

SEQ ID NO: 1419085 - RNA, 12 nt, Pseudomonas aeruginosa PA01
ccgagcgcgagu

SEQ ID NO: 1419086 - RNA, 19 nt, Pseudomonas aeruginosa PA01
ccgagcgcgagugcagcga

SEQ ID NO: 1419087 - RNA, 21 nt, Pseudomonas aeruginosa PA01
ccgagcgcgagugcagcgagu

SEQ ID NO: 1419088 - RNA, 16 nt, Pseudomonas aeruginosa PA01
ccgagcgcgaucagcc

SEQ ID NO: 1419089 - RNA, 12 nt, Pseudomonas aeruginosa PA01
ccgagcgccugg

SEQ ID NO: 1419090 - RNA, 14 nt, Pseudomonas aeruginosa PA01
ccgagcgccuggca

SEQ ID NO: 1419091 - RNA, 17 nt, Pseudomonas aeruginosa PA01
ccgagcgccuggcaacc

SEQ ID NO: 1419092 - RNA, 12 nt, Pseudomonas aeruginosa PA01
ccgagcgcgccg

SEQ ID NO: 1419093 - RNA, 14 nt, Pseudomonas aeruginosa PA01
ccgagcgcagcgcc

SEQ ID NO: 1419094 - RNA, 16 nt, Pseudomonas aeruginosa PA01
ccgagcgcagcgccac

SEQ ID NO: 1419095 - RNA, 19 nt, Pseudomonas aeruginosa PA01
ccgagcgcaguucgucgcc

SEQ ID NO: 1419096 - RNA, 17 nt, Pseudomonas aeruginosa PA01
ccgagcgccgccaggca

SEQ ID NO: 1419097 - RNA, 21 nt, Pseudomonas aeruginosa PA01
ccgagcgccgccaggcaggcc

SEQ ID NO: 1419098 - RNA, 23 nt, Pseudomonas aeruginosa PA01
ccgagcgccgccaggcaggccgg

SEQ ID NO: 1419099 - RNA, 13 nt, Pseudomonas aeruginosa PA01
ccgagcgccgccu

SEQ ID NO: 1419100 - RNA, 15 nt, Pseudomonas aeruginosa PA01
ccgagcgccgccugg

SEQ ID NO: 1419101 - RNA, 20 nt, Pseudomonas aeruginosa PA01
ccgagcgccgccugggccgc

SEQ ID NO: 1419102 - RNA, 21 nt, Pseudomonas aeruginosa PA01
ccgagcccgagugcgcccagc

SEQ ID NO: 1419103 - RNA, 15 nt, Pseudomonas aeruginosa PA01
ccgagcccagcggca

SEQ ID NO: 1419104 - RNA, 16 nt, Pseudomonas aeruginosa PA01
ccgagcccccggcgcc

SEQ ID NO: 1419105 - RNA, 22 nt, Pseudomonas aeruginosa PA01
ccgagccacggauaugcgccgc

SEQ ID NO: 1419106 - RNA, 13 nt, Pseudomonas aeruginosa PA01
ccgagccagccgc

SEQ ID NO: 1419107 - RNA, 17 nt, Pseudomonas aeruginosa PA01
ccgagcauuccgacaag

SEQ ID NO: 1419108 - RNA, 16 nt, Pseudomonas aeruginosa PA01
ccgagccgacauccug

SEQ ID NO: 1419109 - RNA, 21 nt, Pseudomonas aeruginosa PA01
ccgagcgaaaucggcaggcug

SEQ ID NO: 1419110 - RNA, 22 nt, Pseudomonas aeruginosa PA01
ccgagcgaaaucggcaggcugc

SEQ ID NO: 1419111 - RNA, 13 nt, Pseudomonas aeruginosa PA01
ccgagccggcauc

SEQ ID NO: 1419112 - RNA, 14 nt, Pseudomonas aeruginosa PA01
ccgagccggacgag

SEQ ID NO: 1419113 - RNA, 16 nt, Pseudomonas aeruginosa PA01
ccgagccggcugccga

SEQ ID NO: 1419114 - RNA, 13 nt, Pseudomonas aeruginosa PA01
ccgagccgcugca

SEQ ID NO: 1419115 - RNA, 19 nt, Pseudomonas aeruginosa PA01
ccgagcagcaccaggcugg

SEQ ID NO: 1419116 - RNA, 19 nt, Pseudomonas aeruginosa PA01
ccgagcaggaagaagccga

SEQ ID NO: 1419117 - RNA, 14 nt, Pseudomonas aeruginosa PA01
ccgagcaggacagc

SEQ ID NO: 1419118 - RNA, 17 nt, Pseudomonas aeruginosa PA01
ccgagcaggacagcagg

SEQ ID NO: 1419119 - RNA, 11 nt, Pseudomonas aeruginosa PA01
ccgagcaggca

SEQ ID NO: 1419120 - RNA, 12 nt, Pseudomonas aeruginosa PA01
ccgagcaggccu

SEQ ID NO: 1419121 - RNA, 17 nt, Pseudomonas aeruginosa PA01
ccgagcaggcgcgccag

SEQ ID NO: 1419122 - RNA, 21 nt, Pseudomonas aeruginosa PA01
ccgagcaggcgcgccaggccc

SEQ ID NO: 1419123 - RNA, 13 nt, Pseudomonas aeruginosa PA01
ccgagcagcgcca

SEQ ID NO: 1419124 - RNA, 15 nt, Pseudomonas aeruginosa PA01
ccgagcagcggacgc

SEQ ID NO: 1419125 - RNA, 15 nt, Pseudomonas aeruginosa PA01
ccgagcaucagcgac

SEQ ID NO: 1419126 - RNA, 18 nt, Pseudomonas aeruginosa PA01
ccgagcagggucacgccg

SEQ ID NO: 1419127 - RNA, 20 nt, Pseudomonas aeruginosa PA01
ccgagcagggucacgccgau

SEQ ID NO: 1419128 - RNA, 17 nt, Pseudomonas aeruginosa PA01
ccgagcaggucgcggaa

SEQ ID NO: 1419129 - RNA, 16 nt, Pseudomonas aeruginosa PA01
ccgagcaugcgcggca

SEQ ID NO: 1419130 - RNA, 20 nt, Pseudomonas aeruginosa PA01
ccgagcauguaggcgcacca

SEQ ID NO: 1419131 - RNA, 13 nt, Pseudomonas aeruginosa PA01
ccgcacggccguc

SEQ ID NO: 1419132 - RNA, 13 nt, Pseudomonas aeruginosa PA01
ccgcagcucggcc

SEQ ID NO: 1419133 - RNA, 22 nt, Pseudomonas aeruginosa PA01
ccgcaggaaggcgaagccguug

SEQ ID NO: 1419134 - RNA, 20 nt, Pseudomonas aeruginosa PA01
ccgcaggcugccguccaggc

SEQ ID NO: 1419135 - RNA, 17 nt, Pseudomonas aeruginosa PA01
ccgcagggcucgugcca

SEQ ID NO: 1419136 - RNA, 16 nt, Pseudomonas aeruginosa PA01
ccgcagggugcggcug

SEQ ID NO: 1419137 - RNA, 21 nt, Pseudomonas aeruginosa PA01
ccgcaggccggccagggagcg

SEQ ID NO: 1419138 - RNA, 15 nt, Pseudomonas aeruginosa PA01
ccgcaggaugccgcc

SEQ ID NO: 1419139 - RNA, 17 nt, Pseudomonas aeruginosa PA01
ccgcaggaugccgccug

SEQ ID NO: 1419140 - RNA, 20 nt, Pseudomonas aeruginosa PA01
ccgcaggcaguggcgccagc

SEQ ID NO: 1419141 - RNA, 23 nt, Pseudomonas aeruginosa PA01
ccgcaggcaguggcgccagccag

SEQ ID NO: 1419142 - RNA, 24 nt, Pseudomonas aeruginosa PA01
ccgcaggcaguggcgccagccagc

SEQ ID NO: 1419143 - RNA, 16 nt, Pseudomonas aeruginosa PA01
ccgcaguccagggcga

SEQ ID NO: 1419144 - RNA, 21 nt, Pseudomonas aeruginosa PA01
ccgcaguacgaggggccgccg

SEQ ID NO: 1419145 - RNA, 17 nt, Pseudomonas aeruginosa PA01
ccgcaguagaugccgcg

SEQ ID NO: 1419146 - RNA, 20 nt, Pseudomonas aeruginosa PA01
ccgcaguagcucgccgaggu

SEQ ID NO: 1419147 - RNA, 22 nt, Pseudomonas aeruginosa PA01
ccgcagguuggccccgccgagg

SEQ ID NO: 1419148 - RNA, 13 nt, Pseudomonas aeruginosa PA01
ccgcaggucuugu

SEQ ID NO: 1419149 - RNA, 14 nt, Pseudomonas aeruginosa PA01
ccgcaggugaagcu

SEQ ID NO: 1419150 - RNA, 22 nt, Pseudomonas aeruginosa PA01
ccgcagguagcugagcaggccg

SEQ ID NO: 1419151 - RNA, 23 nt, Pseudomonas aeruginosa PA01
ccgcagguagcugagcaggccga

SEQ ID NO: 1419152 - RNA, 20 nt, Pseudomonas aeruginosa PA01
ccgcaguuccuugggcaucg

SEQ ID NO: 1419153 - RNA, 13 nt, Pseudomonas aeruginosa PA01
ccgcaguucgccc

SEQ ID NO: 1419154 - RNA, 19 nt, Pseudomonas aeruginosa PA01
ccgcaguucgccccgccgc

SEQ ID NO: 1419155 - RNA, 21 nt, Pseudomonas aeruginosa PA01
ccgcaguucgccccgccgcca

SEQ ID NO: 1419156 - RNA, 22 nt, Pseudomonas aeruginosa PA01
ccgcaguucgccccgccgccag

SEQ ID NO: 1419157 - RNA, 23 nt, Pseudomonas aeruginosa PA01
ccgcaguucgccccgccgccagg

SEQ ID NO: 1419158 - RNA, 18 nt, Pseudomonas aeruginosa PA01
ccgcaguuguuccucgcg

SEQ ID NO: 1419159 - RNA, 19 nt, Pseudomonas aeruginosa PA01
ccgcaguuguuccucgcgg

SEQ ID NO: 1419160 - RNA, 21 nt, Pseudomonas aeruginosa PA01
ccgcauccucguuccacgggu

SEQ ID NO: 1419161 - RNA, 20 nt, Pseudomonas aeruginosa PA01
ccgcaucgaagcgcaccagg

SEQ ID NO: 1419162 - RNA, 16 nt, Pseudomonas aeruginosa PA01
ccgcaucgaaggcgcc

SEQ ID NO: 1419163 - RNA, 18 nt, Pseudomonas aeruginosa PA01
ccgcaucgaaggcgccgg

SEQ ID NO: 1419164 - RNA, 22 nt, Pseudomonas aeruginosa PA01
ccgcaucgaccuugcccucggc

SEQ ID NO: 1419165 - RNA, 18 nt, Pseudomonas aeruginosa PA01
ccgcaucgaggccgccca

SEQ ID NO: 1419166 - RNA, 22 nt, Pseudomonas aeruginosa PA01
ccgcaucgaggccgcccagcgc

SEQ ID NO: 1419167 - RNA, 19 nt, Pseudomonas aeruginosa PA01
ccgcaucgcgggcgugcuc

SEQ ID NO: 1419168 - RNA, 22 nt, Pseudomonas aeruginosa PA01
ccgcaucgcgguuauccgccga

SEQ ID NO: 1419169 - RNA, 18 nt, Pseudomonas aeruginosa PA01
ccgccagcaccacccggc

SEQ ID NO: 1419170 - RNA, 21 nt, Pseudomonas aeruginosa PA01
ccgccagccagccgcgcgccg

SEQ ID NO: 1419171 - RNA, 19 nt, Pseudomonas aeruginosa PA01
ccgccagccgccaggacgg

SEQ ID NO: 1419172 - RNA, 13 nt, Pseudomonas aeruginosa PA01
ccgccagccggcu

SEQ ID NO: 1419173 - RNA, 14 nt, Pseudomonas aeruginosa PA01
ccgccagccggcug

SEQ ID NO: 1419174 - RNA, 12 nt, Pseudomonas aeruginosa PA01
ccgccagccggc

SEQ ID NO: 1419175 - RNA, 22 nt, Pseudomonas aeruginosa PA01
ccgccagcgcggcgcuuggcga

SEQ ID NO: 1419176 - RNA, 12 nt, Pseudomonas aeruginosa PA01
ccgccagcggca

SEQ ID NO: 1419177 - RNA, 17 nt, Pseudomonas aeruginosa PA01
ccgccagcgccggccau

SEQ ID NO: 1419178 - RNA, 14 nt, Pseudomonas aeruginosa PA01
ccgccaggcggccg

SEQ ID NO: 1419179 - RNA, 15 nt, Pseudomonas aeruginosa PA01
ccgccaggcaggccg

SEQ ID NO: 1419180 - RNA, 17 nt, Pseudomonas aeruginosa PA01
ccgccaggcccugggcg

SEQ ID NO: 1419181 - RNA, 21 nt, Pseudomonas aeruginosa PA01
ccgccaggcuggguuggcgcg

SEQ ID NO: 1419182 - RNA, 21 nt, Pseudomonas aeruginosa PA01
ccgccagggagcaggacgccg

SEQ ID NO: 1419183 - RNA, 13 nt, Pseudomonas aeruginosa PA01
ccgccagcuaccg

SEQ ID NO: 1419184 - RNA, 17 nt, Pseudomonas aeruginosa PA01
ccgccaggccucggcgc

SEQ ID NO: 1419185 - RNA, 14 nt, Pseudomonas aeruginosa PA01
ccgccaggcgcagc

SEQ ID NO: 1419186 - RNA, 19 nt, Pseudomonas aeruginosa PA01
ccgccaggcgcagccagca

SEQ ID NO: 1419187 - RNA, 20 nt, Pseudomonas aeruginosa PA01
ccgccaggcgcagccagcac

SEQ ID NO: 1419188 - RNA, 19 nt, Pseudomonas aeruginosa PA01
ccgccaggcgcgucgcggc

SEQ ID NO: 1419189 - RNA, 13 nt, Pseudomonas aeruginosa PA01
ccgccaggcgcuc

SEQ ID NO: 1419190 - RNA, 16 nt, Pseudomonas aeruginosa PA01
ccgccagcgucgccgc

SEQ ID NO: 1419191 - RNA, 17 nt, Pseudomonas aeruginosa PA01
ccgccagcgucgccgcc

SEQ ID NO: 1419192 - RNA, 16 nt, Pseudomonas aeruginosa PA01
ccgccagcucauggag

SEQ ID NO: 1419193 - RNA, 12 nt, Pseudomonas aeruginosa PA01
ccgccagcucgc

SEQ ID NO: 1419194 - RNA, 13 nt, Pseudomonas aeruginosa PA01
ccgccagcucgcu

SEQ ID NO: 1419195 - RNA, 21 nt, Pseudomonas aeruginosa PA01
ccgccagcucgcuguccagca

SEQ ID NO: 1419196 - RNA, 23 nt, Pseudomonas aeruginosa PA01
ccgccagcggcauucgaacggcu

SEQ ID NO: 1419197 - RNA, 13 nt, Pseudomonas aeruginosa PA01
ccgccagcgggac

SEQ ID NO: 1419198 - RNA, 16 nt, Pseudomonas aeruginosa PA01
ccgccaccccgccggc

SEQ ID NO: 1419199 - RNA, 18 nt, Pseudomonas aeruginosa PA01
ccgccaccccgccggcgu

SEQ ID NO: 1419200 - RNA, 18 nt, Pseudomonas aeruginosa PA01
ccgccaccgccaccgccg

SEQ ID NO: 1419201 - RNA, 13 nt, Pseudomonas aeruginosa PA01
ccgccaccgccgg

SEQ ID NO: 1419202 - RNA, 16 nt, Pseudomonas aeruginosa PA01
ccgcauuggccaggcc

SEQ ID NO: 1419203 - RNA, 21 nt, Pseudomonas aeruginosa PA01
ccgccacuucaagcuggcgca

SEQ ID NO: 1419204 - RNA, 15 nt, Pseudomonas aeruginosa PA01
ccgccacuuccagca

SEQ ID NO: 1419205 - RNA, 16 nt, Pseudomonas aeruginosa PA01
ccgccacuuccagcac

SEQ ID NO: 1419206 - RNA, 21 nt, Pseudomonas aeruginosa PA01
ccgccacuuccagcacgccga

SEQ ID NO: 1419207 - RNA, 16 nt, Pseudomonas aeruginosa PA01
ccgccagacaggccag

SEQ ID NO: 1419208 - RNA, 23 nt, Pseudomonas aeruginosa PA01
ccgccagacaggccagcucgccc

SEQ ID NO: 1419209 - RNA, 17 nt, Pseudomonas aeruginosa PA01
ccgccagaugcgcgucg

SEQ ID NO: 1419210 - RNA, 23 nt, Pseudomonas aeruginosa PA01
ccgccagaugcgcgucgccgaac

SEQ ID NO: 1419211 - RNA, 22 nt, Pseudomonas aeruginosa PA01
ccgccacgugcacgccgugcau

SEQ ID NO: 1419212 - RNA, 22 nt, Pseudomonas aeruginosa PA01
ccgccaccucguauuccacguc

SEQ ID NO: 1419213 - RNA, 13 nt, Pseudomonas aeruginosa PA01
ccgccaccugccc

SEQ ID NO: 1419214 - RNA, 13 nt, Pseudomonas aeruginosa PA01
ccgccaccuggcg

SEQ ID NO: 1419215 - RNA, 15 nt, Pseudomonas aeruginosa PA01
ccgcaaucagcgggc

SEQ ID NO: 1419216 - RNA, 16 nt, Pseudomonas aeruginosa PA01
ccgcaauccgaccggg

SEQ ID NO: 1419217 - RNA, 19 nt, Pseudomonas aeruginosa PA01
ccgcaauccgccgcucccg

SEQ ID NO: 1419218 - RNA, 15 nt, Pseudomonas aeruginosa PA01
ccgcaaccugccaga

SEQ ID NO: 1419219 - RNA, 14 nt, Pseudomonas aeruginosa PA01
ccgcaaccgcugcc

SEQ ID NO: 1419220 - RNA, 19 nt, Pseudomonas aeruginosa PA01
ccgcaaccgcugccgccgu

SEQ ID NO: 1419221 - RNA, 14 nt, Pseudomonas aeruginosa PA01
ccgcaaccagcccu

SEQ ID NO: 1419222 - RNA, 13 nt, Pseudomonas aeruginosa PA01
ccgauucgccggc

SEQ ID NO: 1419223 - RNA, 19 nt, Pseudomonas aeruginosa PA01
ccgcacaguugcgcgccgg

SEQ ID NO: 1419224 - RNA, 21 nt, Pseudomonas aeruginosa PA01
ccgcacaguugcgcgccggcg

SEQ ID NO: 1419225 - RNA, 14 nt, Pseudomonas aeruginosa PA01
ccgcacagguagag

SEQ ID NO: 1419226 - RNA, 18 nt, Pseudomonas aeruginosa PA01
ccgcaccacguagccggc

SEQ ID NO: 1419227 - RNA, 19 nt, Pseudomonas aeruginosa PA01
ccgcaccacguagccggcg

SEQ ID NO: 1419228 - RNA, 14 nt, Pseudomonas aeruginosa PA01
ccgcaccagccggc

SEQ ID NO: 1419229 - RNA, 15 nt, Pseudomonas aeruginosa PA01
ccgcaccagccggcg

SEQ ID NO: 1419230 - RNA, 15 nt, Pseudomonas aeruginosa PA01
ccgaucggcugccca

SEQ ID NO: 1419231 - RNA, 16 nt, Pseudomonas aeruginosa PA01
ccgaucguuggcgaag

SEQ ID NO: 1419232 - RNA, 17 nt, Pseudomonas aeruginosa PA01
ccgaucguuggcgaagu

SEQ ID NO: 1419233 - RNA, 18 nt, Pseudomonas aeruginosa PA01
ccgaucuccuccgccccg

SEQ ID NO: 1419234 - RNA, 21 nt, Pseudomonas aeruginosa PA01
ccgaucucguggacccgugcg

SEQ ID NO: 1419235 - RNA, 22 nt, Pseudomonas aeruginosa PA01
ccgaucucgugggccagcaggc

SEQ ID NO: 1419236 - RNA, 18 nt, Pseudomonas aeruginosa PA01
ccgaugaaauagccggcg

SEQ ID NO: 1419237 - RNA, 14 nt, Pseudomonas aeruginosa PA01
ccgaucuucagcag

SEQ ID NO: 1419238 - RNA, 21 nt, Pseudomonas aeruginosa PA01
ccgaucuucagcagcaggcgc

SEQ ID NO: 1419239 - RNA, 13 nt, Pseudomonas aeruginosa PA01
ccgaucuucgccg

SEQ ID NO: 1419240 - RNA, 16 nt, Pseudomonas aeruginosa PA01
ccgaucuucgccgaca

SEQ ID NO: 1419241 - RNA, 18 nt, Pseudomonas aeruginosa PA01
ccgaugaucuccgcgccg

SEQ ID NO: 1419242 - RNA, 23 nt, Pseudomonas aeruginosa PA01
ccgaugaucuccgcgccgggcug

SEQ ID NO: 1419243 - RNA, 13 nt, Pseudomonas aeruginosa PA01
ccgaugucgccgg

SEQ ID NO: 1419244 - RNA, 18 nt, Pseudomonas aeruginosa PA01
ccgaugucgccggcaugg

SEQ ID NO: 1419245 - RNA, 20 nt, Pseudomonas aeruginosa PA01
ccgaugucguagccgcgcgc

SEQ ID NO: 1419246 - RNA, 22 nt, Pseudomonas aeruginosa PA01
ccgaugucguagccgcgcgcca

SEQ ID NO: 1419247 - RNA, 14 nt, Pseudomonas aeruginosa PA01
ccgaugugcacgcu

SEQ ID NO: 1419248 - RNA, 16 nt, Pseudomonas aeruginosa PA01
ccgauuccgcgcagga

SEQ ID NO: 1419249 - RNA, 18 nt, Pseudomonas aeruginosa PA01
ccgauuccugcggcuugc

SEQ ID NO: 1419250 - RNA, 16 nt, Pseudomonas aeruginosa PA01
ccgaucgaagaaggcu

SEQ ID NO: 1419251 - RNA, 21 nt, Pseudomonas aeruginosa PA01
ccgaucgaagaaggcucaccg

SEQ ID NO: 1419252 - RNA, 17 nt, Pseudomonas aeruginosa PA01
ccgauccguagggcgaa

SEQ ID NO: 1419253 - RNA, 13 nt, Pseudomonas aeruginosa PA01
ccgaucggcaugu

SEQ ID NO: 1419254 - RNA, 19 nt, Pseudomonas aeruginosa PA01
ccgaucgccgcgcggucga

SEQ ID NO: 1419255 - RNA, 23 nt, Pseudomonas aeruginosa PA01
ccgaucgccgcgcggucgagcuc

SEQ ID NO: 1419256 - RNA, 22 nt, Pseudomonas aeruginosa PA01
ccgaucgccucggccaucgagc

SEQ ID NO: 1419257 - RNA, 21 nt, Pseudomonas aeruginosa PA01
ccgaucgccucgucgagcgca

SEQ ID NO: 1419258 - RNA, 22 nt, Pseudomonas aeruginosa PA01
ccgaucgccucgucgagcgcag

SEQ ID NO: 1419259 - RNA, 21 nt, Pseudomonas aeruginosa PA01
ccgaucaggcugaagcggccg

SEQ ID NO: 1419260 - RNA, 22 nt, Pseudomonas aeruginosa PA01
ccgaucaggcugaagcggccgc

SEQ ID NO: 1419261 - RNA, 22 nt, Pseudomonas aeruginosa PA01
ccgaucaggaaauaaccggcgu

SEQ ID NO: 1419262 - RNA, 16 nt, Pseudomonas aeruginosa PA01
ccgaucagcgccucgg

SEQ ID NO: 1419263 - RNA, 13 nt, Pseudomonas aeruginosa PA01
ccgaucagcgcgc

SEQ ID NO: 1419264 - RNA, 23 nt, Pseudomonas aeruginosa PA01
ccgaucagcgcgccuucgacgcg

SEQ ID NO: 1419265 - RNA, 11 nt, Pseudomonas aeruginosa PA01
ccgaucagguc

SEQ ID NO: 1419266 - RNA, 16 nt, Pseudomonas aeruginosa PA01
ccgaucaggucgcgcg

SEQ ID NO: 1419267 - RNA, 13 nt, Pseudomonas aeruginosa PA01
ccgauccgcgaau

SEQ ID NO: 1419268 - RNA, 23 nt, Pseudomonas aeruginosa PA01
ccgaucccgacgcccuccagcac

SEQ ID NO: 1419269 - RNA, 19 nt, Pseudomonas aeruginosa PA01
ccgauccagcagucgcggc

SEQ ID NO: 1419270 - RNA, 15 nt, Pseudomonas aeruginosa PA01
ccgaucaugcucggc

SEQ ID NO: 1419271 - RNA, 20 nt, Pseudomonas aeruginosa PA01
ccgaucaugcucggcgguga

SEQ ID NO: 1419272 - RNA, 21 nt, Pseudomonas aeruginosa PA01
ccgaucaugggggccagcagg

SEQ ID NO: 1419273 - RNA, 15 nt, Pseudomonas aeruginosa PA01
ccgaucaccuggcca

SEQ ID NO: 1419274 - RNA, 16 nt, Pseudomonas aeruginosa PA01
ccgaucaccuggccgg

SEQ ID NO: 1419275 - RNA, 18 nt, Pseudomonas aeruginosa PA01
ccgaucaccuggccggug

SEQ ID NO: 1419276 - RNA, 18 nt, Pseudomonas aeruginosa PA01
ccgaucaccuucaccggc

SEQ ID NO: 1419277 - RNA, 21 nt, Pseudomonas aeruginosa PA01
ccgaucagcccgucggccucg

SEQ ID NO: 1419278 - RNA, 14 nt, Pseudomonas aeruginosa PA01
ccgaucaccaccug

SEQ ID NO: 1419279 - RNA, 13 nt, Pseudomonas aeruginosa PA01
ccgaucaccagcg

SEQ ID NO: 1419280 - RNA, 14 nt, Pseudomonas aeruginosa PA01
ccgaucaccagcgc

SEQ ID NO: 1419281 - RNA, 23 nt, Pseudomonas aeruginosa PA01
ccgaucaccaggaucgccgggcu

SEQ ID NO: 1419282 - RNA, 13 nt, Pseudomonas aeruginosa PA01
ccgaucaccccgc

SEQ ID NO: 1419283 - RNA, 16 nt, Pseudomonas aeruginosa PA01
ccgauauggcuggcgc

SEQ ID NO: 1419284 - RNA, 19 nt, Pseudomonas aeruginosa PA01
ccgaucaacgcggccagca

SEQ ID NO: 1419285 - RNA, 21 nt, Pseudomonas aeruginosa PA01
ccgaucaacgcggccagcagc

SEQ ID NO: 1419286 - RNA, 22 nt, Pseudomonas aeruginosa PA01
ccgaucaacgcggccagcagca

SEQ ID NO: 1419287 - RNA, 17 nt, Pseudomonas aeruginosa PA01
ccgaucaccaccagcgc

SEQ ID NO: 1419288 - RNA, 22 nt, Pseudomonas aeruginosa PA01
ccgaucaccaccagcgccgcca

SEQ ID NO: 1419289 - RNA, 23 nt, Pseudomonas aeruginosa PA01
ccgauacgagaucgagcgcgccc

SEQ ID NO: 1419290 - RNA, 24 nt, Pseudomonas aeruginosa PA01
ccgauacgagaucgagcgcgccca

SEQ ID NO: 1419291 - RNA, 21 nt, Pseudomonas aeruginosa PA01
ccgauauaggcgacgaucagc

SEQ ID NO: 1419292 - RNA, 23 nt, Pseudomonas aeruginosa PA01
ccgauaggcgccggcgcgcggcg

SEQ ID NO: 1419293 - RNA, 15 nt, Pseudomonas aeruginosa PA01
ccgauagcggcgcga

SEQ ID NO: 1419294 - RNA, 14 nt, Pseudomonas aeruginosa PA01
ccugaaaagcgcug

SEQ ID NO: 1419295 - RNA, 15 nt, Pseudomonas aeruginosa PA01
ccugaacgcgcccgg

SEQ ID NO: 1419296 - RNA, 22 nt, Pseudomonas aeruginosa PA01
ccugaacgcgcccggccaggcc

SEQ ID NO: 1419297 - RNA, 20 nt, Pseudomonas aeruginosa PA01
ccucuugaaaacugucggcg

SEQ ID NO: 1419298 - RNA, 22 nt, Pseudomonas aeruginosa PA01
ccucuugaaaacugucggcgga

SEQ ID NO: 1419299 - RNA, 23 nt, Pseudomonas aeruginosa PA01
ccucuucguggacggacagggaa

SEQ ID NO: 1419300 - RNA, 21 nt, Pseudomonas aeruginosa PA01
ccucguaggcguccuggcgag

SEQ ID NO: 1419301 - RNA, 22 nt, Pseudomonas aeruginosa PA01
ccucuaccaggcgguuggcccg

SEQ ID NO: 1419302 - RNA, 14 nt, Pseudomonas aeruginosa PA01
ccucucaacacccc

SEQ ID NO: 1419303 - RNA, 15 nt, Pseudomonas aeruginosa PA01
ccucguaggccgacu

SEQ ID NO: 1419304 - RNA, 15 nt, Pseudomonas aeruginosa PA01
ccucggugcggccga

SEQ ID NO: 1419305 - RNA, 18 nt, Pseudomonas aeruginosa PA01
ccucggugcggccgagga

SEQ ID NO: 1419306 - RNA, 14 nt, Pseudomonas aeruginosa PA01
ccucggugucggcc

SEQ ID NO: 1419307 - RNA, 24 nt, Pseudomonas aeruginosa PA01
ccucugguuggccgaaagcacugc

SEQ ID NO: 1419308 - RNA, 15 nt, Pseudomonas aeruginosa PA01
ccucugccucgacgc

SEQ ID NO: 1419309 - RNA, 18 nt, Pseudomonas aeruginosa PA01
ccucucaggagcgccgcg

SEQ ID NO: 1419310 - RNA, 22 nt, Pseudomonas aeruginosa PA01
ccucucaggagcgccgcgcagc

SEQ ID NO: 1419311 - RNA, 15 nt, Pseudomonas aeruginosa PA01
ccucuccccucgccc

SEQ ID NO: 1419312 - RNA, 17 nt, Pseudomonas aeruginosa PA01
ccucuccgagacgcugc

SEQ ID NO: 1419313 - RNA, 22 nt, Pseudomonas aeruginosa PA01
ccucggcgggagagggcggcga

SEQ ID NO: 1419314 - RNA, 19 nt, Pseudomonas aeruginosa PA01
ccucggguuuggcgcccgc

SEQ ID NO: 1419315 - RNA, 21 nt, Pseudomonas aeruginosa PA01
ccucggguuuggcgcccgccu

SEQ ID NO: 1419316 - RNA, 15 nt, Pseudomonas aeruginosa PA01
ccucggcggcggucg

SEQ ID NO: 1419317 - RNA, 17 nt, Pseudomonas aeruginosa PA01
ccucggucaggcgcugg

SEQ ID NO: 1419318 - RNA, 19 nt, Pseudomonas aeruginosa PA01
ccucggucaggcgcuggug

SEQ ID NO: 1419319 - RNA, 18 nt, Pseudomonas aeruginosa PA01
ccucggugauaccgccgg

SEQ ID NO: 1419320 - RNA, 12 nt, Pseudomonas aeruginosa PA01
ccucggcgcagu

SEQ ID NO: 1419321 - RNA, 22 nt, Pseudomonas aeruginosa PA01
ccucggcgaggaucagucgcug

SEQ ID NO: 1419322 - RNA, 19 nt, Pseudomonas aeruginosa PA01
ccucggcgcccgccugcag

SEQ ID NO: 1419323 - RNA, 14 nt, Pseudomonas aeruginosa PA01
ccucggcgccgagc

SEQ ID NO: 1419324 - RNA, 16 nt, Pseudomonas aeruginosa PA01
ccucggcgcgauccuc

SEQ ID NO: 1419325 - RNA, 17 nt, Pseudomonas aeruginosa PA01
ccucggcgccgucgauc

SEQ ID NO: 1419326 - RNA, 19 nt, Pseudomonas aeruginosa PA01
ccucggcgccgucgaucag

SEQ ID NO: 1419327 - RNA, 17 nt, Pseudomonas aeruginosa PA01
ccucggcgcuggccagg

SEQ ID NO: 1419328 - RNA, 15 nt, Pseudomonas aeruginosa PA01
ccucggcgcgcgccc

SEQ ID NO: 1419329 - RNA, 22 nt, Pseudomonas aeruginosa PA01
ccucggcgcgcgcccccuggcc

SEQ ID NO: 1419330 - RNA, 13 nt, Pseudomonas aeruginosa PA01
ccucggcggccuu

SEQ ID NO: 1419331 - RNA, 11 nt, Pseudomonas aeruginosa PA01
ccucggcggcg

SEQ ID NO: 1419332 - RNA, 13 nt, Pseudomonas aeruginosa PA01
ccucggcggcgag

SEQ ID NO: 1419333 - RNA, 16 nt, Pseudomonas aeruginosa PA01
ccucggcggcgagcgg

SEQ ID NO: 1419334 - RNA, 23 nt, Pseudomonas aeruginosa PA01
ccucggcggcgagcgggucgaug

SEQ ID NO: 1419335 - RNA, 23 nt, Pseudomonas aeruginosa PA01
ccucggcggcggccugcucgcgc

SEQ ID NO: 1419336 - RNA, 15 nt, Pseudomonas aeruginosa PA01
ccucgcgugcgcugg

SEQ ID NO: 1419337 - RNA, 16 nt, Pseudomonas aeruginosa PA01
ccucgcguucgcgguc

SEQ ID NO: 1419338 - RNA, 22 nt, Pseudomonas aeruginosa PA01
ccucgcuagucuuccugcacgc

SEQ ID NO: 1419339 - RNA, 24 nt, Pseudomonas aeruginosa PA01
ccucgcuagucuuccugcacgcug

SEQ ID NO: 1419340 - RNA, 17 nt, Pseudomonas aeruginosa PA01
ccucgcuccaacgcagg

SEQ ID NO: 1419341 - RNA, 15 nt, Pseudomonas aeruginosa PA01
ccucggcgacgagga

SEQ ID NO: 1419342 - RNA, 14 nt, Pseudomonas aeruginosa PA01
ccucgcggguaucg

SEQ ID NO: 1419343 - RNA, 20 nt, Pseudomonas aeruginosa PA01
ccucgcggguaucgauccag

SEQ ID NO: 1419344 - RNA, 23 nt, Pseudomonas aeruginosa PA01
ccucgcgcucggcggccucgcgg

SEQ ID NO: 1419345 - RNA, 20 nt, Pseudomonas aeruginosa PA01
ccucgcggcuaucgaucacu

SEQ ID NO: 1419346 - RNA, 15 nt, Pseudomonas aeruginosa PA01
ccucgcggacgcugg

SEQ ID NO: 1419347 - RNA, 17 nt, Pseudomonas aeruginosa PA01
ccucgcggacgcuggcg

SEQ ID NO: 1419348 - RNA, 23 nt, Pseudomonas aeruginosa PA01
ccucgcggacgcuggcgaucaug

SEQ ID NO: 1419349 - RNA, 13 nt, Pseudomonas aeruginosa PA01
ccucgcgcugccc

SEQ ID NO: 1419350 - RNA, 15 nt, Pseudomonas aeruginosa PA01
ccucgcgcugcccgg

SEQ ID NO: 1419351 - RNA, 17 nt, Pseudomonas aeruginosa PA01
ccucgcgcugcccggcg

SEQ ID NO: 1419352 - RNA, 14 nt, Pseudomonas aeruginosa PA01
ccucgcgcguggcc

SEQ ID NO: 1419353 - RNA, 20 nt, Pseudomonas aeruginosa PA01
ccucgcgcguggccgccagg

SEQ ID NO: 1419354 - RNA, 20 nt, Pseudomonas aeruginosa PA01
ccucgcgccgcgccagcagg

SEQ ID NO: 1419355 - RNA, 18 nt, Pseudomonas aeruginosa PA01
ccucgccucgcgccagag

SEQ ID NO: 1419356 - RNA, 23 nt, Pseudomonas aeruginosa PA01
ccucgccggucagguaggcaucg

SEQ ID NO: 1419357 - RNA, 16 nt, Pseudomonas aeruginosa PA01
ccucgccgucgucggg

SEQ ID NO: 1419358 - RNA, 12 nt, Pseudomonas aeruginosa PA01
ccucgcgcaccg

SEQ ID NO: 1419359 - RNA, 17 nt, Pseudomonas aeruginosa PA01
ccucgcgcaacgccgac

SEQ ID NO: 1419360 - RNA, 21 nt, Pseudomonas aeruginosa PA01
ccucgcgcaacgccgacggcg

SEQ ID NO: 1419361 - RNA, 21 nt, Pseudomonas aeruginosa PA01
ccucgcgcaucuggcugcgcg

SEQ ID NO: 1419362 - RNA, 23 nt, Pseudomonas aeruginosa PA01
ccucgcgccagagaucgcccagc

SEQ ID NO: 1419363 - RNA, 13 nt, Pseudomonas aeruginosa PA01
ccugaccgcgagc

SEQ ID NO: 1419364 - RNA, 16 nt, Pseudomonas aeruginosa PA01
ccugaccccggccugg

SEQ ID NO: 1419365 - RNA, 18 nt, Pseudomonas aeruginosa PA01
ccugaccccggccuggcu

SEQ ID NO: 1419366 - RNA, 17 nt, Pseudomonas aeruginosa PA01
ccugauccgcguuaccg

SEQ ID NO: 1419367 - RNA, 15 nt, Pseudomonas aeruginosa PA01
ccugccccgccggcg

SEQ ID NO: 1419368 - RNA, 19 nt, Pseudomonas aeruginosa PA01
ccugcccagugggccaccg

SEQ ID NO: 1419369 - RNA, 22 nt, Pseudomonas aeruginosa PA01
ccugcccagugggccaccggcu

SEQ ID NO: 1419370 - RNA, 17 nt, Pseudomonas aeruginosa PA01
ccugccccagcaucgcc

SEQ ID NO: 1419371 - RNA, 20 nt, Pseudomonas aeruginosa PA01
ccugccccagcaucgccggc

SEQ ID NO: 1419372 - RNA, 18 nt, Pseudomonas aeruginosa PA01
ccugccccgggcgccggg

SEQ ID NO: 1419373 - RNA, 16 nt, Pseudomonas aeruginosa PA01
ccugcccgcgccucgc

SEQ ID NO: 1419374 - RNA, 13 nt, Pseudomonas aeruginosa PA01
ccugccccgugca

SEQ ID NO: 1419375 - RNA, 22 nt, Pseudomonas aeruginosa PA01
ccugccccgugcaccgaggcgc

SEQ ID NO: 1419376 - RNA, 22 nt, Pseudomonas aeruginosa PA01
ccugccagcgcgucggcacgcc

SEQ ID NO: 1419377 - RNA, 14 nt, Pseudomonas aeruginosa PA01
ccugccagcgggcg

SEQ ID NO: 1419378 - RNA, 16 nt, Pseudomonas aeruginosa PA01
ccugccagcgggcgcc

SEQ ID NO: 1419379 - RNA, 13 nt, Pseudomonas aeruginosa PA01
ccugccaucgaug

SEQ ID NO: 1419380 - RNA, 15 nt, Pseudomonas aeruginosa PA01
ccugcaugucaccga

SEQ ID NO: 1419381 - RNA, 16 nt, Pseudomonas aeruginosa PA01
ccugccagaccgagau

SEQ ID NO: 1419382 - RNA, 22 nt, Pseudomonas aeruginosa PA01
ccugcagcgccauggggaucac

SEQ ID NO: 1419383 - RNA, 17 nt, Pseudomonas aeruginosa PA01
ccugcagcgcgcgcugg

SEQ ID NO: 1419384 - RNA, 14 nt, Pseudomonas aeruginosa PA01
ccugcagcucggug

SEQ ID NO: 1419385 - RNA, 15 nt, Pseudomonas aeruginosa PA01
ccugcaugccggccg

SEQ ID NO: 1419386 - RNA, 13 nt, Pseudomonas aeruginosa PA01
ccugcaucgcgac

SEQ ID NO: 1419387 - RNA, 24 nt, Pseudomonas aeruginosa PA01
ccugcagcaccaccucgccaagcu

SEQ ID NO: 1419388 - RNA, 18 nt, Pseudomonas aeruginosa PA01
ccugcagcaguuccaggc

SEQ ID NO: 1419389 - RNA, 20 nt, Pseudomonas aeruginosa PA01
ccugcagcaggucgagcagu

SEQ ID NO: 1419390 - RNA, 19 nt, Pseudomonas aeruginosa PA01
ccuacgcaacccgcccggc

SEQ ID NO: 1419391 - RNA, 12 nt, Pseudomonas aeruginosa PA01
ccuacgcggcac

SEQ ID NO: 1419392 - RNA, 16 nt, Pseudomonas aeruginosa PA01
ccuacggaccggugcc

SEQ ID NO: 1419393 - RNA, 18 nt, Pseudomonas aeruginosa PA01
ccuacggccccaggcugc

SEQ ID NO: 1419394 - RNA, 23 nt, Pseudomonas aeruginosa PA01
ccuacaucuuggcaaucaucgcg

SEQ ID NO: 1419395 - RNA, 18 nt, Pseudomonas aeruginosa PA01
ccuacuugaucagccgca

SEQ ID NO: 1419396 - RNA, 13 nt, Pseudomonas aeruginosa PA01
ccuacugggcgug

SEQ ID NO: 1419397 - RNA, 22 nt, Pseudomonas aeruginosa PA01
ccuacuccaggggucggcaucg

SEQ ID NO: 1419398 - RNA, 14 nt, Pseudomonas aeruginosa PA01
ccguucgccggccu

SEQ ID NO: 1419399 - RNA, 21 nt, Pseudomonas aeruginosa PA01
ccguucgaucaauugccggua

SEQ ID NO: 1419400 - RNA, 14 nt, Pseudomonas aeruginosa PA01
ccuaccagaccgca

SEQ ID NO: 1419401 - RNA, 16 nt, Pseudomonas aeruginosa PA01
ccuaccagaccgcagc

SEQ ID NO: 1419402 - RNA, 22 nt, Pseudomonas aeruginosa PA01
ccuaccagaccgcagccggcga

SEQ ID NO: 1419403 - RNA, 19 nt, Pseudomonas aeruginosa PA01
ccguucgcuggacaggcgc

SEQ ID NO: 1419404 - RNA, 22 nt, Pseudomonas aeruginosa PA01
ccguucgcuggacaggcgcagg

SEQ ID NO: 1419405 - RNA, 14 nt, Pseudomonas aeruginosa PA01
ccguuccagcggca

SEQ ID NO: 1419406 - RNA, 14 nt, Pseudomonas aeruginosa PA01
ccguucccagcagc

SEQ ID NO: 1419407 - RNA, 18 nt, Pseudomonas aeruginosa PA01
ccguucagguucagggug

SEQ ID NO: 1419408 - RNA, 20 nt, Pseudomonas aeruginosa PA01
ccguuaccuuggccacgacg

SEQ ID NO: 1419409 - RNA, 16 nt, Pseudomonas aeruginosa PA01
ccguuccaccgccugg

SEQ ID NO: 1419410 - RNA, 19 nt, Pseudomonas aeruginosa PA01
ccguucaucgaaaugccgc

SEQ ID NO: 1419411 - RNA, 19 nt, Pseudomonas aeruginosa PA01
ccucaggauagccggcgcg

SEQ ID NO: 1419412 - RNA, 17 nt, Pseudomonas aeruginosa PA01
ccucagcggccuucgac

SEQ ID NO: 1419413 - RNA, 15 nt, Pseudomonas aeruginosa PA01
ccucagcggcuggcg

SEQ ID NO: 1419414 - RNA, 22 nt, Pseudomonas aeruginosa PA01
ccucagggaagaugcacaccag

SEQ ID NO: 1419415 - RNA, 13 nt, Pseudomonas aeruginosa PA01
ccucagggcgcga

SEQ ID NO: 1419416 - RNA, 18 nt, Pseudomonas aeruginosa PA01
ccucaggggugcagcccu

SEQ ID NO: 1419417 - RNA, 22 nt, Pseudomonas aeruginosa PA01
ccucagguagucggcgaugcgc

SEQ ID NO: 1419418 - RNA, 18 nt, Pseudomonas aeruginosa PA01
ccucaggcgcugcgcggc

SEQ ID NO: 1419419 - RNA, 21 nt, Pseudomonas aeruginosa PA01
ccucaggccuggcgcaacagg

SEQ ID NO: 1419420 - RNA, 16 nt, Pseudomonas aeruginosa PA01
ccucagucgugcaggu

SEQ ID NO: 1419421 - RNA, 13 nt, Pseudomonas aeruginosa PA01
ccucaggucggcg

SEQ ID NO: 1419422 - RNA, 14 nt, Pseudomonas aeruginosa PA01
ccucaggucggcgc

SEQ ID NO: 1419423 - RNA, 15 nt, Pseudomonas aeruginosa PA01
ccucaggucggcgcc

SEQ ID NO: 1419424 - RNA, 14 nt, Pseudomonas aeruginosa PA01
ccuagggucggcgu

SEQ ID NO: 1419425 - RNA, 17 nt, Pseudomonas aeruginosa PA01
ccuaggcgacccggcau

SEQ ID NO: 1419426 - RNA, 17 nt, Pseudomonas aeruginosa PA01
ccuccaccgcuccggcg

SEQ ID NO: 1419427 - RNA, 15 nt, Pseudomonas aeruginosa PA01
ccuccacccgcgaag

SEQ ID NO: 1419428 - RNA, 13 nt, Pseudomonas aeruginosa PA01
ccuccacggcggc

SEQ ID NO: 1419429 - RNA, 14 nt, Pseudomonas aeruginosa PA01
ccuccacggcggcc

SEQ ID NO: 1419430 - RNA, 16 nt, Pseudomonas aeruginosa PA01
ccuccgccagcguuuc

SEQ ID NO: 1419431 - RNA, 11 nt, Pseudomonas aeruginosa PA01
ccuccgccagg

SEQ ID NO: 1419432 - RNA, 13 nt, Pseudomonas aeruginosa PA01
ccuccgccagguc

SEQ ID NO: 1419433 - RNA, 20 nt, Pseudomonas aeruginosa PA01
ccuccgccaggucgaucccc

SEQ ID NO: 1419434 - RNA, 18 nt, Pseudomonas aeruginosa PA01
ccuccaccagcgccggcg

SEQ ID NO: 1419435 - RNA, 20 nt, Pseudomonas aeruginosa PA01
ccuccaccagcgccggcggc

SEQ ID NO: 1419436 - RNA, 16 nt, Pseudomonas aeruginosa PA01
ccucauucgcucugcg

SEQ ID NO: 1419437 - RNA, 19 nt, Pseudomonas aeruginosa PA01
ccucauagugcugcggcag

SEQ ID NO: 1419438 - RNA, 14 nt, Pseudomonas aeruginosa PA01
ccucagugcgggca

SEQ ID NO: 1419439 - RNA, 23 nt, Pseudomonas aeruginosa PA01
ccucagugcgggcaguccuggcg

SEQ ID NO: 1419440 - RNA, 18 nt, Pseudomonas aeruginosa PA01
ccucauggaaaccccggc

SEQ ID NO: 1419441 - RNA, 14 nt, Pseudomonas aeruginosa PA01
ccucauggcuguag

SEQ ID NO: 1419442 - RNA, 16 nt, Pseudomonas aeruginosa PA01
ccucgccguacagcag

SEQ ID NO: 1419443 - RNA, 17 nt, Pseudomonas aeruginosa PA01
ccucgccguacagcagg

SEQ ID NO: 1419444 - RNA, 20 nt, Pseudomonas aeruginosa PA01
ccucgcccuugcugcccagu

SEQ ID NO: 1419445 - RNA, 15 nt, Pseudomonas aeruginosa PA01
ccucgccgcuccgcg

SEQ ID NO: 1419446 - RNA, 22 nt, Pseudomonas aeruginosa PA01
ccucgccgcggcagaucccauc

SEQ ID NO: 1419447 - RNA, 17 nt, Pseudomonas aeruginosa PA01
ccucgccgagcauccag

SEQ ID NO: 1419448 - RNA, 12 nt, Pseudomonas aeruginosa PA01
ccucgccgaggc

SEQ ID NO: 1419449 - RNA, 14 nt, Pseudomonas aeruginosa PA01
ccucgccgaucucc

SEQ ID NO: 1419450 - RNA, 22 nt, Pseudomonas aeruginosa PA01
ccucgccgaugucguagccgcg

SEQ ID NO: 1419451 - RNA, 16 nt, Pseudomonas aeruginosa PA01
ccucgccauucucgcc

SEQ ID NO: 1419452 - RNA, 14 nt, Pseudomonas aeruginosa PA01
ccucgcagccggcg

SEQ ID NO: 1419453 - RNA, 16 nt, Pseudomonas aeruginosa PA01
ccucgcccaucgccag

SEQ ID NO: 1419454 - RNA, 15 nt, Pseudomonas aeruginosa PA01
ccucgcccucauggc

SEQ ID NO: 1419455 - RNA, 14 nt, Pseudomonas aeruginosa PA01
ccucgccccgccgg

SEQ ID NO: 1419456 - RNA, 16 nt, Pseudomonas aeruginosa PA01
ccucgccaggcuggcu

SEQ ID NO: 1419457 - RNA, 17 nt, Pseudomonas aeruginosa PA01
ccucgaugauccgcucg

SEQ ID NO: 1419458 - RNA, 16 nt, Pseudomonas aeruginosa PA01
ccucgaugaucgccgg

SEQ ID NO: 1419459 - RNA, 18 nt, Pseudomonas aeruginosa PA01
ccucgaugaucgccgggu

SEQ ID NO: 1419460 - RNA, 16 nt, Pseudomonas aeruginosa PA01
ccucgauggcggcggc

SEQ ID NO: 1419461 - RNA, 13 nt, Pseudomonas aeruginosa PA01
ccucgauggcggc

SEQ ID NO: 1419462 - RNA, 22 nt, Pseudomonas aeruginosa PA01
ccucgauguaggccucggccug

SEQ ID NO: 1419463 - RNA, 14 nt, Pseudomonas aeruginosa PA01
ccucgauguccggg

SEQ ID NO: 1419464 - RNA, 19 nt, Pseudomonas aeruginosa PA01
ccucgcaaaggucggcgaa

SEQ ID NO: 1419465 - RNA, 22 nt, Pseudomonas aeruginosa PA01
ccucgcaaaggucggcgaaggc

SEQ ID NO: 1419466 - RNA, 23 nt, Pseudomonas aeruginosa PA01
ccucgaucuucuuccccgccacu

SEQ ID NO: 1419467 - RNA, 17 nt, Pseudomonas aeruginosa PA01
ccucgaugaaacgcagg

SEQ ID NO: 1419468 - RNA, 20 nt, Pseudomonas aeruginosa PA01
ccucgaugaaugcgcagguc

SEQ ID NO: 1419469 - RNA, 13 nt, Pseudomonas aeruginosa PA01
ccucgauccgcuc

SEQ ID NO: 1419470 - RNA, 18 nt, Pseudomonas aeruginosa PA01
ccucgauccgcugggccu

SEQ ID NO: 1419471 - RNA, 16 nt, Pseudomonas aeruginosa PA01
ccucgaucacccgcga

SEQ ID NO: 1419472 - RNA, 15 nt, Pseudomonas aeruginosa PA01
ccuccgcgcccaggc

SEQ ID NO: 1419473 - RNA, 13 nt, Pseudomonas aeruginosa PA01
ccuccggacgccg

SEQ ID NO: 1419474 - RNA, 16 nt, Pseudomonas aeruginosa PA01
ccuccggacgccgaac

SEQ ID NO: 1419475 - RNA, 17 nt, Pseudomonas aeruginosa PA01
ccuccggacgccgaacg

SEQ ID NO: 1419476 - RNA, 19 nt, Pseudomonas aeruginosa PA01
ccuccggcgccaggcccuc

SEQ ID NO: 1419477 - RNA, 23 nt, Pseudomonas aeruginosa PA01
ccuccucgaucacccgcgaggcc

SEQ ID NO: 1419478 - RNA, 15 nt, Pseudomonas aeruginosa PA01
ccuccucgccgccga

SEQ ID NO: 1419479 - RNA, 20 nt, Pseudomonas aeruginosa PA01
ccuccucgccgcuccgcgcc

SEQ ID NO: 1419480 - RNA, 14 nt, Pseudomonas aeruginosa PA01
ccuccgggcgugcc

SEQ ID NO: 1419481 - RNA, 22 nt, Pseudomonas aeruginosa PA01
ccuccucguaggcguccuggcg

SEQ ID NO: 1419482 - RNA, 14 nt, Pseudomonas aeruginosa PA01
ccuccucggcggcc

SEQ ID NO: 1419483 - RNA, 15 nt, Pseudomonas aeruginosa PA01
ccuccucgcucugcg

SEQ ID NO: 1419484 - RNA, 18 nt, Pseudomonas aeruginosa PA01
ccuccucgcucugcgccg

SEQ ID NO: 1419485 - RNA, 16 nt, Pseudomonas aeruginosa PA01
ccuccucuaccaggcg

SEQ ID NO: 1419486 - RNA, 13 nt, Pseudomonas aeruginosa PA01
ccuccugggccug

SEQ ID NO: 1419487 - RNA, 17 nt, Pseudomonas aeruginosa PA01
ccuccugggccugucgg

SEQ ID NO: 1419488 - RNA, 21 nt, Pseudomonas aeruginosa PA01
ccuccugggccugucgggggc

SEQ ID NO: 1419489 - RNA, 18 nt, Pseudomonas aeruginosa PA01
ccuccuggaaagaccggc

SEQ ID NO: 1419490 - RNA, 21 nt, Pseudomonas aeruginosa PA01
ccuccuggaaagaccggcgcc

SEQ ID NO: 1419491 - RNA, 20 nt, Pseudomonas aeruginosa PA01
ccuccuggauacgcucggcc

SEQ ID NO: 1419492 - RNA, 21 nt, Pseudomonas aeruginosa PA01
ccuccuggauacgcucggcca

SEQ ID NO: 1419493 - RNA, 16 nt, Pseudomonas aeruginosa PA01
ccuccuggcggcgugg

SEQ ID NO: 1419494 - RNA, 18 nt, Pseudomonas aeruginosa PA01
ccuccuggcggcguggca

SEQ ID NO: 1419495 - RNA, 20 nt, Pseudomonas aeruginosa PA01
ccucgaggaucuugcgcccg

SEQ ID NO: 1419496 - RNA, 22 nt, Pseudomonas aeruginosa PA01
ccucgaggaacaggucgacggc

SEQ ID NO: 1419497 - RNA, 17 nt, Pseudomonas aeruginosa PA01
ccucgagcaggccgagg

SEQ ID NO: 1419498 - RNA, 13 nt, Pseudomonas aeruginosa PA01
ccucgagcaccgc

SEQ ID NO: 1419499 - RNA, 14 nt, Pseudomonas aeruginosa PA01
ccguguugaucgcc

SEQ ID NO: 1419500 - RNA, 17 nt, Pseudomonas aeruginosa PA01
ccguguugaucgccgcg

SEQ ID NO: 1419501 - RNA, 20 nt, Pseudomonas aeruginosa PA01
ccguguugaucgccgcgccg

SEQ ID NO: 1419502 - RNA, 16 nt, Pseudomonas aeruginosa PA01
ccguguugaugccgau

SEQ ID NO: 1419503 - RNA, 18 nt, Pseudomonas aeruginosa PA01
ccguguucggccagccgg

SEQ ID NO: 1419504 - RNA, 24 nt, Pseudomonas aeruginosa PA01
ccguucagcucccaggcgucgccg

SEQ ID NO: 1419505 - RNA, 18 nt, Pseudomonas aeruginosa PA01
ccguucaggccggcgccg

SEQ ID NO: 1419506 - RNA, 20 nt, Pseudomonas aeruginosa PA01
ccguucaggccggcgccgcc

SEQ ID NO: 1419507 - RNA, 13 nt, Pseudomonas aeruginosa PA01
ccguucaggcgcg

SEQ ID NO: 1419508 - RNA, 16 nt, Pseudomonas aeruginosa PA01
ccguucaaagcccgcc

SEQ ID NO: 1419509 - RNA, 20 nt, Pseudomonas aeruginosa PA01
ccguggcgacgcagcacggc

SEQ ID NO: 1419510 - RNA, 20 nt, Pseudomonas aeruginosa PA01
ccguggcgcuacgcucgccg

SEQ ID NO: 1419511 - RNA, 21 nt, Pseudomonas aeruginosa PA01
ccguggcgcuacgcucgccga

SEQ ID NO: 1419512 - RNA, 16 nt, Pseudomonas aeruginosa PA01
ccguggcgcuggccga

SEQ ID NO: 1419513 - RNA, 17 nt, Pseudomonas aeruginosa PA01
ccguggcgcuggccgaa

SEQ ID NO: 1419514 - RNA, 17 nt, Pseudomonas aeruginosa PA01
ccguggcgccauccucc

SEQ ID NO: 1419515 - RNA, 17 nt, Pseudomonas aeruginosa PA01
ccguggcgccgcagggc

SEQ ID NO: 1419516 - RNA, 13 nt, Pseudomonas aeruginosa PA01
ccguggcgccggc

SEQ ID NO: 1419517 - RNA, 14 nt, Pseudomonas aeruginosa PA01
ccguggcgccggcg

SEQ ID NO: 1419518 - RNA, 15 nt, Pseudomonas aeruginosa PA01
ccguggcgccggcgc

SEQ ID NO: 1419519 - RNA, 12 nt, Pseudomonas aeruginosa PA01
ccguggcgcgga

SEQ ID NO: 1419520 - RNA, 22 nt, Pseudomonas aeruginosa PA01
ccguggcggccgccgcgcagca

SEQ ID NO: 1419521 - RNA, 15 nt, Pseudomonas aeruginosa PA01
ccguggcggcgcgcg

SEQ ID NO: 1419522 - RNA, 14 nt, Pseudomonas aeruginosa PA01
ccgugucggcggcg

SEQ ID NO: 1419523 - RNA, 13 nt, Pseudomonas aeruginosa PA01
ccgugugcagcag

SEQ ID NO: 1419524 - RNA, 16 nt, Pseudomonas aeruginosa PA01
ccgugugcagcagggu

SEQ ID NO: 1419525 - RNA, 15 nt, Pseudomonas aeruginosa PA01
ccgugaaaagcggcg

SEQ ID NO: 1419526 - RNA, 16 nt, Pseudomonas aeruginosa PA01
ccgugaaaagcggcgu

SEQ ID NO: 1419527 - RNA, 18 nt, Pseudomonas aeruginosa PA01
ccgugaccagcauggcgg

SEQ ID NO: 1419528 - RNA, 14 nt, Pseudomonas aeruginosa PA01
ccgugcccguccua

SEQ ID NO: 1419529 - RNA, 16 nt, Pseudomonas aeruginosa PA01
ccgugccgccggggcg

SEQ ID NO: 1419530 - RNA, 20 nt, Pseudomonas aeruginosa PA01
ccgugccgccggggcgcagg

SEQ ID NO: 1419531 - RNA, 13 nt, Pseudomonas aeruginosa PA01
ccgugccgggcca

SEQ ID NO: 1419532 - RNA, 21 nt, Pseudomonas aeruginosa PA01
ccgugcuggccggcagcagcg

SEQ ID NO: 1419533 - RNA, 17 nt, Pseudomonas aeruginosa PA01
ccguggaaccgauggcc

SEQ ID NO: 1419534 - RNA, 15 nt, Pseudomonas aeruginosa PA01
ccgugcuucaucggc

SEQ ID NO: 1419535 - RNA, 18 nt, Pseudomonas aeruginosa PA01
ccguggaaaccucgccga

SEQ ID NO: 1419536 - RNA, 16 nt, Pseudomonas aeruginosa PA01
ccguggagaggucgcc

SEQ ID NO: 1419537 - RNA, 19 nt, Pseudomonas aeruginosa PA01
ccguggaccaacagccggc

SEQ ID NO: 1419538 - RNA, 20 nt, Pseudomonas aeruginosa PA01
ccguggaccaacagccggcg

SEQ ID NO: 1419539 - RNA, 16 nt, Pseudomonas aeruginosa PA01
ccgucucgucgagcga

SEQ ID NO: 1419540 - RNA, 23 nt, Pseudomonas aeruginosa PA01
ccgucucgucgagcgagggcguc

SEQ ID NO: 1419541 - RNA, 17 nt, Pseudomonas aeruginosa PA01
ccgucgucguggcgaac

SEQ ID NO: 1419542 - RNA, 15 nt, Pseudomonas aeruginosa PA01
ccgucuucgaugaag

SEQ ID NO: 1419543 - RNA, 16 nt, Pseudomonas aeruginosa PA01
ccgucuugccgcugcg

SEQ ID NO: 1419544 - RNA, 22 nt, Pseudomonas aeruginosa PA01
ccgucuuccaccagaaggcggg

SEQ ID NO: 1419545 - RNA, 17 nt, Pseudomonas aeruginosa PA01
ccgucuuccagggcggc

SEQ ID NO: 1419546 - RNA, 13 nt, Pseudomonas aeruginosa PA01
ccgucuggcgcau

SEQ ID NO: 1419547 - RNA, 18 nt, Pseudomonas aeruginosa PA01
ccgucuggcgcauccgcc

SEQ ID NO: 1419548 - RNA, 18 nt, Pseudomonas aeruginosa PA01
ccgucgucaccucggcgc

SEQ ID NO: 1419549 - RNA, 20 nt, Pseudomonas aeruginosa PA01
ccgucgucaccucggcgcca

SEQ ID NO: 1419550 - RNA, 12 nt, Pseudomonas aeruginosa PA01
ccgucggcgacg

SEQ ID NO: 1419551 - RNA, 12 nt, Pseudomonas aeruginosa PA01
ccgucggccugg

SEQ ID NO: 1419552 - RNA, 14 nt, Pseudomonas aeruginosa PA01
ccgucggccucgcc

SEQ ID NO: 1419553 - RNA, 17 nt, Pseudomonas aeruginosa PA01
ccgucggccucgccgau

SEQ ID NO: 1419554 - RNA, 18 nt, Pseudomonas aeruginosa PA01
ccgucgaauuggacagca

SEQ ID NO: 1419555 - RNA, 19 nt, Pseudomonas aeruginosa PA01
ccgucgaauuggacagcag

SEQ ID NO: 1419556 - RNA, 22 nt, Pseudomonas aeruginosa PA01
ccgucgaauuggacagcaggcu

SEQ ID NO: 1419557 - RNA, 23 nt, Pseudomonas aeruginosa PA01
ccgucgaauuggacagcaggcug

SEQ ID NO: 1419558 - RNA, 20 nt, Pseudomonas aeruginosa PA01
ccgucgaagccaggcaccgg

SEQ ID NO: 1419559 - RNA, 14 nt, Pseudomonas aeruginosa PA01
ccgucgaacagcag

SEQ ID NO: 1419560 - RNA, 19 nt, Pseudomonas aeruginosa PA01
ccgucgaacagcagcucgc

SEQ ID NO: 1419561 - RNA, 18 nt, Pseudomonas aeruginosa PA01
ccgucgaaccagccgcgu

SEQ ID NO: 1419562 - RNA, 22 nt, Pseudomonas aeruginosa PA01
ccgucgaaccagggacgcccgg

SEQ ID NO: 1419563 - RNA, 17 nt, Pseudomonas aeruginosa PA01
ccgucgaagaucaccgg

SEQ ID NO: 1419564 - RNA, 19 nt, Pseudomonas aeruginosa PA01
ccgucgaagaucaccgggg

SEQ ID NO: 1419565 - RNA, 15 nt, Pseudomonas aeruginosa PA01
ccgucccgcgcgccg

SEQ ID NO: 1419566 - RNA, 16 nt, Pseudomonas aeruginosa PA01
ccgucccgcgcgccga

SEQ ID NO: 1419567 - RNA, 24 nt, Pseudomonas aeruginosa PA01
ccguccgaggauaccgcacggccg

SEQ ID NO: 1419568 - RNA, 12 nt, Pseudomonas aeruginosa PA01
ccguccgcagcg

SEQ ID NO: 1419569 - RNA, 13 nt, Pseudomonas aeruginosa PA01
ccguccgcgccgc

SEQ ID NO: 1419570 - RNA, 17 nt, Pseudomonas aeruginosa PA01
ccguccgcgccgcgcgu

SEQ ID NO: 1419571 - RNA, 12 nt, Pseudomonas aeruginosa PA01
ccguccgcugcg

SEQ ID NO: 1419572 - RNA, 15 nt, Pseudomonas aeruginosa PA01
ccgucgacgcccugg

SEQ ID NO: 1419573 - RNA, 22 nt, Pseudomonas aeruginosa PA01
ccgucgacgcaucgacggggcg

SEQ ID NO: 1419574 - RNA, 13 nt, Pseudomonas aeruginosa PA01
ccgucgaccugcg

SEQ ID NO: 1419575 - RNA, 18 nt, Pseudomonas aeruginosa PA01
ccgucgaccugcggggcg

SEQ ID NO: 1419576 - RNA, 20 nt, Pseudomonas aeruginosa PA01
ccgucgacccgccucacccc

SEQ ID NO: 1419577 - RNA, 17 nt, Pseudomonas aeruginosa PA01
ccgucgaccaucaccag

SEQ ID NO: 1419578 - RNA, 18 nt, Pseudomonas aeruginosa PA01
ccgucgaccaucaccagc

SEQ ID NO: 1419579 - RNA, 15 nt, Pseudomonas aeruginosa PA01
ccgucgagcaccagc

SEQ ID NO: 1419580 - RNA, 14 nt, Pseudomonas aeruginosa PA01
ccgucggccggggu

SEQ ID NO: 1419581 - RNA, 23 nt, Pseudomonas aeruginosa PA01
ccgucggccggggucaggccgag

SEQ ID NO: 1419582 - RNA, 17 nt, Pseudomonas aeruginosa PA01
ccgucgagccagcccag

SEQ ID NO: 1419583 - RNA, 21 nt, Pseudomonas aeruginosa PA01
ccgucgagccagcccagcggc

SEQ ID NO: 1419584 - RNA, 14 nt, Pseudomonas aeruginosa PA01
ccguacgcaccgcg

SEQ ID NO: 1419585 - RNA, 14 nt, Pseudomonas aeruginosa PA01
ccguacagcaggca

SEQ ID NO: 1419586 - RNA, 18 nt, Pseudomonas aeruginosa PA01
ccguacagcccccgccgg

SEQ ID NO: 1419587 - RNA, 16 nt, Pseudomonas aeruginosa PA01
ccguaccagucgcccg

SEQ ID NO: 1419588 - RNA, 16 nt, Pseudomonas aeruginosa PA01
ccgguuucccucgagc

SEQ ID NO: 1419589 - RNA, 18 nt, Pseudomonas aeruginosa PA01
ccgguuucccucgagcac

SEQ ID NO: 1419590 - RNA, 18 nt, Pseudomonas aeruginosa PA01
ccgguuggcuacccgcag

SEQ ID NO: 1419591 - RNA, 14 nt, Pseudomonas aeruginosa PA01
ccgguugugcgccc

SEQ ID NO: 1419592 - RNA, 16 nt, Pseudomonas aeruginosa PA01
ccgucagccaggcugg

SEQ ID NO: 1419593 - RNA, 14 nt, Pseudomonas aeruginosa PA01
ccgucaccagcagc

SEQ ID NO: 1419594 - RNA, 21 nt, Pseudomonas aeruginosa PA01
ccgucaacccuugcucccgcc

SEQ ID NO: 1419595 - RNA, 17 nt, Pseudomonas aeruginosa PA01
ccgucaggccuugcgcg

SEQ ID NO: 1419596 - RNA, 17 nt, Pseudomonas aeruginosa PA01
ccguccacaccgagacg

SEQ ID NO: 1419597 - RNA, 14 nt, Pseudomonas aeruginosa PA01
ccgucccagucggc

SEQ ID NO: 1419598 - RNA, 17 nt, Pseudomonas aeruginosa PA01
ccgucaugaccagagcc

SEQ ID NO: 1419599 - RNA, 19 nt, Pseudomonas aeruginosa PA01
ccgucaucgcugaccugga

SEQ ID NO: 1419600 - RNA, 14 nt, Pseudomonas aeruginosa PA01
ccgucaucgagcag

SEQ ID NO: 1419601 - RNA, 15 nt, Pseudomonas aeruginosa PA01
ccggugaggcgcagc

SEQ ID NO: 1419602 - RNA, 19 nt, Pseudomonas aeruginosa PA01
ccggugaggcgcagcagcg

SEQ ID NO: 1419603 - RNA, 22 nt, Pseudomonas aeruginosa PA01
ccggugaggcgcagcagcgcca

SEQ ID NO: 1419604 - RNA, 22 nt, Pseudomonas aeruginosa PA01
ccggugacgcugcucaccaggu

SEQ ID NO: 1419605 - RNA, 17 nt, Pseudomonas aeruginosa PA01
ccgggugccccaggcga

SEQ ID NO: 1419606 - RNA, 20 nt, Pseudomonas aeruginosa PA01
ccgggugcagguucaccgcc

SEQ ID NO: 1419607 - RNA, 21 nt, Pseudomonas aeruginosa PA01
ccgggugcagguucaccgccu

SEQ ID NO: 1419608 - RNA, 14 nt, Pseudomonas aeruginosa PA01
ccggugacgaaacc

SEQ ID NO: 1419609 - RNA, 19 nt, Pseudomonas aeruginosa PA01
ccggugacgaaaccggcgu

SEQ ID NO: 1419610 - RNA, 21 nt, Pseudomonas aeruginosa PA01
ccggugacgaaaccggcgucc

SEQ ID NO: 1419611 - RNA, 19 nt, Pseudomonas aeruginosa PA01
ccggugacgaacgaagcgc

SEQ ID NO: 1419612 - RNA, 19 nt, Pseudomonas aeruginosa PA01
ccggguggaacgaggcgac

SEQ ID NO: 1419613 - RNA, 17 nt, Pseudomonas aeruginosa PA01
ccggugcaggccgagcu

SEQ ID NO: 1419614 - RNA, 23 nt, Pseudomonas aeruginosa PA01
ccggugcaugaaggcgcugagcg

SEQ ID NO: 1419615 - RNA, 19 nt, Pseudomonas aeruginosa PA01
ccggugcaugcgcacgguc

SEQ ID NO: 1419616 - RNA, 18 nt, Pseudomonas aeruginosa PA01
ccggugccauacagcgcc

SEQ ID NO: 1419617 - RNA, 20 nt, Pseudomonas aeruginosa PA01
ccggugccauacagcgccca

SEQ ID NO: 1419618 - RNA, 20 nt, Pseudomonas aeruginosa PA01
ccggugccaggaccagcccg

SEQ ID NO: 1419619 - RNA, 21 nt, Pseudomonas aeruginosa PA01
ccggugccagggcggucggcc

SEQ ID NO: 1419620 - RNA, 16 nt, Pseudomonas aeruginosa PA01
ccgggugccuuccgcg

SEQ ID NO: 1419621 - RNA, 17 nt, Pseudomonas aeruginosa PA01
ccggugaugucggcgcu

SEQ ID NO: 1419622 - RNA, 17 nt, Pseudomonas aeruginosa PA01
ccggugucaggccgagg

SEQ ID NO: 1419623 - RNA, 16 nt, Pseudomonas aeruginosa PA01
ccggugucgacgacga

SEQ ID NO: 1419624 - RNA, 21 nt, Pseudomonas aeruginosa PA01
ccggugucgacgacgaaaggc

SEQ ID NO: 1419625 - RNA, 13 nt, Pseudomonas aeruginosa PA01
ccgguggcgacgc

SEQ ID NO: 1419626 - RNA, 17 nt, Pseudomonas aeruginosa PA01
ccgguggcgacgcgcag

SEQ ID NO: 1419627 - RNA, 14 nt, Pseudomonas aeruginosa PA01
ccgguggcgcccag

SEQ ID NO: 1419628 - RNA, 21 nt, Pseudomonas aeruginosa PA01
ccgguggacugguugaccugc

SEQ ID NO: 1419629 - RNA, 21 nt, Pseudomonas aeruginosa PA01
ccgguggccaggacgcuggcg

SEQ ID NO: 1419630 - RNA, 23 nt, Pseudomonas aeruginosa PA01
ccgguggccaggacgcuggcgau

SEQ ID NO: 1419631 - RNA, 12 nt, Pseudomonas aeruginosa PA01
ccgguggcguac

SEQ ID NO: 1419632 - RNA, 18 nt, Pseudomonas aeruginosa PA01
ccgguggcguuauccgcc

SEQ ID NO: 1419633 - RNA, 14 nt, Pseudomonas aeruginosa PA01
ccgguuggcgcccc

SEQ ID NO: 1419634 - RNA, 21 nt, Pseudomonas aeruginosa PA01
ccgguugcugcuugcgcgcgg

SEQ ID NO: 1419635 - RNA, 19 nt, Pseudomonas aeruginosa PA01
ccgguugcuggcacagguc

SEQ ID NO: 1419636 - RNA, 12 nt, Pseudomonas aeruginosa PA01
ccgguugcagcc

SEQ ID NO: 1419637 - RNA, 15 nt, Pseudomonas aeruginosa PA01
ccgguugcggcgccg

SEQ ID NO: 1419638 - RNA, 22 nt, Pseudomonas aeruginosa PA01
ccgguugagauccuggccggcg

SEQ ID NO: 1419639 - RNA, 20 nt, Pseudomonas aeruginosa PA01
ccgguugauuuccgcaccga

SEQ ID NO: 1419640 - RNA, 21 nt, Pseudomonas aeruginosa PA01
ccgguugauuuccgcaccgag

SEQ ID NO: 1419641 - RNA, 19 nt, Pseudomonas aeruginosa PA01
ccgguucguagaguucgcu

SEQ ID NO: 1419642 - RNA, 14 nt, Pseudomonas aeruginosa PA01
ccggugugacggcc

SEQ ID NO: 1419643 - RNA, 14 nt, Pseudomonas aeruginosa PA01
ccggugugcgcugc

SEQ ID NO: 1419644 - RNA, 19 nt, Pseudomonas aeruginosa PA01
ccgggcccugcuucgaacg

SEQ ID NO: 1419645 - RNA, 15 nt, Pseudomonas aeruginosa PA01
ccgggcccugggccc

SEQ ID NO: 1419646 - RNA, 18 nt, Pseudomonas aeruginosa PA01
ccgggcccugggccccgg

SEQ ID NO: 1419647 - RNA, 19 nt, Pseudomonas aeruginosa PA01
ccgggccgaucuucgccga

SEQ ID NO: 1419648 - RNA, 23 nt, Pseudomonas aeruginosa PA01
ccgggccgccuugcgcagcaacg

SEQ ID NO: 1419649 - RNA, 15 nt, Pseudomonas aeruginosa PA01
ccgggccgccggcga

SEQ ID NO: 1419650 - RNA, 13 nt, Pseudomonas aeruginosa PA01
ccgggccgccggc

SEQ ID NO: 1419651 - RNA, 14 nt, Pseudomonas aeruginosa PA01
ccgggcaacgcgca

SEQ ID NO: 1419652 - RNA, 16 nt, Pseudomonas aeruginosa PA01
ccgggcaacgcgcaga

SEQ ID NO: 1419653 - RNA, 17 nt, Pseudomonas aeruginosa PA01
ccgggcaacgcgcagag

SEQ ID NO: 1419654 - RNA, 20 nt, Pseudomonas aeruginosa PA01
ccgggcaacgcgcagaggcg

SEQ ID NO: 1419655 - RNA, 15 nt, Pseudomonas aeruginosa PA01
ccgggcaacugccga

SEQ ID NO: 1419656 - RNA, 16 nt, Pseudomonas aeruginosa PA01
ccgggcaacgccaggc

SEQ ID NO: 1419657 - RNA, 17 nt, Pseudomonas aeruginosa PA01
ccgggcaacgccaggcc

SEQ ID NO: 1419658 - RNA, 22 nt, Pseudomonas aeruginosa PA01
ccgggauggucgagggcgcguu

SEQ ID NO: 1419659 - RNA, 18 nt, Pseudomonas aeruginosa PA01
ccgggagcaucuggcccg

SEQ ID NO: 1419660 - RNA, 20 nt, Pseudomonas aeruginosa PA01
ccgggaggcgccgcgccagg

SEQ ID NO: 1419661 - RNA, 20 nt, Pseudomonas aeruginosa PA01
ccgggcuggccaccagcacc

SEQ ID NO: 1419662 - RNA, 16 nt, Pseudomonas aeruginosa PA01
ccgggcuggccaccgc

SEQ ID NO: 1419663 - RNA, 17 nt, Pseudomonas aeruginosa PA01
ccgggcuggccaccgcc

SEQ ID NO: 1419664 - RNA, 13 nt, Pseudomonas aeruginosa PA01
ccgggcugcgcuc

SEQ ID NO: 1419665 - RNA, 15 nt, Pseudomonas aeruginosa PA01
ccgggcugcgcucgg

SEQ ID NO: 1419666 - RNA, 18 nt, Pseudomonas aeruginosa PA01
ccgggcugcgcucggcgc

SEQ ID NO: 1419667 - RNA, 19 nt, Pseudomonas aeruginosa PA01
ccgggcugcgcucggcgcu

SEQ ID NO: 1419668 - RNA, 15 nt, Pseudomonas aeruginosa PA01
ccgggcucugguagc

SEQ ID NO: 1419669 - RNA, 18 nt, Pseudomonas aeruginosa PA01
ccgggcgguacaggcgca

SEQ ID NO: 1419670 - RNA, 12 nt, Pseudomonas aeruginosa PA01
ccgggcugccga

SEQ ID NO: 1419671 - RNA, 18 nt, Pseudomonas aeruginosa PA01
ccgggcuggccgucgagg

SEQ ID NO: 1419672 - RNA, 20 nt, Pseudomonas aeruginosa PA01
ccgggcuggucguagcagcg

SEQ ID NO: 1419673 - RNA, 22 nt, Pseudomonas aeruginosa PA01
ccgggcuggucguagcagcgga

SEQ ID NO: 1419674 - RNA, 19 nt, Pseudomonas aeruginosa PA01
ccgggcugguucagcgggu

SEQ ID NO: 1419675 - RNA, 14 nt, Pseudomonas aeruginosa PA01
ccgggcuuccuggc

SEQ ID NO: 1419676 - RNA, 19 nt, Pseudomonas aeruginosa PA01
ccgggcuuuuucauggcug

SEQ ID NO: 1419677 - RNA, 22 nt, Pseudomonas aeruginosa PA01
ccgggcuuuuucauggcuggcc

SEQ ID NO: 1419678 - RNA, 20 nt, Pseudomonas aeruginosa PA01
ccgggcuuuuucaugggcgc

SEQ ID NO: 1419679 - RNA, 19 nt, Pseudomonas aeruginosa PA01
ccgggcuuuuucauuuccu

SEQ ID NO: 1419680 - RNA, 23 nt, Pseudomonas aeruginosa PA01
ccgggcuuuuucucgucgcgcga

SEQ ID NO: 1419681 - RNA, 21 nt, Pseudomonas aeruginosa PA01
ccgggcgcaacccugcccagu

SEQ ID NO: 1419682 - RNA, 23 nt, Pseudomonas aeruginosa PA01
ccgggcgccaccgauagcggcgc

SEQ ID NO: 1419683 - RNA, 14 nt, Pseudomonas aeruginosa PA01
ccgggcgccaccgc

SEQ ID NO: 1419684 - RNA, 16 nt, Pseudomonas aeruginosa PA01
ccgggcggcgcggcgc

SEQ ID NO: 1419685 - RNA, 17 nt, Pseudomonas aeruginosa PA01
ccgggcggcgcggcgca

SEQ ID NO: 1419686 - RNA, 15 nt, Pseudomonas aeruginosa PA01
ccgggcggcgggcgc

SEQ ID NO: 1419687 - RNA, 16 nt, Pseudomonas aeruginosa PA01
ccgggcggcgggcgca

SEQ ID NO: 1419688 - RNA, 20 nt, Pseudomonas aeruginosa PA01
ccgggcggcgucgcggagaa

SEQ ID NO: 1419689 - RNA, 21 nt, Pseudomonas aeruginosa PA01
ccgggcggcuguagcggauca

SEQ ID NO: 1419690 - RNA, 18 nt, Pseudomonas aeruginosa PA01
ccggguccagcggccgcg

SEQ ID NO: 1419691 - RNA, 20 nt, Pseudomonas aeruginosa PA01
ccggguccagcggccgcgcc

SEQ ID NO: 1419692 - RNA, 14 nt, Pseudomonas aeruginosa PA01
ccgggucaggccga

SEQ ID NO: 1419693 - RNA, 15 nt, Pseudomonas aeruginosa PA01
ccgggucaucaccgg

SEQ ID NO: 1419694 - RNA, 18 nt, Pseudomonas aeruginosa PA01
ccgggucaucaccggcag

SEQ ID NO: 1419695 - RNA, 19 nt, Pseudomonas aeruginosa PA01
ccgggucaucaccggcagg

SEQ ID NO: 1419696 - RNA, 23 nt, Pseudomonas aeruginosa PA01
ccgggucgacaugcaggccggcc

SEQ ID NO: 1419697 - RNA, 18 nt, Pseudomonas aeruginosa PA01
ccgggucgaccuugccga

SEQ ID NO: 1419698 - RNA, 19 nt, Pseudomonas aeruginosa PA01
ccgggucgacuucgcacca

SEQ ID NO: 1419699 - RNA, 12 nt, Pseudomonas aeruginosa PA01
ccgggucgaggc

SEQ ID NO: 1419700 - RNA, 18 nt, Pseudomonas aeruginosa PA01
ccgggucgaggcugccga

SEQ ID NO: 1419701 - RNA, 13 nt, Pseudomonas aeruginosa PA01
ccgggucgagguc

SEQ ID NO: 1419702 - RNA, 16 nt, Pseudomonas aeruginosa PA01
ccgggucgccgcagcc

SEQ ID NO: 1419703 - RNA, 15 nt, Pseudomonas aeruginosa PA01
ccgggugaugcccgg

SEQ ID NO: 1419704 - RNA, 20 nt, Pseudomonas aeruginosa PA01
ccggggugggcauagauguc

SEQ ID NO: 1419705 - RNA, 14 nt, Pseudomonas aeruginosa PA01
ccgggguuggcgcu

SEQ ID NO: 1419706 - RNA, 16 nt, Pseudomonas aeruginosa PA01
ccgggguuggcgcuga

SEQ ID NO: 1419707 - RNA, 22 nt, Pseudomonas aeruginosa PA01
ccgggguugaguugcaggccgg

SEQ ID NO: 1419708 - RNA, 15 nt, Pseudomonas aeruginosa PA01
ccggguaccugcucg

SEQ ID NO: 1419709 - RNA, 16 nt, Pseudomonas aeruginosa PA01
ccggguauccagcacc

SEQ ID NO: 1419710 - RNA, 13 nt, Pseudomonas aeruginosa PA01
ccgggucacgguc

SEQ ID NO: 1419711 - RNA, 22 nt, Pseudomonas aeruginosa PA01
ccgggucacggucagcucggca

SEQ ID NO: 1419712 - RNA, 16 nt, Pseudomonas aeruginosa PA01
ccggguacuggcgcug

SEQ ID NO: 1419713 - RNA, 22 nt, Pseudomonas aeruginosa PA01
ccggguagcguuaucgccgguc

SEQ ID NO: 1419714 - RNA, 14 nt, Pseudomonas aeruginosa PA01
ccggguacagcgcc

SEQ ID NO: 1419715 - RNA, 19 nt, Pseudomonas aeruginosa PA01
ccggguacagcgccacggc

SEQ ID NO: 1419716 - RNA, 18 nt, Pseudomonas aeruginosa PA01
ccggggcggccgcucuuu

SEQ ID NO: 1419717 - RNA, 18 nt, Pseudomonas aeruginosa PA01
ccggggcgcaggucgcug

SEQ ID NO: 1419718 - RNA, 19 nt, Pseudomonas aeruginosa PA01
ccggggcgcaggucgcugg

SEQ ID NO: 1419719 - RNA, 13 nt, Pseudomonas aeruginosa PA01
ccggggcgggccg

SEQ ID NO: 1419720 - RNA, 18 nt, Pseudomonas aeruginosa PA01
ccggggcgugcaggccgc

SEQ ID NO: 1419721 - RNA, 21 nt, Pseudomonas aeruginosa PA01
ccggggcgugcaggccgccga

SEQ ID NO: 1419722 - RNA, 15 nt, Pseudomonas aeruginosa PA01
ccggggcucaggccu

SEQ ID NO: 1419723 - RNA, 13 nt, Pseudomonas aeruginosa PA01
ccgggggcggcga

SEQ ID NO: 1419724 - RNA, 15 nt, Pseudomonas aeruginosa PA01
ccgggggcggcgaac

SEQ ID NO: 1419725 - RNA, 16 nt, Pseudomonas aeruginosa PA01
ccgggggcggcgaacg

SEQ ID NO: 1419726 - RNA, 15 nt, Pseudomonas aeruginosa PA01
ccgggggcggcgccu

SEQ ID NO: 1419727 - RNA, 17 nt, Pseudomonas aeruginosa PA01
ccgggggcggcgccugg

SEQ ID NO: 1419728 - RNA, 15 nt, Pseudomonas aeruginosa PA01
ccggggucagcgccu

SEQ ID NO: 1419729 - RNA, 16 nt, Pseudomonas aeruginosa PA01
ccggggucaggccgag

SEQ ID NO: 1419730 - RNA, 13 nt, Pseudomonas aeruginosa PA01
ccggggcagcagg

SEQ ID NO: 1419731 - RNA, 20 nt, Pseudomonas aeruginosa PA01
ccggggcgaucuugaucgcc

SEQ ID NO: 1419732 - RNA, 21 nt, Pseudomonas aeruginosa PA01
ccggggcgaucuugaucgcca

SEQ ID NO: 1419733 - RNA, 17 nt, Pseudomonas aeruginosa PA01
ccggggcccggcaggca

SEQ ID NO: 1419734 - RNA, 18 nt, Pseudomonas aeruginosa PA01
ccggggccuucaggcgcu

SEQ ID NO: 1419735 - RNA, 19 nt, Pseudomonas aeruginosa PA01
ccggggccuucaggcgcuc

SEQ ID NO: 1419736 - RNA, 19 nt, Pseudomonas aeruginosa PA01
ccggggaguucgacccaug

SEQ ID NO: 1419737 - RNA, 16 nt, Pseudomonas aeruginosa PA01
ccggggaucagcgaga

SEQ ID NO: 1419738 - RNA, 19 nt, Pseudomonas aeruginosa PA01
ccggggaucaggucgccgc

SEQ ID NO: 1419739 - RNA, 20 nt, Pseudomonas aeruginosa PA01
ccgggcuucuucaggcaagg

SEQ ID NO: 1419740 - RNA, 22 nt, Pseudomonas aeruginosa PA01
ccggggaacagguucggcuuga

SEQ ID NO: 1419741 - RNA, 20 nt, Pseudomonas aeruginosa PA01
ccggcguucgccggguuuuu

SEQ ID NO: 1419742 - RNA, 19 nt, Pseudomonas aeruginosa PA01
ccggcguugaacugcccgc

SEQ ID NO: 1419743 - RNA, 20 nt, Pseudomonas aeruginosa PA01
ccggcguugaacugcccgca

SEQ ID NO: 1419744 - RNA, 15 nt, Pseudomonas aeruginosa PA01
ccggcguuucgccgg

SEQ ID NO: 1419745 - RNA, 19 nt, Pseudomonas aeruginosa PA01
ccggcuacaggccguagcg

SEQ ID NO: 1419746 - RNA, 14 nt, Pseudomonas aeruginosa PA01
ccggcuccggcugc

SEQ ID NO: 1419747 - RNA, 16 nt, Pseudomonas aeruginosa PA01
ccggcuccgcgcacgg

SEQ ID NO: 1419748 - RNA, 17 nt, Pseudomonas aeruginosa PA01
ccggcuccgcgcacgga

SEQ ID NO: 1419749 - RNA, 18 nt, Pseudomonas aeruginosa PA01
ccggcucgacgccgacau

SEQ ID NO: 1419750 - RNA, 15 nt, Pseudomonas aeruginosa PA01
ccggcugagcgccag

SEQ ID NO: 1419751 - RNA, 16 nt, Pseudomonas aeruginosa PA01
ccggcugagcgccagg

SEQ ID NO: 1419752 - RNA, 18 nt, Pseudomonas aeruginosa PA01
ccggcucgccgacuucca

SEQ ID NO: 1419753 - RNA, 13 nt, Pseudomonas aeruginosa PA01
ccggcucgccgcc

SEQ ID NO: 1419754 - RNA, 15 nt, Pseudomonas aeruginosa PA01
ccggcucgccgccgg

SEQ ID NO: 1419755 - RNA, 24 nt, Pseudomonas aeruginosa PA01
ccggcucgccgccgggcgcgcgcc

SEQ ID NO: 1419756 - RNA, 15 nt, Pseudomonas aeruginosa PA01
ccggcucgccgcgcu

SEQ ID NO: 1419757 - RNA, 11 nt, Pseudomonas aeruginosa PA01
ccggcucgccc

SEQ ID NO: 1419758 - RNA, 16 nt, Pseudomonas aeruginosa PA01
ccggcucgcccagcag

SEQ ID NO: 1419759 - RNA, 19 nt, Pseudomonas aeruginosa PA01
ccggcucgcccaugcgcgg

SEQ ID NO: 1419760 - RNA, 20 nt, Pseudomonas aeruginosa PA01
ccggcucgcccaugcgcggc

SEQ ID NO: 1419761 - RNA, 22 nt, Pseudomonas aeruginosa PA01
ccggcucgcccaugcgcggcga

SEQ ID NO: 1419762 - RNA, 20 nt, Pseudomonas aeruginosa PA01
ccggcugcacagguugacga

SEQ ID NO: 1419763 - RNA, 15 nt, Pseudomonas aeruginosa PA01
ccggcugccgcgcgu

SEQ ID NO: 1419764 - RNA, 13 nt, Pseudomonas aeruginosa PA01
ccggcuucggcgg

SEQ ID NO: 1419765 - RNA, 14 nt, Pseudomonas aeruginosa PA01
ccggcuucggcggc

SEQ ID NO: 1419766 - RNA, 15 nt, Pseudomonas aeruginosa PA01
ccggcuucggcggcg

SEQ ID NO: 1419767 - RNA, 19 nt, Pseudomonas aeruginosa PA01
ccggcuucggcggcgcgcu

SEQ ID NO: 1419768 - RNA, 15 nt, Pseudomonas aeruginosa PA01
ccggcuucagcaacu

SEQ ID NO: 1419769 - RNA, 16 nt, Pseudomonas aeruginosa PA01
ccggcuugccgauguc

SEQ ID NO: 1419770 - RNA, 16 nt, Pseudomonas aeruginosa PA01
ccggcuugccggcagc

SEQ ID NO: 1419771 - RNA, 17 nt, Pseudomonas aeruginosa PA01
ccggcuugccggcagcg

SEQ ID NO: 1419772 - RNA, 12 nt, Pseudomonas aeruginosa PA01
ccggcuugccgu

SEQ ID NO: 1419773 - RNA, 14 nt, Pseudomonas aeruginosa PA01
ccggcuugccgucg

SEQ ID NO: 1419774 - RNA, 16 nt, Pseudomonas aeruginosa PA01
ccggcuucgcggguga

SEQ ID NO: 1419775 - RNA, 16 nt, Pseudomonas aeruginosa PA01
ccggcuuccucgcccu

SEQ ID NO: 1419776 - RNA, 19 nt, Pseudomonas aeruginosa PA01
ccggcuuccaccagacgca

SEQ ID NO: 1419777 - RNA, 19 nt, Pseudomonas aeruginosa PA01
ccggcuugguucgcgcgcu

SEQ ID NO: 1419778 - RNA, 22 nt, Pseudomonas aeruginosa PA01
ccggcuuuuucauucggcuugc

SEQ ID NO: 1419779 - RNA, 23 nt, Pseudomonas aeruginosa PA01
ccggcuuggcgggcucgcccauc

SEQ ID NO: 1419780 - RNA, 24 nt, Pseudomonas aeruginosa PA01
ccggcuucuacgccuugcggcgcc

SEQ ID NO: 1419781 - RNA, 18 nt, Pseudomonas aeruginosa PA01
ccggcuugaccgccgccg

SEQ ID NO: 1419782 - RNA, 17 nt, Pseudomonas aeruginosa PA01
ccggcuugaucgagccc

SEQ ID NO: 1419783 - RNA, 16 nt, Pseudomonas aeruginosa PA01
ccgggacccugguagu

SEQ ID NO: 1419784 - RNA, 17 nt, Pseudomonas aeruginosa PA01
ccgggaaacagggcgac

SEQ ID NO: 1419785 - RNA, 23 nt, Pseudomonas aeruginosa PA01
ccgggaaacagggcgacgccgau

SEQ ID NO: 1419786 - RNA, 21 nt, Pseudomonas aeruginosa PA01
ccggcuuuuuucgcccgugcc

SEQ ID NO: 1419787 - RNA, 22 nt, Pseudomonas aeruginosa PA01
ccggcuuuuuucgcccgugccg

SEQ ID NO: 1419788 - RNA, 23 nt, Pseudomonas aeruginosa PA01
ccggcuuuuuucgcccgugccga

SEQ ID NO: 1419789 - RNA, 18 nt, Pseudomonas aeruginosa PA01
ccggcgcccugggcgcga

SEQ ID NO: 1419790 - RNA, 13 nt, Pseudomonas aeruginosa PA01
ccggcgccgccgg

SEQ ID NO: 1419791 - RNA, 13 nt, Pseudomonas aeruginosa PA01
ccggcgccgccga

SEQ ID NO: 1419792 - RNA, 15 nt, Pseudomonas aeruginosa PA01
ccggcggccggcgca

SEQ ID NO: 1419793 - RNA, 12 nt, Pseudomonas aeruginosa PA01
ccggcggcggca

SEQ ID NO: 1419794 - RNA, 20 nt, Pseudomonas aeruginosa PA01
ccggcggcggcaccgacgcc

SEQ ID NO: 1419795 - RNA, 18 nt, Pseudomonas aeruginosa PA01
ccggcggcggacgcaggc

SEQ ID NO: 1419796 - RNA, 19 nt, Pseudomonas aeruginosa PA01
ccggcggcggacgcaggcc

SEQ ID NO: 1419797 - RNA, 20 nt, Pseudomonas aeruginosa PA01
ccggcggcggacgcaggccg

SEQ ID NO: 1419798 - RNA, 21 nt, Pseudomonas aeruginosa PA01
ccggcggcggacgcaggccga

SEQ ID NO: 1419799 - RNA, 13 nt, Pseudomonas aeruginosa PA01
ccggcggcgcuga

SEQ ID NO: 1419800 - RNA, 20 nt, Pseudomonas aeruginosa PA01
ccggcggccugagccggccg

SEQ ID NO: 1419801 - RNA, 15 nt, Pseudomonas aeruginosa PA01
ccggcggcgcggcag

SEQ ID NO: 1419802 - RNA, 13 nt, Pseudomonas aeruginosa PA01
ccggcggcgcggg

SEQ ID NO: 1419803 - RNA, 14 nt, Pseudomonas aeruginosa PA01
ccggcggcgcgucc

SEQ ID NO: 1419804 - RNA, 17 nt, Pseudomonas aeruginosa PA01
ccggcggcugcugcgcc

SEQ ID NO: 1419805 - RNA, 18 nt, Pseudomonas aeruginosa PA01
ccggcggcugcugcgccu

SEQ ID NO: 1419806 - RNA, 20 nt, Pseudomonas aeruginosa PA01
ccggcggcugcugcgccugg

SEQ ID NO: 1419807 - RNA, 20 nt, Pseudomonas aeruginosa PA01
ccggcggguucagcccgccg

SEQ ID NO: 1419808 - RNA, 19 nt, Pseudomonas aeruginosa PA01
ccggcgggacgcgcaugca

SEQ ID NO: 1419809 - RNA, 21 nt, Pseudomonas aeruginosa PA01
ccggcgggacgcgcaugcagg

SEQ ID NO: 1419810 - RNA, 15 nt, Pseudomonas aeruginosa PA01
ccggcguuauccgcc

SEQ ID NO: 1419811 - RNA, 17 nt, Pseudomonas aeruginosa PA01
ccggcguuauccgccga

SEQ ID NO: 1419812 - RNA, 16 nt, Pseudomonas aeruginosa PA01
ccggcguccuugccga

SEQ ID NO: 1419813 - RNA, 15 nt, Pseudomonas aeruginosa PA01
ccggcguccgggugc

SEQ ID NO: 1419814 - RNA, 17 nt, Pseudomonas aeruginosa PA01
ccggcguccuccuccag

SEQ ID NO: 1419815 - RNA, 14 nt, Pseudomonas aeruginosa PA01
ccggcguccucgcg

SEQ ID NO: 1419816 - RNA, 13 nt, Pseudomonas aeruginosa PA01
ccggcguccagga

SEQ ID NO: 1419817 - RNA, 15 nt, Pseudomonas aeruginosa PA01
ccggccucggcggcg

SEQ ID NO: 1419818 - RNA, 23 nt, Pseudomonas aeruginosa PA01
ccggccugcacguggaguucacc

SEQ ID NO: 1419819 - RNA, 13 nt, Pseudomonas aeruginosa PA01
ccggccugcgcgc

SEQ ID NO: 1419820 - RNA, 15 nt, Pseudomonas aeruginosa PA01
ccggccugcgcgcac

SEQ ID NO: 1419821 - RNA, 17 nt, Pseudomonas aeruginosa PA01
ccggccugcgcgcacca

SEQ ID NO: 1419822 - RNA, 22 nt, Pseudomonas aeruginosa PA01
ccggccugcgcgcaccaggccu

SEQ ID NO: 1419823 - RNA, 15 nt, Pseudomonas aeruginosa PA01
ccggccuggcgccgg

SEQ ID NO: 1419824 - RNA, 16 nt, Pseudomonas aeruginosa PA01
ccggccuggcgccggg

SEQ ID NO: 1419825 - RNA, 17 nt, Pseudomonas aeruginosa PA01
ccggccuggaucucggc

SEQ ID NO: 1419826 - RNA, 13 nt, Pseudomonas aeruginosa PA01
ccggccugguagg

SEQ ID NO: 1419827 - RNA, 20 nt, Pseudomonas aeruginosa PA01
ccggccuggugacccggaca

SEQ ID NO: 1419828 - RNA, 17 nt, Pseudomonas aeruginosa PA01
ccggccuggugccgggc

SEQ ID NO: 1419829 - RNA, 15 nt, Pseudomonas aeruginosa PA01
ccggccuucaccgcg

SEQ ID NO: 1419830 - RNA, 16 nt, Pseudomonas aeruginosa PA01
ccggccuucaccgcgc

SEQ ID NO: 1419831 - RNA, 14 nt, Pseudomonas aeruginosa PA01
ccggccuggcgucc

SEQ ID NO: 1419832 - RNA, 17 nt, Pseudomonas aeruginosa PA01
ccggcgaagcuccucga

SEQ ID NO: 1419833 - RNA, 18 nt, Pseudomonas aeruginosa PA01
ccggcgaagggcaggccg

SEQ ID NO: 1419834 - RNA, 23 nt, Pseudomonas aeruginosa PA01
ccggcgaagggcaggccgaucau

SEQ ID NO: 1419835 - RNA, 13 nt, Pseudomonas aeruginosa PA01
ccggcgaacgccg

SEQ ID NO: 1419836 - RNA, 17 nt, Pseudomonas aeruginosa PA01
ccggcgaacgcuugagc

SEQ ID NO: 1419837 - RNA, 23 nt, Pseudomonas aeruginosa PA01
ccggcgaaccagugcaccgccgg

SEQ ID NO: 1419838 - RNA, 20 nt, Pseudomonas aeruginosa PA01
ccggccuugcuuugcgccuc

SEQ ID NO: 1419839 - RNA, 17 nt, Pseudomonas aeruginosa PA01
ccggcgaacagccagcg

SEQ ID NO: 1419840 - RNA, 21 nt, Pseudomonas aeruginosa PA01
ccggcgaacagcgcuuccugg

SEQ ID NO: 1419841 - RNA, 17 nt, Pseudomonas aeruginosa PA01
ccggccggggcgcgccc

SEQ ID NO: 1419842 - RNA, 18 nt, Pseudomonas aeruginosa PA01
ccggccggggcgcgcccg

SEQ ID NO: 1419843 - RNA, 16 nt, Pseudomonas aeruginosa PA01
ccggccggggccggca

SEQ ID NO: 1419844 - RNA, 14 nt, Pseudomonas aeruginosa PA01
ccggccggcucaga

SEQ ID NO: 1419845 - RNA, 15 nt, Pseudomonas aeruginosa PA01
ccggccggcucagaa

SEQ ID NO: 1419846 - RNA, 22 nt, Pseudomonas aeruginosa PA01
ccggccggcggccugagccggc

SEQ ID NO: 1419847 - RNA, 16 nt, Pseudomonas aeruginosa PA01
ccggccggcaggccga

SEQ ID NO: 1419848 - RNA, 12 nt, Pseudomonas aeruginosa PA01
ccggccggcagc

SEQ ID NO: 1419849 - RNA, 16 nt, Pseudomonas aeruginosa PA01
ccggccggcagcgagc

SEQ ID NO: 1419850 - RNA, 19 nt, Pseudomonas aeruginosa PA01
ccggccggcagcgagcggg

SEQ ID NO: 1419851 - RNA, 16 nt, Pseudomonas aeruginosa PA01
ccggccgucgcgcacc

SEQ ID NO: 1419852 - RNA, 17 nt, Pseudomonas aeruginosa PA01
ccggccgucgcgcacca

SEQ ID NO: 1419853 - RNA, 19 nt, Pseudomonas aeruginosa PA01
ccggccgucccagucggcg

SEQ ID NO: 1419854 - RNA, 20 nt, Pseudomonas aeruginosa PA01
ccggccgucccagucggcgu

SEQ ID NO: 1419855 - RNA, 23 nt, Pseudomonas aeruginosa PA01
ccggccucgaagaacuccaucuc

SEQ ID NO: 1419856 - RNA, 14 nt, Pseudomonas aeruginosa PA01
ccggccucgacgca

SEQ ID NO: 1419857 - RNA, 16 nt, Pseudomonas aeruginosa PA01
ccggccucgacgcaga

SEQ ID NO: 1419858 - RNA, 14 nt, Pseudomonas aeruginosa PA01
ccggccucgccggu

SEQ ID NO: 1419859 - RNA, 14 nt, Pseudomonas aeruginosa PA01
ccggccucgcgcaa

SEQ ID NO: 1419860 - RNA, 15 nt, Pseudomonas aeruginosa PA01
ccggccucgcugccg

SEQ ID NO: 1419861 - RNA, 16 nt, Pseudomonas aeruginosa PA01
ccggccucgcugccgc

SEQ ID NO: 1419862 - RNA, 17 nt, Pseudomonas aeruginosa PA01
ccggccucgcugccgcc

SEQ ID NO: 1419863 - RNA, 20 nt, Pseudomonas aeruginosa PA01
ccggccuccagcgccuggcg

SEQ ID NO: 1419864 - RNA, 19 nt, Pseudomonas aeruginosa PA01
ccggccuccaggcuggccu

SEQ ID NO: 1419865 - RNA, 14 nt, Pseudomonas aeruginosa PA01
ccggccuccccggc

SEQ ID NO: 1419866 - RNA, 19 nt, Pseudomonas aeruginosa PA01
ccggccuccccggcccgcg

SEQ ID NO: 1419867 - RNA, 16 nt, Pseudomonas aeruginosa PA01
ccggccucaacgaccg

SEQ ID NO: 1419868 - RNA, 18 nt, Pseudomonas aeruginosa PA01
ccggccucaacgaccgcc

SEQ ID NO: 1419869 - RNA, 22 nt, Pseudomonas aeruginosa PA01
ccggccucaacgaccgcccagg

SEQ ID NO: 1419870 - RNA, 13 nt, Pseudomonas aeruginosa PA01
ccggcgacgcagg

SEQ ID NO: 1419871 - RNA, 15 nt, Pseudomonas aeruginosa PA01
ccggcgacgcaggac

SEQ ID NO: 1419872 - RNA, 22 nt, Pseudomonas aeruginosa PA01
ccggcgaccuuguccaggcgcu

SEQ ID NO: 1419873 - RNA, 15 nt, Pseudomonas aeruginosa PA01
ccggcgacgacgauc

SEQ ID NO: 1419874 - RNA, 18 nt, Pseudomonas aeruginosa PA01
ccggcgacgacgaucccg

SEQ ID NO: 1419875 - RNA, 21 nt, Pseudomonas aeruginosa PA01
ccggcgacgacgaucccggcg

SEQ ID NO: 1419876 - RNA, 15 nt, Pseudomonas aeruginosa PA01
ccggcgaccaccgcc

SEQ ID NO: 1419877 - RNA, 17 nt, Pseudomonas aeruginosa PA01
ccggcgaccaccgccgg

SEQ ID NO: 1419878 - RNA, 15 nt, Pseudomonas aeruginosa PA01
ccggcgaccagcguc

SEQ ID NO: 1419879 - RNA, 16 nt, Pseudomonas aeruginosa PA01
ccggcgaccagcgucg

SEQ ID NO: 1419880 - RNA, 16 nt, Pseudomonas aeruginosa PA01
ccggcgaccagcucga

SEQ ID NO: 1419881 - RNA, 15 nt, Pseudomonas aeruginosa PA01
ccggcgagccgcugg

SEQ ID NO: 1419882 - RNA, 14 nt, Pseudomonas aeruginosa PA01
ccggcgagcgagcg

SEQ ID NO: 1419883 - RNA, 21 nt, Pseudomonas aeruginosa PA01
ccggcgagccagguuuccggc

SEQ ID NO: 1419884 - RNA, 16 nt, Pseudomonas aeruginosa PA01
ccggcgagcacggcga

SEQ ID NO: 1419885 - RNA, 21 nt, Pseudomonas aeruginosa PA01
ccggcgagagcguccggcagg

SEQ ID NO: 1419886 - RNA, 21 nt, Pseudomonas aeruginosa PA01
ccggcgagucguuacgaaacg

SEQ ID NO: 1419887 - RNA, 22 nt, Pseudomonas aeruginosa PA01
ccggcgagucguuacgaaacgg

SEQ ID NO: 1419888 - RNA, 15 nt, Pseudomonas aeruginosa PA01
ccggcgagggcggcg

SEQ ID NO: 1419889 - RNA, 21 nt, Pseudomonas aeruginosa PA01
ccggcgagggcggcgaccugg

SEQ ID NO: 1419890 - RNA, 17 nt, Pseudomonas aeruginosa PA01
ccggcgaggcguuccag

SEQ ID NO: 1419891 - RNA, 16 nt, Pseudomonas aeruginosa PA01
ccggcgaucagcucgc

SEQ ID NO: 1419892 - RNA, 18 nt, Pseudomonas aeruginosa PA01
ccggcgaucagcucgcgg

SEQ ID NO: 1419893 - RNA, 15 nt, Pseudomonas aeruginosa PA01
ccggcgaucauccag

SEQ ID NO: 1419894 - RNA, 16 nt, Pseudomonas aeruginosa PA01
ccggcgaucauccagc

SEQ ID NO: 1419895 - RNA, 12 nt, Pseudomonas aeruginosa PA01
ccggcgaucgcc

SEQ ID NO: 1419896 - RNA, 19 nt, Pseudomonas aeruginosa PA01
ccggcgaucgccaggcgau

SEQ ID NO: 1419897 - RNA, 15 nt, Pseudomonas aeruginosa PA01
ccggcgaucgccggc

SEQ ID NO: 1419898 - RNA, 17 nt, Pseudomonas aeruginosa PA01
ccggcgaucgccggcgu

SEQ ID NO: 1419899 - RNA, 15 nt, Pseudomonas aeruginosa PA01
ccggcgaggaucgcg

SEQ ID NO: 1419900 - RNA, 14 nt, Pseudomonas aeruginosa PA01
ccggcgauguucgc

SEQ ID NO: 1419901 - RNA, 23 nt, Pseudomonas aeruginosa PA01
ccggcgaugauggucaacaccag

SEQ ID NO: 1419902 - RNA, 17 nt, Pseudomonas aeruginosa PA01
ccggcgaugcccaggcc

SEQ ID NO: 1419903 - RNA, 18 nt, Pseudomonas aeruginosa PA01
ccggcgaugcccaggccg

SEQ ID NO: 1419904 - RNA, 22 nt, Pseudomonas aeruginosa PA01
ccggcgaugcccaggccgccga

SEQ ID NO: 1419905 - RNA, 22 nt, Pseudomonas aeruginosa PA01
ccggcgaugcguuugucgaccu

SEQ ID NO: 1419906 - RNA, 19 nt, Pseudomonas aeruginosa PA01
ccggcgaugcucagcgccg

SEQ ID NO: 1419907 - RNA, 22 nt, Pseudomonas aeruginosa PA01
ccggcgaugcucagcgccggcc

SEQ ID NO: 1419908 - RNA, 23 nt, Pseudomonas aeruginosa PA01
ccggcgaugcucagcgccggcca

SEQ ID NO: 1419909 - RNA, 16 nt, Pseudomonas aeruginosa PA01
ccggcgauggcccaga

SEQ ID NO: 1419910 - RNA, 15 nt, Pseudomonas aeruginosa PA01
ccggcgaugccgccc

SEQ ID NO: 1419911 - RNA, 16 nt, Pseudomonas aeruginosa PA01
ccggcgaugccgccca

SEQ ID NO: 1419912 - RNA, 17 nt, Pseudomonas aeruginosa PA01
ccggcgaugccgcccag

SEQ ID NO: 1419913 - RNA, 21 nt, Pseudomonas aeruginosa PA01
ccggcgaugccgcccagcacc

SEQ ID NO: 1419914 - RNA, 22 nt, Pseudomonas aeruginosa PA01
ccggcgaugccgcccagcaccg

SEQ ID NO: 1419915 - RNA, 15 nt, Pseudomonas aeruginosa PA01
ccggcgcagaacugc

SEQ ID NO: 1419916 - RNA, 21 nt, Pseudomonas aeruginosa PA01
ccggcgcagaacugccgggcc

SEQ ID NO: 1419917 - RNA, 13 nt, Pseudomonas aeruginosa PA01
ccggcgcagagcg

SEQ ID NO: 1419918 - RNA, 14 nt, Pseudomonas aeruginosa PA01
ccggcgcacgccgg

SEQ ID NO: 1419919 - RNA, 17 nt, Pseudomonas aeruginosa PA01
ccggcgcacgccggccu

SEQ ID NO: 1419920 - RNA, 22 nt, Pseudomonas aeruginosa PA01
ccggcgcacgccggccucgcgc

SEQ ID NO: 1419921 - RNA, 18 nt, Pseudomonas aeruginosa PA01
ccggcgccaccgcguuga

SEQ ID NO: 1419922 - RNA, 21 nt, Pseudomonas aeruginosa PA01
ccggcgccaacugcuugccga

SEQ ID NO: 1419923 - RNA, 12 nt, Pseudomonas aeruginosa PA01
ccggcgccaccc

SEQ ID NO: 1419924 - RNA, 23 nt, Pseudomonas aeruginosa PA01
ccggcgccaccgauucgccggcc

SEQ ID NO: 1419925 - RNA, 17 nt, Pseudomonas aeruginosa PA01
ccggcgcagaucgcggc

SEQ ID NO: 1419926 - RNA, 18 nt, Pseudomonas aeruginosa PA01
ccggcgcagaucgcggcg

SEQ ID NO: 1419927 - RNA, 14 nt, Pseudomonas aeruginosa PA01
ccggcgcagcccag

SEQ ID NO: 1419928 - RNA, 18 nt, Pseudomonas aeruginosa PA01
ccggcgcagcccagccgc

SEQ ID NO: 1419929 - RNA, 16 nt, Pseudomonas aeruginosa PA01
ccggcgcaucgucgaa

SEQ ID NO: 1419930 - RNA, 19 nt, Pseudomonas aeruginosa PA01
ccggcgcaugcgccggcuu

SEQ ID NO: 1419931 - RNA, 18 nt, Pseudomonas aeruginosa PA01
ccggcgcaucagcgccgg

SEQ ID NO: 1419932 - RNA, 14 nt, Pseudomonas aeruginosa PA01
ccggccccgcggua

SEQ ID NO: 1419933 - RNA, 23 nt, Pseudomonas aeruginosa PA01
ccggccccgcgguacccggcagg

SEQ ID NO: 1419934 - RNA, 15 nt, Pseudomonas aeruginosa PA01
ccggcccauggcgac

SEQ ID NO: 1419935 - RNA, 12 nt, Pseudomonas aeruginosa PA01
ccggcccaggcc

SEQ ID NO: 1419936 - RNA, 19 nt, Pseudomonas aeruginosa PA01
ccggcccagcguucggcgc

SEQ ID NO: 1419937 - RNA, 11 nt, Pseudomonas aeruginosa PA01
ccggcccaggc

SEQ ID NO: 1419938 - RNA, 13 nt, Pseudomonas aeruginosa PA01
ccggcccagcagg

SEQ ID NO: 1419939 - RNA, 17 nt, Pseudomonas aeruginosa PA01
ccggcccagcaggccgg

SEQ ID NO: 1419940 - RNA, 20 nt, Pseudomonas aeruginosa PA01
ccggcccagcaggccggcca

SEQ ID NO: 1419941 - RNA, 14 nt, Pseudomonas aeruginosa PA01
ccggcccggcguga

SEQ ID NO: 1419942 - RNA, 14 nt, Pseudomonas aeruginosa PA01
ccggcccgcgcggc

SEQ ID NO: 1419943 - RNA, 13 nt, Pseudomonas aeruginosa PA01
ccggccccugggc

SEQ ID NO: 1419944 - RNA, 16 nt, Pseudomonas aeruginosa PA01
ccggccccugggccgg

SEQ ID NO: 1419945 - RNA, 22 nt, Pseudomonas aeruginosa PA01
ccggcccggagaucgccgcgcc

SEQ ID NO: 1419946 - RNA, 14 nt, Pseudomonas aeruginosa PA01
ccggcccggagcgc

SEQ ID NO: 1419947 - RNA, 12 nt, Pseudomonas aeruginosa PA01
ccggcccggcca

SEQ ID NO: 1419948 - RNA, 14 nt, Pseudomonas aeruginosa PA01
ccggcccggccagg

SEQ ID NO: 1419949 - RNA, 18 nt, Pseudomonas aeruginosa PA01
ccggcccggccagguagg

SEQ ID NO: 1419950 - RNA, 18 nt, Pseudomonas aeruginosa PA01
ccggccgccuuccucggc

SEQ ID NO: 1419951 - RNA, 13 nt, Pseudomonas aeruginosa PA01
ccggccgccugcc

SEQ ID NO: 1419952 - RNA, 23 nt, Pseudomonas aeruginosa PA01
ccggccggauuggccgaggugga

SEQ ID NO: 1419953 - RNA, 15 nt, Pseudomonas aeruginosa PA01
ccggccggaggggau

SEQ ID NO: 1419954 - RNA, 18 nt, Pseudomonas aeruginosa PA01
ccggccgcgucgcccagg

SEQ ID NO: 1419955 - RNA, 22 nt, Pseudomonas aeruginosa PA01
ccggccgcgucgcccaggccgc

SEQ ID NO: 1419956 - RNA, 14 nt, Pseudomonas aeruginosa PA01
ccggccgcugccgg

SEQ ID NO: 1419957 - RNA, 15 nt, Pseudomonas aeruginosa PA01
ccggccgcgcucgac

SEQ ID NO: 1419958 - RNA, 15 nt, Pseudomonas aeruginosa PA01
ccggccgcgccagcc

SEQ ID NO: 1419959 - RNA, 15 nt, Pseudomonas aeruginosa PA01
ccggccgaucuccug

SEQ ID NO: 1419960 - RNA, 17 nt, Pseudomonas aeruginosa PA01
ccggccgaucuccuggc

SEQ ID NO: 1419961 - RNA, 12 nt, Pseudomonas aeruginosa PA01
ccggccgcagca

SEQ ID NO: 1419962 - RNA, 13 nt, Pseudomonas aeruginosa PA01
ccggccgcaggca

SEQ ID NO: 1419963 - RNA, 15 nt, Pseudomonas aeruginosa PA01
ccggccgccagcagg

SEQ ID NO: 1419964 - RNA, 17 nt, Pseudomonas aeruginosa PA01
ccggccgccagcaggua

SEQ ID NO: 1419965 - RNA, 14 nt, Pseudomonas aeruginosa PA01
ccggccgaccaggu

SEQ ID NO: 1419966 - RNA, 19 nt, Pseudomonas aeruginosa PA01
ccggccgacgauguucgag

SEQ ID NO: 1419967 - RNA, 23 nt, Pseudomonas aeruginosa PA01
ccggccgacgauguucgaggcgc

SEQ ID NO: 1419968 - RNA, 13 nt, Pseudomonas aeruginosa PA01
ccggccgacgaug

SEQ ID NO: 1419969 - RNA, 21 nt, Pseudomonas aeruginosa PA01
ccggcccacgcucagugcgcc

SEQ ID NO: 1419970 - RNA, 17 nt, Pseudomonas aeruginosa PA01
ccggccauuacgccgag

SEQ ID NO: 1419971 - RNA, 18 nt, Pseudomonas aeruginosa PA01
ccggccauuacgccgagc

SEQ ID NO: 1419972 - RNA, 19 nt, Pseudomonas aeruginosa PA01
ccggccauuacgccgagca

SEQ ID NO: 1419973 - RNA, 18 nt, Pseudomonas aeruginosa PA01
ccggccauugccgccaga

SEQ ID NO: 1419974 - RNA, 17 nt, Pseudomonas aeruginosa PA01
ccggccaucagcaccag

SEQ ID NO: 1419975 - RNA, 12 nt, Pseudomonas aeruginosa PA01
ccggccaugccg

SEQ ID NO: 1419976 - RNA, 21 nt, Pseudomonas aeruginosa PA01
ccggccaugccgccgacgccg

SEQ ID NO: 1419977 - RNA, 17 nt, Pseudomonas aeruginosa PA01
ccggccaugcuggcgcu

SEQ ID NO: 1419978 - RNA, 14 nt, Pseudomonas aeruginosa PA01
ccggccaugcaggc

SEQ ID NO: 1419979 - RNA, 23 nt, Pseudomonas aeruginosa PA01
ccggccaugcaggccagggcggu

SEQ ID NO: 1419980 - RNA, 17 nt, Pseudomonas aeruginosa PA01
ccggccagguacuggcg

SEQ ID NO: 1419981 - RNA, 19 nt, Pseudomonas aeruginosa PA01
ccggccagguacuggcgau

SEQ ID NO: 1419982 - RNA, 19 nt, Pseudomonas aeruginosa PA01
ccggccagguaggcgacga

SEQ ID NO: 1419983 - RNA, 20 nt, Pseudomonas aeruginosa PA01
ccggccagguaggcgacgaa

SEQ ID NO: 1419984 - RNA, 22 nt, Pseudomonas aeruginosa PA01
ccggccagguaggcgacgaagc

SEQ ID NO: 1419985 - RNA, 23 nt, Pseudomonas aeruginosa PA01
ccggccaggucguugcgccggcc

SEQ ID NO: 1419986 - RNA, 18 nt, Pseudomonas aeruginosa PA01
ccggccauccagccaggc

SEQ ID NO: 1419987 - RNA, 16 nt, Pseudomonas aeruginosa PA01
ccggccauccuggccg

SEQ ID NO: 1419988 - RNA, 14 nt, Pseudomonas aeruginosa PA01
ccggccaggccgcc

SEQ ID NO: 1419989 - RNA, 16 nt, Pseudomonas aeruginosa PA01
ccggccaggccgccca

SEQ ID NO: 1419990 - RNA, 13 nt, Pseudomonas aeruginosa PA01
ccggccaggcccu

SEQ ID NO: 1419991 - RNA, 20 nt, Pseudomonas aeruginosa PA01
ccggccaggcccucagcggc

SEQ ID NO: 1419992 - RNA, 16 nt, Pseudomonas aeruginosa PA01
ccggccagggucgcca

SEQ ID NO: 1419993 - RNA, 21 nt, Pseudomonas aeruginosa PA01
ccggccagggucgccagcagg

SEQ ID NO: 1419994 - RNA, 23 nt, Pseudomonas aeruginosa PA01
ccggccagggucgccagcaggua

SEQ ID NO: 1419995 - RNA, 17 nt, Pseudomonas aeruginosa PA01
ccggccagggcgcggua

SEQ ID NO: 1419996 - RNA, 13 nt, Pseudomonas aeruginosa PA01
ccggccaggcgcg

SEQ ID NO: 1419997 - RNA, 14 nt, Pseudomonas aeruginosa PA01
ccggccaggcgcgg

SEQ ID NO: 1419998 - RNA, 16 nt, Pseudomonas aeruginosa PA01
ccggccaggcgcggcg

SEQ ID NO: 1419999 - RNA, 19 nt, Pseudomonas aeruginosa PA01
ccggccaggcgcuggucca

SEQ ID NO: 1420000 - RNA, 17 nt, Pseudomonas aeruginosa PA01
ccggccaggcgguccag

SEQ ID NO: 1420001 - RNA, 16 nt, Pseudomonas aeruginosa PA01
ccggccaaccaccggc

SEQ ID NO: 1420002 - RNA, 18 nt, Pseudomonas aeruginosa PA01
ccggcauuggcacccugg

SEQ ID NO: 1420003 - RNA, 14 nt, Pseudomonas aeruginosa PA01
ccggcauucgccgg

SEQ ID NO: 1420004 - RNA, 17 nt, Pseudomonas aeruginosa PA01
ccggcauucgccgggcu

SEQ ID NO: 1420005 - RNA, 16 nt, Pseudomonas aeruginosa PA01
ccgcugggcagcacgc

SEQ ID NO: 1420006 - RNA, 22 nt, Pseudomonas aeruginosa PA01
ccgcuggggaccgcaccuggug

SEQ ID NO: 1420007 - RNA, 18 nt, Pseudomonas aeruginosa PA01
ccgcuggcguuauucgcc

SEQ ID NO: 1420008 - RNA, 19 nt, Pseudomonas aeruginosa PA01
ccgcuggcguuauucgccc

SEQ ID NO: 1420009 - RNA, 21 nt, Pseudomonas aeruginosa PA01
ccgcuggcguuguugccgccg

SEQ ID NO: 1420010 - RNA, 15 nt, Pseudomonas aeruginosa PA01
ccgcugggacggcgg

SEQ ID NO: 1420011 - RNA, 17 nt, Pseudomonas aeruginosa PA01
ccgcugggacggcggcu

SEQ ID NO: 1420012 - RNA, 22 nt, Pseudomonas aeruginosa PA01
ccgcuggcgucgaaugcggcgu

SEQ ID NO: 1420013 - RNA, 20 nt, Pseudomonas aeruginosa PA01
ccgcuggcggccuucggcgu

SEQ ID NO: 1420014 - RNA, 18 nt, Pseudomonas aeruginosa PA01
ccgcuggcggcgacgaag

SEQ ID NO: 1420015 - RNA, 12 nt, Pseudomonas aeruginosa PA01
ccggaagcgcuc

SEQ ID NO: 1420016 - RNA, 22 nt, Pseudomonas aeruginosa PA01
ccggaagcgcucgcgcuuccgg

SEQ ID NO: 1420017 - RNA, 21 nt, Pseudomonas aeruginosa PA01
ccggaagcuucaggcucggcc

SEQ ID NO: 1420018 - RNA, 17 nt, Pseudomonas aeruginosa PA01
ccggaaucacgcugcuc

SEQ ID NO: 1420019 - RNA, 17 nt, Pseudomonas aeruginosa PA01
ccggaaucacgucgauc

SEQ ID NO: 1420020 - RNA, 20 nt, Pseudomonas aeruginosa PA01
ccggaaucacgucgaucugc

SEQ ID NO: 1420021 - RNA, 22 nt, Pseudomonas aeruginosa PA01
ccggcauccagcauccgugcga

SEQ ID NO: 1420022 - RNA, 18 nt, Pseudomonas aeruginosa PA01
ccggcaucgaccagcagc

SEQ ID NO: 1420023 - RNA, 22 nt, Pseudomonas aeruginosa PA01
ccggcaucgaccagcagcggcu

SEQ ID NO: 1420024 - RNA, 15 nt, Pseudomonas aeruginosa PA01
ccggcauaggcgcca

SEQ ID NO: 1420025 - RNA, 13 nt, Pseudomonas aeruginosa PA01
ccggcauaccgcc

SEQ ID NO: 1420026 - RNA, 15 nt, Pseudomonas aeruginosa PA01
ccggcauaccgcccg

SEQ ID NO: 1420027 - RNA, 14 nt, Pseudomonas aeruginosa PA01
cgcgcggaccuucg

SEQ ID NO: 1420028 - RNA, 23 nt, Pseudomonas aeruginosa PA01
cgcgcgcuggucgacguaggcgg

SEQ ID NO: 1420029 - RNA, 16 nt, Pseudomonas aeruginosa PA01
cgcgcgcuggcgcagc

SEQ ID NO: 1420030 - RNA, 22 nt, Pseudomonas aeruginosa PA01
cgcgcgcuggauuucgccgagu

SEQ ID NO: 1420031 - RNA, 15 nt, Pseudomonas aeruginosa PA01
cgcgcgcucucgccg

SEQ ID NO: 1420032 - RNA, 16 nt, Pseudomonas aeruginosa PA01
cgcgcgcucucgccgg

SEQ ID NO: 1420033 - RNA, 14 nt, Pseudomonas aeruginosa PA01
cgcgcgcgucgagc

SEQ ID NO: 1420034 - RNA, 16 nt, Pseudomonas aeruginosa PA01
cgcgcgcuccucgauc

SEQ ID NO: 1420035 - RNA, 14 nt, Pseudomonas aeruginosa PA01
cgcgcgcggucgag

SEQ ID NO: 1420036 - RNA, 15 nt, Pseudomonas aeruginosa PA01
cgcgcgcggucgagc

SEQ ID NO: 1420037 - RNA, 18 nt, Pseudomonas aeruginosa PA01
cgcgcgcggucgagcagc

SEQ ID NO: 1420038 - RNA, 17 nt, Pseudomonas aeruginosa PA01
cgcgccuccaggcgcgc

SEQ ID NO: 1420039 - RNA, 22 nt, Pseudomonas aeruginosa PA01
cgcgccuccaggcgcgccugga

SEQ ID NO: 1420040 - RNA, 14 nt, Pseudomonas aeruginosa PA01
cgcgccuccggcag

SEQ ID NO: 1420041 - RNA, 15 nt, Pseudomonas aeruginosa PA01
cgcgccuccggcagc

SEQ ID NO: 1420042 - RNA, 16 nt, Pseudomonas aeruginosa PA01
cgcgccuccggcagcg

SEQ ID NO: 1420043 - RNA, 18 nt, Pseudomonas aeruginosa PA01
cgcgccuccggcagcguc

SEQ ID NO: 1420044 - RNA, 12 nt, Pseudomonas aeruginosa PA01
cgcgcgcggcca

SEQ ID NO: 1420045 - RNA, 14 nt, Pseudomonas aeruginosa PA01
cgcgcgcgcggucg

SEQ ID NO: 1420046 - RNA, 20 nt, Pseudomonas aeruginosa PA01
cgcgccucagcggcuggcga

SEQ ID NO: 1420047 - RNA, 14 nt, Pseudomonas aeruginosa PA01
cgcgccgugcggcg

SEQ ID NO: 1420048 - RNA, 19 nt, Pseudomonas aeruginosa PA01
cgcgcggucuucaucaccu

SEQ ID NO: 1420049 - RNA, 17 nt, Pseudomonas aeruginosa PA01
cgcgcggguuuccgugc

SEQ ID NO: 1420050 - RNA, 16 nt, Pseudomonas aeruginosa PA01
cgcgcggucgagcagc

SEQ ID NO: 1420051 - RNA, 21 nt, Pseudomonas aeruginosa PA01
cgcgcggucgagcucggccag

SEQ ID NO: 1420052 - RNA, 17 nt, Pseudomonas aeruginosa PA01
cgcgcgggccggcgaug

SEQ ID NO: 1420053 - RNA, 19 nt, Pseudomonas aeruginosa PA01
cgcgcgggccggcgauggc

SEQ ID NO: 1420054 - RNA, 20 nt, Pseudomonas aeruginosa PA01
cgcgcgggccggcgauggcc

SEQ ID NO: 1420055 - RNA, 14 nt, Pseudomonas aeruginosa PA01
cgcgcgggccgagg

SEQ ID NO: 1420056 - RNA, 20 nt, Pseudomonas aeruginosa PA01
cgcgcgggccgaggucgcgg

SEQ ID NO: 1420057 - RNA, 14 nt, Pseudomonas aeruginosa PA01
cgcgcggcuugccg

SEQ ID NO: 1420058 - RNA, 22 nt, Pseudomonas aeruginosa PA01
cgcgcggcauagcgcagccgcu

SEQ ID NO: 1420059 - RNA, 17 nt, Pseudomonas aeruginosa PA01
cgcgcggccagcgcggc

SEQ ID NO: 1420060 - RNA, 22 nt, Pseudomonas aeruginosa PA01
cgcgcggccagcgcggccgccg

SEQ ID NO: 1420061 - RNA, 14 nt, Pseudomonas aeruginosa PA01
cgcgcggcaccccu

SEQ ID NO: 1420062 - RNA, 16 nt, Pseudomonas aeruginosa PA01
cgcgcggccaguucgg

SEQ ID NO: 1420063 - RNA, 12 nt, Pseudomonas aeruginosa PA01
cgcgcggccagu

SEQ ID NO: 1420064 - RNA, 12 nt, Pseudomonas aeruginosa PA01
cgcgcggcgagc

SEQ ID NO: 1420065 - RNA, 17 nt, Pseudomonas aeruginosa PA01
cgcgcggcgagccgcga

SEQ ID NO: 1420066 - RNA, 13 nt, Pseudomonas aeruginosa PA01
cgcgcggcgaggg

SEQ ID NO: 1420067 - RNA, 18 nt, Pseudomonas aeruginosa PA01
cgcgcggcgccccgucca

SEQ ID NO: 1420068 - RNA, 17 nt, Pseudomonas aeruginosa PA01
cgcgcggcccuucgacg

SEQ ID NO: 1420069 - RNA, 19 nt, Pseudomonas aeruginosa PA01
cgcgcggcccuucgacgac

SEQ ID NO: 1420070 - RNA, 14 nt, Pseudomonas aeruginosa PA01
cgcgcugcgugcgc

SEQ ID NO: 1420071 - RNA, 20 nt, Pseudomonas aeruginosa PA01
cgcgcugcgugcgccgcucg

SEQ ID NO: 1420072 - RNA, 23 nt, Pseudomonas aeruginosa PA01
cgcgcugcguggguagccgccca

SEQ ID NO: 1420073 - RNA, 17 nt, Pseudomonas aeruginosa PA01
cgcgcugcugccauccg

SEQ ID NO: 1420074 - RNA, 20 nt, Pseudomonas aeruginosa PA01
cgcgcugcugccauccgcgc

SEQ ID NO: 1420075 - RNA, 14 nt, Pseudomonas aeruginosa PA01
cgcgcugcgccagg

SEQ ID NO: 1420076 - RNA, 19 nt, Pseudomonas aeruginosa PA01
cgcgcuggaugaaacgggc

SEQ ID NO: 1420077 - RNA, 18 nt, Pseudomonas aeruginosa PA01
cgcgcuggaguaucgccc

SEQ ID NO: 1420078 - RNA, 19 nt, Pseudomonas aeruginosa PA01
cgcgcuggaccauggccgg

SEQ ID NO: 1420079 - RNA, 20 nt, Pseudomonas aeruginosa PA01
cgcgcuggaccauggccggc

SEQ ID NO: 1420080 - RNA, 19 nt, Pseudomonas aeruginosa PA01
cgcgcuggacccgcaccug

SEQ ID NO: 1420081 - RNA, 14 nt, Pseudomonas aeruginosa PA01
cgcgcuggaccugg

SEQ ID NO: 1420082 - RNA, 23 nt, Pseudomonas aeruginosa PA01
cgcgcuggaccuggccggcgacc

SEQ ID NO: 1420083 - RNA, 18 nt, Pseudomonas aeruginosa PA01
cgcgcuggauuucgccga

SEQ ID NO: 1420084 - RNA, 16 nt, Pseudomonas aeruginosa PA01
cgcgcugucggccucg

SEQ ID NO: 1420085 - RNA, 16 nt, Pseudomonas aeruginosa PA01
cgcgcuuccaggcacg

SEQ ID NO: 1420086 - RNA, 13 nt, Pseudomonas aeruginosa PA01
cgcgcuuccaggg

SEQ ID NO: 1420087 - RNA, 23 nt, Pseudomonas aeruginosa PA01
cgcgcuuccaggguagcgccgcg

SEQ ID NO: 1420088 - RNA, 24 nt, Pseudomonas aeruginosa PA01
cgcgcuuccaggguagcgccgcgg

SEQ ID NO: 1420089 - RNA, 17 nt, Pseudomonas aeruginosa PA01
cgcgcuuccgcaucggc

SEQ ID NO: 1420090 - RNA, 18 nt, Pseudomonas aeruginosa PA01
cgcgcuuggacagcucgc

SEQ ID NO: 1420091 - RNA, 20 nt, Pseudomonas aeruginosa PA01
cgcgcuugccuuccugggcg

SEQ ID NO: 1420092 - RNA, 22 nt, Pseudomonas aeruginosa PA01
cgcgcuugccuuccugggcgug

SEQ ID NO: 1420093 - RNA, 18 nt, Pseudomonas aeruginosa PA01
cgcgcuugaguugccaga

SEQ ID NO: 1420094 - RNA, 21 nt, Pseudomonas aeruginosa PA01
cgcgcuugaguugccagacga

SEQ ID NO: 1420095 - RNA, 15 nt, Pseudomonas aeruginosa PA01
cgcgcuuguccucca

SEQ ID NO: 1420096 - RNA, 17 nt, Pseudomonas aeruginosa PA01
cgcgcuuguccuccagc

SEQ ID NO: 1420097 - RNA, 18 nt, Pseudomonas aeruginosa PA01
cgcgcuuuccggcgcggc

SEQ ID NO: 1420098 - RNA, 16 nt, Pseudomonas aeruginosa PA01
cgcggaaccagugcgc

SEQ ID NO: 1420099 - RNA, 18 nt, Pseudomonas aeruginosa PA01
cgcggaaccagugcgcgg

SEQ ID NO: 1420100 - RNA, 20 nt, Pseudomonas aeruginosa PA01
cgcggaaacccuuccagccg

SEQ ID NO: 1420101 - RNA, 21 nt, Pseudomonas aeruginosa PA01
cgcggaaacccuuccagccgc

SEQ ID NO: 1420102 - RNA, 21 nt, Pseudomonas aeruginosa PA01
cgcggaaaccugcaacucggc

SEQ ID NO: 1420103 - RNA, 16 nt, Pseudomonas aeruginosa PA01
cgcgcuuuuccggcgc

SEQ ID NO: 1420104 - RNA, 22 nt, Pseudomonas aeruginosa PA01
cgcgcuuuuccggcgccggcag

SEQ ID NO: 1420105 - RNA, 20 nt, Pseudomonas aeruginosa PA01
cgcgcuccaggcccggcagg

SEQ ID NO: 1420106 - RNA, 12 nt, Pseudomonas aeruginosa PA01
cgcgcuccggcg

SEQ ID NO: 1420107 - RNA, 13 nt, Pseudomonas aeruginosa PA01
cgcgcuccggcgc

SEQ ID NO: 1420108 - RNA, 20 nt, Pseudomonas aeruginosa PA01
cgcgcucgaucagguagucg

SEQ ID NO: 1420109 - RNA, 16 nt, Pseudomonas aeruginosa PA01
cgcgcucgacggucag

SEQ ID NO: 1420110 - RNA, 15 nt, Pseudomonas aeruginosa PA01
cgcgcucgcgcauga

SEQ ID NO: 1420111 - RNA, 15 nt, Pseudomonas aeruginosa PA01
cgcgcguccagccgg

SEQ ID NO: 1420112 - RNA, 16 nt, Pseudomonas aeruginosa PA01
cgcgcguccagccggu

SEQ ID NO: 1420113 - RNA, 21 nt, Pseudomonas aeruginosa PA01
cgcgcguaggcuuggucgggc

SEQ ID NO: 1420114 - RNA, 14 nt, Pseudomonas aeruginosa PA01
cgcgcugcaggcgg

SEQ ID NO: 1420115 - RNA, 16 nt, Pseudomonas aeruginosa PA01
cgcgcugccccuggcu

SEQ ID NO: 1420116 - RNA, 16 nt, Pseudomonas aeruginosa PA01
cgcgcugcccggcgcg

SEQ ID NO: 1420117 - RNA, 17 nt, Pseudomonas aeruginosa PA01
cgcgcugcccggcgcga

SEQ ID NO: 1420118 - RNA, 18 nt, Pseudomonas aeruginosa PA01
cgcgcugccaguggcggc

SEQ ID NO: 1420119 - RNA, 20 nt, Pseudomonas aeruginosa PA01
cgcgcugcgaaucgucgccg

SEQ ID NO: 1420120 - RNA, 12 nt, Pseudomonas aeruginosa PA01
cgcgcugaccug

SEQ ID NO: 1420121 - RNA, 13 nt, Pseudomonas aeruginosa PA01
cgcgcugaccugg

SEQ ID NO: 1420122 - RNA, 12 nt, Pseudomonas aeruginosa PA01
cgcgcucgcgga

SEQ ID NO: 1420123 - RNA, 23 nt, Pseudomonas aeruginosa PA01
cgcggcacagcguggccagcgcc

SEQ ID NO: 1420124 - RNA, 14 nt, Pseudomonas aeruginosa PA01
cgcggcacaggcgg

SEQ ID NO: 1420125 - RNA, 15 nt, Pseudomonas aeruginosa PA01
cgcggcacaggcggc

SEQ ID NO: 1420126 - RNA, 21 nt, Pseudomonas aeruginosa PA01
cgcggcacaggcggcuguugc

SEQ ID NO: 1420127 - RNA, 14 nt, Pseudomonas aeruginosa PA01
cgcggcagcaggcg

SEQ ID NO: 1420128 - RNA, 15 nt, Pseudomonas aeruginosa PA01
cgcggcagcaggcgg

SEQ ID NO: 1420129 - RNA, 13 nt, Pseudomonas aeruginosa PA01
cgcggcagcgcca

SEQ ID NO: 1420130 - RNA, 14 nt, Pseudomonas aeruginosa PA01
cgcggcagcgccau

SEQ ID NO: 1420131 - RNA, 16 nt, Pseudomonas aeruginosa PA01
cgcggcagcgccauca

SEQ ID NO: 1420132 - RNA, 22 nt, Pseudomonas aeruginosa PA01
cgcggcagcgccaucaggcccu

SEQ ID NO: 1420133 - RNA, 14 nt, Pseudomonas aeruginosa PA01
cgcggcacuccggc

SEQ ID NO: 1420134 - RNA, 20 nt, Pseudomonas aeruginosa PA01
cgcggcagaucccaucgccc

SEQ ID NO: 1420135 - RNA, 14 nt, Pseudomonas aeruginosa PA01
cgcggcagcaccag

SEQ ID NO: 1420136 - RNA, 15 nt, Pseudomonas aeruginosa PA01
cgcggcagcaccagg

SEQ ID NO: 1420137 - RNA, 17 nt, Pseudomonas aeruginosa PA01
cgcggcagcaccaggcc

SEQ ID NO: 1420138 - RNA, 18 nt, Pseudomonas aeruginosa PA01
cgcggcagcaccaggcca

SEQ ID NO: 1420139 - RNA, 18 nt, Pseudomonas aeruginosa PA01
cgcggacagccugggcgg

SEQ ID NO: 1420140 - RNA, 23 nt, Pseudomonas aeruginosa PA01
cgcggaccgaaggcaacagcccg

SEQ ID NO: 1420141 - RNA, 18 nt, Pseudomonas aeruginosa PA01
cgcggaccgggcggcgcg

SEQ ID NO: 1420142 - RNA, 19 nt, Pseudomonas aeruginosa PA01
cgcggaccgggcggcgcgg

SEQ ID NO: 1420143 - RNA, 18 nt, Pseudomonas aeruginosa PA01
cgcggacccgcgccggca

SEQ ID NO: 1420144 - RNA, 20 nt, Pseudomonas aeruginosa PA01
cgcggacccgcgccggcagc

SEQ ID NO: 1420145 - RNA, 22 nt, Pseudomonas aeruginosa PA01
cgcggacccgcgccggcagcuc

SEQ ID NO: 1420146 - RNA, 12 nt, Pseudomonas aeruginosa PA01
cgcggaccagcu

SEQ ID NO: 1420147 - RNA, 21 nt, Pseudomonas aeruginosa PA01
cgcggcaacgaaaacgcccgg

SEQ ID NO: 1420148 - RNA, 14 nt, Pseudomonas aeruginosa PA01
cgcggcaacgucag

SEQ ID NO: 1420149 - RNA, 17 nt, Pseudomonas aeruginosa PA01
cgcggaccuccagccgg

SEQ ID NO: 1420150 - RNA, 21 nt, Pseudomonas aeruginosa PA01
cgcggaccuccagccggccau

SEQ ID NO: 1420151 - RNA, 22 nt, Pseudomonas aeruginosa PA01
cgcggaccuccagccggccauc

SEQ ID NO: 1420152 - RNA, 18 nt, Pseudomonas aeruginosa PA01
cgcggccacuucguccgg

SEQ ID NO: 1420153 - RNA, 23 nt, Pseudomonas aeruginosa PA01
cgcggccacuucguccggccgcc

SEQ ID NO: 1420154 - RNA, 17 nt, Pseudomonas aeruginosa PA01
cgcggcaucggccuggu

SEQ ID NO: 1420155 - RNA, 18 nt, Pseudomonas aeruginosa PA01
cgcggcaucccgcccggu

SEQ ID NO: 1420156 - RNA, 19 nt, Pseudomonas aeruginosa PA01
cgcggcauagaugccggcc

SEQ ID NO: 1420157 - RNA, 23 nt, Pseudomonas aeruginosa PA01
cgcggcauagaugccggccucga

SEQ ID NO: 1420158 - RNA, 13 nt, Pseudomonas aeruginosa PA01
cgcggcaucggcc

SEQ ID NO: 1420159 - RNA, 14 nt, Pseudomonas aeruginosa PA01
cgcggcagugcucg

SEQ ID NO: 1420160 - RNA, 18 nt, Pseudomonas aeruginosa PA01
cgcggcauagcgcagccg

SEQ ID NO: 1420161 - RNA, 19 nt, Pseudomonas aeruginosa PA01
cgcggcauagcgcagccgc

SEQ ID NO: 1420162 - RNA, 20 nt, Pseudomonas aeruginosa PA01
cgcggcauagcgcagccgcu

SEQ ID NO: 1420163 - RNA, 23 nt, Pseudomonas aeruginosa PA01
cgcggcauagcgcagccgcucgg

SEQ ID NO: 1420164 - RNA, 15 nt, Pseudomonas aeruginosa PA01
cgcggcaggcggcgg

SEQ ID NO: 1420165 - RNA, 19 nt, Pseudomonas aeruginosa PA01
cgcggcaggaucaggcucg

SEQ ID NO: 1420166 - RNA, 13 nt, Pseudomonas aeruginosa PA01
cgcggcaggccgu

SEQ ID NO: 1420167 - RNA, 21 nt, Pseudomonas aeruginosa PA01
cgcggcagguagccgccuugu

SEQ ID NO: 1420168 - RNA, 18 nt, Pseudomonas aeruginosa PA01
cgcggcagguggcuggcc

SEQ ID NO: 1420169 - RNA, 19 nt, Pseudomonas aeruginosa PA01
cgcggcagguggcuggcca

SEQ ID NO: 1420170 - RNA, 15 nt, Pseudomonas aeruginosa PA01
cgcggcgaagcgcuc

SEQ ID NO: 1420171 - RNA, 16 nt, Pseudomonas aeruginosa PA01
cgcggcgaagcgcucg

SEQ ID NO: 1420172 - RNA, 19 nt, Pseudomonas aeruginosa PA01
cgcggcgaagcguugcagc

SEQ ID NO: 1420173 - RNA, 21 nt, Pseudomonas aeruginosa PA01
cgcggcgacagcaccacgccg

SEQ ID NO: 1420174 - RNA, 15 nt, Pseudomonas aeruginosa PA01
cgcggcgaagggcgc

SEQ ID NO: 1420175 - RNA, 22 nt, Pseudomonas aeruginosa PA01
cgcggcgaagggcgcuucggcg

SEQ ID NO: 1420176 - RNA, 18 nt, Pseudomonas aeruginosa PA01
cgcggcgccccaggcgcc

SEQ ID NO: 1420177 - RNA, 22 nt, Pseudomonas aeruginosa PA01
cgcggcgagaucuucaggccga

SEQ ID NO: 1420178 - RNA, 16 nt, Pseudomonas aeruginosa PA01
cgcggcgaccagcgcg

SEQ ID NO: 1420179 - RNA, 22 nt, Pseudomonas aeruginosa PA01
cgcggcgaccauguucaccagc

SEQ ID NO: 1420180 - RNA, 23 nt, Pseudomonas aeruginosa PA01
cgcggcgaccauguucaccagcg

SEQ ID NO: 1420181 - RNA, 13 nt, Pseudomonas aeruginosa PA01
cgcggcgacgauc

SEQ ID NO: 1420182 - RNA, 14 nt, Pseudomonas aeruginosa PA01
cgcggcgacgauca

SEQ ID NO: 1420183 - RNA, 22 nt, Pseudomonas aeruginosa PA01
cgcggcgacgaucacccccagc

SEQ ID NO: 1420184 - RNA, 16 nt, Pseudomonas aeruginosa PA01
cgcggcgcguaggcga

SEQ ID NO: 1420185 - RNA, 13 nt, Pseudomonas aeruginosa PA01
cgcggcgcggcgg

SEQ ID NO: 1420186 - RNA, 14 nt, Pseudomonas aeruginosa PA01
cgcggcgcggcggg

SEQ ID NO: 1420187 - RNA, 13 nt, Pseudomonas aeruginosa PA01
cgcggcgcuccag

SEQ ID NO: 1420188 - RNA, 17 nt, Pseudomonas aeruginosa PA01
cgcggcgcuccaggcgg

SEQ ID NO: 1420189 - RNA, 18 nt, Pseudomonas aeruginosa PA01
cgcggcgcuccaggcggg

SEQ ID NO: 1420190 - RNA, 15 nt, Pseudomonas aeruginosa PA01
cgcggcgcucggcau

SEQ ID NO: 1420191 - RNA, 15 nt, Pseudomonas aeruginosa PA01
cgcggcgcucgucgg

SEQ ID NO: 1420192 - RNA, 20 nt, Pseudomonas aeruginosa PA01
cgcggcgcguuccgggucgc

SEQ ID NO: 1420193 - RNA, 22 nt, Pseudomonas aeruginosa PA01
cgcggcgcguuccgggucgcug

SEQ ID NO: 1420194 - RNA, 12 nt, Pseudomonas aeruginosa PA01
cgcggcgccccg

SEQ ID NO: 1420195 - RNA, 15 nt, Pseudomonas aeruginosa PA01
cgcggcgcccugccg

SEQ ID NO: 1420196 - RNA, 17 nt, Pseudomonas aeruginosa PA01
cgcggcgcccugccggg

SEQ ID NO: 1420197 - RNA, 22 nt, Pseudomonas aeruginosa PA01
cgcggccaguucggggucggcc

SEQ ID NO: 1420198 - RNA, 15 nt, Pseudomonas aeruginosa PA01
cgcggccaucggcga

SEQ ID NO: 1420199 - RNA, 21 nt, Pseudomonas aeruginosa PA01
cgcggccgaacucuggcggcg

SEQ ID NO: 1420200 - RNA, 20 nt, Pseudomonas aeruginosa PA01
cgcggccagcccccucgccc

SEQ ID NO: 1420201 - RNA, 21 nt, Pseudomonas aeruginosa PA01
cgcggccagcccccucgcccu

SEQ ID NO: 1420202 - RNA, 19 nt, Pseudomonas aeruginosa PA01
cgcggccagcagcacgccc

SEQ ID NO: 1420203 - RNA, 16 nt, Pseudomonas aeruginosa PA01
cgcggccagcgcggcc

SEQ ID NO: 1420204 - RNA, 18 nt, Pseudomonas aeruginosa PA01
cgcggccagcgcggccgc

SEQ ID NO: 1420205 - RNA, 13 nt, Pseudomonas aeruginosa PA01
cgcggccagcgcg

SEQ ID NO: 1420206 - RNA, 22 nt, Pseudomonas aeruginosa PA01
cgcggccagcuucuccagcagg

SEQ ID NO: 1420207 - RNA, 17 nt, Pseudomonas aeruginosa PA01
cgcggccgaggaaggcg

SEQ ID NO: 1420208 - RNA, 20 nt, Pseudomonas aeruginosa PA01
cgcggccgaggaaggcgcug

SEQ ID NO: 1420209 - RNA, 23 nt, Pseudomonas aeruginosa PA01
cgcggccgaggaaggcgcuggcg

SEQ ID NO: 1420210 - RNA, 14 nt, Pseudomonas aeruginosa PA01
cgcggccgccgccg

SEQ ID NO: 1420211 - RNA, 17 nt, Pseudomonas aeruginosa PA01
cgcggccgccgccgaca

SEQ ID NO: 1420212 - RNA, 13 nt, Pseudomonas aeruginosa PA01
cgcggccgccgcc

SEQ ID NO: 1420213 - RNA, 14 nt, Pseudomonas aeruginosa PA01
cgcggccugcagcg

SEQ ID NO: 1420214 - RNA, 16 nt, Pseudomonas aeruginosa PA01
cgcggccugcagcgac

SEQ ID NO: 1420215 - RNA, 17 nt, Pseudomonas aeruginosa PA01
cgcggccugcagcgacu

SEQ ID NO: 1420216 - RNA, 20 nt, Pseudomonas aeruginosa PA01
cgcggccugcagcgacucca

SEQ ID NO: 1420217 - RNA, 14 nt, Pseudomonas aeruginosa PA01
cgcggccugcgccg

SEQ ID NO: 1420218 - RNA, 17 nt, Pseudomonas aeruginosa PA01
cgcggccugcgccggac

SEQ ID NO: 1420219 - RNA, 18 nt, Pseudomonas aeruginosa PA01
cgcggccugcgccggacc

SEQ ID NO: 1420220 - RNA, 14 nt, Pseudomonas aeruginosa PA01
cgcggccugcucgg

SEQ ID NO: 1420221 - RNA, 16 nt, Pseudomonas aeruginosa PA01
cgcggccugcucggcu

SEQ ID NO: 1420222 - RNA, 14 nt, Pseudomonas aeruginosa PA01
cgcggccugggccg

SEQ ID NO: 1420223 - RNA, 13 nt, Pseudomonas aeruginosa PA01
cgcggccuguucg

SEQ ID NO: 1420224 - RNA, 21 nt, Pseudomonas aeruginosa PA01
cgcggccuucucgucgccgcc

SEQ ID NO: 1420225 - RNA, 18 nt, Pseudomonas aeruginosa PA01
cgcgcagggucgaggcaa

SEQ ID NO: 1420226 - RNA, 19 nt, Pseudomonas aeruginosa PA01
cgcgcagggucgaggcaau

SEQ ID NO: 1420227 - RNA, 22 nt, Pseudomonas aeruginosa PA01
cgcgcaggcuuucguaggcagg

SEQ ID NO: 1420228 - RNA, 20 nt, Pseudomonas aeruginosa PA01
cgcgcagggccagcaacagg

SEQ ID NO: 1420229 - RNA, 13 nt, Pseudomonas aeruginosa PA01
cgcgcaggccggu

SEQ ID NO: 1420230 - RNA, 17 nt, Pseudomonas aeruginosa PA01
cgcgcaggcgcuggcgg

SEQ ID NO: 1420231 - RNA, 13 nt, Pseudomonas aeruginosa PA01
cgcgcaggcgcua

SEQ ID NO: 1420232 - RNA, 18 nt, Pseudomonas aeruginosa PA01
cgcgcagggccagggcgg

SEQ ID NO: 1420233 - RNA, 23 nt, Pseudomonas aeruginosa PA01
cgcgcagggccagggcggcggcg

SEQ ID NO: 1420234 - RNA, 19 nt, Pseudomonas aeruginosa PA01
cgcgcaggcgggcggcguc

SEQ ID NO: 1420235 - RNA, 20 nt, Pseudomonas aeruginosa PA01
cgcgcaggcgggcggcgucg

SEQ ID NO: 1420236 - RNA, 12 nt, Pseudomonas aeruginosa PA01
cgcgcaggcggg

SEQ ID NO: 1420237 - RNA, 17 nt, Pseudomonas aeruginosa PA01
cgcgcaguaggcgcugc

SEQ ID NO: 1420238 - RNA, 14 nt, Pseudomonas aeruginosa PA01
cgcgcagucccgcg

SEQ ID NO: 1420239 - RNA, 15 nt, Pseudomonas aeruginosa PA01
cgcgcagucccgcgc

SEQ ID NO: 1420240 - RNA, 18 nt, Pseudomonas aeruginosa PA01
cgcgcagucccgcgcggc

SEQ ID NO: 1420241 - RNA, 22 nt, Pseudomonas aeruginosa PA01
cgcgcaggugcuuggcaccgcg

SEQ ID NO: 1420242 - RNA, 16 nt, Pseudomonas aeruginosa PA01
cgcgcagguucaucgc

SEQ ID NO: 1420243 - RNA, 22 nt, Pseudomonas aeruginosa PA01
cgcgcagguucaucgccgccag

SEQ ID NO: 1420244 - RNA, 23 nt, Pseudomonas aeruginosa PA01
cgcgcagguucaucgccgccagg

SEQ ID NO: 1420245 - RNA, 16 nt, Pseudomonas aeruginosa PA01
cgcgcaguuccuucac

SEQ ID NO: 1420246 - RNA, 22 nt, Pseudomonas aeruginosa PA01
cgcgcaguucgucuuccagcgg

SEQ ID NO: 1420247 - RNA, 14 nt, Pseudomonas aeruginosa PA01
cgcgcaucgcggac

SEQ ID NO: 1420248 - RNA, 22 nt, Pseudomonas aeruginosa PA01
cgcgcaucgaugccuugcggcc

SEQ ID NO: 1420249 - RNA, 15 nt, Pseudomonas aeruginosa PA01
cgcgcauaggaggcg

SEQ ID NO: 1420250 - RNA, 13 nt, Pseudomonas aeruginosa PA01
cgcgcagcaggau

SEQ ID NO: 1420251 - RNA, 20 nt, Pseudomonas aeruginosa PA01
cgcgcagcaggauccaggug

SEQ ID NO: 1420252 - RNA, 20 nt, Pseudomonas aeruginosa PA01
cgcgcagcagguagugcggc

SEQ ID NO: 1420253 - RNA, 23 nt, Pseudomonas aeruginosa PA01
cgcgcagcagguagugcggcggg

SEQ ID NO: 1420254 - RNA, 22 nt, Pseudomonas aeruginosa PA01
cgcgcagcaggcggcccaugcg

SEQ ID NO: 1420255 - RNA, 23 nt, Pseudomonas aeruginosa PA01
cgcgcagccaggcgaggaacagc

SEQ ID NO: 1420256 - RNA, 12 nt, Pseudomonas aeruginosa PA01
cgcgcagccagu

SEQ ID NO: 1420257 - RNA, 15 nt, Pseudomonas aeruginosa PA01
cgcgcagcgccgccg

SEQ ID NO: 1420258 - RNA, 13 nt, Pseudomonas aeruginosa PA01
cgcgcagcgccuc

SEQ ID NO: 1420259 - RNA, 22 nt, Pseudomonas aeruginosa PA01
cgcgcagcgaacgggcguugcc

SEQ ID NO: 1420260 - RNA, 14 nt, Pseudomonas aeruginosa PA01
cgcgcagcucggcc

SEQ ID NO: 1420261 - RNA, 12 nt, Pseudomonas aeruginosa PA01
cgcgcagcggcg

SEQ ID NO: 1420262 - RNA, 14 nt, Pseudomonas aeruginosa PA01
cgcgcagcggcgcg

SEQ ID NO: 1420263 - RNA, 13 nt, Pseudomonas aeruginosa PA01
cgcgcagcggcuc

SEQ ID NO: 1420264 - RNA, 21 nt, Pseudomonas aeruginosa PA01
cgcgcagcuugccuuccaggc

SEQ ID NO: 1420265 - RNA, 16 nt, Pseudomonas aeruginosa PA01
cgcgcaggaccacgcu

SEQ ID NO: 1420266 - RNA, 22 nt, Pseudomonas aeruginosa PA01
cgcgcaggaccacgcuggucac

SEQ ID NO: 1420267 - RNA, 23 nt, Pseudomonas aeruginosa PA01
cgcgcaggaccacgcuggucacc

SEQ ID NO: 1420268 - RNA, 18 nt, Pseudomonas aeruginosa PA01
cgcgcaggaccuggcuga

SEQ ID NO: 1420269 - RNA, 14 nt, Pseudomonas aeruginosa PA01
cgcgcaccugggcg

SEQ ID NO: 1420270 - RNA, 23 nt, Pseudomonas aeruginosa PA01
cgcgcacgaggauuuccgcgccc

SEQ ID NO: 1420271 - RNA, 17 nt, Pseudomonas aeruginosa PA01
cgcgcaccuugcuggac

SEQ ID NO: 1420272 - RNA, 13 nt, Pseudomonas aeruginosa PA01
cgcgcaccaccug

SEQ ID NO: 1420273 - RNA, 17 nt, Pseudomonas aeruginosa PA01
cgcgcaccgcggccagu

SEQ ID NO: 1420274 - RNA, 16 nt, Pseudomonas aeruginosa PA01
cgcgcaccgcggcgag

SEQ ID NO: 1420275 - RNA, 19 nt, Pseudomonas aeruginosa PA01
cgcgcaccgccucgugcag

SEQ ID NO: 1420276 - RNA, 21 nt, Pseudomonas aeruginosa PA01
cgcgcaccgccucgugcagca

SEQ ID NO: 1420277 - RNA, 14 nt, Pseudomonas aeruginosa PA01
cgcgcacuuccgga

SEQ ID NO: 1420278 - RNA, 17 nt, Pseudomonas aeruginosa PA01
cgcgcacuuccucggcg

SEQ ID NO: 1420279 - RNA, 18 nt, Pseudomonas aeruginosa PA01
cgcgcacuuccucggcga

SEQ ID NO: 1420280 - RNA, 19 nt, Pseudomonas aeruginosa PA01
cgcgcacuuccucggcgac

SEQ ID NO: 1420281 - RNA, 22 nt, Pseudomonas aeruginosa PA01
cgcgcacuuccucggcgaccac

SEQ ID NO: 1420282 - RNA, 17 nt, Pseudomonas aeruginosa PA01
cgcgcacggucuuggcg

SEQ ID NO: 1420283 - RNA, 17 nt, Pseudomonas aeruginosa PA01
cgcgcacgucaccgucc

SEQ ID NO: 1420284 - RNA, 15 nt, Pseudomonas aeruginosa PA01
cgcgcagaucgccgc

SEQ ID NO: 1420285 - RNA, 16 nt, Pseudomonas aeruginosa PA01
cgcgcagaucgccgcg

SEQ ID NO: 1420286 - RNA, 15 nt, Pseudomonas aeruginosa PA01
cgcgcagaucgcguc

SEQ ID NO: 1420287 - RNA, 20 nt, Pseudomonas aeruginosa PA01
cgcgcagaccaucagcugga

SEQ ID NO: 1420288 - RNA, 18 nt, Pseudomonas aeruginosa PA01
cgcgcagacgauugaccu

SEQ ID NO: 1420289 - RNA, 14 nt, Pseudomonas aeruginosa PA01
cgcgcagaggcgcu

SEQ ID NO: 1420290 - RNA, 21 nt, Pseudomonas aeruginosa PA01
cgcgcagauaaggcgugcagu

SEQ ID NO: 1420291 - RNA, 13 nt, Pseudomonas aeruginosa PA01
cgcgcagcaccga

SEQ ID NO: 1420292 - RNA, 22 nt, Pseudomonas aeruginosa PA01
cgcgcaccacccaucugccggc

SEQ ID NO: 1420293 - RNA, 12 nt, Pseudomonas aeruginosa PA01
cgcgcaccaccg

SEQ ID NO: 1420294 - RNA, 12 nt, Pseudomonas aeruginosa PA01
cgcgcaccaccu

SEQ ID NO: 1420295 - RNA, 13 nt, Pseudomonas aeruginosa PA01
cgcgcaccagcac

SEQ ID NO: 1420296 - RNA, 23 nt, Pseudomonas aeruginosa PA01
cgcgcaccagcacuuccggcgcg

SEQ ID NO: 1420297 - RNA, 15 nt, Pseudomonas aeruginosa PA01
cgcgcaccagcgggu

SEQ ID NO: 1420298 - RNA, 18 nt, Pseudomonas aeruginosa PA01
cgcgcaccaggccuccca

SEQ ID NO: 1420299 - RNA, 22 nt, Pseudomonas aeruginosa PA01
cgcgcaccaggccucccagccg

SEQ ID NO: 1420300 - RNA, 18 nt, Pseudomonas aeruginosa PA01
cgcgcaaugccgcgucga

SEQ ID NO: 1420301 - RNA, 22 nt, Pseudomonas aeruginosa PA01
cgcgcacaaaaaagcccgccag

SEQ ID NO: 1420302 - RNA, 15 nt, Pseudomonas aeruginosa PA01
cgcgcaagccagcca

SEQ ID NO: 1420303 - RNA, 16 nt, Pseudomonas aeruginosa PA01
cgcgcaagccagccau

SEQ ID NO: 1420304 - RNA, 16 nt, Pseudomonas aeruginosa PA01
cgcgcaacuggucgcg

SEQ ID NO: 1420305 - RNA, 20 nt, Pseudomonas aeruginosa PA01
cgcgcaacuggucgcggcug

SEQ ID NO: 1420306 - RNA, 14 nt, Pseudomonas aeruginosa PA01
cgcgcaagcgcccg

SEQ ID NO: 1420307 - RNA, 15 nt, Pseudomonas aeruginosa PA01
cgcgcaagcgcccgg

SEQ ID NO: 1420308 - RNA, 13 nt, Pseudomonas aeruginosa PA01
cgcgcaaggccga

SEQ ID NO: 1420309 - RNA, 14 nt, Pseudomonas aeruginosa PA01
cgcgcaaggccgaa

SEQ ID NO: 1420310 - RNA, 15 nt, Pseudomonas aeruginosa PA01
cgcgcaaggccgaag

SEQ ID NO: 1420311 - RNA, 20 nt, Pseudomonas aeruginosa PA01
cgcgcaaggccgaagaggcc

SEQ ID NO: 1420312 - RNA, 18 nt, Pseudomonas aeruginosa PA01
cgcgaccgcccgccucag

SEQ ID NO: 1420313 - RNA, 23 nt, Pseudomonas aeruginosa PA01
cgcgaccgcccgccucaggccgg

SEQ ID NO: 1420314 - RNA, 12 nt, Pseudomonas aeruginosa PA01
cgcgcaacugcu

SEQ ID NO: 1420315 - RNA, 15 nt, Pseudomonas aeruginosa PA01
cgcgcaacugcucga

SEQ ID NO: 1420316 - RNA, 20 nt, Pseudomonas aeruginosa PA01
cgcgcaacugcucgaacugc

SEQ ID NO: 1420317 - RNA, 17 nt, Pseudomonas aeruginosa PA01
cgcgacccucagucgcc

SEQ ID NO: 1420318 - RNA, 16 nt, Pseudomonas aeruginosa PA01
cgcgacccuggccgcg

SEQ ID NO: 1420319 - RNA, 18 nt, Pseudomonas aeruginosa PA01
cgcgaccgaagccgcgca

SEQ ID NO: 1420320 - RNA, 20 nt, Pseudomonas aeruginosa PA01
cgcgaccgaagccgcgcagc

SEQ ID NO: 1420321 - RNA, 20 nt, Pseudomonas aeruginosa PA01
cgcgaccgagaugcucgcgc

SEQ ID NO: 1420322 - RNA, 23 nt, Pseudomonas aeruginosa PA01
cgcgaccgagaugcucgcgcagc

SEQ ID NO: 1420323 - RNA, 23 nt, Pseudomonas aeruginosa PA01
cgcgccaaaaagcaggacggcga

SEQ ID NO: 1420324 - RNA, 16 nt, Pseudomonas aeruginosa PA01
cgcgcauggcggcgac

SEQ ID NO: 1420325 - RNA, 20 nt, Pseudomonas aeruginosa PA01
cgcgcauggcggcgaccgca

SEQ ID NO: 1420326 - RNA, 14 nt, Pseudomonas aeruginosa PA01
cgcgccaaggccgc

SEQ ID NO: 1420327 - RNA, 18 nt, Pseudomonas aeruginosa PA01
cgcgccaaggccgccagg

SEQ ID NO: 1420328 - RNA, 17 nt, Pseudomonas aeruginosa PA01
cgcgcaugcagggcguc

SEQ ID NO: 1420329 - RNA, 22 nt, Pseudomonas aeruginosa PA01
cgcgcaugaccuucagcaccug

SEQ ID NO: 1420330 - RNA, 17 nt, Pseudomonas aeruginosa PA01
cgcgcaugaucgccucg

SEQ ID NO: 1420331 - RNA, 20 nt, Pseudomonas aeruginosa PA01
cgcgcaugaucgccucggcg

SEQ ID NO: 1420332 - RNA, 23 nt, Pseudomonas aeruginosa PA01
cgcgcaugaucgccucggcgcgc

SEQ ID NO: 1420333 - RNA, 22 nt, Pseudomonas aeruginosa PA01
cgcgcauggagacggcccgccc

SEQ ID NO: 1420334 - RNA, 19 nt, Pseudomonas aeruginosa PA01
cgcgcaucgugcagccaga

SEQ ID NO: 1420335 - RNA, 19 nt, Pseudomonas aeruginosa PA01
cgcgcaucggugccggcag

SEQ ID NO: 1420336 - RNA, 18 nt, Pseudomonas aeruginosa PA01
cgcgcaucuggcugcgcg

SEQ ID NO: 1420337 - RNA, 21 nt, Pseudomonas aeruginosa PA01
cgcgcaucuggcugcgcgcca

SEQ ID NO: 1420338 - RNA, 15 nt, Pseudomonas aeruginosa PA01
cgcgcaucuggugcg

SEQ ID NO: 1420339 - RNA, 21 nt, Pseudomonas aeruginosa PA01
cgcgcaugaaaaagcccggca

SEQ ID NO: 1420340 - RNA, 23 nt, Pseudomonas aeruginosa PA01
cgcgcaugaaaaagcccggcaau

SEQ ID NO: 1420341 - RNA, 17 nt, Pseudomonas aeruginosa PA01
cgcgccacgcaggaaca

SEQ ID NO: 1420342 - RNA, 13 nt, Pseudomonas aeruginosa PA01
cgcgccaccuggu

SEQ ID NO: 1420343 - RNA, 18 nt, Pseudomonas aeruginosa PA01
cgcgccagaagcggccga

SEQ ID NO: 1420344 - RNA, 23 nt, Pseudomonas aeruginosa PA01
cgcgccagaagcggccgaccagg

SEQ ID NO: 1420345 - RNA, 22 nt, Pseudomonas aeruginosa PA01
cgcgccagagaucgcccagcgg

SEQ ID NO: 1420346 - RNA, 19 nt, Pseudomonas aeruginosa PA01
cgcgccacggaaggccacg

SEQ ID NO: 1420347 - RNA, 20 nt, Pseudomonas aeruginosa PA01
cgcgccacggaaggccacgc

SEQ ID NO: 1420348 - RNA, 22 nt, Pseudomonas aeruginosa PA01
cgcgccacggaaggccacgccg

SEQ ID NO: 1420349 - RNA, 21 nt, Pseudomonas aeruginosa PA01
cgcgccacggaugcagucccg

SEQ ID NO: 1420350 - RNA, 21 nt, Pseudomonas aeruginosa PA01
cgcgccacgggcagaccuucg

SEQ ID NO: 1420351 - RNA, 13 nt, Pseudomonas aeruginosa PA01
cgcgccaccagcg

SEQ ID NO: 1420352 - RNA, 13 nt, Pseudomonas aeruginosa PA01
cgcgccaaugccg

SEQ ID NO: 1420353 - RNA, 21 nt, Pseudomonas aeruginosa PA01
cgcgccaaugccuuccgacgc

SEQ ID NO: 1420354 - RNA, 24 nt, Pseudomonas aeruginosa PA01
cgcgccaaugccuuccgacgccgc

SEQ ID NO: 1420355 - RNA, 17 nt, Pseudomonas aeruginosa PA01
cgcgccaggcccacgcc

SEQ ID NO: 1420356 - RNA, 18 nt, Pseudomonas aeruginosa PA01
cgcgccaggcccacgccc

SEQ ID NO: 1420357 - RNA, 20 nt, Pseudomonas aeruginosa PA01
cgcgccaguccacgacgaac

SEQ ID NO: 1420358 - RNA, 21 nt, Pseudomonas aeruginosa PA01
cgcgccagucccgcaaagccc

SEQ ID NO: 1420359 - RNA, 17 nt, Pseudomonas aeruginosa PA01
cgcgccagugccugcac

SEQ ID NO: 1420360 - RNA, 24 nt, Pseudomonas aeruginosa PA01
cgcgccagugccugcaccacgcag

SEQ ID NO: 1420361 - RNA, 14 nt, Pseudomonas aeruginosa PA01
cgcgccaggccgca

SEQ ID NO: 1420362 - RNA, 19 nt, Pseudomonas aeruginosa PA01
cgcgccagccacucccggc

SEQ ID NO: 1420363 - RNA, 12 nt, Pseudomonas aeruginosa PA01
cgcgccagcccc

SEQ ID NO: 1420364 - RNA, 15 nt, Pseudomonas aeruginosa PA01
cgcgccagccccagg

SEQ ID NO: 1420365 - RNA, 16 nt, Pseudomonas aeruginosa PA01
cgcgccagcaacgccu

SEQ ID NO: 1420366 - RNA, 21 nt, Pseudomonas aeruginosa PA01
cgcgccagcaacgccuucugc

SEQ ID NO: 1420367 - RNA, 17 nt, Pseudomonas aeruginosa PA01
cgcgccagcacggcgca

SEQ ID NO: 1420368 - RNA, 19 nt, Pseudomonas aeruginosa PA01
cgcgccagcacggcgcagg

SEQ ID NO: 1420369 - RNA, 15 nt, Pseudomonas aeruginosa PA01
cgcgccagcaggcgc

SEQ ID NO: 1420370 - RNA, 19 nt, Pseudomonas aeruginosa PA01
cgcgccagcaggcgcagca

SEQ ID NO: 1420371 - RNA, 21 nt, Pseudomonas aeruginosa PA01
cgcgccagcaggcgcagcagc

SEQ ID NO: 1420372 - RNA, 13 nt, Pseudomonas aeruginosa PA01
cgcgccagcgccg

SEQ ID NO: 1420373 - RNA, 15 nt, Pseudomonas aeruginosa PA01
cgcgccagcgccgcc

SEQ ID NO: 1420374 - RNA, 17 nt, Pseudomonas aeruginosa PA01
cgcgccagcgccgccag

SEQ ID NO: 1420375 - RNA, 14 nt, Pseudomonas aeruginosa PA01
cgcgccagcgccac

SEQ ID NO: 1420376 - RNA, 19 nt, Pseudomonas aeruginosa PA01
cgcgccagcgccacggcga

SEQ ID NO: 1420377 - RNA, 21 nt, Pseudomonas aeruginosa PA01
cgcgcccguaccaagcgagac

SEQ ID NO: 1420378 - RNA, 18 nt, Pseudomonas aeruginosa PA01
cgcgcccucggugauacc

SEQ ID NO: 1420379 - RNA, 17 nt, Pseudomonas aeruginosa PA01
cgcgcccugcaggccga

SEQ ID NO: 1420380 - RNA, 14 nt, Pseudomonas aeruginosa PA01
cgcgcccggcuggc

SEQ ID NO: 1420381 - RNA, 18 nt, Pseudomonas aeruginosa PA01
cgcgccgaacucgaacgc

SEQ ID NO: 1420382 - RNA, 13 nt, Pseudomonas aeruginosa PA01
cgcgccgaaggcg

SEQ ID NO: 1420383 - RNA, 23 nt, Pseudomonas aeruginosa PA01
cgcgccgacagcacgauggcgag

SEQ ID NO: 1420384 - RNA, 17 nt, Pseudomonas aeruginosa PA01
cgcgcccacuccuccgc

SEQ ID NO: 1420385 - RNA, 19 nt, Pseudomonas aeruginosa PA01
cgcgcccacuccuccgccu

SEQ ID NO: 1420386 - RNA, 21 nt, Pseudomonas aeruginosa PA01
cgcgcccacuccuccgccugc

SEQ ID NO: 1420387 - RNA, 13 nt, Pseudomonas aeruginosa PA01
cgcgcccaggcgc

SEQ ID NO: 1420388 - RNA, 14 nt, Pseudomonas aeruginosa PA01
cgcgcccaggcgca

SEQ ID NO: 1420389 - RNA, 16 nt, Pseudomonas aeruginosa PA01
cgcgcccaggcgcacc

SEQ ID NO: 1420390 - RNA, 12 nt, Pseudomonas aeruginosa PA01
cgcgcccaggcc

SEQ ID NO: 1420391 - RNA, 15 nt, Pseudomonas aeruginosa PA01
cgcgcccaggcccag

SEQ ID NO: 1420392 - RNA, 21 nt, Pseudomonas aeruginosa PA01
cgcgcccaggcccagcgcggc

SEQ ID NO: 1420393 - RNA, 22 nt, Pseudomonas aeruginosa PA01
cgcgcccaggcccagcgcggcg

SEQ ID NO: 1420394 - RNA, 22 nt, Pseudomonas aeruginosa PA01
cgcgccauuccgcggcacuccg

SEQ ID NO: 1420395 - RNA, 17 nt, Pseudomonas aeruginosa PA01
cgcgccauggccgcuga

SEQ ID NO: 1420396 - RNA, 19 nt, Pseudomonas aeruginosa PA01
cgcgccaugccggcgccga

SEQ ID NO: 1420397 - RNA, 23 nt, Pseudomonas aeruginosa PA01
cgcgccaugcaagaacgccgacc

SEQ ID NO: 1420398 - RNA, 19 nt, Pseudomonas aeruginosa PA01
cgcgccaucggucgcgccc

SEQ ID NO: 1420399 - RNA, 20 nt, Pseudomonas aeruginosa PA01
cgcgccggcgaucgccaggc

SEQ ID NO: 1420400 - RNA, 23 nt, Pseudomonas aeruginosa PA01
cgcgccggcgaucgccaggcgau

SEQ ID NO: 1420401 - RNA, 13 nt, Pseudomonas aeruginosa PA01
cgcgccggcgaua

SEQ ID NO: 1420402 - RNA, 12 nt, Pseudomonas aeruginosa PA01
cgcgccggcagc

SEQ ID NO: 1420403 - RNA, 14 nt, Pseudomonas aeruginosa PA01
cgcgccggcagcuc

SEQ ID NO: 1420404 - RNA, 17 nt, Pseudomonas aeruginosa PA01
cgcgccggcagcucggc

SEQ ID NO: 1420405 - RNA, 20 nt, Pseudomonas aeruginosa PA01
cgcgccggcagcucggccga

SEQ ID NO: 1420406 - RNA, 23 nt, Pseudomonas aeruginosa PA01
cgcgccggacaggccacccgccu

SEQ ID NO: 1420407 - RNA, 16 nt, Pseudomonas aeruginosa PA01
cgcgccggccguccca

SEQ ID NO: 1420408 - RNA, 19 nt, Pseudomonas aeruginosa PA01
cgcgccggaaguggcagcg

SEQ ID NO: 1420409 - RNA, 22 nt, Pseudomonas aeruginosa PA01
cgcgccggaaguggcagcgccg

SEQ ID NO: 1420410 - RNA, 21 nt, Pseudomonas aeruginosa PA01
cgcgccgcuaugggcaccgcg

SEQ ID NO: 1420411 - RNA, 15 nt, Pseudomonas aeruginosa PA01
cgcgccgcggcggcg

SEQ ID NO: 1420412 - RNA, 17 nt, Pseudomonas aeruginosa PA01
cgcgccgcgucgccgcc

SEQ ID NO: 1420413 - RNA, 17 nt, Pseudomonas aeruginosa PA01
cgcgccgcaagggcguc

SEQ ID NO: 1420414 - RNA, 21 nt, Pseudomonas aeruginosa PA01
cgcgccgcaguacgaggggcc

SEQ ID NO: 1420415 - RNA, 15 nt, Pseudomonas aeruginosa PA01
cgcguagccccucgc

SEQ ID NO: 1420416 - RNA, 20 nt, Pseudomonas aeruginosa PA01
cgcguagaggaugccggccu

SEQ ID NO: 1420417 - RNA, 20 nt, Pseudomonas aeruginosa PA01
cgcguagcugggcgaucacg

SEQ ID NO: 1420418 - RNA, 20 nt, Pseudomonas aeruginosa PA01
cgcguaggcgaacacgucgg

SEQ ID NO: 1420419 - RNA, 18 nt, Pseudomonas aeruginosa PA01
cgcguaggcuuggucggg

SEQ ID NO: 1420420 - RNA, 20 nt, Pseudomonas aeruginosa PA01
cgcguagguggcgccgccgg

SEQ ID NO: 1420421 - RNA, 23 nt, Pseudomonas aeruginosa PA01
cgcguagguggcgccgccggcga

SEQ ID NO: 1420422 - RNA, 14 nt, Pseudomonas aeruginosa PA01
cgcguacgacuucg

SEQ ID NO: 1420423 - RNA, 21 nt, Pseudomonas aeruginosa PA01
cgcguacggucuugcgcuugc

SEQ ID NO: 1420424 - RNA, 23 nt, Pseudomonas aeruginosa PA01
cgcguagaccaccucgacggcga

SEQ ID NO: 1420425 - RNA, 17 nt, Pseudomonas aeruginosa PA01
cgcguagaccaucgccg

SEQ ID NO: 1420426 - RNA, 18 nt, Pseudomonas aeruginosa PA01
cgcguagaccaucgccgg

SEQ ID NO: 1420427 - RNA, 20 nt, Pseudomonas aeruginosa PA01
cgcguagaccaucgccggcg

SEQ ID NO: 1420428 - RNA, 22 nt, Pseudomonas aeruginosa PA01
cgcguagaccaucgccggcgag

SEQ ID NO: 1420429 - RNA, 18 nt, Pseudomonas aeruginosa PA01
cgcguacagcgggccggg

SEQ ID NO: 1420430 - RNA, 22 nt, Pseudomonas aeruginosa PA01
cgcguaauaggcgaagcggcuc

SEQ ID NO: 1420431 - RNA, 18 nt, Pseudomonas aeruginosa PA01
cgcggucuucaucaccuu

SEQ ID NO: 1420432 - RNA, 21 nt, Pseudomonas aeruginosa PA01
cgcggucuucccguaaggcca

SEQ ID NO: 1420433 - RNA, 23 nt, Pseudomonas aeruginosa PA01
cgcggucuucccguaaggccagg

SEQ ID NO: 1420434 - RNA, 17 nt, Pseudomonas aeruginosa PA01
cgcggucuuccgccgac

SEQ ID NO: 1420435 - RNA, 13 nt, Pseudomonas aeruginosa PA01
cgcggucuucgcg

SEQ ID NO: 1420436 - RNA, 14 nt, Pseudomonas aeruginosa PA01
cgcggugagcaggg

SEQ ID NO: 1420437 - RNA, 19 nt, Pseudomonas aeruginosa PA01
cgcggugacgacgugccca

SEQ ID NO: 1420438 - RNA, 23 nt, Pseudomonas aeruginosa PA01
cgcggucucgcguucaucgucgg

SEQ ID NO: 1420439 - RNA, 16 nt, Pseudomonas aeruginosa PA01
cgcggucucuucgucg

SEQ ID NO: 1420440 - RNA, 21 nt, Pseudomonas aeruginosa PA01
cgcggucucuucgucggucau

SEQ ID NO: 1420441 - RNA, 15 nt, Pseudomonas aeruginosa PA01
cgcggucgggcagau

SEQ ID NO: 1420442 - RNA, 22 nt, Pseudomonas aeruginosa PA01
cgcggucgggcagauguccagg

SEQ ID NO: 1420443 - RNA, 17 nt, Pseudomonas aeruginosa PA01
cgcggucggugagcacg

SEQ ID NO: 1420444 - RNA, 21 nt, Pseudomonas aeruginosa PA01
cgcggucggugagcacgccgc

SEQ ID NO: 1420445 - RNA, 22 nt, Pseudomonas aeruginosa PA01
cgcggucggugagcacgccgcg

SEQ ID NO: 1420446 - RNA, 13 nt, Pseudomonas aeruginosa PA01
cgcgguucugcuc

SEQ ID NO: 1420447 - RNA, 14 nt, Pseudomonas aeruginosa PA01
cgcggugagggcga

SEQ ID NO: 1420448 - RNA, 20 nt, Pseudomonas aeruginosa PA01
cgcgguugccgaagcgcucg

SEQ ID NO: 1420449 - RNA, 20 nt, Pseudomonas aeruginosa PA01
cgcgguugccgcugcggcgg

SEQ ID NO: 1420450 - RNA, 13 nt, Pseudomonas aeruginosa PA01
cgcgguugcgcug

SEQ ID NO: 1420451 - RNA, 17 nt, Pseudomonas aeruginosa PA01
cgcgguuuccgugcgga

SEQ ID NO: 1420452 - RNA, 16 nt, Pseudomonas aeruginosa PA01
cgcgguuucgcagcgc

SEQ ID NO: 1420453 - RNA, 17 nt, Pseudomonas aeruginosa PA01
cgcgguuucgcagcgcu

SEQ ID NO: 1420454 - RNA, 19 nt, Pseudomonas aeruginosa PA01
cgcgguuucgcagcgcucc

SEQ ID NO: 1420455 - RNA, 19 nt, Pseudomonas aeruginosa PA01
cgcgguuucuucgccuugc

SEQ ID NO: 1420456 - RNA, 21 nt, Pseudomonas aeruginosa PA01
cgcgguuucuucgccuugccc

SEQ ID NO: 1420457 - RNA, 17 nt, Pseudomonas aeruginosa PA01
cgcggucauccgcccug

SEQ ID NO: 1420458 - RNA, 18 nt, Pseudomonas aeruginosa PA01
cgcggucaucgccggcgc

SEQ ID NO: 1420459 - RNA, 18 nt, Pseudomonas aeruginosa PA01
cgcggucacucggccucg

SEQ ID NO: 1420460 - RNA, 16 nt, Pseudomonas aeruginosa PA01
cgcgguagacgcaggg

SEQ ID NO: 1420461 - RNA, 16 nt, Pseudomonas aeruginosa PA01
cgcgggugcggcuggc

SEQ ID NO: 1420462 - RNA, 21 nt, Pseudomonas aeruginosa PA01
cgcggggcccggcuccagccg

SEQ ID NO: 1420463 - RNA, 21 nt, Pseudomonas aeruginosa PA01
cgcgguagggaucgucgccaa

SEQ ID NO: 1420464 - RNA, 18 nt, Pseudomonas aeruginosa PA01
cgcgguagcugcgcaggg

SEQ ID NO: 1420465 - RNA, 21 nt, Pseudomonas aeruginosa PA01
cgcgguagcugcgcagggcgc

SEQ ID NO: 1420466 - RNA, 22 nt, Pseudomonas aeruginosa PA01
cgcgguaucccuggaacuagcc

SEQ ID NO: 1420467 - RNA, 21 nt, Pseudomonas aeruginosa PA01
cgcggucaccagggucacgcc

SEQ ID NO: 1420468 - RNA, 22 nt, Pseudomonas aeruginosa PA01
cgcggucaccagggucacgccg

SEQ ID NO: 1420469 - RNA, 23 nt, Pseudomonas aeruginosa PA01
cgcggucaccagggucacgccgc

SEQ ID NO: 1420470 - RNA, 18 nt, Pseudomonas aeruginosa PA01
cgcgguauucuccagcag

SEQ ID NO: 1420471 - RNA, 20 nt, Pseudomonas aeruginosa PA01
cgcgguauucuccagcaggc

SEQ ID NO: 1420472 - RNA, 20 nt, Pseudomonas aeruginosa PA01
cgcgggucuugcgcagggcg

SEQ ID NO: 1420473 - RNA, 21 nt, Pseudomonas aeruginosa PA01
cgcgggucuugcgcagggcgg

SEQ ID NO: 1420474 - RNA, 14 nt, Pseudomonas aeruginosa PA01
cgcgggucgucgau

SEQ ID NO: 1420475 - RNA, 21 nt, Pseudomonas aeruginosa PA01
cgcgggucucgaucagcgccg

SEQ ID NO: 1420476 - RNA, 22 nt, Pseudomonas aeruginosa PA01
cgcgggucucgaucagcgccgg

SEQ ID NO: 1420477 - RNA, 15 nt, Pseudomonas aeruginosa PA01
cgcgggucugcucgg

SEQ ID NO: 1420478 - RNA, 18 nt, Pseudomonas aeruginosa PA01
cgcgggucugcucggcgc

SEQ ID NO: 1420479 - RNA, 19 nt, Pseudomonas aeruginosa PA01
cgcgggucugcucggcgcc

SEQ ID NO: 1420480 - RNA, 17 nt, Pseudomonas aeruginosa PA01
cgcggguaucgauccag

SEQ ID NO: 1420481 - RNA, 14 nt, Pseudomonas aeruginosa PA01
cgcgggucaccacc

SEQ ID NO: 1420482 - RNA, 15 nt, Pseudomonas aeruginosa PA01
cgcgggucaccagcg

SEQ ID NO: 1420483 - RNA, 17 nt, Pseudomonas aeruginosa PA01
cgcgggucaccagcgcc

SEQ ID NO: 1420484 - RNA, 17 nt, Pseudomonas aeruginosa PA01
cgcgggucaccagcggg

SEQ ID NO: 1420485 - RNA, 17 nt, Pseudomonas aeruginosa PA01
cgcgggucaucggcccg

SEQ ID NO: 1420486 - RNA, 23 nt, Pseudomonas aeruginosa PA01
cgcggcggaagaauaccgccagc

SEQ ID NO: 1420487 - RNA, 16 nt, Pseudomonas aeruginosa PA01
cgcggcggacaggcag

SEQ ID NO: 1420488 - RNA, 22 nt, Pseudomonas aeruginosa PA01
cgcggcggacaggcagccggcc

SEQ ID NO: 1420489 - RNA, 15 nt, Pseudomonas aeruginosa PA01
cgcggcgcuuguagc

SEQ ID NO: 1420490 - RNA, 20 nt, Pseudomonas aeruginosa PA01
cgcggcgcuuguagcccagg

SEQ ID NO: 1420491 - RNA, 19 nt, Pseudomonas aeruginosa PA01
cgcggcggaugccggcgcu

SEQ ID NO: 1420492 - RNA, 23 nt, Pseudomonas aeruginosa PA01
cgcgggcguugcgcgccucgccc

SEQ ID NO: 1420493 - RNA, 14 nt, Pseudomonas aeruginosa PA01
cgcgggcuauuccc

SEQ ID NO: 1420494 - RNA, 17 nt, Pseudomonas aeruginosa PA01
cgcgggcuauucccgcc

SEQ ID NO: 1420495 - RNA, 18 nt, Pseudomonas aeruginosa PA01
cgcgggcuauucccgccg

SEQ ID NO: 1420496 - RNA, 20 nt, Pseudomonas aeruginosa PA01
cgcgggcuauucccgccgcu

SEQ ID NO: 1420497 - RNA, 14 nt, Pseudomonas aeruginosa PA01
cgcgggcugccccu

SEQ ID NO: 1420498 - RNA, 13 nt, Pseudomonas aeruginosa PA01
cgcgggcuggcca

SEQ ID NO: 1420499 - RNA, 15 nt, Pseudomonas aeruginosa PA01
cgcgucaugccgccg

SEQ ID NO: 1420500 - RNA, 22 nt, Pseudomonas aeruginosa PA01
cgcgucaucaggcucaggccgg

SEQ ID NO: 1420501 - RNA, 19 nt, Pseudomonas aeruginosa PA01
cgcgucacucgacaggcca

SEQ ID NO: 1420502 - RNA, 14 nt, Pseudomonas aeruginosa PA01
cgcguccaccuggc

SEQ ID NO: 1420503 - RNA, 15 nt, Pseudomonas aeruginosa PA01
cgcguccaccuggcg

SEQ ID NO: 1420504 - RNA, 20 nt, Pseudomonas aeruginosa PA01
cgcguccaccuggcggcuga

SEQ ID NO: 1420505 - RNA, 21 nt, Pseudomonas aeruginosa PA01
cgcguccagccgguaggggcc

SEQ ID NO: 1420506 - RNA, 21 nt, Pseudomonas aeruginosa PA01
cgcguccagcuccaccaggcc

SEQ ID NO: 1420507 - RNA, 15 nt, Pseudomonas aeruginosa PA01
cgcguccagggugcu

SEQ ID NO: 1420508 - RNA, 23 nt, Pseudomonas aeruginosa PA01
cgcguccaugccguacaggucgg

SEQ ID NO: 1420509 - RNA, 13 nt, Pseudomonas aeruginosa PA01
cgcgucccaucgg

SEQ ID NO: 1420510 - RNA, 14 nt, Pseudomonas aeruginosa PA01
cgcgucccugggcg

SEQ ID NO: 1420511 - RNA, 21 nt, Pseudomonas aeruginosa PA01
cgcgucccugggcgcaggggc

SEQ ID NO: 1420512 - RNA, 23 nt, Pseudomonas aeruginosa PA01
cgcgucccuuguuuuccuggccc

SEQ ID NO: 1420513 - RNA, 13 nt, Pseudomonas aeruginosa PA01
cgcgucccugcac

SEQ ID NO: 1420514 - RNA, 21 nt, Pseudomonas aeruginosa PA01
cgcguccggagugaugccgau

SEQ ID NO: 1420515 - RNA, 17 nt, Pseudomonas aeruginosa PA01
cgcguccggccagccug

SEQ ID NO: 1420516 - RNA, 20 nt, Pseudomonas aeruginosa PA01
cgcguccgcaguucgccccg

SEQ ID NO: 1420517 - RNA, 17 nt, Pseudomonas aeruginosa PA01
cgcgucgaccaccgcgu

SEQ ID NO: 1420518 - RNA, 16 nt, Pseudomonas aeruginosa PA01
cgcgucgaagucgauc

SEQ ID NO: 1420519 - RNA, 23 nt, Pseudomonas aeruginosa PA01
cgcguccuucuuguauaccagcg

SEQ ID NO: 1420520 - RNA, 16 nt, Pseudomonas aeruginosa PA01
cgcguccuccuggagg

SEQ ID NO: 1420521 - RNA, 17 nt, Pseudomonas aeruginosa PA01
cgcguccuccuggagga

SEQ ID NO: 1420522 - RNA, 16 nt, Pseudomonas aeruginosa PA01
cgcgucgcacccggcc

SEQ ID NO: 1420523 - RNA, 23 nt, Pseudomonas aeruginosa PA01
cgcgucgcacccggcccauggcg

SEQ ID NO: 1420524 - RNA, 21 nt, Pseudomonas aeruginosa PA01
cgcgucgaugcuuucgagcaa

SEQ ID NO: 1420525 - RNA, 12 nt, Pseudomonas aeruginosa PA01
cgcgucgccgaa

SEQ ID NO: 1420526 - RNA, 21 nt, Pseudomonas aeruginosa PA01
cgcgucgcucauccgcgaggc

SEQ ID NO: 1420527 - RNA, 15 nt, Pseudomonas aeruginosa PA01
cgcgucgcgcgcggc

SEQ ID NO: 1420528 - RNA, 17 nt, Pseudomonas aeruginosa PA01
cgcgucgcugccgccgc

SEQ ID NO: 1420529 - RNA, 13 nt, Pseudomonas aeruginosa PA01
cgcgucgcugcgc

SEQ ID NO: 1420530 - RNA, 13 nt, Pseudomonas aeruginosa PA01
cgcgucggcacgc

SEQ ID NO: 1420531 - RNA, 16 nt, Pseudomonas aeruginosa PA01
cgcgucggcacgccga

SEQ ID NO: 1420532 - RNA, 22 nt, Pseudomonas aeruginosa PA01
cgcgucgggaaaggccgccacg

SEQ ID NO: 1420533 - RNA, 16 nt, Pseudomonas aeruginosa PA01
cgcgucggugccgccc

SEQ ID NO: 1420534 - RNA, 21 nt, Pseudomonas aeruginosa PA01
cgcgucggugccgcccggcgc

SEQ ID NO: 1420535 - RNA, 19 nt, Pseudomonas aeruginosa PA01
cgcgucguauaggcgcugg

SEQ ID NO: 1420536 - RNA, 22 nt, Pseudomonas aeruginosa PA01
cgcgucguauaggcgcuggugc

SEQ ID NO: 1420537 - RNA, 17 nt, Pseudomonas aeruginosa PA01
cgcgucguccagggcgc

SEQ ID NO: 1420538 - RNA, 16 nt, Pseudomonas aeruginosa PA01
cgcgucguccgaggcg

SEQ ID NO: 1420539 - RNA, 20 nt, Pseudomonas aeruginosa PA01
cgcgucgucggcgacgcuga

SEQ ID NO: 1420540 - RNA, 18 nt, Pseudomonas aeruginosa PA01
cgcgucuccagcucggcg

SEQ ID NO: 1420541 - RNA, 21 nt, Pseudomonas aeruginosa PA01
cgcgugaagcuggagcagcag

SEQ ID NO: 1420542 - RNA, 23 nt, Pseudomonas aeruginosa PA01
cgcgugaagcuggagcagcagcg

SEQ ID NO: 1420543 - RNA, 17 nt, Pseudomonas aeruginosa PA01
cgcguugcccagcccca

SEQ ID NO: 1420544 - RNA, 21 nt, Pseudomonas aeruginosa PA01
cgcguugcauguccucggcgc

SEQ ID NO: 1420545 - RNA, 14 nt, Pseudomonas aeruginosa PA01
cgcguugcgaccaa

SEQ ID NO: 1420546 - RNA, 22 nt, Pseudomonas aeruginosa PA01
cgcguugcgagggcucgggcgc

SEQ ID NO: 1420547 - RNA, 21 nt, Pseudomonas aeruginosa PA01
cgcguugcuuguguccgccga

SEQ ID NO: 1420548 - RNA, 23 nt, Pseudomonas aeruginosa PA01
cgcguugcuuguguccgccgagg

SEQ ID NO: 1420549 - RNA, 13 nt, Pseudomonas aeruginosa PA01
cgcguuggcggug

SEQ ID NO: 1420550 - RNA, 18 nt, Pseudomonas aeruginosa PA01
cgcguuggcgugcucgcg

SEQ ID NO: 1420551 - RNA, 13 nt, Pseudomonas aeruginosa PA01
cgcguuggcuggc

SEQ ID NO: 1420552 - RNA, 21 nt, Pseudomonas aeruginosa PA01
cgcguugucccugucccgccg

SEQ ID NO: 1420553 - RNA, 14 nt, Pseudomonas aeruginosa PA01
cgcguucaccccgc

SEQ ID NO: 1420554 - RNA, 21 nt, Pseudomonas aeruginosa PA01
cgcguucccacucgcgacugc

SEQ ID NO: 1420555 - RNA, 15 nt, Pseudomonas aeruginosa PA01
cgcguucaucgucgg

SEQ ID NO: 1420556 - RNA, 13 nt, Pseudomonas aeruginosa PA01
cgcguuccagcac

SEQ ID NO: 1420557 - RNA, 18 nt, Pseudomonas aeruginosa PA01
cgcguuccagcaccucgc

SEQ ID NO: 1420558 - RNA, 19 nt, Pseudomonas aeruginosa PA01
cgcguuccagcaccucgcg

SEQ ID NO: 1420559 - RNA, 17 nt, Pseudomonas aeruginosa PA01
cgcuggccagcgcuucc

SEQ ID NO: 1420560 - RNA, 23 nt, Pseudomonas aeruginosa PA01
cgcuggccagcgcuuccaccgcc

SEQ ID NO: 1420561 - RNA, 21 nt, Pseudomonas aeruginosa PA01
cgcuggauuucgccgaguggc

SEQ ID NO: 1420562 - RNA, 20 nt, Pseudomonas aeruginosa PA01
cgcuggcagguugcacggcc

SEQ ID NO: 1420563 - RNA, 16 nt, Pseudomonas aeruginosa PA01
cgcuggcaccggccag

SEQ ID NO: 1420564 - RNA, 18 nt, Pseudomonas aeruginosa PA01
cgcuggcaccggccaggc

SEQ ID NO: 1420565 - RNA, 19 nt, Pseudomonas aeruginosa PA01
cgcuggcaccggccaggcg

SEQ ID NO: 1420566 - RNA, 20 nt, Pseudomonas aeruginosa PA01
cgcuggcaccggccaggcgc

SEQ ID NO: 1420567 - RNA, 13 nt, Pseudomonas aeruginosa PA01
cgcuggagcugcg

SEQ ID NO: 1420568 - RNA, 16 nt, Pseudomonas aeruginosa PA01
cgcuggaccuggccgg

SEQ ID NO: 1420569 - RNA, 19 nt, Pseudomonas aeruginosa PA01
cgcuggaguaucgcccugg

SEQ ID NO: 1420570 - RNA, 16 nt, Pseudomonas aeruginosa PA01
cgcuggaugccgacca

SEQ ID NO: 1420571 - RNA, 13 nt, Pseudomonas aeruginosa PA01
cgcugcugccggc

SEQ ID NO: 1420572 - RNA, 23 nt, Pseudomonas aeruginosa PA01
cgcugcugccauccgcgccgacc

SEQ ID NO: 1420573 - RNA, 13 nt, Pseudomonas aeruginosa PA01
cgcugcugguagu

SEQ ID NO: 1420574 - RNA, 20 nt, Pseudomonas aeruginosa PA01
cgcugcugguagugcuggcg

SEQ ID NO: 1420575 - RNA, 23 nt, Pseudomonas aeruginosa PA01
cgcugcugguggacgucgucggc

SEQ ID NO: 1420576 - RNA, 14 nt, Pseudomonas aeruginosa PA01
cgcugcugggcggc

SEQ ID NO: 1420577 - RNA, 15 nt, Pseudomonas aeruginosa PA01
cgcugcugggcggcg

SEQ ID NO: 1420578 - RNA, 17 nt, Pseudomonas aeruginosa PA01
cgcugcuggcgccgcug

SEQ ID NO: 1420579 - RNA, 18 nt, Pseudomonas aeruginosa PA01
cgcugcuggcgccgcugg

SEQ ID NO: 1420580 - RNA, 12 nt, Pseudomonas aeruginosa PA01
cgcuggaccagg

SEQ ID NO: 1420581 - RNA, 20 nt, Pseudomonas aeruginosa PA01
cgcuggaccaggcggccggu

SEQ ID NO: 1420582 - RNA, 19 nt, Pseudomonas aeruginosa PA01
cgcuggaccaguucagcgc

SEQ ID NO: 1420583 - RNA, 21 nt, Pseudomonas aeruginosa PA01
cgcuggaccaguucagcgcgc

SEQ ID NO: 1420584 - RNA, 14 nt, Pseudomonas aeruginosa PA01
cgcuggaccauggc

SEQ ID NO: 1420585 - RNA, 17 nt, Pseudomonas aeruginosa PA01
cgcuggaccauggccgg

SEQ ID NO: 1420586 - RNA, 22 nt, Pseudomonas aeruginosa PA01
cgcuggaccauggccggcgugc

SEQ ID NO: 1420587 - RNA, 24 nt, Pseudomonas aeruginosa PA01
cgcuggacccgcaccuggaccggg

SEQ ID NO: 1420588 - RNA, 17 nt, Pseudomonas aeruginosa PA01
cgcuggaacggccaggu

SEQ ID NO: 1420589 - RNA, 18 nt, Pseudomonas aeruginosa PA01
cgcuggaaccggccggca

SEQ ID NO: 1420590 - RNA, 15 nt, Pseudomonas aeruginosa PA01
cgcugcuugaacacc

SEQ ID NO: 1420591 - RNA, 23 nt, Pseudomonas aeruginosa PA01
cgcugcuugaacaccucuucgcc

SEQ ID NO: 1420592 - RNA, 16 nt, Pseudomonas aeruginosa PA01
cgcugcuugaccacca

SEQ ID NO: 1420593 - RNA, 12 nt, Pseudomonas aeruginosa PA01
cgcugcuugcgc

SEQ ID NO: 1420594 - RNA, 14 nt, Pseudomonas aeruginosa PA01
cgcuggucggcauc

SEQ ID NO: 1420595 - RNA, 15 nt, Pseudomonas aeruginosa PA01
cgcugggcgccgauu

SEQ ID NO: 1420596 - RNA, 14 nt, Pseudomonas aeruginosa PA01
cgcugggcgccggc

SEQ ID NO: 1420597 - RNA, 19 nt, Pseudomonas aeruginosa PA01
cgcugggcgccggcaggcc

SEQ ID NO: 1420598 - RNA, 20 nt, Pseudomonas aeruginosa PA01
cgcugggcgccggcaggccu

SEQ ID NO: 1420599 - RNA, 19 nt, Pseudomonas aeruginosa PA01
cgcugggcgccucgucgac

SEQ ID NO: 1420600 - RNA, 21 nt, Pseudomonas aeruginosa PA01
cgcugggcggcuggccgagga

SEQ ID NO: 1420601 - RNA, 20 nt, Pseudomonas aeruginosa PA01
cgcugggcugggucggcugg

SEQ ID NO: 1420602 - RNA, 13 nt, Pseudomonas aeruginosa PA01
cgcugggcaggug

SEQ ID NO: 1420603 - RNA, 15 nt, Pseudomonas aeruginosa PA01
cgcugggcagguggu

SEQ ID NO: 1420604 - RNA, 20 nt, Pseudomonas aeruginosa PA01
cgcugggcagguggugguag

SEQ ID NO: 1420605 - RNA, 20 nt, Pseudomonas aeruginosa PA01
cgcugggccuugagcaggcg

SEQ ID NO: 1420606 - RNA, 15 nt, Pseudomonas aeruginosa PA01
cgcugggacggcggc

SEQ ID NO: 1420607 - RNA, 16 nt, Pseudomonas aeruginosa PA01
cgcugggacggcggcu

SEQ ID NO: 1420608 - RNA, 12 nt, Pseudomonas aeruginosa PA01
cgcuggccaucu

SEQ ID NO: 1420609 - RNA, 24 nt, Pseudomonas aeruginosa PA01
cgcuggccgagcugccgcaccgcc

SEQ ID NO: 1420610 - RNA, 13 nt, Pseudomonas aeruginosa PA01
cgcuggccgcgcg

SEQ ID NO: 1420611 - RNA, 18 nt, Pseudomonas aeruginosa PA01
cgcuggccgcgcgaccgc

SEQ ID NO: 1420612 - RNA, 12 nt, Pseudomonas aeruginosa PA01
cgcuggccggca

SEQ ID NO: 1420613 - RNA, 14 nt, Pseudomonas aeruginosa PA01
cgcuggccugcagg

SEQ ID NO: 1420614 - RNA, 15 nt, Pseudomonas aeruginosa PA01
cgcuggccugcaggu

SEQ ID NO: 1420615 - RNA, 17 nt, Pseudomonas aeruginosa PA01
cgcuggccugccgaugg

SEQ ID NO: 1420616 - RNA, 23 nt, Pseudomonas aeruginosa PA01
cgcuggccugggguagccggccg

SEQ ID NO: 1420617 - RNA, 12 nt, Pseudomonas aeruginosa PA01
cgcuggcgaacg

SEQ ID NO: 1420618 - RNA, 20 nt, Pseudomonas aeruginosa PA01
cgcuggcgaacggcuggucg

SEQ ID NO: 1420619 - RNA, 22 nt, Pseudomonas aeruginosa PA01
cgcuggcgauguagcugccggc

SEQ ID NO: 1420620 - RNA, 13 nt, Pseudomonas aeruginosa PA01
cgcuggcgaucau

SEQ ID NO: 1420621 - RNA, 19 nt, Pseudomonas aeruginosa PA01
cgcuggcgaucucggcgcg

SEQ ID NO: 1420622 - RNA, 17 nt, Pseudomonas aeruginosa PA01
cgcuggcgaggacgccg

SEQ ID NO: 1420623 - RNA, 19 nt, Pseudomonas aeruginosa PA01
cgcuggcgaggacgccggg

SEQ ID NO: 1420624 - RNA, 21 nt, Pseudomonas aeruginosa PA01
cgcuggcgaggacgccgggcu

SEQ ID NO: 1420625 - RNA, 22 nt, Pseudomonas aeruginosa PA01
cgcuggcgaggauuuccucgcg

SEQ ID NO: 1420626 - RNA, 23 nt, Pseudomonas aeruginosa PA01
cgcuggcgaggauuuccucgcgc

SEQ ID NO: 1420627 - RNA, 21 nt, Pseudomonas aeruginosa PA01
cgcuggcgaucaccagggugc

SEQ ID NO: 1420628 - RNA, 22 nt, Pseudomonas aeruginosa PA01
cgcuggcgaauauccucgucga

SEQ ID NO: 1420629 - RNA, 21 nt, Pseudomonas aeruginosa PA01
cgcugcucagggccgcgccga

SEQ ID NO: 1420630 - RNA, 22 nt, Pseudomonas aeruginosa PA01
cgcugcucagggccgcgccgag

SEQ ID NO: 1420631 - RNA, 15 nt, Pseudomonas aeruginosa PA01
cgcugcucagggcuc

SEQ ID NO: 1420632 - RNA, 18 nt, Pseudomonas aeruginosa PA01
cgcugcuaggcuggaagc

SEQ ID NO: 1420633 - RNA, 14 nt, Pseudomonas aeruginosa PA01
cgcugcucaccagg

SEQ ID NO: 1420634 - RNA, 16 nt, Pseudomonas aeruginosa PA01
cgcugcgugcgccgcu

SEQ ID NO: 1420635 - RNA, 19 nt, Pseudomonas aeruginosa PA01
cgcugcgugcgccgcucgc

SEQ ID NO: 1420636 - RNA, 20 nt, Pseudomonas aeruginosa PA01
cgcugcgugcgccgcucgcg

SEQ ID NO: 1420637 - RNA, 17 nt, Pseudomonas aeruginosa PA01
cgcugcgugcguugcgc

SEQ ID NO: 1420638 - RNA, 21 nt, Pseudomonas aeruginosa PA01
cgcugcguggguagccgccca

SEQ ID NO: 1420639 - RNA, 23 nt, Pseudomonas aeruginosa PA01
cgcugcguggguagccgcccacc

SEQ ID NO: 1420640 - RNA, 15 nt, Pseudomonas aeruginosa PA01
cgcugcucgaccacc

SEQ ID NO: 1420641 - RNA, 18 nt, Pseudomonas aeruginosa PA01
cgcugcucgacggcacca

SEQ ID NO: 1420642 - RNA, 21 nt, Pseudomonas aeruginosa PA01
cgcugcucgacggcaccagcg

SEQ ID NO: 1420643 - RNA, 22 nt, Pseudomonas aeruginosa PA01
cgcugcucgacggcaccagcgc

SEQ ID NO: 1420644 - RNA, 23 nt, Pseudomonas aeruginosa PA01
cgcugcucgacggcaccagcgcg

SEQ ID NO: 1420645 - RNA, 13 nt, Pseudomonas aeruginosa PA01
cgcugcucgcagc

SEQ ID NO: 1420646 - RNA, 14 nt, Pseudomonas aeruginosa PA01
cgcugcucgcagcc

SEQ ID NO: 1420647 - RNA, 15 nt, Pseudomonas aeruginosa PA01
cgcugcucgcagccg

SEQ ID NO: 1420648 - RNA, 14 nt, Pseudomonas aeruginosa PA01
cgcugcucggccuu

SEQ ID NO: 1420649 - RNA, 20 nt, Pseudomonas aeruginosa PA01
cgcugcugaaaaacgccugg

SEQ ID NO: 1420650 - RNA, 16 nt, Pseudomonas aeruginosa PA01
cgcugcggccggcgcg

SEQ ID NO: 1420651 - RNA, 19 nt, Pseudomonas aeruginosa PA01
cgcugcgguaccagcgcac

SEQ ID NO: 1420652 - RNA, 13 nt, Pseudomonas aeruginosa PA01
cgcugcggcucgc

SEQ ID NO: 1420653 - RNA, 16 nt, Pseudomonas aeruginosa PA01
cgcugcggcucgccga

SEQ ID NO: 1420654 - RNA, 17 nt, Pseudomonas aeruginosa PA01
cgcugcggcucgccgau

SEQ ID NO: 1420655 - RNA, 13 nt, Pseudomonas aeruginosa PA01
cgcugcggcugca

SEQ ID NO: 1420656 - RNA, 19 nt, Pseudomonas aeruginosa PA01
cgcugcgggucauuggcga

SEQ ID NO: 1420657 - RNA, 20 nt, Pseudomonas aeruginosa PA01
cgcugcgggucauuggcgaa

SEQ ID NO: 1420658 - RNA, 22 nt, Pseudomonas aeruginosa PA01
cgcugcggguucagucggccag

SEQ ID NO: 1420659 - RNA, 23 nt, Pseudomonas aeruginosa PA01
cgcugcggguucagucggccagg

SEQ ID NO: 1420660 - RNA, 15 nt, Pseudomonas aeruginosa PA01
cgcugcgcggccugc

SEQ ID NO: 1420661 - RNA, 13 nt, Pseudomonas aeruginosa PA01
cgcugcgcggcgu

SEQ ID NO: 1420662 - RNA, 13 nt, Pseudomonas aeruginosa PA01
cgcugcgcugcca

SEQ ID NO: 1420663 - RNA, 15 nt, Pseudomonas aeruginosa PA01
cgcugcgcugccagc

SEQ ID NO: 1420664 - RNA, 23 nt, Pseudomonas aeruginosa PA01
cgcugcgcgggucguacaccgcg

SEQ ID NO: 1420665 - RNA, 23 nt, Pseudomonas aeruginosa PA01
cgcugcggaagagguacggccuu

SEQ ID NO: 1420666 - RNA, 15 nt, Pseudomonas aeruginosa PA01
cgcugccgaucagcc

SEQ ID NO: 1420667 - RNA, 22 nt, Pseudomonas aeruginosa PA01
cgcugccucgguuuccggccag

SEQ ID NO: 1420668 - RNA, 13 nt, Pseudomonas aeruginosa PA01
cgcugccguucgc

SEQ ID NO: 1420669 - RNA, 18 nt, Pseudomonas aeruginosa PA01
cgcugccguucgcccgcg

SEQ ID NO: 1420670 - RNA, 22 nt, Pseudomonas aeruginosa PA01
cgcugccguucgcccgcggcgg

SEQ ID NO: 1420671 - RNA, 17 nt, Pseudomonas aeruginosa PA01
cgcugccguugcaggcc

SEQ ID NO: 1420672 - RNA, 13 nt, Pseudomonas aeruginosa PA01
cgcugccugggga

SEQ ID NO: 1420673 - RNA, 16 nt, Pseudomonas aeruginosa PA01
cgcugccugucgcagc

SEQ ID NO: 1420674 - RNA, 19 nt, Pseudomonas aeruginosa PA01
cgcugccuucgaagccggc

SEQ ID NO: 1420675 - RNA, 16 nt, Pseudomonas aeruginosa PA01
cgcugccugcgaugga

SEQ ID NO: 1420676 - RNA, 17 nt, Pseudomonas aeruginosa PA01
cgcugccugcgauggaa

SEQ ID NO: 1420677 - RNA, 12 nt, Pseudomonas aeruginosa PA01
cgcugcgcgcag

SEQ ID NO: 1420678 - RNA, 24 nt, Pseudomonas aeruginosa PA01
cgcugcgcgcaguucagggcguag

SEQ ID NO: 1420679 - RNA, 15 nt, Pseudomonas aeruginosa PA01
cgcugcgagcagguc

SEQ ID NO: 1420680 - RNA, 16 nt, Pseudomonas aeruginosa PA01
cgcugcgagcaggucc

SEQ ID NO: 1420681 - RNA, 16 nt, Pseudomonas aeruginosa PA01
cgcugccugcaccggg

SEQ ID NO: 1420682 - RNA, 14 nt, Pseudomonas aeruginosa PA01
cgcugcgaccuggc

SEQ ID NO: 1420683 - RNA, 19 nt, Pseudomonas aeruginosa PA01
cgcugcgaccuggcgccga

SEQ ID NO: 1420684 - RNA, 21 nt, Pseudomonas aeruginosa PA01
cgcugcgaccuggcgccgaaa

SEQ ID NO: 1420685 - RNA, 17 nt, Pseudomonas aeruginosa PA01
cgcugcgaaucgucgcc

SEQ ID NO: 1420686 - RNA, 19 nt, Pseudomonas aeruginosa PA01
cgcugcgaaucgucgccgg

SEQ ID NO: 1420687 - RNA, 20 nt, Pseudomonas aeruginosa PA01
cgcugcgaaucgucgccgga

SEQ ID NO: 1420688 - RNA, 14 nt, Pseudomonas aeruginosa PA01
cgcugcccggcgcg

SEQ ID NO: 1420689 - RNA, 17 nt, Pseudomonas aeruginosa PA01
cgcugcccggcgcgacg

SEQ ID NO: 1420690 - RNA, 13 nt, Pseudomonas aeruginosa PA01
cgcugccgaacag

SEQ ID NO: 1420691 - RNA, 17 nt, Pseudomonas aeruginosa PA01
cgcugccgaacagcagg

SEQ ID NO: 1420692 - RNA, 18 nt, Pseudomonas aeruginosa PA01
cgcugaucacgaucggca

SEQ ID NO: 1420693 - RNA, 15 nt, Pseudomonas aeruginosa PA01
cgcugaucaucagca

SEQ ID NO: 1420694 - RNA, 20 nt, Pseudomonas aeruginosa PA01
cgcugaucaucagcaggguc

SEQ ID NO: 1420695 - RNA, 15 nt, Pseudomonas aeruginosa PA01
cgcugcccaucgccu

SEQ ID NO: 1420696 - RNA, 18 nt, Pseudomonas aeruginosa PA01
cgcugcccaucgccucca

SEQ ID NO: 1420697 - RNA, 22 nt, Pseudomonas aeruginosa PA01
cgcucggugccuucccagccga

SEQ ID NO: 1420698 - RNA, 24 nt, Pseudomonas aeruginosa PA01
cgcucggugccuucccagccgagg

SEQ ID NO: 1420699 - RNA, 21 nt, Pseudomonas aeruginosa PA01
cgcucguagagcuugcugaag

SEQ ID NO: 1420700 - RNA, 12 nt, Pseudomonas aeruginosa PA01
cgcucguagccg

SEQ ID NO: 1420701 - RNA, 18 nt, Pseudomonas aeruginosa PA01
cgcucguagaacucgccc

SEQ ID NO: 1420702 - RNA, 16 nt, Pseudomonas aeruginosa PA01
cgcucggggugcgcgg

SEQ ID NO: 1420703 - RNA, 21 nt, Pseudomonas aeruginosa PA01
cgcucggggugcgcggcgaag

SEQ ID NO: 1420704 - RNA, 13 nt, Pseudomonas aeruginosa PA01
cgcucggcgucgu

SEQ ID NO: 1420705 - RNA, 14 nt, Pseudomonas aeruginosa PA01
cgcucggcggucag

SEQ ID NO: 1420706 - RNA, 12 nt, Pseudomonas aeruginosa PA01
cgcucggcggcc

SEQ ID NO: 1420707 - RNA, 14 nt, Pseudomonas aeruginosa PA01
cgcucggcggccuc

SEQ ID NO: 1420708 - RNA, 19 nt, Pseudomonas aeruginosa PA01
cgcucgggauggcccccac

SEQ ID NO: 1420709 - RNA, 16 nt, Pseudomonas aeruginosa PA01
cgcucggcuccagcca

SEQ ID NO: 1420710 - RNA, 17 nt, Pseudomonas aeruginosa PA01
cgcucggcuccagccag

SEQ ID NO: 1420711 - RNA, 19 nt, Pseudomonas aeruginosa PA01
cgcucggcuccagccaggc

SEQ ID NO: 1420712 - RNA, 19 nt, Pseudomonas aeruginosa PA01
cgcucggggauguccgccg

SEQ ID NO: 1420713 - RNA, 22 nt, Pseudomonas aeruginosa PA01
cgcucggggauguccgccgccc

SEQ ID NO: 1420714 - RNA, 20 nt, Pseudomonas aeruginosa PA01
cgcucggggcaucggccauu

SEQ ID NO: 1420715 - RNA, 14 nt, Pseudomonas aeruginosa PA01
cgcucgaucaggua

SEQ ID NO: 1420716 - RNA, 16 nt, Pseudomonas aeruginosa PA01
cgcucgaucagguagu

SEQ ID NO: 1420717 - RNA, 19 nt, Pseudomonas aeruginosa PA01
cgcucgaucagguagucgc

SEQ ID NO: 1420718 - RNA, 15 nt, Pseudomonas aeruginosa PA01
cgcucgaucccggcg

SEQ ID NO: 1420719 - RNA, 17 nt, Pseudomonas aeruginosa PA01
cgcucgaucccggcgcg

SEQ ID NO: 1420720 - RNA, 18 nt, Pseudomonas aeruginosa PA01
cgcucgaucccggcgcgg

SEQ ID NO: 1420721 - RNA, 16 nt, Pseudomonas aeruginosa PA01
cgcucgaugcccgcca

SEQ ID NO: 1420722 - RNA, 21 nt, Pseudomonas aeruginosa PA01
cgcucgaugcccgccagcagg

SEQ ID NO: 1420723 - RNA, 23 nt, Pseudomonas aeruginosa PA01
cgcucgaugcccgccagcaggcg

SEQ ID NO: 1420724 - RNA, 15 nt, Pseudomonas aeruginosa PA01
cgcucgagcuugagg

SEQ ID NO: 1420725 - RNA, 21 nt, Pseudomonas aeruginosa PA01
cgcucgagcuugaggucggcc

SEQ ID NO: 1420726 - RNA, 13 nt, Pseudomonas aeruginosa PA01
cgcucgagccggc

SEQ ID NO: 1420727 - RNA, 14 nt, Pseudomonas aeruginosa PA01
cgcucgagccggcu

SEQ ID NO: 1420728 - RNA, 20 nt, Pseudomonas aeruginosa PA01
cgcucggcgcucggcuccag

SEQ ID NO: 1420729 - RNA, 15 nt, Pseudomonas aeruginosa PA01
cgcucggcggcgcgc

SEQ ID NO: 1420730 - RNA, 18 nt, Pseudomonas aeruginosa PA01
cgcucggcggcgcgcagc

SEQ ID NO: 1420731 - RNA, 15 nt, Pseudomonas aeruginosa PA01
cgcucggcggguauc

SEQ ID NO: 1420732 - RNA, 22 nt, Pseudomonas aeruginosa PA01
cgcucggcggguauccgccggg

SEQ ID NO: 1420733 - RNA, 19 nt, Pseudomonas aeruginosa PA01
cgcucuguuucgggucgcc

SEQ ID NO: 1420734 - RNA, 20 nt, Pseudomonas aeruginosa PA01
cgcucuguagggucgcagca

SEQ ID NO: 1420735 - RNA, 23 nt, Pseudomonas aeruginosa PA01
cgcucuguagggucgcagcaggc

SEQ ID NO: 1420736 - RNA, 16 nt, Pseudomonas aeruginosa PA01
cgcucuggcugcuggc

SEQ ID NO: 1420737 - RNA, 17 nt, Pseudomonas aeruginosa PA01
cgcucuucgccgcggcg

SEQ ID NO: 1420738 - RNA, 23 nt, Pseudomonas aeruginosa PA01
cgcucuucgccgcggcguaggcg

SEQ ID NO: 1420739 - RNA, 18 nt, Pseudomonas aeruginosa PA01
cgcucuucaccucgauga

SEQ ID NO: 1420740 - RNA, 22 nt, Pseudomonas aeruginosa PA01
cgcucuucacuuccagcugcca

SEQ ID NO: 1420741 - RNA, 17 nt, Pseudomonas aeruginosa PA01
cgcucuucagcacgccc

SEQ ID NO: 1420742 - RNA, 18 nt, Pseudomonas aeruginosa PA01
cgcucuucagcacgccca

SEQ ID NO: 1420743 - RNA, 16 nt, Pseudomonas aeruginosa PA01
cgcucguccaguucca

SEQ ID NO: 1420744 - RNA, 13 nt, Pseudomonas aeruginosa PA01
cgcucgucaggcg

SEQ ID NO: 1420745 - RNA, 13 nt, Pseudomonas aeruginosa PA01
cgcucgucauggc

SEQ ID NO: 1420746 - RNA, 21 nt, Pseudomonas aeruginosa PA01
cgcucgucauggcgcacgccg

SEQ ID NO: 1420747 - RNA, 16 nt, Pseudomonas aeruginosa PA01
cgcucugcgccaggcg

SEQ ID NO: 1420748 - RNA, 17 nt, Pseudomonas aeruginosa PA01
cgcucugcgccgcggcg

SEQ ID NO: 1420749 - RNA, 23 nt, Pseudomonas aeruginosa PA01
cgcucugcgccgcggcguugcgc

SEQ ID NO: 1420750 - RNA, 19 nt, Pseudomonas aeruginosa PA01
cgcucugccagaaggccug

SEQ ID NO: 1420751 - RNA, 22 nt, Pseudomonas aeruginosa PA01
cgcucugccagaaggccugcgc

SEQ ID NO: 1420752 - RNA, 23 nt, Pseudomonas aeruginosa PA01
cgcucugccagaaggccugcgcu

SEQ ID NO: 1420753 - RNA, 14 nt, Pseudomonas aeruginosa PA01
cgcucugcccgacc

SEQ ID NO: 1420754 - RNA, 12 nt, Pseudomonas aeruginosa PA01
cgcucugcuggc

SEQ ID NO: 1420755 - RNA, 15 nt, Pseudomonas aeruginosa PA01
cgcucugcuggccac

SEQ ID NO: 1420756 - RNA, 21 nt, Pseudomonas aeruginosa PA01
cgcucugcuggccacccuugc

SEQ ID NO: 1420757 - RNA, 22 nt, Pseudomonas aeruginosa PA01
cgcucugcuggccgcccuugcg

SEQ ID NO: 1420758 - RNA, 16 nt, Pseudomonas aeruginosa PA01
cgcugaccucgauggc

SEQ ID NO: 1420759 - RNA, 16 nt, Pseudomonas aeruginosa PA01
cgcugaccuggaagcg

SEQ ID NO: 1420760 - RNA, 16 nt, Pseudomonas aeruginosa PA01
cgcugaccggccgcag

SEQ ID NO: 1420761 - RNA, 19 nt, Pseudomonas aeruginosa PA01
cgcugaccggccgcagcag

SEQ ID NO: 1420762 - RNA, 20 nt, Pseudomonas aeruginosa PA01
cgcugacgaggacgccgccg

SEQ ID NO: 1420763 - RNA, 16 nt, Pseudomonas aeruginosa PA01
cgcugaguuugcccag

SEQ ID NO: 1420764 - RNA, 23 nt, Pseudomonas aeruginosa PA01
cgcugaggauguagccggcuucc

SEQ ID NO: 1420765 - RNA, 18 nt, Pseudomonas aeruginosa PA01
cgcugaggccgcccuggc

SEQ ID NO: 1420766 - RNA, 13 nt, Pseudomonas aeruginosa PA01
cgcugaggcucag

SEQ ID NO: 1420767 - RNA, 14 nt, Pseudomonas aeruginosa PA01
cgcugaggcucagc

SEQ ID NO: 1420768 - RNA, 16 nt, Pseudomonas aeruginosa PA01
cgcugaggcucagcgc

SEQ ID NO: 1420769 - RNA, 23 nt, Pseudomonas aeruginosa PA01
cgcugaggcucagcgcgccgagu

SEQ ID NO: 1420770 - RNA, 12 nt, Pseudomonas aeruginosa PA01
cgcugaggcucg

SEQ ID NO: 1420771 - RNA, 19 nt, Pseudomonas aeruginosa PA01
cgcuccaccgcccccggcg

SEQ ID NO: 1420772 - RNA, 22 nt, Pseudomonas aeruginosa PA01
cgcuccaccgcccccggcgcca

SEQ ID NO: 1420773 - RNA, 14 nt, Pseudomonas aeruginosa PA01
cgcuccacagcugc

SEQ ID NO: 1420774 - RNA, 22 nt, Pseudomonas aeruginosa PA01
cgcuccaccagggccucggggc

SEQ ID NO: 1420775 - RNA, 15 nt, Pseudomonas aeruginosa PA01
cgcuccacccaggcg

SEQ ID NO: 1420776 - RNA, 17 nt, Pseudomonas aeruginosa PA01
cgcuccacccaggcgcc

SEQ ID NO: 1420777 - RNA, 19 nt, Pseudomonas aeruginosa PA01
cgcuccacccaggcgccga

SEQ ID NO: 1420778 - RNA, 17 nt, Pseudomonas aeruginosa PA01
cgcuccagccggcaagc

SEQ ID NO: 1420779 - RNA, 21 nt, Pseudomonas aeruginosa PA01
cgcuccagcgccucgaccaga

SEQ ID NO: 1420780 - RNA, 15 nt, Pseudomonas aeruginosa PA01
cgcuccagcggcagc

SEQ ID NO: 1420781 - RNA, 16 nt, Pseudomonas aeruginosa PA01
cgcuccagcggcagcu

SEQ ID NO: 1420782 - RNA, 21 nt, Pseudomonas aeruginosa PA01
cgcuccagcggcagcucggcg

SEQ ID NO: 1420783 - RNA, 23 nt, Pseudomonas aeruginosa PA01
cgcuccagcggcagcucggcgac

SEQ ID NO: 1420784 - RNA, 17 nt, Pseudomonas aeruginosa PA01
cgcuccagcuccuccag

SEQ ID NO: 1420785 - RNA, 14 nt, Pseudomonas aeruginosa PA01
cgcuccagggcgcu

SEQ ID NO: 1420786 - RNA, 15 nt, Pseudomonas aeruginosa PA01
cgcuccagucggggc

SEQ ID NO: 1420787 - RNA, 22 nt, Pseudomonas aeruginosa PA01
cgcuccagucggggcaggcgca

SEQ ID NO: 1420788 - RNA, 21 nt, Pseudomonas aeruginosa PA01
cgcuccaggugcacggccagg

SEQ ID NO: 1420789 - RNA, 22 nt, Pseudomonas aeruginosa PA01
cgcuccaggugcacggccaggc

SEQ ID NO: 1420790 - RNA, 23 nt, Pseudomonas aeruginosa PA01
cgcuccaggugcacggccaggcc

SEQ ID NO: 1420791 - RNA, 23 nt, Pseudomonas aeruginosa PA01
cgcuccaggaucgccuccaccag

SEQ ID NO: 1420792 - RNA, 13 nt, Pseudomonas aeruginosa PA01
cgcuccaggcccg

SEQ ID NO: 1420793 - RNA, 16 nt, Pseudomonas aeruginosa PA01
cgcuccaggcccggca

SEQ ID NO: 1420794 - RNA, 19 nt, Pseudomonas aeruginosa PA01
cgcuccauccagucggcgc

SEQ ID NO: 1420795 - RNA, 13 nt, Pseudomonas aeruginosa PA01
cgcucauggcgcc

SEQ ID NO: 1420796 - RNA, 23 nt, Pseudomonas aeruginosa PA01
cgcucaugagauccgccagcaga

SEQ ID NO: 1420797 - RNA, 16 nt, Pseudomonas aeruginosa PA01
cgcguuucucagcgcc

SEQ ID NO: 1420798 - RNA, 17 nt, Pseudomonas aeruginosa PA01
cgcguuucucagcgccg

SEQ ID NO: 1420799 - RNA, 18 nt, Pseudomonas aeruginosa PA01
cgcguuucucagcgccgu

SEQ ID NO: 1420800 - RNA, 18 nt, Pseudomonas aeruginosa PA01
cgcucauccgcgaggcau

SEQ ID NO: 1420801 - RNA, 13 nt, Pseudomonas aeruginosa PA01
cgcucccaccgcu

SEQ ID NO: 1420802 - RNA, 23 nt, Pseudomonas aeruginosa PA01
cgcucccaccgcuuucagcgccg

SEQ ID NO: 1420803 - RNA, 14 nt, Pseudomonas aeruginosa PA01
cgcucccagccgac

SEQ ID NO: 1420804 - RNA, 18 nt, Pseudomonas aeruginosa PA01
cgcucccagccgacguag

SEQ ID NO: 1420805 - RNA, 15 nt, Pseudomonas aeruginosa PA01
cgcucccaggcucac

SEQ ID NO: 1420806 - RNA, 18 nt, Pseudomonas aeruginosa PA01
cgcuccgacuccugcaac

SEQ ID NO: 1420807 - RNA, 21 nt, Pseudomonas aeruginosa PA01
cgcuccgcaucuucugcgcgu

SEQ ID NO: 1420808 - RNA, 14 nt, Pseudomonas aeruginosa PA01
cgcuccgccaggcc

SEQ ID NO: 1420809 - RNA, 17 nt, Pseudomonas aeruginosa PA01
cgcuccgccgaacgcca

SEQ ID NO: 1420810 - RNA, 15 nt, Pseudomonas aeruginosa PA01
cgcuccuccagcgcc

SEQ ID NO: 1420811 - RNA, 16 nt, Pseudomonas aeruginosa PA01
cgcuccuccagcgccg

SEQ ID NO: 1420812 - RNA, 18 nt, Pseudomonas aeruginosa PA01
cgcuccggugccagggcg

SEQ ID NO: 1420813 - RNA, 16 nt, Pseudomonas aeruginosa PA01
cgcuccgucgcuucgc

SEQ ID NO: 1420814 - RNA, 22 nt, Pseudomonas aeruginosa PA01
cgcuccgucgcuucgcccgccg

SEQ ID NO: 1420815 - RNA, 14 nt, Pseudomonas aeruginosa PA01
cgcuccuccucgcu

SEQ ID NO: 1420816 - RNA, 20 nt, Pseudomonas aeruginosa PA01
cgcuccuccucgcucugcgc

SEQ ID NO: 1420817 - RNA, 15 nt, Pseudomonas aeruginosa PA01
cgcuccucgcgcugc

SEQ ID NO: 1420818 - RNA, 23 nt, Pseudomonas aeruginosa PA01
cgcuccucgcgcugcccggcgcg

SEQ ID NO: 1420819 - RNA, 14 nt, Pseudomonas aeruginosa PA01
cgcuccucgucgag

SEQ ID NO: 1420820 - RNA, 20 nt, Pseudomonas aeruginosa PA01
cgcuccggcgcgccauggcg

SEQ ID NO: 1420821 - RNA, 15 nt, Pseudomonas aeruginosa PA01
cgcuccggcucuccc

SEQ ID NO: 1420822 - RNA, 12 nt, Pseudomonas aeruginosa PA01
cgcuccggcagc

SEQ ID NO: 1420823 - RNA, 14 nt, Pseudomonas aeruginosa PA01
cgcucgagggcgac

SEQ ID NO: 1420824 - RNA, 20 nt, Pseudomonas aeruginosa PA01
cgcucgagggcgaccgccag

SEQ ID NO: 1420825 - RNA, 21 nt, Pseudomonas aeruginosa PA01
cgcucgagggcgaccgccagg

SEQ ID NO: 1420826 - RNA, 23 nt, Pseudomonas aeruginosa PA01
cgcucgagggcgaccgccaggcg

SEQ ID NO: 1420827 - RNA, 15 nt, Pseudomonas aeruginosa PA01
cgcucgaggggcgac

SEQ ID NO: 1420828 - RNA, 18 nt, Pseudomonas aeruginosa PA01
cgcucgaguucgcgcggg

SEQ ID NO: 1420829 - RNA, 20 nt, Pseudomonas aeruginosa PA01
cgcucgauagcguccaggug

SEQ ID NO: 1420830 - RNA, 18 nt, Pseudomonas aeruginosa PA01
cgcuccuggaagaacagg

SEQ ID NO: 1420831 - RNA, 14 nt, Pseudomonas aeruginosa PA01
cgcuccuggagguu

SEQ ID NO: 1420832 - RNA, 17 nt, Pseudomonas aeruginosa PA01
cgcuccuggugcggcac

SEQ ID NO: 1420833 - RNA, 19 nt, Pseudomonas aeruginosa PA01
cgcuccuggugcggcacca

SEQ ID NO: 1420834 - RNA, 12 nt, Pseudomonas aeruginosa PA01
cgcuccugcgcc

SEQ ID NO: 1420835 - RNA, 16 nt, Pseudomonas aeruginosa PA01
cgcuccugcgccggcu

SEQ ID NO: 1420836 - RNA, 19 nt, Pseudomonas aeruginosa PA01
cgcuccugcgccggcucgu

SEQ ID NO: 1420837 - RNA, 13 nt, Pseudomonas aeruginosa PA01
cgcucgaacgccg

SEQ ID NO: 1420838 - RNA, 20 nt, Pseudomonas aeruginosa PA01
cgcucgaacgccgcccgucg

SEQ ID NO: 1420839 - RNA, 18 nt, Pseudomonas aeruginosa PA01
cgcuccuucuccggggcc

SEQ ID NO: 1420840 - RNA, 18 nt, Pseudomonas aeruginosa PA01
cgcuccuugagcagcucg

SEQ ID NO: 1420841 - RNA, 20 nt, Pseudomonas aeruginosa PA01
cgcuccuugcgccaggcccg

SEQ ID NO: 1420842 - RNA, 19 nt, Pseudomonas aeruginosa PA01
cgcuccuuguagaacggcg

SEQ ID NO: 1420843 - RNA, 21 nt, Pseudomonas aeruginosa PA01
cgcuccuuguagaacggcggc

SEQ ID NO: 1420844 - RNA, 17 nt, Pseudomonas aeruginosa PA01
cgcccauugcccggcca

SEQ ID NO: 1420845 - RNA, 18 nt, Pseudomonas aeruginosa PA01
cgcccauugcccggccag

SEQ ID NO: 1420846 - RNA, 19 nt, Pseudomonas aeruginosa PA01
cgcccauugcccggccagg

SEQ ID NO: 1420847 - RNA, 23 nt, Pseudomonas aeruginosa PA01
cgcccauugcccggccaggcgcg

SEQ ID NO: 1420848 - RNA, 14 nt, Pseudomonas aeruginosa PA01
cgcccauugccggg

SEQ ID NO: 1420849 - RNA, 19 nt, Pseudomonas aeruginosa PA01
cgcccauguagaccaccag

SEQ ID NO: 1420850 - RNA, 20 nt, Pseudomonas aeruginosa PA01
cgcccauguagaccaccagc

SEQ ID NO: 1420851 - RNA, 15 nt, Pseudomonas aeruginosa PA01
cgcccauggcgguga

SEQ ID NO: 1420852 - RNA, 16 nt, Pseudomonas aeruginosa PA01
cgcccauggcggugag

SEQ ID NO: 1420853 - RNA, 22 nt, Pseudomonas aeruginosa PA01
cgcccauggcggugagcugauc

SEQ ID NO: 1420854 - RNA, 13 nt, Pseudomonas aeruginosa PA01
cgccccaggcgcc

SEQ ID NO: 1420855 - RNA, 12 nt, Pseudomonas aeruginosa PA01
cgccccagcgcc

SEQ ID NO: 1420856 - RNA, 22 nt, Pseudomonas aeruginosa PA01
cgccccagcgccugggccgcgc

SEQ ID NO: 1420857 - RNA, 13 nt, Pseudomonas aeruginosa PA01
cgccccagcggca

SEQ ID NO: 1420858 - RNA, 14 nt, Pseudomonas aeruginosa PA01
cgccccagcggcag

SEQ ID NO: 1420859 - RNA, 17 nt, Pseudomonas aeruginosa PA01
cgccccagcggcaggca

SEQ ID NO: 1420860 - RNA, 13 nt, Pseudomonas aeruginosa PA01
cgccccagcucag

SEQ ID NO: 1420861 - RNA, 21 nt, Pseudomonas aeruginosa PA01
cgccccaccaccaucgccgcg

SEQ ID NO: 1420862 - RNA, 23 nt, Pseudomonas aeruginosa PA01
cgccccaccccaggguuggcggc

SEQ ID NO: 1420863 - RNA, 18 nt, Pseudomonas aeruginosa PA01
cgccccagaucgccagcg

SEQ ID NO: 1420864 - RNA, 13 nt, Pseudomonas aeruginosa PA01
cgccccagcaccu

SEQ ID NO: 1420865 - RNA, 15 nt, Pseudomonas aeruginosa PA01
cgccccagcaccucg

SEQ ID NO: 1420866 - RNA, 13 nt, Pseudomonas aeruginosa PA01
cgccccguuggcg

SEQ ID NO: 1420867 - RNA, 19 nt, Pseudomonas aeruginosa PA01
cgccccguuggcgcgggcg

SEQ ID NO: 1420868 - RNA, 14 nt, Pseudomonas aeruginosa PA01
cgccccggucucgc

SEQ ID NO: 1420869 - RNA, 19 nt, Pseudomonas aeruginosa PA01
cgccccggucucgcgcagc

SEQ ID NO: 1420870 - RNA, 20 nt, Pseudomonas aeruginosa PA01
cgccccggucucgcgcagcg

SEQ ID NO: 1420871 - RNA, 22 nt, Pseudomonas aeruginosa PA01
cgccccggucucgcgcagcggc

SEQ ID NO: 1420872 - RNA, 12 nt, Pseudomonas aeruginosa PA01
cgccccgggcgu

SEQ ID NO: 1420873 - RNA, 13 nt, Pseudomonas aeruginosa PA01
cgccccgggucgc

SEQ ID NO: 1420874 - RNA, 14 nt, Pseudomonas aeruginosa PA01
cgccccgggucgcu

SEQ ID NO: 1420875 - RNA, 18 nt, Pseudomonas aeruginosa PA01
cgccccgggucgcugcuc

SEQ ID NO: 1420876 - RNA, 20 nt, Pseudomonas aeruginosa PA01
cgccccgggucgcugcucag

SEQ ID NO: 1420877 - RNA, 16 nt, Pseudomonas aeruginosa PA01
cgccccgggucggcac

SEQ ID NO: 1420878 - RNA, 14 nt, Pseudomonas aeruginosa PA01
cgcccccagcgccc

SEQ ID NO: 1420879 - RNA, 20 nt, Pseudomonas aeruginosa PA01
cgcccccagcgcccgcacca

SEQ ID NO: 1420880 - RNA, 18 nt, Pseudomonas aeruginosa PA01
cgccccauccgggcggcg

SEQ ID NO: 1420881 - RNA, 19 nt, Pseudomonas aeruginosa PA01
cgccccauccgggcggcgg

SEQ ID NO: 1420882 - RNA, 20 nt, Pseudomonas aeruginosa PA01
cgccccauccgggcggcggg

SEQ ID NO: 1420883 - RNA, 16 nt, Pseudomonas aeruginosa PA01
cgccccaggugcagcg

SEQ ID NO: 1420884 - RNA, 15 nt, Pseudomonas aeruginosa PA01
cgccccaggcgggca

SEQ ID NO: 1420885 - RNA, 23 nt, Pseudomonas aeruginosa PA01
cgccccagggaaucgucacggcg

SEQ ID NO: 1420886 - RNA, 17 nt, Pseudomonas aeruginosa PA01
cgcccaguugcgccgcc

SEQ ID NO: 1420887 - RNA, 23 nt, Pseudomonas aeruginosa PA01
cgcccaguugcgccgccugcggc

SEQ ID NO: 1420888 - RNA, 17 nt, Pseudomonas aeruginosa PA01
cgcccaguucgccggcc

SEQ ID NO: 1420889 - RNA, 18 nt, Pseudomonas aeruginosa PA01
cgcccaguucgccggcca

SEQ ID NO: 1420890 - RNA, 19 nt, Pseudomonas aeruginosa PA01
cgcccaguucgccggccag

SEQ ID NO: 1420891 - RNA, 16 nt, Pseudomonas aeruginosa PA01
cgcccaguucuucgcc

SEQ ID NO: 1420892 - RNA, 17 nt, Pseudomonas aeruginosa PA01
cgcccaguucuucgccg

SEQ ID NO: 1420893 - RNA, 19 nt, Pseudomonas aeruginosa PA01
cgcccaguucuucgccgcc

SEQ ID NO: 1420894 - RNA, 20 nt, Pseudomonas aeruginosa PA01
cgcccaguucuucgccgccc

SEQ ID NO: 1420895 - RNA, 23 nt, Pseudomonas aeruginosa PA01
cgcccaguucuucgccgcccgcg

SEQ ID NO: 1420896 - RNA, 20 nt, Pseudomonas aeruginosa PA01
cgcccaggcgcucggcgacc

SEQ ID NO: 1420897 - RNA, 17 nt, Pseudomonas aeruginosa PA01
cgcccagugguuccagg

SEQ ID NO: 1420898 - RNA, 20 nt, Pseudomonas aeruginosa PA01
cgcccaucaacgagccgagc

SEQ ID NO: 1420899 - RNA, 23 nt, Pseudomonas aeruginosa PA01
cgcccaugaaaaauggccgcuuc

SEQ ID NO: 1420900 - RNA, 14 nt, Pseudomonas aeruginosa PA01
cgcccaucgccacc

SEQ ID NO: 1420901 - RNA, 17 nt, Pseudomonas aeruginosa PA01
cgcccaugcgcggcgag

SEQ ID NO: 1420902 - RNA, 18 nt, Pseudomonas aeruginosa PA01
cgcccaugcgcggcgaga

SEQ ID NO: 1420903 - RNA, 19 nt, Pseudomonas aeruginosa PA01
cgcccaugccuugcagcgc

SEQ ID NO: 1420904 - RNA, 21 nt, Pseudomonas aeruginosa PA01
cgcccaugccgcccggccgcu

SEQ ID NO: 1420905 - RNA, 16 nt, Pseudomonas aeruginosa PA01
cgcccagggcgugguc

SEQ ID NO: 1420906 - RNA, 16 nt, Pseudomonas aeruginosa PA01
cgcccagggcuucgcg

SEQ ID NO: 1420907 - RNA, 12 nt, Pseudomonas aeruginosa PA01
cgcccaggcgcu

SEQ ID NO: 1420908 - RNA, 22 nt, Pseudomonas aeruginosa PA01
cgcccaggcgcaccuccucggg

SEQ ID NO: 1420909 - RNA, 16 nt, Pseudomonas aeruginosa PA01
cgcccagggggccggg

SEQ ID NO: 1420910 - RNA, 20 nt, Pseudomonas aeruginosa PA01
cgcccagggggccgggccga

SEQ ID NO: 1420911 - RNA, 22 nt, Pseudomonas aeruginosa PA01
cgcccagggggccgggccgauc

SEQ ID NO: 1420912 - RNA, 19 nt, Pseudomonas aeruginosa PA01
cgcccagguaggagagggu

SEQ ID NO: 1420913 - RNA, 14 nt, Pseudomonas aeruginosa PA01
cgcccagguaggcg

SEQ ID NO: 1420914 - RNA, 20 nt, Pseudomonas aeruginosa PA01
cgcccagguaggcgaugcgc

SEQ ID NO: 1420915 - RNA, 16 nt, Pseudomonas aeruginosa PA01
cgcccagguccggcug

SEQ ID NO: 1420916 - RNA, 19 nt, Pseudomonas aeruginosa PA01
cgcccaggcugccgccgcc

SEQ ID NO: 1420917 - RNA, 20 nt, Pseudomonas aeruginosa PA01
cgcccaggcugccgccgccg

SEQ ID NO: 1420918 - RNA, 17 nt, Pseudomonas aeruginosa PA01
cgcccaggcugccggcc

SEQ ID NO: 1420919 - RNA, 20 nt, Pseudomonas aeruginosa PA01
cgcccaggcugccggccagg

SEQ ID NO: 1420920 - RNA, 15 nt, Pseudomonas aeruginosa PA01
cgcccagggacgcgc

SEQ ID NO: 1420921 - RNA, 12 nt, Pseudomonas aeruginosa PA01
cgcccagggcgu

SEQ ID NO: 1420922 - RNA, 13 nt, Pseudomonas aeruginosa PA01
cgcccaggccggg

SEQ ID NO: 1420923 - RNA, 14 nt, Pseudomonas aeruginosa PA01
cgcccaggugcgcc

SEQ ID NO: 1420924 - RNA, 19 nt, Pseudomonas aeruginosa PA01
cgcccaggugcgccgagcg

SEQ ID NO: 1420925 - RNA, 16 nt, Pseudomonas aeruginosa PA01
cgcccaguaccacgca

SEQ ID NO: 1420926 - RNA, 17 nt, Pseudomonas aeruginosa PA01
cgcccaguaccgccacg

SEQ ID NO: 1420927 - RNA, 16 nt, Pseudomonas aeruginosa PA01
cgcccagugcccggca

SEQ ID NO: 1420928 - RNA, 21 nt, Pseudomonas aeruginosa PA01
cgcccgccacggcgcgcuccg

SEQ ID NO: 1420929 - RNA, 20 nt, Pseudomonas aeruginosa PA01
cgcccgccaggucgagggca

SEQ ID NO: 1420930 - RNA, 22 nt, Pseudomonas aeruginosa PA01
cgcccgccuggaaggcgcuggg

SEQ ID NO: 1420931 - RNA, 22 nt, Pseudomonas aeruginosa PA01
cgcccgcgagccguccugcggc

SEQ ID NO: 1420932 - RNA, 15 nt, Pseudomonas aeruginosa PA01
cgcccgcgccuccag

SEQ ID NO: 1420933 - RNA, 19 nt, Pseudomonas aeruginosa PA01
cgcccgcgccuccaggcgc

SEQ ID NO: 1420934 - RNA, 20 nt, Pseudomonas aeruginosa PA01
cgcccgcgcauggagacggc

SEQ ID NO: 1420935 - RNA, 22 nt, Pseudomonas aeruginosa PA01
cgcccgcaugccagggccuugc

SEQ ID NO: 1420936 - RNA, 21 nt, Pseudomonas aeruginosa PA01
cgcccgccaaggcccugcugc

SEQ ID NO: 1420937 - RNA, 22 nt, Pseudomonas aeruginosa PA01
cgcccgccaaggcccugcugca

SEQ ID NO: 1420938 - RNA, 14 nt, Pseudomonas aeruginosa PA01
cgcccgccaagggc

SEQ ID NO: 1420939 - RNA, 16 nt, Pseudomonas aeruginosa PA01
cgcccgccaagggcgc

SEQ ID NO: 1420940 - RNA, 21 nt, Pseudomonas aeruginosa PA01
cgcccgccaagggcgccgccg

SEQ ID NO: 1420941 - RNA, 22 nt, Pseudomonas aeruginosa PA01
cgcccgccaagggcgccgccga

SEQ ID NO: 1420942 - RNA, 24 nt, Pseudomonas aeruginosa PA01
cgcccgccaagggcgccgccgagg

SEQ ID NO: 1420943 - RNA, 13 nt, Pseudomonas aeruginosa PA01
cgccccucccagc

SEQ ID NO: 1420944 - RNA, 15 nt, Pseudomonas aeruginosa PA01
cgccccucccagcca

SEQ ID NO: 1420945 - RNA, 23 nt, Pseudomonas aeruginosa PA01
cgccccguuugccgucggcgcgg

SEQ ID NO: 1420946 - RNA, 11 nt, Pseudomonas aeruginosa PA01
cgccccugcgg

SEQ ID NO: 1420947 - RNA, 12 nt, Pseudomonas aeruginosa PA01
cgcccggccgga

SEQ ID NO: 1420948 - RNA, 22 nt, Pseudomonas aeruginosa PA01
cgcccggccggauuggccgagg

SEQ ID NO: 1420949 - RNA, 21 nt, Pseudomonas aeruginosa PA01
cgcccggccuccccggcccgc

SEQ ID NO: 1420950 - RNA, 16 nt, Pseudomonas aeruginosa PA01
cgcccggcgcaugccg

SEQ ID NO: 1420951 - RNA, 15 nt, Pseudomonas aeruginosa PA01
cgcccggcgccaccg

SEQ ID NO: 1420952 - RNA, 14 nt, Pseudomonas aeruginosa PA01
cgcccggcgcgacc

SEQ ID NO: 1420953 - RNA, 14 nt, Pseudomonas aeruginosa PA01
cgcccgcugcgcug

SEQ ID NO: 1420954 - RNA, 20 nt, Pseudomonas aeruginosa PA01
cgcccgcugcgcugccagcg

SEQ ID NO: 1420955 - RNA, 22 nt, Pseudomonas aeruginosa PA01
cgcccgcugcgcugccagcgcc

SEQ ID NO: 1420956 - RNA, 15 nt, Pseudomonas aeruginosa PA01
cgcccggcagcggcu

SEQ ID NO: 1420957 - RNA, 18 nt, Pseudomonas aeruginosa PA01
cgcccggcagcggcuggc

SEQ ID NO: 1420958 - RNA, 13 nt, Pseudomonas aeruginosa PA01
cgcccgcuucgcc

SEQ ID NO: 1420959 - RNA, 15 nt, Pseudomonas aeruginosa PA01
cgcccgcuucgccau

SEQ ID NO: 1420960 - RNA, 17 nt, Pseudomonas aeruginosa PA01
cgcccgcuucgccaucg

SEQ ID NO: 1420961 - RNA, 18 nt, Pseudomonas aeruginosa PA01
cgcccgcuucgccaucga

SEQ ID NO: 1420962 - RNA, 13 nt, Pseudomonas aeruginosa PA01
cgcccggccaggc

SEQ ID NO: 1420963 - RNA, 14 nt, Pseudomonas aeruginosa PA01
cgcccggccaggcc

SEQ ID NO: 1420964 - RNA, 22 nt, Pseudomonas aeruginosa PA01
cgcccggccaggccacggcgga

SEQ ID NO: 1420965 - RNA, 16 nt, Pseudomonas aeruginosa PA01
cgcccggccaggccgc

SEQ ID NO: 1420966 - RNA, 19 nt, Pseudomonas aeruginosa PA01
cgcccggccaggccgccca

SEQ ID NO: 1420967 - RNA, 18 nt, Pseudomonas aeruginosa PA01
cgcccggcaucugccggg

SEQ ID NO: 1420968 - RNA, 22 nt, Pseudomonas aeruginosa PA01
cgcccggcaucugccgggcguu

SEQ ID NO: 1420969 - RNA, 20 nt, Pseudomonas aeruginosa PA01
cgcccggcagcaggccgccg

SEQ ID NO: 1420970 - RNA, 20 nt, Pseudomonas aeruginosa PA01
cgcccacgccuugcagcacc

SEQ ID NO: 1420971 - RNA, 21 nt, Pseudomonas aeruginosa PA01
cgcccacgccuugcagcaccg

SEQ ID NO: 1420972 - RNA, 23 nt, Pseudomonas aeruginosa PA01
cgcccacucuucagucccucguc

SEQ ID NO: 1420973 - RNA, 21 nt, Pseudomonas aeruginosa PA01
cgcccagaaaaaagccccgca

SEQ ID NO: 1420974 - RNA, 21 nt, Pseudomonas aeruginosa PA01
cgcccagacacgccucaaggc

SEQ ID NO: 1420975 - RNA, 12 nt, Pseudomonas aeruginosa PA01
cgcccagaccug

SEQ ID NO: 1420976 - RNA, 16 nt, Pseudomonas aeruginosa PA01
cgcccagaccugcaau

SEQ ID NO: 1420977 - RNA, 22 nt, Pseudomonas aeruginosa PA01
cgcccagaguucgcccagcucg

SEQ ID NO: 1420978 - RNA, 12 nt, Pseudomonas aeruginosa PA01
cgcccaccaggu

SEQ ID NO: 1420979 - RNA, 17 nt, Pseudomonas aeruginosa PA01
cgcccacccugcgcgag

SEQ ID NO: 1420980 - RNA, 16 nt, Pseudomonas aeruginosa PA01
cgcccagcggcuggcg

SEQ ID NO: 1420981 - RNA, 17 nt, Pseudomonas aeruginosa PA01
cgcccagcggcuggcgg

SEQ ID NO: 1420982 - RNA, 15 nt, Pseudomonas aeruginosa PA01
cgcccaggccgcugg

SEQ ID NO: 1420983 - RNA, 23 nt, Pseudomonas aeruginosa PA01
cgcccaggccgcuggcggcgacg

SEQ ID NO: 1420984 - RNA, 14 nt, Pseudomonas aeruginosa PA01
cgcccaggcagcag

SEQ ID NO: 1420985 - RNA, 15 nt, Pseudomonas aeruginosa PA01
cgcccaggcagcaga

SEQ ID NO: 1420986 - RNA, 11 nt, Pseudomonas aeruginosa PA01
cgcccagcgcc

SEQ ID NO: 1420987 - RNA, 14 nt, Pseudomonas aeruginosa PA01
cgcccagcgccugu

SEQ ID NO: 1420988 - RNA, 13 nt, Pseudomonas aeruginosa PA01
cgcccagccgagg

SEQ ID NO: 1420989 - RNA, 14 nt, Pseudomonas aeruginosa PA01
cgcccagcagcggc

SEQ ID NO: 1420990 - RNA, 15 nt, Pseudomonas aeruginosa PA01
cgcccagcaggcgcg

SEQ ID NO: 1420991 - RNA, 14 nt, Pseudomonas aeruginosa PA01
cgcccagcagggcc

SEQ ID NO: 1420992 - RNA, 19 nt, Pseudomonas aeruginosa PA01
cgcccagcagggccagcca

SEQ ID NO: 1420993 - RNA, 12 nt, Pseudomonas aeruginosa PA01
cgcccagcacca

SEQ ID NO: 1420994 - RNA, 15 nt, Pseudomonas aeruginosa PA01
cgcccagcaccgagc

SEQ ID NO: 1420995 - RNA, 12 nt, Pseudomonas aeruginosa PA01
cgcccagcagcg

SEQ ID NO: 1420996 - RNA, 14 nt, Pseudomonas aeruginosa PA01
cgcccagcagcagg

SEQ ID NO: 1420997 - RNA, 15 nt, Pseudomonas aeruginosa PA01
cgcccagcagcaggc

SEQ ID NO: 1420998 - RNA, 17 nt, Pseudomonas aeruginosa PA01
cgcccagcagcaggccg

SEQ ID NO: 1420999 - RNA, 18 nt, Pseudomonas aeruginosa PA01
cgcccagcagcaggccgg

SEQ ID NO: 1421000 - RNA, 21 nt, Pseudomonas aeruginosa PA01
cgcccagcagcaggccggcga

SEQ ID NO: 1421001 - RNA, 23 nt, Pseudomonas aeruginosa PA01
cgcccagcagcaggccggcgacc

SEQ ID NO: 1421002 - RNA, 19 nt, Pseudomonas aeruginosa PA01
cgccauggucguucagcgg

SEQ ID NO: 1421003 - RNA, 20 nt, Pseudomonas aeruginosa PA01
cgccauggucguucagcggc

SEQ ID NO: 1421004 - RNA, 15 nt, Pseudomonas aeruginosa PA01
cgccauggcgcuuca

SEQ ID NO: 1421005 - RNA, 13 nt, Pseudomonas aeruginosa PA01
cgccauggccgcu

SEQ ID NO: 1421006 - RNA, 19 nt, Pseudomonas aeruginosa PA01
cgccauggccuggaaaugg

SEQ ID NO: 1421007 - RNA, 18 nt, Pseudomonas aeruginosa PA01
cgccauggggaucaccgg

SEQ ID NO: 1421008 - RNA, 21 nt, Pseudomonas aeruginosa PA01
cgccauggguggaacccgcuu

SEQ ID NO: 1421009 - RNA, 19 nt, Pseudomonas aeruginosa PA01
cgccaugcuguugccgugg

SEQ ID NO: 1421010 - RNA, 21 nt, Pseudomonas aeruginosa PA01
cgccaugcuguugccguggcg

SEQ ID NO: 1421011 - RNA, 22 nt, Pseudomonas aeruginosa PA01
cgccaugcuguugccguggcgg

SEQ ID NO: 1421012 - RNA, 15 nt, Pseudomonas aeruginosa PA01
cgccaugcucggcca

SEQ ID NO: 1421013 - RNA, 16 nt, Pseudomonas aeruginosa PA01
cgccaugcucggccag

SEQ ID NO: 1421014 - RNA, 17 nt, Pseudomonas aeruginosa PA01
cgccaugcucggccagc

SEQ ID NO: 1421015 - RNA, 19 nt, Pseudomonas aeruginosa PA01
cgccaugcucggccagcuc

SEQ ID NO: 1421016 - RNA, 14 nt, Pseudomonas aeruginosa PA01
cgccaugcggcagg

SEQ ID NO: 1421017 - RNA, 23 nt, Pseudomonas aeruginosa PA01
cgccaugcggcaggccuuccacg

SEQ ID NO: 1421018 - RNA, 13 nt, Pseudomonas aeruginosa PA01
cgccaggaucggc

SEQ ID NO: 1421019 - RNA, 14 nt, Pseudomonas aeruginosa PA01
cgccaggaucggca

SEQ ID NO: 1421020 - RNA, 13 nt, Pseudomonas aeruginosa PA01
cgccaggcagacc

SEQ ID NO: 1421021 - RNA, 20 nt, Pseudomonas aeruginosa PA01
cgccaggcagaccaggccga

SEQ ID NO: 1421022 - RNA, 21 nt, Pseudomonas aeruginosa PA01
cgccaggcagaccaggccgag

SEQ ID NO: 1421023 - RNA, 14 nt, Pseudomonas aeruginosa PA01
cgccaggcagaccu

SEQ ID NO: 1421024 - RNA, 17 nt, Pseudomonas aeruginosa PA01
cgccaggcagaccugca

SEQ ID NO: 1421025 - RNA, 20 nt, Pseudomonas aeruginosa PA01
cgccaggcagaccugcagca

SEQ ID NO: 1421026 - RNA, 22 nt, Pseudomonas aeruginosa PA01
cgccaggcagaccugcagcagg

SEQ ID NO: 1421027 - RNA, 15 nt, Pseudomonas aeruginosa PA01
cgccaggcaggccgg

SEQ ID NO: 1421028 - RNA, 16 nt, Pseudomonas aeruginosa PA01
cgccaggcaggccggg

SEQ ID NO: 1421029 - RNA, 21 nt, Pseudomonas aeruginosa PA01
cgccaggcaggccgggcuggc

SEQ ID NO: 1421030 - RNA, 22 nt, Pseudomonas aeruginosa PA01
cgccaggcaggccgggcuggcc

SEQ ID NO: 1421031 - RNA, 13 nt, Pseudomonas aeruginosa PA01
cgccaggcaggcg

SEQ ID NO: 1421032 - RNA, 17 nt, Pseudomonas aeruginosa PA01
cgccaggcaggcgguca

SEQ ID NO: 1421033 - RNA, 18 nt, Pseudomonas aeruginosa PA01
cgccaggcaggcggucag

SEQ ID NO: 1421034 - RNA, 22 nt, Pseudomonas aeruginosa PA01
cgccaggcaggcggucagcgcg

SEQ ID NO: 1421035 - RNA, 14 nt, Pseudomonas aeruginosa PA01
cgccaggagcaggg

SEQ ID NO: 1421036 - RNA, 21 nt, Pseudomonas aeruginosa PA01
cgccaggagcagggcgccgau

SEQ ID NO: 1421037 - RNA, 18 nt, Pseudomonas aeruginosa PA01
cgccaggacucgccaucg

SEQ ID NO: 1421038 - RNA, 14 nt, Pseudomonas aeruginosa PA01
cgccaggaccuccu

SEQ ID NO: 1421039 - RNA, 16 nt, Pseudomonas aeruginosa PA01
cgccaggaccuccugc

SEQ ID NO: 1421040 - RNA, 21 nt, Pseudomonas aeruginosa PA01
cgccaggaccucgaagcuggc

SEQ ID NO: 1421041 - RNA, 16 nt, Pseudomonas aeruginosa PA01
cgccaggacggcaggg

SEQ ID NO: 1421042 - RNA, 16 nt, Pseudomonas aeruginosa PA01
cgccaggaagccgcgc

SEQ ID NO: 1421043 - RNA, 17 nt, Pseudomonas aeruginosa PA01
cgccaggaagccgcgcc

SEQ ID NO: 1421044 - RNA, 22 nt, Pseudomonas aeruginosa PA01
cgccaggaagccgcgccccagc

SEQ ID NO: 1421045 - RNA, 19 nt, Pseudomonas aeruginosa PA01
cgccauguuccacaugcgc

SEQ ID NO: 1421046 - RNA, 22 nt, Pseudomonas aeruginosa PA01
cgccauguuggccuugagcagg

SEQ ID NO: 1421047 - RNA, 19 nt, Pseudomonas aeruginosa PA01
cgccauucaggcggaucac

SEQ ID NO: 1421048 - RNA, 14 nt, Pseudomonas aeruginosa PA01
cgccauugccgcca

SEQ ID NO: 1421049 - RNA, 22 nt, Pseudomonas aeruginosa PA01
cgccauugacgaaauacucguc

SEQ ID NO: 1421050 - RNA, 16 nt, Pseudomonas aeruginosa PA01
cgccauucgaauggcg

SEQ ID NO: 1421051 - RNA, 20 nt, Pseudomonas aeruginosa PA01
cgccauucgaauggcgccgg

SEQ ID NO: 1421052 - RNA, 21 nt, Pseudomonas aeruginosa PA01
cgccauucgaauggcgccggc

SEQ ID NO: 1421053 - RNA, 22 nt, Pseudomonas aeruginosa PA01
cgccauucgaauggcgccggcc

SEQ ID NO: 1421054 - RNA, 13 nt, Pseudomonas aeruginosa PA01
cgccauucggcga

SEQ ID NO: 1421055 - RNA, 15 nt, Pseudomonas aeruginosa PA01
cgccauucggcgacg

SEQ ID NO: 1421056 - RNA, 18 nt, Pseudomonas aeruginosa PA01
cgccauucggcgacgggc

SEQ ID NO: 1421057 - RNA, 22 nt, Pseudomonas aeruginosa PA01
cgcccaacgucuucaggcgcuc

SEQ ID NO: 1421058 - RNA, 17 nt, Pseudomonas aeruginosa PA01
cgccauugugcgcgcgc

SEQ ID NO: 1421059 - RNA, 15 nt, Pseudomonas aeruginosa PA01
cgccauuucaaggcg

SEQ ID NO: 1421060 - RNA, 14 nt, Pseudomonas aeruginosa PA01
cgcccacaaccugc

SEQ ID NO: 1421061 - RNA, 21 nt, Pseudomonas aeruginosa PA01
cgcccacaaccugccgaucgc

SEQ ID NO: 1421062 - RNA, 22 nt, Pseudomonas aeruginosa PA01
cgcccacaaccugccgaucgcc

SEQ ID NO: 1421063 - RNA, 14 nt, Pseudomonas aeruginosa PA01
cgcccaacccccug

SEQ ID NO: 1421064 - RNA, 19 nt, Pseudomonas aeruginosa PA01
cgcccaaugcaucggccgg

SEQ ID NO: 1421065 - RNA, 15 nt, Pseudomonas aeruginosa PA01
cgccgagcagcacca

SEQ ID NO: 1421066 - RNA, 16 nt, Pseudomonas aeruginosa PA01
cgccgagcagcaccag

SEQ ID NO: 1421067 - RNA, 18 nt, Pseudomonas aeruginosa PA01
cgccgagcagcaccaggc

SEQ ID NO: 1421068 - RNA, 19 nt, Pseudomonas aeruginosa PA01
cgccgagcagcaccaggcu

SEQ ID NO: 1421069 - RNA, 21 nt, Pseudomonas aeruginosa PA01
cgccgagaacccggccaggcc

SEQ ID NO: 1421070 - RNA, 17 nt, Pseudomonas aeruginosa PA01
cgccgagaacgcggcga

SEQ ID NO: 1421071 - RNA, 20 nt, Pseudomonas aeruginosa PA01
cgccgagaacgcggcgaagg

SEQ ID NO: 1421072 - RNA, 22 nt, Pseudomonas aeruginosa PA01
cgccgagaacgcggcgaagggc

SEQ ID NO: 1421073 - RNA, 13 nt, Pseudomonas aeruginosa PA01
cgccgagacgauc

SEQ ID NO: 1421074 - RNA, 18 nt, Pseudomonas aeruginosa PA01
cgccgagacgaucagcag

SEQ ID NO: 1421075 - RNA, 19 nt, Pseudomonas aeruginosa PA01
cgccgagacgaucagcagg

SEQ ID NO: 1421076 - RNA, 14 nt, Pseudomonas aeruginosa PA01
cgccgagccagccg

SEQ ID NO: 1421077 - RNA, 15 nt, Pseudomonas aeruginosa PA01
cgccgagccagccgc

SEQ ID NO: 1421078 - RNA, 17 nt, Pseudomonas aeruginosa PA01
cgccgagccagguacgg

SEQ ID NO: 1421079 - RNA, 23 nt, Pseudomonas aeruginosa PA01
cgccgagaaaguucccgcauggc

SEQ ID NO: 1421080 - RNA, 21 nt, Pseudomonas aeruginosa PA01
cgccgagcaugaugcaggcag

SEQ ID NO: 1421081 - RNA, 23 nt, Pseudomonas aeruginosa PA01
cgccgagcaugcgggcgaucucc

SEQ ID NO: 1421082 - RNA, 15 nt, Pseudomonas aeruginosa PA01
cgccgagcauccagg

SEQ ID NO: 1421083 - RNA, 18 nt, Pseudomonas aeruginosa PA01
cgccgagcagcggcgcgc

SEQ ID NO: 1421084 - RNA, 20 nt, Pseudomonas aeruginosa PA01
cgccgagcauuccgacaagg

SEQ ID NO: 1421085 - RNA, 23 nt, Pseudomonas aeruginosa PA01
cgccgagcauuccgacaaggagc

SEQ ID NO: 1421086 - RNA, 14 nt, Pseudomonas aeruginosa PA01
cgccgagccggcug

SEQ ID NO: 1421087 - RNA, 17 nt, Pseudomonas aeruginosa PA01
cgccgagccggcugccg

SEQ ID NO: 1421088 - RNA, 17 nt, Pseudomonas aeruginosa PA01
cgccgaggcggaagacg

SEQ ID NO: 1421089 - RNA, 21 nt, Pseudomonas aeruginosa PA01
cgccgaggcggaagacgaucu

SEQ ID NO: 1421090 - RNA, 15 nt, Pseudomonas aeruginosa PA01
cgccgaggcggcgca

SEQ ID NO: 1421091 - RNA, 17 nt, Pseudomonas aeruginosa PA01
cgccgaggcggcgcagc

SEQ ID NO: 1421092 - RNA, 15 nt, Pseudomonas aeruginosa PA01
cgccgaggcgcgcca

SEQ ID NO: 1421093 - RNA, 16 nt, Pseudomonas aeruginosa PA01
cgccgaggcgcgccac

SEQ ID NO: 1421094 - RNA, 13 nt, Pseudomonas aeruginosa PA01
cgccgaucacccc

SEQ ID NO: 1421095 - RNA, 14 nt, Pseudomonas aeruginosa PA01
cgccgaucaccccg

SEQ ID NO: 1421096 - RNA, 17 nt, Pseudomonas aeruginosa PA01
cgccgaucaccccgccc

SEQ ID NO: 1421097 - RNA, 13 nt, Pseudomonas aeruginosa PA01
cgccgaggcccag

SEQ ID NO: 1421098 - RNA, 15 nt, Pseudomonas aeruginosa PA01
cgccgaggcccagcg

SEQ ID NO: 1421099 - RNA, 16 nt, Pseudomonas aeruginosa PA01
cgccgaggagacgcgg

SEQ ID NO: 1421100 - RNA, 17 nt, Pseudomonas aeruginosa PA01
cgccgaggagacgcggc

SEQ ID NO: 1421101 - RNA, 22 nt, Pseudomonas aeruginosa PA01
cgccgaggaggaucucgcgccc

SEQ ID NO: 1421102 - RNA, 15 nt, Pseudomonas aeruginosa PA01
cgccgagcgccgcca

SEQ ID NO: 1421103 - RNA, 19 nt, Pseudomonas aeruginosa PA01
cgccgaggauacgcucagg

SEQ ID NO: 1421104 - RNA, 22 nt, Pseudomonas aeruginosa PA01
cgccgaggauacgcucaggaag

SEQ ID NO: 1421105 - RNA, 21 nt, Pseudomonas aeruginosa PA01
cgccgacccuagggucggcgu

SEQ ID NO: 1421106 - RNA, 14 nt, Pseudomonas aeruginosa PA01
cgccgacccugcac

SEQ ID NO: 1421107 - RNA, 24 nt, Pseudomonas aeruginosa PA01
cgccgacccugcacccuuggcgca

SEQ ID NO: 1421108 - RNA, 18 nt, Pseudomonas aeruginosa PA01
cgccgacagcacgauggc

SEQ ID NO: 1421109 - RNA, 19 nt, Pseudomonas aeruginosa PA01
cgccgacagcacgauggcg

SEQ ID NO: 1421110 - RNA, 21 nt, Pseudomonas aeruginosa PA01
cgccgacagauuguucgguac

SEQ ID NO: 1421111 - RNA, 21 nt, Pseudomonas aeruginosa PA01
cgccgacaggccggugccgcc

SEQ ID NO: 1421112 - RNA, 22 nt, Pseudomonas aeruginosa PA01
cgccgacaggccggugccgccg

SEQ ID NO: 1421113 - RNA, 13 nt, Pseudomonas aeruginosa PA01
cgccgacaggucg

SEQ ID NO: 1421114 - RNA, 14 nt, Pseudomonas aeruginosa PA01
cgccgacaggucgg

SEQ ID NO: 1421115 - RNA, 18 nt, Pseudomonas aeruginosa PA01
cgccgacaggucggccgg

SEQ ID NO: 1421116 - RNA, 19 nt, Pseudomonas aeruginosa PA01
cgccgacaggucggccggc

SEQ ID NO: 1421117 - RNA, 22 nt, Pseudomonas aeruginosa PA01
cgccgacaggucggccggcagc

SEQ ID NO: 1421118 - RNA, 22 nt, Pseudomonas aeruginosa PA01
cgccgaccgcaccgccagcguc

SEQ ID NO: 1421119 - RNA, 23 nt, Pseudomonas aeruginosa PA01
cgccgaccgcaccgccagcgucg

SEQ ID NO: 1421120 - RNA, 14 nt, Pseudomonas aeruginosa PA01
cgccgaccgcgcgc

SEQ ID NO: 1421121 - RNA, 19 nt, Pseudomonas aeruginosa PA01
cgccgaccgccaaggucgg

SEQ ID NO: 1421122 - RNA, 14 nt, Pseudomonas aeruginosa PA01
cgccgacuucggca

SEQ ID NO: 1421123 - RNA, 15 nt, Pseudomonas aeruginosa PA01
cgccgacuuccaggc

SEQ ID NO: 1421124 - RNA, 17 nt, Pseudomonas aeruginosa PA01
cgccgacuuccaggcgc

SEQ ID NO: 1421125 - RNA, 18 nt, Pseudomonas aeruginosa PA01
cgccgacuuccaggcgca

SEQ ID NO: 1421126 - RNA, 18 nt, Pseudomonas aeruginosa PA01
cgccgacuugcucaucgc

SEQ ID NO: 1421127 - RNA, 23 nt, Pseudomonas aeruginosa PA01
cgccgacuugcucaucgcguagg

SEQ ID NO: 1421128 - RNA, 13 nt, Pseudomonas aeruginosa PA01
cgccgacgccgag

SEQ ID NO: 1421129 - RNA, 14 nt, Pseudomonas aeruginosa PA01
cgccgacgccgagu

SEQ ID NO: 1421130 - RNA, 18 nt, Pseudomonas aeruginosa PA01
cgccgacgccggacgagc

SEQ ID NO: 1421131 - RNA, 12 nt, Pseudomonas aeruginosa PA01
cgccgacgccau

SEQ ID NO: 1421132 - RNA, 18 nt, Pseudomonas aeruginosa PA01
cgccgacgccaccagcca

SEQ ID NO: 1421133 - RNA, 20 nt, Pseudomonas aeruginosa PA01
cgccgacgccaccagccagg

SEQ ID NO: 1421134 - RNA, 22 nt, Pseudomonas aeruginosa PA01
cgccgacgccaccagccaggcg

SEQ ID NO: 1421135 - RNA, 14 nt, Pseudomonas aeruginosa PA01
cgccgaccgggcgg

SEQ ID NO: 1421136 - RNA, 17 nt, Pseudomonas aeruginosa PA01
cgcccuucagcgccucg

SEQ ID NO: 1421137 - RNA, 22 nt, Pseudomonas aeruginosa PA01
cgcccuucagcgccucgaggau

SEQ ID NO: 1421138 - RNA, 20 nt, Pseudomonas aeruginosa PA01
cgcccuugacguucaggcug

SEQ ID NO: 1421139 - RNA, 20 nt, Pseudomonas aeruginosa PA01
cgcccuugccauccuccagc

SEQ ID NO: 1421140 - RNA, 22 nt, Pseudomonas aeruginosa PA01
cgcccuugccauccuccagcac

SEQ ID NO: 1421141 - RNA, 15 nt, Pseudomonas aeruginosa PA01
cgcccuugagcacgu

SEQ ID NO: 1421142 - RNA, 15 nt, Pseudomonas aeruginosa PA01
cgcccuugcgccgcg

SEQ ID NO: 1421143 - RNA, 15 nt, Pseudomonas aeruginosa PA01
cgcccugcggcaggc

SEQ ID NO: 1421144 - RNA, 22 nt, Pseudomonas aeruginosa PA01
cgcccugcggcaggcgccaacc

SEQ ID NO: 1421145 - RNA, 13 nt, Pseudomonas aeruginosa PA01
cgcccugcgggau

SEQ ID NO: 1421146 - RNA, 21 nt, Pseudomonas aeruginosa PA01
cgcccugcguggaaccgcggc

SEQ ID NO: 1421147 - RNA, 22 nt, Pseudomonas aeruginosa PA01
cgcccugcguggaaccgcggcg

SEQ ID NO: 1421148 - RNA, 15 nt, Pseudomonas aeruginosa PA01
cgcccugcucuugcc

SEQ ID NO: 1421149 - RNA, 16 nt, Pseudomonas aeruginosa PA01
cgcccugcucuugccg

SEQ ID NO: 1421150 - RNA, 14 nt, Pseudomonas aeruginosa PA01
cgcccuggaugauc

SEQ ID NO: 1421151 - RNA, 17 nt, Pseudomonas aeruginosa PA01
cgcccuggccgaucagc

SEQ ID NO: 1421152 - RNA, 20 nt, Pseudomonas aeruginosa PA01
cgcccugccccuucggcugc

SEQ ID NO: 1421153 - RNA, 15 nt, Pseudomonas aeruginosa PA01
cgcccgguucguaga

SEQ ID NO: 1421154 - RNA, 22 nt, Pseudomonas aeruginosa PA01
cgcccugcgccagcaucgcauc

SEQ ID NO: 1421155 - RNA, 17 nt, Pseudomonas aeruginosa PA01
cgcccugcgcgaucccc

SEQ ID NO: 1421156 - RNA, 18 nt, Pseudomonas aeruginosa PA01
cgcccggucucagccggc

SEQ ID NO: 1421157 - RNA, 18 nt, Pseudomonas aeruginosa PA01
cgcccggugucgacgacg

SEQ ID NO: 1421158 - RNA, 23 nt, Pseudomonas aeruginosa PA01
cgccgacaacgaaaagagccgcg

SEQ ID NO: 1421159 - RNA, 13 nt, Pseudomonas aeruginosa PA01
cgccgaaggccag

SEQ ID NO: 1421160 - RNA, 19 nt, Pseudomonas aeruginosa PA01
cgccgacacccgcgccgcc

SEQ ID NO: 1421161 - RNA, 20 nt, Pseudomonas aeruginosa PA01
cgccgacacccgcgccgccg

SEQ ID NO: 1421162 - RNA, 22 nt, Pseudomonas aeruginosa PA01
cgccgacacccgcgccgccgcg

SEQ ID NO: 1421163 - RNA, 13 nt, Pseudomonas aeruginosa PA01
cgccgaagccgac

SEQ ID NO: 1421164 - RNA, 14 nt, Pseudomonas aeruginosa PA01
cgccgaagccgacg

SEQ ID NO: 1421165 - RNA, 17 nt, Pseudomonas aeruginosa PA01
cgccgaagccgacgccg

SEQ ID NO: 1421166 - RNA, 21 nt, Pseudomonas aeruginosa PA01
cgccgaagccgacgccgagca

SEQ ID NO: 1421167 - RNA, 23 nt, Pseudomonas aeruginosa PA01
cgccgaagccgacgccgagcagc

SEQ ID NO: 1421168 - RNA, 12 nt, Pseudomonas aeruginosa PA01
cgccgaagccgc

SEQ ID NO: 1421169 - RNA, 14 nt, Pseudomonas aeruginosa PA01
cgccgaagcggggc

SEQ ID NO: 1421170 - RNA, 15 nt, Pseudomonas aeruginosa PA01
cgccgaagcccuugg

SEQ ID NO: 1421171 - RNA, 14 nt, Pseudomonas aeruginosa PA01
cgccgaagauccgc

SEQ ID NO: 1421172 - RNA, 19 nt, Pseudomonas aeruginosa PA01
cgccgaagauccgcuccag

SEQ ID NO: 1421173 - RNA, 21 nt, Pseudomonas aeruginosa PA01
cgccgaagauccgcuccaggc

SEQ ID NO: 1421174 - RNA, 22 nt, Pseudomonas aeruginosa PA01
cgccgaagauccgcuccaggcu

SEQ ID NO: 1421175 - RNA, 15 nt, Pseudomonas aeruginosa PA01
cgccgaaagcacgcg

SEQ ID NO: 1421176 - RNA, 20 nt, Pseudomonas aeruginosa PA01
cgccgaaagcacgcgcaucc

SEQ ID NO: 1421177 - RNA, 16 nt, Pseudomonas aeruginosa PA01
cgccgaaauagcgcgc

SEQ ID NO: 1421178 - RNA, 18 nt, Pseudomonas aeruginosa PA01
cgccgaaauagcgcgccc

SEQ ID NO: 1421179 - RNA, 19 nt, Pseudomonas aeruginosa PA01
cgcccuuuuucgucgccag

SEQ ID NO: 1421180 - RNA, 21 nt, Pseudomonas aeruginosa PA01
cgcccuuuuucgucgccagcc

SEQ ID NO: 1421181 - RNA, 22 nt, Pseudomonas aeruginosa PA01
cgccgaaaaaaaggggcccgaa

SEQ ID NO: 1421182 - RNA, 18 nt, Pseudomonas aeruginosa PA01
cgccgaaaaauucagcgc

SEQ ID NO: 1421183 - RNA, 21 nt, Pseudomonas aeruginosa PA01
cgccgaaaaauucagcgcagc

SEQ ID NO: 1421184 - RNA, 20 nt, Pseudomonas aeruginosa PA01
cgccgaaaagaaaaggccac

SEQ ID NO: 1421185 - RNA, 21 nt, Pseudomonas aeruginosa PA01
cgccgaaaagaaaaggccacc

SEQ ID NO: 1421186 - RNA, 23 nt, Pseudomonas aeruginosa PA01
cgccgaaaagaagccccgcagcc

SEQ ID NO: 1421187 - RNA, 14 nt, Pseudomonas aeruginosa PA01
cgcccuuggcggcg

SEQ ID NO: 1421188 - RNA, 15 nt, Pseudomonas aeruginosa PA01
cgcccuuggcggcgc

SEQ ID NO: 1421189 - RNA, 17 nt, Pseudomonas aeruginosa PA01
cgcccuuggcggcgcca

SEQ ID NO: 1421190 - RNA, 16 nt, Pseudomonas aeruginosa PA01
cgcccuugcucgcggc

SEQ ID NO: 1421191 - RNA, 17 nt, Pseudomonas aeruginosa PA01
cgcccuugcucgcggcg

SEQ ID NO: 1421192 - RNA, 21 nt, Pseudomonas aeruginosa PA01
cgcccuugcggcgcggcccgu

SEQ ID NO: 1421193 - RNA, 18 nt, Pseudomonas aeruginosa PA01
cgcccuugcucgcggcgu

SEQ ID NO: 1421194 - RNA, 15 nt, Pseudomonas aeruginosa PA01
cgcccuugcugccca

SEQ ID NO: 1421195 - RNA, 18 nt, Pseudomonas aeruginosa PA01
cgcccuuguagaucgaca

SEQ ID NO: 1421196 - RNA, 13 nt, Pseudomonas aeruginosa PA01
cgccgaucagcgc

SEQ ID NO: 1421197 - RNA, 15 nt, Pseudomonas aeruginosa PA01
cgccgaucagcgcgc

SEQ ID NO: 1421198 - RNA, 17 nt, Pseudomonas aeruginosa PA01
cgccgaucagcgcgccu

SEQ ID NO: 1421199 - RNA, 15 nt, Pseudomonas aeruginosa PA01
cgccgauccaggaac

SEQ ID NO: 1421200 - RNA, 21 nt, Pseudomonas aeruginosa PA01
cgccgauccaggaaccggcca

SEQ ID NO: 1421201 - RNA, 23 nt, Pseudomonas aeruginosa PA01
cgccgauccaggaaccggccauu

SEQ ID NO: 1421202 - RNA, 23 nt, Pseudomonas aeruginosa PA01
cgccgaucccgacgcccuccagc

SEQ ID NO: 1421203 - RNA, 20 nt, Pseudomonas aeruginosa PA01
cgccgaucccgaucggcaag

SEQ ID NO: 1421204 - RNA, 17 nt, Pseudomonas aeruginosa PA01
cgccgaucccggcggcg

SEQ ID NO: 1421205 - RNA, 19 nt, Pseudomonas aeruginosa PA01
cgccgaucccggcggcgac

SEQ ID NO: 1421206 - RNA, 20 nt, Pseudomonas aeruginosa PA01
cgccgaucccggcggcgacc

SEQ ID NO: 1421207 - RNA, 17 nt, Pseudomonas aeruginosa PA01
cgccgaugcccaggccg

SEQ ID NO: 1421208 - RNA, 19 nt, Pseudomonas aeruginosa PA01
cgccgaugcccaggccgau

SEQ ID NO: 1421209 - RNA, 19 nt, Pseudomonas aeruginosa PA01
cgccgaugccgacgucgac

SEQ ID NO: 1421210 - RNA, 14 nt, Pseudomonas aeruginosa PA01
cgccgaugcgccga

SEQ ID NO: 1421211 - RNA, 15 nt, Pseudomonas aeruginosa PA01
cgccgaugcgccgac

SEQ ID NO: 1421212 - RNA, 17 nt, Pseudomonas aeruginosa PA01
cgccgaugccggccggc

SEQ ID NO: 1421213 - RNA, 18 nt, Pseudomonas aeruginosa PA01
cgccgaugccggccggca

SEQ ID NO: 1421214 - RNA, 20 nt, Pseudomonas aeruginosa PA01
cgccgaugccggccggcagc

SEQ ID NO: 1421215 - RNA, 19 nt, Pseudomonas aeruginosa PA01
cgccgaugcuguucagcag

SEQ ID NO: 1421216 - RNA, 23 nt, Pseudomonas aeruginosa PA01
cgccgaugcucggugugaucacc

SEQ ID NO: 1421217 - RNA, 15 nt, Pseudomonas aeruginosa PA01
cgccgaugcgcuacg

SEQ ID NO: 1421218 - RNA, 20 nt, Pseudomonas aeruginosa PA01
cgccgaugucguagccgcgc

SEQ ID NO: 1421219 - RNA, 22 nt, Pseudomonas aeruginosa PA01
cgccgaugucguagccgcgcgc

SEQ ID NO: 1421220 - RNA, 16 nt, Pseudomonas aeruginosa PA01
cgccgauguacggcac

SEQ ID NO: 1421221 - RNA, 18 nt, Pseudomonas aeruginosa PA01
cgccgauguacggcacca

SEQ ID NO: 1421222 - RNA, 23 nt, Pseudomonas aeruginosa PA01
cgccgauguacggcaccaccacc

SEQ ID NO: 1421223 - RNA, 19 nt, Pseudomonas aeruginosa PA01
cgccgauggcugucggcgc

SEQ ID NO: 1421224 - RNA, 12 nt, Pseudomonas aeruginosa PA01
cgccgcaccggc

SEQ ID NO: 1421225 - RNA, 12 nt, Pseudomonas aeruginosa PA01
cgccgcagacca

SEQ ID NO: 1421226 - RNA, 14 nt, Pseudomonas aeruginosa PA01
cgccgcagaccagc

SEQ ID NO: 1421227 - RNA, 16 nt, Pseudomonas aeruginosa PA01
cgccgcaccggcgaug

SEQ ID NO: 1421228 - RNA, 15 nt, Pseudomonas aeruginosa PA01
cgccgcaaccgcccg

SEQ ID NO: 1421229 - RNA, 16 nt, Pseudomonas aeruginosa PA01
cgccgcaaccgcccga

SEQ ID NO: 1421230 - RNA, 17 nt, Pseudomonas aeruginosa PA01
cgccgcaaccgcccgag

SEQ ID NO: 1421231 - RNA, 17 nt, Pseudomonas aeruginosa PA01
cgccgcacaccgcgcgc

SEQ ID NO: 1421232 - RNA, 22 nt, Pseudomonas aeruginosa PA01
cgccgauugcaugaccuucagg

SEQ ID NO: 1421233 - RNA, 18 nt, Pseudomonas aeruginosa PA01
cgccgauugugcagggcc

SEQ ID NO: 1421234 - RNA, 13 nt, Pseudomonas aeruginosa PA01
cgccgcccagcag

SEQ ID NO: 1421235 - RNA, 14 nt, Pseudomonas aeruginosa PA01
cgccgcccagcagc

SEQ ID NO: 1421236 - RNA, 14 nt, Pseudomonas aeruginosa PA01
cgccgcccccagcg

SEQ ID NO: 1421237 - RNA, 17 nt, Pseudomonas aeruginosa PA01
cgccgcccccagcgcgc

SEQ ID NO: 1421238 - RNA, 19 nt, Pseudomonas aeruginosa PA01
cgccgcccccagcgcgccg

SEQ ID NO: 1421239 - RNA, 21 nt, Pseudomonas aeruginosa PA01
cgccgcccccagcgcgccgcc

SEQ ID NO: 1421240 - RNA, 23 nt, Pseudomonas aeruginosa PA01
cgccgcccccagcgcgccgccga

SEQ ID NO: 1421241 - RNA, 22 nt, Pseudomonas aeruginosa PA01
cgccgcccaguccugggugucg

SEQ ID NO: 1421242 - RNA, 16 nt, Pseudomonas aeruginosa PA01
cgccgcagccguggcg

SEQ ID NO: 1421243 - RNA, 14 nt, Pseudomonas aeruginosa PA01
cgccgcccacgccu

SEQ ID NO: 1421244 - RNA, 21 nt, Pseudomonas aeruginosa PA01
cgccgcccacgccuugcagca

SEQ ID NO: 1421245 - RNA, 24 nt, Pseudomonas aeruginosa PA01
cgccgccagguccgccugguccag

SEQ ID NO: 1421246 - RNA, 19 nt, Pseudomonas aeruginosa PA01
cgccgccagcuaccggcag

SEQ ID NO: 1421247 - RNA, 20 nt, Pseudomonas aeruginosa PA01
cgccgccagcuaccggcagg

SEQ ID NO: 1421248 - RNA, 20 nt, Pseudomonas aeruginosa PA01
cgccgccaggcagaccaggc

SEQ ID NO: 1421249 - RNA, 23 nt, Pseudomonas aeruginosa PA01
cgccgccaggcagaccaggccga

SEQ ID NO: 1421250 - RNA, 18 nt, Pseudomonas aeruginosa PA01
cgccgccaggcagaccug

SEQ ID NO: 1421251 - RNA, 17 nt, Pseudomonas aeruginosa PA01
cgccgccaggcaggccg

SEQ ID NO: 1421252 - RNA, 18 nt, Pseudomonas aeruginosa PA01
cgccgccaggcaggccgg

SEQ ID NO: 1421253 - RNA, 13 nt, Pseudomonas aeruginosa PA01
cgccgccaggcgc

SEQ ID NO: 1421254 - RNA, 14 nt, Pseudomonas aeruginosa PA01
cgccgccaggcgcg

SEQ ID NO: 1421255 - RNA, 15 nt, Pseudomonas aeruginosa PA01
cgccgccaggcgcgu

SEQ ID NO: 1421256 - RNA, 19 nt, Pseudomonas aeruginosa PA01
cgccgccaggcgcgucucc

SEQ ID NO: 1421257 - RNA, 14 nt, Pseudomonas aeruginosa PA01
cgccgccaggcgcu

SEQ ID NO: 1421258 - RNA, 15 nt, Pseudomonas aeruginosa PA01
cgccgccaggcgcug

SEQ ID NO: 1421259 - RNA, 20 nt, Pseudomonas aeruginosa PA01
cgccgccaggcgcuggcgaa

SEQ ID NO: 1421260 - RNA, 15 nt, Pseudomonas aeruginosa PA01
cgccgccaggcggca

SEQ ID NO: 1421261 - RNA, 13 nt, Pseudomonas aeruginosa PA01
cgccgcagcucgg

SEQ ID NO: 1421262 - RNA, 13 nt, Pseudomonas aeruginosa PA01
cgccgcaggaagg

SEQ ID NO: 1421263 - RNA, 15 nt, Pseudomonas aeruginosa PA01
cgccgcaggaaggcg

SEQ ID NO: 1421264 - RNA, 12 nt, Pseudomonas aeruginosa PA01
cgccgcaggcgu

SEQ ID NO: 1421265 - RNA, 12 nt, Pseudomonas aeruginosa PA01
cgccgcagggcc

SEQ ID NO: 1421266 - RNA, 15 nt, Pseudomonas aeruginosa PA01
cgccgccagcaggau

SEQ ID NO: 1421267 - RNA, 14 nt, Pseudomonas aeruginosa PA01
cgccgccagccaga

SEQ ID NO: 1421268 - RNA, 17 nt, Pseudomonas aeruginosa PA01
cgccgccagccagagca

SEQ ID NO: 1421269 - RNA, 13 nt, Pseudomonas aeruginosa PA01
cgccgccagcgcc

SEQ ID NO: 1421270 - RNA, 18 nt, Pseudomonas aeruginosa PA01
cgccgcagcggcgucugc

SEQ ID NO: 1421271 - RNA, 23 nt, Pseudomonas aeruginosa PA01
cgccgcagcggcgucugccgcuc

SEQ ID NO: 1421272 - RNA, 12 nt, Pseudomonas aeruginosa PA01
cgccgcagcggc

SEQ ID NO: 1421273 - RNA, 12 nt, Pseudomonas aeruginosa PA01
cgccgcagcgca

SEQ ID NO: 1421274 - RNA, 20 nt, Pseudomonas aeruginosa PA01
cgccgcagcgcaagucggcc

SEQ ID NO: 1421275 - RNA, 23 nt, Pseudomonas aeruginosa PA01
cgccgcagcgcaagucggccugc

SEQ ID NO: 1421276 - RNA, 19 nt, Pseudomonas aeruginosa PA01
cgccgcagcccuaggcgac

SEQ ID NO: 1421277 - RNA, 12 nt, Pseudomonas aeruginosa PA01
cgccgccgccag

SEQ ID NO: 1421278 - RNA, 14 nt, Pseudomonas aeruginosa PA01
cgccgccgccgacc

SEQ ID NO: 1421279 - RNA, 13 nt, Pseudomonas aeruginosa PA01
cgccgccgccgcg

SEQ ID NO: 1421280 - RNA, 14 nt, Pseudomonas aeruginosa PA01
cgccgccgccgcgg

SEQ ID NO: 1421281 - RNA, 15 nt, Pseudomonas aeruginosa PA01
cgccgccgccgucga

SEQ ID NO: 1421282 - RNA, 12 nt, Pseudomonas aeruginosa PA01
cgccgccgcgcg

SEQ ID NO: 1421283 - RNA, 13 nt, Pseudomonas aeruginosa PA01
cgccgccgcgcgc

SEQ ID NO: 1421284 - RNA, 15 nt, Pseudomonas aeruginosa PA01
cgccgccgcgcgcgc

SEQ ID NO: 1421285 - RNA, 14 nt, Pseudomonas aeruginosa PA01
cgccgccgcgccuu

SEQ ID NO: 1421286 - RNA, 15 nt, Pseudomonas aeruginosa PA01
cgccgccgcgugggc

SEQ ID NO: 1421287 - RNA, 16 nt, Pseudomonas aeruginosa PA01
cgccgccgcggccagc

SEQ ID NO: 1421288 - RNA, 15 nt, Pseudomonas aeruginosa PA01
cgccgccgcgggcga

SEQ ID NO: 1421289 - RNA, 13 nt, Pseudomonas aeruginosa PA01
cgccgccgcgucg

SEQ ID NO: 1421290 - RNA, 22 nt, Pseudomonas aeruginosa PA01
cgccgccggauuagcucagucg

SEQ ID NO: 1421291 - RNA, 11 nt, Pseudomonas aeruginosa PA01
cgccgccggag

SEQ ID NO: 1421292 - RNA, 15 nt, Pseudomonas aeruginosa PA01
cgccgccgcuggcga

SEQ ID NO: 1421293 - RNA, 14 nt, Pseudomonas aeruginosa PA01
cgccgccgaucugc

SEQ ID NO: 1421294 - RNA, 14 nt, Pseudomonas aeruginosa PA01
cgccgccgaggcgc

SEQ ID NO: 1421295 - RNA, 14 nt, Pseudomonas aeruginosa PA01
cgccgccgaggugc

SEQ ID NO: 1421296 - RNA, 13 nt, Pseudomonas aeruginosa PA01
cgccgccgcaacc

SEQ ID NO: 1421297 - RNA, 13 nt, Pseudomonas aeruginosa PA01
cgccgccgagcgc

SEQ ID NO: 1421298 - RNA, 16 nt, Pseudomonas aeruginosa PA01
cgccgccgagcgccug

SEQ ID NO: 1421299 - RNA, 15 nt, Pseudomonas aeruginosa PA01
cgccgccgaggagga

SEQ ID NO: 1421300 - RNA, 16 nt, Pseudomonas aeruginosa PA01
cgccgccgaggaggau

SEQ ID NO: 1421301 - RNA, 21 nt, Pseudomonas aeruginosa PA01
cgccgccgacgccaugggugg

SEQ ID NO: 1421302 - RNA, 15 nt, Pseudomonas aeruginosa PA01
cgccgccgagcaggc

SEQ ID NO: 1421303 - RNA, 22 nt, Pseudomonas aeruginosa PA01
cgccgccgagcaugcgggcgau

SEQ ID NO: 1421304 - RNA, 13 nt, Pseudomonas aeruginosa PA01
cgccgccccagca

SEQ ID NO: 1421305 - RNA, 19 nt, Pseudomonas aeruginosa PA01
cgccgccccagccucggca

SEQ ID NO: 1421306 - RNA, 16 nt, Pseudomonas aeruginosa PA01
cgccgccgaacaugcc

SEQ ID NO: 1421307 - RNA, 17 nt, Pseudomonas aeruginosa PA01
cgccgccgaacaugccg

SEQ ID NO: 1421308 - RNA, 14 nt, Pseudomonas aeruginosa PA01
cgccgccgaagccg

SEQ ID NO: 1421309 - RNA, 16 nt, Pseudomonas aeruginosa PA01
cgccgccgaagccgac

SEQ ID NO: 1421310 - RNA, 21 nt, Pseudomonas aeruginosa PA01
cgccgccgaagccgacgccga

SEQ ID NO: 1421311 - RNA, 23 nt, Pseudomonas aeruginosa PA01
cgccgccgaagccgacgccgagc

SEQ ID NO: 1421312 - RNA, 16 nt, Pseudomonas aeruginosa PA01
cgccgccgacacccgc

SEQ ID NO: 1421313 - RNA, 14 nt, Pseudomonas aeruginosa PA01
cgccgcccuggccg

SEQ ID NO: 1421314 - RNA, 17 nt, Pseudomonas aeruginosa PA01
cgccgcccuguucgucu

SEQ ID NO: 1421315 - RNA, 11 nt, Pseudomonas aeruginosa PA01
cgcgaccagcg

SEQ ID NO: 1421316 - RNA, 18 nt, Pseudomonas aeruginosa PA01
cgcgaccagcgccaggcg

SEQ ID NO: 1421317 - RNA, 19 nt, Pseudomonas aeruginosa PA01
cgcgaccagcgccaggcgc

SEQ ID NO: 1421318 - RNA, 22 nt, Pseudomonas aeruginosa PA01
cgcgaccagcgccaggcgcggu

SEQ ID NO: 1421319 - RNA, 14 nt, Pseudomonas aeruginosa PA01
cgcgacccaucgcc

SEQ ID NO: 1421320 - RNA, 15 nt, Pseudomonas aeruginosa PA01
cgcgacccaucgccg

SEQ ID NO: 1421321 - RNA, 19 nt, Pseudomonas aeruginosa PA01
cgcgacccaucgccgaaga

SEQ ID NO: 1421322 - RNA, 15 nt, Pseudomonas aeruginosa PA01
cgcgacacaccgaca

SEQ ID NO: 1421323 - RNA, 13 nt, Pseudomonas aeruginosa PA01
cgcgacaccgggc

SEQ ID NO: 1421324 - RNA, 15 nt, Pseudomonas aeruginosa PA01
cgcgacacauggucg

SEQ ID NO: 1421325 - RNA, 20 nt, Pseudomonas aeruginosa PA01
cgcgacacauggucggccag

SEQ ID NO: 1421326 - RNA, 20 nt, Pseudomonas aeruginosa PA01
cgcgaaugugguggaagagg

SEQ ID NO: 1421327 - RNA, 21 nt, Pseudomonas aeruginosa PA01
cgcgaagcgguuagccggcga

SEQ ID NO: 1421328 - RNA, 23 nt, Pseudomonas aeruginosa PA01
cgcgaagcgguuagccggcgauc

SEQ ID NO: 1421329 - RNA, 17 nt, Pseudomonas aeruginosa PA01
cgcgaaggccacgccga

SEQ ID NO: 1421330 - RNA, 18 nt, Pseudomonas aeruginosa PA01
cgcgaaggccacgccgac

SEQ ID NO: 1421331 - RNA, 12 nt, Pseudomonas aeruginosa PA01
cgcgaaggcgcc

SEQ ID NO: 1421332 - RNA, 18 nt, Pseudomonas aeruginosa PA01
cgcgaaggcgccuuccag

SEQ ID NO: 1421333 - RNA, 20 nt, Pseudomonas aeruginosa PA01
cgcgaaggcgccuuccaggc

SEQ ID NO: 1421334 - RNA, 19 nt, Pseudomonas aeruginosa PA01
cgcgaagaacacgccccag

SEQ ID NO: 1421335 - RNA, 17 nt, Pseudomonas aeruginosa PA01
cgcgaagaccggccggc

SEQ ID NO: 1421336 - RNA, 18 nt, Pseudomonas aeruginosa PA01
cgcgaaccucgguagccg

SEQ ID NO: 1421337 - RNA, 20 nt, Pseudomonas aeruginosa PA01
cgcgaaccucgguagccggc

SEQ ID NO: 1421338 - RNA, 20 nt, Pseudomonas aeruginosa PA01
cgcgaaccgggucgucagca

SEQ ID NO: 1421339 - RNA, 16 nt, Pseudomonas aeruginosa PA01
cgcgaagcccagcgcc

SEQ ID NO: 1421340 - RNA, 15 nt, Pseudomonas aeruginosa PA01
cgcgaagcacgcucu

SEQ ID NO: 1421341 - RNA, 23 nt, Pseudomonas aeruginosa PA01
cgcgaagcacgcucuucuuacag

SEQ ID NO: 1421342 - RNA, 21 nt, Pseudomonas aeruginosa PA01
cgcgaaccacauccuugccgu

SEQ ID NO: 1421343 - RNA, 15 nt, Pseudomonas aeruginosa PA01
cgcgaaccagcagca

SEQ ID NO: 1421344 - RNA, 19 nt, Pseudomonas aeruginosa PA01
cgcgaacaguuccgacugc

SEQ ID NO: 1421345 - RNA, 22 nt, Pseudomonas aeruginosa PA01
cgcgaacaguuccgacugcgag

SEQ ID NO: 1421346 - RNA, 21 nt, Pseudomonas aeruginosa PA01
cgcgaacacacccugcgcaag

SEQ ID NO: 1421347 - RNA, 15 nt, Pseudomonas aeruginosa PA01
cgccuugcagggggc

SEQ ID NO: 1421348 - RNA, 14 nt, Pseudomonas aeruginosa PA01
cgccuugcccuggc

SEQ ID NO: 1421349 - RNA, 15 nt, Pseudomonas aeruginosa PA01
cgccuugcccuggcc

SEQ ID NO: 1421350 - RNA, 15 nt, Pseudomonas aeruginosa PA01
cgccuugcagcaccg

SEQ ID NO: 1421351 - RNA, 17 nt, Pseudomonas aeruginosa PA01
cgccuugcagcaccgcc

SEQ ID NO: 1421352 - RNA, 22 nt, Pseudomonas aeruginosa PA01
cgcgaaauggcagaacaucgcc

SEQ ID NO: 1421353 - RNA, 23 nt, Pseudomonas aeruginosa PA01
cgccuugcggggcggcgcaucgg

SEQ ID NO: 1421354 - RNA, 23 nt, Pseudomonas aeruginosa PA01
cgccuugcgguccagcgagcggg

SEQ ID NO: 1421355 - RNA, 14 nt, Pseudomonas aeruginosa PA01
cgccuugcggcgcc

SEQ ID NO: 1421356 - RNA, 16 nt, Pseudomonas aeruginosa PA01
cgccuugcggcgccga

SEQ ID NO: 1421357 - RNA, 20 nt, Pseudomonas aeruginosa PA01
cgccuugcggcgccgaggcc

SEQ ID NO: 1421358 - RNA, 21 nt, Pseudomonas aeruginosa PA01
cgccuugcggcgccgaggccc

SEQ ID NO: 1421359 - RNA, 18 nt, Pseudomonas aeruginosa PA01
cgccuucguggccgcggg

SEQ ID NO: 1421360 - RNA, 13 nt, Pseudomonas aeruginosa PA01
cgccuucgggcga

SEQ ID NO: 1421361 - RNA, 13 nt, Pseudomonas aeruginosa PA01
cgccuucgggcgc

SEQ ID NO: 1421362 - RNA, 23 nt, Pseudomonas aeruginosa PA01
cgccuugaccucgacgccgagcc

SEQ ID NO: 1421363 - RNA, 14 nt, Pseudomonas aeruginosa PA01
cgccuugaccagcg

SEQ ID NO: 1421364 - RNA, 20 nt, Pseudomonas aeruginosa PA01
cgccuugaccagcggcccgg

SEQ ID NO: 1421365 - RNA, 20 nt, Pseudomonas aeruginosa PA01
cgccugggccgcgagguccg

SEQ ID NO: 1421366 - RNA, 15 nt, Pseudomonas aeruginosa PA01
cgccugggccgcgcu

SEQ ID NO: 1421367 - RNA, 14 nt, Pseudomonas aeruginosa PA01
cgccugggccggcg

SEQ ID NO: 1421368 - RNA, 19 nt, Pseudomonas aeruginosa PA01
cgccuggcuggccagcagg

SEQ ID NO: 1421369 - RNA, 21 nt, Pseudomonas aeruginosa PA01
cgccuggcuggccagcaggcu

SEQ ID NO: 1421370 - RNA, 21 nt, Pseudomonas aeruginosa PA01
cgccuggcgucgaugccgaau

SEQ ID NO: 1421371 - RNA, 16 nt, Pseudomonas aeruginosa PA01
cgccuggcgugccgcc

SEQ ID NO: 1421372 - RNA, 19 nt, Pseudomonas aeruginosa PA01
cgccuggcgugccgccagg

SEQ ID NO: 1421373 - RNA, 21 nt, Pseudomonas aeruginosa PA01
cgccuggcgugccgccaggcc

SEQ ID NO: 1421374 - RNA, 13 nt, Pseudomonas aeruginosa PA01
cgccuggcgcgac

SEQ ID NO: 1421375 - RNA, 14 nt, Pseudomonas aeruginosa PA01
cgccuggcgcgacg

SEQ ID NO: 1421376 - RNA, 19 nt, Pseudomonas aeruginosa PA01
cgccuggcgcgacgaggcg

SEQ ID NO: 1421377 - RNA, 19 nt, Pseudomonas aeruginosa PA01
cgccugguaggcggcgacg

SEQ ID NO: 1421378 - RNA, 16 nt, Pseudomonas aeruginosa PA01
cgccuggguggcgacg

SEQ ID NO: 1421379 - RNA, 16 nt, Pseudomonas aeruginosa PA01
cgccugguccagcagg

SEQ ID NO: 1421380 - RNA, 19 nt, Pseudomonas aeruginosa PA01
cgccuggugcccgaugccg

SEQ ID NO: 1421381 - RNA, 20 nt, Pseudomonas aeruginosa PA01
cgccuggugcccgaugccgc

SEQ ID NO: 1421382 - RNA, 22 nt, Pseudomonas aeruginosa PA01
cgccuggugcccgaugccgcgc

SEQ ID NO: 1421383 - RNA, 15 nt, Pseudomonas aeruginosa PA01
cgccuggucgccggg

SEQ ID NO: 1421384 - RNA, 13 nt, Pseudomonas aeruginosa PA01
cgccuggucggcg

SEQ ID NO: 1421385 - RNA, 14 nt, Pseudomonas aeruginosa PA01
cgccuggucggcgg

SEQ ID NO: 1421386 - RNA, 15 nt, Pseudomonas aeruginosa PA01
cgccuggucggcggc

SEQ ID NO: 1421387 - RNA, 22 nt, Pseudomonas aeruginosa PA01
cgccuggucggggccggcgaug

SEQ ID NO: 1421388 - RNA, 13 nt, Pseudomonas aeruginosa PA01
cgccuggcccugg

SEQ ID NO: 1421389 - RNA, 23 nt, Pseudomonas aeruginosa PA01
cgccuggccgucuuccagggcgg

SEQ ID NO: 1421390 - RNA, 16 nt, Pseudomonas aeruginosa PA01
cgccuggaugaucgcg

SEQ ID NO: 1421391 - RNA, 17 nt, Pseudomonas aeruginosa PA01
cgccuggcgcauggcgc

SEQ ID NO: 1421392 - RNA, 13 nt, Pseudomonas aeruginosa PA01
cgccuggcgcaag

SEQ ID NO: 1421393 - RNA, 18 nt, Pseudomonas aeruginosa PA01
cgccugcgcuucguuggc

SEQ ID NO: 1421394 - RNA, 22 nt, Pseudomonas aeruginosa PA01
cgccugcgcuucguuggcgacg

SEQ ID NO: 1421395 - RNA, 16 nt, Pseudomonas aeruginosa PA01
cgccuggaucagcgcc

SEQ ID NO: 1421396 - RNA, 23 nt, Pseudomonas aeruginosa PA01
cgccuggaucagcgccucgaccu

SEQ ID NO: 1421397 - RNA, 19 nt, Pseudomonas aeruginosa PA01
cgccuggagcagaaccgcc

SEQ ID NO: 1421398 - RNA, 21 nt, Pseudomonas aeruginosa PA01
cgccuggagcaguuucggauc

SEQ ID NO: 1421399 - RNA, 16 nt, Pseudomonas aeruginosa PA01
cgccuuccagaucguc

SEQ ID NO: 1421400 - RNA, 13 nt, Pseudomonas aeruginosa PA01
cgccuuccagccc

SEQ ID NO: 1421401 - RNA, 16 nt, Pseudomonas aeruginosa PA01
cgccuuccagcuugcg

SEQ ID NO: 1421402 - RNA, 21 nt, Pseudomonas aeruginosa PA01
cgccuuccagcuugcgccaga

SEQ ID NO: 1421403 - RNA, 22 nt, Pseudomonas aeruginosa PA01
cgccuuccagcuugcgccagag

SEQ ID NO: 1421404 - RNA, 21 nt, Pseudomonas aeruginosa PA01
cgccuucccagacguccagcg

SEQ ID NO: 1421405 - RNA, 22 nt, Pseudomonas aeruginosa PA01
cgccuucaccguucccagcagc

SEQ ID NO: 1421406 - RNA, 15 nt, Pseudomonas aeruginosa PA01
cgccuuccaccacca

SEQ ID NO: 1421407 - RNA, 17 nt, Pseudomonas aeruginosa PA01
cgccuuccaccaccagg

SEQ ID NO: 1421408 - RNA, 16 nt, Pseudomonas aeruginosa PA01
cgccuucagccccagc

SEQ ID NO: 1421409 - RNA, 23 nt, Pseudomonas aeruginosa PA01
cgccuucagccccagcacgccga

SEQ ID NO: 1421410 - RNA, 14 nt, Pseudomonas aeruginosa PA01
cgccuucagcgcca

SEQ ID NO: 1421411 - RNA, 22 nt, Pseudomonas aeruginosa PA01
cgccuucagcgccagcaggcga

SEQ ID NO: 1421412 - RNA, 16 nt, Pseudomonas aeruginosa PA01
cgccuucagcgccgcc

SEQ ID NO: 1421413 - RNA, 17 nt, Pseudomonas aeruginosa PA01
cgccuucagcgccgcca

SEQ ID NO: 1421414 - RNA, 19 nt, Pseudomonas aeruginosa PA01
cgccuucagcgccgccagg

SEQ ID NO: 1421415 - RNA, 21 nt, Pseudomonas aeruginosa PA01
cgccuucagcgccgccaggcc

SEQ ID NO: 1421416 - RNA, 15 nt, Pseudomonas aeruginosa PA01
cgccuucagcgccuc

SEQ ID NO: 1421417 - RNA, 22 nt, Pseudomonas aeruginosa PA01
cgccuuccuugucgaucaggaa

SEQ ID NO: 1421418 - RNA, 22 nt, Pseudomonas aeruginosa PA01
cgccuuccggcagguucagcag

SEQ ID NO: 1421419 - RNA, 14 nt, Pseudomonas aeruginosa PA01
cgccuuccucggcc

SEQ ID NO: 1421420 - RNA, 17 nt, Pseudomonas aeruginosa PA01
cgccuuccucggccgcc

SEQ ID NO: 1421421 - RNA, 17 nt, Pseudomonas aeruginosa PA01
cgccuuccucggcgauc

SEQ ID NO: 1421422 - RNA, 12 nt, Pseudomonas aeruginosa PA01
cgccuucggcga

SEQ ID NO: 1421423 - RNA, 13 nt, Pseudomonas aeruginosa PA01
cgccuucggcgac

SEQ ID NO: 1421424 - RNA, 22 nt, Pseudomonas aeruginosa PA01
cgccuucggcgacacagacgca

SEQ ID NO: 1421425 - RNA, 15 nt, Pseudomonas aeruginosa PA01
cgccuucggcaggac

SEQ ID NO: 1421426 - RNA, 21 nt, Pseudomonas aeruginosa PA01
cgccuucgcgggccaggccga

SEQ ID NO: 1421427 - RNA, 15 nt, Pseudomonas aeruginosa PA01
cgccuucgcguucgc

SEQ ID NO: 1421428 - RNA, 23 nt, Pseudomonas aeruginosa PA01
cgccuucgcguucgcuccgggcc

SEQ ID NO: 1421429 - RNA, 21 nt, Pseudomonas aeruginosa PA01
cgccuguggcguuauucgccc

SEQ ID NO: 1421430 - RNA, 21 nt, Pseudomonas aeruginosa PA01
cgccugucgcuccggcagcgc

SEQ ID NO: 1421431 - RNA, 20 nt, Pseudomonas aeruginosa PA01
cgccuguccaccgguggcga

SEQ ID NO: 1421432 - RNA, 16 nt, Pseudomonas aeruginosa PA01
cgccuguuccagggcc

SEQ ID NO: 1421433 - RNA, 12 nt, Pseudomonas aeruginosa PA01
cgccucgggcga

SEQ ID NO: 1421434 - RNA, 17 nt, Pseudomonas aeruginosa PA01
cgccucgggcgagcgca

SEQ ID NO: 1421435 - RNA, 16 nt, Pseudomonas aeruginosa PA01
cgccucgggcagcccc

SEQ ID NO: 1421436 - RNA, 23 nt, Pseudomonas aeruginosa PA01
cgccucgggcagccccuugagcg

SEQ ID NO: 1421437 - RNA, 17 nt, Pseudomonas aeruginosa PA01
cgccucgggccggagca

SEQ ID NO: 1421438 - RNA, 21 nt, Pseudomonas aeruginosa PA01
cgccucgggccggagcaggcc

SEQ ID NO: 1421439 - RNA, 14 nt, Pseudomonas aeruginosa PA01
cgccucggcggcgu

SEQ ID NO: 1421440 - RNA, 12 nt, Pseudomonas aeruginosa PA01
cgccucggcggg

SEQ ID NO: 1421441 - RNA, 13 nt, Pseudomonas aeruginosa PA01
cgccucggcggga

SEQ ID NO: 1421442 - RNA, 13 nt, Pseudomonas aeruginosa PA01
cgccucggcguag

SEQ ID NO: 1421443 - RNA, 14 nt, Pseudomonas aeruginosa PA01
cgccucggcguaga

SEQ ID NO: 1421444 - RNA, 22 nt, Pseudomonas aeruginosa PA01
cgccucggcguagaccuucucg

SEQ ID NO: 1421445 - RNA, 17 nt, Pseudomonas aeruginosa PA01
cgccucgguccaaccca

SEQ ID NO: 1421446 - RNA, 23 nt, Pseudomonas aeruginosa PA01
cgccucgucgaaacggaacagga

SEQ ID NO: 1421447 - RNA, 14 nt, Pseudomonas aeruginosa PA01
cgccucgucgagcg

SEQ ID NO: 1421448 - RNA, 17 nt, Pseudomonas aeruginosa PA01
cgccucgucgagcgcag

SEQ ID NO: 1421449 - RNA, 19 nt, Pseudomonas aeruginosa PA01
cgccucgucgagcgcagcg

SEQ ID NO: 1421450 - RNA, 21 nt, Pseudomonas aeruginosa PA01
cgccucgucgagcgcagcgac

SEQ ID NO: 1421451 - RNA, 13 nt, Pseudomonas aeruginosa PA01
cgccucgucgcgc

SEQ ID NO: 1421452 - RNA, 15 nt, Pseudomonas aeruginosa PA01
cgccucgucgcgcca

SEQ ID NO: 1421453 - RNA, 17 nt, Pseudomonas aeruginosa PA01
cgccucgucgcgccagg

SEQ ID NO: 1421454 - RNA, 19 nt, Pseudomonas aeruginosa PA01
cgccucgucgcgccaggcg

SEQ ID NO: 1421455 - RNA, 17 nt, Pseudomonas aeruginosa PA01
cgccucgucggaggcga

SEQ ID NO: 1421456 - RNA, 16 nt, Pseudomonas aeruginosa PA01
cgccugcgccucggcc

SEQ ID NO: 1421457 - RNA, 19 nt, Pseudomonas aeruginosa PA01
cgccugcaucucuuccucg

SEQ ID NO: 1421458 - RNA, 23 nt, Pseudomonas aeruginosa PA01
cgccugcaacgccagcaggcgca

SEQ ID NO: 1421459 - RNA, 13 nt, Pseudomonas aeruginosa PA01
cgccugcagcacc

SEQ ID NO: 1421460 - RNA, 20 nt, Pseudomonas aeruginosa PA01
cgccugcagcaccaccucgc

SEQ ID NO: 1421461 - RNA, 21 nt, Pseudomonas aeruginosa PA01
cgccugcagcaccaccucgcc

SEQ ID NO: 1421462 - RNA, 22 nt, Pseudomonas aeruginosa PA01
cgccugcagcaccaccucgcca

SEQ ID NO: 1421463 - RNA, 22 nt, Pseudomonas aeruginosa PA01
cgccugcaggucgaggcgcucc

SEQ ID NO: 1421464 - RNA, 16 nt, Pseudomonas aeruginosa PA01
cgccugcagggcguag

SEQ ID NO: 1421465 - RNA, 21 nt, Pseudomonas aeruginosa PA01
cgccugcaaagaggcgcucaa

SEQ ID NO: 1421466 - RNA, 23 nt, Pseudomonas aeruginosa PA01
cgccugcagcucggugaggaacu

SEQ ID NO: 1421467 - RNA, 19 nt, Pseudomonas aeruginosa PA01
cgccguuucgacgaugcuc

SEQ ID NO: 1421468 - RNA, 21 nt, Pseudomonas aeruginosa PA01
cgccguugccuucgccgucga

SEQ ID NO: 1421469 - RNA, 23 nt, Pseudomonas aeruginosa PA01
cgccguugccuucgccgucgagc

SEQ ID NO: 1421470 - RNA, 16 nt, Pseudomonas aeruginosa PA01
cgccguugcggcagca

SEQ ID NO: 1421471 - RNA, 21 nt, Pseudomonas aeruginosa PA01
cgccguuuucaaugacgggga

SEQ ID NO: 1421472 - RNA, 17 nt, Pseudomonas aeruginosa PA01
cgccguuguugaccgca

SEQ ID NO: 1421473 - RNA, 19 nt, Pseudomonas aeruginosa PA01
cgccguuguugaccgcagg

SEQ ID NO: 1421474 - RNA, 20 nt, Pseudomonas aeruginosa PA01
cgccguuguugaccgcagga

SEQ ID NO: 1421475 - RNA, 19 nt, Pseudomonas aeruginosa PA01
cgccuccagcgucugccgc

SEQ ID NO: 1421476 - RNA, 14 nt, Pseudomonas aeruginosa PA01
cgccuccaggcgcg

SEQ ID NO: 1421477 - RNA, 17 nt, Pseudomonas aeruginosa PA01
cgccuccaggcgcgccu

SEQ ID NO: 1421478 - RNA, 14 nt, Pseudomonas aeruginosa PA01
cgccuccagguaga

SEQ ID NO: 1421479 - RNA, 16 nt, Pseudomonas aeruginosa PA01
cgccucccaccgcgcg

SEQ ID NO: 1421480 - RNA, 18 nt, Pseudomonas aeruginosa PA01
cgccucccaccgcgcggc

SEQ ID NO: 1421481 - RNA, 16 nt, Pseudomonas aeruginosa PA01
cgccucccagggucgc

SEQ ID NO: 1421482 - RNA, 19 nt, Pseudomonas aeruginosa PA01
cgccuccggcacgcugccg

SEQ ID NO: 1421483 - RNA, 17 nt, Pseudomonas aeruginosa PA01
cgccucccggcucgccg

SEQ ID NO: 1421484 - RNA, 15 nt, Pseudomonas aeruginosa PA01
cgccucccuggcgac

SEQ ID NO: 1421485 - RNA, 13 nt, Pseudomonas aeruginosa PA01
cgccuccggcagc

SEQ ID NO: 1421486 - RNA, 14 nt, Pseudomonas aeruginosa PA01
cgccuccggcagcg

SEQ ID NO: 1421487 - RNA, 19 nt, Pseudomonas aeruginosa PA01
cgccuccgggcggaggcga

SEQ ID NO: 1421488 - RNA, 17 nt, Pseudomonas aeruginosa PA01
cgccuccgggcguaacg

SEQ ID NO: 1421489 - RNA, 19 nt, Pseudomonas aeruginosa PA01
cgccucgcuagucuuccug

SEQ ID NO: 1421490 - RNA, 22 nt, Pseudomonas aeruginosa PA01
cgccucgcuagucuuccugcac

SEQ ID NO: 1421491 - RNA, 23 nt, Pseudomonas aeruginosa PA01
cgccucgcuagucuuccugcacg

SEQ ID NO: 1421492 - RNA, 13 nt, Pseudomonas aeruginosa PA01
cgccucgcuggcg

SEQ ID NO: 1421493 - RNA, 20 nt, Pseudomonas aeruginosa PA01
cgccucgcggaccucgggca

SEQ ID NO: 1421494 - RNA, 22 nt, Pseudomonas aeruginosa PA01
cgccucgcgggucugcgccucg

SEQ ID NO: 1421495 - RNA, 20 nt, Pseudomonas aeruginosa PA01
cgccucggagaacagcagcg

SEQ ID NO: 1421496 - RNA, 20 nt, Pseudomonas aeruginosa PA01
cgccucggcccuggcggcga

SEQ ID NO: 1421497 - RNA, 21 nt, Pseudomonas aeruginosa PA01
cgccucgcgccagagaucgcc

SEQ ID NO: 1421498 - RNA, 16 nt, Pseudomonas aeruginosa PA01
cgccucggaaucggcg

SEQ ID NO: 1421499 - RNA, 13 nt, Pseudomonas aeruginosa PA01
cgccucggcgcga

SEQ ID NO: 1421500 - RNA, 22 nt, Pseudomonas aeruginosa PA01
cgccucggcgcgauccuccgcc

SEQ ID NO: 1421501 - RNA, 16 nt, Pseudomonas aeruginosa PA01
cgccucggcgcgcgcc

SEQ ID NO: 1421502 - RNA, 13 nt, Pseudomonas aeruginosa PA01
cgccgucgagcca

SEQ ID NO: 1421503 - RNA, 19 nt, Pseudomonas aeruginosa PA01
cgccgucgagccagcccag

SEQ ID NO: 1421504 - RNA, 13 nt, Pseudomonas aeruginosa PA01
cgccgucgaucag

SEQ ID NO: 1421505 - RNA, 14 nt, Pseudomonas aeruginosa PA01
cgccgucgaucagg

SEQ ID NO: 1421506 - RNA, 22 nt, Pseudomonas aeruginosa PA01
cgccgucgaucagguaggccgg

SEQ ID NO: 1421507 - RNA, 12 nt, Pseudomonas aeruginosa PA01
cgccgucggcgg

SEQ ID NO: 1421508 - RNA, 13 nt, Pseudomonas aeruginosa PA01
cgccgucgggggc

SEQ ID NO: 1421509 - RNA, 23 nt, Pseudomonas aeruginosa PA01
cgccgucgcgaccuucggugucg

SEQ ID NO: 1421510 - RNA, 15 nt, Pseudomonas aeruginosa PA01
cgccgucgcuggcga

SEQ ID NO: 1421511 - RNA, 13 nt, Pseudomonas aeruginosa PA01
cgccgucgccgcu

SEQ ID NO: 1421512 - RNA, 15 nt, Pseudomonas aeruginosa PA01
cgccgucgccgcuga

SEQ ID NO: 1421513 - RNA, 14 nt, Pseudomonas aeruginosa PA01
cgccgucgcccaug

SEQ ID NO: 1421514 - RNA, 14 nt, Pseudomonas aeruginosa PA01
cgccguugccggua

SEQ ID NO: 1421515 - RNA, 23 nt, Pseudomonas aeruginosa PA01
cgccguguaaugacuccggucaa

SEQ ID NO: 1421516 - RNA, 16 nt, Pseudomonas aeruginosa PA01
cgccguugccagcauc

SEQ ID NO: 1421517 - RNA, 16 nt, Pseudomonas aeruginosa PA01
cgccguugccgaugcc

SEQ ID NO: 1421518 - RNA, 22 nt, Pseudomonas aeruginosa PA01
cgccguggcugugcuggccacc

SEQ ID NO: 1421519 - RNA, 15 nt, Pseudomonas aeruginosa PA01
cgccgugggaacgcg

SEQ ID NO: 1421520 - RNA, 19 nt, Pseudomonas aeruginosa PA01
cgccgugguggccguggcg

SEQ ID NO: 1421521 - RNA, 13 nt, Pseudomonas aeruginosa PA01
cgccgucguccgg

SEQ ID NO: 1421522 - RNA, 22 nt, Pseudomonas aeruginosa PA01
cgccgucggcggucagcuugcc

SEQ ID NO: 1421523 - RNA, 16 nt, Pseudomonas aeruginosa PA01
cgccguggaucgcccg

SEQ ID NO: 1421524 - RNA, 14 nt, Pseudomonas aeruginosa PA01
cgccguggcaccag

SEQ ID NO: 1421525 - RNA, 16 nt, Pseudomonas aeruginosa PA01
cgccguggcaccaggu

SEQ ID NO: 1421526 - RNA, 17 nt, Pseudomonas aeruginosa PA01
cgccguggcaccagguc

SEQ ID NO: 1421527 - RNA, 18 nt, Pseudomonas aeruginosa PA01
cgccguggcaccaggucg

SEQ ID NO: 1421528 - RNA, 14 nt, Pseudomonas aeruginosa PA01
cgccgucuccgccg

SEQ ID NO: 1421529 - RNA, 19 nt, Pseudomonas aeruginosa PA01
cgccgucuccgccgcuauc

SEQ ID NO: 1421530 - RNA, 21 nt, Pseudomonas aeruginosa PA01
cgccgucuccgccgcuaucgc

SEQ ID NO: 1421531 - RNA, 22 nt, Pseudomonas aeruginosa PA01
cgccgucuccgccgcuaucgcc

SEQ ID NO: 1421532 - RNA, 13 nt, Pseudomonas aeruginosa PA01
cgccggcccgcgc

SEQ ID NO: 1421533 - RNA, 16 nt, Pseudomonas aeruginosa PA01
cgccggcccgcgcggc

SEQ ID NO: 1421534 - RNA, 20 nt, Pseudomonas aeruginosa PA01
cgccggcccgcgcggcaacg

SEQ ID NO: 1421535 - RNA, 22 nt, Pseudomonas aeruginosa PA01
cgccggcccgcgcggcaacguc

SEQ ID NO: 1421536 - RNA, 23 nt, Pseudomonas aeruginosa PA01
cgccggccggcucagcgcuucgg

SEQ ID NO: 1421537 - RNA, 14 nt, Pseudomonas aeruginosa PA01
cgccggccgggcua

SEQ ID NO: 1421538 - RNA, 19 nt, Pseudomonas aeruginosa PA01
cgccggccuccagcacucg

SEQ ID NO: 1421539 - RNA, 21 nt, Pseudomonas aeruginosa PA01
cgccggccggggcgcgcccgc

SEQ ID NO: 1421540 - RNA, 13 nt, Pseudomonas aeruginosa PA01
cgccggccucgca

SEQ ID NO: 1421541 - RNA, 13 nt, Pseudomonas aeruginosa PA01
cgccggccucgcg

SEQ ID NO: 1421542 - RNA, 18 nt, Pseudomonas aeruginosa PA01
cgccggccucgcgcaacu

SEQ ID NO: 1421543 - RNA, 17 nt, Pseudomonas aeruginosa PA01
cgccggccucgcugccg

SEQ ID NO: 1421544 - RNA, 22 nt, Pseudomonas aeruginosa PA01
cgccggccucgcugccgccgca

SEQ ID NO: 1421545 - RNA, 18 nt, Pseudomonas aeruginosa PA01
cgccggcgaacucguaga

SEQ ID NO: 1421546 - RNA, 22 nt, Pseudomonas aeruginosa PA01
cgccggcgaacucguagacgaa

SEQ ID NO: 1421547 - RNA, 22 nt, Pseudomonas aeruginosa PA01
cgccggccuggaucucggcggc

SEQ ID NO: 1421548 - RNA, 19 nt, Pseudomonas aeruginosa PA01
cgccggccugcgcgcacca

SEQ ID NO: 1421549 - RNA, 11 nt, Pseudomonas aeruginosa PA01
cgccggccugc

SEQ ID NO: 1421550 - RNA, 12 nt, Pseudomonas aeruginosa PA01
cgccggccugcg

SEQ ID NO: 1421551 - RNA, 14 nt, Pseudomonas aeruginosa PA01
cgccggccagguag

SEQ ID NO: 1421552 - RNA, 13 nt, Pseudomonas aeruginosa PA01
cgccggcccagca

SEQ ID NO: 1421553 - RNA, 18 nt, Pseudomonas aeruginosa PA01
cgccggcccagcaggccg

SEQ ID NO: 1421554 - RNA, 22 nt, Pseudomonas aeruginosa PA01
cgccggccaguuggugcacgcg

SEQ ID NO: 1421555 - RNA, 11 nt, Pseudomonas aeruginosa PA01
cgccggccagg

SEQ ID NO: 1421556 - RNA, 15 nt, Pseudomonas aeruginosa PA01
cgccggccagcaccu

SEQ ID NO: 1421557 - RNA, 21 nt, Pseudomonas aeruginosa PA01
cgccggccagcaccuucaccg

SEQ ID NO: 1421558 - RNA, 13 nt, Pseudomonas aeruginosa PA01
cgccggccagcac

SEQ ID NO: 1421559 - RNA, 20 nt, Pseudomonas aeruginosa PA01
cgccggcauggaucaacugg

SEQ ID NO: 1421560 - RNA, 16 nt, Pseudomonas aeruginosa PA01
cgccggaugggcgagc

SEQ ID NO: 1421561 - RNA, 17 nt, Pseudomonas aeruginosa PA01
cgccggaugggcgagcu

SEQ ID NO: 1421562 - RNA, 23 nt, Pseudomonas aeruginosa PA01
cgccggcauugccgacuuccucg

SEQ ID NO: 1421563 - RNA, 15 nt, Pseudomonas aeruginosa PA01
cgccggcauuggcac

SEQ ID NO: 1421564 - RNA, 16 nt, Pseudomonas aeruginosa PA01
cgccggcauuggcacc

SEQ ID NO: 1421565 - RNA, 20 nt, Pseudomonas aeruginosa PA01
cgccggcauuggcacccugg

SEQ ID NO: 1421566 - RNA, 15 nt, Pseudomonas aeruginosa PA01
cgccggccaccaggc

SEQ ID NO: 1421567 - RNA, 17 nt, Pseudomonas aeruginosa PA01
cgccggccaccagcagc

SEQ ID NO: 1421568 - RNA, 23 nt, Pseudomonas aeruginosa PA01
cgccggauuagcucagucgguag

SEQ ID NO: 1421569 - RNA, 21 nt, Pseudomonas aeruginosa PA01
cgccggagucguagcgcgcgg

SEQ ID NO: 1421570 - RNA, 14 nt, Pseudomonas aeruginosa PA01
cgccggagccaccg

SEQ ID NO: 1421571 - RNA, 22 nt, Pseudomonas aeruginosa PA01
cgccggagccaccgggaucugg

SEQ ID NO: 1421572 - RNA, 14 nt, Pseudomonas aeruginosa PA01
cgccggaggggcgg

SEQ ID NO: 1421573 - RNA, 17 nt, Pseudomonas aeruginosa PA01
cgccggaggggcggccg

SEQ ID NO: 1421574 - RNA, 21 nt, Pseudomonas aeruginosa PA01
cgccggaggggcggccgccga

SEQ ID NO: 1421575 - RNA, 23 nt, Pseudomonas aeruginosa PA01
cgccggaaccuguccgaacaggg

SEQ ID NO: 1421576 - RNA, 20 nt, Pseudomonas aeruginosa PA01
cgccggagacuucagcgcau

SEQ ID NO: 1421577 - RNA, 18 nt, Pseudomonas aeruginosa PA01
cgccgcugaggcucgccg

SEQ ID NO: 1421578 - RNA, 23 nt, Pseudomonas aeruginosa PA01
cgccgcugaucaguaccggcagc

SEQ ID NO: 1421579 - RNA, 15 nt, Pseudomonas aeruginosa PA01
cgccgcucugcuggc

SEQ ID NO: 1421580 - RNA, 18 nt, Pseudomonas aeruginosa PA01
cgccgcucugcuggccgc

SEQ ID NO: 1421581 - RNA, 15 nt, Pseudomonas aeruginosa PA01
cgccgcucugcccga

SEQ ID NO: 1421582 - RNA, 19 nt, Pseudomonas aeruginosa PA01
cgccgcugaaguccuggcc

SEQ ID NO: 1421583 - RNA, 21 nt, Pseudomonas aeruginosa PA01
cgccgcugaaguccuggccga

SEQ ID NO: 1421584 - RNA, 21 nt, Pseudomonas aeruginosa PA01
cgccgcugaauaccaccgggc

SEQ ID NO: 1421585 - RNA, 21 nt, Pseudomonas aeruginosa PA01
cgccgcuuccgccaggcgcag

SEQ ID NO: 1421586 - RNA, 16 nt, Pseudomonas aeruginosa PA01
cgccgcuuccgccggc

SEQ ID NO: 1421587 - RNA, 20 nt, Pseudomonas aeruginosa PA01
cgccgcuuccgccggcgccg

SEQ ID NO: 1421588 - RNA, 22 nt, Pseudomonas aeruginosa PA01
cgccgcuuccgccggcgccgcc

SEQ ID NO: 1421589 - RNA, 20 nt, Pseudomonas aeruginosa PA01
cgccgcugaugcgcuggucg

SEQ ID NO: 1421590 - RNA, 15 nt, Pseudomonas aeruginosa PA01
cgccgcuuucgguga

SEQ ID NO: 1421591 - RNA, 21 nt, Pseudomonas aeruginosa PA01
cgccgcuugagaccuucgcgg

SEQ ID NO: 1421592 - RNA, 15 nt, Pseudomonas aeruginosa PA01
cgccgcguucgccga

SEQ ID NO: 1421593 - RNA, 17 nt, Pseudomonas aeruginosa PA01
cgccgcguucgccgagc

SEQ ID NO: 1421594 - RNA, 16 nt, Pseudomonas aeruginosa PA01
cgccgcucggcgagcc

SEQ ID NO: 1421595 - RNA, 18 nt, Pseudomonas aeruginosa PA01
cgccgcucggcgagccgc

SEQ ID NO: 1421596 - RNA, 23 nt, Pseudomonas aeruginosa PA01
cgccgcucggcgagccgccgggc

SEQ ID NO: 1421597 - RNA, 17 nt, Pseudomonas aeruginosa PA01
cgccgcuacugcgcggg

SEQ ID NO: 1421598 - RNA, 18 nt, Pseudomonas aeruginosa PA01
cgccgcuagggcgcccuc

SEQ ID NO: 1421599 - RNA, 13 nt, Pseudomonas aeruginosa PA01
cgccgcgugcgcg

SEQ ID NO: 1421600 - RNA, 19 nt, Pseudomonas aeruginosa PA01
cgccgcgugccgccggacc

SEQ ID NO: 1421601 - RNA, 23 nt, Pseudomonas aeruginosa PA01
cgccgccuauccacgacgucggc

SEQ ID NO: 1421602 - RNA, 23 nt, Pseudomonas aeruginosa PA01
cgccgccuauccgugacgucggc

SEQ ID NO: 1421603 - RNA, 18 nt, Pseudomonas aeruginosa PA01
cgccgcgugggcuucgcc

SEQ ID NO: 1421604 - RNA, 21 nt, Pseudomonas aeruginosa PA01
cgccgcgugggcuucgccgcc

SEQ ID NO: 1421605 - RNA, 14 nt, Pseudomonas aeruginosa PA01
cgccgccggccugc

SEQ ID NO: 1421606 - RNA, 12 nt, Pseudomonas aeruginosa PA01
cgccgccggcga

SEQ ID NO: 1421607 - RNA, 17 nt, Pseudomonas aeruginosa PA01
cgccgccggcgaacagc

SEQ ID NO: 1421608 - RNA, 20 nt, Pseudomonas aeruginosa PA01
cgccgccggcgaacagccag

SEQ ID NO: 1421609 - RNA, 14 nt, Pseudomonas aeruginosa PA01
cgccgccggccagc

SEQ ID NO: 1421610 - RNA, 13 nt, Pseudomonas aeruginosa PA01
cgccgccggccag

SEQ ID NO: 1421611 - RNA, 17 nt, Pseudomonas aeruginosa PA01
cgccgccguugaggaag

SEQ ID NO: 1421612 - RNA, 17 nt, Pseudomonas aeruginosa PA01
cgccgccguggcugugc

SEQ ID NO: 1421613 - RNA, 14 nt, Pseudomonas aeruginosa PA01
cgccgggucgacau

SEQ ID NO: 1421614 - RNA, 22 nt, Pseudomonas aeruginosa PA01
cgccgggucgacaugcaggccg

SEQ ID NO: 1421615 - RNA, 23 nt, Pseudomonas aeruginosa PA01
cgccgggucgaccuugccgacgc

SEQ ID NO: 1421616 - RNA, 21 nt, Pseudomonas aeruginosa PA01
cgccgggucgacuucgcacca

SEQ ID NO: 1421617 - RNA, 22 nt, Pseudomonas aeruginosa PA01
cgccgggucgacuucgcaccag

SEQ ID NO: 1421618 - RNA, 15 nt, Pseudomonas aeruginosa PA01
cgccgggucgauggg

SEQ ID NO: 1421619 - RNA, 19 nt, Pseudomonas aeruginosa PA01
cgccgggucgaugggccgu

SEQ ID NO: 1421620 - RNA, 21 nt, Pseudomonas aeruginosa PA01
cgccgggucgaugggccguag

SEQ ID NO: 1421621 - RNA, 14 nt, Pseudomonas aeruginosa PA01
cgccgggucgccgc

SEQ ID NO: 1421622 - RNA, 18 nt, Pseudomonas aeruginosa PA01
cgccgggucgccgcagcc

SEQ ID NO: 1421623 - RNA, 16 nt, Pseudomonas aeruginosa PA01
cgccgguaucccggcu

SEQ ID NO: 1421624 - RNA, 14 nt, Pseudomonas aeruginosa PA01
cgccggucaacagc

SEQ ID NO: 1421625 - RNA, 19 nt, Pseudomonas aeruginosa PA01
cgccgguaguucgcugacc

SEQ ID NO: 1421626 - RNA, 22 nt, Pseudomonas aeruginosa PA01
cgccgguaguucgcugaccgcg

SEQ ID NO: 1421627 - RNA, 18 nt, Pseudomonas aeruginosa PA01
cgccggucagagacaggu

SEQ ID NO: 1421628 - RNA, 15 nt, Pseudomonas aeruginosa PA01
cgccggucaggcugc

SEQ ID NO: 1421629 - RNA, 17 nt, Pseudomonas aeruginosa PA01
cgccggucaggcugcgg

SEQ ID NO: 1421630 - RNA, 18 nt, Pseudomonas aeruginosa PA01
cgccggugcuggcgagca

SEQ ID NO: 1421631 - RNA, 23 nt, Pseudomonas aeruginosa PA01
cgccggugcuggcgagcaggguc

SEQ ID NO: 1421632 - RNA, 13 nt, Pseudomonas aeruginosa PA01
cgccggugcgcga

SEQ ID NO: 1421633 - RNA, 20 nt, Pseudomonas aeruginosa PA01
cgccgguggcguacccgccc

SEQ ID NO: 1421634 - RNA, 18 nt, Pseudomonas aeruginosa PA01
cgccgguggccaggacgc

SEQ ID NO: 1421635 - RNA, 23 nt, Pseudomonas aeruginosa PA01
cgccgguggccaggacgcuggcg

SEQ ID NO: 1421636 - RNA, 16 nt, Pseudomonas aeruginosa PA01
cgccgguggccaggcu

SEQ ID NO: 1421637 - RNA, 17 nt, Pseudomonas aeruginosa PA01
cgccgguggccaggcuc

SEQ ID NO: 1421638 - RNA, 14 nt, Pseudomonas aeruginosa PA01
cgccgggcgcgcgc

SEQ ID NO: 1421639 - RNA, 16 nt, Pseudomonas aeruginosa PA01
cgccgggcggcgucgc

SEQ ID NO: 1421640 - RNA, 19 nt, Pseudomonas aeruginosa PA01
cgccgggcggcgucgcgga

SEQ ID NO: 1421641 - RNA, 14 nt, Pseudomonas aeruginosa PA01
cgccgggcggcguc

SEQ ID NO: 1421642 - RNA, 21 nt, Pseudomonas aeruginosa PA01
cgccgggcgcgcgccucagcg

SEQ ID NO: 1421643 - RNA, 15 nt, Pseudomonas aeruginosa PA01
cgccgggcgcccggc

SEQ ID NO: 1421644 - RNA, 17 nt, Pseudomonas aeruginosa PA01
cgccgggagcggccgug

SEQ ID NO: 1421645 - RNA, 20 nt, Pseudomonas aeruginosa PA01
cgccgggcgcgaugccgaug

SEQ ID NO: 1421646 - RNA, 18 nt, Pseudomonas aeruginosa PA01
cgccgggaaucgccagca

SEQ ID NO: 1421647 - RNA, 19 nt, Pseudomonas aeruginosa PA01
cgccgggaaucgccagcag

SEQ ID NO: 1421648 - RNA, 19 nt, Pseudomonas aeruginosa PA01
cgccgggaaucuggccgau

SEQ ID NO: 1421649 - RNA, 23 nt, Pseudomonas aeruginosa PA01
cgccgggaaucuggccgaugccg

SEQ ID NO: 1421650 - RNA, 17 nt, Pseudomonas aeruginosa PA01
cgccgggaagcaccgac

SEQ ID NO: 1421651 - RNA, 21 nt, Pseudomonas aeruginosa PA01
cgccgggaagcaccgacucgc

SEQ ID NO: 1421652 - RNA, 23 nt, Pseudomonas aeruginosa PA01
cgccgggaagcaccgacucgccc

SEQ ID NO: 1421653 - RNA, 17 nt, Pseudomonas aeruginosa PA01
cgccgggaaacagggcg

SEQ ID NO: 1421654 - RNA, 18 nt, Pseudomonas aeruginosa PA01
cgccgggaaacagggcga

SEQ ID NO: 1421655 - RNA, 20 nt, Pseudomonas aeruginosa PA01
cgccgggaaacagggcgacg

SEQ ID NO: 1421656 - RNA, 23 nt, Pseudomonas aeruginosa PA01
cgccgggaaacagggcgacgccg

SEQ ID NO: 1421657 - RNA, 22 nt, Pseudomonas aeruginosa PA01
cgccgggacccugguaguccag

SEQ ID NO: 1421658 - RNA, 18 nt, Pseudomonas aeruginosa PA01
cgccgggcgucugcccgg

SEQ ID NO: 1421659 - RNA, 23 nt, Pseudomonas aeruginosa PA01
cgccgggcgucugcccgguccaa

SEQ ID NO: 1421660 - RNA, 15 nt, Pseudomonas aeruginosa PA01
cgccgggcugccgaa

SEQ ID NO: 1421661 - RNA, 19 nt, Pseudomonas aeruginosa PA01
cgccgggcugguucagcgg

SEQ ID NO: 1421662 - RNA, 16 nt, Pseudomonas aeruginosa PA01
cgccgggcuggccguc

SEQ ID NO: 1421663 - RNA, 17 nt, Pseudomonas aeruginosa PA01
cgccgggcucagcgcgc

SEQ ID NO: 1421664 - RNA, 19 nt, Pseudomonas aeruginosa PA01
cgccgggcucagcgcgcgu

SEQ ID NO: 1421665 - RNA, 14 nt, Pseudomonas aeruginosa PA01
cgccgggcguaacg

SEQ ID NO: 1421666 - RNA, 17 nt, Pseudomonas aeruginosa PA01
cgccgggcguaacggcu

SEQ ID NO: 1421667 - RNA, 21 nt, Pseudomonas aeruginosa PA01
cgccgggcuuuucaaggcgaa

SEQ ID NO: 1421668 - RNA, 24 nt, Pseudomonas aeruginosa PA01
cgccgggcuuuucaaggcgaaacg

SEQ ID NO: 1421669 - RNA, 15 nt, Pseudomonas aeruginosa PA01
cgccggggaagcugc

SEQ ID NO: 1421670 - RNA, 17 nt, Pseudomonas aeruginosa PA01
cgccggguagggcggau

SEQ ID NO: 1421671 - RNA, 15 nt, Pseudomonas aeruginosa PA01
cgccggguacagcgc

SEQ ID NO: 1421672 - RNA, 17 nt, Pseudomonas aeruginosa PA01
cgccggguacagcgcca

SEQ ID NO: 1421673 - RNA, 19 nt, Pseudomonas aeruginosa PA01
cgccggguacagcgccacg

SEQ ID NO: 1421674 - RNA, 21 nt, Pseudomonas aeruginosa PA01
cgccggguagcguuaucgccg

SEQ ID NO: 1421675 - RNA, 17 nt, Pseudomonas aeruginosa PA01
cgccgggcuugcaaucc

SEQ ID NO: 1421676 - RNA, 23 nt, Pseudomonas aeruginosa PA01
cgccggcggggaagccuucgccc

SEQ ID NO: 1421677 - RNA, 21 nt, Pseudomonas aeruginosa PA01
cgccggcggcgcguccaccug

SEQ ID NO: 1421678 - RNA, 22 nt, Pseudomonas aeruginosa PA01
cgccggcggcgcguccaccugg

SEQ ID NO: 1421679 - RNA, 16 nt, Pseudomonas aeruginosa PA01
cgccggcggccugccc

SEQ ID NO: 1421680 - RNA, 17 nt, Pseudomonas aeruginosa PA01
cgccggcguucgacgcc

SEQ ID NO: 1421681 - RNA, 14 nt, Pseudomonas aeruginosa PA01
cgccggcguugcgc

SEQ ID NO: 1421682 - RNA, 20 nt, Pseudomonas aeruginosa PA01
cgccggcugugcagggcagc

SEQ ID NO: 1421683 - RNA, 21 nt, Pseudomonas aeruginosa PA01
cgccggcugugcagggcagcg

SEQ ID NO: 1421684 - RNA, 23 nt, Pseudomonas aeruginosa PA01
cgccggcugugcagggcagcggc

SEQ ID NO: 1421685 - RNA, 22 nt, Pseudomonas aeruginosa PA01
cgccggcucgcccagcaggcgc

SEQ ID NO: 1421686 - RNA, 14 nt, Pseudomonas aeruginosa PA01
cgccggcucccugc

SEQ ID NO: 1421687 - RNA, 13 nt, Pseudomonas aeruginosa PA01
cgccggcucgugc

SEQ ID NO: 1421688 - RNA, 19 nt, Pseudomonas aeruginosa PA01
cgccggcugacgcuggcga

SEQ ID NO: 1421689 - RNA, 21 nt, Pseudomonas aeruginosa PA01
cgccggcgaccgcgcgcaugg

SEQ ID NO: 1421690 - RNA, 19 nt, Pseudomonas aeruginosa PA01
cgccggcgagccgcuggca

SEQ ID NO: 1421691 - RNA, 17 nt, Pseudomonas aeruginosa PA01
cgccggcgaucgccggc

SEQ ID NO: 1421692 - RNA, 21 nt, Pseudomonas aeruginosa PA01
cgccggcgaugcccaggccgc

SEQ ID NO: 1421693 - RNA, 13 nt, Pseudomonas aeruginosa PA01
cgccggcgaugcg

SEQ ID NO: 1421694 - RNA, 14 nt, Pseudomonas aeruginosa PA01
cgccggcgaugcgc

SEQ ID NO: 1421695 - RNA, 21 nt, Pseudomonas aeruginosa PA01
cgccggcgaugcgcaggccgg

SEQ ID NO: 1421696 - RNA, 14 nt, Pseudomonas aeruginosa PA01
cgccggcgccgccu

SEQ ID NO: 1421697 - RNA, 14 nt, Pseudomonas aeruginosa PA01
cgccggcgccgccg

SEQ ID NO: 1421698 - RNA, 14 nt, Pseudomonas aeruginosa PA01
cgccggcgcccugg

SEQ ID NO: 1421699 - RNA, 13 nt, Pseudomonas aeruginosa PA01
cgccggcgccgau

SEQ ID NO: 1421700 - RNA, 13 nt, Pseudomonas aeruginosa PA01
cgccggcgccgcc

SEQ ID NO: 1421701 - RNA, 13 nt, Pseudomonas aeruginosa PA01
cgccggcgcgcac

SEQ ID NO: 1421702 - RNA, 15 nt, Pseudomonas aeruginosa PA01
cgccggcgcgcccag

SEQ ID NO: 1421703 - RNA, 17 nt, Pseudomonas aeruginosa PA01
cgccggcgcgcccaggc

SEQ ID NO: 1421704 - RNA, 13 nt, Pseudomonas aeruginosa PA01
cgccggcgcgcgg

SEQ ID NO: 1421705 - RNA, 15 nt, Pseudomonas aeruginosa PA01
cgccggcgcgcggcg

SEQ ID NO: 1421706 - RNA, 17 nt, Pseudomonas aeruginosa PA01
cgccggcgcgcggcggg

SEQ ID NO: 1421707 - RNA, 20 nt, Pseudomonas aeruginosa PA01
cgccggcgcgcggcggguag

SEQ ID NO: 1421708 - RNA, 17 nt, Pseudomonas aeruginosa PA01
cgccggcgcugcgagcg

SEQ ID NO: 1421709 - RNA, 14 nt, Pseudomonas aeruginosa PA01
cgccggcgcguagg

SEQ ID NO: 1421710 - RNA, 16 nt, Pseudomonas aeruginosa PA01
cgccggcgcguaggug

SEQ ID NO: 1421711 - RNA, 20 nt, Pseudomonas aeruginosa PA01
cgccggcgcgcuugccgcug

SEQ ID NO: 1421712 - RNA, 13 nt, Pseudomonas aeruginosa PA01
cgccggcgcgggc

SEQ ID NO: 1421713 - RNA, 14 nt, Pseudomonas aeruginosa PA01
cgccggcggccagg

SEQ ID NO: 1421714 - RNA, 17 nt, Pseudomonas aeruginosa PA01
cggcgaugauggucaac

SEQ ID NO: 1421715 - RNA, 22 nt, Pseudomonas aeruginosa PA01
cggcgaugauggucaacaccag

SEQ ID NO: 1421716 - RNA, 21 nt, Pseudomonas aeruginosa PA01
cggcgaugcccaggccgccga

SEQ ID NO: 1421717 - RNA, 23 nt, Pseudomonas aeruginosa PA01
cggcgaugcccaggccgccgauc

SEQ ID NO: 1421718 - RNA, 15 nt, Pseudomonas aeruginosa PA01
cggcgaugccgccca

SEQ ID NO: 1421719 - RNA, 17 nt, Pseudomonas aeruginosa PA01
cggcgaugccgcccagc

SEQ ID NO: 1421720 - RNA, 19 nt, Pseudomonas aeruginosa PA01
cggcgaugccgcccagcac

SEQ ID NO: 1421721 - RNA, 15 nt, Pseudomonas aeruginosa PA01
cggcgaugccgccgg

SEQ ID NO: 1421722 - RNA, 17 nt, Pseudomonas aeruginosa PA01
cggcgaugccgccgggc

SEQ ID NO: 1421723 - RNA, 15 nt, Pseudomonas aeruginosa PA01
cggcgaugccgcgcc

SEQ ID NO: 1421724 - RNA, 18 nt, Pseudomonas aeruginosa PA01
cggcgaugccgcgccagg

SEQ ID NO: 1421725 - RNA, 20 nt, Pseudomonas aeruginosa PA01
cggcgaugccgcgccaggcg

SEQ ID NO: 1421726 - RNA, 18 nt, Pseudomonas aeruginosa PA01
cggcgaucuccgccaggc

SEQ ID NO: 1421727 - RNA, 19 nt, Pseudomonas aeruginosa PA01
cggcgaucuccgccaggcg

SEQ ID NO: 1421728 - RNA, 23 nt, Pseudomonas aeruginosa PA01
cggcgaucuccgccaggcggccg

SEQ ID NO: 1421729 - RNA, 16 nt, Pseudomonas aeruginosa PA01
cggcgaucucgcccag

SEQ ID NO: 1421730 - RNA, 20 nt, Pseudomonas aeruginosa PA01
cggcgaugaucggcagccgu

SEQ ID NO: 1421731 - RNA, 17 nt, Pseudomonas aeruginosa PA01
cggcgaugcgcaugcgc

SEQ ID NO: 1421732 - RNA, 23 nt, Pseudomonas aeruginosa PA01
cggcgaugcgcaugcgcagcgcg

SEQ ID NO: 1421733 - RNA, 18 nt, Pseudomonas aeruginosa PA01
cggcgauggucaggacgc

SEQ ID NO: 1421734 - RNA, 16 nt, Pseudomonas aeruginosa PA01
cggcgaucgccggcgu

SEQ ID NO: 1421735 - RNA, 14 nt, Pseudomonas aeruginosa PA01
cggcgaucgccggg

SEQ ID NO: 1421736 - RNA, 15 nt, Pseudomonas aeruginosa PA01
cggcgaucacccggc

SEQ ID NO: 1421737 - RNA, 19 nt, Pseudomonas aeruginosa PA01
cggcgaucacccggcgaag

SEQ ID NO: 1421738 - RNA, 13 nt, Pseudomonas aeruginosa PA01
cggcgaucgccug

SEQ ID NO: 1421739 - RNA, 15 nt, Pseudomonas aeruginosa PA01
cggcgaucgccgggu

SEQ ID NO: 1421740 - RNA, 16 nt, Pseudomonas aeruginosa PA01
cggcgauaggcgcgca

SEQ ID NO: 1421741 - RNA, 17 nt, Pseudomonas aeruginosa PA01
cggcgauaggcgcgcaa

SEQ ID NO: 1421742 - RNA, 18 nt, Pseudomonas aeruginosa PA01
cggcgauaggcgcgcaac

SEQ ID NO: 1421743 - RNA, 16 nt, Pseudomonas aeruginosa PA01
cggcgaucgccaggcg

SEQ ID NO: 1421744 - RNA, 14 nt, Pseudomonas aeruginosa PA01
cggcgaucgccccg

SEQ ID NO: 1421745 - RNA, 12 nt, Pseudomonas aeruginosa PA01
cggcgaucgccg

SEQ ID NO: 1421746 - RNA, 12 nt, Pseudomonas aeruginosa PA01
cggcgcaggcgg

SEQ ID NO: 1421747 - RNA, 14 nt, Pseudomonas aeruginosa PA01
cggcgcaggcggau

SEQ ID NO: 1421748 - RNA, 18 nt, Pseudomonas aeruginosa PA01
cggcgcaggcggaucgcc

SEQ ID NO: 1421749 - RNA, 15 nt, Pseudomonas aeruginosa PA01
cggcgcaggcugucg

SEQ ID NO: 1421750 - RNA, 20 nt, Pseudomonas aeruginosa PA01
cggcgcaggcugucggccag

SEQ ID NO: 1421751 - RNA, 17 nt, Pseudomonas aeruginosa PA01
cggcgcaguucgucgag

SEQ ID NO: 1421752 - RNA, 17 nt, Pseudomonas aeruginosa PA01
cggcgcauagccaccgc

SEQ ID NO: 1421753 - RNA, 22 nt, Pseudomonas aeruginosa PA01
cggcgcauagccaccgccgaca

SEQ ID NO: 1421754 - RNA, 14 nt, Pseudomonas aeruginosa PA01
cggcgcaguagucg

SEQ ID NO: 1421755 - RNA, 19 nt, Pseudomonas aeruginosa PA01
cggcgcagucgucaagcgc

SEQ ID NO: 1421756 - RNA, 20 nt, Pseudomonas aeruginosa PA01
cggcgcagaacugccgggcc

SEQ ID NO: 1421757 - RNA, 23 nt, Pseudomonas aeruginosa PA01
cggcgcagaacugccgggccagc

SEQ ID NO: 1421758 - RNA, 19 nt, Pseudomonas aeruginosa PA01
cggcgcagcaacuguccga

SEQ ID NO: 1421759 - RNA, 16 nt, Pseudomonas aeruginosa PA01
cggcgcaccgacgccg

SEQ ID NO: 1421760 - RNA, 15 nt, Pseudomonas aeruginosa PA01
cggcgcacgccggcc

SEQ ID NO: 1421761 - RNA, 13 nt, Pseudomonas aeruginosa PA01
cggcgauucgcgg

SEQ ID NO: 1421762 - RNA, 18 nt, Pseudomonas aeruginosa PA01
cggcgauucgcggcgaca

SEQ ID NO: 1421763 - RNA, 22 nt, Pseudomonas aeruginosa PA01
cggcgauucguucgagcagcuc

SEQ ID NO: 1421764 - RNA, 19 nt, Pseudomonas aeruginosa PA01
cggcgauuccacgggccug

SEQ ID NO: 1421765 - RNA, 18 nt, Pseudomonas aeruginosa PA01
cggcgauguugcgcaggg

SEQ ID NO: 1421766 - RNA, 22 nt, Pseudomonas aeruginosa PA01
cggcgauguugcgcagggugcc

SEQ ID NO: 1421767 - RNA, 16 nt, Pseudomonas aeruginosa PA01
cggcgaugucggccug

SEQ ID NO: 1421768 - RNA, 17 nt, Pseudomonas aeruginosa PA01
cggcgaugucggccugc

SEQ ID NO: 1421769 - RNA, 15 nt, Pseudomonas aeruginosa PA01
cggcgaugugcggcg

SEQ ID NO: 1421770 - RNA, 21 nt, Pseudomonas aeruginosa PA01
cggcgaugugcggcguggcga

SEQ ID NO: 1421771 - RNA, 15 nt, Pseudomonas aeruginosa PA01
cggcgaccggccuca

SEQ ID NO: 1421772 - RNA, 19 nt, Pseudomonas aeruginosa PA01
cggcgaccgcgcgcauggu

SEQ ID NO: 1421773 - RNA, 15 nt, Pseudomonas aeruginosa PA01
cggcgaccgcuggac

SEQ ID NO: 1421774 - RNA, 16 nt, Pseudomonas aeruginosa PA01
cggcgaccgcuggacc

SEQ ID NO: 1421775 - RNA, 15 nt, Pseudomonas aeruginosa PA01
cggcgaccugcggca

SEQ ID NO: 1421776 - RNA, 19 nt, Pseudomonas aeruginosa PA01
cggcgacgaaagacgcugc

SEQ ID NO: 1421777 - RNA, 20 nt, Pseudomonas aeruginosa PA01
cggcgacgaaagacgcugcg

SEQ ID NO: 1421778 - RNA, 18 nt, Pseudomonas aeruginosa PA01
cggcgacgaagcccaggc

SEQ ID NO: 1421779 - RNA, 20 nt, Pseudomonas aeruginosa PA01
cggcgacgaagcccaggcug

SEQ ID NO: 1421780 - RNA, 14 nt, Pseudomonas aeruginosa PA01
cggcgacgaaggcc

SEQ ID NO: 1421781 - RNA, 21 nt, Pseudomonas aeruginosa PA01
cggcgacgaaggccuggucga

SEQ ID NO: 1421782 - RNA, 17 nt, Pseudomonas aeruginosa PA01
cggcgacgaagguaucg

SEQ ID NO: 1421783 - RNA, 22 nt, Pseudomonas aeruginosa PA01
cggcgacgaagguaucgaaguc

SEQ ID NO: 1421784 - RNA, 23 nt, Pseudomonas aeruginosa PA01
cggcgacgaagguaucgaagucg

SEQ ID NO: 1421785 - RNA, 17 nt, Pseudomonas aeruginosa PA01
cggcgacgaaggucggc

SEQ ID NO: 1421786 - RNA, 21 nt, Pseudomonas aeruginosa PA01
cggcgacgaaggucggcggca

SEQ ID NO: 1421787 - RNA, 15 nt, Pseudomonas aeruginosa PA01
cggcgagcacggcga

SEQ ID NO: 1421788 - RNA, 16 nt, Pseudomonas aeruginosa PA01
cggcgagcacggcgaa

SEQ ID NO: 1421789 - RNA, 13 nt, Pseudomonas aeruginosa PA01
cggcgagcagcgg

SEQ ID NO: 1421790 - RNA, 14 nt, Pseudomonas aeruginosa PA01
cggcgagcagcggc

SEQ ID NO: 1421791 - RNA, 15 nt, Pseudomonas aeruginosa PA01
cggcgagcagcggcg

SEQ ID NO: 1421792 - RNA, 18 nt, Pseudomonas aeruginosa PA01
cggcgagcagcggcgcuu

SEQ ID NO: 1421793 - RNA, 12 nt, Pseudomonas aeruginosa PA01
cggcgagcaggc

SEQ ID NO: 1421794 - RNA, 15 nt, Pseudomonas aeruginosa PA01
cggcgagcaggcgaa

SEQ ID NO: 1421795 - RNA, 17 nt, Pseudomonas aeruginosa PA01
cggcgagaaaggcugcu

SEQ ID NO: 1421796 - RNA, 22 nt, Pseudomonas aeruginosa PA01
cggcgagaaagucgaucagcgc

SEQ ID NO: 1421797 - RNA, 15 nt, Pseudomonas aeruginosa PA01
cggcgagagcgccga

SEQ ID NO: 1421798 - RNA, 20 nt, Pseudomonas aeruginosa PA01
cggcgagacuaccgaucggc

SEQ ID NO: 1421799 - RNA, 21 nt, Pseudomonas aeruginosa PA01
cggcgagacuaccgaucggcu

SEQ ID NO: 1421800 - RNA, 22 nt, Pseudomonas aeruginosa PA01
cggcgagacuaccgaucggcug

SEQ ID NO: 1421801 - RNA, 20 nt, Pseudomonas aeruginosa PA01
cggcgagagcguccggcagg

SEQ ID NO: 1421802 - RNA, 14 nt, Pseudomonas aeruginosa PA01
cggcgagaggucgg

SEQ ID NO: 1421803 - RNA, 18 nt, Pseudomonas aeruginosa PA01
cggcgagaggucggcgcg

SEQ ID NO: 1421804 - RNA, 22 nt, Pseudomonas aeruginosa PA01
cggcgagaggucggcgcgcccg

SEQ ID NO: 1421805 - RNA, 21 nt, Pseudomonas aeruginosa PA01
cggcgagaucuucaggccgaa

SEQ ID NO: 1421806 - RNA, 22 nt, Pseudomonas aeruginosa PA01
cggcgagaucuucaggccgaag

SEQ ID NO: 1421807 - RNA, 19 nt, Pseudomonas aeruginosa PA01
cggcgagauugcgcugagc

SEQ ID NO: 1421808 - RNA, 18 nt, Pseudomonas aeruginosa PA01
cggcgagcaacgcagguc

SEQ ID NO: 1421809 - RNA, 15 nt, Pseudomonas aeruginosa PA01
cggcgaggccgaccu

SEQ ID NO: 1421810 - RNA, 17 nt, Pseudomonas aeruginosa PA01
cggcgaggccgaccuug

SEQ ID NO: 1421811 - RNA, 12 nt, Pseudomonas aeruginosa PA01
cggcgaggccgg

SEQ ID NO: 1421812 - RNA, 20 nt, Pseudomonas aeruginosa PA01
cggcgaggccggcgaucagc

SEQ ID NO: 1421813 - RNA, 14 nt, Pseudomonas aeruginosa PA01
cggcgaggaacagc

SEQ ID NO: 1421814 - RNA, 20 nt, Pseudomonas aeruginosa PA01
cggcgaggaacagcaccagc

SEQ ID NO: 1421815 - RNA, 21 nt, Pseudomonas aeruginosa PA01
cggcgaggaacagcaccagca

SEQ ID NO: 1421816 - RNA, 12 nt, Pseudomonas aeruginosa PA01
cggcgaggugau

SEQ ID NO: 1421817 - RNA, 19 nt, Pseudomonas aeruginosa PA01
cggcgaggcguuccaggug

SEQ ID NO: 1421818 - RNA, 15 nt, Pseudomonas aeruginosa PA01
cggcgagggcgccgg

SEQ ID NO: 1421819 - RNA, 20 nt, Pseudomonas aeruginosa PA01
cggcgagggcggcgaccugg

SEQ ID NO: 1421820 - RNA, 19 nt, Pseudomonas aeruginosa PA01
cggcgaguucgcgcaggcg

SEQ ID NO: 1421821 - RNA, 23 nt, Pseudomonas aeruginosa PA01
cggcgaguucggcguuguccagg

SEQ ID NO: 1421822 - RNA, 17 nt, Pseudomonas aeruginosa PA01
cggcgaguugcgcgagg

SEQ ID NO: 1421823 - RNA, 18 nt, Pseudomonas aeruginosa PA01
cggcgauacccaggccgu

SEQ ID NO: 1421824 - RNA, 19 nt, Pseudomonas aeruginosa PA01
cggcgauacccaggccguc

SEQ ID NO: 1421825 - RNA, 13 nt, Pseudomonas aeruginosa PA01
cggcgagccaggu

SEQ ID NO: 1421826 - RNA, 20 nt, Pseudomonas aeruginosa PA01
cggcgagcgggucgauggcu

SEQ ID NO: 1421827 - RNA, 13 nt, Pseudomonas aeruginosa PA01
cggcgaggaucag

SEQ ID NO: 1421828 - RNA, 22 nt, Pseudomonas aeruginosa PA01
cggcgaggaucagucgcugcuc

SEQ ID NO: 1421829 - RNA, 23 nt, Pseudomonas aeruginosa PA01
cggcgaggaucagucgcugcucg

SEQ ID NO: 1421830 - RNA, 15 nt, Pseudomonas aeruginosa PA01
cggcgaggaucgcca

SEQ ID NO: 1421831 - RNA, 17 nt, Pseudomonas aeruginosa PA01
cggcgaggaucgccagc

SEQ ID NO: 1421832 - RNA, 18 nt, Pseudomonas aeruginosa PA01
cggcgaggaucgccagca

SEQ ID NO: 1421833 - RNA, 20 nt, Pseudomonas aeruginosa PA01
cggcgaggaucgccagcaau

SEQ ID NO: 1421834 - RNA, 22 nt, Pseudomonas aeruginosa PA01
cggcgaggaucgcgcuggccag

SEQ ID NO: 1421835 - RNA, 23 nt, Pseudomonas aeruginosa PA01
cggcgagccggcgcaucagcgcc

SEQ ID NO: 1421836 - RNA, 13 nt, Pseudomonas aeruginosa PA01
cggcgagcgccgc

SEQ ID NO: 1421837 - RNA, 14 nt, Pseudomonas aeruginosa PA01
cggcgagcgccgcg

SEQ ID NO: 1421838 - RNA, 18 nt, Pseudomonas aeruginosa PA01
cggcgagcgccgcggcga

SEQ ID NO: 1421839 - RNA, 14 nt, Pseudomonas aeruginosa PA01
cggcgagcgccugg

SEQ ID NO: 1421840 - RNA, 15 nt, Pseudomonas aeruginosa PA01
cggcgagcgccugga

SEQ ID NO: 1421841 - RNA, 20 nt, Pseudomonas aeruginosa PA01
cggcgagccgccgggcggcg

SEQ ID NO: 1421842 - RNA, 13 nt, Pseudomonas aeruginosa PA01
cggcgagccgcga

SEQ ID NO: 1421843 - RNA, 20 nt, Pseudomonas aeruginosa PA01
cggcgagcauuccucagcgc

SEQ ID NO: 1421844 - RNA, 21 nt, Pseudomonas aeruginosa PA01
cggcgagcauuccucagcgcc

SEQ ID NO: 1421845 - RNA, 22 nt, Pseudomonas aeruginosa PA01
cggcgagcauuccucagcgccg

SEQ ID NO: 1421846 - RNA, 23 nt, Pseudomonas aeruginosa PA01
cggcgagcauuccucagcgccgg

SEQ ID NO: 1421847 - RNA, 20 nt, Pseudomonas aeruginosa PA01
cggccuggaucucggcggcc

SEQ ID NO: 1421848 - RNA, 23 nt, Pseudomonas aeruginosa PA01
cggccuggaucucggcggccagg

SEQ ID NO: 1421849 - RNA, 14 nt, Pseudomonas aeruginosa PA01
cggccuggaucgcc

SEQ ID NO: 1421850 - RNA, 20 nt, Pseudomonas aeruginosa PA01
cggccuggaucgccuugcgc

SEQ ID NO: 1421851 - RNA, 21 nt, Pseudomonas aeruginosa PA01
cggccuggaucgccuugcgcg

SEQ ID NO: 1421852 - RNA, 15 nt, Pseudomonas aeruginosa PA01
cggccugcugcgccg

SEQ ID NO: 1421853 - RNA, 18 nt, Pseudomonas aeruginosa PA01
cggccugcugcgccggca

SEQ ID NO: 1421854 - RNA, 22 nt, Pseudomonas aeruginosa PA01
cggccugcugcgccggcacggc

SEQ ID NO: 1421855 - RNA, 14 nt, Pseudomonas aeruginosa PA01
cggccugcucgcgc

SEQ ID NO: 1421856 - RNA, 15 nt, Pseudomonas aeruginosa PA01
cggccugcucgcgca

SEQ ID NO: 1421857 - RNA, 22 nt, Pseudomonas aeruginosa PA01
cggccugcucgcgcagccaggc

SEQ ID NO: 1421858 - RNA, 23 nt, Pseudomonas aeruginosa PA01
cggccugcucgcgcagccaggcg

SEQ ID NO: 1421859 - RNA, 23 nt, Pseudomonas aeruginosa PA01
cggccugcucggcucgcgguucg

SEQ ID NO: 1421860 - RNA, 12 nt, Pseudomonas aeruginosa PA01
cggccuggcgcc

SEQ ID NO: 1421861 - RNA, 14 nt, Pseudomonas aeruginosa PA01
cggccuggcgcagc

SEQ ID NO: 1421862 - RNA, 20 nt, Pseudomonas aeruginosa PA01
cggccuggcgcagcggcagc

SEQ ID NO: 1421863 - RNA, 21 nt, Pseudomonas aeruginosa PA01
cggccuggcgcagcggcagcg

SEQ ID NO: 1421864 - RNA, 22 nt, Pseudomonas aeruginosa PA01
cggccuggcgcagcggcagcgc

SEQ ID NO: 1421865 - RNA, 15 nt, Pseudomonas aeruginosa PA01
cggccuggcgcgcgc

SEQ ID NO: 1421866 - RNA, 18 nt, Pseudomonas aeruginosa PA01
cggccuggcgcgcgcgcc

SEQ ID NO: 1421867 - RNA, 21 nt, Pseudomonas aeruginosa PA01
cggccuggcgcgcgcgccagg

SEQ ID NO: 1421868 - RNA, 17 nt, Pseudomonas aeruginosa PA01
cggccuuggucucgauc

SEQ ID NO: 1421869 - RNA, 19 nt, Pseudomonas aeruginosa PA01
cggccuuggucucgaucag

SEQ ID NO: 1421870 - RNA, 17 nt, Pseudomonas aeruginosa PA01
cggccuuguccgcgcgc

SEQ ID NO: 1421871 - RNA, 18 nt, Pseudomonas aeruginosa PA01
cggccuuguccgcgcgcu

SEQ ID NO: 1421872 - RNA, 21 nt, Pseudomonas aeruginosa PA01
cggcgaacccggcgcggcgca

SEQ ID NO: 1421873 - RNA, 14 nt, Pseudomonas aeruginosa PA01
cggcgaaccaggcg

SEQ ID NO: 1421874 - RNA, 15 nt, Pseudomonas aeruginosa PA01
cggcgaaacggcgga

SEQ ID NO: 1421875 - RNA, 16 nt, Pseudomonas aeruginosa PA01
cggcgaaacggcggau

SEQ ID NO: 1421876 - RNA, 15 nt, Pseudomonas aeruginosa PA01
cggcgaaccagugca

SEQ ID NO: 1421877 - RNA, 20 nt, Pseudomonas aeruginosa PA01
cggcgaaccagugcaccgcc

SEQ ID NO: 1421878 - RNA, 23 nt, Pseudomonas aeruginosa PA01
cggcgaaccagugcaccgccggg

SEQ ID NO: 1421879 - RNA, 18 nt, Pseudomonas aeruginosa PA01
cggcgaacgacagcacca

SEQ ID NO: 1421880 - RNA, 21 nt, Pseudomonas aeruginosa PA01
cggcgaacgacagcaccaugc

SEQ ID NO: 1421881 - RNA, 23 nt, Pseudomonas aeruginosa PA01
cggcgaacgacagcaccaugccc

SEQ ID NO: 1421882 - RNA, 18 nt, Pseudomonas aeruginosa PA01
cggccuuuucucugcauc

SEQ ID NO: 1421883 - RNA, 16 nt, Pseudomonas aeruginosa PA01
cggcgaaaccggccag

SEQ ID NO: 1421884 - RNA, 17 nt, Pseudomonas aeruginosa PA01
cggcgaaaccggccagc

SEQ ID NO: 1421885 - RNA, 20 nt, Pseudomonas aeruginosa PA01
cggcgaaaccggccagcgcg

SEQ ID NO: 1421886 - RNA, 21 nt, Pseudomonas aeruginosa PA01
cggcgacccuggggucgccgu

SEQ ID NO: 1421887 - RNA, 17 nt, Pseudomonas aeruginosa PA01
cggcgaccgaacagcgc

SEQ ID NO: 1421888 - RNA, 18 nt, Pseudomonas aeruginosa PA01
cggcgaccgaacagcgcg

SEQ ID NO: 1421889 - RNA, 20 nt, Pseudomonas aeruginosa PA01
cggcgaccgcaucguuggcg

SEQ ID NO: 1421890 - RNA, 13 nt, Pseudomonas aeruginosa PA01
cggcgacccgaag

SEQ ID NO: 1421891 - RNA, 18 nt, Pseudomonas aeruginosa PA01
cggcgacccgaaggucgc

SEQ ID NO: 1421892 - RNA, 16 nt, Pseudomonas aeruginosa PA01
cggcgacagcaccacg

SEQ ID NO: 1421893 - RNA, 22 nt, Pseudomonas aeruginosa PA01
cggcgacagcaccacgccgcug

SEQ ID NO: 1421894 - RNA, 18 nt, Pseudomonas aeruginosa PA01
cggcgacagccgggcagc

SEQ ID NO: 1421895 - RNA, 17 nt, Pseudomonas aeruginosa PA01
cggcgaauucgucgccg

SEQ ID NO: 1421896 - RNA, 22 nt, Pseudomonas aeruginosa PA01
cggcgaauucgucgccgccgag

SEQ ID NO: 1421897 - RNA, 23 nt, Pseudomonas aeruginosa PA01
cggcgaauucgucgccgccgagg

SEQ ID NO: 1421898 - RNA, 16 nt, Pseudomonas aeruginosa PA01
cggcgaaucgucgaug

SEQ ID NO: 1421899 - RNA, 13 nt, Pseudomonas aeruginosa PA01
cggcgacaccccg

SEQ ID NO: 1421900 - RNA, 16 nt, Pseudomonas aeruginosa PA01
cggcgacaccccgaag

SEQ ID NO: 1421901 - RNA, 13 nt, Pseudomonas aeruginosa PA01
cggcgacaccgcc

SEQ ID NO: 1421902 - RNA, 16 nt, Pseudomonas aeruginosa PA01
cggcgacaccgccagc

SEQ ID NO: 1421903 - RNA, 20 nt, Pseudomonas aeruginosa PA01
cggcgaacucguagacgaau

SEQ ID NO: 1421904 - RNA, 16 nt, Pseudomonas aeruginosa PA01
cggcgaacuggccacc

SEQ ID NO: 1421905 - RNA, 17 nt, Pseudomonas aeruginosa PA01
cggcgaacuccgccagc

SEQ ID NO: 1421906 - RNA, 15 nt, Pseudomonas aeruginosa PA01
cggcgaacgcuugag

SEQ ID NO: 1421907 - RNA, 22 nt, Pseudomonas aeruginosa PA01
cggcgaacgcuugagccccggc

SEQ ID NO: 1421908 - RNA, 16 nt, Pseudomonas aeruginosa PA01
cggcgaacggaccgac

SEQ ID NO: 1421909 - RNA, 17 nt, Pseudomonas aeruginosa PA01
cggcgaacggaccgacg

SEQ ID NO: 1421910 - RNA, 20 nt, Pseudomonas aeruginosa PA01
cggcgaacggaccgacguug

SEQ ID NO: 1421911 - RNA, 17 nt, Pseudomonas aeruginosa PA01
cggcgaagcgcaggcug

SEQ ID NO: 1421912 - RNA, 12 nt, Pseudomonas aeruginosa PA01
cggcgaagcgcu

SEQ ID NO: 1421913 - RNA, 18 nt, Pseudomonas aeruginosa PA01
cggcgaagcggcccuugu

SEQ ID NO: 1421914 - RNA, 14 nt, Pseudomonas aeruginosa PA01
cggcgaagccgcgc

SEQ ID NO: 1421915 - RNA, 17 nt, Pseudomonas aeruginosa PA01
cggcgaagccgcgcccg

SEQ ID NO: 1421916 - RNA, 21 nt, Pseudomonas aeruginosa PA01
cggcgaagccgcgcccggccu

SEQ ID NO: 1421917 - RNA, 21 nt, Pseudomonas aeruginosa PA01
cggccucgacgagguugcucu

SEQ ID NO: 1421918 - RNA, 12 nt, Pseudomonas aeruginosa PA01
cggccucgacgc

SEQ ID NO: 1421919 - RNA, 21 nt, Pseudomonas aeruginosa PA01
cggccucgacgcagagcgcca

SEQ ID NO: 1421920 - RNA, 22 nt, Pseudomonas aeruginosa PA01
cggccucgaucucguccucggc

SEQ ID NO: 1421921 - RNA, 23 nt, Pseudomonas aeruginosa PA01
cggccucgaucucguccucggcg

SEQ ID NO: 1421922 - RNA, 17 nt, Pseudomonas aeruginosa PA01
cggccucgauggcggca

SEQ ID NO: 1421923 - RNA, 20 nt, Pseudomonas aeruginosa PA01
cggccucgagcaucuccggc

SEQ ID NO: 1421924 - RNA, 17 nt, Pseudomonas aeruginosa PA01
cggccucgaggaacagg

SEQ ID NO: 1421925 - RNA, 20 nt, Pseudomonas aeruginosa PA01
cggccucgaggucggccugg

SEQ ID NO: 1421926 - RNA, 23 nt, Pseudomonas aeruginosa PA01
cggccucgccggucgcgcucagg

SEQ ID NO: 1421927 - RNA, 17 nt, Pseudomonas aeruginosa PA01
cggccucgccgaugucg

SEQ ID NO: 1421928 - RNA, 18 nt, Pseudomonas aeruginosa PA01
cggccucuucgucggcga

SEQ ID NO: 1421929 - RNA, 21 nt, Pseudomonas aeruginosa PA01
cggccucuucgucggcgaacg

SEQ ID NO: 1421930 - RNA, 19 nt, Pseudomonas aeruginosa PA01
cggccugaucaucugggcc

SEQ ID NO: 1421931 - RNA, 21 nt, Pseudomonas aeruginosa PA01
cggccugaucaucugggccau

SEQ ID NO: 1421932 - RNA, 23 nt, Pseudomonas aeruginosa PA01
cggccugaucaucugggccaucg

SEQ ID NO: 1421933 - RNA, 23 nt, Pseudomonas aeruginosa PA01
cggccugcacguggaguucaccg

SEQ ID NO: 1421934 - RNA, 18 nt, Pseudomonas aeruginosa PA01
cggccugcaacacccagg

SEQ ID NO: 1421935 - RNA, 15 nt, Pseudomonas aeruginosa PA01
cggccugcaacgccg

SEQ ID NO: 1421936 - RNA, 16 nt, Pseudomonas aeruginosa PA01
cggccugcaacgccgc

SEQ ID NO: 1421937 - RNA, 17 nt, Pseudomonas aeruginosa PA01
cggccugcaacgccgcc

SEQ ID NO: 1421938 - RNA, 18 nt, Pseudomonas aeruginosa PA01
cggccugcaacgccgcca

SEQ ID NO: 1421939 - RNA, 18 nt, Pseudomonas aeruginosa PA01
cggccugccguugcacga

SEQ ID NO: 1421940 - RNA, 17 nt, Pseudomonas aeruginosa PA01
cggccugccccgccggc

SEQ ID NO: 1421941 - RNA, 17 nt, Pseudomonas aeruginosa PA01
cggccugcagccuggcg

SEQ ID NO: 1421942 - RNA, 14 nt, Pseudomonas aeruginosa PA01
cggccugcagcgac

SEQ ID NO: 1421943 - RNA, 24 nt, Pseudomonas aeruginosa PA01
cggccugcagcgacuccagccagg

SEQ ID NO: 1421944 - RNA, 14 nt, Pseudomonas aeruginosa PA01
cggccggcggccug

SEQ ID NO: 1421945 - RNA, 17 nt, Pseudomonas aeruginosa PA01
cggccggcgcggcgcgu

SEQ ID NO: 1421946 - RNA, 20 nt, Pseudomonas aeruginosa PA01
cggccggcgcggacggccug

SEQ ID NO: 1421947 - RNA, 24 nt, Pseudomonas aeruginosa PA01
cggccgugccucagagucgcaccg

SEQ ID NO: 1421948 - RNA, 16 nt, Pseudomonas aeruginosa PA01
cggccguugcgggcga

SEQ ID NO: 1421949 - RNA, 17 nt, Pseudomonas aeruginosa PA01
cggccguugcgggcgau

SEQ ID NO: 1421950 - RNA, 18 nt, Pseudomonas aeruginosa PA01
cggccgugugccugagcu

SEQ ID NO: 1421951 - RNA, 22 nt, Pseudomonas aeruginosa PA01
cggccgugugccugagcuggcu

SEQ ID NO: 1421952 - RNA, 18 nt, Pseudomonas aeruginosa PA01
cggccuacuugaucagcc

SEQ ID NO: 1421953 - RNA, 21 nt, Pseudomonas aeruginosa PA01
cggccuccaggcuggccuugg

SEQ ID NO: 1421954 - RNA, 15 nt, Pseudomonas aeruginosa PA01
cggccuccagcgccu

SEQ ID NO: 1421955 - RNA, 17 nt, Pseudomonas aeruginosa PA01
cggccuccagcgccucg

SEQ ID NO: 1421956 - RNA, 18 nt, Pseudomonas aeruginosa PA01
cggccuccagcgccucgc

SEQ ID NO: 1421957 - RNA, 17 nt, Pseudomonas aeruginosa PA01
cggccuccagcgccugg

SEQ ID NO: 1421958 - RNA, 16 nt, Pseudomonas aeruginosa PA01
cggccucaacgaccgc

SEQ ID NO: 1421959 - RNA, 22 nt, Pseudomonas aeruginosa PA01
cggccucaguuuucuaaccggc

SEQ ID NO: 1421960 - RNA, 14 nt, Pseudomonas aeruginosa PA01
cggccucaggccug

SEQ ID NO: 1421961 - RNA, 17 nt, Pseudomonas aeruginosa PA01
cggccucaggccuggcg

SEQ ID NO: 1421962 - RNA, 18 nt, Pseudomonas aeruginosa PA01
cggcccaccaccacgacg

SEQ ID NO: 1421963 - RNA, 12 nt, Pseudomonas aeruginosa PA01
cggcccaccaga

SEQ ID NO: 1421964 - RNA, 13 nt, Pseudomonas aeruginosa PA01
cggcccaccagag

SEQ ID NO: 1421965 - RNA, 14 nt, Pseudomonas aeruginosa PA01
cggcccaggccggg

SEQ ID NO: 1421966 - RNA, 15 nt, Pseudomonas aeruginosa PA01
cggcccaggccgggu

SEQ ID NO: 1421967 - RNA, 14 nt, Pseudomonas aeruginosa PA01
cggccaugccgccg

SEQ ID NO: 1421968 - RNA, 17 nt, Pseudomonas aeruginosa PA01
cggccaugccgccgacg

SEQ ID NO: 1421969 - RNA, 16 nt, Pseudomonas aeruginosa PA01
cggccaugcuggcgcu

SEQ ID NO: 1421970 - RNA, 15 nt, Pseudomonas aeruginosa PA01
cggccauugucggcc

SEQ ID NO: 1421971 - RNA, 16 nt, Pseudomonas aeruginosa PA01
cggccauugucggccu

SEQ ID NO: 1421972 - RNA, 18 nt, Pseudomonas aeruginosa PA01
cggccauugucggccucg

SEQ ID NO: 1421973 - RNA, 21 nt, Pseudomonas aeruginosa PA01
cggccauugucggccucgaug

SEQ ID NO: 1421974 - RNA, 17 nt, Pseudomonas aeruginosa PA01
cggccauuugcgugcug

SEQ ID NO: 1421975 - RNA, 21 nt, Pseudomonas aeruginosa PA01
cggccauuuuucaugggcggg

SEQ ID NO: 1421976 - RNA, 16 nt, Pseudomonas aeruginosa PA01
cggccauggccgagcc

SEQ ID NO: 1421977 - RNA, 14 nt, Pseudomonas aeruginosa PA01
cggccaguucgggg

SEQ ID NO: 1421978 - RNA, 22 nt, Pseudomonas aeruginosa PA01
cggccaguucggggucggccug

SEQ ID NO: 1421979 - RNA, 17 nt, Pseudomonas aeruginosa PA01
cggccaguucgcggcgc

SEQ ID NO: 1421980 - RNA, 18 nt, Pseudomonas aeruginosa PA01
cggccaguucgcggcgca

SEQ ID NO: 1421981 - RNA, 23 nt, Pseudomonas aeruginosa PA01
cggccaguuggugcacgcgccgg

SEQ ID NO: 1421982 - RNA, 24 nt, Pseudomonas aeruginosa PA01
cggccaguuggugcacgcgccggg

SEQ ID NO: 1421983 - RNA, 20 nt, Pseudomonas aeruginosa PA01
cggccauaccuccagccagc

SEQ ID NO: 1421984 - RNA, 16 nt, Pseudomonas aeruginosa PA01
cggccaugcaggccag

SEQ ID NO: 1421985 - RNA, 17 nt, Pseudomonas aeruginosa PA01
cggccaugcaggccagg

SEQ ID NO: 1421986 - RNA, 15 nt, Pseudomonas aeruginosa PA01
cggccaucggcgaag

SEQ ID NO: 1421987 - RNA, 16 nt, Pseudomonas aeruginosa PA01
cggccaucggcgaagc

SEQ ID NO: 1421988 - RNA, 20 nt, Pseudomonas aeruginosa PA01
cggccagguauucgcgcucg

SEQ ID NO: 1421989 - RNA, 21 nt, Pseudomonas aeruginosa PA01
cggccagguauucgcgcucgg

SEQ ID NO: 1421990 - RNA, 21 nt, Pseudomonas aeruginosa PA01
cggccagguaccggccaggcg

SEQ ID NO: 1421991 - RNA, 16 nt, Pseudomonas aeruginosa PA01
cggccagguacuggcg

SEQ ID NO: 1421992 - RNA, 17 nt, Pseudomonas aeruginosa PA01
cggccagguacuggcga

SEQ ID NO: 1421993 - RNA, 22 nt, Pseudomonas aeruginosa PA01
cggccagguacuuggccacgcc

SEQ ID NO: 1421994 - RNA, 13 nt, Pseudomonas aeruginosa PA01
cggccagguagcg

SEQ ID NO: 1421995 - RNA, 20 nt, Pseudomonas aeruginosa PA01
cggccagguagcggaccccg

SEQ ID NO: 1421996 - RNA, 16 nt, Pseudomonas aeruginosa PA01
cggccagguagcggcg

SEQ ID NO: 1421997 - RNA, 22 nt, Pseudomonas aeruginosa PA01
cggccagguagcggcguucgcc

SEQ ID NO: 1421998 - RNA, 14 nt, Pseudomonas aeruginosa PA01
cggccagguaggcg

SEQ ID NO: 1421999 - RNA, 16 nt, Pseudomonas aeruginosa PA01
cggccagguaggcgac

SEQ ID NO: 1422000 - RNA, 17 nt, Pseudomonas aeruginosa PA01
cggccagguaggcgacg

SEQ ID NO: 1422001 - RNA, 18 nt, Pseudomonas aeruginosa PA01
cggccagguaggcgacga

SEQ ID NO: 1422002 - RNA, 16 nt, Pseudomonas aeruginosa PA01
cggccagggucgccag

SEQ ID NO: 1422003 - RNA, 17 nt, Pseudomonas aeruginosa PA01
cggccagggucgccagc

SEQ ID NO: 1422004 - RNA, 20 nt, Pseudomonas aeruginosa PA01
cggccagggucgccagcagg

SEQ ID NO: 1422005 - RNA, 18 nt, Pseudomonas aeruginosa PA01
cggccaggggcugaacag

SEQ ID NO: 1422006 - RNA, 18 nt, Pseudomonas aeruginosa PA01
cggccaggggagcgccgg

SEQ ID NO: 1422007 - RNA, 19 nt, Pseudomonas aeruginosa PA01
cggccaggggagcgccggc

SEQ ID NO: 1422008 - RNA, 21 nt, Pseudomonas aeruginosa PA01
cggccaggggagcgccggcgc

SEQ ID NO: 1422009 - RNA, 22 nt, Pseudomonas aeruginosa PA01
cggccaggggagcgccggcgcg

SEQ ID NO: 1422010 - RNA, 16 nt, Pseudomonas aeruginosa PA01
cggccaccuucgcccg

SEQ ID NO: 1422011 - RNA, 20 nt, Pseudomonas aeruginosa PA01
cggccaccuucgcccgcugc

SEQ ID NO: 1422012 - RNA, 14 nt, Pseudomonas aeruginosa PA01
cggccaggucgcga

SEQ ID NO: 1422013 - RNA, 15 nt, Pseudomonas aeruginosa PA01
cggccaggucgcgac

SEQ ID NO: 1422014 - RNA, 14 nt, Pseudomonas aeruginosa PA01
cggccaggucgcgg

SEQ ID NO: 1422015 - RNA, 18 nt, Pseudomonas aeruginosa PA01
cggccaggucgcggguga

SEQ ID NO: 1422016 - RNA, 21 nt, Pseudomonas aeruginosa PA01
cggccaggucgcgggugaagc

SEQ ID NO: 1422017 - RNA, 22 nt, Pseudomonas aeruginosa PA01
cggccaggucgcgggugaagcg

SEQ ID NO: 1422018 - RNA, 21 nt, Pseudomonas aeruginosa PA01
cggccaggucguugcgccggc

SEQ ID NO: 1422019 - RNA, 17 nt, Pseudomonas aeruginosa PA01
cggccaguuccuucacg

SEQ ID NO: 1422020 - RNA, 23 nt, Pseudomonas aeruginosa PA01
cggccaguccggucagcagcagg

SEQ ID NO: 1422021 - RNA, 20 nt, Pseudomonas aeruginosa PA01
cggcccggagaucgccgcgc

SEQ ID NO: 1422022 - RNA, 12 nt, Pseudomonas aeruginosa PA01
cggcccggagcc

SEQ ID NO: 1422023 - RNA, 22 nt, Pseudomonas aeruginosa PA01
cggcccggagccaacgcccggg

SEQ ID NO: 1422024 - RNA, 15 nt, Pseudomonas aeruginosa PA01
cggcccggagcgcga

SEQ ID NO: 1422025 - RNA, 17 nt, Pseudomonas aeruginosa PA01
cggcccggagcgcgagg

SEQ ID NO: 1422026 - RNA, 19 nt, Pseudomonas aeruginosa PA01
cggcccggagcgcgaggcg

SEQ ID NO: 1422027 - RNA, 21 nt, Pseudomonas aeruginosa PA01
cggcccggagcgcgaggcgag

SEQ ID NO: 1422028 - RNA, 14 nt, Pseudomonas aeruginosa PA01
cggcccgcgcggca

SEQ ID NO: 1422029 - RNA, 22 nt, Pseudomonas aeruginosa PA01
cggcccgcggaucgcgccgucg

SEQ ID NO: 1422030 - RNA, 14 nt, Pseudomonas aeruginosa PA01
cggcccggcaggcg

SEQ ID NO: 1422031 - RNA, 20 nt, Pseudomonas aeruginosa PA01
cggcccggcaggcgcacgcg

SEQ ID NO: 1422032 - RNA, 14 nt, Pseudomonas aeruginosa PA01
cggcccggccaucc

SEQ ID NO: 1422033 - RNA, 15 nt, Pseudomonas aeruginosa PA01
cggcccggccauccu

SEQ ID NO: 1422034 - RNA, 17 nt, Pseudomonas aeruginosa PA01
cggcccgccccgcaagg

SEQ ID NO: 1422035 - RNA, 13 nt, Pseudomonas aeruginosa PA01
cggcccgcgccgc

SEQ ID NO: 1422036 - RNA, 15 nt, Pseudomonas aeruginosa PA01
cggcccgcgccgccu

SEQ ID NO: 1422037 - RNA, 23 nt, Pseudomonas aeruginosa PA01
cggcccgcgccgccucgauggcg

SEQ ID NO: 1422038 - RNA, 15 nt, Pseudomonas aeruginosa PA01
cggcccgccgccggg

SEQ ID NO: 1422039 - RNA, 14 nt, Pseudomonas aeruginosa PA01
cggcccgccggcga

SEQ ID NO: 1422040 - RNA, 13 nt, Pseudomonas aeruginosa PA01
cggccccaccagc

SEQ ID NO: 1422041 - RNA, 19 nt, Pseudomonas aeruginosa PA01
cggccccaaggggccgcgc

SEQ ID NO: 1422042 - RNA, 20 nt, Pseudomonas aeruginosa PA01
cggccccaaggggccgcgcu

SEQ ID NO: 1422043 - RNA, 14 nt, Pseudomonas aeruginosa PA01
cggcccaugcggau

SEQ ID NO: 1422044 - RNA, 21 nt, Pseudomonas aeruginosa PA01
cggcccaugcggaucgccucc

SEQ ID NO: 1422045 - RNA, 13 nt, Pseudomonas aeruginosa PA01
cggcccauggcga

SEQ ID NO: 1422046 - RNA, 14 nt, Pseudomonas aeruginosa PA01
cggcccauccgccg

SEQ ID NO: 1422047 - RNA, 16 nt, Pseudomonas aeruginosa PA01
cggcccauccgccgca

SEQ ID NO: 1422048 - RNA, 15 nt, Pseudomonas aeruginosa PA01
cggcccgagggcggc

SEQ ID NO: 1422049 - RNA, 16 nt, Pseudomonas aeruginosa PA01
cggcccgagggcggca

SEQ ID NO: 1422050 - RNA, 19 nt, Pseudomonas aeruginosa PA01
cggcccgagggcggcaggg

SEQ ID NO: 1422051 - RNA, 13 nt, Pseudomonas aeruginosa PA01
cggcccgacccac

SEQ ID NO: 1422052 - RNA, 18 nt, Pseudomonas aeruginosa PA01
cggcccgacgccgcccgg

SEQ ID NO: 1422053 - RNA, 20 nt, Pseudomonas aeruginosa PA01
cggcccgacgccgcccggca

SEQ ID NO: 1422054 - RNA, 13 nt, Pseudomonas aeruginosa PA01
cggcccgagcagg

SEQ ID NO: 1422055 - RNA, 15 nt, Pseudomonas aeruginosa PA01
cggcccgagcaggcu

SEQ ID NO: 1422056 - RNA, 20 nt, Pseudomonas aeruginosa PA01
cggcccgagcaggcugccga

SEQ ID NO: 1422057 - RNA, 14 nt, Pseudomonas aeruginosa PA01
cggccccugggccg

SEQ ID NO: 1422058 - RNA, 16 nt, Pseudomonas aeruginosa PA01
cggccccugggccggc

SEQ ID NO: 1422059 - RNA, 17 nt, Pseudomonas aeruginosa PA01
cggccccuucagcucca

SEQ ID NO: 1422060 - RNA, 21 nt, Pseudomonas aeruginosa PA01
cggccccuucagcuccagcag

SEQ ID NO: 1422061 - RNA, 17 nt, Pseudomonas aeruginosa PA01
cggcccggggcucugcc

SEQ ID NO: 1422062 - RNA, 19 nt, Pseudomonas aeruginosa PA01
cggcccgggcgccaccgcg

SEQ ID NO: 1422063 - RNA, 23 nt, Pseudomonas aeruginosa PA01
cggcccgggcguuggcuccgggc

SEQ ID NO: 1422064 - RNA, 23 nt, Pseudomonas aeruginosa PA01
cggcccgggucacggucagcucg

SEQ ID NO: 1422065 - RNA, 11 nt, Pseudomonas aeruginosa PA01
cggcccgggcg

SEQ ID NO: 1422066 - RNA, 16 nt, Pseudomonas aeruginosa PA01
cggcccguccgcgcca

SEQ ID NO: 1422067 - RNA, 18 nt, Pseudomonas aeruginosa PA01
cggcccguccgcgccacg

SEQ ID NO: 1422068 - RNA, 20 nt, Pseudomonas aeruginosa PA01
cggcccguccgcgccacggg

SEQ ID NO: 1422069 - RNA, 22 nt, Pseudomonas aeruginosa PA01
cggcccguggcuggggccggcc

SEQ ID NO: 1422070 - RNA, 13 nt, Pseudomonas aeruginosa PA01
cggcccuccggcg

SEQ ID NO: 1422071 - RNA, 12 nt, Pseudomonas aeruginosa PA01
cggcccugcgcc

SEQ ID NO: 1422072 - RNA, 13 nt, Pseudomonas aeruginosa PA01
cggcccugcucgc

SEQ ID NO: 1422073 - RNA, 16 nt, Pseudomonas aeruginosa PA01
cggcccugcucgccgg

SEQ ID NO: 1422074 - RNA, 22 nt, Pseudomonas aeruginosa PA01
cggcccugcucgccggcgcggg

SEQ ID NO: 1422075 - RNA, 22 nt, Pseudomonas aeruginosa PA01
cggcccugguugcggaacggcu

SEQ ID NO: 1422076 - RNA, 21 nt, Pseudomonas aeruginosa PA01
cggcccuucgacaugggccgc

SEQ ID NO: 1422077 - RNA, 20 nt, Pseudomonas aeruginosa PA01
cggcccuucgacgacaccug

SEQ ID NO: 1422078 - RNA, 17 nt, Pseudomonas aeruginosa PA01
cggccgagcaccacgcg

SEQ ID NO: 1422079 - RNA, 18 nt, Pseudomonas aeruginosa PA01
cggccgagcaccacgcgc

SEQ ID NO: 1422080 - RNA, 16 nt, Pseudomonas aeruginosa PA01
cggccgagcaggcgcg

SEQ ID NO: 1422081 - RNA, 22 nt, Pseudomonas aeruginosa PA01
cggccgagcaggcgcgccaggc

SEQ ID NO: 1422082 - RNA, 21 nt, Pseudomonas aeruginosa PA01
cggccgacgauguucgaggcg

SEQ ID NO: 1422083 - RNA, 17 nt, Pseudomonas aeruginosa PA01
cggccgacgugcacccg

SEQ ID NO: 1422084 - RNA, 18 nt, Pseudomonas aeruginosa PA01
cggccgacgugcacccgc

SEQ ID NO: 1422085 - RNA, 15 nt, Pseudomonas aeruginosa PA01
cggccgaggaaggcg

SEQ ID NO: 1422086 - RNA, 21 nt, Pseudomonas aeruginosa PA01
cggccgaggaaggcgcuggcg

SEQ ID NO: 1422087 - RNA, 23 nt, Pseudomonas aeruginosa PA01
cggccgaggaaggcgcuggcgcu

SEQ ID NO: 1422088 - RNA, 23 nt, Pseudomonas aeruginosa PA01
cggccgagggcagccucagcgac

SEQ ID NO: 1422089 - RNA, 14 nt, Pseudomonas aeruginosa PA01
cggccgagggcgag

SEQ ID NO: 1422090 - RNA, 15 nt, Pseudomonas aeruginosa PA01
cggccgagggcgagu

SEQ ID NO: 1422091 - RNA, 22 nt, Pseudomonas aeruginosa PA01
cggccgagggcgaguucggcga

SEQ ID NO: 1422092 - RNA, 23 nt, Pseudomonas aeruginosa PA01
cggccgagggcgaguucggcgag

SEQ ID NO: 1422093 - RNA, 17 nt, Pseudomonas aeruginosa PA01
cggccgaauccuccagc

SEQ ID NO: 1422094 - RNA, 20 nt, Pseudomonas aeruginosa PA01
cggccgaauccuccagccgg

SEQ ID NO: 1422095 - RNA, 22 nt, Pseudomonas aeruginosa PA01
cggccgaauccuccagccggcg

SEQ ID NO: 1422096 - RNA, 23 nt, Pseudomonas aeruginosa PA01
cggccgaauccuccagccggcga

SEQ ID NO: 1422097 - RNA, 20 nt, Pseudomonas aeruginosa PA01
cggccgacagagcggccggc

SEQ ID NO: 1422098 - RNA, 21 nt, Pseudomonas aeruginosa PA01
cggccgacagagcggccggcg

SEQ ID NO: 1422099 - RNA, 22 nt, Pseudomonas aeruginosa PA01
cggccgacagagcggccggcgc

SEQ ID NO: 1422100 - RNA, 19 nt, Pseudomonas aeruginosa PA01
cggccgacaggcuggugcc

SEQ ID NO: 1422101 - RNA, 14 nt, Pseudomonas aeruginosa PA01
cggccgaccaggcc

SEQ ID NO: 1422102 - RNA, 16 nt, Pseudomonas aeruginosa PA01
cggccgaccaggccgu

SEQ ID NO: 1422103 - RNA, 21 nt, Pseudomonas aeruginosa PA01
cggccgaccaggugcuggucg

SEQ ID NO: 1422104 - RNA, 19 nt, Pseudomonas aeruginosa PA01
cggccgaagaacaccacgc

SEQ ID NO: 1422105 - RNA, 22 nt, Pseudomonas aeruginosa PA01
cggccgaaaucgaugucgcggc

SEQ ID NO: 1422106 - RNA, 20 nt, Pseudomonas aeruginosa PA01
cggccgaacagacgcaggca

SEQ ID NO: 1422107 - RNA, 18 nt, Pseudomonas aeruginosa PA01
cggcccuugagcauggcg

SEQ ID NO: 1422108 - RNA, 16 nt, Pseudomonas aeruginosa PA01
cggcccuugcccggau

SEQ ID NO: 1422109 - RNA, 21 nt, Pseudomonas aeruginosa PA01
cggcccuugucgccgcugggc

SEQ ID NO: 1422110 - RNA, 21 nt, Pseudomonas aeruginosa PA01
cggcccuuguucgcggcgaug

SEQ ID NO: 1422111 - RNA, 12 nt, Pseudomonas aeruginosa PA01
cggccgcggcug

SEQ ID NO: 1422112 - RNA, 15 nt, Pseudomonas aeruginosa PA01
cggccgcggcuggca

SEQ ID NO: 1422113 - RNA, 17 nt, Pseudomonas aeruginosa PA01
cggccgcucggccuuga

SEQ ID NO: 1422114 - RNA, 14 nt, Pseudomonas aeruginosa PA01
cggccgcugcgcag

SEQ ID NO: 1422115 - RNA, 21 nt, Pseudomonas aeruginosa PA01
cggccgcugcgcaggccgaga

SEQ ID NO: 1422116 - RNA, 21 nt, Pseudomonas aeruginosa PA01
cggccgcuggaugccgaccac

SEQ ID NO: 1422117 - RNA, 13 nt, Pseudomonas aeruginosa PA01
cggccgcuggcga

SEQ ID NO: 1422118 - RNA, 18 nt, Pseudomonas aeruginosa PA01
cggccgcuggcgaucucg

SEQ ID NO: 1422119 - RNA, 21 nt, Pseudomonas aeruginosa PA01
cggccggccacgcgaccagcg

SEQ ID NO: 1422120 - RNA, 13 nt, Pseudomonas aeruginosa PA01
cggccggcaggcu

SEQ ID NO: 1422121 - RNA, 14 nt, Pseudomonas aeruginosa PA01
cggccggcaggcug

SEQ ID NO: 1422122 - RNA, 15 nt, Pseudomonas aeruginosa PA01
cggccggccaggucg

SEQ ID NO: 1422123 - RNA, 16 nt, Pseudomonas aeruginosa PA01
cggccggcagcuccgg

SEQ ID NO: 1422124 - RNA, 18 nt, Pseudomonas aeruginosa PA01
cggccggcagcuccggcg

SEQ ID NO: 1422125 - RNA, 14 nt, Pseudomonas aeruginosa PA01
cggccggcagcgag

SEQ ID NO: 1422126 - RNA, 14 nt, Pseudomonas aeruginosa PA01
cggccggcaggccg

SEQ ID NO: 1422127 - RNA, 15 nt, Pseudomonas aeruginosa PA01
cggccggcaggccga

SEQ ID NO: 1422128 - RNA, 16 nt, Pseudomonas aeruginosa PA01
cggccggcaggccgau

SEQ ID NO: 1422129 - RNA, 20 nt, Pseudomonas aeruginosa PA01
cggccggcaggccgauggcc

SEQ ID NO: 1422130 - RNA, 20 nt, Pseudomonas aeruginosa PA01
cggccgaguucgcgcaggcg

SEQ ID NO: 1422131 - RNA, 19 nt, Pseudomonas aeruginosa PA01
cggccgaucaccuucaccg

SEQ ID NO: 1422132 - RNA, 22 nt, Pseudomonas aeruginosa PA01
cggccgaucaccuucaccggca

SEQ ID NO: 1422133 - RNA, 16 nt, Pseudomonas aeruginosa PA01
cggccgaucuccuggc

SEQ ID NO: 1422134 - RNA, 17 nt, Pseudomonas aeruginosa PA01
cggccgaucuccuggcg

SEQ ID NO: 1422135 - RNA, 22 nt, Pseudomonas aeruginosa PA01
cggccgaucuucagcagcaggc

SEQ ID NO: 1422136 - RNA, 15 nt, Pseudomonas aeruginosa PA01
cggccgccaucgccc

SEQ ID NO: 1422137 - RNA, 16 nt, Pseudomonas aeruginosa PA01
cggccgccaucgcccg

SEQ ID NO: 1422138 - RNA, 14 nt, Pseudomonas aeruginosa PA01
cggccgccauuccg

SEQ ID NO: 1422139 - RNA, 18 nt, Pseudomonas aeruginosa PA01
cggccgccagggcgucgg

SEQ ID NO: 1422140 - RNA, 14 nt, Pseudomonas aeruginosa PA01
cggccgccaggcgc

SEQ ID NO: 1422141 - RNA, 18 nt, Pseudomonas aeruginosa PA01
cggccgccaggcuggguu

SEQ ID NO: 1422142 - RNA, 12 nt, Pseudomonas aeruginosa PA01
cggccgccaggg

SEQ ID NO: 1422143 - RNA, 14 nt, Pseudomonas aeruginosa PA01
cggccgcccagcgg

SEQ ID NO: 1422144 - RNA, 14 nt, Pseudomonas aeruginosa PA01
cggccgccucggcg

SEQ ID NO: 1422145 - RNA, 19 nt, Pseudomonas aeruginosa PA01
cggccgcgccuucagcgcc

SEQ ID NO: 1422146 - RNA, 23 nt, Pseudomonas aeruginosa PA01
cggccgcgccuugcucaggucgu

SEQ ID NO: 1422147 - RNA, 21 nt, Pseudomonas aeruginosa PA01
cggccgccuuccucggccgcc

SEQ ID NO: 1422148 - RNA, 22 nt, Pseudomonas aeruginosa PA01
cggccgccuuccucggccgcca

SEQ ID NO: 1422149 - RNA, 23 nt, Pseudomonas aeruginosa PA01
cggccgccuuccucggccgccag

SEQ ID NO: 1422150 - RNA, 19 nt, Pseudomonas aeruginosa PA01
cggccgccuugaccugcug

SEQ ID NO: 1422151 - RNA, 21 nt, Pseudomonas aeruginosa PA01
cggccgccuugaccugcuggg

SEQ ID NO: 1422152 - RNA, 12 nt, Pseudomonas aeruginosa PA01
cggccgccuggc

SEQ ID NO: 1422153 - RNA, 13 nt, Pseudomonas aeruginosa PA01
cggccgccuggcg

SEQ ID NO: 1422154 - RNA, 14 nt, Pseudomonas aeruginosa PA01
cggccgccuggcgu

SEQ ID NO: 1422155 - RNA, 23 nt, Pseudomonas aeruginosa PA01
cggccgccuggcgugccgccagg

SEQ ID NO: 1422156 - RNA, 16 nt, Pseudomonas aeruginosa PA01
cggccaacccgcuucg

SEQ ID NO: 1422157 - RNA, 14 nt, Pseudomonas aeruginosa PA01
cggccaacggccgc

SEQ ID NO: 1422158 - RNA, 19 nt, Pseudomonas aeruginosa PA01
cggccaacugagcggcggc

SEQ ID NO: 1422159 - RNA, 16 nt, Pseudomonas aeruginosa PA01
cggccacccgaaggug

SEQ ID NO: 1422160 - RNA, 18 nt, Pseudomonas aeruginosa PA01
cggccaccagcgaaagcg

SEQ ID NO: 1422161 - RNA, 23 nt, Pseudomonas aeruginosa PA01
cggccaccaucacgucgcgcacc

SEQ ID NO: 1422162 - RNA, 14 nt, Pseudomonas aeruginosa PA01
cggccaccaggcuu

SEQ ID NO: 1422163 - RNA, 22 nt, Pseudomonas aeruginosa PA01
cggcaucgaccagggccggguc

SEQ ID NO: 1422164 - RNA, 21 nt, Pseudomonas aeruginosa PA01
cggcaugcacgcccuggagcg

SEQ ID NO: 1422165 - RNA, 18 nt, Pseudomonas aeruginosa PA01
cggcaugcccugccggcg

SEQ ID NO: 1422166 - RNA, 20 nt, Pseudomonas aeruginosa PA01
cggcaugcccugccggcgca

SEQ ID NO: 1422167 - RNA, 22 nt, Pseudomonas aeruginosa PA01
cggcaugcccugccggcgcaga

SEQ ID NO: 1422168 - RNA, 16 nt, Pseudomonas aeruginosa PA01
cggcauccucgccccg

SEQ ID NO: 1422169 - RNA, 22 nt, Pseudomonas aeruginosa PA01
cggcauccucgccccgccggga

SEQ ID NO: 1422170 - RNA, 15 nt, Pseudomonas aeruginosa PA01
cggcauccggcaggc

SEQ ID NO: 1422171 - RNA, 14 nt, Pseudomonas aeruginosa PA01
cggcauccgccgcu

SEQ ID NO: 1422172 - RNA, 17 nt, Pseudomonas aeruginosa PA01
cggcaucccgcccgguc

SEQ ID NO: 1422173 - RNA, 20 nt, Pseudomonas aeruginosa PA01
cggcaucccgcccggucuca

SEQ ID NO: 1422174 - RNA, 17 nt, Pseudomonas aeruginosa PA01
cggcaucaguagcgggc

SEQ ID NO: 1422175 - RNA, 19 nt, Pseudomonas aeruginosa PA01
cggcaucaguagcgggcau

SEQ ID NO: 1422176 - RNA, 16 nt, Pseudomonas aeruginosa PA01
cggcauccagcauccg

SEQ ID NO: 1422177 - RNA, 18 nt, Pseudomonas aeruginosa PA01
cggcaugcguucggcauu

SEQ ID NO: 1422178 - RNA, 17 nt, Pseudomonas aeruginosa PA01
cggcaugcucagccgcg

SEQ ID NO: 1422179 - RNA, 18 nt, Pseudomonas aeruginosa PA01
cggcaugcucagccgcgc

SEQ ID NO: 1422180 - RNA, 15 nt, Pseudomonas aeruginosa PA01
cggcauggccgaccg

SEQ ID NO: 1422181 - RNA, 17 nt, Pseudomonas aeruginosa PA01
cggcauggccgaccgcc

SEQ ID NO: 1422182 - RNA, 16 nt, Pseudomonas aeruginosa PA01
cggcaugccguugggc

SEQ ID NO: 1422183 - RNA, 18 nt, Pseudomonas aeruginosa PA01
cggcauuggcacccugga

SEQ ID NO: 1422184 - RNA, 22 nt, Pseudomonas aeruginosa PA01
cggcauuggcacccuggacccg

SEQ ID NO: 1422185 - RNA, 20 nt, Pseudomonas aeruginosa PA01
cggcauuccgggcgaaagcg

SEQ ID NO: 1422186 - RNA, 17 nt, Pseudomonas aeruginosa PA01
cggcauuccugguccag

SEQ ID NO: 1422187 - RNA, 13 nt, Pseudomonas aeruginosa PA01
cggcauucgccgg

SEQ ID NO: 1422188 - RNA, 16 nt, Pseudomonas aeruginosa PA01
cggcauucgccgggcu

SEQ ID NO: 1422189 - RNA, 15 nt, Pseudomonas aeruginosa PA01
cggcagcgcuggcga

SEQ ID NO: 1422190 - RNA, 18 nt, Pseudomonas aeruginosa PA01
cggcagcgcuggcgauca

SEQ ID NO: 1422191 - RNA, 22 nt, Pseudomonas aeruginosa PA01
cggcagcgcuggcgaucaccag

SEQ ID NO: 1422192 - RNA, 23 nt, Pseudomonas aeruginosa PA01
cggcagcgcuggcgaucaccagg

SEQ ID NO: 1422193 - RNA, 12 nt, Pseudomonas aeruginosa PA01
cggcagcggcuc

SEQ ID NO: 1422194 - RNA, 16 nt, Pseudomonas aeruginosa PA01
cggcagcggcuggccg

SEQ ID NO: 1422195 - RNA, 18 nt, Pseudomonas aeruginosa PA01
cggcagcggcuggccguc

SEQ ID NO: 1422196 - RNA, 17 nt, Pseudomonas aeruginosa PA01
cggcagcgguucgcccg

SEQ ID NO: 1422197 - RNA, 19 nt, Pseudomonas aeruginosa PA01
cggcagcgguucgcccgcg

SEQ ID NO: 1422198 - RNA, 22 nt, Pseudomonas aeruginosa PA01
cggcagcgucucagcccucggc

SEQ ID NO: 1422199 - RNA, 23 nt, Pseudomonas aeruginosa PA01
cggcagcgucucagcccucggcc

SEQ ID NO: 1422200 - RNA, 22 nt, Pseudomonas aeruginosa PA01
cggcagcgucucggcugccgcc

SEQ ID NO: 1422201 - RNA, 14 nt, Pseudomonas aeruginosa PA01
cggcagcgucgagc

SEQ ID NO: 1422202 - RNA, 17 nt, Pseudomonas aeruginosa PA01
cggcagcugcggcggca

SEQ ID NO: 1422203 - RNA, 13 nt, Pseudomonas aeruginosa PA01
cggcagcucggcg

SEQ ID NO: 1422204 - RNA, 15 nt, Pseudomonas aeruginosa PA01
cggcagcucggcgac

SEQ ID NO: 1422205 - RNA, 14 nt, Pseudomonas aeruginosa PA01
cggcagcucggccg

SEQ ID NO: 1422206 - RNA, 16 nt, Pseudomonas aeruginosa PA01
cggcagcucggccgag

SEQ ID NO: 1422207 - RNA, 16 nt, Pseudomonas aeruginosa PA01
cggcagcuuggcgacg

SEQ ID NO: 1422208 - RNA, 15 nt, Pseudomonas aeruginosa PA01
cggcaggaacgcccg

SEQ ID NO: 1422209 - RNA, 14 nt, Pseudomonas aeruginosa PA01
cggcagggcggcga

SEQ ID NO: 1422210 - RNA, 15 nt, Pseudomonas aeruginosa PA01
cggcagcuggauccg

SEQ ID NO: 1422211 - RNA, 20 nt, Pseudomonas aeruginosa PA01
cggcaggaaauccgccgcgc

SEQ ID NO: 1422212 - RNA, 15 nt, Pseudomonas aeruginosa PA01
cggcaggguggcgca

SEQ ID NO: 1422213 - RNA, 15 nt, Pseudomonas aeruginosa PA01
cggcaggguagccac

SEQ ID NO: 1422214 - RNA, 20 nt, Pseudomonas aeruginosa PA01
cggcagggucacgccgguga

SEQ ID NO: 1422215 - RNA, 15 nt, Pseudomonas aeruginosa PA01
cggcagggucagccg

SEQ ID NO: 1422216 - RNA, 16 nt, Pseudomonas aeruginosa PA01
cggcagggucagccga

SEQ ID NO: 1422217 - RNA, 22 nt, Pseudomonas aeruginosa PA01
cggcaggggcuuucuucgccug

SEQ ID NO: 1422218 - RNA, 20 nt, Pseudomonas aeruginosa PA01
cggcagggggucuucgaagg

SEQ ID NO: 1422219 - RNA, 12 nt, Pseudomonas aeruginosa PA01
cggcagguagug

SEQ ID NO: 1422220 - RNA, 22 nt, Pseudomonas aeruginosa PA01
cggcaggucgaggacgaucagc

SEQ ID NO: 1422221 - RNA, 22 nt, Pseudomonas aeruginosa PA01
cggcaggucguugacgaucugc

SEQ ID NO: 1422222 - RNA, 21 nt, Pseudomonas aeruginosa PA01
cggcauagccgaacuccgcca

SEQ ID NO: 1422223 - RNA, 23 nt, Pseudomonas aeruginosa PA01
cggcauagccgaacuccgccagc

SEQ ID NO: 1422224 - RNA, 16 nt, Pseudomonas aeruginosa PA01
cggcauagcgcagccg

SEQ ID NO: 1422225 - RNA, 20 nt, Pseudomonas aeruginosa PA01
cggcauagcgcagccgcucg

SEQ ID NO: 1422226 - RNA, 17 nt, Pseudomonas aeruginosa PA01
cggcauaggcccggcgu

SEQ ID NO: 1422227 - RNA, 16 nt, Pseudomonas aeruginosa PA01
cggcauaggcgccagc

SEQ ID NO: 1422228 - RNA, 17 nt, Pseudomonas aeruginosa PA01
cggcauaggcgccagcc

SEQ ID NO: 1422229 - RNA, 18 nt, Pseudomonas aeruginosa PA01
cggcauaggcgccagccu

SEQ ID NO: 1422230 - RNA, 19 nt, Pseudomonas aeruginosa PA01
cggcauaggcgccagccua

SEQ ID NO: 1422231 - RNA, 17 nt, Pseudomonas aeruginosa PA01
cggcaucaccggcggga

SEQ ID NO: 1422232 - RNA, 18 nt, Pseudomonas aeruginosa PA01
cggcaucaaucgcuggcg

SEQ ID NO: 1422233 - RNA, 23 nt, Pseudomonas aeruginosa PA01
cggcaguggugauccgcacccgc

SEQ ID NO: 1422234 - RNA, 17 nt, Pseudomonas aeruginosa PA01
cggcagugcucgaucag

SEQ ID NO: 1422235 - RNA, 19 nt, Pseudomonas aeruginosa PA01
cggcagugcucgaucaggc

SEQ ID NO: 1422236 - RNA, 17 nt, Pseudomonas aeruginosa PA01
cggcagucccugccagg

SEQ ID NO: 1422237 - RNA, 20 nt, Pseudomonas aeruginosa PA01
cggcagguggcgggucggcg

SEQ ID NO: 1422238 - RNA, 20 nt, Pseudomonas aeruginosa PA01
cggcaggugguaagcgagca

SEQ ID NO: 1422239 - RNA, 21 nt, Pseudomonas aeruginosa PA01
cggcaggugguaagcgagcag

SEQ ID NO: 1422240 - RNA, 13 nt, Pseudomonas aeruginosa PA01
cggcagguggucg

SEQ ID NO: 1422241 - RNA, 19 nt, Pseudomonas aeruginosa PA01
cggcagguggucguugcgc

SEQ ID NO: 1422242 - RNA, 16 nt, Pseudomonas aeruginosa PA01
cggcagguuguucgcc

SEQ ID NO: 1422243 - RNA, 19 nt, Pseudomonas aeruginosa PA01
cggcagguuguucgccgca

SEQ ID NO: 1422244 - RNA, 20 nt, Pseudomonas aeruginosa PA01
cggcagguuguucgccgcag

SEQ ID NO: 1422245 - RNA, 19 nt, Pseudomonas aeruginosa PA01
cggcacggucauggccagc

SEQ ID NO: 1422246 - RNA, 13 nt, Pseudomonas aeruginosa PA01
cggcacggcaucg

SEQ ID NO: 1422247 - RNA, 14 nt, Pseudomonas aeruginosa PA01
cggcacgccauccu

SEQ ID NO: 1422248 - RNA, 17 nt, Pseudomonas aeruginosa PA01
cggcacgccauccuccg

SEQ ID NO: 1422249 - RNA, 22 nt, Pseudomonas aeruginosa PA01
cggcacgaccuucuccgaccag

SEQ ID NO: 1422250 - RNA, 13 nt, Pseudomonas aeruginosa PA01
cggcacgaugucg

SEQ ID NO: 1422251 - RNA, 15 nt, Pseudomonas aeruginosa PA01
cggcacgaugucgac

SEQ ID NO: 1422252 - RNA, 23 nt, Pseudomonas aeruginosa PA01
cggcaccgcuuucguagggcgaa

SEQ ID NO: 1422253 - RNA, 12 nt, Pseudomonas aeruginosa PA01
cggcacgaccac

SEQ ID NO: 1422254 - RNA, 22 nt, Pseudomonas aeruginosa PA01
cggcacgaccacaucggccagu

SEQ ID NO: 1422255 - RNA, 13 nt, Pseudomonas aeruginosa PA01
cggcagcagcgga

SEQ ID NO: 1422256 - RNA, 12 nt, Pseudomonas aeruginosa PA01
cggcagcagcgc

SEQ ID NO: 1422257 - RNA, 14 nt, Pseudomonas aeruginosa PA01
cggcagcagcgcca

SEQ ID NO: 1422258 - RNA, 15 nt, Pseudomonas aeruginosa PA01
cggcagcagcgccag

SEQ ID NO: 1422259 - RNA, 16 nt, Pseudomonas aeruginosa PA01
cggcagcagcgccagg

SEQ ID NO: 1422260 - RNA, 15 nt, Pseudomonas aeruginosa PA01
cggcagcagcuugcc

SEQ ID NO: 1422261 - RNA, 21 nt, Pseudomonas aeruginosa PA01
cggcagcagcuugccggcaua

SEQ ID NO: 1422262 - RNA, 23 nt, Pseudomonas aeruginosa PA01
cggcagcagcuugccggcauagc

SEQ ID NO: 1422263 - RNA, 18 nt, Pseudomonas aeruginosa PA01
cggcagcaggccgccgcg

SEQ ID NO: 1422264 - RNA, 16 nt, Pseudomonas aeruginosa PA01
cggcagcaggcgggcg

SEQ ID NO: 1422265 - RNA, 22 nt, Pseudomonas aeruginosa PA01
cggcagcaggcuguacagcagg

SEQ ID NO: 1422266 - RNA, 15 nt, Pseudomonas aeruginosa PA01
cggcagcagggucag

SEQ ID NO: 1422267 - RNA, 20 nt, Pseudomonas aeruginosa PA01
cggcagcagggucagcagcg

SEQ ID NO: 1422268 - RNA, 22 nt, Pseudomonas aeruginosa PA01
cggcagcagggucagcagcgcc

SEQ ID NO: 1422269 - RNA, 18 nt, Pseudomonas aeruginosa PA01
cggcagcacgcugacgcc

SEQ ID NO: 1422270 - RNA, 22 nt, Pseudomonas aeruginosa PA01
cggcagcacgcugacgccggca

SEQ ID NO: 1422271 - RNA, 14 nt, Pseudomonas aeruginosa PA01
cggcagcacggcga

SEQ ID NO: 1422272 - RNA, 16 nt, Pseudomonas aeruginosa PA01
cggcagcacggcgaua

SEQ ID NO: 1422273 - RNA, 15 nt, Pseudomonas aeruginosa PA01
cggcacucagccagc

SEQ ID NO: 1422274 - RNA, 16 nt, Pseudomonas aeruginosa PA01
cggcacucagccagcg

SEQ ID NO: 1422275 - RNA, 15 nt, Pseudomonas aeruginosa PA01
cggcacuccggcaua

SEQ ID NO: 1422276 - RNA, 19 nt, Pseudomonas aeruginosa PA01
cggcacuccggcauaccgc

SEQ ID NO: 1422277 - RNA, 20 nt, Pseudomonas aeruginosa PA01
cggcacucggcgaccacccg

SEQ ID NO: 1422278 - RNA, 15 nt, Pseudomonas aeruginosa PA01
cggcacucgccgggc

SEQ ID NO: 1422279 - RNA, 17 nt, Pseudomonas aeruginosa PA01
cggcacucgccgggcgu

SEQ ID NO: 1422280 - RNA, 14 nt, Pseudomonas aeruginosa PA01
cggcagcgacugga

SEQ ID NO: 1422281 - RNA, 15 nt, Pseudomonas aeruginosa PA01
cggcagcgaccacca

SEQ ID NO: 1422282 - RNA, 15 nt, Pseudomonas aeruginosa PA01
cggcagcaucagccg

SEQ ID NO: 1422283 - RNA, 12 nt, Pseudomonas aeruginosa PA01
cggcagccgggu

SEQ ID NO: 1422284 - RNA, 14 nt, Pseudomonas aeruginosa PA01
cggcagccguccgc

SEQ ID NO: 1422285 - RNA, 18 nt, Pseudomonas aeruginosa PA01
cggcagccguccgcccag

SEQ ID NO: 1422286 - RNA, 23 nt, Pseudomonas aeruginosa PA01
cggcaaguucgcauaggcggcca

SEQ ID NO: 1422287 - RNA, 15 nt, Pseudomonas aeruginosa PA01
cggcaaucaggcgcg

SEQ ID NO: 1422288 - RNA, 21 nt, Pseudomonas aeruginosa PA01
cggcaaucaggcgcgaucgcg

SEQ ID NO: 1422289 - RNA, 15 nt, Pseudomonas aeruginosa PA01
cggcaauagccgggc

SEQ ID NO: 1422290 - RNA, 16 nt, Pseudomonas aeruginosa PA01
cggcaaugcggcgaug

SEQ ID NO: 1422291 - RNA, 23 nt, Pseudomonas aeruginosa PA01
cggcaccagcacguugccaucca

SEQ ID NO: 1422292 - RNA, 13 nt, Pseudomonas aeruginosa PA01
cggcaccagcgcg

SEQ ID NO: 1422293 - RNA, 22 nt, Pseudomonas aeruginosa PA01
cggcaccagggcuucgcgcaga

SEQ ID NO: 1422294 - RNA, 16 nt, Pseudomonas aeruginosa PA01
cggcaccagcaguagu

SEQ ID NO: 1422295 - RNA, 12 nt, Pseudomonas aeruginosa PA01
cggcaccagcca

SEQ ID NO: 1422296 - RNA, 13 nt, Pseudomonas aeruginosa PA01
cggcaccagccag

SEQ ID NO: 1422297 - RNA, 14 nt, Pseudomonas aeruginosa PA01
cggcaccagccagg

SEQ ID NO: 1422298 - RNA, 15 nt, Pseudomonas aeruginosa PA01
cggcaccagccaggu

SEQ ID NO: 1422299 - RNA, 19 nt, Pseudomonas aeruginosa PA01
cggcaacugagcgcaacuc

SEQ ID NO: 1422300 - RNA, 16 nt, Pseudomonas aeruginosa PA01
cggcaacugauagucg

SEQ ID NO: 1422301 - RNA, 21 nt, Pseudomonas aeruginosa PA01
cggaugcuccagguucggcgc

SEQ ID NO: 1422302 - RNA, 21 nt, Pseudomonas aeruginosa PA01
cggaugcgcgaauaccgcgcg

SEQ ID NO: 1422303 - RNA, 16 nt, Pseudomonas aeruginosa PA01
cggcaagggcacgugc

SEQ ID NO: 1422304 - RNA, 14 nt, Pseudomonas aeruginosa PA01
cggcaagggccugc

SEQ ID NO: 1422305 - RNA, 14 nt, Pseudomonas aeruginosa PA01
cggcaaggcggccu

SEQ ID NO: 1422306 - RNA, 15 nt, Pseudomonas aeruginosa PA01
cggcaaggcgauccc

SEQ ID NO: 1422307 - RNA, 16 nt, Pseudomonas aeruginosa PA01
cggcaaggcgaucccg

SEQ ID NO: 1422308 - RNA, 20 nt, Pseudomonas aeruginosa PA01
cggcaaggcgaucccggcgu

SEQ ID NO: 1422309 - RNA, 18 nt, Pseudomonas aeruginosa PA01
cggcaagcgaaccgagga

SEQ ID NO: 1422310 - RNA, 14 nt, Pseudomonas aeruginosa PA01
cggcaagcaggccg

SEQ ID NO: 1422311 - RNA, 21 nt, Pseudomonas aeruginosa PA01
cggcaagcugaagcgccgcgg

SEQ ID NO: 1422312 - RNA, 23 nt, Pseudomonas aeruginosa PA01
cggcaagcgugccccgacugucg

SEQ ID NO: 1422313 - RNA, 13 nt, Pseudomonas aeruginosa PA01
cggcaagcuccgc

SEQ ID NO: 1422314 - RNA, 18 nt, Pseudomonas aeruginosa PA01
cggcaagcuccgcgaugu

SEQ ID NO: 1422315 - RNA, 15 nt, Pseudomonas aeruginosa PA01
cggcaaggaccugcu

SEQ ID NO: 1422316 - RNA, 21 nt, Pseudomonas aeruginosa PA01
cggcaaggaccugcugcccgg

SEQ ID NO: 1422317 - RNA, 14 nt, Pseudomonas aeruginosa PA01
cggcaaggccaagu

SEQ ID NO: 1422318 - RNA, 21 nt, Pseudomonas aeruginosa PA01
cggcaaggccaagucggccgc

SEQ ID NO: 1422319 - RNA, 22 nt, Pseudomonas aeruginosa PA01
cggcaaggccaagucggccgcc

SEQ ID NO: 1422320 - RNA, 17 nt, Pseudomonas aeruginosa PA01
cggagagggagcgccug

SEQ ID NO: 1422321 - RNA, 22 nt, Pseudomonas aeruginosa PA01
cggagagggagcgccuggcguc

SEQ ID NO: 1422322 - RNA, 16 nt, Pseudomonas aeruginosa PA01
cggagaucgccgcgcc

SEQ ID NO: 1422323 - RNA, 16 nt, Pseudomonas aeruginosa PA01
cggagauugcggcgaa

SEQ ID NO: 1422324 - RNA, 20 nt, Pseudomonas aeruginosa PA01
cggagagauucggguagucu

SEQ ID NO: 1422325 - RNA, 14 nt, Pseudomonas aeruginosa PA01
cggagcaugguguc

SEQ ID NO: 1422326 - RNA, 17 nt, Pseudomonas aeruginosa PA01
cggagcauggugucgcu

SEQ ID NO: 1422327 - RNA, 16 nt, Pseudomonas aeruginosa PA01
cggagccaacgcccgg

SEQ ID NO: 1422328 - RNA, 16 nt, Pseudomonas aeruginosa PA01
cggagcaccgcgccuu

SEQ ID NO: 1422329 - RNA, 17 nt, Pseudomonas aeruginosa PA01
cggagcaccgcgccuuc

SEQ ID NO: 1422330 - RNA, 21 nt, Pseudomonas aeruginosa PA01
cggagcaccgcgccuuccagc

SEQ ID NO: 1422331 - RNA, 14 nt, Pseudomonas aeruginosa PA01
cggagccaccggga

SEQ ID NO: 1422332 - RNA, 12 nt, Pseudomonas aeruginosa PA01
cggagcggcugc

SEQ ID NO: 1422333 - RNA, 15 nt, Pseudomonas aeruginosa PA01
cggagcggcugccga

SEQ ID NO: 1422334 - RNA, 13 nt, Pseudomonas aeruginosa PA01
cggagcgcgaggc

SEQ ID NO: 1422335 - RNA, 21 nt, Pseudomonas aeruginosa PA01
cggagccuucuagcgaaggcu

SEQ ID NO: 1422336 - RNA, 12 nt, Pseudomonas aeruginosa PA01
cggagcgaacga

SEQ ID NO: 1422337 - RNA, 17 nt, Pseudomonas aeruginosa PA01
cggacuccgacgcgucg

SEQ ID NO: 1422338 - RNA, 22 nt, Pseudomonas aeruginosa PA01
cggacuaccuucgaucacccgg

SEQ ID NO: 1422339 - RNA, 16 nt, Pseudomonas aeruginosa PA01
cggacgggugcgcgcc

SEQ ID NO: 1422340 - RNA, 19 nt, Pseudomonas aeruginosa PA01
cggacgggugcgcgccacc

SEQ ID NO: 1422341 - RNA, 21 nt, Pseudomonas aeruginosa PA01
cggacguaggacgaacaaccg

SEQ ID NO: 1422342 - RNA, 15 nt, Pseudomonas aeruginosa PA01
cggacugcccgacga

SEQ ID NO: 1422343 - RNA, 16 nt, Pseudomonas aeruginosa PA01
cggacugcccagcgcc

SEQ ID NO: 1422344 - RNA, 19 nt, Pseudomonas aeruginosa PA01
cggacugcccagcgccgcc

SEQ ID NO: 1422345 - RNA, 14 nt, Pseudomonas aeruginosa PA01
cggacugcucgccg

SEQ ID NO: 1422346 - RNA, 17 nt, Pseudomonas aeruginosa PA01
cggacugcucgccgccg

SEQ ID NO: 1422347 - RNA, 19 nt, Pseudomonas aeruginosa PA01
cggacugcucgccgccggc

SEQ ID NO: 1422348 - RNA, 21 nt, Pseudomonas aeruginosa PA01
cggacugcucgccgccggcga

SEQ ID NO: 1422349 - RNA, 21 nt, Pseudomonas aeruginosa PA01
cggacuggauucggccugccg

SEQ ID NO: 1422350 - RNA, 21 nt, Pseudomonas aeruginosa PA01
cggacugguaggacagggcca

SEQ ID NO: 1422351 - RNA, 23 nt, Pseudomonas aeruginosa PA01
cggacugguaggacagggccagg

SEQ ID NO: 1422352 - RNA, 15 nt, Pseudomonas aeruginosa PA01
cggagagcagcacgg

SEQ ID NO: 1422353 - RNA, 18 nt, Pseudomonas aeruginosa PA01
cggagagcagccaagcca

SEQ ID NO: 1422354 - RNA, 14 nt, Pseudomonas aeruginosa PA01
cggagacgauggcg

SEQ ID NO: 1422355 - RNA, 17 nt, Pseudomonas aeruginosa PA01
cggagagacccgccagc

SEQ ID NO: 1422356 - RNA, 20 nt, Pseudomonas aeruginosa PA01
cggagagacccgccagcggc

SEQ ID NO: 1422357 - RNA, 21 nt, Pseudomonas aeruginosa PA01
cggagagacccgccagcggca

SEQ ID NO: 1422358 - RNA, 22 nt, Pseudomonas aeruginosa PA01
cggagagacccgccagcggcau

SEQ ID NO: 1422359 - RNA, 13 nt, Pseudomonas aeruginosa PA01
cggagaauccgcu

SEQ ID NO: 1422360 - RNA, 16 nt, Pseudomonas aeruginosa PA01
cggagaccgugccgcc

SEQ ID NO: 1422361 - RNA, 23 nt, Pseudomonas aeruginosa PA01
cggagaagcguccgagguggcug

SEQ ID NO: 1422362 - RNA, 20 nt, Pseudomonas aeruginosa PA01
cggagaaggagaacgacaug

SEQ ID NO: 1422363 - RNA, 13 nt, Pseudomonas aeruginosa PA01
cggagaacagcag

SEQ ID NO: 1422364 - RNA, 13 nt, Pseudomonas aeruginosa PA01
cggagaacagcga

SEQ ID NO: 1422365 - RNA, 17 nt, Pseudomonas aeruginosa PA01
cggagaacagcgagacc

SEQ ID NO: 1422366 - RNA, 15 nt, Pseudomonas aeruginosa PA01
cggagaaccggcgga

SEQ ID NO: 1422367 - RNA, 15 nt, Pseudomonas aeruginosa PA01
cggagaacgccgcca

SEQ ID NO: 1422368 - RNA, 23 nt, Pseudomonas aeruginosa PA01
cggagaacgccgccacgccgaua

SEQ ID NO: 1422369 - RNA, 21 nt, Pseudomonas aeruginosa PA01
cggacuuuucgcuuugcgcgc

SEQ ID NO: 1422370 - RNA, 13 nt, Pseudomonas aeruginosa PA01
cggacuugcggcc

SEQ ID NO: 1422371 - RNA, 19 nt, Pseudomonas aeruginosa PA01
cggacuugcggcccaccac

SEQ ID NO: 1422372 - RNA, 18 nt, Pseudomonas aeruginosa PA01
cggaucgaugcccggcug

SEQ ID NO: 1422373 - RNA, 19 nt, Pseudomonas aeruginosa PA01
cggaucgaugcccggcugg

SEQ ID NO: 1422374 - RNA, 13 nt, Pseudomonas aeruginosa PA01
cggaucgaucagc

SEQ ID NO: 1422375 - RNA, 16 nt, Pseudomonas aeruginosa PA01
cggaucgaucagcagc

SEQ ID NO: 1422376 - RNA, 15 nt, Pseudomonas aeruginosa PA01
cggaucgaucagcga

SEQ ID NO: 1422377 - RNA, 18 nt, Pseudomonas aeruginosa PA01
cggaucgaucgaucagcc

SEQ ID NO: 1422378 - RNA, 20 nt, Pseudomonas aeruginosa PA01
cggaucgagcagcggcgcca

SEQ ID NO: 1422379 - RNA, 19 nt, Pseudomonas aeruginosa PA01
cggaucgaaguagucggcg

SEQ ID NO: 1422380 - RNA, 20 nt, Pseudomonas aeruginosa PA01
cggaucgaaguagucggcgu

SEQ ID NO: 1422381 - RNA, 23 nt, Pseudomonas aeruginosa PA01
cggaucgaaguagucggcguagc

SEQ ID NO: 1422382 - RNA, 13 nt, Pseudomonas aeruginosa PA01
cggaucaccggcu

SEQ ID NO: 1422383 - RNA, 15 nt, Pseudomonas aeruginosa PA01
cggaucaccggcugg

SEQ ID NO: 1422384 - RNA, 17 nt, Pseudomonas aeruginosa PA01
cggaucaccggcuggcc

SEQ ID NO: 1422385 - RNA, 15 nt, Pseudomonas aeruginosa PA01
cggaucaccuggccg

SEQ ID NO: 1422386 - RNA, 18 nt, Pseudomonas aeruginosa PA01
cggaucaccuggccgugc

SEQ ID NO: 1422387 - RNA, 14 nt, Pseudomonas aeruginosa PA01
cggauaugcgccgc

SEQ ID NO: 1422388 - RNA, 19 nt, Pseudomonas aeruginosa PA01
cggaucaacuccgccaggc

SEQ ID NO: 1422389 - RNA, 20 nt, Pseudomonas aeruginosa PA01
cggaucaacuccgccaggcg

SEQ ID NO: 1422390 - RNA, 13 nt, Pseudomonas aeruginosa PA01
cggaucagcucga

SEQ ID NO: 1422391 - RNA, 18 nt, Pseudomonas aeruginosa PA01
cggaucagcucgaucagc

SEQ ID NO: 1422392 - RNA, 13 nt, Pseudomonas aeruginosa PA01
cggaucagcccgc

SEQ ID NO: 1422393 - RNA, 17 nt, Pseudomonas aeruginosa PA01
cggaucacggugccauc

SEQ ID NO: 1422394 - RNA, 19 nt, Pseudomonas aeruginosa PA01
cggaucacggugccauccg

SEQ ID NO: 1422395 - RNA, 13 nt, Pseudomonas aeruginosa PA01
cggaucugcucga

SEQ ID NO: 1422396 - RNA, 20 nt, Pseudomonas aeruginosa PA01
cggaucuggaauucgccgcg

SEQ ID NO: 1422397 - RNA, 22 nt, Pseudomonas aeruginosa PA01
cggaucuggaauucgccgcgcg

SEQ ID NO: 1422398 - RNA, 12 nt, Pseudomonas aeruginosa PA01
cggaugccggcg

SEQ ID NO: 1422399 - RNA, 17 nt, Pseudomonas aeruginosa PA01
cggaugccggcgcuguc

SEQ ID NO: 1422400 - RNA, 20 nt, Pseudomonas aeruginosa PA01
cggaucuaaggggcggcucg

SEQ ID NO: 1422401 - RNA, 15 nt, Pseudomonas aeruginosa PA01
cggaucucggugucg

SEQ ID NO: 1422402 - RNA, 13 nt, Pseudomonas aeruginosa PA01
cggaucgccgccu

SEQ ID NO: 1422403 - RNA, 14 nt, Pseudomonas aeruginosa PA01
cggaucgucgcggc

SEQ ID NO: 1422404 - RNA, 17 nt, Pseudomonas aeruginosa PA01
cggaucgucgcggcgcg

SEQ ID NO: 1422405 - RNA, 19 nt, Pseudomonas aeruginosa PA01
cggaucgucgcggcgcgag

SEQ ID NO: 1422406 - RNA, 18 nt, Pseudomonas aeruginosa PA01
cggagcguccaccagcgc

SEQ ID NO: 1422407 - RNA, 16 nt, Pseudomonas aeruginosa PA01
cggagcgucggaagcg

SEQ ID NO: 1422408 - RNA, 15 nt, Pseudomonas aeruginosa PA01
cggagcgucgggcgg

SEQ ID NO: 1422409 - RNA, 19 nt, Pseudomonas aeruginosa PA01
cggagcugguacgcccccu

SEQ ID NO: 1422410 - RNA, 22 nt, Pseudomonas aeruginosa PA01
cggagcugcaugagugucgcca

SEQ ID NO: 1422411 - RNA, 19 nt, Pseudomonas aeruginosa PA01
cggagcuuugcagggcgau

SEQ ID NO: 1422412 - RNA, 18 nt, Pseudomonas aeruginosa PA01
cggaggaaacccaugccc

SEQ ID NO: 1422413 - RNA, 13 nt, Pseudomonas aeruginosa PA01
cggaggcagcgau

SEQ ID NO: 1422414 - RNA, 20 nt, Pseudomonas aeruginosa PA01
cggaggcgaggucgccgggg

SEQ ID NO: 1422415 - RNA, 18 nt, Pseudomonas aeruginosa PA01
cggaggccuucgccgacc

SEQ ID NO: 1422416 - RNA, 22 nt, Pseudomonas aeruginosa PA01
cggauauucgacgcgcggcugc

SEQ ID NO: 1422417 - RNA, 16 nt, Pseudomonas aeruginosa PA01
cggauaucgcgccgcg

SEQ ID NO: 1422418 - RNA, 17 nt, Pseudomonas aeruginosa PA01
cggauaaucgcagcgcg

SEQ ID NO: 1422419 - RNA, 18 nt, Pseudomonas aeruginosa PA01
cggauaacaccguuggcg

SEQ ID NO: 1422420 - RNA, 16 nt, Pseudomonas aeruginosa PA01
cggauaaccgcaagcg

SEQ ID NO: 1422421 - RNA, 20 nt, Pseudomonas aeruginosa PA01
cggauaaccgcgagcgguua

SEQ ID NO: 1422422 - RNA, 21 nt, Pseudomonas aeruginosa PA01
cggauaaccgcguugcgguua

SEQ ID NO: 1422423 - RNA, 13 nt, Pseudomonas aeruginosa PA01
cggauaacgccag

SEQ ID NO: 1422424 - RNA, 18 nt, Pseudomonas aeruginosa PA01
cggauaacgcccgcggcg

SEQ ID NO: 1422425 - RNA, 19 nt, Pseudomonas aeruginosa PA01
cggauaacgcccgcggcgu

SEQ ID NO: 1422426 - RNA, 13 nt, Pseudomonas aeruginosa PA01
cggauaacgccgg

SEQ ID NO: 1422427 - RNA, 14 nt, Pseudomonas aeruginosa PA01
cggauaacgccggu

SEQ ID NO: 1422428 - RNA, 18 nt, Pseudomonas aeruginosa PA01
cggauaacgccguuggcg

SEQ ID NO: 1422429 - RNA, 18 nt, Pseudomonas aeruginosa PA01
cggauaacgccugcggcg

SEQ ID NO: 1422430 - RNA, 19 nt, Pseudomonas aeruginosa PA01
cggauaacgccugcggcgu

SEQ ID NO: 1422431 - RNA, 14 nt, Pseudomonas aeruginosa PA01
cggauaacgccugu

SEQ ID NO: 1422432 - RNA, 18 nt, Pseudomonas aeruginosa PA01
cgcuguaaagcgaguccg

SEQ ID NO: 1422433 - RNA, 13 nt, Pseudomonas aeruginosa PA01
cgcuguagccggc

SEQ ID NO: 1422434 - RNA, 17 nt, Pseudomonas aeruginosa PA01
cgcuguagccggcgccg

SEQ ID NO: 1422435 - RNA, 22 nt, Pseudomonas aeruginosa PA01
cgcuguacaagcgcaacgcgcg

SEQ ID NO: 1422436 - RNA, 23 nt, Pseudomonas aeruginosa PA01
cgcugguuggcgaggucgcggac

SEQ ID NO: 1422437 - RNA, 17 nt, Pseudomonas aeruginosa PA01
cgcugguugaggucgac

SEQ ID NO: 1422438 - RNA, 18 nt, Pseudomonas aeruginosa PA01
cgcugguugaggucgacg

SEQ ID NO: 1422439 - RNA, 19 nt, Pseudomonas aeruginosa PA01
cgcugguugaggucgacga

SEQ ID NO: 1422440 - RNA, 15 nt, Pseudomonas aeruginosa PA01
cgcugguugcccagg

SEQ ID NO: 1422441 - RNA, 13 nt, Pseudomonas aeruginosa PA01
cgcuggugccgac

SEQ ID NO: 1422442 - RNA, 19 nt, Pseudomonas aeruginosa PA01
cgcuggucguucucgcgca

SEQ ID NO: 1422443 - RNA, 21 nt, Pseudomonas aeruginosa PA01
cgcuggucguucucgcgcauc

SEQ ID NO: 1422444 - RNA, 14 nt, Pseudomonas aeruginosa PA01
cgcuggugaucgac

SEQ ID NO: 1422445 - RNA, 21 nt, Pseudomonas aeruginosa PA01
cgcuggugaucgaccacacau

SEQ ID NO: 1422446 - RNA, 18 nt, Pseudomonas aeruginosa PA01
cgcuggugacggugaccu

SEQ ID NO: 1422447 - RNA, 15 nt, Pseudomonas aeruginosa PA01
cggacaacaggccgg

SEQ ID NO: 1422448 - RNA, 16 nt, Pseudomonas aeruginosa PA01
cggacaacaggccggg

SEQ ID NO: 1422449 - RNA, 17 nt, Pseudomonas aeruginosa PA01
cggacaacaggccgggc

SEQ ID NO: 1422450 - RNA, 14 nt, Pseudomonas aeruginosa PA01
cggacaaccaccau

SEQ ID NO: 1422451 - RNA, 22 nt, Pseudomonas aeruginosa PA01
cggacaaccaccaugcggcuac

SEQ ID NO: 1422452 - RNA, 16 nt, Pseudomonas aeruginosa PA01
cgcuguaggcgagcag

SEQ ID NO: 1422453 - RNA, 20 nt, Pseudomonas aeruginosa PA01
cgcuguaggcgagcagcggc

SEQ ID NO: 1422454 - RNA, 15 nt, Pseudomonas aeruginosa PA01
cggacacgcaggcgc

SEQ ID NO: 1422455 - RNA, 16 nt, Pseudomonas aeruginosa PA01
cggacaaccgccguag

SEQ ID NO: 1422456 - RNA, 14 nt, Pseudomonas aeruginosa PA01
cggacaagggccag

SEQ ID NO: 1422457 - RNA, 18 nt, Pseudomonas aeruginosa PA01
cggacaagggccagagca

SEQ ID NO: 1422458 - RNA, 15 nt, Pseudomonas aeruginosa PA01
cggacaggccacccg

SEQ ID NO: 1422459 - RNA, 16 nt, Pseudomonas aeruginosa PA01
cggacaggccacccgc

SEQ ID NO: 1422460 - RNA, 21 nt, Pseudomonas aeruginosa PA01
cggacaggccacccgccucgu

SEQ ID NO: 1422461 - RNA, 14 nt, Pseudomonas aeruginosa PA01
cggacagcccgcgc

SEQ ID NO: 1422462 - RNA, 21 nt, Pseudomonas aeruginosa PA01
cggacagcccgcgcucggccg

SEQ ID NO: 1422463 - RNA, 23 nt, Pseudomonas aeruginosa PA01
cggacaugaaaaagccggaggca

SEQ ID NO: 1422464 - RNA, 16 nt, Pseudomonas aeruginosa PA01
cggaccagggcgccgg

SEQ ID NO: 1422465 - RNA, 18 nt, Pseudomonas aeruginosa PA01
cggaccagggcgccgggc

SEQ ID NO: 1422466 - RNA, 18 nt, Pseudomonas aeruginosa PA01
cggaccagcuccgaaggg

SEQ ID NO: 1422467 - RNA, 19 nt, Pseudomonas aeruginosa PA01
cggaccagcuccgaaggga

SEQ ID NO: 1422468 - RNA, 17 nt, Pseudomonas aeruginosa PA01
cggaccagaucggcgcg

SEQ ID NO: 1422469 - RNA, 20 nt, Pseudomonas aeruginosa PA01
cggaccagccggucccgggc

SEQ ID NO: 1422470 - RNA, 22 nt, Pseudomonas aeruginosa PA01
cggacauguugcagggucgccg

SEQ ID NO: 1422471 - RNA, 15 nt, Pseudomonas aeruginosa PA01
cggacgcaccagcag

SEQ ID NO: 1422472 - RNA, 18 nt, Pseudomonas aeruginosa PA01
cggacgcaccagcaggcc

SEQ ID NO: 1422473 - RNA, 21 nt, Pseudomonas aeruginosa PA01
cggacgcaccagcaggccgau

SEQ ID NO: 1422474 - RNA, 23 nt, Pseudomonas aeruginosa PA01
cggacgcaccagcaggccgauca

SEQ ID NO: 1422475 - RNA, 14 nt, Pseudomonas aeruginosa PA01
cggacgaucgacga

SEQ ID NO: 1422476 - RNA, 15 nt, Pseudomonas aeruginosa PA01
cggacgcaggccgac

SEQ ID NO: 1422477 - RNA, 16 nt, Pseudomonas aeruginosa PA01
cggacgcaggccgacc

SEQ ID NO: 1422478 - RNA, 22 nt, Pseudomonas aeruginosa PA01
cggacgcaggccgaccucggcg

SEQ ID NO: 1422479 - RNA, 12 nt, Pseudomonas aeruginosa PA01
cggacgccgaac

SEQ ID NO: 1422480 - RNA, 14 nt, Pseudomonas aeruginosa PA01
cggacgccgaacgc

SEQ ID NO: 1422481 - RNA, 12 nt, Pseudomonas aeruginosa PA01
cggacgccgaag

SEQ ID NO: 1422482 - RNA, 17 nt, Pseudomonas aeruginosa PA01
cggacgccgaagcgggc

SEQ ID NO: 1422483 - RNA, 18 nt, Pseudomonas aeruginosa PA01
cggacgauggucgccgcg

SEQ ID NO: 1422484 - RNA, 19 nt, Pseudomonas aeruginosa PA01
cggacgauggucgccgcga

SEQ ID NO: 1422485 - RNA, 22 nt, Pseudomonas aeruginosa PA01
cggacgauggucgccgcgaccu

SEQ ID NO: 1422486 - RNA, 15 nt, Pseudomonas aeruginosa PA01
cggacgagcuuuccu

SEQ ID NO: 1422487 - RNA, 22 nt, Pseudomonas aeruginosa PA01
cggacgaggauggucaggccgg

SEQ ID NO: 1422488 - RNA, 20 nt, Pseudomonas aeruginosa PA01
cggacgacaucucguccucg

SEQ ID NO: 1422489 - RNA, 16 nt, Pseudomonas aeruginosa PA01
cggacgcuggcgauca

SEQ ID NO: 1422490 - RNA, 19 nt, Pseudomonas aeruginosa PA01
cggacgcuggcgaucaugc

SEQ ID NO: 1422491 - RNA, 15 nt, Pseudomonas aeruginosa PA01
cggacgcgacgccuu

SEQ ID NO: 1422492 - RNA, 16 nt, Pseudomonas aeruginosa PA01
cggacgcgacugcugc

SEQ ID NO: 1422493 - RNA, 18 nt, Pseudomonas aeruginosa PA01
cggacgcgacugcugcug

SEQ ID NO: 1422494 - RNA, 16 nt, Pseudomonas aeruginosa PA01
cggacgcgaucccgcu

SEQ ID NO: 1422495 - RNA, 21 nt, Pseudomonas aeruginosa PA01
cggacgcgccgcgguuuccgu

SEQ ID NO: 1422496 - RNA, 17 nt, Pseudomonas aeruginosa PA01
cggacggcucgcgcagc

SEQ ID NO: 1422497 - RNA, 19 nt, Pseudomonas aeruginosa PA01
cggacggcugaggcuggcg

SEQ ID NO: 1422498 - RNA, 14 nt, Pseudomonas aeruginosa PA01
cggacgggccgcgc

SEQ ID NO: 1422499 - RNA, 15 nt, Pseudomonas aeruginosa PA01
cggacgggccgcgcc

SEQ ID NO: 1422500 - RNA, 17 nt, Pseudomonas aeruginosa PA01
cggacggccgcgccggc

SEQ ID NO: 1422501 - RNA, 15 nt, Pseudomonas aeruginosa PA01
cggacggccugcgcc

SEQ ID NO: 1422502 - RNA, 15 nt, Pseudomonas aeruginosa PA01
cggaccgccucgacc

SEQ ID NO: 1422503 - RNA, 17 nt, Pseudomonas aeruginosa PA01
cggaccgcagaaccaga

SEQ ID NO: 1422504 - RNA, 13 nt, Pseudomonas aeruginosa PA01
cggaccgcaaccg

SEQ ID NO: 1422505 - RNA, 21 nt, Pseudomonas aeruginosa PA01
cggaccgacguugagaaggcg

SEQ ID NO: 1422506 - RNA, 18 nt, Pseudomonas aeruginosa PA01
cggaccccggccuccagg

SEQ ID NO: 1422507 - RNA, 24 nt, Pseudomonas aeruginosa PA01
cggaccuccagccggccauccagc

SEQ ID NO: 1422508 - RNA, 18 nt, Pseudomonas aeruginosa PA01
cggaccugagaucagcgc

SEQ ID NO: 1422509 - RNA, 19 nt, Pseudomonas aeruginosa PA01
cggaccugagaucagcgcc

SEQ ID NO: 1422510 - RNA, 16 nt, Pseudomonas aeruginosa PA01
cggaccuugucgccgg

SEQ ID NO: 1422511 - RNA, 14 nt, Pseudomonas aeruginosa PA01
cggaccuucgacgg

SEQ ID NO: 1422512 - RNA, 16 nt, Pseudomonas aeruginosa PA01
cggaccuucgacggca

SEQ ID NO: 1422513 - RNA, 21 nt, Pseudomonas aeruginosa PA01
cggaccguggugacgguccgc

SEQ ID NO: 1422514 - RNA, 19 nt, Pseudomonas aeruginosa PA01
cggaccgggcgccucgucg

SEQ ID NO: 1422515 - RNA, 18 nt, Pseudomonas aeruginosa PA01
cggaccgggcggcaggcg

SEQ ID NO: 1422516 - RNA, 20 nt, Pseudomonas aeruginosa PA01
cggaccgggcggcaggcgcc

SEQ ID NO: 1422517 - RNA, 14 nt, Pseudomonas aeruginosa PA01
cggaccgggcggcg

SEQ ID NO: 1422518 - RNA, 13 nt, Pseudomonas aeruginosa PA01
cggcugcugcgcc

SEQ ID NO: 1422519 - RNA, 18 nt, Pseudomonas aeruginosa PA01
cggcugcugcgccuggcc

SEQ ID NO: 1422520 - RNA, 17 nt, Pseudomonas aeruginosa PA01
cggcugcgcugggcgcc

SEQ ID NO: 1422521 - RNA, 16 nt, Pseudomonas aeruginosa PA01
cggcugcgucguuggc

SEQ ID NO: 1422522 - RNA, 21 nt, Pseudomonas aeruginosa PA01
cggcugcgucguuggccggcu

SEQ ID NO: 1422523 - RNA, 19 nt, Pseudomonas aeruginosa PA01
cggcugcgugaggaucacg

SEQ ID NO: 1422524 - RNA, 14 nt, Pseudomonas aeruginosa PA01
cggcugcuccgggc

SEQ ID NO: 1422525 - RNA, 16 nt, Pseudomonas aeruginosa PA01
cggcugcuccgggcgg

SEQ ID NO: 1422526 - RNA, 23 nt, Pseudomonas aeruginosa PA01
cggcuggccauccauaucggcca

SEQ ID NO: 1422527 - RNA, 19 nt, Pseudomonas aeruginosa PA01
cggcuggccauccgcccug

SEQ ID NO: 1422528 - RNA, 21 nt, Pseudomonas aeruginosa PA01
cggcuggccgaggacccggcg

SEQ ID NO: 1422529 - RNA, 18 nt, Pseudomonas aeruginosa PA01
cggcuggccgagggcgcg

SEQ ID NO: 1422530 - RNA, 19 nt, Pseudomonas aeruginosa PA01
cggcuggccgagggcgcgc

SEQ ID NO: 1422531 - RNA, 14 nt, Pseudomonas aeruginosa PA01
cggcugcugcugcg

SEQ ID NO: 1422532 - RNA, 14 nt, Pseudomonas aeruginosa PA01
cggcugcuugccgc

SEQ ID NO: 1422533 - RNA, 15 nt, Pseudomonas aeruginosa PA01
cggcugcuugccgcu

SEQ ID NO: 1422534 - RNA, 19 nt, Pseudomonas aeruginosa PA01
cggcugcuugccggugcca

SEQ ID NO: 1422535 - RNA, 15 nt, Pseudomonas aeruginosa PA01
cggcugcuuggccag

SEQ ID NO: 1422536 - RNA, 11 nt, Pseudomonas aeruginosa PA01
cggcugccggu

SEQ ID NO: 1422537 - RNA, 20 nt, Pseudomonas aeruginosa PA01
cggcugccgguacgcaccag

SEQ ID NO: 1422538 - RNA, 22 nt, Pseudomonas aeruginosa PA01
cggcugccgguacgcaccagcg

SEQ ID NO: 1422539 - RNA, 13 nt, Pseudomonas aeruginosa PA01
cggcugcgccgcg

SEQ ID NO: 1422540 - RNA, 16 nt, Pseudomonas aeruginosa PA01
cggcugcgcgccgggu

SEQ ID NO: 1422541 - RNA, 23 nt, Pseudomonas aeruginosa PA01
cggcugcgcgccgggucgacaug

SEQ ID NO: 1422542 - RNA, 15 nt, Pseudomonas aeruginosa PA01
cggcugcccgggguu

SEQ ID NO: 1422543 - RNA, 22 nt, Pseudomonas aeruginosa PA01
cggcugcccaagggccugggcg

SEQ ID NO: 1422544 - RNA, 15 nt, Pseudomonas aeruginosa PA01
cggcugccgccagcu

SEQ ID NO: 1422545 - RNA, 16 nt, Pseudomonas aeruginosa PA01
cggcugccgccagcuc

SEQ ID NO: 1422546 - RNA, 13 nt, Pseudomonas aeruginosa PA01
cggcugcagggcc

SEQ ID NO: 1422547 - RNA, 13 nt, Pseudomonas aeruginosa PA01
cggcugaagaagc

SEQ ID NO: 1422548 - RNA, 19 nt, Pseudomonas aeruginosa PA01
cggcugcauguccgccagu

SEQ ID NO: 1422549 - RNA, 15 nt, Pseudomonas aeruginosa PA01
cggcugaccggcauc

SEQ ID NO: 1422550 - RNA, 16 nt, Pseudomonas aeruginosa PA01
cggcugaccggcaucg

SEQ ID NO: 1422551 - RNA, 22 nt, Pseudomonas aeruginosa PA01
cggcugaccggcaucgaccagc

SEQ ID NO: 1422552 - RNA, 16 nt, Pseudomonas aeruginosa PA01
cggcugaaggccgaac

SEQ ID NO: 1422553 - RNA, 21 nt, Pseudomonas aeruginosa PA01
cggcugaaggugagauggucg

SEQ ID NO: 1422554 - RNA, 14 nt, Pseudomonas aeruginosa PA01
cggcucuggaugcg

SEQ ID NO: 1422555 - RNA, 13 nt, Pseudomonas aeruginosa PA01
cggcucuggcgca

SEQ ID NO: 1422556 - RNA, 12 nt, Pseudomonas aeruginosa PA01
cggcucuucccc

SEQ ID NO: 1422557 - RNA, 21 nt, Pseudomonas aeruginosa PA01
cggcucguucaugucggcucc

SEQ ID NO: 1422558 - RNA, 16 nt, Pseudomonas aeruginosa PA01
cggcucgugucgacuc

SEQ ID NO: 1422559 - RNA, 16 nt, Pseudomonas aeruginosa PA01
cggcucucuucggccg

SEQ ID NO: 1422560 - RNA, 23 nt, Pseudomonas aeruginosa PA01
cggcucgucaucguccagcucgg

SEQ ID NO: 1422561 - RNA, 15 nt, Pseudomonas aeruginosa PA01
cggcucgugcgacuc

SEQ ID NO: 1422562 - RNA, 12 nt, Pseudomonas aeruginosa PA01
cggcucgucggc

SEQ ID NO: 1422563 - RNA, 14 nt, Pseudomonas aeruginosa PA01
cggcucgucggcgu

SEQ ID NO: 1422564 - RNA, 21 nt, Pseudomonas aeruginosa PA01
cggcucgguguaggcgaucug

SEQ ID NO: 1422565 - RNA, 15 nt, Pseudomonas aeruginosa PA01
cggcuccagggcgaa

SEQ ID NO: 1422566 - RNA, 18 nt, Pseudomonas aeruginosa PA01
cggcuccaguugcagcac

SEQ ID NO: 1422567 - RNA, 17 nt, Pseudomonas aeruginosa PA01
cggcuucagagcuggac

SEQ ID NO: 1422568 - RNA, 13 nt, Pseudomonas aeruginosa PA01
cggcuucagccag

SEQ ID NO: 1422569 - RNA, 17 nt, Pseudomonas aeruginosa PA01
cggcugugcucgacggg

SEQ ID NO: 1422570 - RNA, 20 nt, Pseudomonas aeruginosa PA01
cggcugugcucgacgggcgc

SEQ ID NO: 1422571 - RNA, 17 nt, Pseudomonas aeruginosa PA01
cggcugugcucgaggaa

SEQ ID NO: 1422572 - RNA, 15 nt, Pseudomonas aeruginosa PA01
cggcugugcagggca

SEQ ID NO: 1422573 - RNA, 18 nt, Pseudomonas aeruginosa PA01
cggcuguuucaggccggc

SEQ ID NO: 1422574 - RNA, 20 nt, Pseudomonas aeruginosa PA01
cggcuguuucaggccggcgu

SEQ ID NO: 1422575 - RNA, 20 nt, Pseudomonas aeruginosa PA01
cggcugguucugguccacca

SEQ ID NO: 1422576 - RNA, 23 nt, Pseudomonas aeruginosa PA01
cggcugguucugguccaccagcc

SEQ ID NO: 1422577 - RNA, 15 nt, Pseudomonas aeruginosa PA01
cggcugguugccagc

SEQ ID NO: 1422578 - RNA, 18 nt, Pseudomonas aeruginosa PA01
cggcugguugccagcagc

SEQ ID NO: 1422579 - RNA, 17 nt, Pseudomonas aeruginosa PA01
cggcuguagccacggcg

SEQ ID NO: 1422580 - RNA, 19 nt, Pseudomonas aeruginosa PA01
cggcugguggccguugagc

SEQ ID NO: 1422581 - RNA, 16 nt, Pseudomonas aeruginosa PA01
cggcuggucggcuucc

SEQ ID NO: 1422582 - RNA, 24 nt, Pseudomonas aeruginosa PA01
cggcuggucggcuuccgccgccag

SEQ ID NO: 1422583 - RNA, 14 nt, Pseudomonas aeruginosa PA01
cggcuggucgucgc

SEQ ID NO: 1422584 - RNA, 16 nt, Pseudomonas aeruginosa PA01
cggcuggucgucgcgg

SEQ ID NO: 1422585 - RNA, 15 nt, Pseudomonas aeruginosa PA01
cggcuggcagggcgc

SEQ ID NO: 1422586 - RNA, 16 nt, Pseudomonas aeruginosa PA01
cggcuggcagggcgcg

SEQ ID NO: 1422587 - RNA, 13 nt, Pseudomonas aeruginosa PA01
cggcuggccgccu

SEQ ID NO: 1422588 - RNA, 14 nt, Pseudomonas aeruginosa PA01
cggcuggccgccug

SEQ ID NO: 1422589 - RNA, 13 nt, Pseudomonas aeruginosa PA01
cggcuggccgcga

SEQ ID NO: 1422590 - RNA, 13 nt, Pseudomonas aeruginosa PA01
cggcuggccgucg

SEQ ID NO: 1422591 - RNA, 15 nt, Pseudomonas aeruginosa PA01
cggcuggccgucgac

SEQ ID NO: 1422592 - RNA, 18 nt, Pseudomonas aeruginosa PA01
cggcuggccgucgacccg

SEQ ID NO: 1422593 - RNA, 20 nt, Pseudomonas aeruginosa PA01
cggcuggccgucgacccgcc

SEQ ID NO: 1422594 - RNA, 16 nt, Pseudomonas aeruginosa PA01
cggcuggcgcuugccg

SEQ ID NO: 1422595 - RNA, 20 nt, Pseudomonas aeruginosa PA01
cggcuggcgcuugccgcgcc

SEQ ID NO: 1422596 - RNA, 16 nt, Pseudomonas aeruginosa PA01
cggcuggcggcucggc

SEQ ID NO: 1422597 - RNA, 14 nt, Pseudomonas aeruginosa PA01
cggcuggcgccggu

SEQ ID NO: 1422598 - RNA, 15 nt, Pseudomonas aeruginosa PA01
cggcuggcgcgaucg

SEQ ID NO: 1422599 - RNA, 16 nt, Pseudomonas aeruginosa PA01
cggcuggcugaagccg

SEQ ID NO: 1422600 - RNA, 19 nt, Pseudomonas aeruginosa PA01
cggcuggcguaccucgcca

SEQ ID NO: 1422601 - RNA, 18 nt, Pseudomonas aeruginosa PA01
cggcugggccaggaucag

SEQ ID NO: 1422602 - RNA, 16 nt, Pseudomonas aeruginosa PA01
cggcuggucgaagcgg

SEQ ID NO: 1422603 - RNA, 21 nt, Pseudomonas aeruginosa PA01
cggcuggucagaaccaccggu

SEQ ID NO: 1422604 - RNA, 16 nt, Pseudomonas aeruginosa PA01
cggcuggguucggcga

SEQ ID NO: 1422605 - RNA, 17 nt, Pseudomonas aeruginosa PA01
cggcuggguucggcgag

SEQ ID NO: 1422606 - RNA, 15 nt, Pseudomonas aeruginosa PA01
cggcugggcugcggg

SEQ ID NO: 1422607 - RNA, 14 nt, Pseudomonas aeruginosa PA01
cggcuuccugggcg

SEQ ID NO: 1422608 - RNA, 15 nt, Pseudomonas aeruginosa PA01
cggcuuccugggcga

SEQ ID NO: 1422609 - RNA, 20 nt, Pseudomonas aeruginosa PA01
cggcuuccagguacggcccg

SEQ ID NO: 1422610 - RNA, 22 nt, Pseudomonas aeruginosa PA01
cggcuuccagguacggcccgcg

SEQ ID NO: 1422611 - RNA, 13 nt, Pseudomonas aeruginosa PA01
cggcuuccgccgc

SEQ ID NO: 1422612 - RNA, 17 nt, Pseudomonas aeruginosa PA01
cggcuuccgccgccagg

SEQ ID NO: 1422613 - RNA, 13 nt, Pseudomonas aeruginosa PA01
cggcuucagcgcc

SEQ ID NO: 1422614 - RNA, 18 nt, Pseudomonas aeruginosa PA01
cggcuuggucacgccguu

SEQ ID NO: 1422615 - RNA, 16 nt, Pseudomonas aeruginosa PA01
cggcuugggucagcgg

SEQ ID NO: 1422616 - RNA, 20 nt, Pseudomonas aeruginosa PA01
cggcuuguucagcucggcgu

SEQ ID NO: 1422617 - RNA, 22 nt, Pseudomonas aeruginosa PA01
cggcuuguucagcucggcguag

SEQ ID NO: 1422618 - RNA, 16 nt, Pseudomonas aeruginosa PA01
cggcuugguucgcgcg

SEQ ID NO: 1422619 - RNA, 23 nt, Pseudomonas aeruginosa PA01
cggcuugguucgcgcgcuggucg

SEQ ID NO: 1422620 - RNA, 20 nt, Pseudomonas aeruginosa PA01
cggcuuuuucuugcgugcga

SEQ ID NO: 1422621 - RNA, 14 nt, Pseudomonas aeruginosa PA01
cggcuuuccucggc

SEQ ID NO: 1422622 - RNA, 15 nt, Pseudomonas aeruginosa PA01
cggcuuuccucggcc

SEQ ID NO: 1422623 - RNA, 16 nt, Pseudomonas aeruginosa PA01
cggcuuuccucggcca

SEQ ID NO: 1422624 - RNA, 17 nt, Pseudomonas aeruginosa PA01
cggcuuuccucggccau

SEQ ID NO: 1422625 - RNA, 21 nt, Pseudomonas aeruginosa PA01
cggcuuuccucggccaugccg

SEQ ID NO: 1422626 - RNA, 23 nt, Pseudomonas aeruginosa PA01
cggcuuucucccacagucgauga

SEQ ID NO: 1422627 - RNA, 20 nt, Pseudomonas aeruginosa PA01
cgggaaacagggcgacgccg

SEQ ID NO: 1422628 - RNA, 23 nt, Pseudomonas aeruginosa PA01
cgggaaagucugugaucaggcug

SEQ ID NO: 1422629 - RNA, 16 nt, Pseudomonas aeruginosa PA01
cggcguuguccaggcu

SEQ ID NO: 1422630 - RNA, 22 nt, Pseudomonas aeruginosa PA01
cggcguuguccaggcuguggcg

SEQ ID NO: 1422631 - RNA, 16 nt, Pseudomonas aeruginosa PA01
cggcguugucggccag

SEQ ID NO: 1422632 - RNA, 17 nt, Pseudomonas aeruginosa PA01
cggcguugucggccagc

SEQ ID NO: 1422633 - RNA, 21 nt, Pseudomonas aeruginosa PA01
cggcguugucggccagcagca

SEQ ID NO: 1422634 - RNA, 16 nt, Pseudomonas aeruginosa PA01
cggcguuuagcgcccg

SEQ ID NO: 1422635 - RNA, 20 nt, Pseudomonas aeruginosa PA01
cggcguuggcgucgcugccg

SEQ ID NO: 1422636 - RNA, 13 nt, Pseudomonas aeruginosa PA01
cggcguuucgccg

SEQ ID NO: 1422637 - RNA, 14 nt, Pseudomonas aeruginosa PA01
cggcguuucgccgg

SEQ ID NO: 1422638 - RNA, 16 nt, Pseudomonas aeruginosa PA01
cggcguuucgccgggc

SEQ ID NO: 1422639 - RNA, 18 nt, Pseudomonas aeruginosa PA01
cggcuaaccgccuucgcg

SEQ ID NO: 1422640 - RNA, 14 nt, Pseudomonas aeruginosa PA01
cggcuaaccgcgaa

SEQ ID NO: 1422641 - RNA, 21 nt, Pseudomonas aeruginosa PA01
cggcguuuuucauugggcagc

SEQ ID NO: 1422642 - RNA, 14 nt, Pseudomonas aeruginosa PA01
cggcuccaacggcc

SEQ ID NO: 1422643 - RNA, 16 nt, Pseudomonas aeruginosa PA01
cggcuccagccaggcc

SEQ ID NO: 1422644 - RNA, 19 nt, Pseudomonas aeruginosa PA01
cggcuccagccaggcccgg

SEQ ID NO: 1422645 - RNA, 18 nt, Pseudomonas aeruginosa PA01
cggcuccagccgcugcag

SEQ ID NO: 1422646 - RNA, 20 nt, Pseudomonas aeruginosa PA01
cggcuccagccgggcuccgc

SEQ ID NO: 1422647 - RNA, 19 nt, Pseudomonas aeruginosa PA01
cggcuccagcaccagcacg

SEQ ID NO: 1422648 - RNA, 22 nt, Pseudomonas aeruginosa PA01
cggcucaacugcuuaccuugcc

SEQ ID NO: 1422649 - RNA, 17 nt, Pseudomonas aeruginosa PA01
cggcucaauccggcugg

SEQ ID NO: 1422650 - RNA, 14 nt, Pseudomonas aeruginosa PA01
cggcguguccaggg

SEQ ID NO: 1422651 - RNA, 16 nt, Pseudomonas aeruginosa PA01
cggcgugcauggccgg

SEQ ID NO: 1422652 - RNA, 19 nt, Pseudomonas aeruginosa PA01
cggcguggucuccgugcug

SEQ ID NO: 1422653 - RNA, 15 nt, Pseudomonas aeruginosa PA01
cggcgugcaggccga

SEQ ID NO: 1422654 - RNA, 16 nt, Pseudomonas aeruginosa PA01
cggcgugcaggccgau

SEQ ID NO: 1422655 - RNA, 21 nt, Pseudomonas aeruginosa PA01
cggcgugcaggccgaucagga

SEQ ID NO: 1422656 - RNA, 14 nt, Pseudomonas aeruginosa PA01
cggcgugguugccu

SEQ ID NO: 1422657 - RNA, 20 nt, Pseudomonas aeruginosa PA01
cggcgugagggucgcgccga

SEQ ID NO: 1422658 - RNA, 23 nt, Pseudomonas aeruginosa PA01
cggcgugagggucgcgccgacga

SEQ ID NO: 1422659 - RNA, 16 nt, Pseudomonas aeruginosa PA01
cggcgugagcagggcc

SEQ ID NO: 1422660 - RNA, 20 nt, Pseudomonas aeruginosa PA01
cggcgugauccgcagguagc

SEQ ID NO: 1422661 - RNA, 18 nt, Pseudomonas aeruginosa PA01
cggcguguucaggugcug

SEQ ID NO: 1422662 - RNA, 17 nt, Pseudomonas aeruginosa PA01
cggcguugaacugcccg

SEQ ID NO: 1422663 - RNA, 14 nt, Pseudomonas aeruginosa PA01
cggcguuggccgag

SEQ ID NO: 1422664 - RNA, 14 nt, Pseudomonas aeruginosa PA01
cggcguccuugccg

SEQ ID NO: 1422665 - RNA, 15 nt, Pseudomonas aeruginosa PA01
cggcguccuugccga

SEQ ID NO: 1422666 - RNA, 17 nt, Pseudomonas aeruginosa PA01
cggcguccuugggaucg

SEQ ID NO: 1422667 - RNA, 17 nt, Pseudomonas aeruginosa PA01
cggcgucggcgagcagg

SEQ ID NO: 1422668 - RNA, 12 nt, Pseudomonas aeruginosa PA01
cggcgucggcgc

SEQ ID NO: 1422669 - RNA, 13 nt, Pseudomonas aeruginosa PA01
cggcgucggcgcg

SEQ ID NO: 1422670 - RNA, 18 nt, Pseudomonas aeruginosa PA01
cggcgucggcuggucgaa

SEQ ID NO: 1422671 - RNA, 23 nt, Pseudomonas aeruginosa PA01
cggcgucggcuggucgaagcgga

SEQ ID NO: 1422672 - RNA, 19 nt, Pseudomonas aeruginosa PA01
cggcgucggcgcgggcgcc

SEQ ID NO: 1422673 - RNA, 23 nt, Pseudomonas aeruginosa PA01
cggcgucggcgcgggcgccgaug

SEQ ID NO: 1422674 - RNA, 17 nt, Pseudomonas aeruginosa PA01
cggcgugaacgcggcga

SEQ ID NO: 1422675 - RNA, 19 nt, Pseudomonas aeruginosa PA01
cggcgugaacgcggcgaga

SEQ ID NO: 1422676 - RNA, 15 nt, Pseudomonas aeruginosa PA01
cggcgucgggcaggg

SEQ ID NO: 1422677 - RNA, 16 nt, Pseudomonas aeruginosa PA01
cggcgucgggcagggc

SEQ ID NO: 1422678 - RNA, 13 nt, Pseudomonas aeruginosa PA01
cggcgucgcgcuu

SEQ ID NO: 1422679 - RNA, 18 nt, Pseudomonas aeruginosa PA01
cggcgucgcgcuugccuu

SEQ ID NO: 1422680 - RNA, 13 nt, Pseudomonas aeruginosa PA01
cggcgucggcgaa

SEQ ID NO: 1422681 - RNA, 14 nt, Pseudomonas aeruginosa PA01
cggcgucggcaugg

SEQ ID NO: 1422682 - RNA, 15 nt, Pseudomonas aeruginosa PA01
cggcguccgccucgc

SEQ ID NO: 1422683 - RNA, 19 nt, Pseudomonas aeruginosa PA01
cggcguccgggugccccag

SEQ ID NO: 1422684 - RNA, 22 nt, Pseudomonas aeruginosa PA01
cggcguccgggugccccaggcg

SEQ ID NO: 1422685 - RNA, 23 nt, Pseudomonas aeruginosa PA01
cggcguccgggugccccaggcga

SEQ ID NO: 1422686 - RNA, 17 nt, Pseudomonas aeruginosa PA01
cggcguccgcggccugc

SEQ ID NO: 1422687 - RNA, 14 nt, Pseudomonas aeruginosa PA01
cggcguccucgcga

SEQ ID NO: 1422688 - RNA, 14 nt, Pseudomonas aeruginosa PA01
cggcguccucggag

SEQ ID NO: 1422689 - RNA, 17 nt, Pseudomonas aeruginosa PA01
cggcguccucggagagc

SEQ ID NO: 1422690 - RNA, 15 nt, Pseudomonas aeruginosa PA01
cggcguccuccucca

SEQ ID NO: 1422691 - RNA, 13 nt, Pseudomonas aeruginosa PA01
cggcguccuugcc

SEQ ID NO: 1422692 - RNA, 17 nt, Pseudomonas aeruginosa PA01
cggcguccauggcggcg

SEQ ID NO: 1422693 - RNA, 19 nt, Pseudomonas aeruginosa PA01
cggcguccauggcggcgau

SEQ ID NO: 1422694 - RNA, 21 nt, Pseudomonas aeruginosa PA01
cggcguccccuuccuccucgc

SEQ ID NO: 1422695 - RNA, 13 nt, Pseudomonas aeruginosa PA01
cggcgucccggcg

SEQ ID NO: 1422696 - RNA, 23 nt, Pseudomonas aeruginosa PA01
cggcggguagagucgcucgcgca

SEQ ID NO: 1422697 - RNA, 20 nt, Pseudomonas aeruginosa PA01
cggcgggucacgccgagggc

SEQ ID NO: 1422698 - RNA, 21 nt, Pseudomonas aeruginosa PA01
cggcgggucacgccgagggcg

SEQ ID NO: 1422699 - RNA, 16 nt, Pseudomonas aeruginosa PA01
cggcguccacuccggc

SEQ ID NO: 1422700 - RNA, 22 nt, Pseudomonas aeruginosa PA01
cggcguccacuccggcagcacc

SEQ ID NO: 1422701 - RNA, 23 nt, Pseudomonas aeruginosa PA01
cggcguccacuccggcagcaccc

SEQ ID NO: 1422702 - RNA, 18 nt, Pseudomonas aeruginosa PA01
cggcggcagcugcggcgg

SEQ ID NO: 1422703 - RNA, 14 nt, Pseudomonas aeruginosa PA01
cggcggcaggcgca

SEQ ID NO: 1422704 - RNA, 15 nt, Pseudomonas aeruginosa PA01
cggcggcaggucgga

SEQ ID NO: 1422705 - RNA, 20 nt, Pseudomonas aeruginosa PA01
cggcggcaggucggacaggc

SEQ ID NO: 1422706 - RNA, 22 nt, Pseudomonas aeruginosa PA01
cggcggcacgaccacaucggcc

SEQ ID NO: 1422707 - RNA, 13 nt, Pseudomonas aeruginosa PA01
cggcggcacgcuc

SEQ ID NO: 1422708 - RNA, 21 nt, Pseudomonas aeruginosa PA01
cggcggauuacuccgccggcg

SEQ ID NO: 1422709 - RNA, 13 nt, Pseudomonas aeruginosa PA01
cggcggccagcgg

SEQ ID NO: 1422710 - RNA, 14 nt, Pseudomonas aeruginosa PA01
cggcggccagcgga

SEQ ID NO: 1422711 - RNA, 14 nt, Pseudomonas aeruginosa PA01
cggcggccagcagc

SEQ ID NO: 1422712 - RNA, 21 nt, Pseudomonas aeruginosa PA01
cggcggccagcagcacggcga

SEQ ID NO: 1422713 - RNA, 22 nt, Pseudomonas aeruginosa PA01
cggcggccagcagcacggcgac

SEQ ID NO: 1422714 - RNA, 15 nt, Pseudomonas aeruginosa PA01
cggcggccauugccg

SEQ ID NO: 1422715 - RNA, 13 nt, Pseudomonas aeruginosa PA01
cggcggccaggcg

SEQ ID NO: 1422716 - RNA, 18 nt, Pseudomonas aeruginosa PA01
cggcggccgccaucgccc

SEQ ID NO: 1422717 - RNA, 20 nt, Pseudomonas aeruginosa PA01
cggcggccgccaucgcccgg

SEQ ID NO: 1422718 - RNA, 23 nt, Pseudomonas aeruginosa PA01
cggcggccgccaucgcccgguug

SEQ ID NO: 1422719 - RNA, 21 nt, Pseudomonas aeruginosa PA01
cggcggccgccucggcguaga

SEQ ID NO: 1422720 - RNA, 14 nt, Pseudomonas aeruginosa PA01
cggcggccgcaugc

SEQ ID NO: 1422721 - RNA, 15 nt, Pseudomonas aeruginosa PA01
cggcggcgcuauccg

SEQ ID NO: 1422722 - RNA, 14 nt, Pseudomonas aeruginosa PA01
cggcggcgcggggg

SEQ ID NO: 1422723 - RNA, 17 nt, Pseudomonas aeruginosa PA01
cggcggcgcgucggugc

SEQ ID NO: 1422724 - RNA, 19 nt, Pseudomonas aeruginosa PA01
cggcggcgcgucggugccg

SEQ ID NO: 1422725 - RNA, 21 nt, Pseudomonas aeruginosa PA01
cggcggcggaccuccgccagg

SEQ ID NO: 1422726 - RNA, 15 nt, Pseudomonas aeruginosa PA01
cggcggcgugcaggc

SEQ ID NO: 1422727 - RNA, 19 nt, Pseudomonas aeruginosa PA01
cggcggcgugcaggccgau

SEQ ID NO: 1422728 - RNA, 16 nt, Pseudomonas aeruginosa PA01
cggcggcguuggccga

SEQ ID NO: 1422729 - RNA, 19 nt, Pseudomonas aeruginosa PA01
cggcggcguuggccgagga

SEQ ID NO: 1422730 - RNA, 16 nt, Pseudomonas aeruginosa PA01
cggcggcucaacggga

SEQ ID NO: 1422731 - RNA, 16 nt, Pseudomonas aeruginosa PA01
cggcggcucaggccgc

SEQ ID NO: 1422732 - RNA, 19 nt, Pseudomonas aeruginosa PA01
cggcggcucaggccgccgc

SEQ ID NO: 1422733 - RNA, 21 nt, Pseudomonas aeruginosa PA01
cggcggcuaccagcgcuucgg

SEQ ID NO: 1422734 - RNA, 18 nt, Pseudomonas aeruginosa PA01
cggcggggcgcaccgccu

SEQ ID NO: 1422735 - RNA, 14 nt, Pseudomonas aeruginosa PA01
cggcggggcgcagc

SEQ ID NO: 1422736 - RNA, 14 nt, Pseudomonas aeruginosa PA01
cggcgggcugccgc

SEQ ID NO: 1422737 - RNA, 16 nt, Pseudomonas aeruginosa PA01
cggcgggcugccgcgg

SEQ ID NO: 1422738 - RNA, 18 nt, Pseudomonas aeruginosa PA01
cggcgggcugccgcggaa

SEQ ID NO: 1422739 - RNA, 14 nt, Pseudomonas aeruginosa PA01
cggcggcugcugcg

SEQ ID NO: 1422740 - RNA, 18 nt, Pseudomonas aeruginosa PA01
cggcggcugcugcgccug

SEQ ID NO: 1422741 - RNA, 17 nt, Pseudomonas aeruginosa PA01
cggcggcuccggcgcca

SEQ ID NO: 1422742 - RNA, 20 nt, Pseudomonas aeruginosa PA01
cggcgggcgguagcgggcca

SEQ ID NO: 1422743 - RNA, 14 nt, Pseudomonas aeruginosa PA01
cggcggccucggcc

SEQ ID NO: 1422744 - RNA, 14 nt, Pseudomonas aeruginosa PA01
cggcggccugcccc

SEQ ID NO: 1422745 - RNA, 18 nt, Pseudomonas aeruginosa PA01
cggcggcgacgcuggcgg

SEQ ID NO: 1422746 - RNA, 14 nt, Pseudomonas aeruginosa PA01
cggcggcgcgcagc

SEQ ID NO: 1422747 - RNA, 12 nt, Pseudomonas aeruginosa PA01
cggcggcgcggc

SEQ ID NO: 1422748 - RNA, 17 nt, Pseudomonas aeruginosa PA01
cggcggcgcgcugcggg

SEQ ID NO: 1422749 - RNA, 14 nt, Pseudomonas aeruginosa PA01
cggcggccugcucg

SEQ ID NO: 1422750 - RNA, 17 nt, Pseudomonas aeruginosa PA01
cggcggccugcucgcgc

SEQ ID NO: 1422751 - RNA, 17 nt, Pseudomonas aeruginosa PA01
cggcggcgacccagacc

SEQ ID NO: 1422752 - RNA, 19 nt, Pseudomonas aeruginosa PA01
cggcggcgacccagaccug

SEQ ID NO: 1422753 - RNA, 17 nt, Pseudomonas aeruginosa PA01
cggcggacgcaggccga

SEQ ID NO: 1422754 - RNA, 18 nt, Pseudomonas aeruginosa PA01
cggcggaccuccgccagg

SEQ ID NO: 1422755 - RNA, 15 nt, Pseudomonas aeruginosa PA01
cggcggacgacgaag

SEQ ID NO: 1422756 - RNA, 15 nt, Pseudomonas aeruginosa PA01
cggcggaucagcccg

SEQ ID NO: 1422757 - RNA, 23 nt, Pseudomonas aeruginosa PA01
cggcggagucguagcgcaugccg

SEQ ID NO: 1422758 - RNA, 23 nt, Pseudomonas aeruginosa PA01
cggcggauaaacggcaugcacgc

SEQ ID NO: 1422759 - RNA, 21 nt, Pseudomonas aeruginosa PA01
cggcggauaacaccguuggcg

SEQ ID NO: 1422760 - RNA, 18 nt, Pseudomonas aeruginosa PA01
cggcggauaaccgcgagc

SEQ ID NO: 1422761 - RNA, 21 nt, Pseudomonas aeruginosa PA01
cggcggauaaccgcguugcgg

SEQ ID NO: 1422762 - RNA, 21 nt, Pseudomonas aeruginosa PA01
cggcggauaacgccgauggcg

SEQ ID NO: 1422763 - RNA, 21 nt, Pseudomonas aeruginosa PA01
cggcggauaacgccgcuggcg

SEQ ID NO: 1422764 - RNA, 21 nt, Pseudomonas aeruginosa PA01
cggcggauaacgccguuggcg

SEQ ID NO: 1422765 - RNA, 16 nt, Pseudomonas aeruginosa PA01
cggcggauaacgccug

SEQ ID NO: 1422766 - RNA, 20 nt, Pseudomonas aeruginosa PA01
cggcggauaacgcuucgcag

SEQ ID NO: 1422767 - RNA, 17 nt, Pseudomonas aeruginosa PA01
cggcggauacaggcgca

SEQ ID NO: 1422768 - RNA, 18 nt, Pseudomonas aeruginosa PA01
cggcggauacaggcgcag

SEQ ID NO: 1422769 - RNA, 19 nt, Pseudomonas aeruginosa PA01
cggcggauacaggcgcagc

SEQ ID NO: 1422770 - RNA, 16 nt, Pseudomonas aeruginosa PA01
cggcggaucgaucagc

SEQ ID NO: 1422771 - RNA, 22 nt, Pseudomonas aeruginosa PA01
cggcggaucgaucgaucagccg

SEQ ID NO: 1422772 - RNA, 22 nt, Pseudomonas aeruginosa PA01
cggcggauugacgauggccagc

SEQ ID NO: 1422773 - RNA, 23 nt, Pseudomonas aeruginosa PA01
cggcggauugacgauggccagcc

SEQ ID NO: 1422774 - RNA, 16 nt, Pseudomonas aeruginosa PA01
cggcggauugccagca

SEQ ID NO: 1422775 - RNA, 21 nt, Pseudomonas aeruginosa PA01
cggcggaagucgaagcagccg

SEQ ID NO: 1422776 - RNA, 13 nt, Pseudomonas aeruginosa PA01
cggcggaaggcgg

SEQ ID NO: 1422777 - RNA, 15 nt, Pseudomonas aeruginosa PA01
cggcggaaggcggcg

SEQ ID NO: 1422778 - RNA, 20 nt, Pseudomonas aeruginosa PA01
cggcggacaaccaccaugcg

SEQ ID NO: 1422779 - RNA, 13 nt, Pseudomonas aeruginosa PA01
cggcggacagccc

SEQ ID NO: 1422780 - RNA, 17 nt, Pseudomonas aeruginosa PA01
cggcggacagcccgcgc

SEQ ID NO: 1422781 - RNA, 14 nt, Pseudomonas aeruginosa PA01
cggcggacagcgga

SEQ ID NO: 1422782 - RNA, 19 nt, Pseudomonas aeruginosa PA01
cggcggaacuugucgccgc

SEQ ID NO: 1422783 - RNA, 17 nt, Pseudomonas aeruginosa PA01
cggcggaagaagcccuu

SEQ ID NO: 1422784 - RNA, 15 nt, Pseudomonas aeruginosa PA01
cggcgcugucgccgu

SEQ ID NO: 1422785 - RNA, 13 nt, Pseudomonas aeruginosa PA01
cggcgcuucugcg

SEQ ID NO: 1422786 - RNA, 21 nt, Pseudomonas aeruginosa PA01
cggcgcuucugcgagccgcgc

SEQ ID NO: 1422787 - RNA, 13 nt, Pseudomonas aeruginosa PA01
cggcgcuuugcug

SEQ ID NO: 1422788 - RNA, 18 nt, Pseudomonas aeruginosa PA01
cggcgcuuugcugcacgc

SEQ ID NO: 1422789 - RNA, 17 nt, Pseudomonas aeruginosa PA01
cggcgcuucgcgcagga

SEQ ID NO: 1422790 - RNA, 13 nt, Pseudomonas aeruginosa PA01
cggcgcuuggcga

SEQ ID NO: 1422791 - RNA, 17 nt, Pseudomonas aeruginosa PA01
cggcgcuuucaucaggc

SEQ ID NO: 1422792 - RNA, 18 nt, Pseudomonas aeruginosa PA01
cggcgcuuucaucaggcg

SEQ ID NO: 1422793 - RNA, 19 nt, Pseudomonas aeruginosa PA01
cggcgcuuucaucaggcgc

SEQ ID NO: 1422794 - RNA, 20 nt, Pseudomonas aeruginosa PA01
cggcgcuuucaucaggcgcu

SEQ ID NO: 1422795 - RNA, 18 nt, Pseudomonas aeruginosa PA01
cggcgcucggcuccagcc

SEQ ID NO: 1422796 - RNA, 21 nt, Pseudomonas aeruginosa PA01
cggcgcucggcuccagccagg

SEQ ID NO: 1422797 - RNA, 23 nt, Pseudomonas aeruginosa PA01
cggcgcucggcuccagccaggcc

SEQ ID NO: 1422798 - RNA, 12 nt, Pseudomonas aeruginosa PA01
cggcgcucggga

SEQ ID NO: 1422799 - RNA, 17 nt, Pseudomonas aeruginosa PA01
cggcgcucgggauggcc

SEQ ID NO: 1422800 - RNA, 12 nt, Pseudomonas aeruginosa PA01
cggcgcucggca

SEQ ID NO: 1422801 - RNA, 14 nt, Pseudomonas aeruginosa PA01
cggcgcucggccag

SEQ ID NO: 1422802 - RNA, 16 nt, Pseudomonas aeruginosa PA01
cggcgcucggccaggu

SEQ ID NO: 1422803 - RNA, 19 nt, Pseudomonas aeruginosa PA01
cggcgcucggccaggucgc

SEQ ID NO: 1422804 - RNA, 14 nt, Pseudomonas aeruginosa PA01
cggcgcugaccucg

SEQ ID NO: 1422805 - RNA, 20 nt, Pseudomonas aeruginosa PA01
cggcgcugaccucgauggcg

SEQ ID NO: 1422806 - RNA, 18 nt, Pseudomonas aeruginosa PA01
cggcgcucuucagcacgc

SEQ ID NO: 1422807 - RNA, 22 nt, Pseudomonas aeruginosa PA01
cggcgcucuucagcacgcccag

SEQ ID NO: 1422808 - RNA, 18 nt, Pseudomonas aeruginosa PA01
cggcgcugaacagcuggc

SEQ ID NO: 1422809 - RNA, 21 nt, Pseudomonas aeruginosa PA01
cggcgcugaacagcuggcgcg

SEQ ID NO: 1422810 - RNA, 22 nt, Pseudomonas aeruginosa PA01
cggcgcugaacagcuggcgcgu

SEQ ID NO: 1422811 - RNA, 12 nt, Pseudomonas aeruginosa PA01
cggcgcugccga

SEQ ID NO: 1422812 - RNA, 17 nt, Pseudomonas aeruginosa PA01
cggcgcugccgaacagc

SEQ ID NO: 1422813 - RNA, 15 nt, Pseudomonas aeruginosa PA01
cggcgcugccggcca

SEQ ID NO: 1422814 - RNA, 16 nt, Pseudomonas aeruginosa PA01
cggcgcugccggccag

SEQ ID NO: 1422815 - RNA, 17 nt, Pseudomonas aeruginosa PA01
cggcgcugccggccagg

SEQ ID NO: 1422816 - RNA, 14 nt, Pseudomonas aeruginosa PA01
cggcgcugcccggg

SEQ ID NO: 1422817 - RNA, 14 nt, Pseudomonas aeruginosa PA01
cggcgcuggcgcgg

SEQ ID NO: 1422818 - RNA, 16 nt, Pseudomonas aeruginosa PA01
cggcgcuggccgcgcg

SEQ ID NO: 1422819 - RNA, 17 nt, Pseudomonas aeruginosa PA01
cggcgcuggccgcgcga

SEQ ID NO: 1422820 - RNA, 19 nt, Pseudomonas aeruginosa PA01
cggcgcuggucucuuccag

SEQ ID NO: 1422821 - RNA, 23 nt, Pseudomonas aeruginosa PA01
cggcgcuggucucuuccagcaug

SEQ ID NO: 1422822 - RNA, 16 nt, Pseudomonas aeruginosa PA01
cggcgcugucucgcca

SEQ ID NO: 1422823 - RNA, 18 nt, Pseudomonas aeruginosa PA01
cggcgcuguuugcggcgc

SEQ ID NO: 1422824 - RNA, 23 nt, Pseudomonas aeruginosa PA01
cggcgcuguuugcggcgcaggcg

SEQ ID NO: 1422825 - RNA, 20 nt, Pseudomonas aeruginosa PA01
cggcgcuggagagauagagc

SEQ ID NO: 1422826 - RNA, 13 nt, Pseudomonas aeruginosa PA01
cggcgcuggccgc

SEQ ID NO: 1422827 - RNA, 12 nt, Pseudomonas aeruginosa PA01
cggcgcggcgua

SEQ ID NO: 1422828 - RNA, 22 nt, Pseudomonas aeruginosa PA01
cggcgcggcguaccagccgcgg

SEQ ID NO: 1422829 - RNA, 16 nt, Pseudomonas aeruginosa PA01
cggcgcggcguggcgg

SEQ ID NO: 1422830 - RNA, 22 nt, Pseudomonas aeruginosa PA01
cggcgcggcuacccucucccca

SEQ ID NO: 1422831 - RNA, 21 nt, Pseudomonas aeruginosa PA01
cggcgccaucgaucagcagcg

SEQ ID NO: 1422832 - RNA, 23 nt, Pseudomonas aeruginosa PA01
cggcgccaucgaucagcagcgcc

SEQ ID NO: 1422833 - RNA, 16 nt, Pseudomonas aeruginosa PA01
cggcgccaguucgccg

SEQ ID NO: 1422834 - RNA, 22 nt, Pseudomonas aeruginosa PA01
cggcgccauaccggcaaggcgg

SEQ ID NO: 1422835 - RNA, 16 nt, Pseudomonas aeruginosa PA01
cggcgccauaggccag

SEQ ID NO: 1422836 - RNA, 16 nt, Pseudomonas aeruginosa PA01
cggcgccaggcguucc

SEQ ID NO: 1422837 - RNA, 20 nt, Pseudomonas aeruginosa PA01
cggcgccaggcguuccagcu

SEQ ID NO: 1422838 - RNA, 13 nt, Pseudomonas aeruginosa PA01
cggcgccaggccc

SEQ ID NO: 1422839 - RNA, 23 nt, Pseudomonas aeruginosa PA01
cggcgccaggcccucggcgacca

SEQ ID NO: 1422840 - RNA, 15 nt, Pseudomonas aeruginosa PA01
cggcgccaggccggc

SEQ ID NO: 1422841 - RNA, 19 nt, Pseudomonas aeruginosa PA01
cggcgccaggccggcgagg

SEQ ID NO: 1422842 - RNA, 15 nt, Pseudomonas aeruginosa PA01
cggcgcgggcgccga

SEQ ID NO: 1422843 - RNA, 16 nt, Pseudomonas aeruginosa PA01
cggcgcgggcgccgau

SEQ ID NO: 1422844 - RNA, 17 nt, Pseudomonas aeruginosa PA01
cggcgcgggcgccgaug

SEQ ID NO: 1422845 - RNA, 14 nt, Pseudomonas aeruginosa PA01
cggcgcgggcgcgc

SEQ ID NO: 1422846 - RNA, 12 nt, Pseudomonas aeruginosa PA01
cggcgccacccu

SEQ ID NO: 1422847 - RNA, 19 nt, Pseudomonas aeruginosa PA01
cggcgccaccgauucgccg

SEQ ID NO: 1422848 - RNA, 13 nt, Pseudomonas aeruginosa PA01
cggcgccaccccg

SEQ ID NO: 1422849 - RNA, 15 nt, Pseudomonas aeruginosa PA01
cggcgccaccccgcc

SEQ ID NO: 1422850 - RNA, 17 nt, Pseudomonas aeruginosa PA01
cggcgccaccccgccgc

SEQ ID NO: 1422851 - RNA, 14 nt, Pseudomonas aeruginosa PA01
cggcgccagcgccc

SEQ ID NO: 1422852 - RNA, 17 nt, Pseudomonas aeruginosa PA01
cggcgccagcgccccac

SEQ ID NO: 1422853 - RNA, 22 nt, Pseudomonas aeruginosa PA01
cggcgccagcgccccaccaggc

SEQ ID NO: 1422854 - RNA, 16 nt, Pseudomonas aeruginosa PA01
cggcgccagcuccagc

SEQ ID NO: 1422855 - RNA, 19 nt, Pseudomonas aeruginosa PA01
cggcgccagcuccagcgcc

SEQ ID NO: 1422856 - RNA, 16 nt, Pseudomonas aeruginosa PA01
cggcgcaugccgcagg

SEQ ID NO: 1422857 - RNA, 15 nt, Pseudomonas aeruginosa PA01
cggcgcaugcgccgg

SEQ ID NO: 1422858 - RNA, 14 nt, Pseudomonas aeruginosa PA01
cggcgcaucggcgg

SEQ ID NO: 1422859 - RNA, 15 nt, Pseudomonas aeruginosa PA01
cggcgcaucggcgga

SEQ ID NO: 1422860 - RNA, 18 nt, Pseudomonas aeruginosa PA01
cggcgcaucgucgaaacg

SEQ ID NO: 1422861 - RNA, 12 nt, Pseudomonas aeruginosa PA01
cggcgccacccc

SEQ ID NO: 1422862 - RNA, 18 nt, Pseudomonas aeruginosa PA01
cggcgccaacucggccug

SEQ ID NO: 1422863 - RNA, 20 nt, Pseudomonas aeruginosa PA01
cggcgccaacugcuugccga

SEQ ID NO: 1422864 - RNA, 13 nt, Pseudomonas aeruginosa PA01
cggcgcgucggcg

SEQ ID NO: 1422865 - RNA, 14 nt, Pseudomonas aeruginosa PA01
cggcgcgucggcgg

SEQ ID NO: 1422866 - RNA, 19 nt, Pseudomonas aeruginosa PA01
cggcgcgucggcggugucg

SEQ ID NO: 1422867 - RNA, 14 nt, Pseudomonas aeruginosa PA01
cggcgcgucuccau

SEQ ID NO: 1422868 - RNA, 15 nt, Pseudomonas aeruginosa PA01
cggcgcguccaccug

SEQ ID NO: 1422869 - RNA, 17 nt, Pseudomonas aeruginosa PA01
cggcgcgucccugggcg

SEQ ID NO: 1422870 - RNA, 22 nt, Pseudomonas aeruginosa PA01
cggcgcgucccugggcgcaggg

SEQ ID NO: 1422871 - RNA, 15 nt, Pseudomonas aeruginosa PA01
cggcgcgucgcucau

SEQ ID NO: 1422872 - RNA, 15 nt, Pseudomonas aeruginosa PA01
cggcgcgucgcugcg

SEQ ID NO: 1422873 - RNA, 15 nt, Pseudomonas aeruginosa PA01
cggcgcgggcggccu

SEQ ID NO: 1422874 - RNA, 18 nt, Pseudomonas aeruginosa PA01
cggcgcgggcggccucga

SEQ ID NO: 1422875 - RNA, 19 nt, Pseudomonas aeruginosa PA01
cggcgcggugagggcgacg

SEQ ID NO: 1422876 - RNA, 22 nt, Pseudomonas aeruginosa PA01
cggcgcggugccgugggucgcc

SEQ ID NO: 1422877 - RNA, 23 nt, Pseudomonas aeruginosa PA01
cggcgcggugccgugggucgccu

SEQ ID NO: 1422878 - RNA, 23 nt, Pseudomonas aeruginosa PA01
cggcgcguagaggaugccggccu

SEQ ID NO: 1422879 - RNA, 23 nt, Pseudomonas aeruginosa PA01
cggcgcguaggcgaacacgucgg

SEQ ID NO: 1422880 - RNA, 17 nt, Pseudomonas aeruginosa PA01
cggcgcgguuucgcagc

SEQ ID NO: 1422881 - RNA, 18 nt, Pseudomonas aeruginosa PA01
cggcgcgguuucgcagcg

SEQ ID NO: 1422882 - RNA, 19 nt, Pseudomonas aeruginosa PA01
cggcgcgguuucgcagcgc

SEQ ID NO: 1422883 - RNA, 16 nt, Pseudomonas aeruginosa PA01
cggcgcguuggcuggc

SEQ ID NO: 1422884 - RNA, 18 nt, Pseudomonas aeruginosa PA01
cggcgcguuggcuggcgg

SEQ ID NO: 1422885 - RNA, 23 nt, Pseudomonas aeruginosa PA01
cggcgcguuuuuccgcgaggaaa

SEQ ID NO: 1422886 - RNA, 14 nt, Pseudomonas aeruginosa PA01
cggcgcgucggugc

SEQ ID NO: 1422887 - RNA, 13 nt, Pseudomonas aeruginosa PA01
cggcgcuauccgc

SEQ ID NO: 1422888 - RNA, 13 nt, Pseudomonas aeruginosa PA01
cggcgcuccgccg

SEQ ID NO: 1422889 - RNA, 19 nt, Pseudomonas aeruginosa PA01
cggcgcuccgccgaacgcc

SEQ ID NO: 1422890 - RNA, 15 nt, Pseudomonas aeruginosa PA01
cggcgcuccaacagc

SEQ ID NO: 1422891 - RNA, 18 nt, Pseudomonas aeruginosa PA01
cggcgcuccaacagcagg

SEQ ID NO: 1422892 - RNA, 21 nt, Pseudomonas aeruginosa PA01
cggcgcuccacagcugccagc

SEQ ID NO: 1422893 - RNA, 22 nt, Pseudomonas aeruginosa PA01
cggcgcuccacagcugccagcc

SEQ ID NO: 1422894 - RNA, 23 nt, Pseudomonas aeruginosa PA01
cggcgcuccacagcugccagccc

SEQ ID NO: 1422895 - RNA, 13 nt, Pseudomonas aeruginosa PA01
cggcgcuccaggc

SEQ ID NO: 1422896 - RNA, 13 nt, Pseudomonas aeruginosa PA01
cggcgcucaccgc

SEQ ID NO: 1422897 - RNA, 15 nt, Pseudomonas aeruginosa PA01
cggcgcucacccaca

SEQ ID NO: 1422898 - RNA, 16 nt, Pseudomonas aeruginosa PA01
cggcgcuacgaaggcg

SEQ ID NO: 1422899 - RNA, 22 nt, Pseudomonas aeruginosa PA01
cggcgcuacgaaggcgugccgc

SEQ ID NO: 1422900 - RNA, 16 nt, Pseudomonas aeruginosa PA01
cgggguucgacgcgcc

SEQ ID NO: 1422901 - RNA, 21 nt, Pseudomonas aeruginosa PA01
cgggguucuugucgaccagcg

SEQ ID NO: 1422902 - RNA, 17 nt, Pseudomonas aeruginosa PA01
cgggguugcccagcagg

SEQ ID NO: 1422903 - RNA, 19 nt, Pseudomonas aeruginosa PA01
cgggguuuccucgaagcgc

SEQ ID NO: 1422904 - RNA, 17 nt, Pseudomonas aeruginosa PA01
cgggguuggcgcugacc

SEQ ID NO: 1422905 - RNA, 15 nt, Pseudomonas aeruginosa PA01
cggguaaagcgcccg

SEQ ID NO: 1422906 - RNA, 16 nt, Pseudomonas aeruginosa PA01
cggguaaagcgcccgc

SEQ ID NO: 1422907 - RNA, 17 nt, Pseudomonas aeruginosa PA01
cggguaaagcgcccgcg

SEQ ID NO: 1422908 - RNA, 21 nt, Pseudomonas aeruginosa PA01
cggguaaagcgcccgcgcaug

SEQ ID NO: 1422909 - RNA, 13 nt, Pseudomonas aeruginosa PA01
cggguagcugcug

SEQ ID NO: 1422910 - RNA, 19 nt, Pseudomonas aeruginosa PA01
cggguagcguuaucgccgg

SEQ ID NO: 1422911 - RNA, 19 nt, Pseudomonas aeruginosa PA01
cggguaguguuugcgcagg

SEQ ID NO: 1422912 - RNA, 23 nt, Pseudomonas aeruginosa PA01
cggguaguguuugcgcagggcgu

SEQ ID NO: 1422913 - RNA, 22 nt, Pseudomonas aeruginosa PA01
cggguauagaaaucgaucgagc

SEQ ID NO: 1422914 - RNA, 17 nt, Pseudomonas aeruginosa PA01
cggguauccagcacccg

SEQ ID NO: 1422915 - RNA, 15 nt, Pseudomonas aeruginosa PA01
cggguauccgccggg

SEQ ID NO: 1422916 - RNA, 21 nt, Pseudomonas aeruginosa PA01
cggguaucgaucucgaucgag

SEQ ID NO: 1422917 - RNA, 22 nt, Pseudomonas aeruginosa PA01
cggguaucgaucucgaucgagu

SEQ ID NO: 1422918 - RNA, 16 nt, Pseudomonas aeruginosa PA01
cggguaguagaucagc

SEQ ID NO: 1422919 - RNA, 15 nt, Pseudomonas aeruginosa PA01
cggguaguccagcga

SEQ ID NO: 1422920 - RNA, 23 nt, Pseudomonas aeruginosa PA01
cggguagucuucgaugcgccgca

SEQ ID NO: 1422921 - RNA, 20 nt, Pseudomonas aeruginosa PA01
cggguacagcgccacggcca

SEQ ID NO: 1422922 - RNA, 22 nt, Pseudomonas aeruginosa PA01
cggguacagcgccacggccagc

SEQ ID NO: 1422923 - RNA, 22 nt, Pseudomonas aeruginosa PA01
cggguacuggcgcugcgcggcg

SEQ ID NO: 1422924 - RNA, 23 nt, Pseudomonas aeruginosa PA01
cggguacuggcgcugcgcggcgu

SEQ ID NO: 1422925 - RNA, 22 nt, Pseudomonas aeruginosa PA01
cggguagaugccacugacgcgc

SEQ ID NO: 1422926 - RNA, 14 nt, Pseudomonas aeruginosa PA01
cggguagagcgggc

SEQ ID NO: 1422927 - RNA, 14 nt, Pseudomonas aeruginosa PA01
cggguagagucgcu

SEQ ID NO: 1422928 - RNA, 13 nt, Pseudomonas aeruginosa PA01
cggguccaggcgc

SEQ ID NO: 1422929 - RNA, 19 nt, Pseudomonas aeruginosa PA01
cggguccagcggccgcgcc

SEQ ID NO: 1422930 - RNA, 22 nt, Pseudomonas aeruginosa PA01
cggguccaucugcaacgcggcg

SEQ ID NO: 1422931 - RNA, 15 nt, Pseudomonas aeruginosa PA01
cgggucgcgcagcgg

SEQ ID NO: 1422932 - RNA, 16 nt, Pseudomonas aeruginosa PA01
cgggucgcgcagcggc

SEQ ID NO: 1422933 - RNA, 18 nt, Pseudomonas aeruginosa PA01
cgggucaucaccggcagg

SEQ ID NO: 1422934 - RNA, 16 nt, Pseudomonas aeruginosa PA01
cgggucaugccgccau

SEQ ID NO: 1422935 - RNA, 23 nt, Pseudomonas aeruginosa PA01
cgggucaugccgccaucgaccag

SEQ ID NO: 1422936 - RNA, 16 nt, Pseudomonas aeruginosa PA01
cgggucauuggcgaag

SEQ ID NO: 1422937 - RNA, 17 nt, Pseudomonas aeruginosa PA01
cgggucauuggcgaagu

SEQ ID NO: 1422938 - RNA, 14 nt, Pseudomonas aeruginosa PA01
cgggucaucggccc

SEQ ID NO: 1422939 - RNA, 15 nt, Pseudomonas aeruginosa PA01
cgggucaucggcccg

SEQ ID NO: 1422940 - RNA, 16 nt, Pseudomonas aeruginosa PA01
cgggucaucggcccga

SEQ ID NO: 1422941 - RNA, 18 nt, Pseudomonas aeruginosa PA01
cgggucaucggcccgacg

SEQ ID NO: 1422942 - RNA, 13 nt, Pseudomonas aeruginosa PA01
cgggucgucgguc

SEQ ID NO: 1422943 - RNA, 17 nt, Pseudomonas aeruginosa PA01
cgggucgucggucggcc

SEQ ID NO: 1422944 - RNA, 22 nt, Pseudomonas aeruginosa PA01
cgggucgucggucggccaggac

SEQ ID NO: 1422945 - RNA, 19 nt, Pseudomonas aeruginosa PA01
cgggucucgaucagcgccg

SEQ ID NO: 1422946 - RNA, 20 nt, Pseudomonas aeruginosa PA01
cgggucucgaucagcgccgg

SEQ ID NO: 1422947 - RNA, 15 nt, Pseudomonas aeruginosa PA01
cgggucggcacggcc

SEQ ID NO: 1422948 - RNA, 14 nt, Pseudomonas aeruginosa PA01
cgggucgcggcuga

SEQ ID NO: 1422949 - RNA, 14 nt, Pseudomonas aeruginosa PA01
cgggucgcggcugg

SEQ ID NO: 1422950 - RNA, 16 nt, Pseudomonas aeruginosa PA01
cgggucgcggcuggcc

SEQ ID NO: 1422951 - RNA, 17 nt, Pseudomonas aeruginosa PA01
cgggucgcggcuggccg

SEQ ID NO: 1422952 - RNA, 13 nt, Pseudomonas aeruginosa PA01
cggggucggccug

SEQ ID NO: 1422953 - RNA, 16 nt, Pseudomonas aeruginosa PA01
cggggucggccugcgg

SEQ ID NO: 1422954 - RNA, 18 nt, Pseudomonas aeruginosa PA01
cggggucgggcagcuucu

SEQ ID NO: 1422955 - RNA, 14 nt, Pseudomonas aeruginosa PA01
cgggggcuccaggg

SEQ ID NO: 1422956 - RNA, 16 nt, Pseudomonas aeruginosa PA01
cgggggcuccagggga

SEQ ID NO: 1422957 - RNA, 13 nt, Pseudomonas aeruginosa PA01
cggggcugcuccu

SEQ ID NO: 1422958 - RNA, 15 nt, Pseudomonas aeruginosa PA01
cggggugauccagcu

SEQ ID NO: 1422959 - RNA, 19 nt, Pseudomonas aeruginosa PA01
cggggugauccagcuggcg

SEQ ID NO: 1422960 - RNA, 15 nt, Pseudomonas aeruginosa PA01
cggggugaagcucuu

SEQ ID NO: 1422961 - RNA, 23 nt, Pseudomonas aeruginosa PA01
cggggugagcaguucgucgauga

SEQ ID NO: 1422962 - RNA, 21 nt, Pseudomonas aeruginosa PA01
cggggucuggccggcgaucag

SEQ ID NO: 1422963 - RNA, 16 nt, Pseudomonas aeruginosa PA01
cggggccgugagcacg

SEQ ID NO: 1422964 - RNA, 19 nt, Pseudomonas aeruginosa PA01
cggggccguucaggaagac

SEQ ID NO: 1422965 - RNA, 15 nt, Pseudomonas aeruginosa PA01
cggggccuacugcug

SEQ ID NO: 1422966 - RNA, 17 nt, Pseudomonas aeruginosa PA01
cggggccuacugcugga

SEQ ID NO: 1422967 - RNA, 21 nt, Pseudomonas aeruginosa PA01
cggggccuacugcuggacggc

SEQ ID NO: 1422968 - RNA, 16 nt, Pseudomonas aeruginosa PA01
cgggcuggaaaacgcc

SEQ ID NO: 1422969 - RNA, 17 nt, Pseudomonas aeruginosa PA01
cgggcuggccaccgcca

SEQ ID NO: 1422970 - RNA, 17 nt, Pseudomonas aeruginosa PA01
cgggcuggccaccggga

SEQ ID NO: 1422971 - RNA, 17 nt, Pseudomonas aeruginosa PA01
cgggcugcgcucggcgc

SEQ ID NO: 1422972 - RNA, 13 nt, Pseudomonas aeruginosa PA01
cgggcugccagca

SEQ ID NO: 1422973 - RNA, 16 nt, Pseudomonas aeruginosa PA01
cgggcugcgugccagc

SEQ ID NO: 1422974 - RNA, 19 nt, Pseudomonas aeruginosa PA01
cgggcugcgugccagcacc

SEQ ID NO: 1422975 - RNA, 13 nt, Pseudomonas aeruginosa PA01
cggggcgaccagc

SEQ ID NO: 1422976 - RNA, 16 nt, Pseudomonas aeruginosa PA01
cggggcgaggucggcc

SEQ ID NO: 1422977 - RNA, 22 nt, Pseudomonas aeruginosa PA01
cggggcgaggucggccugcggg

SEQ ID NO: 1422978 - RNA, 14 nt, Pseudomonas aeruginosa PA01
cggggccugcugcg

SEQ ID NO: 1422979 - RNA, 16 nt, Pseudomonas aeruginosa PA01
cggggccugcugcggg

SEQ ID NO: 1422980 - RNA, 16 nt, Pseudomonas aeruginosa PA01
cggggccuucaggcgc

SEQ ID NO: 1422981 - RNA, 17 nt, Pseudomonas aeruginosa PA01
cggggccucgcugccug

SEQ ID NO: 1422982 - RNA, 18 nt, Pseudomonas aeruginosa PA01
cggggccucgcugccugg

SEQ ID NO: 1422983 - RNA, 17 nt, Pseudomonas aeruginosa PA01
cggggcgcaaggccagc

SEQ ID NO: 1422984 - RNA, 19 nt, Pseudomonas aeruginosa PA01
cggggcgcaaggccagcgg

SEQ ID NO: 1422985 - RNA, 17 nt, Pseudomonas aeruginosa PA01
cggggcgcaccgccucg

SEQ ID NO: 1422986 - RNA, 23 nt, Pseudomonas aeruginosa PA01
cggggcguagggggccgggucga

SEQ ID NO: 1422987 - RNA, 19 nt, Pseudomonas aeruginosa PA01
cggggcgaucuugaucgcc

SEQ ID NO: 1422988 - RNA, 22 nt, Pseudomonas aeruginosa PA01
cggggcgaucuugaucgccagc

SEQ ID NO: 1422989 - RNA, 16 nt, Pseudomonas aeruginosa PA01
cggggcgugcaggccg

SEQ ID NO: 1422990 - RNA, 20 nt, Pseudomonas aeruginosa PA01
cggggcgugcaggccgccga

SEQ ID NO: 1422991 - RNA, 13 nt, Pseudomonas aeruginosa PA01
cggggcugcggcc

SEQ ID NO: 1422992 - RNA, 22 nt, Pseudomonas aeruginosa PA01
cggguucgagucccguccgcug

SEQ ID NO: 1422993 - RNA, 17 nt, Pseudomonas aeruginosa PA01
cggguucgugccaggcg

SEQ ID NO: 1422994 - RNA, 17 nt, Pseudomonas aeruginosa PA01
cggguucccaguugcug

SEQ ID NO: 1422995 - RNA, 22 nt, Pseudomonas aeruginosa PA01
cggguucccaguugcugggcga

SEQ ID NO: 1422996 - RNA, 15 nt, Pseudomonas aeruginosa PA01
cggguucccugcgcc

SEQ ID NO: 1422997 - RNA, 16 nt, Pseudomonas aeruginosa PA01
cggguucagucggcca

SEQ ID NO: 1422998 - RNA, 22 nt, Pseudomonas aeruginosa PA01
cggguucagucggccaggcgcc

SEQ ID NO: 1422999 - RNA, 23 nt, Pseudomonas aeruginosa PA01
cggguucagucggccaggcgcca

SEQ ID NO: 1423000 - RNA, 12 nt, Pseudomonas aeruginosa PA01
cggguggucuug

SEQ ID NO: 1423001 - RNA, 13 nt, Pseudomonas aeruginosa PA01
cggguucagcccg

SEQ ID NO: 1423002 - RNA, 16 nt, Pseudomonas aeruginosa PA01
cggguucagcccgccg

SEQ ID NO: 1423003 - RNA, 21 nt, Pseudomonas aeruginosa PA01
cggguucagcccgccgugcgc

SEQ ID NO: 1423004 - RNA, 14 nt, Pseudomonas aeruginosa PA01
cggguggucgccgc

SEQ ID NO: 1423005 - RNA, 17 nt, Pseudomonas aeruginosa PA01
cggguggucgccgccca

SEQ ID NO: 1423006 - RNA, 18 nt, Pseudomonas aeruginosa PA01
cggguggucgccgcccac

SEQ ID NO: 1423007 - RNA, 22 nt, Pseudomonas aeruginosa PA01
cggguggucgccgcccacgccu

SEQ ID NO: 1423008 - RNA, 20 nt, Pseudomonas aeruginosa PA01
cgggugggacauggagaccu

SEQ ID NO: 1423009 - RNA, 20 nt, Pseudomonas aeruginosa PA01
cgggugacggcguucggggc

SEQ ID NO: 1423010 - RNA, 16 nt, Pseudomonas aeruginosa PA01
cgggucugcucggcgc

SEQ ID NO: 1423011 - RNA, 21 nt, Pseudomonas aeruginosa PA01
cgggugaaggucugguaggcc

SEQ ID NO: 1423012 - RNA, 20 nt, Pseudomonas aeruginosa PA01
cgggugaacucaugcaggcc

SEQ ID NO: 1423013 - RNA, 17 nt, Pseudomonas aeruginosa PA01
cgggucuugcgcagggc

SEQ ID NO: 1423014 - RNA, 19 nt, Pseudomonas aeruginosa PA01
cggguugcccucgcagccg

SEQ ID NO: 1423015 - RNA, 13 nt, Pseudomonas aeruginosa PA01
cggguugaucagg

SEQ ID NO: 1423016 - RNA, 15 nt, Pseudomonas aeruginosa PA01
cggguugaucagguu

SEQ ID NO: 1423017 - RNA, 18 nt, Pseudomonas aeruginosa PA01
cggguugaugccgaggcu

SEQ ID NO: 1423018 - RNA, 15 nt, Pseudomonas aeruginosa PA01
cggguucuugccgcu

SEQ ID NO: 1423019 - RNA, 19 nt, Pseudomonas aeruginosa PA01
cggguugacccagagccgc

SEQ ID NO: 1423020 - RNA, 20 nt, Pseudomonas aeruginosa PA01
cggguugaccgccagacagg

SEQ ID NO: 1423021 - RNA, 16 nt, Pseudomonas aeruginosa PA01
cggguugagcaccccg

SEQ ID NO: 1423022 - RNA, 15 nt, Pseudomonas aeruginosa PA01
cggguugcgccuccg

SEQ ID NO: 1423023 - RNA, 16 nt, Pseudomonas aeruginosa PA01
cggguugccgcuggcc

SEQ ID NO: 1423024 - RNA, 20 nt, Pseudomonas aeruginosa PA01
cggguuggcuuccagccagc

SEQ ID NO: 1423025 - RNA, 18 nt, Pseudomonas aeruginosa PA01
cggguuggcgcaggccgg

SEQ ID NO: 1423026 - RNA, 22 nt, Pseudomonas aeruginosa PA01
cggguuggcgcaggccgggcgg

SEQ ID NO: 1423027 - RNA, 16 nt, Pseudomonas aeruginosa PA01
cgguacccgccggcca

SEQ ID NO: 1423028 - RNA, 17 nt, Pseudomonas aeruginosa PA01
cgguacccguacgcugc

SEQ ID NO: 1423029 - RNA, 14 nt, Pseudomonas aeruginosa PA01
cgguacgccgcgcu

SEQ ID NO: 1423030 - RNA, 19 nt, Pseudomonas aeruginosa PA01
cgguacgcccuccagcacc

SEQ ID NO: 1423031 - RNA, 13 nt, Pseudomonas aeruginosa PA01
cgguacggucgag

SEQ ID NO: 1423032 - RNA, 20 nt, Pseudomonas aeruginosa PA01
cgguacggucgaggcggaga

SEQ ID NO: 1423033 - RNA, 18 nt, Pseudomonas aeruginosa PA01
cgguacgcucaccaccac

SEQ ID NO: 1423034 - RNA, 15 nt, Pseudomonas aeruginosa PA01
cgguacucgccgggc

SEQ ID NO: 1423035 - RNA, 21 nt, Pseudomonas aeruginosa PA01
cgguacuccggguugaccgcc

SEQ ID NO: 1423036 - RNA, 19 nt, Pseudomonas aeruginosa PA01
cgguacugcugggccuuga

SEQ ID NO: 1423037 - RNA, 20 nt, Pseudomonas aeruginosa PA01
cgguaucggcuugccggcgg

SEQ ID NO: 1423038 - RNA, 16 nt, Pseudomonas aeruginosa PA01
cgguauggcugcugug

SEQ ID NO: 1423039 - RNA, 18 nt, Pseudomonas aeruginosa PA01
cgguauggcugcugugcg

SEQ ID NO: 1423040 - RNA, 15 nt, Pseudomonas aeruginosa PA01
cgguagugggcgagg

SEQ ID NO: 1423041 - RNA, 14 nt, Pseudomonas aeruginosa PA01
cgguagugcccggu

SEQ ID NO: 1423042 - RNA, 15 nt, Pseudomonas aeruginosa PA01
cgguagugcccggua

SEQ ID NO: 1423043 - RNA, 20 nt, Pseudomonas aeruginosa PA01
cgguagugcuucagguagcu

SEQ ID NO: 1423044 - RNA, 21 nt, Pseudomonas aeruginosa PA01
cgguaguaccucgaagcccag

SEQ ID NO: 1423045 - RNA, 16 nt, Pseudomonas aeruginosa PA01
cgguaguaggguucgc

SEQ ID NO: 1423046 - RNA, 20 nt, Pseudomonas aeruginosa PA01
cgguaguaggguucgccgac

SEQ ID NO: 1423047 - RNA, 21 nt, Pseudomonas aeruginosa PA01
cgguaguaggguucgccgacg

SEQ ID NO: 1423048 - RNA, 21 nt, Pseudomonas aeruginosa PA01
cgguagguguacccagggugc

SEQ ID NO: 1423049 - RNA, 13 nt, Pseudomonas aeruginosa PA01
cgguaggugaugc

SEQ ID NO: 1423050 - RNA, 18 nt, Pseudomonas aeruginosa PA01
cgguaggugauguugcgc

SEQ ID NO: 1423051 - RNA, 16 nt, Pseudomonas aeruginosa PA01
cgguaggucagcggua

SEQ ID NO: 1423052 - RNA, 21 nt, Pseudomonas aeruginosa PA01
cgguagggcgaauagcgccgc

SEQ ID NO: 1423053 - RNA, 16 nt, Pseudomonas aeruginosa PA01
cgguaggggccgacga

SEQ ID NO: 1423054 - RNA, 18 nt, Pseudomonas aeruginosa PA01
cgguagggaucgucgcca

SEQ ID NO: 1423055 - RNA, 15 nt, Pseudomonas aeruginosa PA01
cgguagggccgaggu

SEQ ID NO: 1423056 - RNA, 20 nt, Pseudomonas aeruginosa PA01
cgguagggccgaggucgagg

SEQ ID NO: 1423057 - RNA, 19 nt, Pseudomonas aeruginosa PA01
cgguaggcguugauccggu

SEQ ID NO: 1423058 - RNA, 13 nt, Pseudomonas aeruginosa PA01
cgguagcccggca

SEQ ID NO: 1423059 - RNA, 14 nt, Pseudomonas aeruginosa PA01
cgguagccgaggcg

SEQ ID NO: 1423060 - RNA, 18 nt, Pseudomonas aeruginosa PA01
cgguagccgaggcggccg

SEQ ID NO: 1423061 - RNA, 19 nt, Pseudomonas aeruginosa PA01
cgguagccgaggcggccga

SEQ ID NO: 1423062 - RNA, 17 nt, Pseudomonas aeruginosa PA01
cgguagaacaggcgaua

SEQ ID NO: 1423063 - RNA, 18 nt, Pseudomonas aeruginosa PA01
cgguauuguggccccagc

SEQ ID NO: 1423064 - RNA, 23 nt, Pseudomonas aeruginosa PA01
cgguauucagccagagcccgucg

SEQ ID NO: 1423065 - RNA, 16 nt, Pseudomonas aeruginosa PA01
cgguauucuccagcag

SEQ ID NO: 1423066 - RNA, 21 nt, Pseudomonas aeruginosa PA01
cggucaaccgcgggcgagguc

SEQ ID NO: 1423067 - RNA, 22 nt, Pseudomonas aeruginosa PA01
cggucaaccgcgggcgaggucg

SEQ ID NO: 1423068 - RNA, 21 nt, Pseudomonas aeruginosa PA01
cggucacccauucgaugccgc

SEQ ID NO: 1423069 - RNA, 15 nt, Pseudomonas aeruginosa PA01
cggucaccacccagc

SEQ ID NO: 1423070 - RNA, 19 nt, Pseudomonas aeruginosa PA01
cggucaccacccagccgcg

SEQ ID NO: 1423071 - RNA, 22 nt, Pseudomonas aeruginosa PA01
cggucaccacccagccgcggcc

SEQ ID NO: 1423072 - RNA, 23 nt, Pseudomonas aeruginosa PA01
cggucaccacccagccgcggccg

SEQ ID NO: 1423073 - RNA, 13 nt, Pseudomonas aeruginosa PA01
cggucacgccggg

SEQ ID NO: 1423074 - RNA, 15 nt, Pseudomonas aeruginosa PA01
cggucagaucagcgg

SEQ ID NO: 1423075 - RNA, 14 nt, Pseudomonas aeruginosa PA01
cggucacucggccu

SEQ ID NO: 1423076 - RNA, 20 nt, Pseudomonas aeruginosa PA01
cggucacucggccucggcgu

SEQ ID NO: 1423077 - RNA, 21 nt, Pseudomonas aeruginosa PA01
cggucacucggccucggcguc

SEQ ID NO: 1423078 - RNA, 14 nt, Pseudomonas aeruginosa PA01
cggucacgaaggcg

SEQ ID NO: 1423079 - RNA, 15 nt, Pseudomonas aeruginosa PA01
cggucaccguggaga

SEQ ID NO: 1423080 - RNA, 20 nt, Pseudomonas aeruginosa PA01
cggucaccguggucauggcg

SEQ ID NO: 1423081 - RNA, 23 nt, Pseudomonas aeruginosa PA01
cgggcacaaaaaaggcggaugac

SEQ ID NO: 1423082 - RNA, 17 nt, Pseudomonas aeruginosa PA01
cgggaagcgcaggccgc

SEQ ID NO: 1423083 - RNA, 17 nt, Pseudomonas aeruginosa PA01
cgggaagggaucgaccg

SEQ ID NO: 1423084 - RNA, 18 nt, Pseudomonas aeruginosa PA01
cgggaagccgcucggcgu

SEQ ID NO: 1423085 - RNA, 20 nt, Pseudomonas aeruginosa PA01
cgggaagcgaaccaggcaau

SEQ ID NO: 1423086 - RNA, 21 nt, Pseudomonas aeruginosa PA01
cgggaaguccgggcgcggcug

SEQ ID NO: 1423087 - RNA, 23 nt, Pseudomonas aeruginosa PA01
cgggaaguccgggcgcggcuggu

SEQ ID NO: 1423088 - RNA, 20 nt, Pseudomonas aeruginosa PA01
cgggaagggucugcuugcgc

SEQ ID NO: 1423089 - RNA, 16 nt, Pseudomonas aeruginosa PA01
cgggaaggucggcagc

SEQ ID NO: 1423090 - RNA, 18 nt, Pseudomonas aeruginosa PA01
cgggaaguaggccuggcc

SEQ ID NO: 1423091 - RNA, 19 nt, Pseudomonas aeruginosa PA01
cgggaaguaggccuggccg

SEQ ID NO: 1423092 - RNA, 20 nt, Pseudomonas aeruginosa PA01
cgggaaguaggccuggccgc

SEQ ID NO: 1423093 - RNA, 20 nt, Pseudomonas aeruginosa PA01
cgggcacgcauagcgcgcug

SEQ ID NO: 1423094 - RNA, 14 nt, Pseudomonas aeruginosa PA01
cgggcaccagcacg

SEQ ID NO: 1423095 - RNA, 14 nt, Pseudomonas aeruginosa PA01
cgggcacgucgcgg

SEQ ID NO: 1423096 - RNA, 19 nt, Pseudomonas aeruginosa PA01
cgggcacuucucgaacagc

SEQ ID NO: 1423097 - RNA, 15 nt, Pseudomonas aeruginosa PA01
cgggcagaccagcag

SEQ ID NO: 1423098 - RNA, 16 nt, Pseudomonas aeruginosa PA01
cgggcagaguggcgcg

SEQ ID NO: 1423099 - RNA, 18 nt, Pseudomonas aeruginosa PA01
cgggcagaguggcgcggc

SEQ ID NO: 1423100 - RNA, 22 nt, Pseudomonas aeruginosa PA01
cgggcagcucguugcacagcgc

SEQ ID NO: 1423101 - RNA, 14 nt, Pseudomonas aeruginosa PA01
cgggcaucgccgac

SEQ ID NO: 1423102 - RNA, 15 nt, Pseudomonas aeruginosa PA01
cgggcaucgccgacc

SEQ ID NO: 1423103 - RNA, 16 nt, Pseudomonas aeruginosa PA01
cgggcaucgccgacca

SEQ ID NO: 1423104 - RNA, 20 nt, Pseudomonas aeruginosa PA01
cgggcaggccgaggccggcg

SEQ ID NO: 1423105 - RNA, 18 nt, Pseudomonas aeruginosa PA01
cgggcagggcagccgccg

SEQ ID NO: 1423106 - RNA, 17 nt, Pseudomonas aeruginosa PA01
cgggcauggaucucccg

SEQ ID NO: 1423107 - RNA, 13 nt, Pseudomonas aeruginosa PA01
cgggcauggcgau

SEQ ID NO: 1423108 - RNA, 17 nt, Pseudomonas aeruginosa PA01
cgggcaucgucgaaggg

SEQ ID NO: 1423109 - RNA, 18 nt, Pseudomonas aeruginosa PA01
cgggcaucgucgaagggc

SEQ ID NO: 1423110 - RNA, 21 nt, Pseudomonas aeruginosa PA01
cgggcaucuugcccagccgac

SEQ ID NO: 1423111 - RNA, 19 nt, Pseudomonas aeruginosa PA01
cgggcaucaugccgagcau

SEQ ID NO: 1423112 - RNA, 16 nt, Pseudomonas aeruginosa PA01
cgggcauucgcagcgg

SEQ ID NO: 1423113 - RNA, 17 nt, Pseudomonas aeruginosa PA01
cgggcauuuccucgaug

SEQ ID NO: 1423114 - RNA, 21 nt, Pseudomonas aeruginosa PA01
cgggcauuuccucgaugagca

SEQ ID NO: 1423115 - RNA, 14 nt, Pseudomonas aeruginosa PA01
cgggcccagcggua

SEQ ID NO: 1423116 - RNA, 14 nt, Pseudomonas aeruginosa PA01
cgggccgacggccc

SEQ ID NO: 1423117 - RNA, 18 nt, Pseudomonas aeruginosa PA01
cgggccgaucaccaccug

SEQ ID NO: 1423118 - RNA, 20 nt, Pseudomonas aeruginosa PA01
cgggccgaucuucgccgaca

SEQ ID NO: 1423119 - RNA, 20 nt, Pseudomonas aeruginosa PA01
cgggccgcucgcgcggcacc

SEQ ID NO: 1423120 - RNA, 15 nt, Pseudomonas aeruginosa PA01
cgggcgacccaggcc

SEQ ID NO: 1423121 - RNA, 16 nt, Pseudomonas aeruginosa PA01
cgggcgacccaggccg

SEQ ID NO: 1423122 - RNA, 17 nt, Pseudomonas aeruginosa PA01
cgggcgacccaggccga

SEQ ID NO: 1423123 - RNA, 19 nt, Pseudomonas aeruginosa PA01
cgggcgacccaggccgaca

SEQ ID NO: 1423124 - RNA, 21 nt, Pseudomonas aeruginosa PA01
cgggcgacccaggccgacagc

SEQ ID NO: 1423125 - RNA, 21 nt, Pseudomonas aeruginosa PA01
cgggcgaaggccucgucgauc

SEQ ID NO: 1423126 - RNA, 17 nt, Pseudomonas aeruginosa PA01
cgggcgaacccgaaucc

SEQ ID NO: 1423127 - RNA, 18 nt, Pseudomonas aeruginosa PA01
cgggcgaacccgaauccc

SEQ ID NO: 1423128 - RNA, 15 nt, Pseudomonas aeruginosa PA01
cgggcgaccugcucg

SEQ ID NO: 1423129 - RNA, 16 nt, Pseudomonas aeruginosa PA01
cgggcgacgcguccgg

SEQ ID NO: 1423130 - RNA, 18 nt, Pseudomonas aeruginosa PA01
cgggcgagaaucgccgag

SEQ ID NO: 1423131 - RNA, 23 nt, Pseudomonas aeruginosa PA01
cgggcgagcagggaggagggcga

SEQ ID NO: 1423132 - RNA, 13 nt, Pseudomonas aeruginosa PA01
cgggcgagcugca

SEQ ID NO: 1423133 - RNA, 14 nt, Pseudomonas aeruginosa PA01
cgggccggggaucg

SEQ ID NO: 1423134 - RNA, 16 nt, Pseudomonas aeruginosa PA01
cgggccggggaucggc

SEQ ID NO: 1423135 - RNA, 15 nt, Pseudomonas aeruginosa PA01
cgggcgaaacggcag

SEQ ID NO: 1423136 - RNA, 16 nt, Pseudomonas aeruginosa PA01
cgggcgaaacggcagg

SEQ ID NO: 1423137 - RNA, 22 nt, Pseudomonas aeruginosa PA01
cgggcgaaacggcaggccagca

SEQ ID NO: 1423138 - RNA, 13 nt, Pseudomonas aeruginosa PA01
cgggccggcgaug

SEQ ID NO: 1423139 - RNA, 17 nt, Pseudomonas aeruginosa PA01
cgggccggccagggcga

SEQ ID NO: 1423140 - RNA, 16 nt, Pseudomonas aeruginosa PA01
cgggccggcgauggcc

SEQ ID NO: 1423141 - RNA, 21 nt, Pseudomonas aeruginosa PA01
cgggccggcgauggcccagau

SEQ ID NO: 1423142 - RNA, 15 nt, Pseudomonas aeruginosa PA01
cgggccggcguccag

SEQ ID NO: 1423143 - RNA, 19 nt, Pseudomonas aeruginosa PA01
cgggcggacgcugggcugg

SEQ ID NO: 1423144 - RNA, 20 nt, Pseudomonas aeruginosa PA01
cgggcggaugaccuguccag

SEQ ID NO: 1423145 - RNA, 18 nt, Pseudomonas aeruginosa PA01
cgggcggccucgauggcg

SEQ ID NO: 1423146 - RNA, 12 nt, Pseudomonas aeruginosa PA01
cgggcggccgac

SEQ ID NO: 1423147 - RNA, 12 nt, Pseudomonas aeruginosa PA01
cgggcggcggcg

SEQ ID NO: 1423148 - RNA, 15 nt, Pseudomonas aeruginosa PA01
cgggcggcgcggcgc

SEQ ID NO: 1423149 - RNA, 21 nt, Pseudomonas aeruginosa PA01
cgggcgggaucaggucgccag

SEQ ID NO: 1423150 - RNA, 16 nt, Pseudomonas aeruginosa PA01
cgggcgggacucgccg

SEQ ID NO: 1423151 - RNA, 14 nt, Pseudomonas aeruginosa PA01
cgggcggcuguagc

SEQ ID NO: 1423152 - RNA, 23 nt, Pseudomonas aeruginosa PA01
cgggcggcuguagcggaucaggc

SEQ ID NO: 1423153 - RNA, 18 nt, Pseudomonas aeruginosa PA01
cgggcgggaucuccgcgc

SEQ ID NO: 1423154 - RNA, 22 nt, Pseudomonas aeruginosa PA01
cgggcggguaaagcgcccgcgc

SEQ ID NO: 1423155 - RNA, 15 nt, Pseudomonas aeruginosa PA01
cgggcggucgaggcc

SEQ ID NO: 1423156 - RNA, 16 nt, Pseudomonas aeruginosa PA01
cgggcggucgaggccc

SEQ ID NO: 1423157 - RNA, 12 nt, Pseudomonas aeruginosa PA01
cgggcgguagcg

SEQ ID NO: 1423158 - RNA, 13 nt, Pseudomonas aeruginosa PA01
cgggcggucgucg

SEQ ID NO: 1423159 - RNA, 17 nt, Pseudomonas aeruginosa PA01
cgggcggucgucgccau

SEQ ID NO: 1423160 - RNA, 14 nt, Pseudomonas aeruginosa PA01
cgggcguagcgcgg

SEQ ID NO: 1423161 - RNA, 19 nt, Pseudomonas aeruginosa PA01
cgggcguagcgcggcagcg

SEQ ID NO: 1423162 - RNA, 13 nt, Pseudomonas aeruginosa PA01
cgggcguccggcg

SEQ ID NO: 1423163 - RNA, 16 nt, Pseudomonas aeruginosa PA01
cgggcguccggcgagc

SEQ ID NO: 1423164 - RNA, 23 nt, Pseudomonas aeruginosa PA01
cgggcguccguaaugcaacccgc

SEQ ID NO: 1423165 - RNA, 13 nt, Pseudomonas aeruginosa PA01
cgggcgucggcgu

SEQ ID NO: 1423166 - RNA, 14 nt, Pseudomonas aeruginosa PA01
cgggcgucgucggg

SEQ ID NO: 1423167 - RNA, 22 nt, Pseudomonas aeruginosa PA01
cgggcgucgucggggugccgcc

SEQ ID NO: 1423168 - RNA, 23 nt, Pseudomonas aeruginosa PA01
cgggcgucugcucauucggccag

SEQ ID NO: 1423169 - RNA, 17 nt, Pseudomonas aeruginosa PA01
cgggcgugcuccagcac

SEQ ID NO: 1423170 - RNA, 18 nt, Pseudomonas aeruginosa PA01
cgggcuauucccgccgcu

SEQ ID NO: 1423171 - RNA, 24 nt, Pseudomonas aeruginosa PA01
cgggcucacauuaauugcgagcga

SEQ ID NO: 1423172 - RNA, 14 nt, Pseudomonas aeruginosa PA01
cgggcucagcgcgc

SEQ ID NO: 1423173 - RNA, 13 nt, Pseudomonas aeruginosa PA01
cgggcucacuccc

SEQ ID NO: 1423174 - RNA, 22 nt, Pseudomonas aeruginosa PA01
cgggcucacucccguccagcgc

SEQ ID NO: 1423175 - RNA, 21 nt, Pseudomonas aeruginosa PA01
cgggcucgcaaucagcgcgau

SEQ ID NO: 1423176 - RNA, 12 nt, Pseudomonas aeruginosa PA01
cgggcuccgccg

SEQ ID NO: 1423177 - RNA, 14 nt, Pseudomonas aeruginosa PA01
cgggcuccgccgcg

SEQ ID NO: 1423178 - RNA, 17 nt, Pseudomonas aeruginosa PA01
cgggcuccgccgcgagc

SEQ ID NO: 1423179 - RNA, 22 nt, Pseudomonas aeruginosa PA01
cgggcgccuuuuuucauccugc

SEQ ID NO: 1423180 - RNA, 19 nt, Pseudomonas aeruginosa PA01
cgggcgcgaggcgcccgcc

SEQ ID NO: 1423181 - RNA, 14 nt, Pseudomonas aeruginosa PA01
cgggcgcgcgccuc

SEQ ID NO: 1423182 - RNA, 13 nt, Pseudomonas aeruginosa PA01
cgggcgcgcgcca

SEQ ID NO: 1423183 - RNA, 16 nt, Pseudomonas aeruginosa PA01
cgggcgcgggcguugu

SEQ ID NO: 1423184 - RNA, 19 nt, Pseudomonas aeruginosa PA01
cgggcgcuaugcgccguua

SEQ ID NO: 1423185 - RNA, 16 nt, Pseudomonas aeruginosa PA01
cgggcgcugcaugggc

SEQ ID NO: 1423186 - RNA, 20 nt, Pseudomonas aeruginosa PA01
cgggcgcuugaagccggcgu

SEQ ID NO: 1423187 - RNA, 13 nt, Pseudomonas aeruginosa PA01
cgggcggaggcga

SEQ ID NO: 1423188 - RNA, 16 nt, Pseudomonas aeruginosa PA01
cgggcggaggcgaggu

SEQ ID NO: 1423189 - RNA, 17 nt, Pseudomonas aeruginosa PA01
cgggcggaucagcucga

SEQ ID NO: 1423190 - RNA, 15 nt, Pseudomonas aeruginosa PA01
cgggcggaucgagca

SEQ ID NO: 1423191 - RNA, 19 nt, Pseudomonas aeruginosa PA01
cgggcggaucgagcagcgg

SEQ ID NO: 1423192 - RNA, 18 nt, Pseudomonas aeruginosa PA01
cgggcggaucgccaacca

SEQ ID NO: 1423193 - RNA, 14 nt, Pseudomonas aeruginosa PA01
cgggcggcaggcgc

SEQ ID NO: 1423194 - RNA, 15 nt, Pseudomonas aeruginosa PA01
cgggcggcaggcgcc

SEQ ID NO: 1423195 - RNA, 19 nt, Pseudomonas aeruginosa PA01
cgggcggcaggcgccggcc

SEQ ID NO: 1423196 - RNA, 12 nt, Pseudomonas aeruginosa PA01
cgggcgccaccg

SEQ ID NO: 1423197 - RNA, 13 nt, Pseudomonas aeruginosa PA01
cgggcgccaccga

SEQ ID NO: 1423198 - RNA, 17 nt, Pseudomonas aeruginosa PA01
cgggcgccaccgauagc

SEQ ID NO: 1423199 - RNA, 15 nt, Pseudomonas aeruginosa PA01
cgggcgcccgccaag

SEQ ID NO: 1423200 - RNA, 15 nt, Pseudomonas aeruginosa PA01
cgggcgccaucgcuu

SEQ ID NO: 1423201 - RNA, 14 nt, Pseudomonas aeruginosa PA01
cgggcgccgaugcc

SEQ ID NO: 1423202 - RNA, 14 nt, Pseudomonas aeruginosa PA01
cgggcgccgccgcu

SEQ ID NO: 1423203 - RNA, 19 nt, Pseudomonas aeruginosa PA01
cgggcgccgccgcuggcga

SEQ ID NO: 1423204 - RNA, 19 nt, Pseudomonas aeruginosa PA01
cgggcgccggaccagccgg

SEQ ID NO: 1423205 - RNA, 21 nt, Pseudomonas aeruginosa PA01
cgggcgccguggaucgcccgg

SEQ ID NO: 1423206 - RNA, 15 nt, Pseudomonas aeruginosa PA01
cgggcgcaacccugc

SEQ ID NO: 1423207 - RNA, 21 nt, Pseudomonas aeruginosa PA01
cgggcgaucuccucgauccgc

SEQ ID NO: 1423208 - RNA, 22 nt, Pseudomonas aeruginosa PA01
cgggcgaugaggcuguccagca

SEQ ID NO: 1423209 - RNA, 23 nt, Pseudomonas aeruginosa PA01
cgggcgaugaggcuguccagcag

SEQ ID NO: 1423210 - RNA, 15 nt, Pseudomonas aeruginosa PA01
cgggcgaagcgcagc

SEQ ID NO: 1423211 - RNA, 22 nt, Pseudomonas aeruginosa PA01
cgggcgaggcuaacgccgagga

SEQ ID NO: 1423212 - RNA, 15 nt, Pseudomonas aeruginosa PA01
cgggcgagggcggcg

SEQ ID NO: 1423213 - RNA, 16 nt, Pseudomonas aeruginosa PA01
cgggcgagggcggcgc

SEQ ID NO: 1423214 - RNA, 15 nt, Pseudomonas aeruginosa PA01
gaggaugccggccuc

SEQ ID NO: 1423215 - RNA, 17 nt, Pseudomonas aeruginosa PA01
gaggaucuugcgcccgg

SEQ ID NO: 1423216 - RNA, 17 nt, Pseudomonas aeruginosa PA01
gaggaucuccaacuggc

SEQ ID NO: 1423217 - RNA, 14 nt, Pseudomonas aeruginosa PA01
gaggaucgccagga

SEQ ID NO: 1423218 - RNA, 19 nt, Pseudomonas aeruginosa PA01
gaggaucuccuggcgcguc

SEQ ID NO: 1423219 - RNA, 14 nt, Pseudomonas aeruginosa PA01
gaggaugucggcga

SEQ ID NO: 1423220 - RNA, 20 nt, Pseudomonas aeruginosa PA01
gaggaugucggcgaacuggc

SEQ ID NO: 1423221 - RNA, 23 nt, Pseudomonas aeruginosa PA01
gaggauguacagggucuugccgg

SEQ ID NO: 1423222 - RNA, 15 nt, Pseudomonas aeruginosa PA01
gaggaugcucgccug

SEQ ID NO: 1423223 - RNA, 16 nt, Pseudomonas aeruginosa PA01
gaggauggucaggccg

SEQ ID NO: 1423224 - RNA, 17 nt, Pseudomonas aeruginosa PA01
gaggauccacuugccgu

SEQ ID NO: 1423225 - RNA, 18 nt, Pseudomonas aeruginosa PA01
gaggaucgcucccaggcu

SEQ ID NO: 1423226 - RNA, 13 nt, Pseudomonas aeruginosa PA01
gaggaucggccaa

SEQ ID NO: 1423227 - RNA, 15 nt, Pseudomonas aeruginosa PA01
gaggaucggccaacu

SEQ ID NO: 1423228 - RNA, 23 nt, Pseudomonas aeruginosa PA01
gaggaucgcggccuucucgucgc

SEQ ID NO: 1423229 - RNA, 13 nt, Pseudomonas aeruginosa PA01
gaggaucagccac

SEQ ID NO: 1423230 - RNA, 22 nt, Pseudomonas aeruginosa PA01
gaggaucagccagccggcgaag

SEQ ID NO: 1423231 - RNA, 18 nt, Pseudomonas aeruginosa PA01
gaggauaccgcacggccg

SEQ ID NO: 1423232 - RNA, 19 nt, Pseudomonas aeruginosa PA01
gaggauaccgcacggccgu

SEQ ID NO: 1423233 - RNA, 20 nt, Pseudomonas aeruginosa PA01
gaggaagcuccccgcaccug

SEQ ID NO: 1423234 - RNA, 13 nt, Pseudomonas aeruginosa PA01
gaggaagcgcccg

SEQ ID NO: 1423235 - RNA, 21 nt, Pseudomonas aeruginosa PA01
gaggaagucgcuucaccgggc

SEQ ID NO: 1423236 - RNA, 13 nt, Pseudomonas aeruginosa PA01
gaggaagucggcg

SEQ ID NO: 1423237 - RNA, 17 nt, Pseudomonas aeruginosa PA01
gaggaagucggcggccg

SEQ ID NO: 1423238 - RNA, 17 nt, Pseudomonas aeruginosa PA01
gaggaaguggccggugu

SEQ ID NO: 1423239 - RNA, 18 nt, Pseudomonas aeruginosa PA01
gaggaaguugcgcagcaa

SEQ ID NO: 1423240 - RNA, 19 nt, Pseudomonas aeruginosa PA01
gaggaauaaagaaaaggcc

SEQ ID NO: 1423241 - RNA, 23 nt, Pseudomonas aeruginosa PA01
gaggaaguaguagaugcggcugu

SEQ ID NO: 1423242 - RNA, 18 nt, Pseudomonas aeruginosa PA01
gaggaagccgaccggcgc

SEQ ID NO: 1423243 - RNA, 14 nt, Pseudomonas aeruginosa PA01
gaggaccgacggca

SEQ ID NO: 1423244 - RNA, 15 nt, Pseudomonas aeruginosa PA01
gaggaccuggccgcg

SEQ ID NO: 1423245 - RNA, 14 nt, Pseudomonas aeruginosa PA01
gaggacgccgggcu

SEQ ID NO: 1423246 - RNA, 20 nt, Pseudomonas aeruginosa PA01
gaggacgcugggacggcugc

SEQ ID NO: 1423247 - RNA, 22 nt, Pseudomonas aeruginosa PA01
gaggaggaucucgcgccccggg

SEQ ID NO: 1423248 - RNA, 13 nt, Pseudomonas aeruginosa PA01
gagcuuggcccug

SEQ ID NO: 1423249 - RNA, 15 nt, Pseudomonas aeruginosa PA01
gagcuuggcccuggc

SEQ ID NO: 1423250 - RNA, 14 nt, Pseudomonas aeruginosa PA01
gagcuucgccgcgc

SEQ ID NO: 1423251 - RNA, 14 nt, Pseudomonas aeruginosa PA01
gagcuucucgucgc

SEQ ID NO: 1423252 - RNA, 20 nt, Pseudomonas aeruginosa PA01
gagcuguccaucucgccgcg

SEQ ID NO: 1423253 - RNA, 16 nt, Pseudomonas aeruginosa PA01
gagcuguccggcgcug

SEQ ID NO: 1423254 - RNA, 19 nt, Pseudomonas aeruginosa PA01
gagcuguuucagcccacgc

SEQ ID NO: 1423255 - RNA, 22 nt, Pseudomonas aeruginosa PA01
gagcuguuucagcccacgcgcc

SEQ ID NO: 1423256 - RNA, 18 nt, Pseudomonas aeruginosa PA01
gaggaaauacagcacccg

SEQ ID NO: 1423257 - RNA, 19 nt, Pseudomonas aeruginosa PA01
gaggaacaguucggcgagu

SEQ ID NO: 1423258 - RNA, 17 nt, Pseudomonas aeruginosa PA01
gagcuuguccagggcgc

SEQ ID NO: 1423259 - RNA, 18 nt, Pseudomonas aeruginosa PA01
gagcuuguccagggcgcc

SEQ ID NO: 1423260 - RNA, 15 nt, Pseudomonas aeruginosa PA01
gagcugcucgauggc

SEQ ID NO: 1423261 - RNA, 20 nt, Pseudomonas aeruginosa PA01
gagcuggaaauggcggucgc

SEQ ID NO: 1423262 - RNA, 21 nt, Pseudomonas aeruginosa PA01
gagcuggaagucguccagcag

SEQ ID NO: 1423263 - RNA, 14 nt, Pseudomonas aeruginosa PA01
gagcugcucggcgg

SEQ ID NO: 1423264 - RNA, 22 nt, Pseudomonas aeruginosa PA01
gagcuggacgacgcuggccugc

SEQ ID NO: 1423265 - RNA, 19 nt, Pseudomonas aeruginosa PA01
gagcugccccucguggcgc

SEQ ID NO: 1423266 - RNA, 11 nt, Pseudomonas aeruginosa PA01
gagcuggcgcc

SEQ ID NO: 1423267 - RNA, 11 nt, Pseudomonas aeruginosa PA01
gagcuggcgcu

SEQ ID NO: 1423268 - RNA, 15 nt, Pseudomonas aeruginosa PA01
gagcuggcgcugguc

SEQ ID NO: 1423269 - RNA, 16 nt, Pseudomonas aeruginosa PA01
gagcuggcgcuggucc

SEQ ID NO: 1423270 - RNA, 19 nt, Pseudomonas aeruginosa PA01
gagcugggcguugcccaug

SEQ ID NO: 1423271 - RNA, 16 nt, Pseudomonas aeruginosa PA01
gagcugguacgccccc

SEQ ID NO: 1423272 - RNA, 21 nt, Pseudomonas aeruginosa PA01
gagcugguggauguucgccgc

SEQ ID NO: 1423273 - RNA, 22 nt, Pseudomonas aeruginosa PA01
gagcugguggauguucgccgcc

SEQ ID NO: 1423274 - RNA, 23 nt, Pseudomonas aeruginosa PA01
gagcugguggauguucgccgcca

SEQ ID NO: 1423275 - RNA, 17 nt, Pseudomonas aeruginosa PA01
gagggucugcugguagc

SEQ ID NO: 1423276 - RNA, 14 nt, Pseudomonas aeruginosa PA01
gaggguggucgcgc

SEQ ID NO: 1423277 - RNA, 15 nt, Pseudomonas aeruginosa PA01
gaggguggucgcgcu

SEQ ID NO: 1423278 - RNA, 17 nt, Pseudomonas aeruginosa PA01
gagggucgcgccgacga

SEQ ID NO: 1423279 - RNA, 20 nt, Pseudomonas aeruginosa PA01
gaggucgcacgcagcgccgc

SEQ ID NO: 1423280 - RNA, 22 nt, Pseudomonas aeruginosa PA01
gaggucgcagcguuccagcgcu

SEQ ID NO: 1423281 - RNA, 17 nt, Pseudomonas aeruginosa PA01
gaggguguucagcggcg

SEQ ID NO: 1423282 - RNA, 18 nt, Pseudomonas aeruginosa PA01
gaggguguucagcggcgc

SEQ ID NO: 1423283 - RNA, 18 nt, Pseudomonas aeruginosa PA01
gaggucuuggccagccgc

SEQ ID NO: 1423284 - RNA, 12 nt, Pseudomonas aeruginosa PA01
gaggucguccac

SEQ ID NO: 1423285 - RNA, 16 nt, Pseudomonas aeruginosa PA01
gaggucgccgccagcu

SEQ ID NO: 1423286 - RNA, 17 nt, Pseudomonas aeruginosa PA01
gaggucgcgggccaggc

SEQ ID NO: 1423287 - RNA, 19 nt, Pseudomonas aeruginosa PA01
gaggucgcgggccaggccc

SEQ ID NO: 1423288 - RNA, 14 nt, Pseudomonas aeruginosa PA01
gaggucggccucga

SEQ ID NO: 1423289 - RNA, 19 nt, Pseudomonas aeruginosa PA01
gaggucggccuggcugccg

SEQ ID NO: 1423290 - RNA, 12 nt, Pseudomonas aeruginosa PA01
gaggucggcgcg

SEQ ID NO: 1423291 - RNA, 13 nt, Pseudomonas aeruginosa PA01
gaggucggcgcgc

SEQ ID NO: 1423292 - RNA, 18 nt, Pseudomonas aeruginosa PA01
gaggucggcgcgcccggc

SEQ ID NO: 1423293 - RNA, 14 nt, Pseudomonas aeruginosa PA01
gaggucggcgcgcg

SEQ ID NO: 1423294 - RNA, 16 nt, Pseudomonas aeruginosa PA01
gagucaggcgccggcc

SEQ ID NO: 1423295 - RNA, 13 nt, Pseudomonas aeruginosa PA01
gaguaguuucuga

SEQ ID NO: 1423296 - RNA, 14 nt, Pseudomonas aeruginosa PA01
gaguaccaggccac

SEQ ID NO: 1423297 - RNA, 14 nt, Pseudomonas aeruginosa PA01
gaguaccgcugcgg

SEQ ID NO: 1423298 - RNA, 18 nt, Pseudomonas aeruginosa PA01
gaguaccgcugcggccgg

SEQ ID NO: 1423299 - RNA, 19 nt, Pseudomonas aeruginosa PA01
gaguagcugaagcugucgc

SEQ ID NO: 1423300 - RNA, 14 nt, Pseudomonas aeruginosa PA01
gaguagcuggcgca

SEQ ID NO: 1423301 - RNA, 22 nt, Pseudomonas aeruginosa PA01
gaguagguccaggcgucggcgc

SEQ ID NO: 1423302 - RNA, 16 nt, Pseudomonas aeruginosa PA01
gaguaguagcguuccu

SEQ ID NO: 1423303 - RNA, 16 nt, Pseudomonas aeruginosa PA01
gaggggcggccgccga

SEQ ID NO: 1423304 - RNA, 12 nt, Pseudomonas aeruginosa PA01
gaggggcugcgg

SEQ ID NO: 1423305 - RNA, 19 nt, Pseudomonas aeruginosa PA01
gagggucagcaggcugccg

SEQ ID NO: 1423306 - RNA, 20 nt, Pseudomonas aeruginosa PA01
gagggucagcaggcugccgu

SEQ ID NO: 1423307 - RNA, 16 nt, Pseudomonas aeruginosa PA01
gagggucagccggccg

SEQ ID NO: 1423308 - RNA, 21 nt, Pseudomonas aeruginosa PA01
gagggucaggccgagggcugc

SEQ ID NO: 1423309 - RNA, 16 nt, Pseudomonas aeruginosa PA01
gaggggaaucgccguc

SEQ ID NO: 1423310 - RNA, 14 nt, Pseudomonas aeruginosa PA01
gaggcuuuccagca

SEQ ID NO: 1423311 - RNA, 16 nt, Pseudomonas aeruginosa PA01
gaggcuguccagcagg

SEQ ID NO: 1423312 - RNA, 23 nt, Pseudomonas aeruginosa PA01
gaggcugugggucgggucggcga

SEQ ID NO: 1423313 - RNA, 20 nt, Pseudomonas aeruginosa PA01
gagggcugagacgcugccgu

SEQ ID NO: 1423314 - RNA, 20 nt, Pseudomonas aeruginosa PA01
gagggcugcuguccagcgcu

SEQ ID NO: 1423315 - RNA, 12 nt, Pseudomonas aeruginosa PA01
gaggcucgccgg

SEQ ID NO: 1423316 - RNA, 14 nt, Pseudomonas aeruginosa PA01
gaggcucggcggcc

SEQ ID NO: 1423317 - RNA, 16 nt, Pseudomonas aeruginosa PA01
gaggcuaacgccgagg

SEQ ID NO: 1423318 - RNA, 14 nt, Pseudomonas aeruginosa PA01
gaggcucagccgau

SEQ ID NO: 1423319 - RNA, 18 nt, Pseudomonas aeruginosa PA01
gaggcucagcgcgccgag

SEQ ID NO: 1423320 - RNA, 17 nt, Pseudomonas aeruginosa PA01
gaggcgcgccgacagca

SEQ ID NO: 1423321 - RNA, 15 nt, Pseudomonas aeruginosa PA01
gaggcgcgcgccgaa

SEQ ID NO: 1423322 - RNA, 23 nt, Pseudomonas aeruginosa PA01
gaggcguucgaucuccucgcgca

SEQ ID NO: 1423323 - RNA, 13 nt, Pseudomonas aeruginosa PA01
gaggcugccgaag

SEQ ID NO: 1423324 - RNA, 15 nt, Pseudomonas aeruginosa PA01
gaggcugacccgcug

SEQ ID NO: 1423325 - RNA, 16 nt, Pseudomonas aeruginosa PA01
gaggcugacccgcugu

SEQ ID NO: 1423326 - RNA, 14 nt, Pseudomonas aeruginosa PA01
gaggcuggcgaccg

SEQ ID NO: 1423327 - RNA, 19 nt, Pseudomonas aeruginosa PA01
gaggcugcgcuccaggcgg

SEQ ID NO: 1423328 - RNA, 18 nt, Pseudomonas aeruginosa PA01
gaggcuguagcgcuccug

SEQ ID NO: 1423329 - RNA, 13 nt, Pseudomonas aeruginosa PA01
gaggcuguccagc

SEQ ID NO: 1423330 - RNA, 15 nt, Pseudomonas aeruginosa PA01
gaggcgacgcccugu

SEQ ID NO: 1423331 - RNA, 22 nt, Pseudomonas aeruginosa PA01
gaggcgacccgggucaggccga

SEQ ID NO: 1423332 - RNA, 22 nt, Pseudomonas aeruginosa PA01
gaggcgaggaaaaggaucgccg

SEQ ID NO: 1423333 - RNA, 14 nt, Pseudomonas aeruginosa PA01
gaggcgaucgccgc

SEQ ID NO: 1423334 - RNA, 18 nt, Pseudomonas aeruginosa PA01
gaggcgcacaggcggaag

SEQ ID NO: 1423335 - RNA, 16 nt, Pseudomonas aeruginosa PA01
gaggcgcagcagcgcc

SEQ ID NO: 1423336 - RNA, 15 nt, Pseudomonas aeruginosa PA01
gaggcguuccaggug

SEQ ID NO: 1423337 - RNA, 15 nt, Pseudomonas aeruginosa PA01
gaggcguuccaguuc

SEQ ID NO: 1423338 - RNA, 20 nt, Pseudomonas aeruginosa PA01
gaggcguuccaguucggccg

SEQ ID NO: 1423339 - RNA, 21 nt, Pseudomonas aeruginosa PA01
gaggcguuccaguucggccgc

SEQ ID NO: 1423340 - RNA, 22 nt, Pseudomonas aeruginosa PA01
gaggcguuccaguucggccgcg

SEQ ID NO: 1423341 - RNA, 13 nt, Pseudomonas aeruginosa PA01
gaggcgcccgccg

SEQ ID NO: 1423342 - RNA, 16 nt, Pseudomonas aeruginosa PA01
gaggcgccgaccacga

SEQ ID NO: 1423343 - RNA, 13 nt, Pseudomonas aeruginosa PA01
gaggcgccgcgcc

SEQ ID NO: 1423344 - RNA, 14 nt, Pseudomonas aeruginosa PA01
gaggcgccgcgcca

SEQ ID NO: 1423345 - RNA, 17 nt, Pseudomonas aeruginosa PA01
gaggcgccgcgccaggu

SEQ ID NO: 1423346 - RNA, 17 nt, Pseudomonas aeruginosa PA01
gaggccuucgccgacca

SEQ ID NO: 1423347 - RNA, 23 nt, Pseudomonas aeruginosa PA01
gaggccuucgccgaccagguccg

SEQ ID NO: 1423348 - RNA, 13 nt, Pseudomonas aeruginosa PA01
gaggcgaccagcc

SEQ ID NO: 1423349 - RNA, 16 nt, Pseudomonas aeruginosa PA01
gaggauuuccucgcgc

SEQ ID NO: 1423350 - RNA, 21 nt, Pseudomonas aeruginosa PA01
gaggcgaacggcagguggucg

SEQ ID NO: 1423351 - RNA, 22 nt, Pseudomonas aeruginosa PA01
gaggcaaucugcccggcaucgu

SEQ ID NO: 1423352 - RNA, 21 nt, Pseudomonas aeruginosa PA01
gaggccuacuucucgacgaag

SEQ ID NO: 1423353 - RNA, 22 nt, Pseudomonas aeruginosa PA01
gaggccucgucguucagcccac

SEQ ID NO: 1423354 - RNA, 14 nt, Pseudomonas aeruginosa PA01
gauaaggcaaagcg

SEQ ID NO: 1423355 - RNA, 13 nt, Pseudomonas aeruginosa PA01
gauaagccgcgcc

SEQ ID NO: 1423356 - RNA, 18 nt, Pseudomonas aeruginosa PA01
gauaaucgcagcgcgguc

SEQ ID NO: 1423357 - RNA, 14 nt, Pseudomonas aeruginosa PA01
gaguucggcgagca

SEQ ID NO: 1423358 - RNA, 20 nt, Pseudomonas aeruginosa PA01
gaguucgucaaccagcaccg

SEQ ID NO: 1423359 - RNA, 15 nt, Pseudomonas aeruginosa PA01
gaguucgcugcgcgc

SEQ ID NO: 1423360 - RNA, 22 nt, Pseudomonas aeruginosa PA01
gaguucgcgcaggcgcuggcgg

SEQ ID NO: 1423361 - RNA, 17 nt, Pseudomonas aeruginosa PA01
gagucccuugcggcaga

SEQ ID NO: 1423362 - RNA, 20 nt, Pseudomonas aeruginosa PA01
gagucccguccgcugcgcca

SEQ ID NO: 1423363 - RNA, 18 nt, Pseudomonas aeruginosa PA01
gaguccaugcucaggucg

SEQ ID NO: 1423364 - RNA, 16 nt, Pseudomonas aeruginosa PA01
gagucgacccaggccc

SEQ ID NO: 1423365 - RNA, 14 nt, Pseudomonas aeruginosa PA01
gauaacggcagccg

SEQ ID NO: 1423366 - RNA, 17 nt, Pseudomonas aeruginosa PA01
gauaacggcagccgcgu

SEQ ID NO: 1423367 - RNA, 15 nt, Pseudomonas aeruginosa PA01
gauaacgccgauggc

SEQ ID NO: 1423368 - RNA, 16 nt, Pseudomonas aeruginosa PA01
gauaacgccgcuggcg

SEQ ID NO: 1423369 - RNA, 12 nt, Pseudomonas aeruginosa PA01
gauaacgccugu

SEQ ID NO: 1423370 - RNA, 17 nt, Pseudomonas aeruginosa PA01
gauaacguccgcgucau

SEQ ID NO: 1423371 - RNA, 17 nt, Pseudomonas aeruginosa PA01
gaguugcuuggcgcgcu

SEQ ID NO: 1423372 - RNA, 20 nt, Pseudomonas aeruginosa PA01
gaguugcuuggcgcgcuggc

SEQ ID NO: 1423373 - RNA, 16 nt, Pseudomonas aeruginosa PA01
gauaacaccaggagcg

SEQ ID NO: 1423374 - RNA, 13 nt, Pseudomonas aeruginosa PA01
gauaaccgcaagc

SEQ ID NO: 1423375 - RNA, 14 nt, Pseudomonas aeruginosa PA01
gaguugcaggccgg

SEQ ID NO: 1423376 - RNA, 15 nt, Pseudomonas aeruginosa PA01
gauagugcggccagg

SEQ ID NO: 1423377 - RNA, 19 nt, Pseudomonas aeruginosa PA01
gauauccagggccaggaug

SEQ ID NO: 1423378 - RNA, 22 nt, Pseudomonas aeruginosa PA01
gauauccgggcccaggcuggcg

SEQ ID NO: 1423379 - RNA, 23 nt, Pseudomonas aeruginosa PA01
gauauccccccacccgucccgcg

SEQ ID NO: 1423380 - RNA, 20 nt, Pseudomonas aeruginosa PA01
gauaucccgccgccgcgccu

SEQ ID NO: 1423381 - RNA, 21 nt, Pseudomonas aeruginosa PA01
gauaucccgccgccgcgccuu

SEQ ID NO: 1423382 - RNA, 13 nt, Pseudomonas aeruginosa PA01
gauauccgccagg

SEQ ID NO: 1423383 - RNA, 16 nt, Pseudomonas aeruginosa PA01
gauaggcgccggcgcg

SEQ ID NO: 1423384 - RNA, 17 nt, Pseudomonas aeruginosa PA01
gauagggcaucagcccc

SEQ ID NO: 1423385 - RNA, 23 nt, Pseudomonas aeruginosa PA01
gauaggcggcggauaaccgcgag

SEQ ID NO: 1423386 - RNA, 13 nt, Pseudomonas aeruginosa PA01
gauacggcgcagc

SEQ ID NO: 1423387 - RNA, 17 nt, Pseudomonas aeruginosa PA01
gauacgucuucgauggc

SEQ ID NO: 1423388 - RNA, 21 nt, Pseudomonas aeruginosa PA01
gauacgucuucgauggcggcc

SEQ ID NO: 1423389 - RNA, 13 nt, Pseudomonas aeruginosa PA01
gaucaacgccggu

SEQ ID NO: 1423390 - RNA, 14 nt, Pseudomonas aeruginosa PA01
gauaucugggccau

SEQ ID NO: 1423391 - RNA, 16 nt, Pseudomonas aeruginosa PA01
gauaucugggccaucg

SEQ ID NO: 1423392 - RNA, 14 nt, Pseudomonas aeruginosa PA01
gauaucgcuggcgc

SEQ ID NO: 1423393 - RNA, 13 nt, Pseudomonas aeruginosa PA01
gauaucggcgccg

SEQ ID NO: 1423394 - RNA, 22 nt, Pseudomonas aeruginosa PA01
gauaucggcgccggccuccagc

SEQ ID NO: 1423395 - RNA, 21 nt, Pseudomonas aeruginosa PA01
gaucaccaccacgccgucgcc

SEQ ID NO: 1423396 - RNA, 13 nt, Pseudomonas aeruginosa PA01
gaucaccaccagc

SEQ ID NO: 1423397 - RNA, 14 nt, Pseudomonas aeruginosa PA01
gaucaccaccagca

SEQ ID NO: 1423398 - RNA, 17 nt, Pseudomonas aeruginosa PA01
gaucaccaccagcgccg

SEQ ID NO: 1423399 - RNA, 18 nt, Pseudomonas aeruginosa PA01
gaucaccaccagcgccgc

SEQ ID NO: 1423400 - RNA, 18 nt, Pseudomonas aeruginosa PA01
gaucaccaccggcuggcg

SEQ ID NO: 1423401 - RNA, 21 nt, Pseudomonas aeruginosa PA01
gaucaccagcaauugccggcg

SEQ ID NO: 1423402 - RNA, 14 nt, Pseudomonas aeruginosa PA01
gaucaccagcgcca

SEQ ID NO: 1423403 - RNA, 20 nt, Pseudomonas aeruginosa PA01
gaucaccagcgccaggccgc

SEQ ID NO: 1423404 - RNA, 22 nt, Pseudomonas aeruginosa PA01
gaucaccagcgccaggccgccg

SEQ ID NO: 1423405 - RNA, 23 nt, Pseudomonas aeruginosa PA01
gaucaccagcgccaggccgccga

SEQ ID NO: 1423406 - RNA, 23 nt, Pseudomonas aeruginosa PA01
gaucaacuccgccaggcgcucca

SEQ ID NO: 1423407 - RNA, 20 nt, Pseudomonas aeruginosa PA01
gaucaacgcggccagcagca

SEQ ID NO: 1423408 - RNA, 17 nt, Pseudomonas aeruginosa PA01
gaucacaucgcccggca

SEQ ID NO: 1423409 - RNA, 21 nt, Pseudomonas aeruginosa PA01
gagcaucaccgcgguggaggc

SEQ ID NO: 1423410 - RNA, 22 nt, Pseudomonas aeruginosa PA01
gagcauccacagggucggcagg

SEQ ID NO: 1423411 - RNA, 13 nt, Pseudomonas aeruginosa PA01
gagcaucggcgcg

SEQ ID NO: 1423412 - RNA, 16 nt, Pseudomonas aeruginosa PA01
gagcaucucggccagg

SEQ ID NO: 1423413 - RNA, 13 nt, Pseudomonas aeruginosa PA01
gagcaucugccgg

SEQ ID NO: 1423414 - RNA, 16 nt, Pseudomonas aeruginosa PA01
gagcaucugccgggcg

SEQ ID NO: 1423415 - RNA, 22 nt, Pseudomonas aeruginosa PA01
gagcaucugccgggcgcgcugg

SEQ ID NO: 1423416 - RNA, 18 nt, Pseudomonas aeruginosa PA01
gagcagucgccuggcccu

SEQ ID NO: 1423417 - RNA, 14 nt, Pseudomonas aeruginosa PA01
gagcaguucgucga

SEQ ID NO: 1423418 - RNA, 17 nt, Pseudomonas aeruginosa PA01
gagcaguugcagauaac

SEQ ID NO: 1423419 - RNA, 19 nt, Pseudomonas aeruginosa PA01
gagcaguuccaggcguccg

SEQ ID NO: 1423420 - RNA, 17 nt, Pseudomonas aeruginosa PA01
gagcaguucccccagca

SEQ ID NO: 1423421 - RNA, 22 nt, Pseudomonas aeruginosa PA01
gagcaguucccccagcaccugg

SEQ ID NO: 1423422 - RNA, 18 nt, Pseudomonas aeruginosa PA01
gagcaugauggugccgcc

SEQ ID NO: 1423423 - RNA, 19 nt, Pseudomonas aeruginosa PA01
gagcaugauggugccgccg

SEQ ID NO: 1423424 - RNA, 14 nt, Pseudomonas aeruginosa PA01
gagcaucuggcccg

SEQ ID NO: 1423425 - RNA, 22 nt, Pseudomonas aeruginosa PA01
gagcaugacgauaucggcgccg

SEQ ID NO: 1423426 - RNA, 19 nt, Pseudomonas aeruginosa PA01
gagcaugucuucgucgcgc

SEQ ID NO: 1423427 - RNA, 22 nt, Pseudomonas aeruginosa PA01
gagcauuccgacaaggagcgcg

SEQ ID NO: 1423428 - RNA, 12 nt, Pseudomonas aeruginosa PA01
gagcauggcguu

SEQ ID NO: 1423429 - RNA, 22 nt, Pseudomonas aeruginosa PA01
gagcauggcguugagguugcga

SEQ ID NO: 1423430 - RNA, 15 nt, Pseudomonas aeruginosa PA01
gagcccccggcgccc

SEQ ID NO: 1423431 - RNA, 19 nt, Pseudomonas aeruginosa PA01
gagcccagcggcagggcgg

SEQ ID NO: 1423432 - RNA, 19 nt, Pseudomonas aeruginosa PA01
gagccagucgagagcgggu

SEQ ID NO: 1423433 - RNA, 22 nt, Pseudomonas aeruginosa PA01
gagccauucggcuuccugggcg

SEQ ID NO: 1423434 - RNA, 15 nt, Pseudomonas aeruginosa PA01
gagccaugggccggc

SEQ ID NO: 1423435 - RNA, 19 nt, Pseudomonas aeruginosa PA01
gagccaugggccggccgac

SEQ ID NO: 1423436 - RNA, 16 nt, Pseudomonas aeruginosa PA01
gagccaucgcuccagc

SEQ ID NO: 1423437 - RNA, 20 nt, Pseudomonas aeruginosa PA01
gagccagguuuccggcagca

SEQ ID NO: 1423438 - RNA, 15 nt, Pseudomonas aeruginosa PA01
gagccagccgcgagu

SEQ ID NO: 1423439 - RNA, 21 nt, Pseudomonas aeruginosa PA01
gagccagccgcggaucaccug

SEQ ID NO: 1423440 - RNA, 22 nt, Pseudomonas aeruginosa PA01
gagccagccguggcaggcgccc

SEQ ID NO: 1423441 - RNA, 13 nt, Pseudomonas aeruginosa PA01
gagccaggcggcu

SEQ ID NO: 1423442 - RNA, 16 nt, Pseudomonas aeruginosa PA01
gagccaggcggcuccc

SEQ ID NO: 1423443 - RNA, 21 nt, Pseudomonas aeruginosa PA01
gagccagguacggaugccgcg

SEQ ID NO: 1423444 - RNA, 14 nt, Pseudomonas aeruginosa PA01
gagccagccgcagc

SEQ ID NO: 1423445 - RNA, 17 nt, Pseudomonas aeruginosa PA01
gagccagccgcagcccg

SEQ ID NO: 1423446 - RNA, 19 nt, Pseudomonas aeruginosa PA01
gagccagccgcagcccggu

SEQ ID NO: 1423447 - RNA, 14 nt, Pseudomonas aeruginosa PA01
gagcagggugacgg

SEQ ID NO: 1423448 - RNA, 22 nt, Pseudomonas aeruginosa PA01
gagcagggugacggugaucgcc

SEQ ID NO: 1423449 - RNA, 23 nt, Pseudomonas aeruginosa PA01
gagcagggccgagcgcagcgcca

SEQ ID NO: 1423450 - RNA, 19 nt, Pseudomonas aeruginosa PA01
gagcagcgccagccagggu

SEQ ID NO: 1423451 - RNA, 12 nt, Pseudomonas aeruginosa PA01
gagcaggucgcg

SEQ ID NO: 1423452 - RNA, 14 nt, Pseudomonas aeruginosa PA01
gagcaggucgcgga

SEQ ID NO: 1423453 - RNA, 21 nt, Pseudomonas aeruginosa PA01
gagcaggacugcccgcguccc

SEQ ID NO: 1423454 - RNA, 15 nt, Pseudomonas aeruginosa PA01
gagcagggcgaugcc

SEQ ID NO: 1423455 - RNA, 17 nt, Pseudomonas aeruginosa PA01
gagcagggcgaugccga

SEQ ID NO: 1423456 - RNA, 23 nt, Pseudomonas aeruginosa PA01
gagcagggcgaugccgauggcgc

SEQ ID NO: 1423457 - RNA, 15 nt, Pseudomonas aeruginosa PA01
gagcagggcgccgau

SEQ ID NO: 1423458 - RNA, 17 nt, Pseudomonas aeruginosa PA01
gagcagggcgccgauca

SEQ ID NO: 1423459 - RNA, 19 nt, Pseudomonas aeruginosa PA01
gagcagggcgccgaucagg

SEQ ID NO: 1423460 - RNA, 20 nt, Pseudomonas aeruginosa PA01
gagcagggcgcugagcgcgg

SEQ ID NO: 1423461 - RNA, 21 nt, Pseudomonas aeruginosa PA01
gagcagggcguucuuggccgc

SEQ ID NO: 1423462 - RNA, 13 nt, Pseudomonas aeruginosa PA01
gagcaggcgccgg

SEQ ID NO: 1423463 - RNA, 14 nt, Pseudomonas aeruginosa PA01
gagcaggcgccgga

SEQ ID NO: 1423464 - RNA, 14 nt, Pseudomonas aeruginosa PA01
gagcaggcgcgcca

SEQ ID NO: 1423465 - RNA, 21 nt, Pseudomonas aeruginosa PA01
gagcaggcggaaaaagcgcgg

SEQ ID NO: 1423466 - RNA, 17 nt, Pseudomonas aeruginosa PA01
gagcaggcggaucgccg

SEQ ID NO: 1423467 - RNA, 14 nt, Pseudomonas aeruginosa PA01
gagcaggcgggagu

SEQ ID NO: 1423468 - RNA, 14 nt, Pseudomonas aeruginosa PA01
gagcaggcugccga

SEQ ID NO: 1423469 - RNA, 16 nt, Pseudomonas aeruginosa PA01
gagcaggcugccgaag

SEQ ID NO: 1423470 - RNA, 14 nt, Pseudomonas aeruginosa PA01
gagcagcucgccgg

SEQ ID NO: 1423471 - RNA, 17 nt, Pseudomonas aeruginosa PA01
gagcagcucgccggcgu

SEQ ID NO: 1423472 - RNA, 16 nt, Pseudomonas aeruginosa PA01
gagcagcggacgcagc

SEQ ID NO: 1423473 - RNA, 19 nt, Pseudomonas aeruginosa PA01
gagcagcggacgcagcggg

SEQ ID NO: 1423474 - RNA, 22 nt, Pseudomonas aeruginosa PA01
gagcagcggacgcagcgggucg

SEQ ID NO: 1423475 - RNA, 23 nt, Pseudomonas aeruginosa PA01
gagcagcggcacgcucuggccgu

SEQ ID NO: 1423476 - RNA, 23 nt, Pseudomonas aeruginosa PA01
gagcagcggcgccaacucggccu

SEQ ID NO: 1423477 - RNA, 23 nt, Pseudomonas aeruginosa PA01
gagcaggccacgcaccagcuccc

SEQ ID NO: 1423478 - RNA, 21 nt, Pseudomonas aeruginosa PA01
gagcaggcccaugauggucgg

SEQ ID NO: 1423479 - RNA, 22 nt, Pseudomonas aeruginosa PA01
gagcaggcccaugauggucggc

SEQ ID NO: 1423480 - RNA, 22 nt, Pseudomonas aeruginosa PA01
gagcaggaacucgaucagcgcg

SEQ ID NO: 1423481 - RNA, 16 nt, Pseudomonas aeruginosa PA01
gagcaggacagcaggg

SEQ ID NO: 1423482 - RNA, 19 nt, Pseudomonas aeruginosa PA01
gagcaggacgccgaacccg

SEQ ID NO: 1423483 - RNA, 16 nt, Pseudomonas aeruginosa PA01
gagcagcccgggcaac

SEQ ID NO: 1423484 - RNA, 14 nt, Pseudomonas aeruginosa PA01
gagcagcgcgcggc

SEQ ID NO: 1423485 - RNA, 17 nt, Pseudomonas aeruginosa PA01
gagcagcgcgcggcucg

SEQ ID NO: 1423486 - RNA, 12 nt, Pseudomonas aeruginosa PA01
gagcagcgccgc

SEQ ID NO: 1423487 - RNA, 17 nt, Pseudomonas aeruginosa PA01
gagcagcgccgcggugu

SEQ ID NO: 1423488 - RNA, 22 nt, Pseudomonas aeruginosa PA01
gagcagccaggcgaagcggcug

SEQ ID NO: 1423489 - RNA, 19 nt, Pseudomonas aeruginosa PA01
gagcagccaagccaccagc

SEQ ID NO: 1423490 - RNA, 21 nt, Pseudomonas aeruginosa PA01
gagcagccaagccaccagcga

SEQ ID NO: 1423491 - RNA, 20 nt, Pseudomonas aeruginosa PA01
gacgucguggauaggcggcg

SEQ ID NO: 1423492 - RNA, 15 nt, Pseudomonas aeruginosa PA01
gagcagcacggccuc

SEQ ID NO: 1423493 - RNA, 16 nt, Pseudomonas aeruginosa PA01
gagcagcacggccucg

SEQ ID NO: 1423494 - RNA, 17 nt, Pseudomonas aeruginosa PA01
gagcagcacggccucgc

SEQ ID NO: 1423495 - RNA, 16 nt, Pseudomonas aeruginosa PA01
gacgucguagccaggc

SEQ ID NO: 1423496 - RNA, 13 nt, Pseudomonas aeruginosa PA01
gagccgaucacca

SEQ ID NO: 1423497 - RNA, 14 nt, Pseudomonas aeruginosa PA01
gagccgaucaccag

SEQ ID NO: 1423498 - RNA, 16 nt, Pseudomonas aeruginosa PA01
gagccgaucaccagca

SEQ ID NO: 1423499 - RNA, 17 nt, Pseudomonas aeruginosa PA01
gagccgcccucggggcc

SEQ ID NO: 1423500 - RNA, 12 nt, Pseudomonas aeruginosa PA01
gagccgcgcugc

SEQ ID NO: 1423501 - RNA, 13 nt, Pseudomonas aeruginosa PA01
gagccgcgcagca

SEQ ID NO: 1423502 - RNA, 14 nt, Pseudomonas aeruginosa PA01
gagccgcgcagcag

SEQ ID NO: 1423503 - RNA, 12 nt, Pseudomonas aeruginosa PA01
gagccgcgccuu

SEQ ID NO: 1423504 - RNA, 20 nt, Pseudomonas aeruginosa PA01
gagccgacauccugucgagg

SEQ ID NO: 1423505 - RNA, 22 nt, Pseudomonas aeruginosa PA01
gagccgacauccugucgaggcc

SEQ ID NO: 1423506 - RNA, 15 nt, Pseudomonas aeruginosa PA01
gagcccuugcgcggc

SEQ ID NO: 1423507 - RNA, 15 nt, Pseudomonas aeruginosa PA01
gagccgagcaggcca

SEQ ID NO: 1423508 - RNA, 16 nt, Pseudomonas aeruginosa PA01
gagccgagcaggccac

SEQ ID NO: 1423509 - RNA, 14 nt, Pseudomonas aeruginosa PA01
gagcccgagugcgc

SEQ ID NO: 1423510 - RNA, 22 nt, Pseudomonas aeruginosa PA01
gagcccggcaaaugccgggcuu

SEQ ID NO: 1423511 - RNA, 16 nt, Pseudomonas aeruginosa PA01
gagcccgucgaagcca

SEQ ID NO: 1423512 - RNA, 21 nt, Pseudomonas aeruginosa PA01
gagcccgucgaagccaggcac

SEQ ID NO: 1423513 - RNA, 20 nt, Pseudomonas aeruginosa PA01
gagccccggcaggcaggccu

SEQ ID NO: 1423514 - RNA, 14 nt, Pseudomonas aeruginosa PA01
gagcccgccugaag

SEQ ID NO: 1423515 - RNA, 14 nt, Pseudomonas aeruginosa PA01
gagccggccaggcg

SEQ ID NO: 1423516 - RNA, 13 nt, Pseudomonas aeruginosa PA01
gagccgcuggguu

SEQ ID NO: 1423517 - RNA, 16 nt, Pseudomonas aeruginosa PA01
gagccggacggcggcg

SEQ ID NO: 1423518 - RNA, 11 nt, Pseudomonas aeruginosa PA01
gagccggccag

SEQ ID NO: 1423519 - RNA, 14 nt, Pseudomonas aeruginosa PA01
gagccgcugcaugg

SEQ ID NO: 1423520 - RNA, 14 nt, Pseudomonas aeruginosa PA01
gagccggugccggc

SEQ ID NO: 1423521 - RNA, 23 nt, Pseudomonas aeruginosa PA01
gagccgguagugcuucagguagc

SEQ ID NO: 1423522 - RNA, 15 nt, Pseudomonas aeruginosa PA01
gagccguuccaggcg

SEQ ID NO: 1423523 - RNA, 16 nt, Pseudomonas aeruginosa PA01
gagccguuccaggcgg

SEQ ID NO: 1423524 - RNA, 12 nt, Pseudomonas aeruginosa PA01
gagccggugccg

SEQ ID NO: 1423525 - RNA, 18 nt, Pseudomonas aeruginosa PA01
gagccguccugcggccgc

SEQ ID NO: 1423526 - RNA, 21 nt, Pseudomonas aeruginosa PA01
gagccguccugcggccgcaac

SEQ ID NO: 1423527 - RNA, 22 nt, Pseudomonas aeruginosa PA01
gagccguccugcggccgcaacc

SEQ ID NO: 1423528 - RNA, 17 nt, Pseudomonas aeruginosa PA01
gagccgucgccggcgac

SEQ ID NO: 1423529 - RNA, 20 nt, Pseudomonas aeruginosa PA01
gagcguucggaucggcccgg

SEQ ID NO: 1423530 - RNA, 15 nt, Pseudomonas aeruginosa PA01
gagcgucgagucgcg

SEQ ID NO: 1423531 - RNA, 18 nt, Pseudomonas aeruginosa PA01
gagcguccaccagcgccc

SEQ ID NO: 1423532 - RNA, 15 nt, Pseudomonas aeruginosa PA01
gagcguccgccgccg

SEQ ID NO: 1423533 - RNA, 17 nt, Pseudomonas aeruginosa PA01
gagcguccggcagggcc

SEQ ID NO: 1423534 - RNA, 12 nt, Pseudomonas aeruginosa PA01
gagcucggccag

SEQ ID NO: 1423535 - RNA, 16 nt, Pseudomonas aeruginosa PA01
gagcucggccaggcac

SEQ ID NO: 1423536 - RNA, 15 nt, Pseudomonas aeruginosa PA01
gagcuccagggcugc

SEQ ID NO: 1423537 - RNA, 23 nt, Pseudomonas aeruginosa PA01
gagcuccagggcugccaccgagg

SEQ ID NO: 1423538 - RNA, 12 nt, Pseudomonas aeruginosa PA01
gagcggcugccg

SEQ ID NO: 1423539 - RNA, 15 nt, Pseudomonas aeruginosa PA01
gagcggcugccgagg

SEQ ID NO: 1423540 - RNA, 16 nt, Pseudomonas aeruginosa PA01
gagcggcugguggccg

SEQ ID NO: 1423541 - RNA, 12 nt, Pseudomonas aeruginosa PA01
gagcggcggccg

SEQ ID NO: 1423542 - RNA, 12 nt, Pseudomonas aeruginosa PA01
gagcggcgccag

SEQ ID NO: 1423543 - RNA, 15 nt, Pseudomonas aeruginosa PA01
gagcggcgccaggcg

SEQ ID NO: 1423544 - RNA, 15 nt, Pseudomonas aeruginosa PA01
gagcggcgcccuggc

SEQ ID NO: 1423545 - RNA, 19 nt, Pseudomonas aeruginosa PA01
gagcggaucgucgcggcgc

SEQ ID NO: 1423546 - RNA, 21 nt, Pseudomonas aeruginosa PA01
gagcggaucgucgcggcgcga

SEQ ID NO: 1423547 - RNA, 21 nt, Pseudomonas aeruginosa PA01
gagcggcaccucgauggcggc

SEQ ID NO: 1423548 - RNA, 16 nt, Pseudomonas aeruginosa PA01
gagcggcaaggccaag

SEQ ID NO: 1423549 - RNA, 23 nt, Pseudomonas aeruginosa PA01
gagcggcaaggccaagucggccg

SEQ ID NO: 1423550 - RNA, 14 nt, Pseudomonas aeruginosa PA01
gagcggcaggccgc

SEQ ID NO: 1423551 - RNA, 17 nt, Pseudomonas aeruginosa PA01
gagcggcaggccgccga

SEQ ID NO: 1423552 - RNA, 13 nt, Pseudomonas aeruginosa PA01
gagcggccggcgc

SEQ ID NO: 1423553 - RNA, 14 nt, Pseudomonas aeruginosa PA01
gagcggccggcgcg

SEQ ID NO: 1423554 - RNA, 20 nt, Pseudomonas aeruginosa PA01
gagcggccggcgcggcgcgu

SEQ ID NO: 1423555 - RNA, 12 nt, Pseudomonas aeruginosa PA01
gagcggccgugc

SEQ ID NO: 1423556 - RNA, 22 nt, Pseudomonas aeruginosa PA01
gagcggccgugcaugccgacga

SEQ ID NO: 1423557 - RNA, 14 nt, Pseudomonas aeruginosa PA01
gagcgggucgaugg

SEQ ID NO: 1423558 - RNA, 18 nt, Pseudomonas aeruginosa PA01
gagcgguuauucgcccua

SEQ ID NO: 1423559 - RNA, 18 nt, Pseudomonas aeruginosa PA01
gagcggugaaaccggcaa

SEQ ID NO: 1423560 - RNA, 20 nt, Pseudomonas aeruginosa PA01
gagcgggucagcagcaccgc

SEQ ID NO: 1423561 - RNA, 13 nt, Pseudomonas aeruginosa PA01
gagcgggcggucg

SEQ ID NO: 1423562 - RNA, 18 nt, Pseudomonas aeruginosa PA01
gagcgggcgccggaccag

SEQ ID NO: 1423563 - RNA, 16 nt, Pseudomonas aeruginosa PA01
gagcggguagcgccgg

SEQ ID NO: 1423564 - RNA, 17 nt, Pseudomonas aeruginosa PA01
gagcggguagcgccggu

SEQ ID NO: 1423565 - RNA, 18 nt, Pseudomonas aeruginosa PA01
gagcgcggcgcaggcgau

SEQ ID NO: 1423566 - RNA, 12 nt, Pseudomonas aeruginosa PA01
gagcgcggccgg

SEQ ID NO: 1423567 - RNA, 16 nt, Pseudomonas aeruginosa PA01
gagcgcggccggccac

SEQ ID NO: 1423568 - RNA, 23 nt, Pseudomonas aeruginosa PA01
gagcgcggucacccauucgaugc

SEQ ID NO: 1423569 - RNA, 20 nt, Pseudomonas aeruginosa PA01
gagcgcggcuucagagcugg

SEQ ID NO: 1423570 - RNA, 20 nt, Pseudomonas aeruginosa PA01
gagcggaaacccgugguccg

SEQ ID NO: 1423571 - RNA, 20 nt, Pseudomonas aeruginosa PA01
gagcggaacgggacgccugg

SEQ ID NO: 1423572 - RNA, 21 nt, Pseudomonas aeruginosa PA01
gagcggaacgggacgccuggc

SEQ ID NO: 1423573 - RNA, 12 nt, Pseudomonas aeruginosa PA01
gagcgcucgcgc

SEQ ID NO: 1423574 - RNA, 14 nt, Pseudomonas aeruginosa PA01
gagcgcucgcgcag

SEQ ID NO: 1423575 - RNA, 19 nt, Pseudomonas aeruginosa PA01
gagcgcugccugcaccggg

SEQ ID NO: 1423576 - RNA, 23 nt, Pseudomonas aeruginosa PA01
gagcgcuccaccgcgcuccgcug

SEQ ID NO: 1423577 - RNA, 14 nt, Pseudomonas aeruginosa PA01
gagcgcgccgccga

SEQ ID NO: 1423578 - RNA, 14 nt, Pseudomonas aeruginosa PA01
gagcgcgcccaggc

SEQ ID NO: 1423579 - RNA, 20 nt, Pseudomonas aeruginosa PA01
gagcgcgcccaggcaggcga

SEQ ID NO: 1423580 - RNA, 21 nt, Pseudomonas aeruginosa PA01
gagcgcgcccaggcaggcgau

SEQ ID NO: 1423581 - RNA, 19 nt, Pseudomonas aeruginosa PA01
gagcgcgcccugcaggccg

SEQ ID NO: 1423582 - RNA, 20 nt, Pseudomonas aeruginosa PA01
gagcgcgcccugcaggccga

SEQ ID NO: 1423583 - RNA, 15 nt, Pseudomonas aeruginosa PA01
gagcgccucgaucgc

SEQ ID NO: 1423584 - RNA, 16 nt, Pseudomonas aeruginosa PA01
gagcgcgaaagcgccc

SEQ ID NO: 1423585 - RNA, 16 nt, Pseudomonas aeruginosa PA01
gagcgcgaucagccgc

SEQ ID NO: 1423586 - RNA, 22 nt, Pseudomonas aeruginosa PA01
gagcgcgacuuggacagcgucu

SEQ ID NO: 1423587 - RNA, 21 nt, Pseudomonas aeruginosa PA01
gagcgcccggcaaucaggcgc

SEQ ID NO: 1423588 - RNA, 14 nt, Pseudomonas aeruginosa PA01
gagcgccgccaggc

SEQ ID NO: 1423589 - RNA, 20 nt, Pseudomonas aeruginosa PA01
gagcgccgccaggcaggccg

SEQ ID NO: 1423590 - RNA, 21 nt, Pseudomonas aeruginosa PA01
gagcgccgccaggcaggccgg

SEQ ID NO: 1423591 - RNA, 13 nt, Pseudomonas aeruginosa PA01
gagcgccgaaggc

SEQ ID NO: 1423592 - RNA, 13 nt, Pseudomonas aeruginosa PA01
gagcgccggcgcg

SEQ ID NO: 1423593 - RNA, 14 nt, Pseudomonas aeruginosa PA01
gagcgccggcgcgg

SEQ ID NO: 1423594 - RNA, 15 nt, Pseudomonas aeruginosa PA01
gagcgccggcgcggu

SEQ ID NO: 1423595 - RNA, 12 nt, Pseudomonas aeruginosa PA01
gagcgccgcggc

SEQ ID NO: 1423596 - RNA, 14 nt, Pseudomonas aeruginosa PA01
gagcgccgcggcgg

SEQ ID NO: 1423597 - RNA, 14 nt, Pseudomonas aeruginosa PA01
gagcgaucccaggu

SEQ ID NO: 1423598 - RNA, 22 nt, Pseudomonas aeruginosa PA01
gagcgaucccaggucggcgggc

SEQ ID NO: 1423599 - RNA, 15 nt, Pseudomonas aeruginosa PA01
gagcgagggcgucga

SEQ ID NO: 1423600 - RNA, 23 nt, Pseudomonas aeruginosa PA01
gagcgacaccaugcuccgccugg

SEQ ID NO: 1423601 - RNA, 13 nt, Pseudomonas aeruginosa PA01
gagcgaagcgucg

SEQ ID NO: 1423602 - RNA, 14 nt, Pseudomonas aeruginosa PA01
gagcgaaaucggca

SEQ ID NO: 1423603 - RNA, 17 nt, Pseudomonas aeruginosa PA01
gagcgaaaucggcaggc

SEQ ID NO: 1423604 - RNA, 20 nt, Pseudomonas aeruginosa PA01
gagccuugcggcgcucggga

SEQ ID NO: 1423605 - RNA, 20 nt, Pseudomonas aeruginosa PA01
gagccuggaguugugccagc

SEQ ID NO: 1423606 - RNA, 15 nt, Pseudomonas aeruginosa PA01
gagccuggccaggcg

SEQ ID NO: 1423607 - RNA, 19 nt, Pseudomonas aeruginosa PA01
gagccuggccaggcgcucc

SEQ ID NO: 1423608 - RNA, 14 nt, Pseudomonas aeruginosa PA01
gagccugcgugagc

SEQ ID NO: 1423609 - RNA, 16 nt, Pseudomonas aeruginosa PA01
gagcgccagccagcgc

SEQ ID NO: 1423610 - RNA, 22 nt, Pseudomonas aeruginosa PA01
gagcgccagccagcgcggcucg

SEQ ID NO: 1423611 - RNA, 13 nt, Pseudomonas aeruginosa PA01
gagcgccagcacc

SEQ ID NO: 1423612 - RNA, 14 nt, Pseudomonas aeruginosa PA01
gagcgccagcacca

SEQ ID NO: 1423613 - RNA, 19 nt, Pseudomonas aeruginosa PA01
gagcgccagcaccagcagg

SEQ ID NO: 1423614 - RNA, 17 nt, Pseudomonas aeruginosa PA01
gagcgccagcagguugg

SEQ ID NO: 1423615 - RNA, 13 nt, Pseudomonas aeruginosa PA01
gagcgccaggcgc

SEQ ID NO: 1423616 - RNA, 14 nt, Pseudomonas aeruginosa PA01
gagcgccagcgaga

SEQ ID NO: 1423617 - RNA, 19 nt, Pseudomonas aeruginosa PA01
gagcgccaugacccgcggc

SEQ ID NO: 1423618 - RNA, 22 nt, Pseudomonas aeruginosa PA01
gagcgccaugacccgcggcagg

SEQ ID NO: 1423619 - RNA, 19 nt, Pseudomonas aeruginosa PA01
gagcgcaguucgucgccca

SEQ ID NO: 1423620 - RNA, 13 nt, Pseudomonas aeruginosa PA01
gagcgcagcgcca

SEQ ID NO: 1423621 - RNA, 15 nt, Pseudomonas aeruginosa PA01
gaugaaacugcccgg

SEQ ID NO: 1423622 - RNA, 15 nt, Pseudomonas aeruginosa PA01
gaugacgauggccgc

SEQ ID NO: 1423623 - RNA, 17 nt, Pseudomonas aeruginosa PA01
gaugacgauggccgccg

SEQ ID NO: 1423624 - RNA, 19 nt, Pseudomonas aeruginosa PA01
gaugacgauggccgccgcc

SEQ ID NO: 1423625 - RNA, 22 nt, Pseudomonas aeruginosa PA01
gaugaccuucggaucggucagc

SEQ ID NO: 1423626 - RNA, 22 nt, Pseudomonas aeruginosa PA01
gaugaucaggccgagcaccggc

SEQ ID NO: 1423627 - RNA, 12 nt, Pseudomonas aeruginosa PA01
gaugaucagccc

SEQ ID NO: 1423628 - RNA, 13 nt, Pseudomonas aeruginosa PA01
gaugaucagcccu

SEQ ID NO: 1423629 - RNA, 23 nt, Pseudomonas aeruginosa PA01
gaugaucagcccuucgcgcucga

SEQ ID NO: 1423630 - RNA, 14 nt, Pseudomonas aeruginosa PA01
gaugcaccggccac

SEQ ID NO: 1423631 - RNA, 15 nt, Pseudomonas aeruginosa PA01
gaugcaccggccacu

SEQ ID NO: 1423632 - RNA, 21 nt, Pseudomonas aeruginosa PA01
gaugcaccggccacucgcagc

SEQ ID NO: 1423633 - RNA, 22 nt, Pseudomonas aeruginosa PA01
gaugcaccggccacucgcagcc

SEQ ID NO: 1423634 - RNA, 19 nt, Pseudomonas aeruginosa PA01
gaugcacaccagcuccccg

SEQ ID NO: 1423635 - RNA, 19 nt, Pseudomonas aeruginosa PA01
gaugcaaccgcccuggucc

SEQ ID NO: 1423636 - RNA, 21 nt, Pseudomonas aeruginosa PA01
gaugcaauggauguugccgcc

SEQ ID NO: 1423637 - RNA, 19 nt, Pseudomonas aeruginosa PA01
gaugcagucccgccaggcg

SEQ ID NO: 1423638 - RNA, 15 nt, Pseudomonas aeruginosa PA01
gaugcagccgauggc

SEQ ID NO: 1423639 - RNA, 19 nt, Pseudomonas aeruginosa PA01
gaugcagccggggcucagg

SEQ ID NO: 1423640 - RNA, 16 nt, Pseudomonas aeruginosa PA01
gaugcagcgucgcgcg

SEQ ID NO: 1423641 - RNA, 19 nt, Pseudomonas aeruginosa PA01
gaugcagagaaaaggccgc

SEQ ID NO: 1423642 - RNA, 15 nt, Pseudomonas aeruginosa PA01
gaugaucuugucgug

SEQ ID NO: 1423643 - RNA, 21 nt, Pseudomonas aeruginosa PA01
gaugaucggcagccguccgcc

SEQ ID NO: 1423644 - RNA, 17 nt, Pseudomonas aeruginosa PA01
gaugaucuccgcgccgg

SEQ ID NO: 1423645 - RNA, 12 nt, Pseudomonas aeruginosa PA01
gaugaucgccgg

SEQ ID NO: 1423646 - RNA, 14 nt, Pseudomonas aeruginosa PA01
gaugaucagggcac

SEQ ID NO: 1423647 - RNA, 23 nt, Pseudomonas aeruginosa PA01
gaugaugguauccaggcgguugc

SEQ ID NO: 1423648 - RNA, 17 nt, Pseudomonas aeruginosa PA01
gaucugcugggucaucg

SEQ ID NO: 1423649 - RNA, 19 nt, Pseudomonas aeruginosa PA01
gaucugcugcaacauggcg

SEQ ID NO: 1423650 - RNA, 20 nt, Pseudomonas aeruginosa PA01
gaucugcucguccaggccgc

SEQ ID NO: 1423651 - RNA, 22 nt, Pseudomonas aeruginosa PA01
gaucugcucguccaggccgcag

SEQ ID NO: 1423652 - RNA, 18 nt, Pseudomonas aeruginosa PA01
gaucugcucgacgucguc

SEQ ID NO: 1423653 - RNA, 20 nt, Pseudomonas aeruginosa PA01
gaucucggugggcuugccgg

SEQ ID NO: 1423654 - RNA, 19 nt, Pseudomonas aeruginosa PA01
gaucucgguaucgcuucca

SEQ ID NO: 1423655 - RNA, 21 nt, Pseudomonas aeruginosa PA01
gaucugcgggaacuuggcgcg

SEQ ID NO: 1423656 - RNA, 16 nt, Pseudomonas aeruginosa PA01
gaucucgcggcgcggc

SEQ ID NO: 1423657 - RNA, 17 nt, Pseudomonas aeruginosa PA01
gaucucgcggcgcggcg

SEQ ID NO: 1423658 - RNA, 13 nt, Pseudomonas aeruginosa PA01
gaucucggcgcgg

SEQ ID NO: 1423659 - RNA, 16 nt, Pseudomonas aeruginosa PA01
gaucucggcggccagg

SEQ ID NO: 1423660 - RNA, 22 nt, Pseudomonas aeruginosa PA01
gaucucgccgaaggugcaggcc

SEQ ID NO: 1423661 - RNA, 16 nt, Pseudomonas aeruginosa PA01
gaucuugcgcccggcg

SEQ ID NO: 1423662 - RNA, 21 nt, Pseudomonas aeruginosa PA01
gaucuugcgcccggcgcgacc

SEQ ID NO: 1423663 - RNA, 13 nt, Pseudomonas aeruginosa PA01
gaucuuguagccg

SEQ ID NO: 1423664 - RNA, 17 nt, Pseudomonas aeruginosa PA01
gaucuucuaccuggcgc

SEQ ID NO: 1423665 - RNA, 18 nt, Pseudomonas aeruginosa PA01
gaucuucuaccuggcgcu

SEQ ID NO: 1423666 - RNA, 16 nt, Pseudomonas aeruginosa PA01
gaucuucuccgccgcg

SEQ ID NO: 1423667 - RNA, 20 nt, Pseudomonas aeruginosa PA01
gaucugcuugcgcgccgccg

SEQ ID NO: 1423668 - RNA, 16 nt, Pseudomonas aeruginosa PA01
gaucucgcccaguacc

SEQ ID NO: 1423669 - RNA, 14 nt, Pseudomonas aeruginosa PA01
gaucucgccgaagg

SEQ ID NO: 1423670 - RNA, 16 nt, Pseudomonas aeruginosa PA01
gaucuccaacuggcgg

SEQ ID NO: 1423671 - RNA, 13 nt, Pseudomonas aeruginosa PA01
gaucuaccugcgu

SEQ ID NO: 1423672 - RNA, 14 nt, Pseudomonas aeruginosa PA01
gaucggcgcgccgg

SEQ ID NO: 1423673 - RNA, 16 nt, Pseudomonas aeruginosa PA01
gaucggcgcgccggcc

SEQ ID NO: 1423674 - RNA, 20 nt, Pseudomonas aeruginosa PA01
gaucggcgcgccggcccggg

SEQ ID NO: 1423675 - RNA, 18 nt, Pseudomonas aeruginosa PA01
gaucggcgcccagcacca

SEQ ID NO: 1423676 - RNA, 13 nt, Pseudomonas aeruginosa PA01
gaucggcgcgccg

SEQ ID NO: 1423677 - RNA, 12 nt, Pseudomonas aeruginosa PA01
gaucggcccggc

SEQ ID NO: 1423678 - RNA, 19 nt, Pseudomonas aeruginosa PA01
gaucggcccuucgacaugg

SEQ ID NO: 1423679 - RNA, 23 nt, Pseudomonas aeruginosa PA01
gaucggcccuucgacaugggccg

SEQ ID NO: 1423680 - RNA, 16 nt, Pseudomonas aeruginosa PA01
gaucggccgccagugc

SEQ ID NO: 1423681 - RNA, 16 nt, Pseudomonas aeruginosa PA01
gaucggccucgcggcg

SEQ ID NO: 1423682 - RNA, 18 nt, Pseudomonas aeruginosa PA01
gaucggccucgcggcgcu

SEQ ID NO: 1423683 - RNA, 19 nt, Pseudomonas aeruginosa PA01
gaucggccucgcggcgcuc

SEQ ID NO: 1423684 - RNA, 16 nt, Pseudomonas aeruginosa PA01
gaucgcguuccagcaa

SEQ ID NO: 1423685 - RNA, 19 nt, Pseudomonas aeruginosa PA01
gaucgcguuccagcaacgg

SEQ ID NO: 1423686 - RNA, 18 nt, Pseudomonas aeruginosa PA01
gaucgcucucgcgcuuga

SEQ ID NO: 1423687 - RNA, 20 nt, Pseudomonas aeruginosa PA01
gaucgcgugggccaccauca

SEQ ID NO: 1423688 - RNA, 20 nt, Pseudomonas aeruginosa PA01
gaucgcguuugccgucccgg

SEQ ID NO: 1423689 - RNA, 17 nt, Pseudomonas aeruginosa PA01
gaucggaagaucgcccg

SEQ ID NO: 1423690 - RNA, 14 nt, Pseudomonas aeruginosa PA01
gaucgcgcggcugg

SEQ ID NO: 1423691 - RNA, 16 nt, Pseudomonas aeruginosa PA01
gaucgcgcggcuggcu

SEQ ID NO: 1423692 - RNA, 19 nt, Pseudomonas aeruginosa PA01
gaucgcgccgucgcuggcg

SEQ ID NO: 1423693 - RNA, 22 nt, Pseudomonas aeruginosa PA01
gaucgcgucguauaggcgcugg

SEQ ID NO: 1423694 - RNA, 15 nt, Pseudomonas aeruginosa PA01
gaucgcgcugggcgc

SEQ ID NO: 1423695 - RNA, 18 nt, Pseudomonas aeruginosa PA01
gaucgcgcugggcgcagc

SEQ ID NO: 1423696 - RNA, 21 nt, Pseudomonas aeruginosa PA01
gaucgcgcugggcgcagcccu

SEQ ID NO: 1423697 - RNA, 22 nt, Pseudomonas aeruginosa PA01
gaucgcgccgagcuggcgcgcg

SEQ ID NO: 1423698 - RNA, 19 nt, Pseudomonas aeruginosa PA01
gaucgcgcagaucgccgcg

SEQ ID NO: 1423699 - RNA, 15 nt, Pseudomonas aeruginosa PA01
gaucgccucggccau

SEQ ID NO: 1423700 - RNA, 15 nt, Pseudomonas aeruginosa PA01
gaucgccuccggcac

SEQ ID NO: 1423701 - RNA, 20 nt, Pseudomonas aeruginosa PA01
gaucgccuccggcacgcugc

SEQ ID NO: 1423702 - RNA, 14 nt, Pseudomonas aeruginosa PA01
gaucgccguguuga

SEQ ID NO: 1423703 - RNA, 20 nt, Pseudomonas aeruginosa PA01
gaucgccguguugaugccga

SEQ ID NO: 1423704 - RNA, 22 nt, Pseudomonas aeruginosa PA01
gaucgccguguugaugccgauc

SEQ ID NO: 1423705 - RNA, 23 nt, Pseudomonas aeruginosa PA01
gaucgccguguugaugccgauca

SEQ ID NO: 1423706 - RNA, 14 nt, Pseudomonas aeruginosa PA01
gaucgccuccacca

SEQ ID NO: 1423707 - RNA, 19 nt, Pseudomonas aeruginosa PA01
gaucgccuccaccagcgcc

SEQ ID NO: 1423708 - RNA, 20 nt, Pseudomonas aeruginosa PA01
gaucgccuccaccagcgccg

SEQ ID NO: 1423709 - RNA, 22 nt, Pseudomonas aeruginosa PA01
gaucgccuccaccagcgccggc

SEQ ID NO: 1423710 - RNA, 16 nt, Pseudomonas aeruginosa PA01
gaucgccggguugccg

SEQ ID NO: 1423711 - RNA, 20 nt, Pseudomonas aeruginosa PA01
gaucgccggguugccgcugg

SEQ ID NO: 1423712 - RNA, 21 nt, Pseudomonas aeruginosa PA01
gaucgccggguugccgcuggc

SEQ ID NO: 1423713 - RNA, 23 nt, Pseudomonas aeruginosa PA01
gaucgccggguugccgcuggccu

SEQ ID NO: 1423714 - RNA, 23 nt, Pseudomonas aeruginosa PA01
gaucgccucguucgucgccgacu

SEQ ID NO: 1423715 - RNA, 16 nt, Pseudomonas aeruginosa PA01
gaucgccugcuggccg

SEQ ID NO: 1423716 - RNA, 17 nt, Pseudomonas aeruginosa PA01
gaucgccucggcgcgcg

SEQ ID NO: 1423717 - RNA, 19 nt, Pseudomonas aeruginosa PA01
gaucgccucggcgcgcgcc

SEQ ID NO: 1423718 - RNA, 17 nt, Pseudomonas aeruginosa PA01
gaucgccucgggcgagc

SEQ ID NO: 1423719 - RNA, 14 nt, Pseudomonas aeruginosa PA01
gaucgccucgucga

SEQ ID NO: 1423720 - RNA, 14 nt, Pseudomonas aeruginosa PA01
gaucgccgcgccgc

SEQ ID NO: 1423721 - RNA, 20 nt, Pseudomonas aeruginosa PA01
gaucgccgcgccgccgaggg

SEQ ID NO: 1423722 - RNA, 17 nt, Pseudomonas aeruginosa PA01
gaucgccgcgcggucga

SEQ ID NO: 1423723 - RNA, 13 nt, Pseudomonas aeruginosa PA01
gaucgccgcgacc

SEQ ID NO: 1423724 - RNA, 18 nt, Pseudomonas aeruginosa PA01
gaucgccgcgaccugcuc

SEQ ID NO: 1423725 - RNA, 12 nt, Pseudomonas aeruginosa PA01
gaucgccgcgcc

SEQ ID NO: 1423726 - RNA, 15 nt, Pseudomonas aeruginosa PA01
gaucgaggccuaccc

SEQ ID NO: 1423727 - RNA, 19 nt, Pseudomonas aeruginosa PA01
gaucgaggccuacccgcgc

SEQ ID NO: 1423728 - RNA, 17 nt, Pseudomonas aeruginosa PA01
gaucgagccagcgcucg

SEQ ID NO: 1423729 - RNA, 17 nt, Pseudomonas aeruginosa PA01
gaucgagagcuucucgg

SEQ ID NO: 1423730 - RNA, 13 nt, Pseudomonas aeruginosa PA01
gaucgagacgccg

SEQ ID NO: 1423731 - RNA, 18 nt, Pseudomonas aeruginosa PA01
gaucgagacgccguagcg

SEQ ID NO: 1423732 - RNA, 21 nt, Pseudomonas aeruginosa PA01
gaucgagcagcggcgccaacu

SEQ ID NO: 1423733 - RNA, 20 nt, Pseudomonas aeruginosa PA01
gaucgaggaauuccggcagc

SEQ ID NO: 1423734 - RNA, 23 nt, Pseudomonas aeruginosa PA01
gaucgaggaauuccggcagcgac

SEQ ID NO: 1423735 - RNA, 19 nt, Pseudomonas aeruginosa PA01
gaucgagccuugcggcgcu

SEQ ID NO: 1423736 - RNA, 21 nt, Pseudomonas aeruginosa PA01
gaucgacugcaugaccuccag

SEQ ID NO: 1423737 - RNA, 14 nt, Pseudomonas aeruginosa PA01
gaucacccggcgaa

SEQ ID NO: 1423738 - RNA, 15 nt, Pseudomonas aeruginosa PA01
gaucacccccagcga

SEQ ID NO: 1423739 - RNA, 23 nt, Pseudomonas aeruginosa PA01
gaucaccuucucguagcgcucgu

SEQ ID NO: 1423740 - RNA, 16 nt, Pseudomonas aeruginosa PA01
gaucaccuugcccucg

SEQ ID NO: 1423741 - RNA, 23 nt, Pseudomonas aeruginosa PA01
gaucaccuuguacggcagcggcg

SEQ ID NO: 1423742 - RNA, 12 nt, Pseudomonas aeruginosa PA01
gaucacgcagca

SEQ ID NO: 1423743 - RNA, 16 nt, Pseudomonas aeruginosa PA01
gaucacgaucggcacc

SEQ ID NO: 1423744 - RNA, 16 nt, Pseudomonas aeruginosa PA01
gaucacgaacagcuug

SEQ ID NO: 1423745 - RNA, 17 nt, Pseudomonas aeruginosa PA01
gaucacggcgccccggg

SEQ ID NO: 1423746 - RNA, 13 nt, Pseudomonas aeruginosa PA01
gaucacgccgaag

SEQ ID NO: 1423747 - RNA, 15 nt, Pseudomonas aeruginosa PA01
gaucacgccgcgcac

SEQ ID NO: 1423748 - RNA, 16 nt, Pseudomonas aeruginosa PA01
gaucacgucggcgucc

SEQ ID NO: 1423749 - RNA, 18 nt, Pseudomonas aeruginosa PA01
gauccaggucgaucagca

SEQ ID NO: 1423750 - RNA, 16 nt, Pseudomonas aeruginosa PA01
gauccaggugcgcggc

SEQ ID NO: 1423751 - RNA, 16 nt, Pseudomonas aeruginosa PA01
gaucacguccagguug

SEQ ID NO: 1423752 - RNA, 19 nt, Pseudomonas aeruginosa PA01
gaucacguccuugaccacg

SEQ ID NO: 1423753 - RNA, 15 nt, Pseudomonas aeruginosa PA01
gaucccaggucggcg

SEQ ID NO: 1423754 - RNA, 17 nt, Pseudomonas aeruginosa PA01
gaucccaggucggcggg

SEQ ID NO: 1423755 - RNA, 18 nt, Pseudomonas aeruginosa PA01
gauccccaacccggccag

SEQ ID NO: 1423756 - RNA, 19 nt, Pseudomonas aeruginosa PA01
gauccccaacccggccagc

SEQ ID NO: 1423757 - RNA, 21 nt, Pseudomonas aeruginosa PA01
gauccccaacccggccagccc

SEQ ID NO: 1423758 - RNA, 19 nt, Pseudomonas aeruginosa PA01
gaucgacgccgcuggcggc

SEQ ID NO: 1423759 - RNA, 16 nt, Pseudomonas aeruginosa PA01
gaucgaccucgcgggc

SEQ ID NO: 1423760 - RNA, 13 nt, Pseudomonas aeruginosa PA01
gaucgacgccagc

SEQ ID NO: 1423761 - RNA, 16 nt, Pseudomonas aeruginosa PA01
gaucgacgccagcucg

SEQ ID NO: 1423762 - RNA, 14 nt, Pseudomonas aeruginosa PA01
gaucgacaggccgc

SEQ ID NO: 1423763 - RNA, 20 nt, Pseudomonas aeruginosa PA01
gaucgacaggccgccguaga

SEQ ID NO: 1423764 - RNA, 22 nt, Pseudomonas aeruginosa PA01
gaucgaccgguuaauggcgcuc

SEQ ID NO: 1423765 - RNA, 13 nt, Pseudomonas aeruginosa PA01
gaucgacagcagc

SEQ ID NO: 1423766 - RNA, 20 nt, Pseudomonas aeruginosa PA01
gaucgacagcagcgccaggg

SEQ ID NO: 1423767 - RNA, 12 nt, Pseudomonas aeruginosa PA01
gauccugacccc

SEQ ID NO: 1423768 - RNA, 18 nt, Pseudomonas aeruginosa PA01
gauccugaccguccuggc

SEQ ID NO: 1423769 - RNA, 21 nt, Pseudomonas aeruginosa PA01
gauccugaccguccuggcccu

SEQ ID NO: 1423770 - RNA, 14 nt, Pseudomonas aeruginosa PA01
gauccguggcgagc

SEQ ID NO: 1423771 - RNA, 15 nt, Pseudomonas aeruginosa PA01
gauccuccgccagcc

SEQ ID NO: 1423772 - RNA, 18 nt, Pseudomonas aeruginosa PA01
gauccuccgccagcccca

SEQ ID NO: 1423773 - RNA, 16 nt, Pseudomonas aeruginosa PA01
gauccggugcaggccg

SEQ ID NO: 1423774 - RNA, 17 nt, Pseudomonas aeruginosa PA01
gauccggugcaggccga

SEQ ID NO: 1423775 - RNA, 19 nt, Pseudomonas aeruginosa PA01
gauccggugcaggccgagc

SEQ ID NO: 1423776 - RNA, 22 nt, Pseudomonas aeruginosa PA01
gauccggguggagaggcgugcu

SEQ ID NO: 1423777 - RNA, 22 nt, Pseudomonas aeruginosa PA01
gaucccguguaccacgcccgcg

SEQ ID NO: 1423778 - RNA, 22 nt, Pseudomonas aeruginosa PA01
gaucccgucaucacccaccaau

SEQ ID NO: 1423779 - RNA, 17 nt, Pseudomonas aeruginosa PA01
gaucccggcgcggaacu

SEQ ID NO: 1423780 - RNA, 22 nt, Pseudomonas aeruginosa PA01
gaucccggcggcgacccagacc

SEQ ID NO: 1423781 - RNA, 19 nt, Pseudomonas aeruginosa PA01
gaucccggaggcggcgagc

SEQ ID NO: 1423782 - RNA, 19 nt, Pseudomonas aeruginosa PA01
gaucccgacgcccuccagc

SEQ ID NO: 1423783 - RNA, 24 nt, Pseudomonas aeruginosa PA01
gaucccgacgcccuccagcaccgc

SEQ ID NO: 1423784 - RNA, 22 nt, Pseudomonas aeruginosa PA01
gaucccgaucucgguuuccagg

SEQ ID NO: 1423785 - RNA, 16 nt, Pseudomonas aeruginosa PA01
gaugcccgccagcagg

SEQ ID NO: 1423786 - RNA, 20 nt, Pseudomonas aeruginosa PA01
gaugcccgccagcaggcgcc

SEQ ID NO: 1423787 - RNA, 16 nt, Pseudomonas aeruginosa PA01
gaugcccgucaggccu

SEQ ID NO: 1423788 - RNA, 20 nt, Pseudomonas aeruginosa PA01
gaugcccgucaggccuugcg

SEQ ID NO: 1423789 - RNA, 17 nt, Pseudomonas aeruginosa PA01
gaugcccgggucgucgg

SEQ ID NO: 1423790 - RNA, 16 nt, Pseudomonas aeruginosa PA01
gaugcccggccgcagg

SEQ ID NO: 1423791 - RNA, 17 nt, Pseudomonas aeruginosa PA01
gaugcccgccucgcgca

SEQ ID NO: 1423792 - RNA, 21 nt, Pseudomonas aeruginosa PA01
gaugcccuuggccagcgcggc

SEQ ID NO: 1423793 - RNA, 16 nt, Pseudomonas aeruginosa PA01
gaugcccuggucggcg

SEQ ID NO: 1423794 - RNA, 19 nt, Pseudomonas aeruginosa PA01
gaugcccugcucuuccagc

SEQ ID NO: 1423795 - RNA, 14 nt, Pseudomonas aeruginosa PA01
gaugcccuggccgc

SEQ ID NO: 1423796 - RNA, 17 nt, Pseudomonas aeruginosa PA01
gaugcccuggccgcugc

SEQ ID NO: 1423797 - RNA, 16 nt, Pseudomonas aeruginosa PA01
gaugccgacgucgacu

SEQ ID NO: 1423798 - RNA, 18 nt, Pseudomonas aeruginosa PA01
gaugccgaaggcgugggc

SEQ ID NO: 1423799 - RNA, 17 nt, Pseudomonas aeruginosa PA01
gaugccgaauccgcugu

SEQ ID NO: 1423800 - RNA, 19 nt, Pseudomonas aeruginosa PA01
gaugcccagcggcgccagc

SEQ ID NO: 1423801 - RNA, 12 nt, Pseudomonas aeruginosa PA01
gaugcccaggcc

SEQ ID NO: 1423802 - RNA, 14 nt, Pseudomonas aeruginosa PA01
gaugcccaggccga

SEQ ID NO: 1423803 - RNA, 20 nt, Pseudomonas aeruginosa PA01
gaugcccaggccgccgaucc

SEQ ID NO: 1423804 - RNA, 23 nt, Pseudomonas aeruginosa PA01
gaugccacugacgcgcagcgccg

SEQ ID NO: 1423805 - RNA, 24 nt, Pseudomonas aeruginosa PA01
gaugccacugacgcgcagcgccgc

SEQ ID NO: 1423806 - RNA, 13 nt, Pseudomonas aeruginosa PA01
gaugccaccgcuc

SEQ ID NO: 1423807 - RNA, 22 nt, Pseudomonas aeruginosa PA01
gaugcaguugagucgcgcgcgc

SEQ ID NO: 1423808 - RNA, 12 nt, Pseudomonas aeruginosa PA01
gaugcgccagcg

SEQ ID NO: 1423809 - RNA, 23 nt, Pseudomonas aeruginosa PA01
gaugcgcagcuugcucgaugcca

SEQ ID NO: 1423810 - RNA, 22 nt, Pseudomonas aeruginosa PA01
gaugccggugcuggugcggccg

SEQ ID NO: 1423811 - RNA, 16 nt, Pseudomonas aeruginosa PA01
gaugccgguggcgccc

SEQ ID NO: 1423812 - RNA, 22 nt, Pseudomonas aeruginosa PA01
gaugccgguggcgcccagccag

SEQ ID NO: 1423813 - RNA, 18 nt, Pseudomonas aeruginosa PA01
gaugcgcaacgggcggcg

SEQ ID NO: 1423814 - RNA, 19 nt, Pseudomonas aeruginosa PA01
gaugcgcaacgggcggcgg

SEQ ID NO: 1423815 - RNA, 15 nt, Pseudomonas aeruginosa PA01
gaugccgaggcggcc

SEQ ID NO: 1423816 - RNA, 17 nt, Pseudomonas aeruginosa PA01
gaugccgaucucgccca

SEQ ID NO: 1423817 - RNA, 19 nt, Pseudomonas aeruginosa PA01
gaugccgaacaccugcauc

SEQ ID NO: 1423818 - RNA, 14 nt, Pseudomonas aeruginosa PA01
gaugccgcaggcau

SEQ ID NO: 1423819 - RNA, 16 nt, Pseudomonas aeruginosa PA01
gaugccgaugccgccg

SEQ ID NO: 1423820 - RNA, 13 nt, Pseudomonas aeruginosa PA01
gaugccgauggcg

SEQ ID NO: 1423821 - RNA, 17 nt, Pseudomonas aeruginosa PA01
gaugccgauggcgccgc

SEQ ID NO: 1423822 - RNA, 20 nt, Pseudomonas aeruginosa PA01
gaugccgcacaggcuggcca

SEQ ID NO: 1423823 - RNA, 14 nt, Pseudomonas aeruginosa PA01
gaugccggcgcugu

SEQ ID NO: 1423824 - RNA, 12 nt, Pseudomonas aeruginosa PA01
gaugccggcggc

SEQ ID NO: 1423825 - RNA, 13 nt, Pseudomonas aeruginosa PA01
gaugccggcggca

SEQ ID NO: 1423826 - RNA, 19 nt, Pseudomonas aeruginosa PA01
gaugccggcgucggcgagc

SEQ ID NO: 1423827 - RNA, 22 nt, Pseudomonas aeruginosa PA01
gaugccgccgaccucggccgcc

SEQ ID NO: 1423828 - RNA, 19 nt, Pseudomonas aeruginosa PA01
gaugccgcccugcggcagg

SEQ ID NO: 1423829 - RNA, 22 nt, Pseudomonas aeruginosa PA01
gaugccgcccugcggcaggcgc

SEQ ID NO: 1423830 - RNA, 17 nt, Pseudomonas aeruginosa PA01
gaugccgcccagcaccg

SEQ ID NO: 1423831 - RNA, 20 nt, Pseudomonas aeruginosa PA01
gaugccgcccagcaccgagc

SEQ ID NO: 1423832 - RNA, 22 nt, Pseudomonas aeruginosa PA01
gauggcgggcucuaugcgcggg

SEQ ID NO: 1423833 - RNA, 17 nt, Pseudomonas aeruginosa PA01
gauggcggccgccauuc

SEQ ID NO: 1423834 - RNA, 14 nt, Pseudomonas aeruginosa PA01
gauggcggccgcca

SEQ ID NO: 1423835 - RNA, 22 nt, Pseudomonas aeruginosa PA01
gauggcggcauugagcgccagc

SEQ ID NO: 1423836 - RNA, 22 nt, Pseudomonas aeruginosa PA01
gauggcgcugccaaacgccguc

SEQ ID NO: 1423837 - RNA, 23 nt, Pseudomonas aeruginosa PA01
gauggcgcugccaaacgccgucu

SEQ ID NO: 1423838 - RNA, 21 nt, Pseudomonas aeruginosa PA01
gauggcccagauauccagggc

SEQ ID NO: 1423839 - RNA, 20 nt, Pseudomonas aeruginosa PA01
gauggcccguuccaccgccu

SEQ ID NO: 1423840 - RNA, 19 nt, Pseudomonas aeruginosa PA01
gauggccgccgccgccguc

SEQ ID NO: 1423841 - RNA, 23 nt, Pseudomonas aeruginosa PA01
gauggccgccgccgccgucgacu

SEQ ID NO: 1423842 - RNA, 14 nt, Pseudomonas aeruginosa PA01
gauggccgccagca

SEQ ID NO: 1423843 - RNA, 20 nt, Pseudomonas aeruginosa PA01
gauggccgccagcaggccga

SEQ ID NO: 1423844 - RNA, 22 nt, Pseudomonas aeruginosa PA01
gauggccgccagcaggccgaag

SEQ ID NO: 1423845 - RNA, 14 nt, Pseudomonas aeruginosa PA01
gaugcgccagcggc

SEQ ID NO: 1423846 - RNA, 13 nt, Pseudomonas aeruginosa PA01
gaugcgcguggca

SEQ ID NO: 1423847 - RNA, 17 nt, Pseudomonas aeruginosa PA01
gaugcgguagucgcugc

SEQ ID NO: 1423848 - RNA, 22 nt, Pseudomonas aeruginosa PA01
gaugcgguagucgcugcuggcg

SEQ ID NO: 1423849 - RNA, 14 nt, Pseudomonas aeruginosa PA01
gaugcgguugccgg

SEQ ID NO: 1423850 - RNA, 19 nt, Pseudomonas aeruginosa PA01
gaugcguuccagggcgaag

SEQ ID NO: 1423851 - RNA, 19 nt, Pseudomonas aeruginosa PA01
gaugcgguuccuggcugga

SEQ ID NO: 1423852 - RNA, 16 nt, Pseudomonas aeruginosa PA01
gaugcugucagcgccc

SEQ ID NO: 1423853 - RNA, 23 nt, Pseudomonas aeruginosa PA01
gaugcuguaguugacgucgccga

SEQ ID NO: 1423854 - RNA, 17 nt, Pseudomonas aeruginosa PA01
gaugcuguucagcagga

SEQ ID NO: 1423855 - RNA, 13 nt, Pseudomonas aeruginosa PA01
gaugcuuucgagc

SEQ ID NO: 1423856 - RNA, 18 nt, Pseudomonas aeruginosa PA01
gauuggccgggccgaugc

SEQ ID NO: 1423857 - RNA, 19 nt, Pseudomonas aeruginosa PA01
gauugcagcuccuggucgc

SEQ ID NO: 1423858 - RNA, 22 nt, Pseudomonas aeruginosa PA01
gauugcagcuccuggucgcggg

SEQ ID NO: 1423859 - RNA, 18 nt, Pseudomonas aeruginosa PA01
gauugcguacgcccagca

SEQ ID NO: 1423860 - RNA, 17 nt, Pseudomonas aeruginosa PA01
gauuccacccgcuccgc

SEQ ID NO: 1423861 - RNA, 15 nt, Pseudomonas aeruginosa PA01
gauucaucggcggca

SEQ ID NO: 1423862 - RNA, 17 nt, Pseudomonas aeruginosa PA01
gauucaggcgcgcucgg

SEQ ID NO: 1423863 - RNA, 13 nt, Pseudomonas aeruginosa PA01
gauucccagugcu

SEQ ID NO: 1423864 - RNA, 22 nt, Pseudomonas aeruginosa PA01
gauuccgccggaagcuuccagc

SEQ ID NO: 1423865 - RNA, 22 nt, Pseudomonas aeruginosa PA01
gauuccgggucgaggcugccga

SEQ ID NO: 1423866 - RNA, 20 nt, Pseudomonas aeruginosa PA01
gaugucggcgaacuggccac

SEQ ID NO: 1423867 - RNA, 19 nt, Pseudomonas aeruginosa PA01
gaugucggcgcugucgccg

SEQ ID NO: 1423868 - RNA, 22 nt, Pseudomonas aeruginosa PA01
gaugucgggcucgacgaggaac

SEQ ID NO: 1423869 - RNA, 16 nt, Pseudomonas aeruginosa PA01
gaugucguagccgcgc

SEQ ID NO: 1423870 - RNA, 20 nt, Pseudomonas aeruginosa PA01
gaugucguagccgcgcgcca

SEQ ID NO: 1423871 - RNA, 13 nt, Pseudomonas aeruginosa PA01
gaugucgcuggcc

SEQ ID NO: 1423872 - RNA, 19 nt, Pseudomonas aeruginosa PA01
gaugucgcuggccagcuug

SEQ ID NO: 1423873 - RNA, 13 nt, Pseudomonas aeruginosa PA01
gaugucgcggcag

SEQ ID NO: 1423874 - RNA, 15 nt, Pseudomonas aeruginosa PA01
gaugucgcggcaggc

SEQ ID NO: 1423875 - RNA, 17 nt, Pseudomonas aeruginosa PA01
gaugucgcggcaggcgg

SEQ ID NO: 1423876 - RNA, 20 nt, Pseudomonas aeruginosa PA01
gaugucgcggcugacgaagu

SEQ ID NO: 1423877 - RNA, 19 nt, Pseudomonas aeruginosa PA01
gaugucgaccacgaucucg

SEQ ID NO: 1423878 - RNA, 21 nt, Pseudomonas aeruginosa PA01
gaugucgaccuggguaccgac

SEQ ID NO: 1423879 - RNA, 19 nt, Pseudomonas aeruginosa PA01
gaugugagccccaugccgu

SEQ ID NO: 1423880 - RNA, 13 nt, Pseudomonas aeruginosa PA01
gauguugcgcagg

SEQ ID NO: 1423881 - RNA, 22 nt, Pseudomonas aeruginosa PA01
gauguugccgccgccgaggagg

SEQ ID NO: 1423882 - RNA, 19 nt, Pseudomonas aeruginosa PA01
gauguuguugcccaccagc

SEQ ID NO: 1423883 - RNA, 23 nt, Pseudomonas aeruginosa PA01
gauguccccggccagcagcgccu

SEQ ID NO: 1423884 - RNA, 17 nt, Pseudomonas aeruginosa PA01
gauguccgggaugccgg

SEQ ID NO: 1423885 - RNA, 20 nt, Pseudomonas aeruginosa PA01
gauguccgggaugccggugc

SEQ ID NO: 1423886 - RNA, 19 nt, Pseudomonas aeruginosa PA01
gaugucgaacaacccgcca

SEQ ID NO: 1423887 - RNA, 21 nt, Pseudomonas aeruginosa PA01
gaugucgaacaacccgccagc

SEQ ID NO: 1423888 - RNA, 20 nt, Pseudomonas aeruginosa PA01
gauguccuggaucggcagcu

SEQ ID NO: 1423889 - RNA, 23 nt, Pseudomonas aeruginosa PA01
gauguccugggccaccuggcucu

SEQ ID NO: 1423890 - RNA, 16 nt, Pseudomonas aeruginosa PA01
gauguccaucagccgc

SEQ ID NO: 1423891 - RNA, 18 nt, Pseudomonas aeruginosa PA01
gauguccaucagccgcgc

SEQ ID NO: 1423892 - RNA, 21 nt, Pseudomonas aeruginosa PA01
gauguccaucagccgcgcgcu

SEQ ID NO: 1423893 - RNA, 22 nt, Pseudomonas aeruginosa PA01
gauguccccccuacgaaagcgc

SEQ ID NO: 1423894 - RNA, 20 nt, Pseudomonas aeruginosa PA01
gauguauccguacuggcgcc

SEQ ID NO: 1423895 - RNA, 17 nt, Pseudomonas aeruginosa PA01
gauguaggucaccgcgc

SEQ ID NO: 1423896 - RNA, 20 nt, Pseudomonas aeruginosa PA01
gauguaggucaccgcgccgg

SEQ ID NO: 1423897 - RNA, 18 nt, Pseudomonas aeruginosa PA01
gauguaguccagcgccgc

SEQ ID NO: 1423898 - RNA, 22 nt, Pseudomonas aeruginosa PA01
gauguacggcaccaccaccgac

SEQ ID NO: 1423899 - RNA, 17 nt, Pseudomonas aeruginosa PA01
gauguagcggaaguuca

SEQ ID NO: 1423900 - RNA, 23 nt, Pseudomonas aeruginosa PA01
gauguagccggcuuccucgcccu

SEQ ID NO: 1423901 - RNA, 13 nt, Pseudomonas aeruginosa PA01
gauguagcugccg

SEQ ID NO: 1423902 - RNA, 17 nt, Pseudomonas aeruginosa PA01
gauggugugcagcagca

SEQ ID NO: 1423903 - RNA, 18 nt, Pseudomonas aeruginosa PA01
gauggugugcagcagcac

SEQ ID NO: 1423904 - RNA, 22 nt, Pseudomonas aeruginosa PA01
gauggcguuugcgucauccgcc

SEQ ID NO: 1423905 - RNA, 23 nt, Pseudomonas aeruginosa PA01
gauggcguuugcgucauccgccu

SEQ ID NO: 1423906 - RNA, 19 nt, Pseudomonas aeruginosa PA01
gauggcguguucgucgauc

SEQ ID NO: 1423907 - RNA, 19 nt, Pseudomonas aeruginosa PA01
gauggcguagaggcucggc

SEQ ID NO: 1423908 - RNA, 22 nt, Pseudomonas aeruginosa PA01
gauggcguagaggcucggcggc

SEQ ID NO: 1423909 - RNA, 16 nt, Pseudomonas aeruginosa PA01
gauggcguccaccgcu

SEQ ID NO: 1423910 - RNA, 15 nt, Pseudomonas aeruginosa PA01
gcagccucagcgaca

SEQ ID NO: 1423911 - RNA, 15 nt, Pseudomonas aeruginosa PA01
gcagccugcuggccu

SEQ ID NO: 1423912 - RNA, 18 nt, Pseudomonas aeruginosa PA01
gcagccugcuggccuggg

SEQ ID NO: 1423913 - RNA, 12 nt, Pseudomonas aeruginosa PA01
gcagccuggcgu

SEQ ID NO: 1423914 - RNA, 22 nt, Pseudomonas aeruginosa PA01
gcagcgacuccagccaggcgau

SEQ ID NO: 1423915 - RNA, 23 nt, Pseudomonas aeruginosa PA01
gcagcgacucgaugaacgcccug

SEQ ID NO: 1423916 - RNA, 21 nt, Pseudomonas aeruginosa PA01
gcagcgacucgcugggcgccg

SEQ ID NO: 1423917 - RNA, 15 nt, Pseudomonas aeruginosa PA01
gcagcgagucgccgu

SEQ ID NO: 1423918 - RNA, 13 nt, Pseudomonas aeruginosa PA01
gcagcgccagcag

SEQ ID NO: 1423919 - RNA, 21 nt, Pseudomonas aeruginosa PA01
gcagcgccagcaggucgcgcu

SEQ ID NO: 1423920 - RNA, 14 nt, Pseudomonas aeruginosa PA01
gcagcgccagccag

SEQ ID NO: 1423921 - RNA, 15 nt, Pseudomonas aeruginosa PA01
gcagcgaucgccgcc

SEQ ID NO: 1423922 - RNA, 16 nt, Pseudomonas aeruginosa PA01
gcagcgaucgccgcca

SEQ ID NO: 1423923 - RNA, 14 nt, Pseudomonas aeruginosa PA01
gcagcgaucagcac

SEQ ID NO: 1423924 - RNA, 16 nt, Pseudomonas aeruginosa PA01
gcagcgaucagcacca

SEQ ID NO: 1423925 - RNA, 20 nt, Pseudomonas aeruginosa PA01
gcagccucgcgcucggcggc

SEQ ID NO: 1423926 - RNA, 23 nt, Pseudomonas aeruginosa PA01
gcagccguuggccagcaggcgcc

SEQ ID NO: 1423927 - RNA, 17 nt, Pseudomonas aeruginosa PA01
gcagccgucggugaucg

SEQ ID NO: 1423928 - RNA, 15 nt, Pseudomonas aeruginosa PA01
gcagccguggcgcga

SEQ ID NO: 1423929 - RNA, 18 nt, Pseudomonas aeruginosa PA01
gcagccguauggccccuc

SEQ ID NO: 1423930 - RNA, 19 nt, Pseudomonas aeruginosa PA01
gcagccguauggccccucc

SEQ ID NO: 1423931 - RNA, 21 nt, Pseudomonas aeruginosa PA01
gcagccagcuucagccgaccg

SEQ ID NO: 1423932 - RNA, 22 nt, Pseudomonas aeruginosa PA01
gcagccaggccuugugcgccag

SEQ ID NO: 1423933 - RNA, 23 nt, Pseudomonas aeruginosa PA01
gcagccaggccuugugcgccagc

SEQ ID NO: 1423934 - RNA, 12 nt, Pseudomonas aeruginosa PA01
gcagccaggcga

SEQ ID NO: 1423935 - RNA, 21 nt, Pseudomonas aeruginosa PA01
gcagccaggcgaagcggcugg

SEQ ID NO: 1423936 - RNA, 23 nt, Pseudomonas aeruginosa PA01
gcagccaggcgaagcggcuggcc

SEQ ID NO: 1423937 - RNA, 16 nt, Pseudomonas aeruginosa PA01
gcagcgccuccagcgu

SEQ ID NO: 1423938 - RNA, 17 nt, Pseudomonas aeruginosa PA01
gcagcgccucccgggcc

SEQ ID NO: 1423939 - RNA, 19 nt, Pseudomonas aeruginosa PA01
gcagcgccguugccgaugc

SEQ ID NO: 1423940 - RNA, 18 nt, Pseudomonas aeruginosa PA01
gcagcgcgcgcuggucgu

SEQ ID NO: 1423941 - RNA, 14 nt, Pseudomonas aeruginosa PA01
gcagcgcgcgucgg

SEQ ID NO: 1423942 - RNA, 16 nt, Pseudomonas aeruginosa PA01
gcagcgcgcgucgguc

SEQ ID NO: 1423943 - RNA, 14 nt, Pseudomonas aeruginosa PA01
gcagcgcgcggcca

SEQ ID NO: 1423944 - RNA, 20 nt, Pseudomonas aeruginosa PA01
gcagcgcgcggccaguucgg

SEQ ID NO: 1423945 - RNA, 14 nt, Pseudomonas aeruginosa PA01
gcagcgcgcggcuc

SEQ ID NO: 1423946 - RNA, 17 nt, Pseudomonas aeruginosa PA01
gcagcgccaggaagccg

SEQ ID NO: 1423947 - RNA, 20 nt, Pseudomonas aeruginosa PA01
gcagcgccaggaagccgcgc

SEQ ID NO: 1423948 - RNA, 15 nt, Pseudomonas aeruginosa PA01
gcagcgccagguagu

SEQ ID NO: 1423949 - RNA, 23 nt, Pseudomonas aeruginosa PA01
gcagcgccaguacuccgagggcc

SEQ ID NO: 1423950 - RNA, 19 nt, Pseudomonas aeruginosa PA01
gcagcgcccgauaggcgcc

SEQ ID NO: 1423951 - RNA, 20 nt, Pseudomonas aeruginosa PA01
gcagcgcccgauaggcgccg

SEQ ID NO: 1423952 - RNA, 14 nt, Pseudomonas aeruginosa PA01
gcagcgccaugcuc

SEQ ID NO: 1423953 - RNA, 18 nt, Pseudomonas aeruginosa PA01
gcagcgccauggggauca

SEQ ID NO: 1423954 - RNA, 13 nt, Pseudomonas aeruginosa PA01
gcagcgccccagc

SEQ ID NO: 1423955 - RNA, 15 nt, Pseudomonas aeruginosa PA01
gcagcgccccagcac

SEQ ID NO: 1423956 - RNA, 21 nt, Pseudomonas aeruginosa PA01
gcagcgccccagcaccucgcc

SEQ ID NO: 1423957 - RNA, 23 nt, Pseudomonas aeruginosa PA01
gcagcgccccagcaccucgccgu

SEQ ID NO: 1423958 - RNA, 12 nt, Pseudomonas aeruginosa PA01
gcagcgccgcca

SEQ ID NO: 1423959 - RNA, 15 nt, Pseudomonas aeruginosa PA01
gcagcgccgccagca

SEQ ID NO: 1423960 - RNA, 14 nt, Pseudomonas aeruginosa PA01
gcagcgccgccagc

SEQ ID NO: 1423961 - RNA, 13 nt, Pseudomonas aeruginosa PA01
gcagcgccgccgc

SEQ ID NO: 1423962 - RNA, 21 nt, Pseudomonas aeruginosa PA01
gcagcgccgccgggcguaacg

SEQ ID NO: 1423963 - RNA, 15 nt, Pseudomonas aeruginosa PA01
gcagcgccgcgcggc

SEQ ID NO: 1423964 - RNA, 13 nt, Pseudomonas aeruginosa PA01
gcagcgccgcgcc

SEQ ID NO: 1423965 - RNA, 17 nt, Pseudomonas aeruginosa PA01
gcagcggaagcccugcu

SEQ ID NO: 1423966 - RNA, 17 nt, Pseudomonas aeruginosa PA01
gcagcgcuucguugcuc

SEQ ID NO: 1423967 - RNA, 23 nt, Pseudomonas aeruginosa PA01
gcagcgcuuguagcagccgcagg

SEQ ID NO: 1423968 - RNA, 17 nt, Pseudomonas aeruginosa PA01
gcagcgcuggcgaucac

SEQ ID NO: 1423969 - RNA, 14 nt, Pseudomonas aeruginosa PA01
gcagcggcaccagc

SEQ ID NO: 1423970 - RNA, 15 nt, Pseudomonas aeruginosa PA01
gcagcggcacccggc

SEQ ID NO: 1423971 - RNA, 21 nt, Pseudomonas aeruginosa PA01
gcagcggcaaaggcccggcgc

SEQ ID NO: 1423972 - RNA, 20 nt, Pseudomonas aeruginosa PA01
gcagcggauauucgacgcgc

SEQ ID NO: 1423973 - RNA, 18 nt, Pseudomonas aeruginosa PA01
gcagcggauccgggugga

SEQ ID NO: 1423974 - RNA, 18 nt, Pseudomonas aeruginosa PA01
gcagcggcaugcccugcc

SEQ ID NO: 1423975 - RNA, 17 nt, Pseudomonas aeruginosa PA01
gcagcgguacaggcgga

SEQ ID NO: 1423976 - RNA, 14 nt, Pseudomonas aeruginosa PA01
gcagcguuccagcg

SEQ ID NO: 1423977 - RNA, 15 nt, Pseudomonas aeruginosa PA01
gcagcguuccagcgc

SEQ ID NO: 1423978 - RNA, 16 nt, Pseudomonas aeruginosa PA01
gcagcguuccagcgcu

SEQ ID NO: 1423979 - RNA, 17 nt, Pseudomonas aeruginosa PA01
gcagcguuccagcgcug

SEQ ID NO: 1423980 - RNA, 21 nt, Pseudomonas aeruginosa PA01
gcagcguuccagcgcuggcag

SEQ ID NO: 1423981 - RNA, 22 nt, Pseudomonas aeruginosa PA01
gcagcguuccagcgcuggcagg

SEQ ID NO: 1423982 - RNA, 18 nt, Pseudomonas aeruginosa PA01
gcagcguccugcccuccu

SEQ ID NO: 1423983 - RNA, 16 nt, Pseudomonas aeruginosa PA01
gcagcgucgacgccga

SEQ ID NO: 1423984 - RNA, 17 nt, Pseudomonas aeruginosa PA01
gcagcgucgacgccgag

SEQ ID NO: 1423985 - RNA, 19 nt, Pseudomonas aeruginosa PA01
gcagcgucgacgccgagcu

SEQ ID NO: 1423986 - RNA, 17 nt, Pseudomonas aeruginosa PA01
gcagcgucgagcuggcg

SEQ ID NO: 1423987 - RNA, 13 nt, Pseudomonas aeruginosa PA01
gcagcgucaccgc

SEQ ID NO: 1423988 - RNA, 13 nt, Pseudomonas aeruginosa PA01
gcagcggucgccg

SEQ ID NO: 1423989 - RNA, 23 nt, Pseudomonas aeruginosa PA01
gcagcgguaguucagucgguuag

SEQ ID NO: 1423990 - RNA, 13 nt, Pseudomonas aeruginosa PA01
gcagcuccggcag

SEQ ID NO: 1423991 - RNA, 14 nt, Pseudomonas aeruginosa PA01
gcagcuccggcagc

SEQ ID NO: 1423992 - RNA, 17 nt, Pseudomonas aeruginosa PA01
gcagcuccggcagcagg

SEQ ID NO: 1423993 - RNA, 14 nt, Pseudomonas aeruginosa PA01
gcagcuccggcggg

SEQ ID NO: 1423994 - RNA, 15 nt, Pseudomonas aeruginosa PA01
gcagcuccggcgggc

SEQ ID NO: 1423995 - RNA, 12 nt, Pseudomonas aeruginosa PA01
gcagcuccucgg

SEQ ID NO: 1423996 - RNA, 15 nt, Pseudomonas aeruginosa PA01
gcagcuccauguccg

SEQ ID NO: 1423997 - RNA, 14 nt, Pseudomonas aeruginosa PA01
gcagcuccagcgga

SEQ ID NO: 1423998 - RNA, 19 nt, Pseudomonas aeruginosa PA01
gcagcucguccauguugcg

SEQ ID NO: 1423999 - RNA, 16 nt, Pseudomonas aeruginosa PA01
gcagcucggugaggaa

SEQ ID NO: 1424000 - RNA, 21 nt, Pseudomonas aeruginosa PA01
gcagcucguugcacagcgccc

SEQ ID NO: 1424001 - RNA, 14 nt, Pseudomonas aeruginosa PA01
gcagcucggcgaca

SEQ ID NO: 1424002 - RNA, 15 nt, Pseudomonas aeruginosa PA01
gcagcucggccuggu

SEQ ID NO: 1424003 - RNA, 12 nt, Pseudomonas aeruginosa PA01
gcagcucggcga

SEQ ID NO: 1424004 - RNA, 14 nt, Pseudomonas aeruginosa PA01
gcagcaggccggcg

SEQ ID NO: 1424005 - RNA, 18 nt, Pseudomonas aeruginosa PA01
gcagcaggccggcgacca

SEQ ID NO: 1424006 - RNA, 23 nt, Pseudomonas aeruginosa PA01
gcagcagggcguaggcgucgcga

SEQ ID NO: 1424007 - RNA, 15 nt, Pseudomonas aeruginosa PA01
gcagcagggcgucgg

SEQ ID NO: 1424008 - RNA, 17 nt, Pseudomonas aeruginosa PA01
gcagcagggcgucggcg

SEQ ID NO: 1424009 - RNA, 12 nt, Pseudomonas aeruginosa PA01
gcagcaggucgc

SEQ ID NO: 1424010 - RNA, 19 nt, Pseudomonas aeruginosa PA01
gcagcaggccgccgcgugc

SEQ ID NO: 1424011 - RNA, 23 nt, Pseudomonas aeruginosa PA01
gcagcagguagaagaacaucggc

SEQ ID NO: 1424012 - RNA, 22 nt, Pseudomonas aeruginosa PA01
gcagcagguagugcggcgggcg

SEQ ID NO: 1424013 - RNA, 20 nt, Pseudomonas aeruginosa PA01
gcagcaggguaccgcuggcg

SEQ ID NO: 1424014 - RNA, 21 nt, Pseudomonas aeruginosa PA01
gcagcagggucagcagcgcca

SEQ ID NO: 1424015 - RNA, 14 nt, Pseudomonas aeruginosa PA01
gcagcagggucggg

SEQ ID NO: 1424016 - RNA, 16 nt, Pseudomonas aeruginosa PA01
gcagcagggucggggu

SEQ ID NO: 1424017 - RNA, 15 nt, Pseudomonas aeruginosa PA01
gcagcaggcggccca

SEQ ID NO: 1424018 - RNA, 17 nt, Pseudomonas aeruginosa PA01
gcagcaggcggcccaug

SEQ ID NO: 1424019 - RNA, 13 nt, Pseudomonas aeruginosa PA01
gcagcagguucga

SEQ ID NO: 1424020 - RNA, 17 nt, Pseudomonas aeruginosa PA01
gcagcagguugaccccg

SEQ ID NO: 1424021 - RNA, 18 nt, Pseudomonas aeruginosa PA01
gcagcagguugaccccgc

SEQ ID NO: 1424022 - RNA, 22 nt, Pseudomonas aeruginosa PA01
gcagcagguugaccccgcggcc

SEQ ID NO: 1424023 - RNA, 15 nt, Pseudomonas aeruginosa PA01
gcagcaggucgucgg

SEQ ID NO: 1424024 - RNA, 16 nt, Pseudomonas aeruginosa PA01
gcagcaggucgucggc

SEQ ID NO: 1424025 - RNA, 23 nt, Pseudomonas aeruginosa PA01
gcagcagaaguuguucgaugcgu

SEQ ID NO: 1424026 - RNA, 21 nt, Pseudomonas aeruginosa PA01
gcagcacuuccugaaggcgcg

SEQ ID NO: 1424027 - RNA, 11 nt, Pseudomonas aeruginosa PA01
gcagcaggccg

SEQ ID NO: 1424028 - RNA, 15 nt, Pseudomonas aeruginosa PA01
gcagcaggccgcugg

SEQ ID NO: 1424029 - RNA, 17 nt, Pseudomonas aeruginosa PA01
gcagcaggccgcuggcg

SEQ ID NO: 1424030 - RNA, 18 nt, Pseudomonas aeruginosa PA01
gcagcaggccgcuggcga

SEQ ID NO: 1424031 - RNA, 19 nt, Pseudomonas aeruginosa PA01
gcagcaggccgcuggcgac

SEQ ID NO: 1424032 - RNA, 12 nt, Pseudomonas aeruginosa PA01
gcagcaccggcu

SEQ ID NO: 1424033 - RNA, 18 nt, Pseudomonas aeruginosa PA01
gcagcacagccccagccu

SEQ ID NO: 1424034 - RNA, 13 nt, Pseudomonas aeruginosa PA01
gcagccaccaggu

SEQ ID NO: 1424035 - RNA, 13 nt, Pseudomonas aeruginosa PA01
gcagccacccagc

SEQ ID NO: 1424036 - RNA, 15 nt, Pseudomonas aeruginosa PA01
gcagccacccagcag

SEQ ID NO: 1424037 - RNA, 14 nt, Pseudomonas aeruginosa PA01
gcagccacccgcgg

SEQ ID NO: 1424038 - RNA, 14 nt, Pseudomonas aeruginosa PA01
gcagccacccgcuc

SEQ ID NO: 1424039 - RNA, 18 nt, Pseudomonas aeruginosa PA01
gcagcaugggauggcgcg

SEQ ID NO: 1424040 - RNA, 17 nt, Pseudomonas aeruginosa PA01
gcagccacaggcgccag

SEQ ID NO: 1424041 - RNA, 18 nt, Pseudomonas aeruginosa PA01
gcagccaaccgucgcccu

SEQ ID NO: 1424042 - RNA, 23 nt, Pseudomonas aeruginosa PA01
gcagccaaccgucgcccuggugc

SEQ ID NO: 1424043 - RNA, 20 nt, Pseudomonas aeruginosa PA01
gcagccaaggaugcgccagc

SEQ ID NO: 1424044 - RNA, 17 nt, Pseudomonas aeruginosa PA01
gcagccagagcuccagg

SEQ ID NO: 1424045 - RNA, 19 nt, Pseudomonas aeruginosa PA01
gcagccagcacaugcggug

SEQ ID NO: 1424046 - RNA, 13 nt, Pseudomonas aeruginosa PA01
gcagccagccgcc

SEQ ID NO: 1424047 - RNA, 14 nt, Pseudomonas aeruginosa PA01
gcagccagccgccg

SEQ ID NO: 1424048 - RNA, 15 nt, Pseudomonas aeruginosa PA01
gcagccagccgccga

SEQ ID NO: 1424049 - RNA, 15 nt, Pseudomonas aeruginosa PA01
gcagccagccgucgu

SEQ ID NO: 1424050 - RNA, 20 nt, Pseudomonas aeruginosa PA01
gcagccagccucagguacgg

SEQ ID NO: 1424051 - RNA, 16 nt, Pseudomonas aeruginosa PA01
gcagccacucggccag

SEQ ID NO: 1424052 - RNA, 21 nt, Pseudomonas aeruginosa PA01
gcagccacucggccaggcgcc

SEQ ID NO: 1424053 - RNA, 12 nt, Pseudomonas aeruginosa PA01
gcagccacuggc

SEQ ID NO: 1424054 - RNA, 15 nt, Pseudomonas aeruginosa PA01
gcagccacuguccau

SEQ ID NO: 1424055 - RNA, 15 nt, Pseudomonas aeruginosa PA01
gcagcaucggaccgg

SEQ ID NO: 1424056 - RNA, 13 nt, Pseudomonas aeruginosa PA01
gcagcaucagccg

SEQ ID NO: 1424057 - RNA, 15 nt, Pseudomonas aeruginosa PA01
gcagcaucaggcgcu

SEQ ID NO: 1424058 - RNA, 19 nt, Pseudomonas aeruginosa PA01
gcagcaucuucucggcgau

SEQ ID NO: 1424059 - RNA, 23 nt, Pseudomonas aeruginosa PA01
gcagcaucuucucggcgauucgc

SEQ ID NO: 1424060 - RNA, 14 nt, Pseudomonas aeruginosa PA01
gcacucgccgggcg

SEQ ID NO: 1424061 - RNA, 15 nt, Pseudomonas aeruginosa PA01
gcagagccagccgca

SEQ ID NO: 1424062 - RNA, 16 nt, Pseudomonas aeruginosa PA01
gcagagccagccgcag

SEQ ID NO: 1424063 - RNA, 20 nt, Pseudomonas aeruginosa PA01
gcagagcggcaggccgccga

SEQ ID NO: 1424064 - RNA, 13 nt, Pseudomonas aeruginosa PA01
gcagagcggccag

SEQ ID NO: 1424065 - RNA, 14 nt, Pseudomonas aeruginosa PA01
gcagagcggccagg

SEQ ID NO: 1424066 - RNA, 15 nt, Pseudomonas aeruginosa PA01
gcagagcggccaggu

SEQ ID NO: 1424067 - RNA, 13 nt, Pseudomonas aeruginosa PA01
gcagagcgccagc

SEQ ID NO: 1424068 - RNA, 15 nt, Pseudomonas aeruginosa PA01
gcagagcgccagcca

SEQ ID NO: 1424069 - RNA, 12 nt, Pseudomonas aeruginosa PA01
gcagagcuggaa

SEQ ID NO: 1424070 - RNA, 16 nt, Pseudomonas aeruginosa PA01
gcagagcuggaagucg

SEQ ID NO: 1424071 - RNA, 21 nt, Pseudomonas aeruginosa PA01
gcagagcggugaaaccggcaa

SEQ ID NO: 1424072 - RNA, 14 nt, Pseudomonas aeruginosa PA01
gcagagggcgaugc

SEQ ID NO: 1424073 - RNA, 15 nt, Pseudomonas aeruginosa PA01
gcagagggcgaugcc

SEQ ID NO: 1424074 - RNA, 17 nt, Pseudomonas aeruginosa PA01
gcagagggucgccagcg

SEQ ID NO: 1424075 - RNA, 19 nt, Pseudomonas aeruginosa PA01
gcagagggucgccagcgag

SEQ ID NO: 1424076 - RNA, 14 nt, Pseudomonas aeruginosa PA01
gcacucggcgacca

SEQ ID NO: 1424077 - RNA, 16 nt, Pseudomonas aeruginosa PA01
gcacucggcgaccacc

SEQ ID NO: 1424078 - RNA, 18 nt, Pseudomonas aeruginosa PA01
gcacucggcgaccacccg

SEQ ID NO: 1424079 - RNA, 14 nt, Pseudomonas aeruginosa PA01
gcacucgcuccucc

SEQ ID NO: 1424080 - RNA, 21 nt, Pseudomonas aeruginosa PA01
gcacucgaugaacagcgcgaa

SEQ ID NO: 1424081 - RNA, 14 nt, Pseudomonas aeruginosa PA01
gcagaggcgcucca

SEQ ID NO: 1424082 - RNA, 16 nt, Pseudomonas aeruginosa PA01
gcagaguggcgcggcu

SEQ ID NO: 1424083 - RNA, 17 nt, Pseudomonas aeruginosa PA01
gcagaguuuagccgcca

SEQ ID NO: 1424084 - RNA, 20 nt, Pseudomonas aeruginosa PA01
gcagaguuucucggucgccg

SEQ ID NO: 1424085 - RNA, 23 nt, Pseudomonas aeruginosa PA01
gcagaguuucucggucgccgcca

SEQ ID NO: 1424086 - RNA, 16 nt, Pseudomonas aeruginosa PA01
gcagauaaagcuggac

SEQ ID NO: 1424087 - RNA, 14 nt, Pseudomonas aeruginosa PA01
gcagauagggcauc

SEQ ID NO: 1424088 - RNA, 18 nt, Pseudomonas aeruginosa PA01
gcagauaucgugcaggcg

SEQ ID NO: 1424089 - RNA, 13 nt, Pseudomonas aeruginosa PA01
gcagauaaggcgu

SEQ ID NO: 1424090 - RNA, 17 nt, Pseudomonas aeruginosa PA01
gcagauccagcggcagg

SEQ ID NO: 1424091 - RNA, 16 nt, Pseudomonas aeruginosa PA01
gcagaucgcguccagg

SEQ ID NO: 1424092 - RNA, 17 nt, Pseudomonas aeruginosa PA01
gcagaucgcggcgcagg

SEQ ID NO: 1424093 - RNA, 18 nt, Pseudomonas aeruginosa PA01
gcagaucgcggcgcaggc

SEQ ID NO: 1424094 - RNA, 16 nt, Pseudomonas aeruginosa PA01
gcagaucggugcgggc

SEQ ID NO: 1424095 - RNA, 14 nt, Pseudomonas aeruginosa PA01
gcagaucgcgccga

SEQ ID NO: 1424096 - RNA, 15 nt, Pseudomonas aeruginosa PA01
gcagaucgcgccgag

SEQ ID NO: 1424097 - RNA, 16 nt, Pseudomonas aeruginosa PA01
gcagaucgcgccgagc

SEQ ID NO: 1424098 - RNA, 17 nt, Pseudomonas aeruginosa PA01
gcagaucgcgccgagcu

SEQ ID NO: 1424099 - RNA, 16 nt, Pseudomonas aeruginosa PA01
gcagaugaccagcgca

SEQ ID NO: 1424100 - RNA, 13 nt, Pseudomonas aeruginosa PA01
gcagaugccgggc

SEQ ID NO: 1424101 - RNA, 14 nt, Pseudomonas aeruginosa PA01
gcagcaccaggcug

SEQ ID NO: 1424102 - RNA, 13 nt, Pseudomonas aeruginosa PA01
gcagcaccgcgag

SEQ ID NO: 1424103 - RNA, 15 nt, Pseudomonas aeruginosa PA01
gcagcaccgcgagca

SEQ ID NO: 1424104 - RNA, 19 nt, Pseudomonas aeruginosa PA01
gcagcacauagagggucag

SEQ ID NO: 1424105 - RNA, 18 nt, Pseudomonas aeruginosa PA01
gcagcaccaccucgccaa

SEQ ID NO: 1424106 - RNA, 21 nt, Pseudomonas aeruginosa PA01
gcagcaccaccucgccaagcu

SEQ ID NO: 1424107 - RNA, 13 nt, Pseudomonas aeruginosa PA01
gcagcaccaggcc

SEQ ID NO: 1424108 - RNA, 14 nt, Pseudomonas aeruginosa PA01
gcagcaccaggcca

SEQ ID NO: 1424109 - RNA, 20 nt, Pseudomonas aeruginosa PA01
gcagcacccccagcaggcca

SEQ ID NO: 1424110 - RNA, 23 nt, Pseudomonas aeruginosa PA01
gcagcacccccagcaggccagcc

SEQ ID NO: 1424111 - RNA, 17 nt, Pseudomonas aeruginosa PA01
gcagcacccgcaccagc

SEQ ID NO: 1424112 - RNA, 22 nt, Pseudomonas aeruginosa PA01
gcagcacccgcaccagccggcg

SEQ ID NO: 1424113 - RNA, 23 nt, Pseudomonas aeruginosa PA01
gcagcacccgcaccagccggcgc

SEQ ID NO: 1424114 - RNA, 16 nt, Pseudomonas aeruginosa PA01
gcagcaccaggcuggc

SEQ ID NO: 1424115 - RNA, 19 nt, Pseudomonas aeruginosa PA01
gcagcaccaggcuggccag

SEQ ID NO: 1424116 - RNA, 20 nt, Pseudomonas aeruginosa PA01
gcagcaccaggcuggccagu

SEQ ID NO: 1424117 - RNA, 12 nt, Pseudomonas aeruginosa PA01
gcagcaccagca

SEQ ID NO: 1424118 - RNA, 14 nt, Pseudomonas aeruginosa PA01
gcagcaccagcacc

SEQ ID NO: 1424119 - RNA, 15 nt, Pseudomonas aeruginosa PA01
gcagcaccagcacca

SEQ ID NO: 1424120 - RNA, 16 nt, Pseudomonas aeruginosa PA01
gcagcaccagcaccag

SEQ ID NO: 1424121 - RNA, 17 nt, Pseudomonas aeruginosa PA01
gcagcaccagcaccagc

SEQ ID NO: 1424122 - RNA, 17 nt, Pseudomonas aeruginosa PA01
gcaggauguugaacagg

SEQ ID NO: 1424123 - RNA, 20 nt, Pseudomonas aeruginosa PA01
gcaggauaucgcccagggcc

SEQ ID NO: 1424124 - RNA, 15 nt, Pseudomonas aeruginosa PA01
gcaggaugcagucgg

SEQ ID NO: 1424125 - RNA, 14 nt, Pseudomonas aeruginosa PA01
gcaggaugccgccu

SEQ ID NO: 1424126 - RNA, 21 nt, Pseudomonas aeruginosa PA01
gcaggaugccgccugcgucag

SEQ ID NO: 1424127 - RNA, 23 nt, Pseudomonas aeruginosa PA01
gcaggaucaguucgugccaggcg

SEQ ID NO: 1424128 - RNA, 17 nt, Pseudomonas aeruginosa PA01
gcaggaucgacagcagc

SEQ ID NO: 1424129 - RNA, 19 nt, Pseudomonas aeruginosa PA01
gcaggaucgacagcagcgc

SEQ ID NO: 1424130 - RNA, 22 nt, Pseudomonas aeruginosa PA01
gcaggaucgacagcagcgccag

SEQ ID NO: 1424131 - RNA, 23 nt, Pseudomonas aeruginosa PA01
gcaggaucgacagcagcgccagg

SEQ ID NO: 1424132 - RNA, 18 nt, Pseudomonas aeruginosa PA01
gcaggaucgagcccuggu

SEQ ID NO: 1424133 - RNA, 21 nt, Pseudomonas aeruginosa PA01
gcaggaucgagcccuggucga

SEQ ID NO: 1424134 - RNA, 15 nt, Pseudomonas aeruginosa PA01
gcaggaagccgacca

SEQ ID NO: 1424135 - RNA, 19 nt, Pseudomonas aeruginosa PA01
gcaggaagccgaccacucg

SEQ ID NO: 1424136 - RNA, 13 nt, Pseudomonas aeruginosa PA01
gcaggaagcgccg

SEQ ID NO: 1424137 - RNA, 15 nt, Pseudomonas aeruginosa PA01
gcaggaagcugacga

SEQ ID NO: 1424138 - RNA, 18 nt, Pseudomonas aeruginosa PA01
gcaggaagcugacgaaca

SEQ ID NO: 1424139 - RNA, 15 nt, Pseudomonas aeruginosa PA01
gcaggaagcugcgcu

SEQ ID NO: 1424140 - RNA, 19 nt, Pseudomonas aeruginosa PA01
gcaggaaguggcggaugca

SEQ ID NO: 1424141 - RNA, 22 nt, Pseudomonas aeruginosa PA01
gcaggaaguugauggucaggcu

SEQ ID NO: 1424142 - RNA, 16 nt, Pseudomonas aeruginosa PA01
gcaggacccgcgacuc

SEQ ID NO: 1424143 - RNA, 22 nt, Pseudomonas aeruginosa PA01
gcaggacgaagucgccggcauc

SEQ ID NO: 1424144 - RNA, 12 nt, Pseudomonas aeruginosa PA01
gcaggacgagga

SEQ ID NO: 1424145 - RNA, 23 nt, Pseudomonas aeruginosa PA01
gcaggacgaugaucaccaggacc

SEQ ID NO: 1424146 - RNA, 23 nt, Pseudomonas aeruginosa PA01
gcaggaccuuggugaugaagucg

SEQ ID NO: 1424147 - RNA, 15 nt, Pseudomonas aeruginosa PA01
gcaggaccacgcugg

SEQ ID NO: 1424148 - RNA, 23 nt, Pseudomonas aeruginosa PA01
gcaggaccacgcuggucaccguc

SEQ ID NO: 1424149 - RNA, 20 nt, Pseudomonas aeruginosa PA01
gcaggagcagcuugcgcgag

SEQ ID NO: 1424150 - RNA, 20 nt, Pseudomonas aeruginosa PA01
gcaggagaagcgccucgccu

SEQ ID NO: 1424151 - RNA, 20 nt, Pseudomonas aeruginosa PA01
gcaggacgucguagccaggc

SEQ ID NO: 1424152 - RNA, 23 nt, Pseudomonas aeruginosa PA01
gcaggacgucguagccaggcacc

SEQ ID NO: 1424153 - RNA, 23 nt, Pseudomonas aeruginosa PA01
gcaggacggauaacggcagccgc

SEQ ID NO: 1424154 - RNA, 12 nt, Pseudomonas aeruginosa PA01
gcaggacggcga

SEQ ID NO: 1424155 - RNA, 16 nt, Pseudomonas aeruginosa PA01
gcaggacggcgacccg

SEQ ID NO: 1424156 - RNA, 15 nt, Pseudomonas aeruginosa PA01
gcagcuucggcgcga

SEQ ID NO: 1424157 - RNA, 22 nt, Pseudomonas aeruginosa PA01
gcagcuggauccgugccaggcg

SEQ ID NO: 1424158 - RNA, 14 nt, Pseudomonas aeruginosa PA01
gcagcugcggcggc

SEQ ID NO: 1424159 - RNA, 17 nt, Pseudomonas aeruginosa PA01
gcagcugguaggagccg

SEQ ID NO: 1424160 - RNA, 14 nt, Pseudomonas aeruginosa PA01
gcagcuugugggca

SEQ ID NO: 1424161 - RNA, 23 nt, Pseudomonas aeruginosa PA01
gcagcuugguauccaccucgccc

SEQ ID NO: 1424162 - RNA, 17 nt, Pseudomonas aeruginosa PA01
gcagcuuggcgaauagc

SEQ ID NO: 1424163 - RNA, 19 nt, Pseudomonas aeruginosa PA01
gcagcuugccuuccaggcu

SEQ ID NO: 1424164 - RNA, 20 nt, Pseudomonas aeruginosa PA01
gcagcuugccuuccaggcug

SEQ ID NO: 1424165 - RNA, 13 nt, Pseudomonas aeruginosa PA01
gcaggaacagcca

SEQ ID NO: 1424166 - RNA, 20 nt, Pseudomonas aeruginosa PA01
gcaggaacuggucgauccgc

SEQ ID NO: 1424167 - RNA, 18 nt, Pseudomonas aeruginosa PA01
gcaggaaauccgccgcgc

SEQ ID NO: 1424168 - RNA, 14 nt, Pseudomonas aeruginosa PA01
gcaggaaaccccuc

SEQ ID NO: 1424169 - RNA, 19 nt, Pseudomonas aeruginosa PA01
gcaggaaaccccucggcua

SEQ ID NO: 1424170 - RNA, 12 nt, Pseudomonas aeruginosa PA01
gcaggcggcugg

SEQ ID NO: 1424171 - RNA, 16 nt, Pseudomonas aeruginosa PA01
gcaggcggccguccuc

SEQ ID NO: 1424172 - RNA, 15 nt, Pseudomonas aeruginosa PA01
gcaggcugccuucga

SEQ ID NO: 1424173 - RNA, 18 nt, Pseudomonas aeruginosa PA01
gcaggcugccuucgacgu

SEQ ID NO: 1424174 - RNA, 13 nt, Pseudomonas aeruginosa PA01
gcaggcugcgccg

SEQ ID NO: 1424175 - RNA, 14 nt, Pseudomonas aeruginosa PA01
gcaggcugcgccgc

SEQ ID NO: 1424176 - RNA, 17 nt, Pseudomonas aeruginosa PA01
gcaggcgguagcgccgc

SEQ ID NO: 1424177 - RNA, 19 nt, Pseudomonas aeruginosa PA01
gcaggcgguagcgccgcgc

SEQ ID NO: 1424178 - RNA, 16 nt, Pseudomonas aeruginosa PA01
gcaggcggucagcgcg

SEQ ID NO: 1424179 - RNA, 20 nt, Pseudomonas aeruginosa PA01
gcaggcugguaugcagcaac

SEQ ID NO: 1424180 - RNA, 17 nt, Pseudomonas aeruginosa PA01
gcaggcugcugcugcgg

SEQ ID NO: 1424181 - RNA, 23 nt, Pseudomonas aeruginosa PA01
gcaggcugcugcugcggcgguug

SEQ ID NO: 1424182 - RNA, 15 nt, Pseudomonas aeruginosa PA01
gcaggcuggccgagc

SEQ ID NO: 1424183 - RNA, 16 nt, Pseudomonas aeruginosa PA01
gcaggcuggccgagcg

SEQ ID NO: 1424184 - RNA, 15 nt, Pseudomonas aeruginosa PA01
gcaggcugucggcca

SEQ ID NO: 1424185 - RNA, 16 nt, Pseudomonas aeruginosa PA01
gcaggcugucggccag

SEQ ID NO: 1424186 - RNA, 17 nt, Pseudomonas aeruginosa PA01
gcaggcugucggccagc

SEQ ID NO: 1424187 - RNA, 13 nt, Pseudomonas aeruginosa PA01
gcagggccgcggc

SEQ ID NO: 1424188 - RNA, 15 nt, Pseudomonas aeruginosa PA01
gcagggccgcggcgg

SEQ ID NO: 1424189 - RNA, 23 nt, Pseudomonas aeruginosa PA01
gcagggccgcggcguugucggcc

SEQ ID NO: 1424190 - RNA, 15 nt, Pseudomonas aeruginosa PA01
gcagggccgccagcc

SEQ ID NO: 1424191 - RNA, 22 nt, Pseudomonas aeruginosa PA01
gcagggccgccagccgccagga

SEQ ID NO: 1424192 - RNA, 15 nt, Pseudomonas aeruginosa PA01
gcagggccgccgagg

SEQ ID NO: 1424193 - RNA, 17 nt, Pseudomonas aeruginosa PA01
gcagggccaggccgagc

SEQ ID NO: 1424194 - RNA, 20 nt, Pseudomonas aeruginosa PA01
gcagggcccauuccacgugc

SEQ ID NO: 1424195 - RNA, 15 nt, Pseudomonas aeruginosa PA01
gcagggccagcagcg

SEQ ID NO: 1424196 - RNA, 16 nt, Pseudomonas aeruginosa PA01
gcagggccagcagcgc

SEQ ID NO: 1424197 - RNA, 18 nt, Pseudomonas aeruginosa PA01
gcagggccagccagagcc

SEQ ID NO: 1424198 - RNA, 16 nt, Pseudomonas aeruginosa PA01
gcagggcagccgccgc

SEQ ID NO: 1424199 - RNA, 18 nt, Pseudomonas aeruginosa PA01
gcagggcagccgccgcgg

SEQ ID NO: 1424200 - RNA, 14 nt, Pseudomonas aeruginosa PA01
gcagggccagcagc

SEQ ID NO: 1424201 - RNA, 14 nt, Pseudomonas aeruginosa PA01
gcagggccagcgcc

SEQ ID NO: 1424202 - RNA, 21 nt, Pseudomonas aeruginosa PA01
gcagggccagcgccuggcgca

SEQ ID NO: 1424203 - RNA, 14 nt, Pseudomonas aeruginosa PA01
gcagggccagcgga

SEQ ID NO: 1424204 - RNA, 16 nt, Pseudomonas aeruginosa PA01
gcagggaguccgccag

SEQ ID NO: 1424205 - RNA, 17 nt, Pseudomonas aeruginosa PA01
gcagggaguccgccagc

SEQ ID NO: 1424206 - RNA, 16 nt, Pseudomonas aeruginosa PA01
gcagggauuccggguc

SEQ ID NO: 1424207 - RNA, 19 nt, Pseudomonas aeruginosa PA01
gcaggcuuuccagcccggc

SEQ ID NO: 1424208 - RNA, 16 nt, Pseudomonas aeruginosa PA01
gcaggcuuucguaggc

SEQ ID NO: 1424209 - RNA, 23 nt, Pseudomonas aeruginosa PA01
gcaggcuuucguaggcaggcgcg

SEQ ID NO: 1424210 - RNA, 22 nt, Pseudomonas aeruginosa PA01
gcaggcgauacaggcggugacg

SEQ ID NO: 1424211 - RNA, 16 nt, Pseudomonas aeruginosa PA01
gcaggcgauagaugug

SEQ ID NO: 1424212 - RNA, 22 nt, Pseudomonas aeruginosa PA01
gcaggcgaugaucagcccuucg

SEQ ID NO: 1424213 - RNA, 15 nt, Pseudomonas aeruginosa PA01
gcaggcgaugccgac

SEQ ID NO: 1424214 - RNA, 17 nt, Pseudomonas aeruginosa PA01
gcaggcgaugccgacgc

SEQ ID NO: 1424215 - RNA, 14 nt, Pseudomonas aeruginosa PA01
gcaggcgcuggccg

SEQ ID NO: 1424216 - RNA, 15 nt, Pseudomonas aeruginosa PA01
gcaggcgcuggcggg

SEQ ID NO: 1424217 - RNA, 20 nt, Pseudomonas aeruginosa PA01
gcaggcggaguagccggcgg

SEQ ID NO: 1424218 - RNA, 14 nt, Pseudomonas aeruginosa PA01
gcaggcggaucgcc

SEQ ID NO: 1424219 - RNA, 19 nt, Pseudomonas aeruginosa PA01
gcaggcggaucgccgccuu

SEQ ID NO: 1424220 - RNA, 21 nt, Pseudomonas aeruginosa PA01
gcaggcggaaaaagcgcggag

SEQ ID NO: 1424221 - RNA, 22 nt, Pseudomonas aeruginosa PA01
gcaggcggaaaaagcgcggagg

SEQ ID NO: 1424222 - RNA, 21 nt, Pseudomonas aeruginosa PA01
gcaggccuggaauaccccgcg

SEQ ID NO: 1424223 - RNA, 17 nt, Pseudomonas aeruginosa PA01
gcaggccuggagcgccu

SEQ ID NO: 1424224 - RNA, 21 nt, Pseudomonas aeruginosa PA01
gcaggcgaggauggccguccu

SEQ ID NO: 1424225 - RNA, 22 nt, Pseudomonas aeruginosa PA01
gcaggcgaggauggccguccuc

SEQ ID NO: 1424226 - RNA, 20 nt, Pseudomonas aeruginosa PA01
gcaggcgaacugccgacggc

SEQ ID NO: 1424227 - RNA, 14 nt, Pseudomonas aeruginosa PA01
gcaggcccggccgc

SEQ ID NO: 1424228 - RNA, 17 nt, Pseudomonas aeruginosa PA01
gcaggcccggccgccug

SEQ ID NO: 1424229 - RNA, 15 nt, Pseudomonas aeruginosa PA01
gcaggccuuccacgc

SEQ ID NO: 1424230 - RNA, 12 nt, Pseudomonas aeruginosa PA01
gcaggccuucga

SEQ ID NO: 1424231 - RNA, 12 nt, Pseudomonas aeruginosa PA01
gcaggccuucgg

SEQ ID NO: 1424232 - RNA, 17 nt, Pseudomonas aeruginosa PA01
gcaggccuucggcgccg

SEQ ID NO: 1424233 - RNA, 19 nt, Pseudomonas aeruginosa PA01
gcaggccuugcagggccgc

SEQ ID NO: 1424234 - RNA, 22 nt, Pseudomonas aeruginosa PA01
gcaggccuugcagggccgccag

SEQ ID NO: 1424235 - RNA, 16 nt, Pseudomonas aeruginosa PA01
gcaggcccgagccgga

SEQ ID NO: 1424236 - RNA, 19 nt, Pseudomonas aeruginosa PA01
gcaggcccgagccggacga

SEQ ID NO: 1424237 - RNA, 18 nt, Pseudomonas aeruginosa PA01
gcaggccgugccagagcu

SEQ ID NO: 1424238 - RNA, 19 nt, Pseudomonas aeruginosa PA01
gcaggccgugggccggcgc

SEQ ID NO: 1424239 - RNA, 23 nt, Pseudomonas aeruginosa PA01
gcaggcccagccauugcgccagg

SEQ ID NO: 1424240 - RNA, 20 nt, Pseudomonas aeruginosa PA01
gcaggcccaugauggucggc

SEQ ID NO: 1424241 - RNA, 21 nt, Pseudomonas aeruginosa PA01
gcaggcccaugauggucggca

SEQ ID NO: 1424242 - RNA, 12 nt, Pseudomonas aeruginosa PA01
gcaggccagggc

SEQ ID NO: 1424243 - RNA, 19 nt, Pseudomonas aeruginosa PA01
gcaggccaugggugucggc

SEQ ID NO: 1424244 - RNA, 20 nt, Pseudomonas aeruginosa PA01
gcaggccaugggugucggcg

SEQ ID NO: 1424245 - RNA, 14 nt, Pseudomonas aeruginosa PA01
gcaggcacagggcg

SEQ ID NO: 1424246 - RNA, 16 nt, Pseudomonas aeruginosa PA01
gcaggcacagggcgac

SEQ ID NO: 1424247 - RNA, 17 nt, Pseudomonas aeruginosa PA01
gcaggcacagggcgacu

SEQ ID NO: 1424248 - RNA, 13 nt, Pseudomonas aeruginosa PA01
gcaggcacccgcg

SEQ ID NO: 1424249 - RNA, 22 nt, Pseudomonas aeruginosa PA01
gcaggccagcuuccaggcgcgc

SEQ ID NO: 1424250 - RNA, 13 nt, Pseudomonas aeruginosa PA01
gcaggccaggccc

SEQ ID NO: 1424251 - RNA, 13 nt, Pseudomonas aeruginosa PA01
gcaggccaggcgc

SEQ ID NO: 1424252 - RNA, 17 nt, Pseudomonas aeruginosa PA01
gcaggccaggcgcagug

SEQ ID NO: 1424253 - RNA, 20 nt, Pseudomonas aeruginosa PA01
gcaggccaggcgcagugccu

SEQ ID NO: 1424254 - RNA, 15 nt, Pseudomonas aeruginosa PA01
gcaucagugcucauc

SEQ ID NO: 1424255 - RNA, 13 nt, Pseudomonas aeruginosa PA01
gcauccagcaccg

SEQ ID NO: 1424256 - RNA, 21 nt, Pseudomonas aeruginosa PA01
gcaucaugaucugguagacca

SEQ ID NO: 1424257 - RNA, 12 nt, Pseudomonas aeruginosa PA01
gcaucaggucgg

SEQ ID NO: 1424258 - RNA, 14 nt, Pseudomonas aeruginosa PA01
gcaucaggucggcg

SEQ ID NO: 1424259 - RNA, 20 nt, Pseudomonas aeruginosa PA01
gcaucaggucggcgcgcacc

SEQ ID NO: 1424260 - RNA, 23 nt, Pseudomonas aeruginosa PA01
gcaucaggucggcgcgcaccugu

SEQ ID NO: 1424261 - RNA, 22 nt, Pseudomonas aeruginosa PA01
gcaucaguagcgggcauccagc

SEQ ID NO: 1424262 - RNA, 13 nt, Pseudomonas aeruginosa PA01
gcaucagcgccgg

SEQ ID NO: 1424263 - RNA, 15 nt, Pseudomonas aeruginosa PA01
gcaucagcgccgguu

SEQ ID NO: 1424264 - RNA, 16 nt, Pseudomonas aeruginosa PA01
gcaucagcgccgguuc

SEQ ID NO: 1424265 - RNA, 23 nt, Pseudomonas aeruginosa PA01
gcaucagcgacagcauggccuug

SEQ ID NO: 1424266 - RNA, 22 nt, Pseudomonas aeruginosa PA01
gcaucagccuggccagcgucgc

SEQ ID NO: 1424267 - RNA, 21 nt, Pseudomonas aeruginosa PA01
gcaucagccgcgacgacugcg

SEQ ID NO: 1424268 - RNA, 18 nt, Pseudomonas aeruginosa PA01
gcaucagaggcaacacca

SEQ ID NO: 1424269 - RNA, 19 nt, Pseudomonas aeruginosa PA01
gcaucagccccucggccag

SEQ ID NO: 1424270 - RNA, 17 nt, Pseudomonas aeruginosa PA01
gcauauucuucaacagc

SEQ ID NO: 1424271 - RNA, 18 nt, Pseudomonas aeruginosa PA01
gcauacgaaaacggcccu

SEQ ID NO: 1424272 - RNA, 15 nt, Pseudomonas aeruginosa PA01
gcaguuccaggcguc

SEQ ID NO: 1424273 - RNA, 21 nt, Pseudomonas aeruginosa PA01
gcaguucccccagcaccugga

SEQ ID NO: 1424274 - RNA, 15 nt, Pseudomonas aeruginosa PA01
gcaguuccgcggcgu

SEQ ID NO: 1424275 - RNA, 19 nt, Pseudomonas aeruginosa PA01
gcaguucgaccuccaggcc

SEQ ID NO: 1424276 - RNA, 21 nt, Pseudomonas aeruginosa PA01
gcaguuccucgccgcugcugg

SEQ ID NO: 1424277 - RNA, 20 nt, Pseudomonas aeruginosa PA01
gcaguucagccacugccgcc

SEQ ID NO: 1424278 - RNA, 23 nt, Pseudomonas aeruginosa PA01
gcaguucgccccgccgccaggcg

SEQ ID NO: 1424279 - RNA, 14 nt, Pseudomonas aeruginosa PA01
gcaguucgccgccg

SEQ ID NO: 1424280 - RNA, 17 nt, Pseudomonas aeruginosa PA01
gcaguucgccgccgagc

SEQ ID NO: 1424281 - RNA, 18 nt, Pseudomonas aeruginosa PA01
gcaguucgccgccgagcg

SEQ ID NO: 1424282 - RNA, 21 nt, Pseudomonas aeruginosa PA01
gcagucgguagaaauccuccg

SEQ ID NO: 1424283 - RNA, 18 nt, Pseudomonas aeruginosa PA01
gcaguggcuccgcgcguu

SEQ ID NO: 1424284 - RNA, 18 nt, Pseudomonas aeruginosa PA01
gcagugugccgcccugcu

SEQ ID NO: 1424285 - RNA, 16 nt, Pseudomonas aeruginosa PA01
gcagucgccgcaccgg

SEQ ID NO: 1424286 - RNA, 16 nt, Pseudomonas aeruginosa PA01
gcagucgccuggcccu

SEQ ID NO: 1424287 - RNA, 20 nt, Pseudomonas aeruginosa PA01
gcagucgcacagccaggggc

SEQ ID NO: 1424288 - RNA, 14 nt, Pseudomonas aeruginosa PA01
gcagucgcggcccu

SEQ ID NO: 1424289 - RNA, 17 nt, Pseudomonas aeruginosa PA01
gcagucgcggcccuggu

SEQ ID NO: 1424290 - RNA, 15 nt, Pseudomonas aeruginosa PA01
gcaguccgguagcgc

SEQ ID NO: 1424291 - RNA, 23 nt, Pseudomonas aeruginosa PA01
gcaguccuggcgguagcccggca

SEQ ID NO: 1424292 - RNA, 20 nt, Pseudomonas aeruginosa PA01
gcaguccuugagcgccagca

SEQ ID NO: 1424293 - RNA, 19 nt, Pseudomonas aeruginosa PA01
gcagucccagaaggccagg

SEQ ID NO: 1424294 - RNA, 15 nt, Pseudomonas aeruginosa PA01
gcagucccgccaggc

SEQ ID NO: 1424295 - RNA, 14 nt, Pseudomonas aeruginosa PA01
gcagucccgcgcgg

SEQ ID NO: 1424296 - RNA, 17 nt, Pseudomonas aeruginosa PA01
gcagucccgcgcggccc

SEQ ID NO: 1424297 - RNA, 18 nt, Pseudomonas aeruginosa PA01
gcagggggcuuugcggcc

SEQ ID NO: 1424298 - RNA, 22 nt, Pseudomonas aeruginosa PA01
gcaggggcuuucuucgccuggc

SEQ ID NO: 1424299 - RNA, 15 nt, Pseudomonas aeruginosa PA01
gcaggcggcuggcgc

SEQ ID NO: 1424300 - RNA, 17 nt, Pseudomonas aeruginosa PA01
gcaggggcaccggcgga

SEQ ID NO: 1424301 - RNA, 14 nt, Pseudomonas aeruginosa PA01
gcaggggcgcgccg

SEQ ID NO: 1424302 - RNA, 15 nt, Pseudomonas aeruginosa PA01
gcaggggcgcgccgg

SEQ ID NO: 1424303 - RNA, 17 nt, Pseudomonas aeruginosa PA01
gcaggggcgcgccggcu

SEQ ID NO: 1424304 - RNA, 16 nt, Pseudomonas aeruginosa PA01
gcagggucagcagcgc

SEQ ID NO: 1424305 - RNA, 17 nt, Pseudomonas aeruginosa PA01
gcagggucagccgaugc

SEQ ID NO: 1424306 - RNA, 18 nt, Pseudomonas aeruginosa PA01
gcagggucagucgagcag

SEQ ID NO: 1424307 - RNA, 12 nt, Pseudomonas aeruginosa PA01
gcagggucaggg

SEQ ID NO: 1424308 - RNA, 13 nt, Pseudomonas aeruginosa PA01
gcaggguaccgcu

SEQ ID NO: 1424309 - RNA, 15 nt, Pseudomonas aeruginosa PA01
gcaggguaccgcugg

SEQ ID NO: 1424310 - RNA, 18 nt, Pseudomonas aeruginosa PA01
gcaggguaccgcuggcgc

SEQ ID NO: 1424311 - RNA, 19 nt, Pseudomonas aeruginosa PA01
gcaggguauuuuccagcag

SEQ ID NO: 1424312 - RNA, 18 nt, Pseudomonas aeruginosa PA01
gcagggucacgccgauca

SEQ ID NO: 1424313 - RNA, 17 nt, Pseudomonas aeruginosa PA01
gcagggucacgccggug

SEQ ID NO: 1424314 - RNA, 15 nt, Pseudomonas aeruginosa PA01
gcagggucacgcugg

SEQ ID NO: 1424315 - RNA, 19 nt, Pseudomonas aeruginosa PA01
gcagggucacgcugggcag

SEQ ID NO: 1424316 - RNA, 14 nt, Pseudomonas aeruginosa PA01
gcagguuggccccg

SEQ ID NO: 1424317 - RNA, 18 nt, Pseudomonas aeruginosa PA01
gcagguugcgcuggcgca

SEQ ID NO: 1424318 - RNA, 16 nt, Pseudomonas aeruginosa PA01
gcagguugcuggcgag

SEQ ID NO: 1424319 - RNA, 14 nt, Pseudomonas aeruginosa PA01
gcagguugcgcugg

SEQ ID NO: 1424320 - RNA, 12 nt, Pseudomonas aeruginosa PA01
gcagggugcccu

SEQ ID NO: 1424321 - RNA, 19 nt, Pseudomonas aeruginosa PA01
gcagggugcggauggcgau

SEQ ID NO: 1424322 - RNA, 21 nt, Pseudomonas aeruginosa PA01
gcagguugauccugggcgcca

SEQ ID NO: 1424323 - RNA, 12 nt, Pseudomonas aeruginosa PA01
gcagggucgagg

SEQ ID NO: 1424324 - RNA, 22 nt, Pseudomonas aeruginosa PA01
gcagggucgaggcaaucugccc

SEQ ID NO: 1424325 - RNA, 15 nt, Pseudomonas aeruginosa PA01
gcagggucgccgggu

SEQ ID NO: 1424326 - RNA, 14 nt, Pseudomonas aeruginosa PA01
gcagggucgcgagc

SEQ ID NO: 1424327 - RNA, 17 nt, Pseudomonas aeruginosa PA01
gcagggucgcgagcagg

SEQ ID NO: 1424328 - RNA, 18 nt, Pseudomonas aeruginosa PA01
gcagggucgcgagcaggg

SEQ ID NO: 1424329 - RNA, 22 nt, Pseudomonas aeruginosa PA01
gcagggucgcgagcagggcgau

SEQ ID NO: 1424330 - RNA, 15 nt, Pseudomonas aeruginosa PA01
gcagggugacgguga

SEQ ID NO: 1424331 - RNA, 20 nt, Pseudomonas aeruginosa PA01
gcagggucgcgccguccauc

SEQ ID NO: 1424332 - RNA, 17 nt, Pseudomonas aeruginosa PA01
gcagggugaagcugcgg

SEQ ID NO: 1424333 - RNA, 18 nt, Pseudomonas aeruginosa PA01
gcagggucuucaggcgcc

SEQ ID NO: 1424334 - RNA, 21 nt, Pseudomonas aeruginosa PA01
gcagggucuucaggcgccguu

SEQ ID NO: 1424335 - RNA, 16 nt, Pseudomonas aeruginosa PA01
gcaguacuuggccagc

SEQ ID NO: 1424336 - RNA, 14 nt, Pseudomonas aeruginosa PA01
gcaguaggccuggu

SEQ ID NO: 1424337 - RNA, 15 nt, Pseudomonas aeruginosa PA01
gcaguaggccuggua

SEQ ID NO: 1424338 - RNA, 13 nt, Pseudomonas aeruginosa PA01
gcaguaacgccug

SEQ ID NO: 1424339 - RNA, 22 nt, Pseudomonas aeruginosa PA01
gcaguaacgccugucgcuccgg

SEQ ID NO: 1424340 - RNA, 16 nt, Pseudomonas aeruginosa PA01
gcagguuguccagggc

SEQ ID NO: 1424341 - RNA, 17 nt, Pseudomonas aeruginosa PA01
gcagguuguccagggca

SEQ ID NO: 1424342 - RNA, 13 nt, Pseudomonas aeruginosa PA01
gcagguuucgcga

SEQ ID NO: 1424343 - RNA, 16 nt, Pseudomonas aeruginosa PA01
gcaguacagcucggcg

SEQ ID NO: 1424344 - RNA, 17 nt, Pseudomonas aeruginosa PA01
gcaguacagcucggcgc

SEQ ID NO: 1424345 - RNA, 14 nt, Pseudomonas aeruginosa PA01
gcaguacagcugca

SEQ ID NO: 1424346 - RNA, 17 nt, Pseudomonas aeruginosa PA01
gcaguacagcugcaccg

SEQ ID NO: 1424347 - RNA, 22 nt, Pseudomonas aeruginosa PA01
gcaguacagcugcaccgcgcgg

SEQ ID NO: 1424348 - RNA, 13 nt, Pseudomonas aeruginosa PA01
gcaguacccggcc

SEQ ID NO: 1424349 - RNA, 20 nt, Pseudomonas aeruginosa PA01
gcaguaccugcucacggccg

SEQ ID NO: 1424350 - RNA, 20 nt, Pseudomonas aeruginosa PA01
gcaguacgaucagccagggc

SEQ ID NO: 1424351 - RNA, 21 nt, Pseudomonas aeruginosa PA01
gcaguacgaucagccagggca

SEQ ID NO: 1424352 - RNA, 13 nt, Pseudomonas aeruginosa PA01
gcaccacgucgga

SEQ ID NO: 1424353 - RNA, 19 nt, Pseudomonas aeruginosa PA01
gcaccacggcgauggucag

SEQ ID NO: 1424354 - RNA, 14 nt, Pseudomonas aeruginosa PA01
gcaccacguagccg

SEQ ID NO: 1424355 - RNA, 18 nt, Pseudomonas aeruginosa PA01
gcaccacguagccggcgu

SEQ ID NO: 1424356 - RNA, 13 nt, Pseudomonas aeruginosa PA01
gcaccagcacgcc

SEQ ID NO: 1424357 - RNA, 17 nt, Pseudomonas aeruginosa PA01
gcaccaccgccgccagc

SEQ ID NO: 1424358 - RNA, 20 nt, Pseudomonas aeruginosa PA01
gcaccaccgccgccagcaac

SEQ ID NO: 1424359 - RNA, 15 nt, Pseudomonas aeruginosa PA01
gcaccacccggccgc

SEQ ID NO: 1424360 - RNA, 16 nt, Pseudomonas aeruginosa PA01
gcaccacccggccgcg

SEQ ID NO: 1424361 - RNA, 18 nt, Pseudomonas aeruginosa PA01
gcaccacccggccgcgcu

SEQ ID NO: 1424362 - RNA, 15 nt, Pseudomonas aeruginosa PA01
gcaccacccggcgca

SEQ ID NO: 1424363 - RNA, 16 nt, Pseudomonas aeruginosa PA01
gcaccacccggcgcac

SEQ ID NO: 1424364 - RNA, 13 nt, Pseudomonas aeruginosa PA01
gcaccaccugcuu

SEQ ID NO: 1424365 - RNA, 24 nt, Pseudomonas aeruginosa PA01
gcaccaccugcuugggcgccucgc

SEQ ID NO: 1424366 - RNA, 21 nt, Pseudomonas aeruginosa PA01
gcaccaccucgccaagcuggc

SEQ ID NO: 1424367 - RNA, 14 nt, Pseudomonas aeruginosa PA01
gcaccacgcaggcg

SEQ ID NO: 1424368 - RNA, 16 nt, Pseudomonas aeruginosa PA01
gcaccacgcaggcgcg

SEQ ID NO: 1424369 - RNA, 17 nt, Pseudomonas aeruginosa PA01
gcaccacgcaggcgcgu

SEQ ID NO: 1424370 - RNA, 18 nt, Pseudomonas aeruginosa PA01
gcaccacgcgcaagccag

SEQ ID NO: 1424371 - RNA, 22 nt, Pseudomonas aeruginosa PA01
gcaccacgcgcaagccagccau

SEQ ID NO: 1424372 - RNA, 14 nt, Pseudomonas aeruginosa PA01
gcacaugccgagcg

SEQ ID NO: 1424373 - RNA, 19 nt, Pseudomonas aeruginosa PA01
gcacaugccgagcgaaauc

SEQ ID NO: 1424374 - RNA, 23 nt, Pseudomonas aeruginosa PA01
gcacauuacccccuugcccgucg

SEQ ID NO: 1424375 - RNA, 20 nt, Pseudomonas aeruginosa PA01
gcacaugccacgcaccacca

SEQ ID NO: 1424376 - RNA, 23 nt, Pseudomonas aeruginosa PA01
gcaccaccagcgcgcgcuggcgc

SEQ ID NO: 1424377 - RNA, 17 nt, Pseudomonas aeruginosa PA01
gcaccacccaucugccg

SEQ ID NO: 1424378 - RNA, 22 nt, Pseudomonas aeruginosa PA01
gcaccacccaucugccggccac

SEQ ID NO: 1424379 - RNA, 23 nt, Pseudomonas aeruginosa PA01
gcaccacccaucugccggccacc

SEQ ID NO: 1424380 - RNA, 22 nt, Pseudomonas aeruginosa PA01
gcaccagcggaccgucgggcag

SEQ ID NO: 1424381 - RNA, 12 nt, Pseudomonas aeruginosa PA01
gcaccagcggac

SEQ ID NO: 1424382 - RNA, 16 nt, Pseudomonas aeruginosa PA01
gcaccagcucccggcu

SEQ ID NO: 1424383 - RNA, 16 nt, Pseudomonas aeruginosa PA01
gcaccaggccaggcug

SEQ ID NO: 1424384 - RNA, 20 nt, Pseudomonas aeruginosa PA01
gcaccaggccaggcugcgcu

SEQ ID NO: 1424385 - RNA, 14 nt, Pseudomonas aeruginosa PA01
gcaccaggccaggu

SEQ ID NO: 1424386 - RNA, 20 nt, Pseudomonas aeruginosa PA01
gcaccaggccagguggucga

SEQ ID NO: 1424387 - RNA, 15 nt, Pseudomonas aeruginosa PA01
gcaccaggcgaugcg

SEQ ID NO: 1424388 - RNA, 17 nt, Pseudomonas aeruginosa PA01
gcaccaggcgaugcgcc

SEQ ID NO: 1424389 - RNA, 21 nt, Pseudomonas aeruginosa PA01
gcaccaggcgaugcgccggau

SEQ ID NO: 1424390 - RNA, 18 nt, Pseudomonas aeruginosa PA01
gcaccagccuuccggcac

SEQ ID NO: 1424391 - RNA, 17 nt, Pseudomonas aeruginosa PA01
gcaccagccggccgcgu

SEQ ID NO: 1424392 - RNA, 15 nt, Pseudomonas aeruginosa PA01
gcaccagccggcgcu

SEQ ID NO: 1424393 - RNA, 23 nt, Pseudomonas aeruginosa PA01
gcaccagccggcgcucggccagg

SEQ ID NO: 1424394 - RNA, 18 nt, Pseudomonas aeruginosa PA01
gcaccagccaguccggca

SEQ ID NO: 1424395 - RNA, 23 nt, Pseudomonas aeruginosa PA01
gcaccagcaguagugcgacgcag

SEQ ID NO: 1424396 - RNA, 14 nt, Pseudomonas aeruginosa PA01
gcaccagcaggcga

SEQ ID NO: 1424397 - RNA, 15 nt, Pseudomonas aeruginosa PA01
gcaccagcaggucga

SEQ ID NO: 1424398 - RNA, 16 nt, Pseudomonas aeruginosa PA01
gcaccagcaggucgag

SEQ ID NO: 1424399 - RNA, 17 nt, Pseudomonas aeruginosa PA01
gcaccagcaggucggcg

SEQ ID NO: 1424400 - RNA, 19 nt, Pseudomonas aeruginosa PA01
gcaccagcaggucggcgcg

SEQ ID NO: 1424401 - RNA, 21 nt, Pseudomonas aeruginosa PA01
gcaccagcaggucggcgcgac

SEQ ID NO: 1424402 - RNA, 14 nt, Pseudomonas aeruginosa PA01
gcaccagcaggccg

SEQ ID NO: 1424403 - RNA, 16 nt, Pseudomonas aeruginosa PA01
gcaccagcaggccgau

SEQ ID NO: 1424404 - RNA, 18 nt, Pseudomonas aeruginosa PA01
gcaccagcaggccgauca

SEQ ID NO: 1424405 - RNA, 22 nt, Pseudomonas aeruginosa PA01
gcaccagcacguugccauccag

SEQ ID NO: 1424406 - RNA, 20 nt, Pseudomonas aeruginosa PA01
gcaccagcacuuccggcgcg

SEQ ID NO: 1424407 - RNA, 15 nt, Pseudomonas aeruginosa PA01
gcaccagcaggagca

SEQ ID NO: 1424408 - RNA, 13 nt, Pseudomonas aeruginosa PA01
gcaccagggccag

SEQ ID NO: 1424409 - RNA, 14 nt, Pseudomonas aeruginosa PA01
gcaccagggccagg

SEQ ID NO: 1424410 - RNA, 18 nt, Pseudomonas aeruginosa PA01
gcaccagggccagggcga

SEQ ID NO: 1424411 - RNA, 19 nt, Pseudomonas aeruginosa PA01
gcaccagggcuucgcgcag

SEQ ID NO: 1424412 - RNA, 19 nt, Pseudomonas aeruginosa PA01
gcaccagucccuggccggc

SEQ ID NO: 1424413 - RNA, 19 nt, Pseudomonas aeruginosa PA01
gcaccaggucgucgucacg

SEQ ID NO: 1424414 - RNA, 16 nt, Pseudomonas aeruginosa PA01
gcaccaguggcgccgc

SEQ ID NO: 1424415 - RNA, 18 nt, Pseudomonas aeruginosa PA01
gcaccauccucguaggug

SEQ ID NO: 1424416 - RNA, 12 nt, Pseudomonas aeruginosa PA01
gcaccauccgcc

SEQ ID NO: 1424417 - RNA, 13 nt, Pseudomonas aeruginosa PA01
gcaccauccgccg

SEQ ID NO: 1424418 - RNA, 15 nt, Pseudomonas aeruginosa PA01
gcaccauccgccgca

SEQ ID NO: 1424419 - RNA, 23 nt, Pseudomonas aeruginosa PA01
gcaccauccgccgcaggucggcg

SEQ ID NO: 1424420 - RNA, 18 nt, Pseudomonas aeruginosa PA01
gcaccaugcagcggcaug

SEQ ID NO: 1424421 - RNA, 23 nt, Pseudomonas aeruginosa PA01
gcaccaugcagcggcauggucag

SEQ ID NO: 1424422 - RNA, 14 nt, Pseudomonas aeruginosa PA01
gcacaguugcgcgc

SEQ ID NO: 1424423 - RNA, 19 nt, Pseudomonas aeruginosa PA01
gcacaguugcgcgccggcg

SEQ ID NO: 1424424 - RNA, 23 nt, Pseudomonas aeruginosa PA01
gcacauagagggucagccggccg

SEQ ID NO: 1424425 - RNA, 13 nt, Pseudomonas aeruginosa PA01
gcacaggcuggcc

SEQ ID NO: 1424426 - RNA, 14 nt, Pseudomonas aeruginosa PA01
gcacaggcuggcca

SEQ ID NO: 1424427 - RNA, 16 nt, Pseudomonas aeruginosa PA01
gcacaggcuggccaga

SEQ ID NO: 1424428 - RNA, 13 nt, Pseudomonas aeruginosa PA01
gcacagggacgcg

SEQ ID NO: 1424429 - RNA, 20 nt, Pseudomonas aeruginosa PA01
gcacagggcgacuaccaggu

SEQ ID NO: 1424430 - RNA, 18 nt, Pseudomonas aeruginosa PA01
gcacagguagaggucgaa

SEQ ID NO: 1424431 - RNA, 20 nt, Pseudomonas aeruginosa PA01
gcacagguagaggucgaaag

SEQ ID NO: 1424432 - RNA, 15 nt, Pseudomonas aeruginosa PA01
gcacauagcugccga

SEQ ID NO: 1424433 - RNA, 17 nt, Pseudomonas aeruginosa PA01
gcacauagcugccgaau

SEQ ID NO: 1424434 - RNA, 18 nt, Pseudomonas aeruginosa PA01
gcacaucaccuucgcccu

SEQ ID NO: 1424435 - RNA, 14 nt, Pseudomonas aeruginosa PA01
gcacaggcggcugu

SEQ ID NO: 1424436 - RNA, 20 nt, Pseudomonas aeruginosa PA01
gcacaggcggcuguugccgu

SEQ ID NO: 1424437 - RNA, 17 nt, Pseudomonas aeruginosa PA01
gcacacggucgagaccc

SEQ ID NO: 1424438 - RNA, 21 nt, Pseudomonas aeruginosa PA01
gcacaccuggucuucgguggc

SEQ ID NO: 1424439 - RNA, 18 nt, Pseudomonas aeruginosa PA01
gcacaccuccagcggcuu

SEQ ID NO: 1424440 - RNA, 20 nt, Pseudomonas aeruginosa PA01
gcacaacgggugcugcggau

SEQ ID NO: 1424441 - RNA, 18 nt, Pseudomonas aeruginosa PA01
gcacagccccagccucgg

SEQ ID NO: 1424442 - RNA, 22 nt, Pseudomonas aeruginosa PA01
gcacagccccagccucggcagg

SEQ ID NO: 1424443 - RNA, 19 nt, Pseudomonas aeruginosa PA01
gcacagccaggggcacgcu

SEQ ID NO: 1424444 - RNA, 16 nt, Pseudomonas aeruginosa PA01
gcacagccauagcgcc

SEQ ID NO: 1424445 - RNA, 20 nt, Pseudomonas aeruginosa PA01
gcacagccauagcgccggca

SEQ ID NO: 1424446 - RNA, 21 nt, Pseudomonas aeruginosa PA01
gcacagccauagcgccggcac

SEQ ID NO: 1424447 - RNA, 18 nt, Pseudomonas aeruginosa PA01
gcacagccauagugcugg

SEQ ID NO: 1424448 - RNA, 16 nt, Pseudomonas aeruginosa PA01
gcaauacccgccgcug

SEQ ID NO: 1424449 - RNA, 16 nt, Pseudomonas aeruginosa PA01
gcaaacgccauccgcc

SEQ ID NO: 1424450 - RNA, 17 nt, Pseudomonas aeruginosa PA01
gcaaacgccauccgccu

SEQ ID NO: 1424451 - RNA, 13 nt, Pseudomonas aeruginosa PA01
gcaaacgccgcca

SEQ ID NO: 1424452 - RNA, 14 nt, Pseudomonas aeruginosa PA01
gcaaacgccgccac

SEQ ID NO: 1424453 - RNA, 15 nt, Pseudomonas aeruginosa PA01
gcacaaaaaagcccg

SEQ ID NO: 1424454 - RNA, 17 nt, Pseudomonas aeruginosa PA01
gcaaugcccgcgccugg

SEQ ID NO: 1424455 - RNA, 22 nt, Pseudomonas aeruginosa PA01
gcaauggggcggccggcgcgga

SEQ ID NO: 1424456 - RNA, 19 nt, Pseudomonas aeruginosa PA01
gcaauggcgcagccgcugg

SEQ ID NO: 1424457 - RNA, 22 nt, Pseudomonas aeruginosa PA01
gcaauggauguugccgccgccg

SEQ ID NO: 1424458 - RNA, 12 nt, Pseudomonas aeruginosa PA01
gcaaucgcugcc

SEQ ID NO: 1424459 - RNA, 15 nt, Pseudomonas aeruginosa PA01
gcaaucgaugucgug

SEQ ID NO: 1424460 - RNA, 19 nt, Pseudomonas aeruginosa PA01
gcaaucggcgagccgcagc

SEQ ID NO: 1424461 - RNA, 20 nt, Pseudomonas aeruginosa PA01
gcaauccucggugcgcacgc

SEQ ID NO: 1424462 - RNA, 18 nt, Pseudomonas aeruginosa PA01
gcaauccggcgcugccga

SEQ ID NO: 1424463 - RNA, 17 nt, Pseudomonas aeruginosa PA01
gcaaucgaccaucaucc

SEQ ID NO: 1424464 - RNA, 21 nt, Pseudomonas aeruginosa PA01
gcaaucgaccaucauccgcgu

SEQ ID NO: 1424465 - RNA, 18 nt, Pseudomonas aeruginosa PA01
gcacgaucugcgccgcaa

SEQ ID NO: 1424466 - RNA, 16 nt, Pseudomonas aeruginosa PA01
gcacgagcuuggccac

SEQ ID NO: 1424467 - RNA, 17 nt, Pseudomonas aeruginosa PA01
gcacgaggauuuccgcg

SEQ ID NO: 1424468 - RNA, 20 nt, Pseudomonas aeruginosa PA01
gcacgaggauuuccgcgccc

SEQ ID NO: 1424469 - RNA, 13 nt, Pseudomonas aeruginosa PA01
gcacgaggcgggc

SEQ ID NO: 1424470 - RNA, 21 nt, Pseudomonas aeruginosa PA01
gcacgaggcgggcuggaaaac

SEQ ID NO: 1424471 - RNA, 17 nt, Pseudomonas aeruginosa PA01
gcacgagucgaggcgau

SEQ ID NO: 1424472 - RNA, 13 nt, Pseudomonas aeruginosa PA01
gcacgacgccggu

SEQ ID NO: 1424473 - RNA, 19 nt, Pseudomonas aeruginosa PA01
gcaccuugcgaaaagcccg

SEQ ID NO: 1424474 - RNA, 17 nt, Pseudomonas aeruginosa PA01
gcaccuguuucagcggg

SEQ ID NO: 1424475 - RNA, 18 nt, Pseudomonas aeruginosa PA01
gcaccuucaucaccaggu

SEQ ID NO: 1424476 - RNA, 12 nt, Pseudomonas aeruginosa PA01
gcaccuucaccg

SEQ ID NO: 1424477 - RNA, 17 nt, Pseudomonas aeruginosa PA01
gcaccuguuccagcaac

SEQ ID NO: 1424478 - RNA, 20 nt, Pseudomonas aeruginosa PA01
gcaccugggcguuggccagc

SEQ ID NO: 1424479 - RNA, 21 nt, Pseudomonas aeruginosa PA01
gcaccugggcguuggccagcg

SEQ ID NO: 1424480 - RNA, 13 nt, Pseudomonas aeruginosa PA01
gcaccugggugcu

SEQ ID NO: 1424481 - RNA, 22 nt, Pseudomonas aeruginosa PA01
gcaccugggugcuuuccugcuc

SEQ ID NO: 1424482 - RNA, 20 nt, Pseudomonas aeruginosa PA01
gcaccugguggacacccugc

SEQ ID NO: 1424483 - RNA, 17 nt, Pseudomonas aeruginosa PA01
gcaccuggcggucgccg

SEQ ID NO: 1424484 - RNA, 24 nt, Pseudomonas aeruginosa PA01
gcaccuggcggucgccgccggcga

SEQ ID NO: 1424485 - RNA, 17 nt, Pseudomonas aeruginosa PA01
gcacgccgcucugcccg

SEQ ID NO: 1424486 - RNA, 18 nt, Pseudomonas aeruginosa PA01
gcacgccggccucgcgca

SEQ ID NO: 1424487 - RNA, 17 nt, Pseudomonas aeruginosa PA01
gcacgccgguggccagg

SEQ ID NO: 1424488 - RNA, 17 nt, Pseudomonas aeruginosa PA01
gcacgcggagggcggcc

SEQ ID NO: 1424489 - RNA, 15 nt, Pseudomonas aeruginosa PA01
gcacgccauccuccg

SEQ ID NO: 1424490 - RNA, 20 nt, Pseudomonas aeruginosa PA01
gcacgcaggccgcugccugu

SEQ ID NO: 1424491 - RNA, 18 nt, Pseudomonas aeruginosa PA01
gcacgcauagcgcgcugu

SEQ ID NO: 1424492 - RNA, 21 nt, Pseudomonas aeruginosa PA01
gcacgcaauagugcagcucca

SEQ ID NO: 1424493 - RNA, 22 nt, Pseudomonas aeruginosa PA01
gcacgcagcagcuucggcgcga

SEQ ID NO: 1424494 - RNA, 13 nt, Pseudomonas aeruginosa PA01
gcacgcagcgccg

SEQ ID NO: 1424495 - RNA, 23 nt, Pseudomonas aeruginosa PA01
gcacgucgauauccagcggcagc

SEQ ID NO: 1424496 - RNA, 22 nt, Pseudomonas aeruginosa PA01
gcacgucgcggcggauaacgcc

SEQ ID NO: 1424497 - RNA, 20 nt, Pseudomonas aeruginosa PA01
gcacuccggcauaccgcccg

SEQ ID NO: 1424498 - RNA, 21 nt, Pseudomonas aeruginosa PA01
gcacuccgggcagaccagcag

SEQ ID NO: 1424499 - RNA, 17 nt, Pseudomonas aeruginosa PA01
gcacgucguccagcgcc

SEQ ID NO: 1424500 - RNA, 18 nt, Pseudomonas aeruginosa PA01
gcacgucguccagcgccg

SEQ ID NO: 1424501 - RNA, 20 nt, Pseudomonas aeruginosa PA01
gcacgucguccagcgccgag

SEQ ID NO: 1424502 - RNA, 16 nt, Pseudomonas aeruginosa PA01
gcacgucaccguccuu

SEQ ID NO: 1424503 - RNA, 19 nt, Pseudomonas aeruginosa PA01
gcacguacuuuggucgagu

SEQ ID NO: 1424504 - RNA, 18 nt, Pseudomonas aeruginosa PA01
gcacguacguccagggca

SEQ ID NO: 1424505 - RNA, 16 nt, Pseudomonas aeruginosa PA01
gcacggugcuggcguc

SEQ ID NO: 1424506 - RNA, 14 nt, Pseudomonas aeruginosa PA01
gcacgcguccgacc

SEQ ID NO: 1424507 - RNA, 20 nt, Pseudomonas aeruginosa PA01
gcacgcuggcgaggacgccg

SEQ ID NO: 1424508 - RNA, 13 nt, Pseudomonas aeruginosa PA01
gcacgcucaugcg

SEQ ID NO: 1424509 - RNA, 16 nt, Pseudomonas aeruginosa PA01
gcacgcuccagaucgc

SEQ ID NO: 1424510 - RNA, 17 nt, Pseudomonas aeruginosa PA01
gcacgcucaggcagcga

SEQ ID NO: 1424511 - RNA, 15 nt, Pseudomonas aeruginosa PA01
gcacgcucaggcgca

SEQ ID NO: 1424512 - RNA, 17 nt, Pseudomonas aeruginosa PA01
gcacgcuucuccucggc

SEQ ID NO: 1424513 - RNA, 20 nt, Pseudomonas aeruginosa PA01
gcacgcuucuccucggccga

SEQ ID NO: 1424514 - RNA, 13 nt, Pseudomonas aeruginosa PA01
gcacgcuggcguc

SEQ ID NO: 1424515 - RNA, 13 nt, Pseudomonas aeruginosa PA01
gcacgcuggugcc

SEQ ID NO: 1424516 - RNA, 23 nt, Pseudomonas aeruginosa PA01
gcacgcuggugccgacgcugauc

SEQ ID NO: 1424517 - RNA, 16 nt, Pseudomonas aeruginosa PA01
gcacgcuguagaccag

SEQ ID NO: 1424518 - RNA, 23 nt, Pseudomonas aeruginosa PA01
gcacggaaucggacgaucgacga

SEQ ID NO: 1424519 - RNA, 13 nt, Pseudomonas aeruginosa PA01
gcacggaggcgcu

SEQ ID NO: 1424520 - RNA, 16 nt, Pseudomonas aeruginosa PA01
gcacggaggcgcucag

SEQ ID NO: 1424521 - RNA, 19 nt, Pseudomonas aeruginosa PA01
gcacggcuucagcgccagg

SEQ ID NO: 1424522 - RNA, 21 nt, Pseudomonas aeruginosa PA01
gcacggcuucagcgccaggcc

SEQ ID NO: 1424523 - RNA, 13 nt, Pseudomonas aeruginosa PA01
gcacggcucggcg

SEQ ID NO: 1424524 - RNA, 22 nt, Pseudomonas aeruginosa PA01
gcacggcucggcgaggaacagc

SEQ ID NO: 1424525 - RNA, 22 nt, Pseudomonas aeruginosa PA01
gcacggcgggacaggaacgccc

SEQ ID NO: 1424526 - RNA, 19 nt, Pseudomonas aeruginosa PA01
gcacggaagcgcugcucga

SEQ ID NO: 1424527 - RNA, 21 nt, Pseudomonas aeruginosa PA01
gcacggugacacccugccgcg

SEQ ID NO: 1424528 - RNA, 23 nt, Pseudomonas aeruginosa PA01
gcacggugacacccugccgcgcc

SEQ ID NO: 1424529 - RNA, 15 nt, Pseudomonas aeruginosa PA01
gcaccgucgagcacc

SEQ ID NO: 1424530 - RNA, 17 nt, Pseudomonas aeruginosa PA01
gcaccgucgagcaccag

SEQ ID NO: 1424531 - RNA, 13 nt, Pseudomonas aeruginosa PA01
gcaccucggccag

SEQ ID NO: 1424532 - RNA, 16 nt, Pseudomonas aeruginosa PA01
gcaccucggccaggcg

SEQ ID NO: 1424533 - RNA, 16 nt, Pseudomonas aeruginosa PA01
gcaccucguaggccga

SEQ ID NO: 1424534 - RNA, 18 nt, Pseudomonas aeruginosa PA01
gcaccucguaggccgacu

SEQ ID NO: 1424535 - RNA, 16 nt, Pseudomonas aeruginosa PA01
gcaccucguccagcag

SEQ ID NO: 1424536 - RNA, 20 nt, Pseudomonas aeruginosa PA01
gcaccgucaccuguucggcg

SEQ ID NO: 1424537 - RNA, 23 nt, Pseudomonas aeruginosa PA01
gcaccgucaccuguucggcgcug

SEQ ID NO: 1424538 - RNA, 13 nt, Pseudomonas aeruginosa PA01
gcaccgucauggu

SEQ ID NO: 1424539 - RNA, 18 nt, Pseudomonas aeruginosa PA01
gcaccgucaagggccagg

SEQ ID NO: 1424540 - RNA, 22 nt, Pseudomonas aeruginosa PA01
gcaccguagcggcugcgguagg

SEQ ID NO: 1424541 - RNA, 18 nt, Pseudomonas aeruginosa PA01
gcaccguaggccaggcag

SEQ ID NO: 1424542 - RNA, 16 nt, Pseudomonas aeruginosa PA01
gcaccgguucgacacg

SEQ ID NO: 1424543 - RNA, 19 nt, Pseudomonas aeruginosa PA01
gcaccggggugauccagcu

SEQ ID NO: 1424544 - RNA, 14 nt, Pseudomonas aeruginosa PA01
gcaccgggccgacc

SEQ ID NO: 1424545 - RNA, 17 nt, Pseudomonas aeruginosa PA01
gcaccgggccgaccugc

SEQ ID NO: 1424546 - RNA, 13 nt, Pseudomonas aeruginosa PA01
gcaccgcggcgcg

SEQ ID NO: 1424547 - RNA, 12 nt, Pseudomonas aeruginosa PA01
gcaccgcccugc

SEQ ID NO: 1424548 - RNA, 20 nt, Pseudomonas aeruginosa PA01
gcaccggcgauggccggcac

SEQ ID NO: 1424549 - RNA, 17 nt, Pseudomonas aeruginosa PA01
gcaccggcggcgccagg

SEQ ID NO: 1424550 - RNA, 22 nt, Pseudomonas aeruginosa PA01
gcaccggcggcgccaggccggc

SEQ ID NO: 1424551 - RNA, 15 nt, Pseudomonas aeruginosa PA01
gcaccggcgcgccgg

SEQ ID NO: 1424552 - RNA, 16 nt, Pseudomonas aeruginosa PA01
gcaccggcgcgccgga

SEQ ID NO: 1424553 - RNA, 18 nt, Pseudomonas aeruginosa PA01
gcaccggcgcggccagcu

SEQ ID NO: 1424554 - RNA, 12 nt, Pseudomonas aeruginosa PA01
gcaccggcggcg

SEQ ID NO: 1424555 - RNA, 19 nt, Pseudomonas aeruginosa PA01
gcaccgggaggcgccgcgc

SEQ ID NO: 1424556 - RNA, 21 nt, Pseudomonas aeruginosa PA01
gcaccgggaggcgccgcgcca

SEQ ID NO: 1424557 - RNA, 16 nt, Pseudomonas aeruginosa PA01
gcacccgcucggccuu

SEQ ID NO: 1424558 - RNA, 14 nt, Pseudomonas aeruginosa PA01
gcacccuggacccg

SEQ ID NO: 1424559 - RNA, 18 nt, Pseudomonas aeruginosa PA01
gcacccuggacccgggcc

SEQ ID NO: 1424560 - RNA, 14 nt, Pseudomonas aeruginosa PA01
gcacccuggccacg

SEQ ID NO: 1424561 - RNA, 15 nt, Pseudomonas aeruginosa PA01
gcacccgcgacucga

SEQ ID NO: 1424562 - RNA, 15 nt, Pseudomonas aeruginosa PA01
gcaccgaacggugca

SEQ ID NO: 1424563 - RNA, 16 nt, Pseudomonas aeruginosa PA01
gcaccgaacggugcag

SEQ ID NO: 1424564 - RNA, 16 nt, Pseudomonas aeruginosa PA01
gcaccgacacgcacuc

SEQ ID NO: 1424565 - RNA, 14 nt, Pseudomonas aeruginosa PA01
gcacccuuggcgca

SEQ ID NO: 1424566 - RNA, 14 nt, Pseudomonas aeruginosa PA01
gcaccgaggcgcgc

SEQ ID NO: 1424567 - RNA, 15 nt, Pseudomonas aeruginosa PA01
gcaccgaggcgcgcc

SEQ ID NO: 1424568 - RNA, 12 nt, Pseudomonas aeruginosa PA01
gcaccgccagcc

SEQ ID NO: 1424569 - RNA, 13 nt, Pseudomonas aeruginosa PA01
gcaccgccagcgu

SEQ ID NO: 1424570 - RNA, 19 nt, Pseudomonas aeruginosa PA01
gcaccgccagcgucgccgc

SEQ ID NO: 1424571 - RNA, 20 nt, Pseudomonas aeruginosa PA01
gcaccgccagcgucgccgcc

SEQ ID NO: 1424572 - RNA, 20 nt, Pseudomonas aeruginosa PA01
gcaccgagcaggcacccgcg

SEQ ID NO: 1424573 - RNA, 13 nt, Pseudomonas aeruginosa PA01
gcaccgaggagaa

SEQ ID NO: 1424574 - RNA, 14 nt, Pseudomonas aeruginosa PA01
gcaccgacgccgcc

SEQ ID NO: 1424575 - RNA, 19 nt, Pseudomonas aeruginosa PA01
gcaccgacgccgccugcgc

SEQ ID NO: 1424576 - RNA, 19 nt, Pseudomonas aeruginosa PA01
gcaccccgucgacgcccug

SEQ ID NO: 1424577 - RNA, 18 nt, Pseudomonas aeruginosa PA01
gcacccgcaccagccggc

SEQ ID NO: 1424578 - RNA, 21 nt, Pseudomonas aeruginosa PA01
gcacccaugaaaaaggccggu

SEQ ID NO: 1424579 - RNA, 20 nt, Pseudomonas aeruginosa PA01
gcacccagucuucgcuggcg

SEQ ID NO: 1424580 - RNA, 18 nt, Pseudomonas aeruginosa PA01
gcaccccauccucgccgg

SEQ ID NO: 1424581 - RNA, 13 nt, Pseudomonas aeruginosa PA01
gcacccccagcag

SEQ ID NO: 1424582 - RNA, 22 nt, Pseudomonas aeruginosa PA01
gcacccccagcaggccagccaa

SEQ ID NO: 1424583 - RNA, 21 nt, Pseudomonas aeruginosa PA01
gcacccagaccuuccagccgc

SEQ ID NO: 1424584 - RNA, 23 nt, Pseudomonas aeruginosa PA01
gcacccaggauuuguccgcgcca

SEQ ID NO: 1424585 - RNA, 12 nt, Pseudomonas aeruginosa PA01
gcacccaggcca

SEQ ID NO: 1424586 - RNA, 14 nt, Pseudomonas aeruginosa PA01
gcacccaggccacg

SEQ ID NO: 1424587 - RNA, 17 nt, Pseudomonas aeruginosa PA01
gcacccaggccacgccc

SEQ ID NO: 1424588 - RNA, 16 nt, Pseudomonas aeruginosa PA01
gcacccaggcgacgcu

SEQ ID NO: 1424589 - RNA, 19 nt, Pseudomonas aeruginosa PA01
gccgcgaccgaagccgcgc

SEQ ID NO: 1424590 - RNA, 20 nt, Pseudomonas aeruginosa PA01
gccgcgaacacacccugcgc

SEQ ID NO: 1424591 - RNA, 19 nt, Pseudomonas aeruginosa PA01
gccgcgaagcccagcgccg

SEQ ID NO: 1424592 - RNA, 20 nt, Pseudomonas aeruginosa PA01
gccgcgaagcccagcgccgc

SEQ ID NO: 1424593 - RNA, 12 nt, Pseudomonas aeruginosa PA01
gccgcgcaccag

SEQ ID NO: 1424594 - RNA, 23 nt, Pseudomonas aeruginosa PA01
gccgcgcaccagcacuuccggcg

SEQ ID NO: 1424595 - RNA, 15 nt, Pseudomonas aeruginosa PA01
gccgcgcaccaccga

SEQ ID NO: 1424596 - RNA, 23 nt, Pseudomonas aeruginosa PA01
gccgcgcaccaccgagagcggcg

SEQ ID NO: 1424597 - RNA, 17 nt, Pseudomonas aeruginosa PA01
gccgcgcaccucgaccg

SEQ ID NO: 1424598 - RNA, 18 nt, Pseudomonas aeruginosa PA01
gccgcgcaccucgaccgc

SEQ ID NO: 1424599 - RNA, 21 nt, Pseudomonas aeruginosa PA01
gccgcgcaccucgaccgcgcc

SEQ ID NO: 1424600 - RNA, 22 nt, Pseudomonas aeruginosa PA01
gccgcgcaccucgaccgcgccg

SEQ ID NO: 1424601 - RNA, 13 nt, Pseudomonas aeruginosa PA01
gccgcgcaccugg

SEQ ID NO: 1424602 - RNA, 16 nt, Pseudomonas aeruginosa PA01
gccgcgcaccugggcg

SEQ ID NO: 1424603 - RNA, 22 nt, Pseudomonas aeruginosa PA01
gccgcgcacgucgagguagaac

SEQ ID NO: 1424604 - RNA, 20 nt, Pseudomonas aeruginosa PA01
gccgcgcaaccguuccagcg

SEQ ID NO: 1424605 - RNA, 14 nt, Pseudomonas aeruginosa PA01
gccgcgcaaggcag

SEQ ID NO: 1424606 - RNA, 22 nt, Pseudomonas aeruginosa PA01
gccgcgcacaaaaaagcccgcc

SEQ ID NO: 1424607 - RNA, 23 nt, Pseudomonas aeruginosa PA01
gccgcgcacaaaaaagcccgcca

SEQ ID NO: 1424608 - RNA, 12 nt, Pseudomonas aeruginosa PA01
gccgcgauggcu

SEQ ID NO: 1424609 - RNA, 16 nt, Pseudomonas aeruginosa PA01
gccgcgauggcucgcg

SEQ ID NO: 1424610 - RNA, 20 nt, Pseudomonas aeruginosa PA01
gccgcgauggcucgcggcgc

SEQ ID NO: 1424611 - RNA, 22 nt, Pseudomonas aeruginosa PA01
gccgcgaugguaggugccaugg

SEQ ID NO: 1424612 - RNA, 17 nt, Pseudomonas aeruginosa PA01
gccgccuuguuccaggc

SEQ ID NO: 1424613 - RNA, 17 nt, Pseudomonas aeruginosa PA01
gccgccuuucugcccgg

SEQ ID NO: 1424614 - RNA, 19 nt, Pseudomonas aeruginosa PA01
gccgccuuucugcccggcu

SEQ ID NO: 1424615 - RNA, 21 nt, Pseudomonas aeruginosa PA01
gccgccuugaccugcugggcc

SEQ ID NO: 1424616 - RNA, 22 nt, Pseudomonas aeruginosa PA01
gccgccuugaccugcugggcca

SEQ ID NO: 1424617 - RNA, 23 nt, Pseudomonas aeruginosa PA01
gccgccuugaccugcugggccag

SEQ ID NO: 1424618 - RNA, 19 nt, Pseudomonas aeruginosa PA01
gccgccuucgcgggccagg

SEQ ID NO: 1424619 - RNA, 15 nt, Pseudomonas aeruginosa PA01
gccgccuucggcagg

SEQ ID NO: 1424620 - RNA, 21 nt, Pseudomonas aeruginosa PA01
gccgccuucggcaggaccucg

SEQ ID NO: 1424621 - RNA, 22 nt, Pseudomonas aeruginosa PA01
gccgccuucggcaggaccucgg

SEQ ID NO: 1424622 - RNA, 17 nt, Pseudomonas aeruginosa PA01
gccgccuucgggcggcu

SEQ ID NO: 1424623 - RNA, 16 nt, Pseudomonas aeruginosa PA01
gccgccuugcgcagca

SEQ ID NO: 1424624 - RNA, 21 nt, Pseudomonas aeruginosa PA01
gccgccuugcguaccagcgcg

SEQ ID NO: 1424625 - RNA, 23 nt, Pseudomonas aeruginosa PA01
gccgccuugcguaccagcgcgca

SEQ ID NO: 1424626 - RNA, 16 nt, Pseudomonas aeruginosa PA01
gccgccuugcucgacc

SEQ ID NO: 1424627 - RNA, 19 nt, Pseudomonas aeruginosa PA01
gccgccuugcucgacccgg

SEQ ID NO: 1424628 - RNA, 20 nt, Pseudomonas aeruginosa PA01
gccgccuugcucgacccggu

SEQ ID NO: 1424629 - RNA, 22 nt, Pseudomonas aeruginosa PA01
gccgccuggcgugccgccaggc

SEQ ID NO: 1424630 - RNA, 23 nt, Pseudomonas aeruginosa PA01
gccgccuggcgugccgccaggcc

SEQ ID NO: 1424631 - RNA, 13 nt, Pseudomonas aeruginosa PA01
gccgccuggccgg

SEQ ID NO: 1424632 - RNA, 20 nt, Pseudomonas aeruginosa PA01
gccgccuggccggccagcca

SEQ ID NO: 1424633 - RNA, 15 nt, Pseudomonas aeruginosa PA01
gccgccuggccggug

SEQ ID NO: 1424634 - RNA, 17 nt, Pseudomonas aeruginosa PA01
gccgccuggccggugac

SEQ ID NO: 1424635 - RNA, 11 nt, Pseudomonas aeruginosa PA01
gccgccuggcg

SEQ ID NO: 1424636 - RNA, 16 nt, Pseudomonas aeruginosa PA01
gccgccuggcgcaugg

SEQ ID NO: 1424637 - RNA, 20 nt, Pseudomonas aeruginosa PA01
gccgccuggcgcauggcgcu

SEQ ID NO: 1424638 - RNA, 22 nt, Pseudomonas aeruginosa PA01
gccgccuggcgcauggcgcucu

SEQ ID NO: 1424639 - RNA, 19 nt, Pseudomonas aeruginosa PA01
gccgccuggguggcgacga

SEQ ID NO: 1424640 - RNA, 19 nt, Pseudomonas aeruginosa PA01
gccgccuggucggggccgg

SEQ ID NO: 1424641 - RNA, 21 nt, Pseudomonas aeruginosa PA01
gccgccuggucggggccggcg

SEQ ID NO: 1424642 - RNA, 22 nt, Pseudomonas aeruginosa PA01
gccgccuggucggggccggcga

SEQ ID NO: 1424643 - RNA, 15 nt, Pseudomonas aeruginosa PA01
gccgccuggugcccg

SEQ ID NO: 1424644 - RNA, 18 nt, Pseudomonas aeruginosa PA01
gccgccuggugcccgaug

SEQ ID NO: 1424645 - RNA, 13 nt, Pseudomonas aeruginosa PA01
gccgccuuccucg

SEQ ID NO: 1424646 - RNA, 17 nt, Pseudomonas aeruginosa PA01
gccgccuuccucggccg

SEQ ID NO: 1424647 - RNA, 22 nt, Pseudomonas aeruginosa PA01
gccgccuuccucggccgccagg

SEQ ID NO: 1424648 - RNA, 15 nt, Pseudomonas aeruginosa PA01
gccgccugcucgccg

SEQ ID NO: 1424649 - RNA, 21 nt, Pseudomonas aeruginosa PA01
gccgccugcucgccgcugaag

SEQ ID NO: 1424650 - RNA, 15 nt, Pseudomonas aeruginosa PA01
gccgccugcucggcc

SEQ ID NO: 1424651 - RNA, 22 nt, Pseudomonas aeruginosa PA01
gccgccucuaugaaccggggcg

SEQ ID NO: 1424652 - RNA, 23 nt, Pseudomonas aeruginosa PA01
gccgccucuaugaaccggggcgg

SEQ ID NO: 1424653 - RNA, 13 nt, Pseudomonas aeruginosa PA01
gccgccugcaggg

SEQ ID NO: 1424654 - RNA, 14 nt, Pseudomonas aeruginosa PA01
gccgccggggauca

SEQ ID NO: 1424655 - RNA, 18 nt, Pseudomonas aeruginosa PA01
gccgccggggaucagcga

SEQ ID NO: 1424656 - RNA, 20 nt, Pseudomonas aeruginosa PA01
gccgccgggcuucgguguau

SEQ ID NO: 1424657 - RNA, 15 nt, Pseudomonas aeruginosa PA01
gccgccgggcgcccg

SEQ ID NO: 1424658 - RNA, 16 nt, Pseudomonas aeruginosa PA01
gccgccgggcgcccgg

SEQ ID NO: 1424659 - RNA, 19 nt, Pseudomonas aeruginosa PA01
gccgccgggcgcgcgccuc

SEQ ID NO: 1424660 - RNA, 17 nt, Pseudomonas aeruginosa PA01
gccgccgggcggcgucg

SEQ ID NO: 1424661 - RNA, 20 nt, Pseudomonas aeruginosa PA01
gccgccgggcggcgucgcgg

SEQ ID NO: 1424662 - RNA, 16 nt, Pseudomonas aeruginosa PA01
gccgccggggcgcagg

SEQ ID NO: 1424663 - RNA, 16 nt, Pseudomonas aeruginosa PA01
gccgccucgggcagcc

SEQ ID NO: 1424664 - RNA, 21 nt, Pseudomonas aeruginosa PA01
gccgccucgggcagccccuug

SEQ ID NO: 1424665 - RNA, 13 nt, Pseudomonas aeruginosa PA01
gccgcgccggccg

SEQ ID NO: 1424666 - RNA, 16 nt, Pseudomonas aeruginosa PA01
gccgcgccgcucaggc

SEQ ID NO: 1424667 - RNA, 22 nt, Pseudomonas aeruginosa PA01
gccgcgccgcucaggcgucccg

SEQ ID NO: 1424668 - RNA, 12 nt, Pseudomonas aeruginosa PA01
gccgcgccggcg

SEQ ID NO: 1424669 - RNA, 15 nt, Pseudomonas aeruginosa PA01
gccgcgccggcgauc

SEQ ID NO: 1424670 - RNA, 16 nt, Pseudomonas aeruginosa PA01
gccgcgccggcgaucg

SEQ ID NO: 1424671 - RNA, 17 nt, Pseudomonas aeruginosa PA01
gccgcgccggcgaucgc

SEQ ID NO: 1424672 - RNA, 12 nt, Pseudomonas aeruginosa PA01
gccgcgccggcu

SEQ ID NO: 1424673 - RNA, 18 nt, Pseudomonas aeruginosa PA01
gccgcgccugcugcgggu

SEQ ID NO: 1424674 - RNA, 17 nt, Pseudomonas aeruginosa PA01
gccgcgccuucagcgcc

SEQ ID NO: 1424675 - RNA, 18 nt, Pseudomonas aeruginosa PA01
gccgcgccuucagcgcca

SEQ ID NO: 1424676 - RNA, 20 nt, Pseudomonas aeruginosa PA01
gccgcgccuucagcgccagc

SEQ ID NO: 1424677 - RNA, 21 nt, Pseudomonas aeruginosa PA01
gccgcgccuucagcgccagca

SEQ ID NO: 1424678 - RNA, 22 nt, Pseudomonas aeruginosa PA01
gccgcgccuucagcgccagcag

SEQ ID NO: 1424679 - RNA, 14 nt, Pseudomonas aeruginosa PA01
gccgcgccuucgag

SEQ ID NO: 1424680 - RNA, 13 nt, Pseudomonas aeruginosa PA01
gccgcgcgauggc

SEQ ID NO: 1424681 - RNA, 16 nt, Pseudomonas aeruginosa PA01
gccgcgcgauggccgg

SEQ ID NO: 1424682 - RNA, 15 nt, Pseudomonas aeruginosa PA01
gccgcgccucgucgc

SEQ ID NO: 1424683 - RNA, 17 nt, Pseudomonas aeruginosa PA01
gccgcgccucgucgcgc

SEQ ID NO: 1424684 - RNA, 18 nt, Pseudomonas aeruginosa PA01
gccgcgccucgucgcgcc

SEQ ID NO: 1424685 - RNA, 23 nt, Pseudomonas aeruginosa PA01
gccgcgccucgucgcgccaggcg

SEQ ID NO: 1424686 - RNA, 13 nt, Pseudomonas aeruginosa PA01
gccgcgccggggc

SEQ ID NO: 1424687 - RNA, 12 nt, Pseudomonas aeruginosa PA01
gccgcgccgaug

SEQ ID NO: 1424688 - RNA, 14 nt, Pseudomonas aeruginosa PA01
gccgcgccgaugcc

SEQ ID NO: 1424689 - RNA, 10 nt, Pseudomonas aeruginosa PA01
gccgcgccgc

SEQ ID NO: 1424690 - RNA, 22 nt, Pseudomonas aeruginosa PA01
gccgcgccgcaagggcgucgcu

SEQ ID NO: 1424691 - RNA, 18 nt, Pseudomonas aeruginosa PA01
gccgcgccgagccggcug

SEQ ID NO: 1424692 - RNA, 19 nt, Pseudomonas aeruginosa PA01
gccgcgccgagccggcugc

SEQ ID NO: 1424693 - RNA, 21 nt, Pseudomonas aeruginosa PA01
gccgcgccgagccggcugccg

SEQ ID NO: 1424694 - RNA, 22 nt, Pseudomonas aeruginosa PA01
gccgcgccgagccggcugccga

SEQ ID NO: 1424695 - RNA, 12 nt, Pseudomonas aeruginosa PA01
gccgcgccgccc

SEQ ID NO: 1424696 - RNA, 13 nt, Pseudomonas aeruginosa PA01
gccgcgccgcccu

SEQ ID NO: 1424697 - RNA, 15 nt, Pseudomonas aeruginosa PA01
gccgcgccgcccugg

SEQ ID NO: 1424698 - RNA, 17 nt, Pseudomonas aeruginosa PA01
gccgcgccgccgagggc

SEQ ID NO: 1424699 - RNA, 20 nt, Pseudomonas aeruginosa PA01
gccgcgcccggcgccaggcu

SEQ ID NO: 1424700 - RNA, 21 nt, Pseudomonas aeruginosa PA01
gccgcgcccggcgccaggcug

SEQ ID NO: 1424701 - RNA, 14 nt, Pseudomonas aeruginosa PA01
gccgcgcccggcgc

SEQ ID NO: 1424702 - RNA, 16 nt, Pseudomonas aeruginosa PA01
gccgcgcccggccuuc

SEQ ID NO: 1424703 - RNA, 19 nt, Pseudomonas aeruginosa PA01
gccgcgcccggccuucacc

SEQ ID NO: 1424704 - RNA, 13 nt, Pseudomonas aeruginosa PA01
gccgcgcccggcc

SEQ ID NO: 1424705 - RNA, 14 nt, Pseudomonas aeruginosa PA01
gccgcgcccggcca

SEQ ID NO: 1424706 - RNA, 17 nt, Pseudomonas aeruginosa PA01
gccgcgcccggccaggc

SEQ ID NO: 1424707 - RNA, 12 nt, Pseudomonas aeruginosa PA01
gccgcgccgacc

SEQ ID NO: 1424708 - RNA, 14 nt, Pseudomonas aeruginosa PA01
gccgcgccgaccca

SEQ ID NO: 1424709 - RNA, 12 nt, Pseudomonas aeruginosa PA01
gccgcgccagca

SEQ ID NO: 1424710 - RNA, 13 nt, Pseudomonas aeruginosa PA01
gccgcgccagcag

SEQ ID NO: 1424711 - RNA, 14 nt, Pseudomonas aeruginosa PA01
gccgcgccagcagg

SEQ ID NO: 1424712 - RNA, 17 nt, Pseudomonas aeruginosa PA01
gccgcgccagcaggcgc

SEQ ID NO: 1424713 - RNA, 14 nt, Pseudomonas aeruginosa PA01
gccgcgccaggcgc

SEQ ID NO: 1424714 - RNA, 15 nt, Pseudomonas aeruginosa PA01
gccgcgccaggcgca

SEQ ID NO: 1424715 - RNA, 19 nt, Pseudomonas aeruginosa PA01
gccgcgccaggcgcaguag

SEQ ID NO: 1424716 - RNA, 22 nt, Pseudomonas aeruginosa PA01
gccgcgccaggcgcaguaggcc

SEQ ID NO: 1424717 - RNA, 20 nt, Pseudomonas aeruginosa PA01
gccgcgccaucggucgcgcc

SEQ ID NO: 1424718 - RNA, 22 nt, Pseudomonas aeruginosa PA01
gccgcgccaucggucgcgcccc

SEQ ID NO: 1424719 - RNA, 13 nt, Pseudomonas aeruginosa PA01
gccgcgccccacg

SEQ ID NO: 1424720 - RNA, 13 nt, Pseudomonas aeruginosa PA01
gccgcgccccagc

SEQ ID NO: 1424721 - RNA, 17 nt, Pseudomonas aeruginosa PA01
gccgcgccccagcggca

SEQ ID NO: 1424722 - RNA, 18 nt, Pseudomonas aeruginosa PA01
gccgcgccccagcggcag

SEQ ID NO: 1424723 - RNA, 20 nt, Pseudomonas aeruginosa PA01
gccgcgccccagcggcaggc

SEQ ID NO: 1424724 - RNA, 22 nt, Pseudomonas aeruginosa PA01
gccgcgccccagcggcaggcac

SEQ ID NO: 1424725 - RNA, 13 nt, Pseudomonas aeruginosa PA01
gccgcgcagcagu

SEQ ID NO: 1424726 - RNA, 21 nt, Pseudomonas aeruginosa PA01
gccgcgcagcaguaccuggcg

SEQ ID NO: 1424727 - RNA, 13 nt, Pseudomonas aeruginosa PA01
gccgcgcagcacc

SEQ ID NO: 1424728 - RNA, 20 nt, Pseudomonas aeruginosa PA01
gccgcgcagaucgcguccag

SEQ ID NO: 1424729 - RNA, 22 nt, Pseudomonas aeruginosa PA01
gccgcgcacuuguagaggauca

SEQ ID NO: 1424730 - RNA, 14 nt, Pseudomonas aeruginosa PA01
gccgcgcagcgcgg

SEQ ID NO: 1424731 - RNA, 17 nt, Pseudomonas aeruginosa PA01
gccgcgcaggcggucgg

SEQ ID NO: 1424732 - RNA, 21 nt, Pseudomonas aeruginosa PA01
gccgcgcagcuugccuuccag

SEQ ID NO: 1424733 - RNA, 22 nt, Pseudomonas aeruginosa PA01
gccgcgcagcuugccuuccagg

SEQ ID NO: 1424734 - RNA, 22 nt, Pseudomonas aeruginosa PA01
gccgcgcaggaagaaggcgucc

SEQ ID NO: 1424735 - RNA, 22 nt, Pseudomonas aeruginosa PA01
gccgcgcagguucaucgccgcc

SEQ ID NO: 1424736 - RNA, 23 nt, Pseudomonas aeruginosa PA01
gccgcgcagguucaucgccgcca

SEQ ID NO: 1424737 - RNA, 17 nt, Pseudomonas aeruginosa PA01
gccgcgcagucccgcgc

SEQ ID NO: 1424738 - RNA, 20 nt, Pseudomonas aeruginosa PA01
gccgcgcagucccgcgcggc

SEQ ID NO: 1424739 - RNA, 15 nt, Pseudomonas aeruginosa PA01
gccgcgcauccucgg

SEQ ID NO: 1424740 - RNA, 20 nt, Pseudomonas aeruginosa PA01
gccgcgcauccucggcaucc

SEQ ID NO: 1424741 - RNA, 21 nt, Pseudomonas aeruginosa PA01
gccgcgccacggggccccucg

SEQ ID NO: 1424742 - RNA, 20 nt, Pseudomonas aeruginosa PA01
gccgcgcaucaccccgcaac

SEQ ID NO: 1424743 - RNA, 13 nt, Pseudomonas aeruginosa PA01
gccgccgccgaca

SEQ ID NO: 1424744 - RNA, 14 nt, Pseudomonas aeruginosa PA01
gccgccgccgaccg

SEQ ID NO: 1424745 - RNA, 12 nt, Pseudomonas aeruginosa PA01
gccgccgccgcc

SEQ ID NO: 1424746 - RNA, 16 nt, Pseudomonas aeruginosa PA01
gccgccgcccagcagc

SEQ ID NO: 1424747 - RNA, 12 nt, Pseudomonas aeruginosa PA01
gccgccgaugcc

SEQ ID NO: 1424748 - RNA, 19 nt, Pseudomonas aeruginosa PA01
gccgccgauagggaaacac

SEQ ID NO: 1424749 - RNA, 19 nt, Pseudomonas aeruginosa PA01
gccgccgaucagcgcgccu

SEQ ID NO: 1424750 - RNA, 14 nt, Pseudomonas aeruginosa PA01
gccgccgaggagga

SEQ ID NO: 1424751 - RNA, 22 nt, Pseudomonas aeruginosa PA01
gccgccgaggauagcguccagc

SEQ ID NO: 1424752 - RNA, 12 nt, Pseudomonas aeruginosa PA01
gccgccgagcgc

SEQ ID NO: 1424753 - RNA, 14 nt, Pseudomonas aeruginosa PA01
gccgccgagcgccu

SEQ ID NO: 1424754 - RNA, 16 nt, Pseudomonas aeruginosa PA01
gccgccgagcgccugg

SEQ ID NO: 1424755 - RNA, 17 nt, Pseudomonas aeruginosa PA01
gccgccgagcgccuggc

SEQ ID NO: 1424756 - RNA, 18 nt, Pseudomonas aeruginosa PA01
gccgccgagcgccuggca

SEQ ID NO: 1424757 - RNA, 14 nt, Pseudomonas aeruginosa PA01
gccgccgagguugc

SEQ ID NO: 1424758 - RNA, 15 nt, Pseudomonas aeruginosa PA01
gccgccgagguugcg

SEQ ID NO: 1424759 - RNA, 19 nt, Pseudomonas aeruginosa PA01
gccgccgagguugcgcagg

SEQ ID NO: 1424760 - RNA, 18 nt, Pseudomonas aeruginosa PA01
gccgccgagugugccggc

SEQ ID NO: 1424761 - RNA, 13 nt, Pseudomonas aeruginosa PA01
gccgccgaggcgc

SEQ ID NO: 1424762 - RNA, 16 nt, Pseudomonas aeruginosa PA01
gccgccgaggcgcgcc

SEQ ID NO: 1424763 - RNA, 17 nt, Pseudomonas aeruginosa PA01
gccgccgaggcgcgcca

SEQ ID NO: 1424764 - RNA, 14 nt, Pseudomonas aeruginosa PA01
gccgccgagggcac

SEQ ID NO: 1424765 - RNA, 21 nt, Pseudomonas aeruginosa PA01
gccgccgagaacccggccagg

SEQ ID NO: 1424766 - RNA, 22 nt, Pseudomonas aeruginosa PA01
gccgccgagaacccggccaggc

SEQ ID NO: 1424767 - RNA, 14 nt, Pseudomonas aeruginosa PA01
gccgccgacgccgg

SEQ ID NO: 1424768 - RNA, 22 nt, Pseudomonas aeruginosa PA01
gccgccgacgucacggauaggc

SEQ ID NO: 1424769 - RNA, 16 nt, Pseudomonas aeruginosa PA01
gccgccgagcaacugc

SEQ ID NO: 1424770 - RNA, 13 nt, Pseudomonas aeruginosa PA01
gccgccgagcagg

SEQ ID NO: 1424771 - RNA, 17 nt, Pseudomonas aeruginosa PA01
gccgccgagcaggccca

SEQ ID NO: 1424772 - RNA, 13 nt, Pseudomonas aeruginosa PA01
gccgccgacaggu

SEQ ID NO: 1424773 - RNA, 17 nt, Pseudomonas aeruginosa PA01
gccgccgacaggucgcu

SEQ ID NO: 1424774 - RNA, 20 nt, Pseudomonas aeruginosa PA01
gccgccgaagaacucggcgc

SEQ ID NO: 1424775 - RNA, 20 nt, Pseudomonas aeruginosa PA01
gccgccgacacccgcgccgc

SEQ ID NO: 1424776 - RNA, 12 nt, Pseudomonas aeruginosa PA01
gccgccgaccgg

SEQ ID NO: 1424777 - RNA, 14 nt, Pseudomonas aeruginosa PA01
gccgccgaccgggc

SEQ ID NO: 1424778 - RNA, 16 nt, Pseudomonas aeruginosa PA01
gccgccgaccucggcc

SEQ ID NO: 1424779 - RNA, 17 nt, Pseudomonas aeruginosa PA01
gccgccgccgccccagc

SEQ ID NO: 1424780 - RNA, 14 nt, Pseudomonas aeruginosa PA01
gccgccgccgcgcc

SEQ ID NO: 1424781 - RNA, 16 nt, Pseudomonas aeruginosa PA01
gccgccgccgcgccgg

SEQ ID NO: 1424782 - RNA, 13 nt, Pseudomonas aeruginosa PA01
gccgccgccgcgg

SEQ ID NO: 1424783 - RNA, 14 nt, Pseudomonas aeruginosa PA01
gccgccgccgcggu

SEQ ID NO: 1424784 - RNA, 14 nt, Pseudomonas aeruginosa PA01
gccgccgccgucga

SEQ ID NO: 1424785 - RNA, 12 nt, Pseudomonas aeruginosa PA01
gccgccgccguc

SEQ ID NO: 1424786 - RNA, 14 nt, Pseudomonas aeruginosa PA01
gccgccgcgugccg

SEQ ID NO: 1424787 - RNA, 17 nt, Pseudomonas aeruginosa PA01
gccgccgcgucgucggc

SEQ ID NO: 1424788 - RNA, 22 nt, Pseudomonas aeruginosa PA01
gccgccgcgucgucggcgacgc

SEQ ID NO: 1424789 - RNA, 12 nt, Pseudomonas aeruginosa PA01
gccgccgcugca

SEQ ID NO: 1424790 - RNA, 15 nt, Pseudomonas aeruginosa PA01
gccgccgcggccagc

SEQ ID NO: 1424791 - RNA, 14 nt, Pseudomonas aeruginosa PA01
gccgccgcgggcaa

SEQ ID NO: 1424792 - RNA, 21 nt, Pseudomonas aeruginosa PA01
gccgccgcgggcaaccgcggc

SEQ ID NO: 1424793 - RNA, 14 nt, Pseudomonas aeruginosa PA01
gccgccgcgggcga

SEQ ID NO: 1424794 - RNA, 12 nt, Pseudomonas aeruginosa PA01
gccgccgcgguc

SEQ ID NO: 1424795 - RNA, 13 nt, Pseudomonas aeruginosa PA01
gccgccgcuggcg

SEQ ID NO: 1424796 - RNA, 17 nt, Pseudomonas aeruginosa PA01
gccgccggcgaccgcgc

SEQ ID NO: 1424797 - RNA, 13 nt, Pseudomonas aeruginosa PA01
gccgccggcgacg

SEQ ID NO: 1424798 - RNA, 16 nt, Pseudomonas aeruginosa PA01
gccgccggcgcccugc

SEQ ID NO: 1424799 - RNA, 18 nt, Pseudomonas aeruginosa PA01
gccgccggcgcccugcuc

SEQ ID NO: 1424800 - RNA, 22 nt, Pseudomonas aeruginosa PA01
gccgccgggcaucaugccgagc

SEQ ID NO: 1424801 - RNA, 13 nt, Pseudomonas aeruginosa PA01
gccgcagcgcaag

SEQ ID NO: 1424802 - RNA, 16 nt, Pseudomonas aeruginosa PA01
gccgcagcgcagccga

SEQ ID NO: 1424803 - RNA, 13 nt, Pseudomonas aeruginosa PA01
gccgccagccgcc

SEQ ID NO: 1424804 - RNA, 16 nt, Pseudomonas aeruginosa PA01
gccgccagccgccagg

SEQ ID NO: 1424805 - RNA, 13 nt, Pseudomonas aeruginosa PA01
gccgccagcgcgg

SEQ ID NO: 1424806 - RNA, 14 nt, Pseudomonas aeruginosa PA01
gccgccagcgcggc

SEQ ID NO: 1424807 - RNA, 17 nt, Pseudomonas aeruginosa PA01
gccgccagcgcggcgcu

SEQ ID NO: 1424808 - RNA, 21 nt, Pseudomonas aeruginosa PA01
gccgcagcagguucgaaugcu

SEQ ID NO: 1424809 - RNA, 19 nt, Pseudomonas aeruginosa PA01
gccgcagcccuaggcgacc

SEQ ID NO: 1424810 - RNA, 21 nt, Pseudomonas aeruginosa PA01
gccgcagcccuaggcgacccg

SEQ ID NO: 1424811 - RNA, 14 nt, Pseudomonas aeruginosa PA01
gccgccaggcagac

SEQ ID NO: 1424812 - RNA, 16 nt, Pseudomonas aeruginosa PA01
gccgccaggcagacca

SEQ ID NO: 1424813 - RNA, 22 nt, Pseudomonas aeruginosa PA01
gccgccaggcagaccugcagca

SEQ ID NO: 1424814 - RNA, 14 nt, Pseudomonas aeruginosa PA01
gccgccaggacggc

SEQ ID NO: 1424815 - RNA, 17 nt, Pseudomonas aeruginosa PA01
gccgccaggacggcagg

SEQ ID NO: 1424816 - RNA, 24 nt, Pseudomonas aeruginosa PA01
gccgccagcuaccggcagggucac

SEQ ID NO: 1424817 - RNA, 12 nt, Pseudomonas aeruginosa PA01
gccgccagcuca

SEQ ID NO: 1424818 - RNA, 19 nt, Pseudomonas aeruginosa PA01
gccgccaucgccucgccgg

SEQ ID NO: 1424819 - RNA, 21 nt, Pseudomonas aeruginosa PA01
gccgccaucgccucgccggcc

SEQ ID NO: 1424820 - RNA, 23 nt, Pseudomonas aeruginosa PA01
gccgccaucgccucgccggccag

SEQ ID NO: 1424821 - RNA, 15 nt, Pseudomonas aeruginosa PA01
gccgccaucgcccgg

SEQ ID NO: 1424822 - RNA, 18 nt, Pseudomonas aeruginosa PA01
gccgccaucgcccgguug

SEQ ID NO: 1424823 - RNA, 16 nt, Pseudomonas aeruginosa PA01
gccgccaucgaccagg

SEQ ID NO: 1424824 - RNA, 13 nt, Pseudomonas aeruginosa PA01
gccgcccagcgga

SEQ ID NO: 1424825 - RNA, 19 nt, Pseudomonas aeruginosa PA01
gccgcccagcggaugcgcg

SEQ ID NO: 1424826 - RNA, 14 nt, Pseudomonas aeruginosa PA01
gccgcccggccgcu

SEQ ID NO: 1424827 - RNA, 17 nt, Pseudomonas aeruginosa PA01
gccgcccggccgcugga

SEQ ID NO: 1424828 - RNA, 20 nt, Pseudomonas aeruginosa PA01
gccgcccggccgcuggaugc

SEQ ID NO: 1424829 - RNA, 11 nt, Pseudomonas aeruginosa PA01
gccgcccggca

SEQ ID NO: 1424830 - RNA, 13 nt, Pseudomonas aeruginosa PA01
gccgcccggcagc

SEQ ID NO: 1424831 - RNA, 17 nt, Pseudomonas aeruginosa PA01
gccgcccggcagcggcu

SEQ ID NO: 1424832 - RNA, 24 nt, Pseudomonas aeruginosa PA01
gccgcccggcagcggcuggccguc

SEQ ID NO: 1424833 - RNA, 13 nt, Pseudomonas aeruginosa PA01
gccgcccggccag

SEQ ID NO: 1424834 - RNA, 14 nt, Pseudomonas aeruginosa PA01
gccgcccggccagg

SEQ ID NO: 1424835 - RNA, 15 nt, Pseudomonas aeruginosa PA01
gccgcccggccaggc

SEQ ID NO: 1424836 - RNA, 22 nt, Pseudomonas aeruginosa PA01
gccgcccaccgcgggggucgga

SEQ ID NO: 1424837 - RNA, 12 nt, Pseudomonas aeruginosa PA01
gccgcccagcag

SEQ ID NO: 1424838 - RNA, 14 nt, Pseudomonas aeruginosa PA01
gccgcccagcagca

SEQ ID NO: 1424839 - RNA, 13 nt, Pseudomonas aeruginosa PA01
gccgcccagcgca

SEQ ID NO: 1424840 - RNA, 14 nt, Pseudomonas aeruginosa PA01
gccgcccagcgcag

SEQ ID NO: 1424841 - RNA, 19 nt, Pseudomonas aeruginosa PA01
gccgcccagcgcagccugc

SEQ ID NO: 1424842 - RNA, 20 nt, Pseudomonas aeruginosa PA01
gccgcccagcgcagccugcu

SEQ ID NO: 1424843 - RNA, 20 nt, Pseudomonas aeruginosa PA01
gccgcccgucgcgccggcca

SEQ ID NO: 1424844 - RNA, 13 nt, Pseudomonas aeruginosa PA01
gccgcccuuuucc

SEQ ID NO: 1424845 - RNA, 19 nt, Pseudomonas aeruginosa PA01
gccgccgaaaugcugcagg

SEQ ID NO: 1424846 - RNA, 23 nt, Pseudomonas aeruginosa PA01
gccgccgaaaugcugcaggccga

SEQ ID NO: 1424847 - RNA, 15 nt, Pseudomonas aeruginosa PA01
gccgccgaacacgca

SEQ ID NO: 1424848 - RNA, 18 nt, Pseudomonas aeruginosa PA01
gccgcccggucuagcgcc

SEQ ID NO: 1424849 - RNA, 17 nt, Pseudomonas aeruginosa PA01
gccgcccgguucguaga

SEQ ID NO: 1424850 - RNA, 18 nt, Pseudomonas aeruginosa PA01
gccgcccggcucgccgcc

SEQ ID NO: 1424851 - RNA, 20 nt, Pseudomonas aeruginosa PA01
gccgcccggcucgccgccgg

SEQ ID NO: 1424852 - RNA, 16 nt, Pseudomonas aeruginosa PA01
gccgccgaagggccgc

SEQ ID NO: 1424853 - RNA, 16 nt, Pseudomonas aeruginosa PA01
gccgccgaagccgacg

SEQ ID NO: 1424854 - RNA, 19 nt, Pseudomonas aeruginosa PA01
gccgccgaagcccuuggag

SEQ ID NO: 1424855 - RNA, 14 nt, Pseudomonas aeruginosa PA01
gccgcuggaugccg

SEQ ID NO: 1424856 - RNA, 23 nt, Pseudomonas aeruginosa PA01
gccgcuggcauacacaugcaggc

SEQ ID NO: 1424857 - RNA, 12 nt, Pseudomonas aeruginosa PA01
gccgcuggccga

SEQ ID NO: 1424858 - RNA, 14 nt, Pseudomonas aeruginosa PA01
gccgcuggccgacc

SEQ ID NO: 1424859 - RNA, 14 nt, Pseudomonas aeruginosa PA01
gccgcuggccuggc

SEQ ID NO: 1424860 - RNA, 15 nt, Pseudomonas aeruginosa PA01
gccgcuggccuggcc

SEQ ID NO: 1424861 - RNA, 16 nt, Pseudomonas aeruginosa PA01
gccgcuggccuggcca

SEQ ID NO: 1424862 - RNA, 17 nt, Pseudomonas aeruginosa PA01
gccgcuggccuggccac

SEQ ID NO: 1424863 - RNA, 22 nt, Pseudomonas aeruginosa PA01
gccgcuggccuggccacccuug

SEQ ID NO: 1424864 - RNA, 15 nt, Pseudomonas aeruginosa PA01
gccgcuggcgacgcu

SEQ ID NO: 1424865 - RNA, 20 nt, Pseudomonas aeruginosa PA01
gccgcuggcggccuucggcg

SEQ ID NO: 1424866 - RNA, 13 nt, Pseudomonas aeruginosa PA01
gccgcuggcggcg

SEQ ID NO: 1424867 - RNA, 17 nt, Pseudomonas aeruginosa PA01
gccgcuggcggcgacga

SEQ ID NO: 1424868 - RNA, 15 nt, Pseudomonas aeruginosa PA01
gccgcuggcggcgcu

SEQ ID NO: 1424869 - RNA, 21 nt, Pseudomonas aeruginosa PA01
gccgcugguagcuaccgucgg

SEQ ID NO: 1424870 - RNA, 18 nt, Pseudomonas aeruginosa PA01
gccgcuggugaucgacca

SEQ ID NO: 1424871 - RNA, 21 nt, Pseudomonas aeruginosa PA01
gccgcugguccagcuggcgca

SEQ ID NO: 1424872 - RNA, 21 nt, Pseudomonas aeruginosa PA01
gccgcuggggaccgcaccugg

SEQ ID NO: 1424873 - RNA, 22 nt, Pseudomonas aeruginosa PA01
gccgcuggggaccgcaccuggu

SEQ ID NO: 1424874 - RNA, 13 nt, Pseudomonas aeruginosa PA01
gccgcuggcgugg

SEQ ID NO: 1424875 - RNA, 19 nt, Pseudomonas aeruginosa PA01
gccgcuggcguuguugccg

SEQ ID NO: 1424876 - RNA, 23 nt, Pseudomonas aeruginosa PA01
gccgcuggcguuguugccgccga

SEQ ID NO: 1424877 - RNA, 16 nt, Pseudomonas aeruginosa PA01
gccgcuggcgcugacc

SEQ ID NO: 1424878 - RNA, 13 nt, Pseudomonas aeruginosa PA01
gccgcuggcggca

SEQ ID NO: 1424879 - RNA, 21 nt, Pseudomonas aeruginosa PA01
gccgcugugcagggucagucg

SEQ ID NO: 1424880 - RNA, 18 nt, Pseudomonas aeruginosa PA01
gccgcugucuaucugcgc

SEQ ID NO: 1424881 - RNA, 23 nt, Pseudomonas aeruginosa PA01
gccgcugucuaucugcgccgaag

SEQ ID NO: 1424882 - RNA, 18 nt, Pseudomonas aeruginosa PA01
gccgcuucuucccgccca

SEQ ID NO: 1424883 - RNA, 15 nt, Pseudomonas aeruginosa PA01
gccgcuugaagcggc

SEQ ID NO: 1424884 - RNA, 17 nt, Pseudomonas aeruginosa PA01
gccgcuugaagcggcca

SEQ ID NO: 1424885 - RNA, 17 nt, Pseudomonas aeruginosa PA01
gccgcugucguccagcg

SEQ ID NO: 1424886 - RNA, 21 nt, Pseudomonas aeruginosa PA01
gccgcugucgucuucggccag

SEQ ID NO: 1424887 - RNA, 14 nt, Pseudomonas aeruginosa PA01
gccgcuguacaagc

SEQ ID NO: 1424888 - RNA, 17 nt, Pseudomonas aeruginosa PA01
gccgcuguaggacaggu

SEQ ID NO: 1424889 - RNA, 18 nt, Pseudomonas aeruginosa PA01
gccgcuugaucuuguccu

SEQ ID NO: 1424890 - RNA, 16 nt, Pseudomonas aeruginosa PA01
gccgcuuggagcgggc

SEQ ID NO: 1424891 - RNA, 17 nt, Pseudomonas aeruginosa PA01
gccgcuuggccauggcg

SEQ ID NO: 1424892 - RNA, 18 nt, Pseudomonas aeruginosa PA01
gccgcuuggccauggcgc

SEQ ID NO: 1424893 - RNA, 13 nt, Pseudomonas aeruginosa PA01
gccggacaggcca

SEQ ID NO: 1424894 - RNA, 14 nt, Pseudomonas aeruginosa PA01
gccggacaggccac

SEQ ID NO: 1424895 - RNA, 14 nt, Pseudomonas aeruginosa PA01
gccggaccaacugc

SEQ ID NO: 1424896 - RNA, 19 nt, Pseudomonas aeruginosa PA01
gccggaccaacugcgaacc

SEQ ID NO: 1424897 - RNA, 15 nt, Pseudomonas aeruginosa PA01
gccggaccagccggu

SEQ ID NO: 1424898 - RNA, 15 nt, Pseudomonas aeruginosa PA01
gccggaccgucgcga

SEQ ID NO: 1424899 - RNA, 22 nt, Pseudomonas aeruginosa PA01
gccggaccucucucgcugcgcg

SEQ ID NO: 1424900 - RNA, 23 nt, Pseudomonas aeruginosa PA01
gccggaccucucucgcugcgcgg

SEQ ID NO: 1424901 - RNA, 15 nt, Pseudomonas aeruginosa PA01
gccggacgcaccagc

SEQ ID NO: 1424902 - RNA, 17 nt, Pseudomonas aeruginosa PA01
gccggacgcaccagcag

SEQ ID NO: 1424903 - RNA, 22 nt, Pseudomonas aeruginosa PA01
gccggacgcaccagcaggccga

SEQ ID NO: 1424904 - RNA, 16 nt, Pseudomonas aeruginosa PA01
gccggacggcggcguc

SEQ ID NO: 1424905 - RNA, 16 nt, Pseudomonas aeruginosa PA01
gccggacgcgacugcu

SEQ ID NO: 1424906 - RNA, 16 nt, Pseudomonas aeruginosa PA01
gccggaggggcggccg

SEQ ID NO: 1424907 - RNA, 17 nt, Pseudomonas aeruginosa PA01
gccggaggggcggccgc

SEQ ID NO: 1424908 - RNA, 19 nt, Pseudomonas aeruginosa PA01
gccggaggggcggccgccg

SEQ ID NO: 1424909 - RNA, 19 nt, Pseudomonas aeruginosa PA01
gccggaggggaugugcuca

SEQ ID NO: 1424910 - RNA, 23 nt, Pseudomonas aeruginosa PA01
gccggaggggaugugcucagcga

SEQ ID NO: 1424911 - RNA, 15 nt, Pseudomonas aeruginosa PA01
gccggaggcagcgau

SEQ ID NO: 1424912 - RNA, 16 nt, Pseudomonas aeruginosa PA01
gccggaggcagcgaug

SEQ ID NO: 1424913 - RNA, 14 nt, Pseudomonas aeruginosa PA01
gccggagcugguca

SEQ ID NO: 1424914 - RNA, 22 nt, Pseudomonas aeruginosa PA01
gccggacuuggagaagaucgcc

SEQ ID NO: 1424915 - RNA, 15 nt, Pseudomonas aeruginosa PA01
gccggagaacgccgc

SEQ ID NO: 1424916 - RNA, 17 nt, Pseudomonas aeruginosa PA01
gccggagaacgccgcca

SEQ ID NO: 1424917 - RNA, 23 nt, Pseudomonas aeruginosa PA01
gccggagaacgccgccacgccga

SEQ ID NO: 1424918 - RNA, 24 nt, Pseudomonas aeruginosa PA01
gccggagaacgccgccacgccgau

SEQ ID NO: 1424919 - RNA, 19 nt, Pseudomonas aeruginosa PA01
gccggacguuuccagcggc

SEQ ID NO: 1424920 - RNA, 13 nt, Pseudomonas aeruginosa PA01
gccggcaucgcca

SEQ ID NO: 1424921 - RNA, 17 nt, Pseudomonas aeruginosa PA01
gccggcauccagcaucc

SEQ ID NO: 1424922 - RNA, 16 nt, Pseudomonas aeruginosa PA01
gccggcagcgaccacc

SEQ ID NO: 1424923 - RNA, 17 nt, Pseudomonas aeruginosa PA01
gccggcagcgaccacca

SEQ ID NO: 1424924 - RNA, 20 nt, Pseudomonas aeruginosa PA01
gccggcagcgaccaccacca

SEQ ID NO: 1424925 - RNA, 22 nt, Pseudomonas aeruginosa PA01
gccggcagcgaccaccaccagg

SEQ ID NO: 1424926 - RNA, 14 nt, Pseudomonas aeruginosa PA01
gccggcagcgagcg

SEQ ID NO: 1424927 - RNA, 22 nt, Pseudomonas aeruginosa PA01
gccggcagcgagcgggucagca

SEQ ID NO: 1424928 - RNA, 14 nt, Pseudomonas aeruginosa PA01
gccggcagcgccgc

SEQ ID NO: 1424929 - RNA, 20 nt, Pseudomonas aeruginosa PA01
gccggcauggaucaacuggu

SEQ ID NO: 1424930 - RNA, 22 nt, Pseudomonas aeruginosa PA01
gccggcauugcccaauacggcg

SEQ ID NO: 1424931 - RNA, 18 nt, Pseudomonas aeruginosa PA01
gccggcauuggcacccug

SEQ ID NO: 1424932 - RNA, 19 nt, Pseudomonas aeruginosa PA01
gccggcauuggcacccugg

SEQ ID NO: 1424933 - RNA, 20 nt, Pseudomonas aeruginosa PA01
gccggcauuggcacccugga

SEQ ID NO: 1424934 - RNA, 23 nt, Pseudomonas aeruginosa PA01
gccggcaugcucagccgcgccgg

SEQ ID NO: 1424935 - RNA, 16 nt, Pseudomonas aeruginosa PA01
gccggcaucguggcca

SEQ ID NO: 1424936 - RNA, 12 nt, Pseudomonas aeruginosa PA01
gccggcccagca

SEQ ID NO: 1424937 - RNA, 13 nt, Pseudomonas aeruginosa PA01
gccggcccagcag

SEQ ID NO: 1424938 - RNA, 18 nt, Pseudomonas aeruginosa PA01
gccggcccagcaggccgg

SEQ ID NO: 1424939 - RNA, 19 nt, Pseudomonas aeruginosa PA01
gccggcccagcaggccggc

SEQ ID NO: 1424940 - RNA, 21 nt, Pseudomonas aeruginosa PA01
gccggcccagcaggccggcca

SEQ ID NO: 1424941 - RNA, 18 nt, Pseudomonas aeruginosa PA01
gccggccauucgcugucg

SEQ ID NO: 1424942 - RNA, 20 nt, Pseudomonas aeruginosa PA01
gccggccauucgcugucgag

SEQ ID NO: 1424943 - RNA, 19 nt, Pseudomonas aeruginosa PA01
gccggccauugccgccaga

SEQ ID NO: 1424944 - RNA, 14 nt, Pseudomonas aeruginosa PA01
gccggccagccagg

SEQ ID NO: 1424945 - RNA, 15 nt, Pseudomonas aeruginosa PA01
gccggccagccaggc

SEQ ID NO: 1424946 - RNA, 19 nt, Pseudomonas aeruginosa PA01
gccggccagccuucccggc

SEQ ID NO: 1424947 - RNA, 22 nt, Pseudomonas aeruginosa PA01
gccggccagccuucccggcgcu

SEQ ID NO: 1424948 - RNA, 18 nt, Pseudomonas aeruginosa PA01
gccggccagccgcgccag

SEQ ID NO: 1424949 - RNA, 23 nt, Pseudomonas aeruginosa PA01
gccggccagccgcgccagugccu

SEQ ID NO: 1424950 - RNA, 14 nt, Pseudomonas aeruginosa PA01
gccggaucggccuu

SEQ ID NO: 1424951 - RNA, 17 nt, Pseudomonas aeruginosa PA01
gccggaucggcugaccg

SEQ ID NO: 1424952 - RNA, 15 nt, Pseudomonas aeruginosa PA01
gccggagucguagcg

SEQ ID NO: 1424953 - RNA, 13 nt, Pseudomonas aeruginosa PA01
gccggcacccuga

SEQ ID NO: 1424954 - RNA, 21 nt, Pseudomonas aeruginosa PA01
gccggcacccugaccgcgagc

SEQ ID NO: 1424955 - RNA, 22 nt, Pseudomonas aeruginosa PA01
gccggcacccugaccgcgagcg

SEQ ID NO: 1424956 - RNA, 23 nt, Pseudomonas aeruginosa PA01
gccggcacuguuccucagccccu

SEQ ID NO: 1424957 - RNA, 16 nt, Pseudomonas aeruginosa PA01
gccggcagcagcgcca

SEQ ID NO: 1424958 - RNA, 17 nt, Pseudomonas aeruginosa PA01
gccggcagcagcgccag

SEQ ID NO: 1424959 - RNA, 21 nt, Pseudomonas aeruginosa PA01
gccggcagcagcgccaggaag

SEQ ID NO: 1424960 - RNA, 21 nt, Pseudomonas aeruginosa PA01
gccggcaagcgugccccgacu

SEQ ID NO: 1424961 - RNA, 17 nt, Pseudomonas aeruginosa PA01
gccgcucguuggcggcc

SEQ ID NO: 1424962 - RNA, 16 nt, Pseudomonas aeruginosa PA01
gccgcugaugcgcugg

SEQ ID NO: 1424963 - RNA, 18 nt, Pseudomonas aeruginosa PA01
gccgcugcacgccuuccg

SEQ ID NO: 1424964 - RNA, 20 nt, Pseudomonas aeruginosa PA01
gccgcugcauggggaugguc

SEQ ID NO: 1424965 - RNA, 19 nt, Pseudomonas aeruginosa PA01
gccgcugcagggcggcgcu

SEQ ID NO: 1424966 - RNA, 14 nt, Pseudomonas aeruginosa PA01
gccgcugcaggcca

SEQ ID NO: 1424967 - RNA, 21 nt, Pseudomonas aeruginosa PA01
gccgcugccgccgcgcaggcg

SEQ ID NO: 1424968 - RNA, 16 nt, Pseudomonas aeruginosa PA01
gccgcuggacgaaccg

SEQ ID NO: 1424969 - RNA, 20 nt, Pseudomonas aeruginosa PA01
gccgcuggacgaaccgauca

SEQ ID NO: 1424970 - RNA, 13 nt, Pseudomonas aeruginosa PA01
gccgcugccgggc

SEQ ID NO: 1424971 - RNA, 14 nt, Pseudomonas aeruginosa PA01
gccgcuggaaccgg

SEQ ID NO: 1424972 - RNA, 17 nt, Pseudomonas aeruginosa PA01
gccgcuggaaccggccg

SEQ ID NO: 1424973 - RNA, 22 nt, Pseudomonas aeruginosa PA01
gccgcuggaaccggccggcagg

SEQ ID NO: 1424974 - RNA, 20 nt, Pseudomonas aeruginosa PA01
gccgcucggcguagccggcg

SEQ ID NO: 1424975 - RNA, 12 nt, Pseudomonas aeruginosa PA01
gccgcucggcgg

SEQ ID NO: 1424976 - RNA, 12 nt, Pseudomonas aeruginosa PA01
gccgcucggcgu

SEQ ID NO: 1424977 - RNA, 16 nt, Pseudomonas aeruginosa PA01
gccgcucguccaguuc

SEQ ID NO: 1424978 - RNA, 23 nt, Pseudomonas aeruginosa PA01
gccgcucguccaguuccaggguc

SEQ ID NO: 1424979 - RNA, 15 nt, Pseudomonas aeruginosa PA01
gccgcucgcgcggca

SEQ ID NO: 1424980 - RNA, 17 nt, Pseudomonas aeruginosa PA01
gccgcucgcguccgcag

SEQ ID NO: 1424981 - RNA, 15 nt, Pseudomonas aeruginosa PA01
gccgcucggccgcca

SEQ ID NO: 1424982 - RNA, 12 nt, Pseudomonas aeruginosa PA01
gccgcucggcga

SEQ ID NO: 1424983 - RNA, 14 nt, Pseudomonas aeruginosa PA01
gccgcucggcgagc

SEQ ID NO: 1424984 - RNA, 19 nt, Pseudomonas aeruginosa PA01
gccgcucggcgagccgccg

SEQ ID NO: 1424985 - RNA, 21 nt, Pseudomonas aeruginosa PA01
gccgcuaucgcuggcgcagcc

SEQ ID NO: 1424986 - RNA, 13 nt, Pseudomonas aeruginosa PA01
gccgcucaggcgu

SEQ ID NO: 1424987 - RNA, 15 nt, Pseudomonas aeruginosa PA01
gccgcucaggcgucc

SEQ ID NO: 1424988 - RNA, 17 nt, Pseudomonas aeruginosa PA01
gccgcucaggcgucccg

SEQ ID NO: 1424989 - RNA, 18 nt, Pseudomonas aeruginosa PA01
gccgcucaggcugugcag

SEQ ID NO: 1424990 - RNA, 13 nt, Pseudomonas aeruginosa PA01
gccgcucaccgcc

SEQ ID NO: 1424991 - RNA, 14 nt, Pseudomonas aeruginosa PA01
gccgcucaccgcca

SEQ ID NO: 1424992 - RNA, 16 nt, Pseudomonas aeruginosa PA01
gccgcuagggcgcccu

SEQ ID NO: 1424993 - RNA, 19 nt, Pseudomonas aeruginosa PA01
gccgcguucagucccgcgg

SEQ ID NO: 1424994 - RNA, 14 nt, Pseudomonas aeruginosa PA01
gccgcguucgccga

SEQ ID NO: 1424995 - RNA, 15 nt, Pseudomonas aeruginosa PA01
gccgcguucgccgag

SEQ ID NO: 1424996 - RNA, 16 nt, Pseudomonas aeruginosa PA01
gccgcguucgccgagc

SEQ ID NO: 1424997 - RNA, 17 nt, Pseudomonas aeruginosa PA01
gccgcguucgccgagcu

SEQ ID NO: 1424998 - RNA, 17 nt, Pseudomonas aeruginosa PA01
gccgcguucgccgaggc

SEQ ID NO: 1424999 - RNA, 20 nt, Pseudomonas aeruginosa PA01
gccgcuaugggcaccgcgcc

SEQ ID NO: 1425000 - RNA, 21 nt, Pseudomonas aeruginosa PA01
gccgcuaugggcaccgcgccg

SEQ ID NO: 1425001 - RNA, 13 nt, Pseudomonas aeruginosa PA01
gccgcuaucgccg

SEQ ID NO: 1425002 - RNA, 14 nt, Pseudomonas aeruginosa PA01
gccgcuaucgccgc

SEQ ID NO: 1425003 - RNA, 18 nt, Pseudomonas aeruginosa PA01
gccgcuaucgccgccgca

SEQ ID NO: 1425004 - RNA, 22 nt, Pseudomonas aeruginosa PA01
gccgcuaucgccgccgcagccg

SEQ ID NO: 1425005 - RNA, 18 nt, Pseudomonas aeruginosa PA01
gccgcgugggcuucgccg

SEQ ID NO: 1425006 - RNA, 20 nt, Pseudomonas aeruginosa PA01
gccgcgugggcuucgccgcc

SEQ ID NO: 1425007 - RNA, 16 nt, Pseudomonas aeruginosa PA01
gccgcgugccgccgga

SEQ ID NO: 1425008 - RNA, 14 nt, Pseudomonas aeruginosa PA01
gccgcgugcgcgcc

SEQ ID NO: 1425009 - RNA, 17 nt, Pseudomonas aeruginosa PA01
gccgcgugcgcgcccuc

SEQ ID NO: 1425010 - RNA, 17 nt, Pseudomonas aeruginosa PA01
gccgcgugcgcgccgcc

SEQ ID NO: 1425011 - RNA, 18 nt, Pseudomonas aeruginosa PA01
gccgcgugcgcgccgccg

SEQ ID NO: 1425012 - RNA, 19 nt, Pseudomonas aeruginosa PA01
gccgcgugcgcgccgccgg

SEQ ID NO: 1425013 - RNA, 15 nt, Pseudomonas aeruginosa PA01
gccgcguaagcggcc

SEQ ID NO: 1425014 - RNA, 17 nt, Pseudomonas aeruginosa PA01
gccgcguagcgccaggc

SEQ ID NO: 1425015 - RNA, 13 nt, Pseudomonas aeruginosa PA01
gccgcgucgccgc

SEQ ID NO: 1425016 - RNA, 14 nt, Pseudomonas aeruginosa PA01
gccgcgucgccgcc

SEQ ID NO: 1425017 - RNA, 15 nt, Pseudomonas aeruginosa PA01
gccgcgucgccgcca

SEQ ID NO: 1425018 - RNA, 17 nt, Pseudomonas aeruginosa PA01
gccgcgucgccgccagc

SEQ ID NO: 1425019 - RNA, 18 nt, Pseudomonas aeruginosa PA01
gccgcgucgccgccagcg

SEQ ID NO: 1425020 - RNA, 15 nt, Pseudomonas aeruginosa PA01
gccgcgugcccgaga

SEQ ID NO: 1425021 - RNA, 15 nt, Pseudomonas aeruginosa PA01
gccgcgucgucggcg

SEQ ID NO: 1425022 - RNA, 23 nt, Pseudomonas aeruginosa PA01
gccgcggccagcccccucgcccu

SEQ ID NO: 1425023 - RNA, 14 nt, Pseudomonas aeruginosa PA01
gccgcggcccugcg

SEQ ID NO: 1425024 - RNA, 23 nt, Pseudomonas aeruginosa PA01
gccgcggccgaaaucgaugucgc

SEQ ID NO: 1425025 - RNA, 15 nt, Pseudomonas aeruginosa PA01
gccgcggcccggcgc

SEQ ID NO: 1425026 - RNA, 15 nt, Pseudomonas aeruginosa PA01
gccgcgggacgccgc

SEQ ID NO: 1425027 - RNA, 16 nt, Pseudomonas aeruginosa PA01
gccgcgggacgccgca

SEQ ID NO: 1425028 - RNA, 15 nt, Pseudomonas aeruginosa PA01
gccgcgggaggccgc

SEQ ID NO: 1425029 - RNA, 18 nt, Pseudomonas aeruginosa PA01
gccgcgggaggccgccuc

SEQ ID NO: 1425030 - RNA, 19 nt, Pseudomonas aeruginosa PA01
gccgcgggaggccgccucg

SEQ ID NO: 1425031 - RNA, 18 nt, Pseudomonas aeruginosa PA01
gccgcgggcaaccgcggc

SEQ ID NO: 1425032 - RNA, 20 nt, Pseudomonas aeruginosa PA01
gccgcgggcaaccgcggcgg

SEQ ID NO: 1425033 - RNA, 15 nt, Pseudomonas aeruginosa PA01
gccgcggccggggaa

SEQ ID NO: 1425034 - RNA, 19 nt, Pseudomonas aeruginosa PA01
gccgcggccggggaacagg

SEQ ID NO: 1425035 - RNA, 20 nt, Pseudomonas aeruginosa PA01
gccgcggccggggaacaggu

SEQ ID NO: 1425036 - RNA, 13 nt, Pseudomonas aeruginosa PA01
gccgcggccggcg

SEQ ID NO: 1425037 - RNA, 14 nt, Pseudomonas aeruginosa PA01
gccgcggccggcga

SEQ ID NO: 1425038 - RNA, 15 nt, Pseudomonas aeruginosa PA01
gccgcggccggcgac

SEQ ID NO: 1425039 - RNA, 16 nt, Pseudomonas aeruginosa PA01
gccgcggugucggcga

SEQ ID NO: 1425040 - RNA, 18 nt, Pseudomonas aeruginosa PA01
gccgcgguuuccgugcgg

SEQ ID NO: 1425041 - RNA, 14 nt, Pseudomonas aeruginosa PA01
gccgcgggucacca

SEQ ID NO: 1425042 - RNA, 16 nt, Pseudomonas aeruginosa PA01
gccgcgggucaccagc

SEQ ID NO: 1425043 - RNA, 18 nt, Pseudomonas aeruginosa PA01
gccgcgggucaccagcgc

SEQ ID NO: 1425044 - RNA, 19 nt, Pseudomonas aeruginosa PA01
gccgcgggucaccagcgcc

SEQ ID NO: 1425045 - RNA, 20 nt, Pseudomonas aeruginosa PA01
gccgcgggucaccagcgccg

SEQ ID NO: 1425046 - RNA, 17 nt, Pseudomonas aeruginosa PA01
gccgcggggaggaagcu

SEQ ID NO: 1425047 - RNA, 12 nt, Pseudomonas aeruginosa PA01
gccgcgggcgcu

SEQ ID NO: 1425048 - RNA, 15 nt, Pseudomonas aeruginosa PA01
gccgcgggcguugcg

SEQ ID NO: 1425049 - RNA, 22 nt, Pseudomonas aeruginosa PA01
gccgcgggcuauucccgccgcu

SEQ ID NO: 1425050 - RNA, 19 nt, Pseudomonas aeruginosa PA01
gccgcgggccagccguucg

SEQ ID NO: 1425051 - RNA, 13 nt, Pseudomonas aeruginosa PA01
gccgcggcaccgg

SEQ ID NO: 1425052 - RNA, 22 nt, Pseudomonas aeruginosa PA01
gccgcggcagaucccaucgccc

SEQ ID NO: 1425053 - RNA, 14 nt, Pseudomonas aeruginosa PA01
gccgcgcuugccgu

SEQ ID NO: 1425054 - RNA, 16 nt, Pseudomonas aeruginosa PA01
gccgcgcuugccgucg

SEQ ID NO: 1425055 - RNA, 18 nt, Pseudomonas aeruginosa PA01
gccgcgcuugccgucgcg

SEQ ID NO: 1425056 - RNA, 18 nt, Pseudomonas aeruginosa PA01
gccgcgcuucaccagagc

SEQ ID NO: 1425057 - RNA, 13 nt, Pseudomonas aeruginosa PA01
gccgcgcugucgg

SEQ ID NO: 1425058 - RNA, 14 nt, Pseudomonas aeruginosa PA01
gccgcgcugucggc

SEQ ID NO: 1425059 - RNA, 19 nt, Pseudomonas aeruginosa PA01
gccgcgcugucggccucga

SEQ ID NO: 1425060 - RNA, 20 nt, Pseudomonas aeruginosa PA01
gccgcgcugucggccucgac

SEQ ID NO: 1425061 - RNA, 18 nt, Pseudomonas aeruginosa PA01
gccgcggcaaugcggcga

SEQ ID NO: 1425062 - RNA, 19 nt, Pseudomonas aeruginosa PA01
gccgcggcaaugcggcgau

SEQ ID NO: 1425063 - RNA, 21 nt, Pseudomonas aeruginosa PA01
gccgcggcaaugcggcgaugg

SEQ ID NO: 1425064 - RNA, 22 nt, Pseudomonas aeruginosa PA01
gccgcggcaaugcggcgauggc

SEQ ID NO: 1425065 - RNA, 18 nt, Pseudomonas aeruginosa PA01
gccgcggaugacgggcga

SEQ ID NO: 1425066 - RNA, 13 nt, Pseudomonas aeruginosa PA01
gccgcgcgccagc

SEQ ID NO: 1425067 - RNA, 14 nt, Pseudomonas aeruginosa PA01
gccgcgcgccagca

SEQ ID NO: 1425068 - RNA, 20 nt, Pseudomonas aeruginosa PA01
gccgcgccuuucgcucaggc

SEQ ID NO: 1425069 - RNA, 13 nt, Pseudomonas aeruginosa PA01
gccgcgcgccgag

SEQ ID NO: 1425070 - RNA, 14 nt, Pseudomonas aeruginosa PA01
gccgcgcgccgcau

SEQ ID NO: 1425071 - RNA, 14 nt, Pseudomonas aeruginosa PA01
gccgcgcugcgcca

SEQ ID NO: 1425072 - RNA, 17 nt, Pseudomonas aeruginosa PA01
gccgcgcugcgccaggc

SEQ ID NO: 1425073 - RNA, 16 nt, Pseudomonas aeruginosa PA01
gccgcgcugcugccau

SEQ ID NO: 1425074 - RNA, 15 nt, Pseudomonas aeruginosa PA01
gccgcgcgccuggcu

SEQ ID NO: 1425075 - RNA, 20 nt, Pseudomonas aeruginosa PA01
gccgacaagccuccagcgcc

SEQ ID NO: 1425076 - RNA, 14 nt, Pseudomonas aeruginosa PA01
gccgacacccgcgc

SEQ ID NO: 1425077 - RNA, 16 nt, Pseudomonas aeruginosa PA01
gccgacacccgcgccg

SEQ ID NO: 1425078 - RNA, 23 nt, Pseudomonas aeruginosa PA01
gccgacacccgcgccgccgcggc

SEQ ID NO: 1425079 - RNA, 17 nt, Pseudomonas aeruginosa PA01
gccgacaccucgaucag

SEQ ID NO: 1425080 - RNA, 17 nt, Pseudomonas aeruginosa PA01
gccgaagggccgcaggu

SEQ ID NO: 1425081 - RNA, 14 nt, Pseudomonas aeruginosa PA01
gccgaagucggcga

SEQ ID NO: 1425082 - RNA, 16 nt, Pseudomonas aeruginosa PA01
gccgaagucggcgagc

SEQ ID NO: 1425083 - RNA, 19 nt, Pseudomonas aeruginosa PA01
gccgaagucggcgagccgg

SEQ ID NO: 1425084 - RNA, 14 nt, Pseudomonas aeruginosa PA01
gccgaaguccugca

SEQ ID NO: 1425085 - RNA, 13 nt, Pseudomonas aeruginosa PA01
gccgaaggccugg

SEQ ID NO: 1425086 - RNA, 20 nt, Pseudomonas aeruginosa PA01
gccgaaggccuggccguugc

SEQ ID NO: 1425087 - RNA, 17 nt, Pseudomonas aeruginosa PA01
gccgaagcugucgagca

SEQ ID NO: 1425088 - RNA, 22 nt, Pseudomonas aeruginosa PA01
gccgaagcugucgagcacggcg

SEQ ID NO: 1425089 - RNA, 24 nt, Pseudomonas aeruginosa PA01
gccgaagcugucgagcacggcgcu

SEQ ID NO: 1425090 - RNA, 17 nt, Pseudomonas aeruginosa PA01
gccgaaggacaggccgu

SEQ ID NO: 1425091 - RNA, 16 nt, Pseudomonas aeruginosa PA01
gccgaaggccagcuug

SEQ ID NO: 1425092 - RNA, 13 nt, Pseudomonas aeruginosa PA01
gccgaaggccagg

SEQ ID NO: 1425093 - RNA, 14 nt, Pseudomonas aeruginosa PA01
gccgaaggccagga

SEQ ID NO: 1425094 - RNA, 19 nt, Pseudomonas aeruginosa PA01
gccgaaggccaggaccgcg

SEQ ID NO: 1425095 - RNA, 20 nt, Pseudomonas aeruginosa PA01
gccgaaggccaggaccgcga

SEQ ID NO: 1425096 - RNA, 15 nt, Pseudomonas aeruginosa PA01
gccgaaggccaggcc

SEQ ID NO: 1425097 - RNA, 16 nt, Pseudomonas aeruginosa PA01
gccgaaggccaggccg

SEQ ID NO: 1425098 - RNA, 20 nt, Pseudomonas aeruginosa PA01
gccgaaggccaggccggcgc

SEQ ID NO: 1425099 - RNA, 18 nt, Pseudomonas aeruginosa PA01
gccgaaggugcaggccgc

SEQ ID NO: 1425100 - RNA, 22 nt, Pseudomonas aeruginosa PA01
gccgaaggugcaggccgcgcga

SEQ ID NO: 1425101 - RNA, 23 nt, Pseudomonas aeruginosa PA01
gccgaaggugcaggccgcgcgau

SEQ ID NO: 1425102 - RNA, 20 nt, Pseudomonas aeruginosa PA01
gccgaaggcgucauccgcca

SEQ ID NO: 1425103 - RNA, 15 nt, Pseudomonas aeruginosa PA01
gccgaaggcgugggc

SEQ ID NO: 1425104 - RNA, 20 nt, Pseudomonas aeruginosa PA01
gccgaaggcgugggcgccgg

SEQ ID NO: 1425105 - RNA, 21 nt, Pseudomonas aeruginosa PA01
gccgaaggcgugggcgccggc

SEQ ID NO: 1425106 - RNA, 17 nt, Pseudomonas aeruginosa PA01
gccgaagggaaacacca

SEQ ID NO: 1425107 - RNA, 19 nt, Pseudomonas aeruginosa PA01
gccgaagggaaacaccagg

SEQ ID NO: 1425108 - RNA, 20 nt, Pseudomonas aeruginosa PA01
gccgaagggaaacaccaggc

SEQ ID NO: 1425109 - RNA, 22 nt, Pseudomonas aeruginosa PA01
gccgaagggaaacaccaggccg

SEQ ID NO: 1425110 - RNA, 24 nt, Pseudomonas aeruginosa PA01
gccgaagggaaacaccaggccgau

SEQ ID NO: 1425111 - RNA, 15 nt, Pseudomonas aeruginosa PA01
gccgaccggcgccgg

SEQ ID NO: 1425112 - RNA, 18 nt, Pseudomonas aeruginosa PA01
gccgaccggcgccgggau

SEQ ID NO: 1425113 - RNA, 22 nt, Pseudomonas aeruginosa PA01
gccgaccgggcgggucuggcgg

SEQ ID NO: 1425114 - RNA, 14 nt, Pseudomonas aeruginosa PA01
gccgaccguccgcc

SEQ ID NO: 1425115 - RNA, 16 nt, Pseudomonas aeruginosa PA01
gccgaccguccgccug

SEQ ID NO: 1425116 - RNA, 20 nt, Pseudomonas aeruginosa PA01
gccgaccguccgccugcgga

SEQ ID NO: 1425117 - RNA, 22 nt, Pseudomonas aeruginosa PA01
gccgaccguggcgacaggcgau

SEQ ID NO: 1425118 - RNA, 12 nt, Pseudomonas aeruginosa PA01
gccgacgacccg

SEQ ID NO: 1425119 - RNA, 14 nt, Pseudomonas aeruginosa PA01
gccgacgaaggccg

SEQ ID NO: 1425120 - RNA, 16 nt, Pseudomonas aeruginosa PA01
gccgacgaaggccgcg

SEQ ID NO: 1425121 - RNA, 20 nt, Pseudomonas aeruginosa PA01
gccgacgaaggccgcggucg

SEQ ID NO: 1425122 - RNA, 14 nt, Pseudomonas aeruginosa PA01
gccgaccucggcgg

SEQ ID NO: 1425123 - RNA, 15 nt, Pseudomonas aeruginosa PA01
gccgaccucggcggu

SEQ ID NO: 1425124 - RNA, 18 nt, Pseudomonas aeruginosa PA01
gccgaccucggcggucag

SEQ ID NO: 1425125 - RNA, 20 nt, Pseudomonas aeruginosa PA01
gccgaccucggcggucaggu

SEQ ID NO: 1425126 - RNA, 17 nt, Pseudomonas aeruginosa PA01
gccgacccgugcgccgc

SEQ ID NO: 1425127 - RNA, 18 nt, Pseudomonas aeruginosa PA01
gccgacccgugcgccgcg

SEQ ID NO: 1425128 - RNA, 22 nt, Pseudomonas aeruginosa PA01
gccgacccgugcgccgcggguc

SEQ ID NO: 1425129 - RNA, 23 nt, Pseudomonas aeruginosa PA01
gccgacccgugcgccgcggguca

SEQ ID NO: 1425130 - RNA, 18 nt, Pseudomonas aeruginosa PA01
gccgacccuagggucggc

SEQ ID NO: 1425131 - RNA, 16 nt, Pseudomonas aeruginosa PA01
gccgacccagagcgcg

SEQ ID NO: 1425132 - RNA, 18 nt, Pseudomonas aeruginosa PA01
gccgacccgcagcggcgc

SEQ ID NO: 1425133 - RNA, 19 nt, Pseudomonas aeruginosa PA01
gccgacccgcaggccggcc

SEQ ID NO: 1425134 - RNA, 22 nt, Pseudomonas aeruginosa PA01
gccgacccgcaggccggccagg

SEQ ID NO: 1425135 - RNA, 14 nt, Pseudomonas aeruginosa PA01
gccgaccagcaaca

SEQ ID NO: 1425136 - RNA, 23 nt, Pseudomonas aeruginosa PA01
gccgaccacguaguaggcgcggg

SEQ ID NO: 1425137 - RNA, 22 nt, Pseudomonas aeruginosa PA01
gccgaccacucgcgagauggcg

SEQ ID NO: 1425138 - RNA, 15 nt, Pseudomonas aeruginosa PA01
gccgaccacuuccag

SEQ ID NO: 1425139 - RNA, 21 nt, Pseudomonas aeruginosa PA01
gccgaccacuuccagguagcc

SEQ ID NO: 1425140 - RNA, 13 nt, Pseudomonas aeruginosa PA01
gccgaccacgacc

SEQ ID NO: 1425141 - RNA, 15 nt, Pseudomonas aeruginosa PA01
gccgaccacgaccgc

SEQ ID NO: 1425142 - RNA, 14 nt, Pseudomonas aeruginosa PA01
gccgagccggcugc

SEQ ID NO: 1425143 - RNA, 15 nt, Pseudomonas aeruginosa PA01
gccgagccggcugcc

SEQ ID NO: 1425144 - RNA, 16 nt, Pseudomonas aeruginosa PA01
gccgagccggcugccg

SEQ ID NO: 1425145 - RNA, 17 nt, Pseudomonas aeruginosa PA01
gccgagccggcugccga

SEQ ID NO: 1425146 - RNA, 16 nt, Pseudomonas aeruginosa PA01
gccgagcaccggcagg

SEQ ID NO: 1425147 - RNA, 20 nt, Pseudomonas aeruginosa PA01
gccgagcaaccgcgauggcg

SEQ ID NO: 1425148 - RNA, 12 nt, Pseudomonas aeruginosa PA01
gccgagcaccgg

SEQ ID NO: 1425149 - RNA, 15 nt, Pseudomonas aeruginosa PA01
gccgagccgcuugga

SEQ ID NO: 1425150 - RNA, 18 nt, Pseudomonas aeruginosa PA01
gccgagcgaaaucggcag

SEQ ID NO: 1425151 - RNA, 20 nt, Pseudomonas aeruginosa PA01
gccgagcgaaaucggcaggc

SEQ ID NO: 1425152 - RNA, 22 nt, Pseudomonas aeruginosa PA01
gccgagcgaaaucggcaggcug

SEQ ID NO: 1425153 - RNA, 23 nt, Pseudomonas aeruginosa PA01
gccgagcgaaaucggcaggcugc

SEQ ID NO: 1425154 - RNA, 23 nt, Pseudomonas aeruginosa PA01
gccgacucgcgaucgaucggcug

SEQ ID NO: 1425155 - RNA, 19 nt, Pseudomonas aeruginosa PA01
gccgacugcaacuggccga

SEQ ID NO: 1425156 - RNA, 22 nt, Pseudomonas aeruginosa PA01
gccgacugcgguuuuccugccc

SEQ ID NO: 1425157 - RNA, 16 nt, Pseudomonas aeruginosa PA01
gccgacuggcagcgau

SEQ ID NO: 1425158 - RNA, 15 nt, Pseudomonas aeruginosa PA01
gccgagaucggucac

SEQ ID NO: 1425159 - RNA, 17 nt, Pseudomonas aeruginosa PA01
gccgagauccugcagca

SEQ ID NO: 1425160 - RNA, 14 nt, Pseudomonas aeruginosa PA01
gccgacuuccagcu

SEQ ID NO: 1425161 - RNA, 15 nt, Pseudomonas aeruginosa PA01
gccgacuuccaggcg

SEQ ID NO: 1425162 - RNA, 20 nt, Pseudomonas aeruginosa PA01
gccgacuuccaggcgcaggc

SEQ ID NO: 1425163 - RNA, 12 nt, Pseudomonas aeruginosa PA01
gccgagcacagg

SEQ ID NO: 1425164 - RNA, 14 nt, Pseudomonas aeruginosa PA01
gccgagcaccacgc

SEQ ID NO: 1425165 - RNA, 15 nt, Pseudomonas aeruginosa PA01
gccgagcaacggcag

SEQ ID NO: 1425166 - RNA, 19 nt, Pseudomonas aeruginosa PA01
gccgagcaacucggcggcg

SEQ ID NO: 1425167 - RNA, 13 nt, Pseudomonas aeruginosa PA01
gccgagcaacugc

SEQ ID NO: 1425168 - RNA, 18 nt, Pseudomonas aeruginosa PA01
gccgagcaauccggcgcu

SEQ ID NO: 1425169 - RNA, 20 nt, Pseudomonas aeruginosa PA01
gccgagcaauccggcgcugc

SEQ ID NO: 1425170 - RNA, 23 nt, Pseudomonas aeruginosa PA01
gccgagcaauccggcgcugccga

SEQ ID NO: 1425171 - RNA, 13 nt, Pseudomonas aeruginosa PA01
gccgacgagcagc

SEQ ID NO: 1425172 - RNA, 15 nt, Pseudomonas aeruginosa PA01
gccgacgagcagcuc

SEQ ID NO: 1425173 - RNA, 19 nt, Pseudomonas aeruginosa PA01
gccgacgagcagcucgccg

SEQ ID NO: 1425174 - RNA, 20 nt, Pseudomonas aeruginosa PA01
gccgacgagcagcucgccgg

SEQ ID NO: 1425175 - RNA, 21 nt, Pseudomonas aeruginosa PA01
gccgacgagcagcucgccggc

SEQ ID NO: 1425176 - RNA, 16 nt, Pseudomonas aeruginosa PA01
gccgacgauccggccg

SEQ ID NO: 1425177 - RNA, 18 nt, Pseudomonas aeruginosa PA01
gccgacgauccggccgau

SEQ ID NO: 1425178 - RNA, 23 nt, Pseudomonas aeruginosa PA01
gccgacgauccggccgaucuccu

SEQ ID NO: 1425179 - RNA, 18 nt, Pseudomonas aeruginosa PA01
gccgacgccaccagccag

SEQ ID NO: 1425180 - RNA, 20 nt, Pseudomonas aeruginosa PA01
gccgacgccaccagccaggc

SEQ ID NO: 1425181 - RNA, 21 nt, Pseudomonas aeruginosa PA01
gccgacgauguucgaggcgcc

SEQ ID NO: 1425182 - RNA, 21 nt, Pseudomonas aeruginosa PA01
gccgacggguucuucucgucg

SEQ ID NO: 1425183 - RNA, 22 nt, Pseudomonas aeruginosa PA01
gccgacggguucuucucgucga

SEQ ID NO: 1425184 - RNA, 19 nt, Pseudomonas aeruginosa PA01
gccgacgguaguaccucga

SEQ ID NO: 1425185 - RNA, 24 nt, Pseudomonas aeruginosa PA01
gccgacggcgcgcugcgugcgccg

SEQ ID NO: 1425186 - RNA, 18 nt, Pseudomonas aeruginosa PA01
gccgacggcuucgaccac

SEQ ID NO: 1425187 - RNA, 19 nt, Pseudomonas aeruginosa PA01
gccgacggcuucgaccacg

SEQ ID NO: 1425188 - RNA, 20 nt, Pseudomonas aeruginosa PA01
gccgacggcuucgaccacga

SEQ ID NO: 1425189 - RNA, 22 nt, Pseudomonas aeruginosa PA01
gccgacggcuucgaccacgacc

SEQ ID NO: 1425190 - RNA, 12 nt, Pseudomonas aeruginosa PA01
gccgacggcccu

SEQ ID NO: 1425191 - RNA, 15 nt, Pseudomonas aeruginosa PA01
gccgacggcggcggc

SEQ ID NO: 1425192 - RNA, 14 nt, Pseudomonas aeruginosa PA01
gccgacggcgugcc

SEQ ID NO: 1425193 - RNA, 16 nt, Pseudomonas aeruginosa PA01
gccgacggcgugccgu

SEQ ID NO: 1425194 - RNA, 20 nt, Pseudomonas aeruginosa PA01
gccgacggcgugccguggcu

SEQ ID NO: 1425195 - RNA, 17 nt, Pseudomonas aeruginosa PA01
gccgacgccgagcagca

SEQ ID NO: 1425196 - RNA, 18 nt, Pseudomonas aeruginosa PA01
gccgacgccgagcagcac

SEQ ID NO: 1425197 - RNA, 17 nt, Pseudomonas aeruginosa PA01
gccgcaagggcgucgcu

SEQ ID NO: 1425198 - RNA, 21 nt, Pseudomonas aeruginosa PA01
gccgcaaguaccgccggcagu

SEQ ID NO: 1425199 - RNA, 15 nt, Pseudomonas aeruginosa PA01
gccgcaaguggcggc

SEQ ID NO: 1425200 - RNA, 16 nt, Pseudomonas aeruginosa PA01
gccgcaaguggcggcu

SEQ ID NO: 1425201 - RNA, 19 nt, Pseudomonas aeruginosa PA01
gccgauguccucgaacagc

SEQ ID NO: 1425202 - RNA, 23 nt, Pseudomonas aeruginosa PA01
gccgauggucucucucugcaugg

SEQ ID NO: 1425203 - RNA, 16 nt, Pseudomonas aeruginosa PA01
gccgaugugcacgcug

SEQ ID NO: 1425204 - RNA, 15 nt, Pseudomonas aeruginosa PA01
gccgcaaggccaggg

SEQ ID NO: 1425205 - RNA, 16 nt, Pseudomonas aeruginosa PA01
gccgcaaggccagggc

SEQ ID NO: 1425206 - RNA, 19 nt, Pseudomonas aeruginosa PA01
gccgcaaggccagggcggc

SEQ ID NO: 1425207 - RNA, 16 nt, Pseudomonas aeruginosa PA01
gccgaugucguagccg

SEQ ID NO: 1425208 - RNA, 19 nt, Pseudomonas aeruginosa PA01
gccgaugucguagccgcgc

SEQ ID NO: 1425209 - RNA, 22 nt, Pseudomonas aeruginosa PA01
gccgaugucguagccgcgcgcc

SEQ ID NO: 1425210 - RNA, 23 nt, Pseudomonas aeruginosa PA01
gccgaugucguagccgcgcgcca

SEQ ID NO: 1425211 - RNA, 15 nt, Pseudomonas aeruginosa PA01
gccgauguacggcac

SEQ ID NO: 1425212 - RNA, 20 nt, Pseudomonas aeruginosa PA01
gccgauguacggcaccacca

SEQ ID NO: 1425213 - RNA, 23 nt, Pseudomonas aeruginosa PA01
gccgauguacggcaccaccaccg

SEQ ID NO: 1425214 - RNA, 20 nt, Pseudomonas aeruginosa PA01
gccgcagcagcggcaaaggc

SEQ ID NO: 1425215 - RNA, 23 nt, Pseudomonas aeruginosa PA01
gccgcaccggcgauggccggcac

SEQ ID NO: 1425216 - RNA, 22 nt, Pseudomonas aeruginosa PA01
gccgaugcgcaacgggcggcgg

SEQ ID NO: 1425217 - RNA, 23 nt, Pseudomonas aeruginosa PA01
gccgaugccgggcaacgcgcaga

SEQ ID NO: 1425218 - RNA, 17 nt, Pseudomonas aeruginosa PA01
gccgaugcgcgacucga

SEQ ID NO: 1425219 - RNA, 18 nt, Pseudomonas aeruginosa PA01
gccgaugcgcuacggcau

SEQ ID NO: 1425220 - RNA, 20 nt, Pseudomonas aeruginosa PA01
gccgaugcgcuacggcauca

SEQ ID NO: 1425221 - RNA, 20 nt, Pseudomonas aeruginosa PA01
gccgaugcuguucagcagga

SEQ ID NO: 1425222 - RNA, 19 nt, Pseudomonas aeruginosa PA01
gccgauggaaaucggccac

SEQ ID NO: 1425223 - RNA, 21 nt, Pseudomonas aeruginosa PA01
gccgauggaaaucggccacuc

SEQ ID NO: 1425224 - RNA, 15 nt, Pseudomonas aeruginosa PA01
gccgauggacaggcu

SEQ ID NO: 1425225 - RNA, 20 nt, Pseudomonas aeruginosa PA01
gccgauggacaggcugggca

SEQ ID NO: 1425226 - RNA, 16 nt, Pseudomonas aeruginosa PA01
gccgaugcucgcgcca

SEQ ID NO: 1425227 - RNA, 18 nt, Pseudomonas aeruginosa PA01
gccgaugcucgcgccagc

SEQ ID NO: 1425228 - RNA, 22 nt, Pseudomonas aeruginosa PA01
gccgaugcucgcgccagcccca

SEQ ID NO: 1425229 - RNA, 15 nt, Pseudomonas aeruginosa PA01
gccgauggccccggc

SEQ ID NO: 1425230 - RNA, 21 nt, Pseudomonas aeruginosa PA01
gccgauggcugucggcgccca

SEQ ID NO: 1425231 - RNA, 16 nt, Pseudomonas aeruginosa PA01
gccgauggcgccgccg

SEQ ID NO: 1425232 - RNA, 20 nt, Pseudomonas aeruginosa PA01
gccgauggcguuauucgccc

SEQ ID NO: 1425233 - RNA, 23 nt, Pseudomonas aeruginosa PA01
gccgaucuucagcagcaggcgcu

SEQ ID NO: 1425234 - RNA, 17 nt, Pseudomonas aeruginosa PA01
gccgaucuucgccgaca

SEQ ID NO: 1425235 - RNA, 19 nt, Pseudomonas aeruginosa PA01
gccgaugaaagagcccgcg

SEQ ID NO: 1425236 - RNA, 19 nt, Pseudomonas aeruginosa PA01
gccgaugaaauagccggcg

SEQ ID NO: 1425237 - RNA, 20 nt, Pseudomonas aeruginosa PA01
gccgaugaaauagccggcga

SEQ ID NO: 1425238 - RNA, 17 nt, Pseudomonas aeruginosa PA01
gccgaugaacgccgcga

SEQ ID NO: 1425239 - RNA, 14 nt, Pseudomonas aeruginosa PA01
gccgaugcgccgac

SEQ ID NO: 1425240 - RNA, 18 nt, Pseudomonas aeruginosa PA01
gccgaggcuuuccagcag

SEQ ID NO: 1425241 - RNA, 21 nt, Pseudomonas aeruginosa PA01
gccgaggcuuuccagcaggcg

SEQ ID NO: 1425242 - RNA, 16 nt, Pseudomonas aeruginosa PA01
gccgaggucggcggcg

SEQ ID NO: 1425243 - RNA, 20 nt, Pseudomonas aeruginosa PA01
gccgaggucggcggcgggga

SEQ ID NO: 1425244 - RNA, 20 nt, Pseudomonas aeruginosa PA01
gccgaggucgucgcugagca

SEQ ID NO: 1425245 - RNA, 16 nt, Pseudomonas aeruginosa PA01
gccgaggcugcgggcg

SEQ ID NO: 1425246 - RNA, 13 nt, Pseudomonas aeruginosa PA01
gccgaggcgucga

SEQ ID NO: 1425247 - RNA, 16 nt, Pseudomonas aeruginosa PA01
gccgaggcggaagacg

SEQ ID NO: 1425248 - RNA, 13 nt, Pseudomonas aeruginosa PA01
gccgaggcggccg

SEQ ID NO: 1425249 - RNA, 14 nt, Pseudomonas aeruginosa PA01
gccgaggcggccga

SEQ ID NO: 1425250 - RNA, 18 nt, Pseudomonas aeruginosa PA01
gccgaggcggccgagggc

SEQ ID NO: 1425251 - RNA, 21 nt, Pseudomonas aeruginosa PA01
gccgaggcggccguagccguc

SEQ ID NO: 1425252 - RNA, 16 nt, Pseudomonas aeruginosa PA01
gccgaggcggcgcagc

SEQ ID NO: 1425253 - RNA, 16 nt, Pseudomonas aeruginosa PA01
gccgaggcgcgccacg

SEQ ID NO: 1425254 - RNA, 17 nt, Pseudomonas aeruginosa PA01
gccgagguugacgaacg

SEQ ID NO: 1425255 - RNA, 20 nt, Pseudomonas aeruginosa PA01
gccgagguugacgaacggca

SEQ ID NO: 1425256 - RNA, 22 nt, Pseudomonas aeruginosa PA01
gccgaggugguauugcagcucg

SEQ ID NO: 1425257 - RNA, 20 nt, Pseudomonas aeruginosa PA01
gccgaggucuuggccagccg

SEQ ID NO: 1425258 - RNA, 22 nt, Pseudomonas aeruginosa PA01
gccgaggucuuggccagccgcg

SEQ ID NO: 1425259 - RNA, 13 nt, Pseudomonas aeruginosa PA01
gccgaggugcugc

SEQ ID NO: 1425260 - RNA, 18 nt, Pseudomonas aeruginosa PA01
gccgaggugcugcaccgg

SEQ ID NO: 1425261 - RNA, 16 nt, Pseudomonas aeruginosa PA01
gccgagguggagauca

SEQ ID NO: 1425262 - RNA, 19 nt, Pseudomonas aeruginosa PA01
gccgagguggagaucagcg

SEQ ID NO: 1425263 - RNA, 12 nt, Pseudomonas aeruginosa PA01
gccgaggccggc

SEQ ID NO: 1425264 - RNA, 14 nt, Pseudomonas aeruginosa PA01
gccgaggccggcga

SEQ ID NO: 1425265 - RNA, 16 nt, Pseudomonas aeruginosa PA01
gccgaggccggcgaag

SEQ ID NO: 1425266 - RNA, 12 nt, Pseudomonas aeruginosa PA01
gccgaggccgcc

SEQ ID NO: 1425267 - RNA, 13 nt, Pseudomonas aeruginosa PA01
gccgaggccgccg

SEQ ID NO: 1425268 - RNA, 16 nt, Pseudomonas aeruginosa PA01
gccgaggccgccgcgg

SEQ ID NO: 1425269 - RNA, 13 nt, Pseudomonas aeruginosa PA01
gccgaggcagccg

SEQ ID NO: 1425270 - RNA, 15 nt, Pseudomonas aeruginosa PA01
gccgaggcagccguc

SEQ ID NO: 1425271 - RNA, 14 nt, Pseudomonas aeruginosa PA01
gccgaggcccuaca

SEQ ID NO: 1425272 - RNA, 14 nt, Pseudomonas aeruginosa PA01
gccgaggccgaggu

SEQ ID NO: 1425273 - RNA, 16 nt, Pseudomonas aeruginosa PA01
gccgagcugaccacca

SEQ ID NO: 1425274 - RNA, 22 nt, Pseudomonas aeruginosa PA01
gccgagcugaccaccagggcga

SEQ ID NO: 1425275 - RNA, 14 nt, Pseudomonas aeruginosa PA01
gccgagcugggcgu

SEQ ID NO: 1425276 - RNA, 23 nt, Pseudomonas aeruginosa PA01
gccgagcugccgcaccgccucga

SEQ ID NO: 1425277 - RNA, 13 nt, Pseudomonas aeruginosa PA01
gccgagcugccgg

SEQ ID NO: 1425278 - RNA, 14 nt, Pseudomonas aeruginosa PA01
gccgagcugccggg

SEQ ID NO: 1425279 - RNA, 15 nt, Pseudomonas aeruginosa PA01
gccgagcugccgggc

SEQ ID NO: 1425280 - RNA, 17 nt, Pseudomonas aeruginosa PA01
gccgagcugccgggcga

SEQ ID NO: 1425281 - RNA, 21 nt, Pseudomonas aeruginosa PA01
gccgagcugccgggcgagcug

SEQ ID NO: 1425282 - RNA, 22 nt, Pseudomonas aeruginosa PA01
gccgagcugccgggcgagcugc

SEQ ID NO: 1425283 - RNA, 22 nt, Pseudomonas aeruginosa PA01
gccgagcguugggccucgcugc

SEQ ID NO: 1425284 - RNA, 14 nt, Pseudomonas aeruginosa PA01
gccgaucaacgcgg

SEQ ID NO: 1425285 - RNA, 17 nt, Pseudomonas aeruginosa PA01
gccgaucaacgcggcca

SEQ ID NO: 1425286 - RNA, 19 nt, Pseudomonas aeruginosa PA01
gccgaucaacgcggccagc

SEQ ID NO: 1425287 - RNA, 23 nt, Pseudomonas aeruginosa PA01
gccgaucaacgcggccagcagca

SEQ ID NO: 1425288 - RNA, 17 nt, Pseudomonas aeruginosa PA01
gccgaucaccagcgcca

SEQ ID NO: 1425289 - RNA, 21 nt, Pseudomonas aeruginosa PA01
gccgaucaccagcgccaggcc

SEQ ID NO: 1425290 - RNA, 19 nt, Pseudomonas aeruginosa PA01
gccgaucagcuuggccuug

SEQ ID NO: 1425291 - RNA, 22 nt, Pseudomonas aeruginosa PA01
gccgaucaggcguaggccgucg

SEQ ID NO: 1425292 - RNA, 14 nt, Pseudomonas aeruginosa PA01
gccgaucaggcuga

SEQ ID NO: 1425293 - RNA, 22 nt, Pseudomonas aeruginosa PA01
gccgaucaggcugaagcggccg

SEQ ID NO: 1425294 - RNA, 14 nt, Pseudomonas aeruginosa PA01
gccgaucaggucgc

SEQ ID NO: 1425295 - RNA, 15 nt, Pseudomonas aeruginosa PA01
gccgaucaggucgcg

SEQ ID NO: 1425296 - RNA, 20 nt, Pseudomonas aeruginosa PA01
gccgaucaggucgcgcgccu

SEQ ID NO: 1425297 - RNA, 14 nt, Pseudomonas aeruginosa PA01
gccgaucaccacca

SEQ ID NO: 1425298 - RNA, 15 nt, Pseudomonas aeruginosa PA01
gccgaucaccaccag

SEQ ID NO: 1425299 - RNA, 17 nt, Pseudomonas aeruginosa PA01
gccgaucaccaccagca

SEQ ID NO: 1425300 - RNA, 23 nt, Pseudomonas aeruginosa PA01
gccgaucaccaccagcaucagca

SEQ ID NO: 1425301 - RNA, 19 nt, Pseudomonas aeruginosa PA01
gccgaucaccaccagcgcc

SEQ ID NO: 1425302 - RNA, 20 nt, Pseudomonas aeruginosa PA01
gccgaucaccaccagcgccg

SEQ ID NO: 1425303 - RNA, 21 nt, Pseudomonas aeruginosa PA01
gccgaucaccaccagcgccgc

SEQ ID NO: 1425304 - RNA, 16 nt, Pseudomonas aeruginosa PA01
gccgaucaccaccugg

SEQ ID NO: 1425305 - RNA, 17 nt, Pseudomonas aeruginosa PA01
gccgaucaccaccugga

SEQ ID NO: 1425306 - RNA, 22 nt, Pseudomonas aeruginosa PA01
gccgaucgaagaaggcucaccg

SEQ ID NO: 1425307 - RNA, 22 nt, Pseudomonas aeruginosa PA01
gccgauccgcgaauagggcggc

SEQ ID NO: 1425308 - RNA, 23 nt, Pseudomonas aeruginosa PA01
gccgauccgcgaauagggcggcg

SEQ ID NO: 1425309 - RNA, 13 nt, Pseudomonas aeruginosa PA01
gccgaucgccgcg

SEQ ID NO: 1425310 - RNA, 16 nt, Pseudomonas aeruginosa PA01
gccgaucgccgcgcgg

SEQ ID NO: 1425311 - RNA, 19 nt, Pseudomonas aeruginosa PA01
gccgaucgccgcgcggucg

SEQ ID NO: 1425312 - RNA, 15 nt, Pseudomonas aeruginosa PA01
gccgaucgagcggcc

SEQ ID NO: 1425313 - RNA, 19 nt, Pseudomonas aeruginosa PA01
gccgaucgagcggcccgcg

SEQ ID NO: 1425314 - RNA, 20 nt, Pseudomonas aeruginosa PA01
gccgaucgagcggcccgcgg

SEQ ID NO: 1425315 - RNA, 23 nt, Pseudomonas aeruginosa PA01
gccgaucgagcggcccgcgguca

SEQ ID NO: 1425316 - RNA, 13 nt, Pseudomonas aeruginosa PA01
gccgaucaucggc

SEQ ID NO: 1425317 - RNA, 20 nt, Pseudomonas aeruginosa PA01
gccgaucaugcucggcggug

SEQ ID NO: 1425318 - RNA, 17 nt, Pseudomonas aeruginosa PA01
gccgaucccggcggcga

SEQ ID NO: 1425319 - RNA, 15 nt, Pseudomonas aeruginosa PA01
gccgaucccgacgcc

SEQ ID NO: 1425320 - RNA, 12 nt, Pseudomonas aeruginosa PA01
gccgaucccgau

SEQ ID NO: 1425321 - RNA, 13 nt, Pseudomonas aeruginosa PA01
gccgaucccggcg

SEQ ID NO: 1425322 - RNA, 14 nt, Pseudomonas aeruginosa PA01
gccgaucaucauca

SEQ ID NO: 1425323 - RNA, 20 nt, Pseudomonas aeruginosa PA01
gccgauccaggaaccggcca

SEQ ID NO: 1425324 - RNA, 21 nt, Pseudomonas aeruginosa PA01
gcccucucaggagcgccgcgc

SEQ ID NO: 1425325 - RNA, 22 nt, Pseudomonas aeruginosa PA01
gcccucucaggagcgccgcgca

SEQ ID NO: 1425326 - RNA, 23 nt, Pseudomonas aeruginosa PA01
gcccucucaggagcgccgcgcag

SEQ ID NO: 1425327 - RNA, 21 nt, Pseudomonas aeruginosa PA01
gcccucguugauuccgccgga

SEQ ID NO: 1425328 - RNA, 22 nt, Pseudomonas aeruginosa PA01
gcccucguugauuccgccggaa

SEQ ID NO: 1425329 - RNA, 16 nt, Pseudomonas aeruginosa PA01
gcccucgcagccggcg

SEQ ID NO: 1425330 - RNA, 20 nt, Pseudomonas aeruginosa PA01
gcccugacauccuuggucag

SEQ ID NO: 1425331 - RNA, 17 nt, Pseudomonas aeruginosa PA01
gcccugacccgcaccgg

SEQ ID NO: 1425332 - RNA, 15 nt, Pseudomonas aeruginosa PA01
gcccucgcgacggca

SEQ ID NO: 1425333 - RNA, 22 nt, Pseudomonas aeruginosa PA01
gcccucgauguaggccucggcc

SEQ ID NO: 1425334 - RNA, 20 nt, Pseudomonas aeruginosa PA01
gcccucgcuccaacgcaggc

SEQ ID NO: 1425335 - RNA, 22 nt, Pseudomonas aeruginosa PA01
gcccucgcuccaacgcaggcgc

SEQ ID NO: 1425336 - RNA, 24 nt, Pseudomonas aeruginosa PA01
gcccucgcucguuccgcggagucg

SEQ ID NO: 1425337 - RNA, 17 nt, Pseudomonas aeruginosa PA01
gcccucgcggcggcagg

SEQ ID NO: 1425338 - RNA, 20 nt, Pseudomonas aeruginosa PA01
gcccucgcggcggcaggcca

SEQ ID NO: 1425339 - RNA, 12 nt, Pseudomonas aeruginosa PA01
gcccucgcgccc

SEQ ID NO: 1425340 - RNA, 13 nt, Pseudomonas aeruginosa PA01
gcccucgcgcugg

SEQ ID NO: 1425341 - RNA, 19 nt, Pseudomonas aeruginosa PA01
gcccucgcggacgcuggcg

SEQ ID NO: 1425342 - RNA, 20 nt, Pseudomonas aeruginosa PA01
gcccucgcggacgcuggcga

SEQ ID NO: 1425343 - RNA, 13 nt, Pseudomonas aeruginosa PA01
gcccucgcggauc

SEQ ID NO: 1425344 - RNA, 13 nt, Pseudomonas aeruginosa PA01
gcccucggcgcug

SEQ ID NO: 1425345 - RNA, 14 nt, Pseudomonas aeruginosa PA01
gcccucggcggcga

SEQ ID NO: 1425346 - RNA, 17 nt, Pseudomonas aeruginosa PA01
gcccucggcggcgagcg

SEQ ID NO: 1425347 - RNA, 22 nt, Pseudomonas aeruginosa PA01
gcccucggcggcgagcgggucg

SEQ ID NO: 1425348 - RNA, 16 nt, Pseudomonas aeruginosa PA01
gcccucgggccgcagg

SEQ ID NO: 1425349 - RNA, 17 nt, Pseudomonas aeruginosa PA01
gcccucgggccgcaggg

SEQ ID NO: 1425350 - RNA, 20 nt, Pseudomonas aeruginosa PA01
gcccucggugauaccgccgg

SEQ ID NO: 1425351 - RNA, 21 nt, Pseudomonas aeruginosa PA01
gcccucggugauaccgccggc

SEQ ID NO: 1425352 - RNA, 15 nt, Pseudomonas aeruginosa PA01
gcccucggcgcccgc

SEQ ID NO: 1425353 - RNA, 22 nt, Pseudomonas aeruginosa PA01
gcccucggcgcccgccugcagg

SEQ ID NO: 1425354 - RNA, 23 nt, Pseudomonas aeruginosa PA01
gcccucggcgcccgccugcagga

SEQ ID NO: 1425355 - RNA, 15 nt, Pseudomonas aeruginosa PA01
gcccucggccaggca

SEQ ID NO: 1425356 - RNA, 17 nt, Pseudomonas aeruginosa PA01
gcccucggccaggcauu

SEQ ID NO: 1425357 - RNA, 14 nt, Pseudomonas aeruginosa PA01
gcccucggcccgga

SEQ ID NO: 1425358 - RNA, 13 nt, Pseudomonas aeruginosa PA01
gcccugcaggccg

SEQ ID NO: 1425359 - RNA, 14 nt, Pseudomonas aeruginosa PA01
gcccugcaggccga

SEQ ID NO: 1425360 - RNA, 15 nt, Pseudomonas aeruginosa PA01
gcccugcaggccgaa

SEQ ID NO: 1425361 - RNA, 15 nt, Pseudomonas aeruginosa PA01
gcccugccagcgggc

SEQ ID NO: 1425362 - RNA, 16 nt, Pseudomonas aeruginosa PA01
gcccugccagcgggcg

SEQ ID NO: 1425363 - RNA, 18 nt, Pseudomonas aeruginosa PA01
gcccugccagcgggcgcc

SEQ ID NO: 1425364 - RNA, 21 nt, Pseudomonas aeruginosa PA01
gcccugccagaggaucggcca

SEQ ID NO: 1425365 - RNA, 12 nt, Pseudomonas aeruginosa PA01
gcccugccggcg

SEQ ID NO: 1425366 - RNA, 13 nt, Pseudomonas aeruginosa PA01
gcccugccggcgc

SEQ ID NO: 1425367 - RNA, 15 nt, Pseudomonas aeruginosa PA01
gcccugccggcgcag

SEQ ID NO: 1425368 - RNA, 18 nt, Pseudomonas aeruginosa PA01
gcccugccggcgcagauc

SEQ ID NO: 1425369 - RNA, 23 nt, Pseudomonas aeruginosa PA01
gcccugcccgguggggcgggcga

SEQ ID NO: 1425370 - RNA, 19 nt, Pseudomonas aeruginosa PA01
gcccugaggcuuuccugcg

SEQ ID NO: 1425371 - RNA, 20 nt, Pseudomonas aeruginosa PA01
gcccugaggcuuuccugcgc

SEQ ID NO: 1425372 - RNA, 17 nt, Pseudomonas aeruginosa PA01
gcccugcaaagcggcga

SEQ ID NO: 1425373 - RNA, 14 nt, Pseudomonas aeruginosa PA01
gcccugcagcgcca

SEQ ID NO: 1425374 - RNA, 13 nt, Pseudomonas aeruginosa PA01
gcccugcagcgcg

SEQ ID NO: 1425375 - RNA, 15 nt, Pseudomonas aeruginosa PA01
gcccugcagcgcgcg

SEQ ID NO: 1425376 - RNA, 22 nt, Pseudomonas aeruginosa PA01
gcccugcagcgcgcgcuggucg

SEQ ID NO: 1425377 - RNA, 14 nt, Pseudomonas aeruginosa PA01
gcccugcucgccgg

SEQ ID NO: 1425378 - RNA, 15 nt, Pseudomonas aeruginosa PA01
gcccugcucgccggc

SEQ ID NO: 1425379 - RNA, 17 nt, Pseudomonas aeruginosa PA01
gcccugcucgccggcgc

SEQ ID NO: 1425380 - RNA, 18 nt, Pseudomonas aeruginosa PA01
gcccugcucgccggcgcg

SEQ ID NO: 1425381 - RNA, 22 nt, Pseudomonas aeruginosa PA01
gcccugcucgccggcgcgggcg

SEQ ID NO: 1425382 - RNA, 13 nt, Pseudomonas aeruginosa PA01
gcccugcgccgca

SEQ ID NO: 1425383 - RNA, 16 nt, Pseudomonas aeruginosa PA01
gcccugcgggaugccc

SEQ ID NO: 1425384 - RNA, 15 nt, Pseudomonas aeruginosa PA01
gcccugcggauggcg

SEQ ID NO: 1425385 - RNA, 18 nt, Pseudomonas aeruginosa PA01
gcccugcggcaggcgcca

SEQ ID NO: 1425386 - RNA, 14 nt, Pseudomonas aeruginosa PA01
gcccugcugcucgc

SEQ ID NO: 1425387 - RNA, 20 nt, Pseudomonas aeruginosa PA01
gcccugcugcagggccucgc

SEQ ID NO: 1425388 - RNA, 13 nt, Pseudomonas aeruginosa PA01
gcccugcucuucc

SEQ ID NO: 1425389 - RNA, 13 nt, Pseudomonas aeruginosa PA01
gcccugcucgucg

SEQ ID NO: 1425390 - RNA, 14 nt, Pseudomonas aeruginosa PA01
gcccugcucgucgc

SEQ ID NO: 1425391 - RNA, 15 nt, Pseudomonas aeruginosa PA01
gcccugcucgucgcu

SEQ ID NO: 1425392 - RNA, 21 nt, Pseudomonas aeruginosa PA01
gcccugcuucgaacgugcgcg

SEQ ID NO: 1425393 - RNA, 13 nt, Pseudomonas aeruginosa PA01
gcccugcuggcgc

SEQ ID NO: 1425394 - RNA, 14 nt, Pseudomonas aeruginosa PA01
gcccugcuggcgca

SEQ ID NO: 1425395 - RNA, 23 nt, Pseudomonas aeruginosa PA01
gcccugcuggcgcagccaggcga

SEQ ID NO: 1425396 - RNA, 18 nt, Pseudomonas aeruginosa PA01
gcccuggaaaggccucgg

SEQ ID NO: 1425397 - RNA, 15 nt, Pseudomonas aeruginosa PA01
gcccuggaagccggc

SEQ ID NO: 1425398 - RNA, 16 nt, Pseudomonas aeruginosa PA01
gcccuggaagccggca

SEQ ID NO: 1425399 - RNA, 19 nt, Pseudomonas aeruginosa PA01
gcccuggaagccggcaggg

SEQ ID NO: 1425400 - RNA, 15 nt, Pseudomonas aeruginosa PA01
gcccgugccucggcg

SEQ ID NO: 1425401 - RNA, 16 nt, Pseudomonas aeruginosa PA01
gcccgugccucggcgg

SEQ ID NO: 1425402 - RNA, 17 nt, Pseudomonas aeruginosa PA01
gcccgugcccguccuag

SEQ ID NO: 1425403 - RNA, 14 nt, Pseudomonas aeruginosa PA01
gcccguggcgcgga

SEQ ID NO: 1425404 - RNA, 20 nt, Pseudomonas aeruginosa PA01
gcccguggcgcggacgggcc

SEQ ID NO: 1425405 - RNA, 23 nt, Pseudomonas aeruginosa PA01
gcccgugggguauuccaggcgaa

SEQ ID NO: 1425406 - RNA, 22 nt, Pseudomonas aeruginosa PA01
gcccgugguagucgagccggau

SEQ ID NO: 1425407 - RNA, 12 nt, Pseudomonas aeruginosa PA01
gcccgugucgcc

SEQ ID NO: 1425408 - RNA, 20 nt, Pseudomonas aeruginosa PA01
gcccgugucgccuuccggca

SEQ ID NO: 1425409 - RNA, 17 nt, Pseudomonas aeruginosa PA01
gcccgugcggcacgcug

SEQ ID NO: 1425410 - RNA, 15 nt, Pseudomonas aeruginosa PA01
gcccguguucggcca

SEQ ID NO: 1425411 - RNA, 16 nt, Pseudomonas aeruginosa PA01
gcccguguucggccag

SEQ ID NO: 1425412 - RNA, 21 nt, Pseudomonas aeruginosa PA01
gcccguguucggccagccggc

SEQ ID NO: 1425413 - RNA, 22 nt, Pseudomonas aeruginosa PA01
gcccguguucggccagccggcg

SEQ ID NO: 1425414 - RNA, 23 nt, Pseudomonas aeruginosa PA01
gcccguguucggccagccggcgc

SEQ ID NO: 1425415 - RNA, 21 nt, Pseudomonas aeruginosa PA01
gcccguucgaucaauugccgg

SEQ ID NO: 1425416 - RNA, 22 nt, Pseudomonas aeruginosa PA01
gcccguucgaucaauugccggu

SEQ ID NO: 1425417 - RNA, 16 nt, Pseudomonas aeruginosa PA01
gcccguuccaccgccu

SEQ ID NO: 1425418 - RNA, 22 nt, Pseudomonas aeruginosa PA01
gcccguuccaccgccuggacca

SEQ ID NO: 1425419 - RNA, 14 nt, Pseudomonas aeruginosa PA01
gcccuccagcaccc

SEQ ID NO: 1425420 - RNA, 20 nt, Pseudomonas aeruginosa PA01
gcccuccagcacccagguag

SEQ ID NO: 1425421 - RNA, 16 nt, Pseudomonas aeruginosa PA01
gcccuccagcaccgcc

SEQ ID NO: 1425422 - RNA, 23 nt, Pseudomonas aeruginosa PA01
gcccuccagcaccgccuggcgca

SEQ ID NO: 1425423 - RNA, 12 nt, Pseudomonas aeruginosa PA01
gcccuccaggcg

SEQ ID NO: 1425424 - RNA, 13 nt, Pseudomonas aeruginosa PA01
gcccuccaggcga

SEQ ID NO: 1425425 - RNA, 16 nt, Pseudomonas aeruginosa PA01
gcccuccaucagcgcc

SEQ ID NO: 1425426 - RNA, 14 nt, Pseudomonas aeruginosa PA01
gcccuccccuggcc

SEQ ID NO: 1425427 - RNA, 19 nt, Pseudomonas aeruginosa PA01
gcccuccccuggcccugca

SEQ ID NO: 1425428 - RNA, 18 nt, Pseudomonas aeruginosa PA01
gcccucgaccagguccgg

SEQ ID NO: 1425429 - RNA, 22 nt, Pseudomonas aeruginosa PA01
gcccucgaccagguccggcagc

SEQ ID NO: 1425430 - RNA, 15 nt, Pseudomonas aeruginosa PA01
gcccucgaccuggcu

SEQ ID NO: 1425431 - RNA, 13 nt, Pseudomonas aeruginosa PA01
gcccucgacgaua

SEQ ID NO: 1425432 - RNA, 18 nt, Pseudomonas aeruginosa PA01
gcccucgaacggcgugag

SEQ ID NO: 1425433 - RNA, 17 nt, Pseudomonas aeruginosa PA01
gcccucgaagcccugca

SEQ ID NO: 1425434 - RNA, 16 nt, Pseudomonas aeruginosa PA01
gcccgccucggcggcu

SEQ ID NO: 1425435 - RNA, 14 nt, Pseudomonas aeruginosa PA01
gcccgguccgucca

SEQ ID NO: 1425436 - RNA, 16 nt, Pseudomonas aeruginosa PA01
gcccgguccguccagc

SEQ ID NO: 1425437 - RNA, 19 nt, Pseudomonas aeruginosa PA01
gcccgguccguccagcgcg

SEQ ID NO: 1425438 - RNA, 20 nt, Pseudomonas aeruginosa PA01
gcccgguccguccagcgcgc

SEQ ID NO: 1425439 - RNA, 15 nt, Pseudomonas aeruginosa PA01
gcccgccucggcggc

SEQ ID NO: 1425440 - RNA, 18 nt, Pseudomonas aeruginosa PA01
gcccggucuagccgggcc

SEQ ID NO: 1425441 - RNA, 21 nt, Pseudomonas aeruginosa PA01
gcccggucuagcgccccggcc

SEQ ID NO: 1425442 - RNA, 19 nt, Pseudomonas aeruginosa PA01
gcccggucucagccggcgc

SEQ ID NO: 1425443 - RNA, 15 nt, Pseudomonas aeruginosa PA01
gcccgccugauggcg

SEQ ID NO: 1425444 - RNA, 11 nt, Pseudomonas aeruginosa PA01
gcccgguggaa

SEQ ID NO: 1425445 - RNA, 15 nt, Pseudomonas aeruginosa PA01
gcccgucgucguggc

SEQ ID NO: 1425446 - RNA, 15 nt, Pseudomonas aeruginosa PA01
gcccguauggcgggc

SEQ ID NO: 1425447 - RNA, 20 nt, Pseudomonas aeruginosa PA01
gcccguagucguucagcgcc

SEQ ID NO: 1425448 - RNA, 19 nt, Pseudomonas aeruginosa PA01
gcccgguuggccaggacca

SEQ ID NO: 1425449 - RNA, 16 nt, Pseudomonas aeruginosa PA01
gcccgguugccuucgu

SEQ ID NO: 1425450 - RNA, 18 nt, Pseudomonas aeruginosa PA01
gcccgguugccuucgucg

SEQ ID NO: 1425451 - RNA, 21 nt, Pseudomonas aeruginosa PA01
gcccgguugagauccuggccg

SEQ ID NO: 1425452 - RNA, 22 nt, Pseudomonas aeruginosa PA01
gcccgguugagauccuggccgg

SEQ ID NO: 1425453 - RNA, 20 nt, Pseudomonas aeruginosa PA01
gcccuguacauagcggguca

SEQ ID NO: 1425454 - RNA, 22 nt, Pseudomonas aeruginosa PA01
gcccuggucgacauagcgcagc

SEQ ID NO: 1425455 - RNA, 15 nt, Pseudomonas aeruginosa PA01
gcccuggucggcggu

SEQ ID NO: 1425456 - RNA, 20 nt, Pseudomonas aeruginosa PA01
gcccuggucggcggucucga

SEQ ID NO: 1425457 - RNA, 23 nt, Pseudomonas aeruginosa PA01
gcccugguugcggaacggcucgc

SEQ ID NO: 1425458 - RNA, 18 nt, Pseudomonas aeruginosa PA01
gcccuggcucuugccgcg

SEQ ID NO: 1425459 - RNA, 21 nt, Pseudomonas aeruginosa PA01
gcccuggcucuugccgcgagc

SEQ ID NO: 1425460 - RNA, 21 nt, Pseudomonas aeruginosa PA01
gcccugggccccggccggcag

SEQ ID NO: 1425461 - RNA, 14 nt, Pseudomonas aeruginosa PA01
gcccugggccggcg

SEQ ID NO: 1425462 - RNA, 15 nt, Pseudomonas aeruginosa PA01
gcccugggccggcgc

SEQ ID NO: 1425463 - RNA, 18 nt, Pseudomonas aeruginosa PA01
gcccugggccggcgccag

SEQ ID NO: 1425464 - RNA, 20 nt, Pseudomonas aeruginosa PA01
gcccugggcgaacagcaccc

SEQ ID NO: 1425465 - RNA, 23 nt, Pseudomonas aeruginosa PA01
gcccugggcgaacagcacccagg

SEQ ID NO: 1425466 - RNA, 20 nt, Pseudomonas aeruginosa PA01
gcccuggguggucugcacgg

SEQ ID NO: 1425467 - RNA, 22 nt, Pseudomonas aeruginosa PA01
gcccugggguuucugcuggcca

SEQ ID NO: 1425468 - RNA, 16 nt, Pseudomonas aeruginosa PA01
gcccugggcggccucg

SEQ ID NO: 1425469 - RNA, 17 nt, Pseudomonas aeruginosa PA01
gcccugggcggccucgu

SEQ ID NO: 1425470 - RNA, 16 nt, Pseudomonas aeruginosa PA01
gcccugggcggcgacc

SEQ ID NO: 1425471 - RNA, 17 nt, Pseudomonas aeruginosa PA01
gcccugggcggcgaccu

SEQ ID NO: 1425472 - RNA, 23 nt, Pseudomonas aeruginosa PA01
gcccugggcggcgaccugcggca

SEQ ID NO: 1425473 - RNA, 16 nt, Pseudomonas aeruginosa PA01
gcccugggcgaugcgg

SEQ ID NO: 1425474 - RNA, 11 nt, Pseudomonas aeruginosa PA01
gcccugggcgc

SEQ ID NO: 1425475 - RNA, 14 nt, Pseudomonas aeruginosa PA01
gcccugggcgccgc

SEQ ID NO: 1425476 - RNA, 18 nt, Pseudomonas aeruginosa PA01
gcccugggcgccgccggu

SEQ ID NO: 1425477 - RNA, 19 nt, Pseudomonas aeruginosa PA01
gcccugggcgccgccggug

SEQ ID NO: 1425478 - RNA, 20 nt, Pseudomonas aeruginosa PA01
gcccugggcgccgccggugc

SEQ ID NO: 1425479 - RNA, 17 nt, Pseudomonas aeruginosa PA01
gcccuggagcggaaacc

SEQ ID NO: 1425480 - RNA, 20 nt, Pseudomonas aeruginosa PA01
gcccuggcagacgcugcucg

SEQ ID NO: 1425481 - RNA, 17 nt, Pseudomonas aeruginosa PA01
gcccuggauaucugggc

SEQ ID NO: 1425482 - RNA, 19 nt, Pseudomonas aeruginosa PA01
gcccuggauaucugggcca

SEQ ID NO: 1425483 - RNA, 20 nt, Pseudomonas aeruginosa PA01
gcccuggauaucugggccau

SEQ ID NO: 1425484 - RNA, 22 nt, Pseudomonas aeruginosa PA01
gcccuggaucaccgcggcgcug

SEQ ID NO: 1425485 - RNA, 14 nt, Pseudomonas aeruginosa PA01
gcccuggccgacgc

SEQ ID NO: 1425486 - RNA, 16 nt, Pseudomonas aeruginosa PA01
gcccuggccgaucagc

SEQ ID NO: 1425487 - RNA, 23 nt, Pseudomonas aeruginosa PA01
gcccuggccgaucagcuuggccu

SEQ ID NO: 1425488 - RNA, 14 nt, Pseudomonas aeruginosa PA01
gcccuggccgccca

SEQ ID NO: 1425489 - RNA, 14 nt, Pseudomonas aeruginosa PA01
gcccuggcgcagac

SEQ ID NO: 1425490 - RNA, 21 nt, Pseudomonas aeruginosa PA01
gcccuggcgcagacaggccuc

SEQ ID NO: 1425491 - RNA, 23 nt, Pseudomonas aeruginosa PA01
gcccuggcgcagacaggccucca

SEQ ID NO: 1425492 - RNA, 14 nt, Pseudomonas aeruginosa PA01
gcccuggcgccagc

SEQ ID NO: 1425493 - RNA, 18 nt, Pseudomonas aeruginosa PA01
gcccuggcgccagcguug

SEQ ID NO: 1425494 - RNA, 12 nt, Pseudomonas aeruginosa PA01
gcccuggccggc

SEQ ID NO: 1425495 - RNA, 13 nt, Pseudomonas aeruginosa PA01
gcccuggccggca

SEQ ID NO: 1425496 - RNA, 15 nt, Pseudomonas aeruginosa PA01
gcccuggccgucggc

SEQ ID NO: 1425497 - RNA, 18 nt, Pseudomonas aeruginosa PA01
gcccuggccgucggccug

SEQ ID NO: 1425498 - RNA, 14 nt, Pseudomonas aeruginosa PA01
gcccuggccucggc

SEQ ID NO: 1425499 - RNA, 16 nt, Pseudomonas aeruginosa PA01
gcccuggccucggcgu

SEQ ID NO: 1425500 - RNA, 20 nt, Pseudomonas aeruginosa PA01
gcccuggcguggccggcgag

SEQ ID NO: 1425501 - RNA, 15 nt, Pseudomonas aeruginosa PA01
gcccuggccuuggcc

SEQ ID NO: 1425502 - RNA, 12 nt, Pseudomonas aeruginosa PA01
gcccuggcgcgc

SEQ ID NO: 1425503 - RNA, 13 nt, Pseudomonas aeruginosa PA01
gcccuggcgcgcg

SEQ ID NO: 1425504 - RNA, 14 nt, Pseudomonas aeruginosa PA01
gcccuggcgcggca

SEQ ID NO: 1425505 - RNA, 16 nt, Pseudomonas aeruginosa PA01
gcccuugccauccucc

SEQ ID NO: 1425506 - RNA, 20 nt, Pseudomonas aeruginosa PA01
gcccuugccauccuccagca

SEQ ID NO: 1425507 - RNA, 15 nt, Pseudomonas aeruginosa PA01
gcccuugcaaccgcc

SEQ ID NO: 1425508 - RNA, 21 nt, Pseudomonas aeruginosa PA01
gcccuugcaaccgccgccgca

SEQ ID NO: 1425509 - RNA, 23 nt, Pseudomonas aeruginosa PA01
gcccuugaugaucaggucggccg

SEQ ID NO: 1425510 - RNA, 20 nt, Pseudomonas aeruginosa PA01
gcccuugauggugugcagca

SEQ ID NO: 1425511 - RNA, 21 nt, Pseudomonas aeruginosa PA01
gcccuugauggugugcagcag

SEQ ID NO: 1425512 - RNA, 23 nt, Pseudomonas aeruginosa PA01
gcccuugauggugugcagcagca

SEQ ID NO: 1425513 - RNA, 14 nt, Pseudomonas aeruginosa PA01
gcccuugcuguucg

SEQ ID NO: 1425514 - RNA, 15 nt, Pseudomonas aeruginosa PA01
gcccuugcucgcggc

SEQ ID NO: 1425515 - RNA, 19 nt, Pseudomonas aeruginosa PA01
gcccuugcucgcggcguag

SEQ ID NO: 1425516 - RNA, 17 nt, Pseudomonas aeruginosa PA01
gcccuugcggcgcggcc

SEQ ID NO: 1425517 - RNA, 14 nt, Pseudomonas aeruginosa PA01
gcccuugcgccgcg

SEQ ID NO: 1425518 - RNA, 15 nt, Pseudomonas aeruginosa PA01
gcccuugcgccgcgg

SEQ ID NO: 1425519 - RNA, 17 nt, Pseudomonas aeruginosa PA01
gcccuugggaccgggca

SEQ ID NO: 1425520 - RNA, 18 nt, Pseudomonas aeruginosa PA01
gcccuugggaccgggcau

SEQ ID NO: 1425521 - RNA, 23 nt, Pseudomonas aeruginosa PA01
gcccuuguacagcuucaggcgca

SEQ ID NO: 1425522 - RNA, 24 nt, Pseudomonas aeruginosa PA01
gcccuuguacagcuucaggcgcac

SEQ ID NO: 1425523 - RNA, 22 nt, Pseudomonas aeruginosa PA01
gcccuuguagaucgacagccac

SEQ ID NO: 1425524 - RNA, 16 nt, Pseudomonas aeruginosa PA01
gcccuuucacggcggu

SEQ ID NO: 1425525 - RNA, 22 nt, Pseudomonas aeruginosa PA01
gcccuuuucaauuccgccgcgg

SEQ ID NO: 1425526 - RNA, 17 nt, Pseudomonas aeruginosa PA01
gcccuuuuccuccaggg

SEQ ID NO: 1425527 - RNA, 16 nt, Pseudomonas aeruginosa PA01
gcccuucuccgccagc

SEQ ID NO: 1425528 - RNA, 22 nt, Pseudomonas aeruginosa PA01
gcccuucuccgccagccagccg

SEQ ID NO: 1425529 - RNA, 21 nt, Pseudomonas aeruginosa PA01
gcccuugaggaaguugcgcag

SEQ ID NO: 1425530 - RNA, 18 nt, Pseudomonas aeruginosa PA01
gcccuugaggucguuggc

SEQ ID NO: 1425531 - RNA, 13 nt, Pseudomonas aeruginosa PA01
gcccuucagcgcc

SEQ ID NO: 1425532 - RNA, 20 nt, Pseudomonas aeruginosa PA01
gcccuucgacgacaccugca

SEQ ID NO: 1425533 - RNA, 16 nt, Pseudomonas aeruginosa PA01
gcccuucgaacccgcc

SEQ ID NO: 1425534 - RNA, 20 nt, Pseudomonas aeruginosa PA01
gcccuucgaacccgcccucg

SEQ ID NO: 1425535 - RNA, 22 nt, Pseudomonas aeruginosa PA01
gcccuucgacaugggccgcgca

SEQ ID NO: 1425536 - RNA, 17 nt, Pseudomonas aeruginosa PA01
gcccuucgacgucgauc

SEQ ID NO: 1425537 - RNA, 11 nt, Pseudomonas aeruginosa PA01
gcccuucgccc

SEQ ID NO: 1425538 - RNA, 14 nt, Pseudomonas aeruginosa PA01
gcccuucgcccugc

SEQ ID NO: 1425539 - RNA, 14 nt, Pseudomonas aeruginosa PA01
gcccuucgcgcucg

SEQ ID NO: 1425540 - RNA, 20 nt, Pseudomonas aeruginosa PA01
gcccuucaggucgacaugca

SEQ ID NO: 1425541 - RNA, 21 nt, Pseudomonas aeruginosa PA01
gcccuucaucauuucccgucc

SEQ ID NO: 1425542 - RNA, 21 nt, Pseudomonas aeruginosa PA01
gcccuguuucggguccaggcg

SEQ ID NO: 1425543 - RNA, 23 nt, Pseudomonas aeruginosa PA01
gcccuguuucggguccaggcgcc

SEQ ID NO: 1425544 - RNA, 24 nt, Pseudomonas aeruginosa PA01
gcccuguuucggguccaggcgcca

SEQ ID NO: 1425545 - RNA, 19 nt, Pseudomonas aeruginosa PA01
gcccuguucggcgggaucg

SEQ ID NO: 1425546 - RNA, 14 nt, Pseudomonas aeruginosa PA01
gcccuguucgucug

SEQ ID NO: 1425547 - RNA, 16 nt, Pseudomonas aeruginosa PA01
gcccuguucgucuggc

SEQ ID NO: 1425548 - RNA, 22 nt, Pseudomonas aeruginosa PA01
gcccuguucgucuggcgccugg

SEQ ID NO: 1425549 - RNA, 22 nt, Pseudomonas aeruginosa PA01
gccgaacggguagagcgggccg

SEQ ID NO: 1425550 - RNA, 21 nt, Pseudomonas aeruginosa PA01
gccgaacggaucgcgucgcag

SEQ ID NO: 1425551 - RNA, 20 nt, Pseudomonas aeruginosa PA01
gccgaacggcagcuggaucc

SEQ ID NO: 1425552 - RNA, 18 nt, Pseudomonas aeruginosa PA01
gccgaacgccaccagggc

SEQ ID NO: 1425553 - RNA, 20 nt, Pseudomonas aeruginosa PA01
gccgaacgccaccagggccu

SEQ ID NO: 1425554 - RNA, 23 nt, Pseudomonas aeruginosa PA01
gccgaacuccggugucaggccga

SEQ ID NO: 1425555 - RNA, 16 nt, Pseudomonas aeruginosa PA01
gccgaacuccgccagc

SEQ ID NO: 1425556 - RNA, 17 nt, Pseudomonas aeruginosa PA01
gccgaacuccgccagca

SEQ ID NO: 1425557 - RNA, 22 nt, Pseudomonas aeruginosa PA01
gccgaacuccgccagcaccacc

SEQ ID NO: 1425558 - RNA, 14 nt, Pseudomonas aeruginosa PA01
gccgaacucaugcc

SEQ ID NO: 1425559 - RNA, 16 nt, Pseudomonas aeruginosa PA01
gccgaacucuggcggc

SEQ ID NO: 1425560 - RNA, 18 nt, Pseudomonas aeruginosa PA01
gccgaacucuggcggcgu

SEQ ID NO: 1425561 - RNA, 21 nt, Pseudomonas aeruginosa PA01
gccgaacugcagggcgucgcc

SEQ ID NO: 1425562 - RNA, 22 nt, Pseudomonas aeruginosa PA01
gccgaacugcagggcgucgccg

SEQ ID NO: 1425563 - RNA, 23 nt, Pseudomonas aeruginosa PA01
gccgaacugcagggcgucgccgg

SEQ ID NO: 1425564 - RNA, 19 nt, Pseudomonas aeruginosa PA01
gccgaacuucuccgccacc

SEQ ID NO: 1425565 - RNA, 16 nt, Pseudomonas aeruginosa PA01
gccgaagccgccggga

SEQ ID NO: 1425566 - RNA, 16 nt, Pseudomonas aeruginosa PA01
gccgaagccgacgccg

SEQ ID NO: 1425567 - RNA, 17 nt, Pseudomonas aeruginosa PA01
gccgaagccgacgccga

SEQ ID NO: 1425568 - RNA, 19 nt, Pseudomonas aeruginosa PA01
gccgaagcgugggcggccg

SEQ ID NO: 1425569 - RNA, 21 nt, Pseudomonas aeruginosa PA01
gccgaagcgugggcggccggc

SEQ ID NO: 1425570 - RNA, 23 nt, Pseudomonas aeruginosa PA01
gccgaagcgugggcggccggcca

SEQ ID NO: 1425571 - RNA, 18 nt, Pseudomonas aeruginosa PA01
gccgaagaccaccauggu

SEQ ID NO: 1425572 - RNA, 17 nt, Pseudomonas aeruginosa PA01
gccgaagaacucggcgc

SEQ ID NO: 1425573 - RNA, 20 nt, Pseudomonas aeruginosa PA01
gccgaagaacucggcgcugc

SEQ ID NO: 1425574 - RNA, 21 nt, Pseudomonas aeruginosa PA01
gccgaagaacucggcgcugcc

SEQ ID NO: 1425575 - RNA, 17 nt, Pseudomonas aeruginosa PA01
gccgaagaacaccacgc

SEQ ID NO: 1425576 - RNA, 17 nt, Pseudomonas aeruginosa PA01
gccgaagacgccugucg

SEQ ID NO: 1425577 - RNA, 19 nt, Pseudomonas aeruginosa PA01
gccgaagauccgcuccagg

SEQ ID NO: 1425578 - RNA, 20 nt, Pseudomonas aeruginosa PA01
gccgaagauccgcuccaggc

SEQ ID NO: 1425579 - RNA, 21 nt, Pseudomonas aeruginosa PA01
gccgaagauccgcuccaggcu

SEQ ID NO: 1425580 - RNA, 20 nt, Pseudomonas aeruginosa PA01
gccgaagaucgacaggccgc

SEQ ID NO: 1425581 - RNA, 15 nt, Pseudomonas aeruginosa PA01
gccgaagaggcccuc

SEQ ID NO: 1425582 - RNA, 19 nt, Pseudomonas aeruginosa PA01
gccgaagaggcccucggcg

SEQ ID NO: 1425583 - RNA, 22 nt, Pseudomonas aeruginosa PA01
gccgaagaggcccucggcgccg

SEQ ID NO: 1425584 - RNA, 13 nt, Pseudomonas aeruginosa PA01
gccgaacaugccg

SEQ ID NO: 1425585 - RNA, 17 nt, Pseudomonas aeruginosa PA01
gccgaacaugccgaaga

SEQ ID NO: 1425586 - RNA, 19 nt, Pseudomonas aeruginosa PA01
gccgaacaugccgaagagc

SEQ ID NO: 1425587 - RNA, 13 nt, Pseudomonas aeruginosa PA01
gccgaaccggggc

SEQ ID NO: 1425588 - RNA, 23 nt, Pseudomonas aeruginosa PA01
gccgaacagcagggaggcgcaca

SEQ ID NO: 1425589 - RNA, 20 nt, Pseudomonas aeruginosa PA01
gccgaacaggaucuccucgg

SEQ ID NO: 1425590 - RNA, 13 nt, Pseudomonas aeruginosa PA01
gccgaacagcagg

SEQ ID NO: 1425591 - RNA, 15 nt, Pseudomonas aeruginosa PA01
gccgaacaggcgucc

SEQ ID NO: 1425592 - RNA, 13 nt, Pseudomonas aeruginosa PA01
gccgaacagggcg

SEQ ID NO: 1425593 - RNA, 14 nt, Pseudomonas aeruginosa PA01
gccgaacagggcga

SEQ ID NO: 1425594 - RNA, 17 nt, Pseudomonas aeruginosa PA01
gccgaacagggcgagca

SEQ ID NO: 1425595 - RNA, 23 nt, Pseudomonas aeruginosa PA01
gccgaacagggcgagcagggcgc

SEQ ID NO: 1425596 - RNA, 20 nt, Pseudomonas aeruginosa PA01
gccgaaaugcugcaggccga

SEQ ID NO: 1425597 - RNA, 22 nt, Pseudomonas aeruginosa PA01
gccgaaauggcgguggccgugg

SEQ ID NO: 1425598 - RNA, 15 nt, Pseudomonas aeruginosa PA01
gccgaaauugaccag

SEQ ID NO: 1425599 - RNA, 12 nt, Pseudomonas aeruginosa PA01
gccgaacagcaa

SEQ ID NO: 1425600 - RNA, 14 nt, Pseudomonas aeruginosa PA01
gccgaacagcaaca

SEQ ID NO: 1425601 - RNA, 22 nt, Pseudomonas aeruginosa PA01
gccgaacaccugcaucaccagg

SEQ ID NO: 1425602 - RNA, 17 nt, Pseudomonas aeruginosa PA01
gccgaacagacgcaggc

SEQ ID NO: 1425603 - RNA, 17 nt, Pseudomonas aeruginosa PA01
gcccuuuuucgucgcca

SEQ ID NO: 1425604 - RNA, 18 nt, Pseudomonas aeruginosa PA01
gccgaaagcacugcggcg

SEQ ID NO: 1425605 - RNA, 21 nt, Pseudomonas aeruginosa PA01
gccgaaaucgaugucgcggcg

SEQ ID NO: 1425606 - RNA, 18 nt, Pseudomonas aeruginosa PA01
gccgaaauagcgcgccca

SEQ ID NO: 1425607 - RNA, 15 nt, Pseudomonas aeruginosa PA01
gccccagucccuuca

SEQ ID NO: 1425608 - RNA, 15 nt, Pseudomonas aeruginosa PA01
gccccaguccucgua

SEQ ID NO: 1425609 - RNA, 13 nt, Pseudomonas aeruginosa PA01
gcccccgccgcug

SEQ ID NO: 1425610 - RNA, 15 nt, Pseudomonas aeruginosa PA01
gcccccgccggccgg

SEQ ID NO: 1425611 - RNA, 23 nt, Pseudomonas aeruginosa PA01
gccccgacugucgugccuccagc

SEQ ID NO: 1425612 - RNA, 18 nt, Pseudomonas aeruginosa PA01
gccccgagaaaacccugg

SEQ ID NO: 1425613 - RNA, 14 nt, Pseudomonas aeruginosa PA01
gccccgagcgggcc

SEQ ID NO: 1425614 - RNA, 16 nt, Pseudomonas aeruginosa PA01
gccccgagcgggccga

SEQ ID NO: 1425615 - RNA, 14 nt, Pseudomonas aeruginosa PA01
gccccgaucgccuc

SEQ ID NO: 1425616 - RNA, 18 nt, Pseudomonas aeruginosa PA01
gccccgaucgccucggcc

SEQ ID NO: 1425617 - RNA, 16 nt, Pseudomonas aeruginosa PA01
gccccgaggccagcag

SEQ ID NO: 1425618 - RNA, 21 nt, Pseudomonas aeruginosa PA01
gccccgaggccagcaggccgu

SEQ ID NO: 1425619 - RNA, 13 nt, Pseudomonas aeruginosa PA01
gccccgcagccgc

SEQ ID NO: 1425620 - RNA, 13 nt, Pseudomonas aeruginosa PA01
gccccgcaccagc

SEQ ID NO: 1425621 - RNA, 16 nt, Pseudomonas aeruginosa PA01
gccccgcaccagccag

SEQ ID NO: 1425622 - RNA, 13 nt, Pseudomonas aeruginosa PA01
gccccagggccgg

SEQ ID NO: 1425623 - RNA, 16 nt, Pseudomonas aeruginosa PA01
gccccagggccggcgc

SEQ ID NO: 1425624 - RNA, 17 nt, Pseudomonas aeruginosa PA01
gccccagggccggcgcc

SEQ ID NO: 1425625 - RNA, 18 nt, Pseudomonas aeruginosa PA01
gccccagggccggcgccc

SEQ ID NO: 1425626 - RNA, 21 nt, Pseudomonas aeruginosa PA01
gccccagggccggcgcccuuc

SEQ ID NO: 1425627 - RNA, 18 nt, Pseudomonas aeruginosa PA01
gccccagggaaucgucac

SEQ ID NO: 1425628 - RNA, 19 nt, Pseudomonas aeruginosa PA01
gccccagggaaucgucacg

SEQ ID NO: 1425629 - RNA, 15 nt, Pseudomonas aeruginosa PA01
gccccagcaucgccg

SEQ ID NO: 1425630 - RNA, 15 nt, Pseudomonas aeruginosa PA01
gccccaggccgccgc

SEQ ID NO: 1425631 - RNA, 18 nt, Pseudomonas aeruginosa PA01
gccccaggccgccgccug

SEQ ID NO: 1425632 - RNA, 13 nt, Pseudomonas aeruginosa PA01
gccccaggcgagu

SEQ ID NO: 1425633 - RNA, 14 nt, Pseudomonas aeruginosa PA01
gccccaggcgccca

SEQ ID NO: 1425634 - RNA, 17 nt, Pseudomonas aeruginosa PA01
gccccaggcgcccaggc

SEQ ID NO: 1425635 - RNA, 15 nt, Pseudomonas aeruginosa PA01
gccccaggcgggcac

SEQ ID NO: 1425636 - RNA, 17 nt, Pseudomonas aeruginosa PA01
gccccaggcugcccagg

SEQ ID NO: 1425637 - RNA, 21 nt, Pseudomonas aeruginosa PA01
gccccagcacgccgagcaacg

SEQ ID NO: 1425638 - RNA, 18 nt, Pseudomonas aeruginosa PA01
gccccagagcccgccgaa

SEQ ID NO: 1425639 - RNA, 20 nt, Pseudomonas aeruginosa PA01
gccccagaucgccagcgcca

SEQ ID NO: 1425640 - RNA, 23 nt, Pseudomonas aeruginosa PA01
gccccagauggguaagguugccg

SEQ ID NO: 1425641 - RNA, 13 nt, Pseudomonas aeruginosa PA01
gccccagcaacug

SEQ ID NO: 1425642 - RNA, 14 nt, Pseudomonas aeruginosa PA01
gccccaccuggcga

SEQ ID NO: 1425643 - RNA, 12 nt, Pseudomonas aeruginosa PA01
gccccacggcgc

SEQ ID NO: 1425644 - RNA, 21 nt, Pseudomonas aeruginosa PA01
gccccacggcgcggccgugcc

SEQ ID NO: 1425645 - RNA, 21 nt, Pseudomonas aeruginosa PA01
gccccacgggucgucgcccug

SEQ ID NO: 1425646 - RNA, 20 nt, Pseudomonas aeruginosa PA01
gccccacuuccggcccggcc

SEQ ID NO: 1425647 - RNA, 22 nt, Pseudomonas aeruginosa PA01
gccccagacccaggugcgcagg

SEQ ID NO: 1425648 - RNA, 19 nt, Pseudomonas aeruginosa PA01
gcccaugauggucggcacg

SEQ ID NO: 1425649 - RNA, 16 nt, Pseudomonas aeruginosa PA01
gcccaucuucaggccg

SEQ ID NO: 1425650 - RNA, 18 nt, Pseudomonas aeruginosa PA01
gcccaugaaaaagccccg

SEQ ID NO: 1425651 - RNA, 19 nt, Pseudomonas aeruginosa PA01
gcccaugaaaaagccccgc

SEQ ID NO: 1425652 - RNA, 21 nt, Pseudomonas aeruginosa PA01
gcccaugaaaaauggccgcuu

SEQ ID NO: 1425653 - RNA, 19 nt, Pseudomonas aeruginosa PA01
gcccaucucgguguccacc

SEQ ID NO: 1425654 - RNA, 23 nt, Pseudomonas aeruginosa PA01
gcccaucucgguguccaccacca

SEQ ID NO: 1425655 - RNA, 21 nt, Pseudomonas aeruginosa PA01
gcccaucgccaccagcaggaa

SEQ ID NO: 1425656 - RNA, 14 nt, Pseudomonas aeruginosa PA01
gcccaucggcgucg

SEQ ID NO: 1425657 - RNA, 18 nt, Pseudomonas aeruginosa PA01
gcccaucggcgucggcug

SEQ ID NO: 1425658 - RNA, 23 nt, Pseudomonas aeruginosa PA01
gcccaucggcgucggcuggucga

SEQ ID NO: 1425659 - RNA, 15 nt, Pseudomonas aeruginosa PA01
gcccaugccuccgac

SEQ ID NO: 1425660 - RNA, 20 nt, Pseudomonas aeruginosa PA01
gcccaugccuugcagcgcca

SEQ ID NO: 1425661 - RNA, 14 nt, Pseudomonas aeruginosa PA01
gcccaugcggaucg

SEQ ID NO: 1425662 - RNA, 13 nt, Pseudomonas aeruginosa PA01
gcccaugcgcggc

SEQ ID NO: 1425663 - RNA, 16 nt, Pseudomonas aeruginosa PA01
gcccaugcgcggcgag

SEQ ID NO: 1425664 - RNA, 14 nt, Pseudomonas aeruginosa PA01
gcccaggcccagcg

SEQ ID NO: 1425665 - RNA, 16 nt, Pseudomonas aeruginosa PA01
gcccaggcccagcgcg

SEQ ID NO: 1425666 - RNA, 20 nt, Pseudomonas aeruginosa PA01
gcccaggccgcuggcggcga

SEQ ID NO: 1425667 - RNA, 20 nt, Pseudomonas aeruginosa PA01
gcccaggccgggucgcagcc

SEQ ID NO: 1425668 - RNA, 22 nt, Pseudomonas aeruginosa PA01
gcccaggccgggucgcagccgg

SEQ ID NO: 1425669 - RNA, 17 nt, Pseudomonas aeruginosa PA01
gcccaggcgccgcucga

SEQ ID NO: 1425670 - RNA, 21 nt, Pseudomonas aeruginosa PA01
gcccaggcgccgcucgaugcc

SEQ ID NO: 1425671 - RNA, 17 nt, Pseudomonas aeruginosa PA01
gcccagguacugggcga

SEQ ID NO: 1425672 - RNA, 18 nt, Pseudomonas aeruginosa PA01
gcccagguacugggcgau

SEQ ID NO: 1425673 - RNA, 17 nt, Pseudomonas aeruginosa PA01
gcccagguagccggcga

SEQ ID NO: 1425674 - RNA, 18 nt, Pseudomonas aeruginosa PA01
gcccagguagccggcgag

SEQ ID NO: 1425675 - RNA, 14 nt, Pseudomonas aeruginosa PA01
gcccaggcgccgcu

SEQ ID NO: 1425676 - RNA, 13 nt, Pseudomonas aeruginosa PA01
gcccaggcgcacc

SEQ ID NO: 1425677 - RNA, 20 nt, Pseudomonas aeruginosa PA01
gcccaggcgcaccuccucgg

SEQ ID NO: 1425678 - RNA, 17 nt, Pseudomonas aeruginosa PA01
gcccagcucguccaggc

SEQ ID NO: 1425679 - RNA, 19 nt, Pseudomonas aeruginosa PA01
gcccagcucguccaggcaa

SEQ ID NO: 1425680 - RNA, 14 nt, Pseudomonas aeruginosa PA01
gcccagcucgccgc

SEQ ID NO: 1425681 - RNA, 15 nt, Pseudomonas aeruginosa PA01
gcccagcucgccgcu

SEQ ID NO: 1425682 - RNA, 15 nt, Pseudomonas aeruginosa PA01
gcccagcguucggcg

SEQ ID NO: 1425683 - RNA, 18 nt, Pseudomonas aeruginosa PA01
gcccagcguucggcgcug

SEQ ID NO: 1425684 - RNA, 22 nt, Pseudomonas aeruginosa PA01
gcccagcguucggcgcuggcgc

SEQ ID NO: 1425685 - RNA, 24 nt, Pseudomonas aeruginosa PA01
gcccagcguucggcgcuggcgcgg

SEQ ID NO: 1425686 - RNA, 18 nt, Pseudomonas aeruginosa PA01
gcccagcgacuccgccag

SEQ ID NO: 1425687 - RNA, 13 nt, Pseudomonas aeruginosa PA01
gcccagcggcugg

SEQ ID NO: 1425688 - RNA, 18 nt, Pseudomonas aeruginosa PA01
gcccagcggcuggcgggc

SEQ ID NO: 1425689 - RNA, 20 nt, Pseudomonas aeruginosa PA01
gcccagcggcuggcgggcga

SEQ ID NO: 1425690 - RNA, 22 nt, Pseudomonas aeruginosa PA01
gcccagccggugaaacggauca

SEQ ID NO: 1425691 - RNA, 20 nt, Pseudomonas aeruginosa PA01
gcccagguagucgcccagcg

SEQ ID NO: 1425692 - RNA, 15 nt, Pseudomonas aeruginosa PA01
gcccagguggcaggc

SEQ ID NO: 1425693 - RNA, 19 nt, Pseudomonas aeruginosa PA01
gcccagguugaugccguug

SEQ ID NO: 1425694 - RNA, 20 nt, Pseudomonas aeruginosa PA01
gcccaggugcgccgagcgcu

SEQ ID NO: 1425695 - RNA, 23 nt, Pseudomonas aeruginosa PA01
gcccaggugcgccgagcgcucgc

SEQ ID NO: 1425696 - RNA, 16 nt, Pseudomonas aeruginosa PA01
gcccaguacccgcugg

SEQ ID NO: 1425697 - RNA, 17 nt, Pseudomonas aeruginosa PA01
gcccaguaccgccacgu

SEQ ID NO: 1425698 - RNA, 16 nt, Pseudomonas aeruginosa PA01
gcccaguucuucgccg

SEQ ID NO: 1425699 - RNA, 18 nt, Pseudomonas aeruginosa PA01
gcccaguucuucgccgcc

SEQ ID NO: 1425700 - RNA, 20 nt, Pseudomonas aeruginosa PA01
gcccaguucuucgccgcccg

SEQ ID NO: 1425701 - RNA, 13 nt, Pseudomonas aeruginosa PA01
gcccaguucgcug

SEQ ID NO: 1425702 - RNA, 20 nt, Pseudomonas aeruginosa PA01
gcccaguucgcugccgccgc

SEQ ID NO: 1425703 - RNA, 22 nt, Pseudomonas aeruginosa PA01
gcccaguucgcugccgccgcgc

SEQ ID NO: 1425704 - RNA, 14 nt, Pseudomonas aeruginosa PA01
gcccauacaccagg

SEQ ID NO: 1425705 - RNA, 21 nt, Pseudomonas aeruginosa PA01
gcccauacaccaggccggcgg

SEQ ID NO: 1425706 - RNA, 15 nt, Pseudomonas aeruginosa PA01
gcccaguugcccggc

SEQ ID NO: 1425707 - RNA, 16 nt, Pseudomonas aeruginosa PA01
gcccaguugcccggcc

SEQ ID NO: 1425708 - RNA, 19 nt, Pseudomonas aeruginosa PA01
gcccaguugcccggccugg

SEQ ID NO: 1425709 - RNA, 20 nt, Pseudomonas aeruginosa PA01
gcccaguugcccggccuggu

SEQ ID NO: 1425710 - RNA, 16 nt, Pseudomonas aeruginosa PA01
gcccaguugcgccgcc

SEQ ID NO: 1425711 - RNA, 17 nt, Pseudomonas aeruginosa PA01
gcccaguugcgccgccu

SEQ ID NO: 1425712 - RNA, 18 nt, Pseudomonas aeruginosa PA01
gcccaguugcgccgccug

SEQ ID NO: 1425713 - RNA, 15 nt, Pseudomonas aeruginosa PA01
gcccaguugcgcggc

SEQ ID NO: 1425714 - RNA, 19 nt, Pseudomonas aeruginosa PA01
gcccaguugcgcggcgagu

SEQ ID NO: 1425715 - RNA, 17 nt, Pseudomonas aeruginosa PA01
gcccaucgccagggucu

SEQ ID NO: 1425716 - RNA, 14 nt, Pseudomonas aeruginosa PA01
gcccauccgccgca

SEQ ID NO: 1425717 - RNA, 14 nt, Pseudomonas aeruginosa PA01
gcccauccgcucgg

SEQ ID NO: 1425718 - RNA, 17 nt, Pseudomonas aeruginosa PA01
gcccauccgcucggcga

SEQ ID NO: 1425719 - RNA, 18 nt, Pseudomonas aeruginosa PA01
gcccauccgcucggcgag

SEQ ID NO: 1425720 - RNA, 18 nt, Pseudomonas aeruginosa PA01
gcccaucgacugcaacag

SEQ ID NO: 1425721 - RNA, 14 nt, Pseudomonas aeruginosa PA01
gcccaucaggcuca

SEQ ID NO: 1425722 - RNA, 17 nt, Pseudomonas aeruginosa PA01
gcccaucaacgagccga

SEQ ID NO: 1425723 - RNA, 20 nt, Pseudomonas aeruginosa PA01
gcccaucaacgagccgagca

SEQ ID NO: 1425724 - RNA, 19 nt, Pseudomonas aeruginosa PA01
gcccaucaggaugcggugc

SEQ ID NO: 1425725 - RNA, 12 nt, Pseudomonas aeruginosa PA01
gcccgccggcga

SEQ ID NO: 1425726 - RNA, 14 nt, Pseudomonas aeruginosa PA01
gcccgccggcgaac

SEQ ID NO: 1425727 - RNA, 13 nt, Pseudomonas aeruginosa PA01
gcccgccggcgau

SEQ ID NO: 1425728 - RNA, 14 nt, Pseudomonas aeruginosa PA01
gcccgccggcgaug

SEQ ID NO: 1425729 - RNA, 17 nt, Pseudomonas aeruginosa PA01
gcccgccggcgaugcgc

SEQ ID NO: 1425730 - RNA, 14 nt, Pseudomonas aeruginosa PA01
gcccgccggcgccc

SEQ ID NO: 1425731 - RNA, 17 nt, Pseudomonas aeruginosa PA01
gcccgccggcgcccugg

SEQ ID NO: 1425732 - RNA, 20 nt, Pseudomonas aeruginosa PA01
gcccgccggcgcccugggcg

SEQ ID NO: 1425733 - RNA, 15 nt, Pseudomonas aeruginosa PA01
gcccgccggucaacc

SEQ ID NO: 1425734 - RNA, 22 nt, Pseudomonas aeruginosa PA01
gcccgccggucaaccgcgggcg

SEQ ID NO: 1425735 - RNA, 12 nt, Pseudomonas aeruginosa PA01
gcccgccggcgu

SEQ ID NO: 1425736 - RNA, 15 nt, Pseudomonas aeruginosa PA01
gcccgccggcgugcc

SEQ ID NO: 1425737 - RNA, 18 nt, Pseudomonas aeruginosa PA01
gcccgccggcgugccgac

SEQ ID NO: 1425738 - RNA, 19 nt, Pseudomonas aeruginosa PA01
gcccgccggcgugccgacc

SEQ ID NO: 1425739 - RNA, 20 nt, Pseudomonas aeruginosa PA01
gcccgccgucauggcgggcg

SEQ ID NO: 1425740 - RNA, 23 nt, Pseudomonas aeruginosa PA01
gcccgccggcgcgcccaggccca

SEQ ID NO: 1425741 - RNA, 14 nt, Pseudomonas aeruginosa PA01
gcccgccgucgccc

SEQ ID NO: 1425742 - RNA, 16 nt, Pseudomonas aeruginosa PA01
gcccgccguccuccag

SEQ ID NO: 1425743 - RNA, 20 nt, Pseudomonas aeruginosa PA01
gcccgccguccuccagcaag

SEQ ID NO: 1425744 - RNA, 16 nt, Pseudomonas aeruginosa PA01
gcccgccucaggccgg

SEQ ID NO: 1425745 - RNA, 21 nt, Pseudomonas aeruginosa PA01
gcccgccgugcgcuccgccag

SEQ ID NO: 1425746 - RNA, 12 nt, Pseudomonas aeruginosa PA01
gcccgccgugcg

SEQ ID NO: 1425747 - RNA, 13 nt, Pseudomonas aeruginosa PA01
gcccgccgugcgc

SEQ ID NO: 1425748 - RNA, 16 nt, Pseudomonas aeruginosa PA01
gcccgccgcggcgagc

SEQ ID NO: 1425749 - RNA, 14 nt, Pseudomonas aeruginosa PA01
gcccgccgcggcga

SEQ ID NO: 1425750 - RNA, 16 nt, Pseudomonas aeruginosa PA01
gcccgccgcgagcgcc

SEQ ID NO: 1425751 - RNA, 18 nt, Pseudomonas aeruginosa PA01
gcccgccgcgagcgccgc

SEQ ID NO: 1425752 - RNA, 19 nt, Pseudomonas aeruginosa PA01
gcccgccagcaggcgccgg

SEQ ID NO: 1425753 - RNA, 22 nt, Pseudomonas aeruginosa PA01
gcccgccagcaggcgccggcgg

SEQ ID NO: 1425754 - RNA, 14 nt, Pseudomonas aeruginosa PA01
gcccgccaggucga

SEQ ID NO: 1425755 - RNA, 19 nt, Pseudomonas aeruginosa PA01
gcccgcaugccagggccuu

SEQ ID NO: 1425756 - RNA, 14 nt, Pseudomonas aeruginosa PA01
gcccgaucgccucg

SEQ ID NO: 1425757 - RNA, 17 nt, Pseudomonas aeruginosa PA01
gcccgaucgccucgucg

SEQ ID NO: 1425758 - RNA, 10 nt, Pseudomonas aeruginosa PA01
gcccgcacca

SEQ ID NO: 1425759 - RNA, 18 nt, Pseudomonas aeruginosa PA01
gcccgacgaagacgcuca

SEQ ID NO: 1425760 - RNA, 21 nt, Pseudomonas aeruginosa PA01
gcccgacgaaguugcaggcca

SEQ ID NO: 1425761 - RNA, 22 nt, Pseudomonas aeruginosa PA01
gcccgacgaaguugcaggccag

SEQ ID NO: 1425762 - RNA, 15 nt, Pseudomonas aeruginosa PA01
gcccgaccgguucca

SEQ ID NO: 1425763 - RNA, 18 nt, Pseudomonas aeruginosa PA01
gcccgaccgguuccagcg

SEQ ID NO: 1425764 - RNA, 21 nt, Pseudomonas aeruginosa PA01
gcccgaccgguuccagcggcc

SEQ ID NO: 1425765 - RNA, 23 nt, Pseudomonas aeruginosa PA01
gcccgaccgguuccagcggccgc

SEQ ID NO: 1425766 - RNA, 20 nt, Pseudomonas aeruginosa PA01
gccccuggcucaggcacucg

SEQ ID NO: 1425767 - RNA, 13 nt, Pseudomonas aeruginosa PA01
gccccugggccgg

SEQ ID NO: 1425768 - RNA, 12 nt, Pseudomonas aeruginosa PA01
gcccgacgccgc

SEQ ID NO: 1425769 - RNA, 15 nt, Pseudomonas aeruginosa PA01
gcccgacgccgcccg

SEQ ID NO: 1425770 - RNA, 23 nt, Pseudomonas aeruginosa PA01
gcccgacggcuugaucacgccga

SEQ ID NO: 1425771 - RNA, 22 nt, Pseudomonas aeruginosa PA01
gcccgacugcgaaaaagaacgc

SEQ ID NO: 1425772 - RNA, 19 nt, Pseudomonas aeruginosa PA01
gcccgagaagccggggcag

SEQ ID NO: 1425773 - RNA, 13 nt, Pseudomonas aeruginosa PA01
gcccgagcaggcu

SEQ ID NO: 1425774 - RNA, 18 nt, Pseudomonas aeruginosa PA01
gcccgagcaggcugccga

SEQ ID NO: 1425775 - RNA, 14 nt, Pseudomonas aeruginosa PA01
gcccgagugccggc

SEQ ID NO: 1425776 - RNA, 16 nt, Pseudomonas aeruginosa PA01
gcccgagugccggcgc

SEQ ID NO: 1425777 - RNA, 17 nt, Pseudomonas aeruginosa PA01
gcccgagugccggcgcg

SEQ ID NO: 1425778 - RNA, 18 nt, Pseudomonas aeruginosa PA01
gccccgccgaggaagccg

SEQ ID NO: 1425779 - RNA, 21 nt, Pseudomonas aeruginosa PA01
gccccgccgaggaagccgacc

SEQ ID NO: 1425780 - RNA, 14 nt, Pseudomonas aeruginosa PA01
gccccgccgacugg

SEQ ID NO: 1425781 - RNA, 23 nt, Pseudomonas aeruginosa PA01
gccccgccgacuggcagcgauaa

SEQ ID NO: 1425782 - RNA, 12 nt, Pseudomonas aeruginosa PA01
gccccgccagga

SEQ ID NO: 1425783 - RNA, 15 nt, Pseudomonas aeruginosa PA01
gccccgccaggagcc

SEQ ID NO: 1425784 - RNA, 16 nt, Pseudomonas aeruginosa PA01
gccccgccaaggcggg

SEQ ID NO: 1425785 - RNA, 14 nt, Pseudomonas aeruginosa PA01
gccccggucucgcg

SEQ ID NO: 1425786 - RNA, 15 nt, Pseudomonas aeruginosa PA01
gccccggucucgcgc

SEQ ID NO: 1425787 - RNA, 16 nt, Pseudomonas aeruginosa PA01
gccccggucucgcgca

SEQ ID NO: 1425788 - RNA, 17 nt, Pseudomonas aeruginosa PA01
gccccggucucgcgcag

SEQ ID NO: 1425789 - RNA, 19 nt, Pseudomonas aeruginosa PA01
gccccggucucgcgcagcg

SEQ ID NO: 1425790 - RNA, 22 nt, Pseudomonas aeruginosa PA01
gccccggugauguaggccgcuu

SEQ ID NO: 1425791 - RNA, 12 nt, Pseudomonas aeruginosa PA01
gccccgccgcca

SEQ ID NO: 1425792 - RNA, 18 nt, Pseudomonas aeruginosa PA01
gccccgguuacucgccgg

SEQ ID NO: 1425793 - RNA, 21 nt, Pseudomonas aeruginosa PA01
gccccgguuacucgccggcau

SEQ ID NO: 1425794 - RNA, 15 nt, Pseudomonas aeruginosa PA01
gccccgguuggcgcc

SEQ ID NO: 1425795 - RNA, 19 nt, Pseudomonas aeruginosa PA01
gccccgucggcccuccccu

SEQ ID NO: 1425796 - RNA, 17 nt, Pseudomonas aeruginosa PA01
gccccguuaaugccggu

SEQ ID NO: 1425797 - RNA, 18 nt, Pseudomonas aeruginosa PA01
gccccguuaaugccggug

SEQ ID NO: 1425798 - RNA, 15 nt, Pseudomonas aeruginosa PA01
gccccguggcgggcc

SEQ ID NO: 1425799 - RNA, 17 nt, Pseudomonas aeruginosa PA01
gccccguggcgggccag

SEQ ID NO: 1425800 - RNA, 18 nt, Pseudomonas aeruginosa PA01
gccccguggcgggccagc

SEQ ID NO: 1425801 - RNA, 18 nt, Pseudomonas aeruginosa PA01
gccccucguggcgcgauc

SEQ ID NO: 1425802 - RNA, 22 nt, Pseudomonas aeruginosa PA01
gccccucuuccacgcgccgauc

SEQ ID NO: 1425803 - RNA, 12 nt, Pseudomonas aeruginosa PA01
gccccugccgcg

SEQ ID NO: 1425804 - RNA, 15 nt, Pseudomonas aeruginosa PA01
gccccugcgaccgug

SEQ ID NO: 1425805 - RNA, 23 nt, Pseudomonas aeruginosa PA01
gccccugcgaccgugaggcgcag

SEQ ID NO: 1425806 - RNA, 21 nt, Pseudomonas aeruginosa PA01
gccccugcgcccagggacgcg

SEQ ID NO: 1425807 - RNA, 19 nt, Pseudomonas aeruginosa PA01
gccccugcggcgccgguug

SEQ ID NO: 1425808 - RNA, 14 nt, Pseudomonas aeruginosa PA01
gccccugcuccucg

SEQ ID NO: 1425809 - RNA, 17 nt, Pseudomonas aeruginosa PA01
gccccugcuccucgccg

SEQ ID NO: 1425810 - RNA, 12 nt, Pseudomonas aeruginosa PA01
gccccuggcgcu

SEQ ID NO: 1425811 - RNA, 16 nt, Pseudomonas aeruginosa PA01
gccccuggcgcugggc

SEQ ID NO: 1425812 - RNA, 17 nt, Pseudomonas aeruginosa PA01
gccccuggcgcugggcc

SEQ ID NO: 1425813 - RNA, 16 nt, Pseudomonas aeruginosa PA01
gccauacucggacggc

SEQ ID NO: 1425814 - RNA, 20 nt, Pseudomonas aeruginosa PA01
gccauacucggacggcucgc

SEQ ID NO: 1425815 - RNA, 21 nt, Pseudomonas aeruginosa PA01
gccauacucggacggcucgcg

SEQ ID NO: 1425816 - RNA, 22 nt, Pseudomonas aeruginosa PA01
gccauacucggacggcucgcgc

SEQ ID NO: 1425817 - RNA, 16 nt, Pseudomonas aeruginosa PA01
gccauccgcgccgacc

SEQ ID NO: 1425818 - RNA, 19 nt, Pseudomonas aeruginosa PA01
gccauccgcgccgaccagc

SEQ ID NO: 1425819 - RNA, 14 nt, Pseudomonas aeruginosa PA01
gccauacagcgccc

SEQ ID NO: 1425820 - RNA, 17 nt, Pseudomonas aeruginosa PA01
gccauccggggugggca

SEQ ID NO: 1425821 - RNA, 15 nt, Pseudomonas aeruginosa PA01
gccauccuccagcac

SEQ ID NO: 1425822 - RNA, 16 nt, Pseudomonas aeruginosa PA01
gccauccuccgaggcc

SEQ ID NO: 1425823 - RNA, 17 nt, Pseudomonas aeruginosa PA01
gccauccuccgaggcca

SEQ ID NO: 1425824 - RNA, 16 nt, Pseudomonas aeruginosa PA01
gccauccuucggcgug

SEQ ID NO: 1425825 - RNA, 17 nt, Pseudomonas aeruginosa PA01
gccaucgaaaucgccca

SEQ ID NO: 1425826 - RNA, 20 nt, Pseudomonas aeruginosa PA01
gccaucgaaaucgcccacca

SEQ ID NO: 1425827 - RNA, 22 nt, Pseudomonas aeruginosa PA01
gccaucgaaaucgcccaccagg

SEQ ID NO: 1425828 - RNA, 14 nt, Pseudomonas aeruginosa PA01
gccauccuggccgg

SEQ ID NO: 1425829 - RNA, 18 nt, Pseudomonas aeruginosa PA01
gccauccuggccggucgu

SEQ ID NO: 1425830 - RNA, 13 nt, Pseudomonas aeruginosa PA01
gccaucgaccagg

SEQ ID NO: 1425831 - RNA, 14 nt, Pseudomonas aeruginosa PA01
gccaucgaccagga

SEQ ID NO: 1425832 - RNA, 20 nt, Pseudomonas aeruginosa PA01
gccaucgaccaggaauuccu

SEQ ID NO: 1425833 - RNA, 22 nt, Pseudomonas aeruginosa PA01
gccaucgaccaggaauuccugg

SEQ ID NO: 1425834 - RNA, 15 nt, Pseudomonas aeruginosa PA01
gccaucgagcgcucc

SEQ ID NO: 1425835 - RNA, 13 nt, Pseudomonas aeruginosa PA01
gccauccuggccg

SEQ ID NO: 1425836 - RNA, 18 nt, Pseudomonas aeruginosa PA01
gccaucgaggccaggccg

SEQ ID NO: 1425837 - RNA, 19 nt, Pseudomonas aeruginosa PA01
gccaucgaggccaggccga

SEQ ID NO: 1425838 - RNA, 20 nt, Pseudomonas aeruginosa PA01
gccaucgaggccaggccgag

SEQ ID NO: 1425839 - RNA, 21 nt, Pseudomonas aeruginosa PA01
gccaucgauggucacuggcga

SEQ ID NO: 1425840 - RNA, 17 nt, Pseudomonas aeruginosa PA01
gccaucgauggucaggc

SEQ ID NO: 1425841 - RNA, 13 nt, Pseudomonas aeruginosa PA01
gccaucgaucagc

SEQ ID NO: 1425842 - RNA, 14 nt, Pseudomonas aeruginosa PA01
gccaucgaucagca

SEQ ID NO: 1425843 - RNA, 16 nt, Pseudomonas aeruginosa PA01
gccaucgaucagcagc

SEQ ID NO: 1425844 - RNA, 17 nt, Pseudomonas aeruginosa PA01
gccaucgaucagcagcg

SEQ ID NO: 1425845 - RNA, 20 nt, Pseudomonas aeruginosa PA01
gccaucgaucagcagcgcca

SEQ ID NO: 1425846 - RNA, 19 nt, Pseudomonas aeruginosa PA01
gccaucggucgcgccccca

SEQ ID NO: 1425847 - RNA, 16 nt, Pseudomonas aeruginosa PA01
gccaugccgccgacgc

SEQ ID NO: 1425848 - RNA, 17 nt, Pseudomonas aeruginosa PA01
gccaugauccggugcag

SEQ ID NO: 1425849 - RNA, 14 nt, Pseudomonas aeruginosa PA01
gccaugccggccag

SEQ ID NO: 1425850 - RNA, 17 nt, Pseudomonas aeruginosa PA01
gccaugccggccaggaa

SEQ ID NO: 1425851 - RNA, 15 nt, Pseudomonas aeruginosa PA01
gccaugccggcgccg

SEQ ID NO: 1425852 - RNA, 21 nt, Pseudomonas aeruginosa PA01
gccaugccguucaggccggcg

SEQ ID NO: 1425853 - RNA, 22 nt, Pseudomonas aeruginosa PA01
gccaugccguucaggccggcgc

SEQ ID NO: 1425854 - RNA, 15 nt, Pseudomonas aeruginosa PA01
gccaugcaggccagg

SEQ ID NO: 1425855 - RNA, 16 nt, Pseudomonas aeruginosa PA01
gccaugcaggccaggg

SEQ ID NO: 1425856 - RNA, 18 nt, Pseudomonas aeruginosa PA01
gccaugcccagacgccgc

SEQ ID NO: 1425857 - RNA, 19 nt, Pseudomonas aeruginosa PA01
gccaugcccagacgccgcu

SEQ ID NO: 1425858 - RNA, 15 nt, Pseudomonas aeruginosa PA01
gccaugcccggcugg

SEQ ID NO: 1425859 - RNA, 17 nt, Pseudomonas aeruginosa PA01
gccaugcccggcuggcg

SEQ ID NO: 1425860 - RNA, 18 nt, Pseudomonas aeruginosa PA01
gccaugcaagaacgccga

SEQ ID NO: 1425861 - RNA, 14 nt, Pseudomonas aeruginosa PA01
gccaggaccagggc

SEQ ID NO: 1425862 - RNA, 16 nt, Pseudomonas aeruginosa PA01
gccaggaccagggcgg

SEQ ID NO: 1425863 - RNA, 15 nt, Pseudomonas aeruginosa PA01
gccaggacucgccau

SEQ ID NO: 1425864 - RNA, 17 nt, Pseudomonas aeruginosa PA01
gccaggacucgccaucg

SEQ ID NO: 1425865 - RNA, 18 nt, Pseudomonas aeruginosa PA01
gccaggaccuccugcaca

SEQ ID NO: 1425866 - RNA, 18 nt, Pseudomonas aeruginosa PA01
gccaggaccucgaagcug

SEQ ID NO: 1425867 - RNA, 22 nt, Pseudomonas aeruginosa PA01
gccaggaccucgaagcuggcca

SEQ ID NO: 1425868 - RNA, 18 nt, Pseudomonas aeruginosa PA01
gccaggacgccaccaggc

SEQ ID NO: 1425869 - RNA, 19 nt, Pseudomonas aeruginosa PA01
gccaggacgccaccaggcc

SEQ ID NO: 1425870 - RNA, 13 nt, Pseudomonas aeruginosa PA01
gccaggacgcugg

SEQ ID NO: 1425871 - RNA, 16 nt, Pseudomonas aeruginosa PA01
gccaggacgcuggcga

SEQ ID NO: 1425872 - RNA, 13 nt, Pseudomonas aeruginosa PA01
gccaggagccuac

SEQ ID NO: 1425873 - RNA, 16 nt, Pseudomonas aeruginosa PA01
gccaggagcuugccga

SEQ ID NO: 1425874 - RNA, 18 nt, Pseudomonas aeruginosa PA01
gccaggaggauucgccag

SEQ ID NO: 1425875 - RNA, 20 nt, Pseudomonas aeruginosa PA01
gccaggaggauucgccagcc

SEQ ID NO: 1425876 - RNA, 21 nt, Pseudomonas aeruginosa PA01
gccagguucuugaugucagcg

SEQ ID NO: 1425877 - RNA, 15 nt, Pseudomonas aeruginosa PA01
gccagguugaccagu

SEQ ID NO: 1425878 - RNA, 14 nt, Pseudomonas aeruginosa PA01
gccaggagaaccug

SEQ ID NO: 1425879 - RNA, 15 nt, Pseudomonas aeruginosa PA01
gccaggagcacgccg

SEQ ID NO: 1425880 - RNA, 19 nt, Pseudomonas aeruginosa PA01
gccaggagcacgccgugca

SEQ ID NO: 1425881 - RNA, 19 nt, Pseudomonas aeruginosa PA01
gccaggagcagggcgccga

SEQ ID NO: 1425882 - RNA, 20 nt, Pseudomonas aeruginosa PA01
gccaggagcagggcgccgau

SEQ ID NO: 1425883 - RNA, 20 nt, Pseudomonas aeruginosa PA01
gccaggagcaucggcgcggc

SEQ ID NO: 1425884 - RNA, 19 nt, Pseudomonas aeruginosa PA01
gccaggacaauggacaagc

SEQ ID NO: 1425885 - RNA, 19 nt, Pseudomonas aeruginosa PA01
gccaggaagagcccgccac

SEQ ID NO: 1425886 - RNA, 19 nt, Pseudomonas aeruginosa PA01
gccaggaacgccucugcgc

SEQ ID NO: 1425887 - RNA, 13 nt, Pseudomonas aeruginosa PA01
gccaggaagccgc

SEQ ID NO: 1425888 - RNA, 18 nt, Pseudomonas aeruginosa PA01
gccaggaagcggcgguac

SEQ ID NO: 1425889 - RNA, 21 nt, Pseudomonas aeruginosa PA01
gccaguacuccgagggccgcg

SEQ ID NO: 1425890 - RNA, 23 nt, Pseudomonas aeruginosa PA01
gccagucggcggucuugaucacg

SEQ ID NO: 1425891 - RNA, 15 nt, Pseudomonas aeruginosa PA01
gccagucgagacgcc

SEQ ID NO: 1425892 - RNA, 18 nt, Pseudomonas aeruginosa PA01
gccagucgagacgccagc

SEQ ID NO: 1425893 - RNA, 22 nt, Pseudomonas aeruginosa PA01
gccagucgagacgccagccgcc

SEQ ID NO: 1425894 - RNA, 17 nt, Pseudomonas aeruginosa PA01
gccagguuggccuggcc

SEQ ID NO: 1425895 - RNA, 23 nt, Pseudomonas aeruginosa PA01
gccagguuggccuggcccggcgc

SEQ ID NO: 1425896 - RNA, 18 nt, Pseudomonas aeruginosa PA01
gccaguaauggggaucgc

SEQ ID NO: 1425897 - RNA, 23 nt, Pseudomonas aeruginosa PA01
gccaguucgucgagcaugccgag

SEQ ID NO: 1425898 - RNA, 15 nt, Pseudomonas aeruginosa PA01
gccaguucgcggcgc

SEQ ID NO: 1425899 - RNA, 16 nt, Pseudomonas aeruginosa PA01
gccaguucgccgguga

SEQ ID NO: 1425900 - RNA, 15 nt, Pseudomonas aeruginosa PA01
gccaguucgcgcagg

SEQ ID NO: 1425901 - RNA, 18 nt, Pseudomonas aeruginosa PA01
gccaguucgcgcaggugc

SEQ ID NO: 1425902 - RNA, 13 nt, Pseudomonas aeruginosa PA01
gccaguuccuucg

SEQ ID NO: 1425903 - RNA, 16 nt, Pseudomonas aeruginosa PA01
gccaguuccuucgccg

SEQ ID NO: 1425904 - RNA, 20 nt, Pseudomonas aeruginosa PA01
gccaguuccuugaggucguc

SEQ ID NO: 1425905 - RNA, 21 nt, Pseudomonas aeruginosa PA01
gccaguuggaaguugccgcca

SEQ ID NO: 1425906 - RNA, 17 nt, Pseudomonas aeruginosa PA01
gccaguuggugcacgcg

SEQ ID NO: 1425907 - RNA, 21 nt, Pseudomonas aeruginosa PA01
gccaguuggugcacgcgccgg

SEQ ID NO: 1425908 - RNA, 18 nt, Pseudomonas aeruginosa PA01
gccaguuguuccggcugg

SEQ ID NO: 1425909 - RNA, 22 nt, Pseudomonas aeruginosa PA01
gccaguuccggggucagcgccu

SEQ ID NO: 1425910 - RNA, 22 nt, Pseudomonas aeruginosa PA01
gccagugccucgcgcguggccg

SEQ ID NO: 1425911 - RNA, 20 nt, Pseudomonas aeruginosa PA01
gccagugcaugcguucgccg

SEQ ID NO: 1425912 - RNA, 18 nt, Pseudomonas aeruginosa PA01
gcccacagugccaggcuc

SEQ ID NO: 1425913 - RNA, 23 nt, Pseudomonas aeruginosa PA01
gcccacagugccaggcucgccgc

SEQ ID NO: 1425914 - RNA, 23 nt, Pseudomonas aeruginosa PA01
gcccacaaagucacugcgggccg

SEQ ID NO: 1425915 - RNA, 13 nt, Pseudomonas aeruginosa PA01
gccauggcgcuga

SEQ ID NO: 1425916 - RNA, 22 nt, Pseudomonas aeruginosa PA01
gccauggcgcugaggaagagca

SEQ ID NO: 1425917 - RNA, 13 nt, Pseudomonas aeruginosa PA01
gccauggcgcugc

SEQ ID NO: 1425918 - RNA, 14 nt, Pseudomonas aeruginosa PA01
gccauggccgagcc

SEQ ID NO: 1425919 - RNA, 20 nt, Pseudomonas aeruginosa PA01
gccauggccgagcccagcgg

SEQ ID NO: 1425920 - RNA, 19 nt, Pseudomonas aeruginosa PA01
gccaugcgcucggggucgu

SEQ ID NO: 1425921 - RNA, 14 nt, Pseudomonas aeruginosa PA01
gccaugcgcccgcu

SEQ ID NO: 1425922 - RNA, 16 nt, Pseudomonas aeruginosa PA01
gccaugcuggcgcucu

SEQ ID NO: 1425923 - RNA, 18 nt, Pseudomonas aeruginosa PA01
gccaugcucuucaggcug

SEQ ID NO: 1425924 - RNA, 22 nt, Pseudomonas aeruginosa PA01
gccaugcucuucaggcugucgg

SEQ ID NO: 1425925 - RNA, 14 nt, Pseudomonas aeruginosa PA01
gccaugcucggcca

SEQ ID NO: 1425926 - RNA, 15 nt, Pseudomonas aeruginosa PA01
gccaugcucggccag

SEQ ID NO: 1425927 - RNA, 22 nt, Pseudomonas aeruginosa PA01
gccaugcucggccagcucgccg

SEQ ID NO: 1425928 - RNA, 13 nt, Pseudomonas aeruginosa PA01
gccauggaucacc

SEQ ID NO: 1425929 - RNA, 18 nt, Pseudomonas aeruginosa PA01
gcccacgcgccuggccgu

SEQ ID NO: 1425930 - RNA, 20 nt, Pseudomonas aeruginosa PA01
gcccacgcgccuggccgucu

SEQ ID NO: 1425931 - RNA, 17 nt, Pseudomonas aeruginosa PA01
gcccacgcccaucggcg

SEQ ID NO: 1425932 - RNA, 23 nt, Pseudomonas aeruginosa PA01
gcccacgcccaucggcgucggcu

SEQ ID NO: 1425933 - RNA, 16 nt, Pseudomonas aeruginosa PA01
gcccacgcagaaggcg

SEQ ID NO: 1425934 - RNA, 22 nt, Pseudomonas aeruginosa PA01
gcccacgcagaaggcgcuuucg

SEQ ID NO: 1425935 - RNA, 13 nt, Pseudomonas aeruginosa PA01
gcccaccugaacg

SEQ ID NO: 1425936 - RNA, 18 nt, Pseudomonas aeruginosa PA01
gcccaccugaacgcgccc

SEQ ID NO: 1425937 - RNA, 12 nt, Pseudomonas aeruginosa PA01
gcccacccugcg

SEQ ID NO: 1425938 - RNA, 16 nt, Pseudomonas aeruginosa PA01
gcccacccugcgcgag

SEQ ID NO: 1425939 - RNA, 17 nt, Pseudomonas aeruginosa PA01
gcccacccugcgcgagg

SEQ ID NO: 1425940 - RNA, 17 nt, Pseudomonas aeruginosa PA01
gcccacccccagcccgg

SEQ ID NO: 1425941 - RNA, 19 nt, Pseudomonas aeruginosa PA01
gcccacccccagcccggcc

SEQ ID NO: 1425942 - RNA, 23 nt, Pseudomonas aeruginosa PA01
gcccacccccagcccggccaucc

SEQ ID NO: 1425943 - RNA, 19 nt, Pseudomonas aeruginosa PA01
gcccacccccggcccggcc

SEQ ID NO: 1425944 - RNA, 23 nt, Pseudomonas aeruginosa PA01
gcccacccccggcccggccaucc

SEQ ID NO: 1425945 - RNA, 22 nt, Pseudomonas aeruginosa PA01
gcccaccccggacugcccgacg

SEQ ID NO: 1425946 - RNA, 15 nt, Pseudomonas aeruginosa PA01
gcccagcagcaggcc

SEQ ID NO: 1425947 - RNA, 18 nt, Pseudomonas aeruginosa PA01
gcccagcagcaggccggc

SEQ ID NO: 1425948 - RNA, 20 nt, Pseudomonas aeruginosa PA01
gcccagcagcaggccggcga

SEQ ID NO: 1425949 - RNA, 14 nt, Pseudomonas aeruginosa PA01
gcccagcagcacca

SEQ ID NO: 1425950 - RNA, 20 nt, Pseudomonas aeruginosa PA01
gcccagcagcaccaucagcc

SEQ ID NO: 1425951 - RNA, 14 nt, Pseudomonas aeruginosa PA01
gcccagcagcgcuc

SEQ ID NO: 1425952 - RNA, 14 nt, Pseudomonas aeruginosa PA01
gcccagcagcggca

SEQ ID NO: 1425953 - RNA, 15 nt, Pseudomonas aeruginosa PA01
gcccagcagcggcag

SEQ ID NO: 1425954 - RNA, 21 nt, Pseudomonas aeruginosa PA01
gcccagcagcggcaggagcgu

SEQ ID NO: 1425955 - RNA, 19 nt, Pseudomonas aeruginosa PA01
gcccagcagggccagccag

SEQ ID NO: 1425956 - RNA, 14 nt, Pseudomonas aeruginosa PA01
gcccagcaggccgg

SEQ ID NO: 1425957 - RNA, 17 nt, Pseudomonas aeruginosa PA01
gcccagcaggccggcca

SEQ ID NO: 1425958 - RNA, 20 nt, Pseudomonas aeruginosa PA01
gcccagcaggccggccagcc

SEQ ID NO: 1425959 - RNA, 15 nt, Pseudomonas aeruginosa PA01
gcccagcaggcgcgc

SEQ ID NO: 1425960 - RNA, 16 nt, Pseudomonas aeruginosa PA01
gcccagcaggcgcgcc

SEQ ID NO: 1425961 - RNA, 19 nt, Pseudomonas aeruginosa PA01
gcccagcaggcucaucgcc

SEQ ID NO: 1425962 - RNA, 20 nt, Pseudomonas aeruginosa PA01
gcccagcaggcucaucgccc

SEQ ID NO: 1425963 - RNA, 14 nt, Pseudomonas aeruginosa PA01
gcccagcaggcugc

SEQ ID NO: 1425964 - RNA, 13 nt, Pseudomonas aeruginosa PA01
gcccagccgcggc

SEQ ID NO: 1425965 - RNA, 14 nt, Pseudomonas aeruginosa PA01
gcccagcccgccuu

SEQ ID NO: 1425966 - RNA, 14 nt, Pseudomonas aeruginosa PA01
gcccagccagggcc

SEQ ID NO: 1425967 - RNA, 17 nt, Pseudomonas aeruginosa PA01
gcccagccagggccgcg

SEQ ID NO: 1425968 - RNA, 23 nt, Pseudomonas aeruginosa PA01
gcccagaucauguagagcaggcu

SEQ ID NO: 1425969 - RNA, 19 nt, Pseudomonas aeruginosa PA01
gcccagauccccugcagga

SEQ ID NO: 1425970 - RNA, 22 nt, Pseudomonas aeruginosa PA01
gcccagauccccugcaggaccc

SEQ ID NO: 1425971 - RNA, 18 nt, Pseudomonas aeruginosa PA01
gcccagaugaucaggccg

SEQ ID NO: 1425972 - RNA, 19 nt, Pseudomonas aeruginosa PA01
gcccagaugaucaggccga

SEQ ID NO: 1425973 - RNA, 21 nt, Pseudomonas aeruginosa PA01
gcccagaugaucaggccgagc

SEQ ID NO: 1425974 - RNA, 23 nt, Pseudomonas aeruginosa PA01
gcccagaugaucaggccgagcac

SEQ ID NO: 1425975 - RNA, 19 nt, Pseudomonas aeruginosa PA01
gcccagagcagcaccagca

SEQ ID NO: 1425976 - RNA, 16 nt, Pseudomonas aeruginosa PA01
gcccagauauccaggg

SEQ ID NO: 1425977 - RNA, 19 nt, Pseudomonas aeruginosa PA01
gcccagauauccagggcca

SEQ ID NO: 1425978 - RNA, 22 nt, Pseudomonas aeruginosa PA01
gcccagauauccagggccagga

SEQ ID NO: 1425979 - RNA, 17 nt, Pseudomonas aeruginosa PA01
gcccagcaacgcgugau

SEQ ID NO: 1425980 - RNA, 19 nt, Pseudomonas aeruginosa PA01
gcccagcaccacagcacca

SEQ ID NO: 1425981 - RNA, 17 nt, Pseudomonas aeruginosa PA01
gcccagcaccgagcuga

SEQ ID NO: 1425982 - RNA, 12 nt, Pseudomonas aeruginosa PA01
gcccacggcgag

SEQ ID NO: 1425983 - RNA, 21 nt, Pseudomonas aeruginosa PA01
gcccacggcgagacuaccgau

SEQ ID NO: 1425984 - RNA, 18 nt, Pseudomonas aeruginosa PA01
gcccacgggcggccgacg

SEQ ID NO: 1425985 - RNA, 22 nt, Pseudomonas aeruginosa PA01
gcccacgggcggccgacgugca

SEQ ID NO: 1425986 - RNA, 17 nt, Pseudomonas aeruginosa PA01
gcccacuccuccgccug

SEQ ID NO: 1425987 - RNA, 18 nt, Pseudomonas aeruginosa PA01
gcccacuccuccgccugc

SEQ ID NO: 1425988 - RNA, 20 nt, Pseudomonas aeruginosa PA01
gcccacgcucagugcgccgg

SEQ ID NO: 1425989 - RNA, 18 nt, Pseudomonas aeruginosa PA01
gcccacucuucagucccu

SEQ ID NO: 1425990 - RNA, 18 nt, Pseudomonas aeruginosa PA01
gcccagaccccauccgca

SEQ ID NO: 1425991 - RNA, 17 nt, Pseudomonas aeruginosa PA01
gccacgcuucugcgccu

SEQ ID NO: 1425992 - RNA, 19 nt, Pseudomonas aeruginosa PA01
gccacgcuucugcgccucc

SEQ ID NO: 1425993 - RNA, 18 nt, Pseudomonas aeruginosa PA01
gccacgcuugucguggcg

SEQ ID NO: 1425994 - RNA, 19 nt, Pseudomonas aeruginosa PA01
gccacgcuugucguggcgg

SEQ ID NO: 1425995 - RNA, 21 nt, Pseudomonas aeruginosa PA01
gccacgcuugucguggcgggc

SEQ ID NO: 1425996 - RNA, 16 nt, Pseudomonas aeruginosa PA01
gccacgcugcugccgg

SEQ ID NO: 1425997 - RNA, 17 nt, Pseudomonas aeruginosa PA01
gccacggaaggccacgc

SEQ ID NO: 1425998 - RNA, 16 nt, Pseudomonas aeruginosa PA01
gccacggacgcgcagg

SEQ ID NO: 1425999 - RNA, 18 nt, Pseudomonas aeruginosa PA01
gccacggauaugcgccgc

SEQ ID NO: 1426000 - RNA, 20 nt, Pseudomonas aeruginosa PA01
gccacggauaugcgccgcca

SEQ ID NO: 1426001 - RNA, 22 nt, Pseudomonas aeruginosa PA01
gccacggauaugcgccgccacg

SEQ ID NO: 1426002 - RNA, 19 nt, Pseudomonas aeruginosa PA01
gccacgcucucgaacagca

SEQ ID NO: 1426003 - RNA, 22 nt, Pseudomonas aeruginosa PA01
gccacgcucucgaacagcagca

SEQ ID NO: 1426004 - RNA, 15 nt, Pseudomonas aeruginosa PA01
gccacgcccgccgug

SEQ ID NO: 1426005 - RNA, 16 nt, Pseudomonas aeruginosa PA01
gccacgcccgccgugg

SEQ ID NO: 1426006 - RNA, 19 nt, Pseudomonas aeruginosa PA01
gccacgcccgccguggcgg

SEQ ID NO: 1426007 - RNA, 13 nt, Pseudomonas aeruginosa PA01
gccacgccgacgc

SEQ ID NO: 1426008 - RNA, 13 nt, Pseudomonas aeruginosa PA01
gccaccugagcga

SEQ ID NO: 1426009 - RNA, 20 nt, Pseudomonas aeruginosa PA01
gccaccucguauuccacguc

SEQ ID NO: 1426010 - RNA, 22 nt, Pseudomonas aeruginosa PA01
gccaccugccccgggcgccggg

SEQ ID NO: 1426011 - RNA, 16 nt, Pseudomonas aeruginosa PA01
gccaccugcucgcuga

SEQ ID NO: 1426012 - RNA, 24 nt, Pseudomonas aeruginosa PA01
gccaccugcucgcugaaccgcguc

SEQ ID NO: 1426013 - RNA, 22 nt, Pseudomonas aeruginosa PA01
gccaccugguucaucgagcggc

SEQ ID NO: 1426014 - RNA, 19 nt, Pseudomonas aeruginosa PA01
gccacgccauucgaauggc

SEQ ID NO: 1426015 - RNA, 23 nt, Pseudomonas aeruginosa PA01
gccacgccauucgaauggcgccg

SEQ ID NO: 1426016 - RNA, 20 nt, Pseudomonas aeruginosa PA01
gccaccuugcgucccugggc

SEQ ID NO: 1426017 - RNA, 13 nt, Pseudomonas aeruginosa PA01
gccaccuucgccc

SEQ ID NO: 1426018 - RNA, 16 nt, Pseudomonas aeruginosa PA01
gccaccuucgcccgcu

SEQ ID NO: 1426019 - RNA, 15 nt, Pseudomonas aeruginosa PA01
gccacguacagcgcg

SEQ ID NO: 1426020 - RNA, 16 nt, Pseudomonas aeruginosa PA01
gccacguacagcgcga

SEQ ID NO: 1426021 - RNA, 15 nt, Pseudomonas aeruginosa PA01
gccacucgcagccgc

SEQ ID NO: 1426022 - RNA, 16 nt, Pseudomonas aeruginosa PA01
gccacucgcagccgcg

SEQ ID NO: 1426023 - RNA, 17 nt, Pseudomonas aeruginosa PA01
gccacucgcagccgcgc

SEQ ID NO: 1426024 - RNA, 18 nt, Pseudomonas aeruginosa PA01
gccacucgcagccgcgcu

SEQ ID NO: 1426025 - RNA, 14 nt, Pseudomonas aeruginosa PA01
gccacggcaucgga

SEQ ID NO: 1426026 - RNA, 17 nt, Pseudomonas aeruginosa PA01
gccacggcacacgucgg

SEQ ID NO: 1426027 - RNA, 16 nt, Pseudomonas aeruginosa PA01
gccacugacgcgcagc

SEQ ID NO: 1426028 - RNA, 17 nt, Pseudomonas aeruginosa PA01
gccacugacgcgcagcg

SEQ ID NO: 1426029 - RNA, 21 nt, Pseudomonas aeruginosa PA01
gccacugacgcgcagcgccgc

SEQ ID NO: 1426030 - RNA, 16 nt, Pseudomonas aeruginosa PA01
gccacugauaccgcug

SEQ ID NO: 1426031 - RNA, 17 nt, Pseudomonas aeruginosa PA01
gccacugauaccgcugg

SEQ ID NO: 1426032 - RNA, 22 nt, Pseudomonas aeruginosa PA01
gccacugauaccgcuggccagg

SEQ ID NO: 1426033 - RNA, 19 nt, Pseudomonas aeruginosa PA01
gccacugaacuggaucggc

SEQ ID NO: 1426034 - RNA, 20 nt, Pseudomonas aeruginosa PA01
gccacugaacuggaucggcc

SEQ ID NO: 1426035 - RNA, 13 nt, Pseudomonas aeruginosa PA01
gccacucgcgacg

SEQ ID NO: 1426036 - RNA, 16 nt, Pseudomonas aeruginosa PA01
gccacucggccaggcg

SEQ ID NO: 1426037 - RNA, 17 nt, Pseudomonas aeruginosa PA01
gccacucggccaggcgc

SEQ ID NO: 1426038 - RNA, 24 nt, Pseudomonas aeruginosa PA01
gccacucggccaggcgccagggcc

SEQ ID NO: 1426039 - RNA, 18 nt, Pseudomonas aeruginosa PA01
gccacuucaagcuggcgc

SEQ ID NO: 1426040 - RNA, 14 nt, Pseudomonas aeruginosa PA01
gccacugcuuggcg

SEQ ID NO: 1426041 - RNA, 15 nt, Pseudomonas aeruginosa PA01
gccacugcuuggcga

SEQ ID NO: 1426042 - RNA, 19 nt, Pseudomonas aeruginosa PA01
gccacugcuuggcgaacuc

SEQ ID NO: 1426043 - RNA, 14 nt, Pseudomonas aeruginosa PA01
gccacugcgcgcca

SEQ ID NO: 1426044 - RNA, 13 nt, Pseudomonas aeruginosa PA01
gccacugccgccu

SEQ ID NO: 1426045 - RNA, 14 nt, Pseudomonas aeruginosa PA01
gccacugccgccuc

SEQ ID NO: 1426046 - RNA, 16 nt, Pseudomonas aeruginosa PA01
gccacugccgccucag

SEQ ID NO: 1426047 - RNA, 19 nt, Pseudomonas aeruginosa PA01
gccagcagcacggcgacga

SEQ ID NO: 1426048 - RNA, 24 nt, Pseudomonas aeruginosa PA01
gccagcagcacggcgacgaaggcc

SEQ ID NO: 1426049 - RNA, 22 nt, Pseudomonas aeruginosa PA01
gccagcagcagaagggcggaga

SEQ ID NO: 1426050 - RNA, 15 nt, Pseudomonas aeruginosa PA01
gccagcagccaggcc

SEQ ID NO: 1426051 - RNA, 16 nt, Pseudomonas aeruginosa PA01
gccagcagccaggccu

SEQ ID NO: 1426052 - RNA, 14 nt, Pseudomonas aeruginosa PA01
gccagcacggcgca

SEQ ID NO: 1426053 - RNA, 22 nt, Pseudomonas aeruginosa PA01
gccagcacgguacacgccguug

SEQ ID NO: 1426054 - RNA, 18 nt, Pseudomonas aeruginosa PA01
gccagcaccucgacgccc

SEQ ID NO: 1426055 - RNA, 21 nt, Pseudomonas aeruginosa PA01
gccagcaccucgacgcccgcu

SEQ ID NO: 1426056 - RNA, 17 nt, Pseudomonas aeruginosa PA01
gccagcaccguggucag

SEQ ID NO: 1426057 - RNA, 22 nt, Pseudomonas aeruginosa PA01
gccagcaccguggucagcacca

SEQ ID NO: 1426058 - RNA, 14 nt, Pseudomonas aeruginosa PA01
gccagcaccaugcg

SEQ ID NO: 1426059 - RNA, 22 nt, Pseudomonas aeruginosa PA01
gccagcaccagucccuggccgg

SEQ ID NO: 1426060 - RNA, 18 nt, Pseudomonas aeruginosa PA01
gccagaggcugcgcucca

SEQ ID NO: 1426061 - RNA, 16 nt, Pseudomonas aeruginosa PA01
gccagcaacccgcccu

SEQ ID NO: 1426062 - RNA, 14 nt, Pseudomonas aeruginosa PA01
gccagcaccagcag

SEQ ID NO: 1426063 - RNA, 17 nt, Pseudomonas aeruginosa PA01
gccagcaaacccgggcc

SEQ ID NO: 1426064 - RNA, 18 nt, Pseudomonas aeruginosa PA01
gccagcaaacccgggccc

SEQ ID NO: 1426065 - RNA, 19 nt, Pseudomonas aeruginosa PA01
gccagcaaacccgggccca

SEQ ID NO: 1426066 - RNA, 13 nt, Pseudomonas aeruginosa PA01
gccagagcagcgu

SEQ ID NO: 1426067 - RNA, 14 nt, Pseudomonas aeruginosa PA01
gccagagcaggcgg

SEQ ID NO: 1426068 - RNA, 13 nt, Pseudomonas aeruginosa PA01
gccagagaucgcc

SEQ ID NO: 1426069 - RNA, 15 nt, Pseudomonas aeruginosa PA01
gccagagaucgccca

SEQ ID NO: 1426070 - RNA, 20 nt, Pseudomonas aeruginosa PA01
gccagagaucgcccagcggc

SEQ ID NO: 1426071 - RNA, 22 nt, Pseudomonas aeruginosa PA01
gccagagaucgcccagcggcug

SEQ ID NO: 1426072 - RNA, 15 nt, Pseudomonas aeruginosa PA01
gccacuucccggcgc

SEQ ID NO: 1426073 - RNA, 19 nt, Pseudomonas aeruginosa PA01
gccacuuccagcacgccga

SEQ ID NO: 1426074 - RNA, 20 nt, Pseudomonas aeruginosa PA01
gccacuuccagcacgccgau

SEQ ID NO: 1426075 - RNA, 15 nt, Pseudomonas aeruginosa PA01
gccacuucguccggc

SEQ ID NO: 1426076 - RNA, 16 nt, Pseudomonas aeruginosa PA01
gccacuucguccggcc

SEQ ID NO: 1426077 - RNA, 17 nt, Pseudomonas aeruginosa PA01
gccacuucguccggccg

SEQ ID NO: 1426078 - RNA, 20 nt, Pseudomonas aeruginosa PA01
gccacuucguccggccgccc

SEQ ID NO: 1426079 - RNA, 22 nt, Pseudomonas aeruginosa PA01
gccacuucguccggccgcccga

SEQ ID NO: 1426080 - RNA, 17 nt, Pseudomonas aeruginosa PA01
gccagaggaucggccaa

SEQ ID NO: 1426081 - RNA, 19 nt, Pseudomonas aeruginosa PA01
gccagagcguaucgaugcg

SEQ ID NO: 1426082 - RNA, 12 nt, Pseudomonas aeruginosa PA01
gccagagccagu

SEQ ID NO: 1426083 - RNA, 19 nt, Pseudomonas aeruginosa PA01
gccagagcccgucgaagcc

SEQ ID NO: 1426084 - RNA, 16 nt, Pseudomonas aeruginosa PA01
gccagagcuucugcug

SEQ ID NO: 1426085 - RNA, 20 nt, Pseudomonas aeruginosa PA01
gccacuuccagcuugcgcuc

SEQ ID NO: 1426086 - RNA, 18 nt, Pseudomonas aeruginosa PA01
gccagagcgcugccugca

SEQ ID NO: 1426087 - RNA, 17 nt, Pseudomonas aeruginosa PA01
gccagcgggacgaugcc

SEQ ID NO: 1426088 - RNA, 14 nt, Pseudomonas aeruginosa PA01
gccagcgguacccg

SEQ ID NO: 1426089 - RNA, 17 nt, Pseudomonas aeruginosa PA01
gccagcgguacccgccg

SEQ ID NO: 1426090 - RNA, 18 nt, Pseudomonas aeruginosa PA01
gccagcgguacccgccgg

SEQ ID NO: 1426091 - RNA, 20 nt, Pseudomonas aeruginosa PA01
gccagcgguacccgccggcc

SEQ ID NO: 1426092 - RNA, 21 nt, Pseudomonas aeruginosa PA01
gccagcgguacccgccggcca

SEQ ID NO: 1426093 - RNA, 18 nt, Pseudomonas aeruginosa PA01
gccagcgguucaggucga

SEQ ID NO: 1426094 - RNA, 20 nt, Pseudomonas aeruginosa PA01
gccagcgguucaggucgagg

SEQ ID NO: 1426095 - RNA, 19 nt, Pseudomonas aeruginosa PA01
gccagcggcguauccucgg

SEQ ID NO: 1426096 - RNA, 15 nt, Pseudomonas aeruginosa PA01
gccagcggcuccucg

SEQ ID NO: 1426097 - RNA, 15 nt, Pseudomonas aeruginosa PA01
gccagcgggcgccgc

SEQ ID NO: 1426098 - RNA, 17 nt, Pseudomonas aeruginosa PA01
gccagcgcggccgccgc

SEQ ID NO: 1426099 - RNA, 17 nt, Pseudomonas aeruginosa PA01
gccagcgccgccgcgug

SEQ ID NO: 1426100 - RNA, 17 nt, Pseudomonas aeruginosa PA01
gccagcgccgccgcugc

SEQ ID NO: 1426101 - RNA, 14 nt, Pseudomonas aeruginosa PA01
gccagcgccgccgc

SEQ ID NO: 1426102 - RNA, 13 nt, Pseudomonas aeruginosa PA01
gccagcgccgccg

SEQ ID NO: 1426103 - RNA, 15 nt, Pseudomonas aeruginosa PA01
gccagcgccgccagu

SEQ ID NO: 1426104 - RNA, 21 nt, Pseudomonas aeruginosa PA01
gccagcuccgccugaccgcug

SEQ ID NO: 1426105 - RNA, 19 nt, Pseudomonas aeruginosa PA01
gccagcucuugcccugcca

SEQ ID NO: 1426106 - RNA, 20 nt, Pseudomonas aeruginosa PA01
gccagcucuugcccugccag

SEQ ID NO: 1426107 - RNA, 22 nt, Pseudomonas aeruginosa PA01
gccagcucuugcccugccagcg

SEQ ID NO: 1426108 - RNA, 20 nt, Pseudomonas aeruginosa PA01
gccagcucauggagcaacag

SEQ ID NO: 1426109 - RNA, 21 nt, Pseudomonas aeruginosa PA01
gccagcucauggagcaacagc

SEQ ID NO: 1426110 - RNA, 16 nt, Pseudomonas aeruginosa PA01
gccagcuaccggcagg

SEQ ID NO: 1426111 - RNA, 16 nt, Pseudomonas aeruginosa PA01
gccagcuccagcaccg

SEQ ID NO: 1426112 - RNA, 17 nt, Pseudomonas aeruginosa PA01
gccagcuccagcaccgg

SEQ ID NO: 1426113 - RNA, 17 nt, Pseudomonas aeruginosa PA01
gccagcuccagcgccca

SEQ ID NO: 1426114 - RNA, 20 nt, Pseudomonas aeruginosa PA01
gccagcuccagcgcccaggu

SEQ ID NO: 1426115 - RNA, 14 nt, Pseudomonas aeruginosa PA01
gccaggaaaucgag

SEQ ID NO: 1426116 - RNA, 22 nt, Pseudomonas aeruginosa PA01
gccagcuuguaguagcgcccga

SEQ ID NO: 1426117 - RNA, 15 nt, Pseudomonas aeruginosa PA01
gccagcuuggucggg

SEQ ID NO: 1426118 - RNA, 23 nt, Pseudomonas aeruginosa PA01
gccagcuucuccagcagggucgc

SEQ ID NO: 1426119 - RNA, 16 nt, Pseudomonas aeruginosa PA01
gccagcuuccaggcgc

SEQ ID NO: 1426120 - RNA, 19 nt, Pseudomonas aeruginosa PA01
gccagcuuccaggcgcgcu

SEQ ID NO: 1426121 - RNA, 20 nt, Pseudomonas aeruginosa PA01
gccagcuuccaggcgcgcug

SEQ ID NO: 1426122 - RNA, 16 nt, Pseudomonas aeruginosa PA01
gccagcuggcgacggc

SEQ ID NO: 1426123 - RNA, 12 nt, Pseudomonas aeruginosa PA01
gccagccggcgc

SEQ ID NO: 1426124 - RNA, 18 nt, Pseudomonas aeruginosa PA01
gccagcccuuucagcggc

SEQ ID NO: 1426125 - RNA, 21 nt, Pseudomonas aeruginosa PA01
gccagcccuuucagcggcugc

SEQ ID NO: 1426126 - RNA, 16 nt, Pseudomonas aeruginosa PA01
gccagccgacuggcgg

SEQ ID NO: 1426127 - RNA, 21 nt, Pseudomonas aeruginosa PA01
gccagccgagcaacucggcgg

SEQ ID NO: 1426128 - RNA, 13 nt, Pseudomonas aeruginosa PA01
gccagccggcgcc

SEQ ID NO: 1426129 - RNA, 15 nt, Pseudomonas aeruginosa PA01
gccagccgucgucgu

SEQ ID NO: 1426130 - RNA, 21 nt, Pseudomonas aeruginosa PA01
gccagccgucgucguccaccg

SEQ ID NO: 1426131 - RNA, 17 nt, Pseudomonas aeruginosa PA01
gccagccuacugggcgu

SEQ ID NO: 1426132 - RNA, 18 nt, Pseudomonas aeruginosa PA01
gccagccguucgcuggac

SEQ ID NO: 1426133 - RNA, 19 nt, Pseudomonas aeruginosa PA01
gccagccguucgcuggaca

SEQ ID NO: 1426134 - RNA, 20 nt, Pseudomonas aeruginosa PA01
gccagccguucgcuggacag

SEQ ID NO: 1426135 - RNA, 19 nt, Pseudomonas aeruginosa PA01
gccagccguggcaggcgcc

SEQ ID NO: 1426136 - RNA, 22 nt, Pseudomonas aeruginosa PA01
gccagccguggcaggcgcccgg

SEQ ID NO: 1426137 - RNA, 17 nt, Pseudomonas aeruginosa PA01
gccagcgccccaccagg

SEQ ID NO: 1426138 - RNA, 18 nt, Pseudomonas aeruginosa PA01
gccagcgccccaccaggc

SEQ ID NO: 1426139 - RNA, 21 nt, Pseudomonas aeruginosa PA01
gccagcgccccaccaggcucg

SEQ ID NO: 1426140 - RNA, 13 nt, Pseudomonas aeruginosa PA01
gccagcgcccagg

SEQ ID NO: 1426141 - RNA, 15 nt, Pseudomonas aeruginosa PA01
gccagcgcccaggcc

SEQ ID NO: 1426142 - RNA, 23 nt, Pseudomonas aeruginosa PA01
gccagcgcccaggccgggucgca

SEQ ID NO: 1426143 - RNA, 13 nt, Pseudomonas aeruginosa PA01
gccagcgccagga

SEQ ID NO: 1426144 - RNA, 14 nt, Pseudomonas aeruginosa PA01
gccagcgccaggag

SEQ ID NO: 1426145 - RNA, 13 nt, Pseudomonas aeruginosa PA01
gccagcgccaggu

SEQ ID NO: 1426146 - RNA, 14 nt, Pseudomonas aeruginosa PA01
gccagcgccagcag

SEQ ID NO: 1426147 - RNA, 14 nt, Pseudomonas aeruginosa PA01
gccagcgccacgcc

SEQ ID NO: 1426148 - RNA, 16 nt, Pseudomonas aeruginosa PA01
gccagcgccacgccgc

SEQ ID NO: 1426149 - RNA, 17 nt, Pseudomonas aeruginosa PA01
gccagcgccacgccgcu

SEQ ID NO: 1426150 - RNA, 19 nt, Pseudomonas aeruginosa PA01
gccagcgccacgccgcugu

SEQ ID NO: 1426151 - RNA, 20 nt, Pseudomonas aeruginosa PA01
gccagcgccacggcgaucgc

SEQ ID NO: 1426152 - RNA, 21 nt, Pseudomonas aeruginosa PA01
gccagcgccacggcgaucgcc

SEQ ID NO: 1426153 - RNA, 23 nt, Pseudomonas aeruginosa PA01
gccagcgccacggcgaucgccgg

SEQ ID NO: 1426154 - RNA, 23 nt, Pseudomonas aeruginosa PA01
gccagcgcaccuacuaccgcugg

SEQ ID NO: 1426155 - RNA, 17 nt, Pseudomonas aeruginosa PA01
gccagccucagguacgg

SEQ ID NO: 1426156 - RNA, 14 nt, Pseudomonas aeruginosa PA01
gccagcgccaccag

SEQ ID NO: 1426157 - RNA, 17 nt, Pseudomonas aeruginosa PA01
gccagcgccaccagcag

SEQ ID NO: 1426158 - RNA, 21 nt, Pseudomonas aeruginosa PA01
gccagcgccaccagcagggcc

SEQ ID NO: 1426159 - RNA, 12 nt, Pseudomonas aeruginosa PA01
gccagcgcaucg

SEQ ID NO: 1426160 - RNA, 19 nt, Pseudomonas aeruginosa PA01
gccagcagcggcggcgccg

SEQ ID NO: 1426161 - RNA, 17 nt, Pseudomonas aeruginosa PA01
gccagcagcgcugauca

SEQ ID NO: 1426162 - RNA, 19 nt, Pseudomonas aeruginosa PA01
gccagcagcgcugaucacg

SEQ ID NO: 1426163 - RNA, 20 nt, Pseudomonas aeruginosa PA01
gccagcagcgcugaucacga

SEQ ID NO: 1426164 - RNA, 13 nt, Pseudomonas aeruginosa PA01
gccagcagcaucg

SEQ ID NO: 1426165 - RNA, 20 nt, Pseudomonas aeruginosa PA01
gccagcagcaucggaccggu

SEQ ID NO: 1426166 - RNA, 12 nt, Pseudomonas aeruginosa PA01
gccagcagcaug

SEQ ID NO: 1426167 - RNA, 13 nt, Pseudomonas aeruginosa PA01
gccagcagcccgg

SEQ ID NO: 1426168 - RNA, 15 nt, Pseudomonas aeruginosa PA01
gccagcagcccggcc

SEQ ID NO: 1426169 - RNA, 16 nt, Pseudomonas aeruginosa PA01
gccagcagcgccuccu

SEQ ID NO: 1426170 - RNA, 13 nt, Pseudomonas aeruginosa PA01
gccagcaggccga

SEQ ID NO: 1426171 - RNA, 15 nt, Pseudomonas aeruginosa PA01
gccagcaggccgaag

SEQ ID NO: 1426172 - RNA, 15 nt, Pseudomonas aeruginosa PA01
gccagcaggcgauac

SEQ ID NO: 1426173 - RNA, 21 nt, Pseudomonas aeruginosa PA01
gccagcaggcgauacaccgca

SEQ ID NO: 1426174 - RNA, 12 nt, Pseudomonas aeruginosa PA01
gccagcaggcgc

SEQ ID NO: 1426175 - RNA, 13 nt, Pseudomonas aeruginosa PA01
gccagcaggcgca

SEQ ID NO: 1426176 - RNA, 15 nt, Pseudomonas aeruginosa PA01
gccagcaggcgcagg

SEQ ID NO: 1426177 - RNA, 19 nt, Pseudomonas aeruginosa PA01
gccagcaggcgcaggucgg

SEQ ID NO: 1426178 - RNA, 14 nt, Pseudomonas aeruginosa PA01
gccagcaggcgccg

SEQ ID NO: 1426179 - RNA, 18 nt, Pseudomonas aeruginosa PA01
gccagcaggcgccgcgca

SEQ ID NO: 1426180 - RNA, 15 nt, Pseudomonas aeruginosa PA01
gccagcaggcgccgg

SEQ ID NO: 1426181 - RNA, 17 nt, Pseudomonas aeruginosa PA01
gccagcaggccgaaggc

SEQ ID NO: 1426182 - RNA, 14 nt, Pseudomonas aeruginosa PA01
gccagcaggccgag

SEQ ID NO: 1426183 - RNA, 16 nt, Pseudomonas aeruginosa PA01
gccagcaggccgagcg

SEQ ID NO: 1426184 - RNA, 19 nt, Pseudomonas aeruginosa PA01
gccagcaggccgagcgugg

SEQ ID NO: 1426185 - RNA, 18 nt, Pseudomonas aeruginosa PA01
gccagcaggccgaucagc

SEQ ID NO: 1426186 - RNA, 19 nt, Pseudomonas aeruginosa PA01
gccagcaggccgaucagcg

SEQ ID NO: 1426187 - RNA, 23 nt, Pseudomonas aeruginosa PA01
gccagcaggaucgacagcagcgc

SEQ ID NO: 1426188 - RNA, 22 nt, Pseudomonas aeruginosa PA01
gccagcaggaugcugcacagcc

SEQ ID NO: 1426189 - RNA, 15 nt, Pseudomonas aeruginosa PA01
gccagcccucgccca

SEQ ID NO: 1426190 - RNA, 17 nt, Pseudomonas aeruginosa PA01
gccagcccucgcccagg

SEQ ID NO: 1426191 - RNA, 22 nt, Pseudomonas aeruginosa PA01
gccagcccucgcccaggugcgc

SEQ ID NO: 1426192 - RNA, 12 nt, Pseudomonas aeruginosa PA01
gccagcccggca

SEQ ID NO: 1426193 - RNA, 17 nt, Pseudomonas aeruginosa PA01
gccagcccggccucgcc

SEQ ID NO: 1426194 - RNA, 18 nt, Pseudomonas aeruginosa PA01
gccagcccggccucgccg

SEQ ID NO: 1426195 - RNA, 20 nt, Pseudomonas aeruginosa PA01
gccagcccggccucgccggu

SEQ ID NO: 1426196 - RNA, 21 nt, Pseudomonas aeruginosa PA01
gccagcccggccucgccgguc

SEQ ID NO: 1426197 - RNA, 15 nt, Pseudomonas aeruginosa PA01
gccagcccggcggug

SEQ ID NO: 1426198 - RNA, 20 nt, Pseudomonas aeruginosa PA01
gccaaugccuuccgacgccg

SEQ ID NO: 1426199 - RNA, 22 nt, Pseudomonas aeruginosa PA01
gccaaugccuuccgacgccgcg

SEQ ID NO: 1426200 - RNA, 22 nt, Pseudomonas aeruginosa PA01
gccaaugcguggguccacgccg

SEQ ID NO: 1426201 - RNA, 19 nt, Pseudomonas aeruginosa PA01
gccacaggcccuggaucac

SEQ ID NO: 1426202 - RNA, 21 nt, Pseudomonas aeruginosa PA01
gccacaggcccuggaucaccg

SEQ ID NO: 1426203 - RNA, 19 nt, Pseudomonas aeruginosa PA01
gccacagguggaucgcggc

SEQ ID NO: 1426204 - RNA, 21 nt, Pseudomonas aeruginosa PA01
gccacagguggaucgcggcgu

SEQ ID NO: 1426205 - RNA, 15 nt, Pseudomonas aeruginosa PA01
gccacaggcgccagu

SEQ ID NO: 1426206 - RNA, 19 nt, Pseudomonas aeruginosa PA01
gccacaggcguuauccgcc

SEQ ID NO: 1426207 - RNA, 23 nt, Pseudomonas aeruginosa PA01
gccacaggcguuauccgccgccg

SEQ ID NO: 1426208 - RNA, 15 nt, Pseudomonas aeruginosa PA01
gccacagaggucgcu

SEQ ID NO: 1426209 - RNA, 17 nt, Pseudomonas aeruginosa PA01
gccacagaggucgcuga

SEQ ID NO: 1426210 - RNA, 14 nt, Pseudomonas aeruginosa PA01
gccacagaucgcca

SEQ ID NO: 1426211 - RNA, 16 nt, Pseudomonas aeruginosa PA01
gcauccucggcaucca

SEQ ID NO: 1426212 - RNA, 23 nt, Pseudomonas aeruginosa PA01
gcauccgugcgaacacaccgacc

SEQ ID NO: 1426213 - RNA, 23 nt, Pseudomonas aeruginosa PA01
gcaucccaguagccggucaggcg

SEQ ID NO: 1426214 - RNA, 18 nt, Pseudomonas aeruginosa PA01
gcauccaguuccugcacc

SEQ ID NO: 1426215 - RNA, 17 nt, Pseudomonas aeruginosa PA01
gcauccaucgccaguug

SEQ ID NO: 1426216 - RNA, 14 nt, Pseudomonas aeruginosa PA01
gcauccagggucgc

SEQ ID NO: 1426217 - RNA, 15 nt, Pseudomonas aeruginosa PA01
gcauccagggucgcg

SEQ ID NO: 1426218 - RNA, 17 nt, Pseudomonas aeruginosa PA01
gcauccagcauccgugc

SEQ ID NO: 1426219 - RNA, 19 nt, Pseudomonas aeruginosa PA01
gcauccagcauccgugcga

SEQ ID NO: 1426220 - RNA, 19 nt, Pseudomonas aeruginosa PA01
gccaacugcuucaggcgcg

SEQ ID NO: 1426221 - RNA, 19 nt, Pseudomonas aeruginosa PA01
gccaacugcuugccgagcu

SEQ ID NO: 1426222 - RNA, 16 nt, Pseudomonas aeruginosa PA01
gccaacuggcgcaacu

SEQ ID NO: 1426223 - RNA, 14 nt, Pseudomonas aeruginosa PA01
gccaacuggcgucc

SEQ ID NO: 1426224 - RNA, 15 nt, Pseudomonas aeruginosa PA01
gccaacucggccugg

SEQ ID NO: 1426225 - RNA, 15 nt, Pseudomonas aeruginosa PA01
gccaacugagcggcg

SEQ ID NO: 1426226 - RNA, 16 nt, Pseudomonas aeruginosa PA01
gccaacugagcggcgg

SEQ ID NO: 1426227 - RNA, 18 nt, Pseudomonas aeruginosa PA01
gccaacugagcggcggca

SEQ ID NO: 1426228 - RNA, 13 nt, Pseudomonas aeruginosa PA01
gcauccuggcggu

SEQ ID NO: 1426229 - RNA, 15 nt, Pseudomonas aeruginosa PA01
gcaucgaaggcgccg

SEQ ID NO: 1426230 - RNA, 13 nt, Pseudomonas aeruginosa PA01
gccaaggccucgg

SEQ ID NO: 1426231 - RNA, 17 nt, Pseudomonas aeruginosa PA01
gccaaggcccugcugca

SEQ ID NO: 1426232 - RNA, 17 nt, Pseudomonas aeruginosa PA01
gccaaggaugcgccagc

SEQ ID NO: 1426233 - RNA, 16 nt, Pseudomonas aeruginosa PA01
gccaagcuggcgaucg

SEQ ID NO: 1426234 - RNA, 20 nt, Pseudomonas aeruginosa PA01
gccaagcuuguugcgcaggc

SEQ ID NO: 1426235 - RNA, 13 nt, Pseudomonas aeruginosa PA01
gccaagcccggcg

SEQ ID NO: 1426236 - RNA, 22 nt, Pseudomonas aeruginosa PA01
gccaagcccggcgagagcgucc

SEQ ID NO: 1426237 - RNA, 15 nt, Pseudomonas aeruginosa PA01
gccaagccaccagcg

SEQ ID NO: 1426238 - RNA, 17 nt, Pseudomonas aeruginosa PA01
gccaaucaggugcguac

SEQ ID NO: 1426239 - RNA, 16 nt, Pseudomonas aeruginosa PA01
gccaauccaugauccc

SEQ ID NO: 1426240 - RNA, 19 nt, Pseudomonas aeruginosa PA01
gccaauccgggcguagggc

SEQ ID NO: 1426241 - RNA, 22 nt, Pseudomonas aeruginosa PA01
gccaauccgggcguggggcgaa

SEQ ID NO: 1426242 - RNA, 21 nt, Pseudomonas aeruginosa PA01
gccaaggucggucucgccacc

SEQ ID NO: 1426243 - RNA, 18 nt, Pseudomonas aeruginosa PA01
gccaagggcgccgccgag

SEQ ID NO: 1426244 - RNA, 20 nt, Pseudomonas aeruginosa PA01
gccaagguacggggcugcgg

SEQ ID NO: 1426245 - RNA, 16 nt, Pseudomonas aeruginosa PA01
gccaagucggccgccc

SEQ ID NO: 1426246 - RNA, 20 nt, Pseudomonas aeruginosa PA01
gccaagucggccgcccagcg

SEQ ID NO: 1426247 - RNA, 14 nt, Pseudomonas aeruginosa PA01
gccaccaccgugac

SEQ ID NO: 1426248 - RNA, 20 nt, Pseudomonas aeruginosa PA01
gccaccacggcgaagccgcg

SEQ ID NO: 1426249 - RNA, 22 nt, Pseudomonas aeruginosa PA01
gccaccacggcgaagccgcgcc

SEQ ID NO: 1426250 - RNA, 23 nt, Pseudomonas aeruginosa PA01
gccaccacggcgaagccgcgccc

SEQ ID NO: 1426251 - RNA, 17 nt, Pseudomonas aeruginosa PA01
gccaccacgaucaggcc

SEQ ID NO: 1426252 - RNA, 15 nt, Pseudomonas aeruginosa PA01
gccaccagcgagucg

SEQ ID NO: 1426253 - RNA, 15 nt, Pseudomonas aeruginosa PA01
gccaccagccaggcg

SEQ ID NO: 1426254 - RNA, 19 nt, Pseudomonas aeruginosa PA01
gccaccagccaggcggcca

SEQ ID NO: 1426255 - RNA, 13 nt, Pseudomonas aeruginosa PA01
gccaccagccgaa

SEQ ID NO: 1426256 - RNA, 13 nt, Pseudomonas aeruginosa PA01
gccaccagcagga

SEQ ID NO: 1426257 - RNA, 14 nt, Pseudomonas aeruginosa PA01
gccaccagcaggaa

SEQ ID NO: 1426258 - RNA, 16 nt, Pseudomonas aeruginosa PA01
gccaccagcaggaagc

SEQ ID NO: 1426259 - RNA, 15 nt, Pseudomonas aeruginosa PA01
gccaccagcagggcc

SEQ ID NO: 1426260 - RNA, 19 nt, Pseudomonas aeruginosa PA01
gccaccagcagggccaggc

SEQ ID NO: 1426261 - RNA, 20 nt, Pseudomonas aeruginosa PA01
gccaccagcagggccaggcc

SEQ ID NO: 1426262 - RNA, 22 nt, Pseudomonas aeruginosa PA01
gccaccagcagggccaggccga

SEQ ID NO: 1426263 - RNA, 18 nt, Pseudomonas aeruginosa PA01
gccaccagagccagccgc

SEQ ID NO: 1426264 - RNA, 20 nt, Pseudomonas aeruginosa PA01
gccaccagagccagccgcga

SEQ ID NO: 1426265 - RNA, 18 nt, Pseudomonas aeruginosa PA01
gccaccagcaugcccagc

SEQ ID NO: 1426266 - RNA, 19 nt, Pseudomonas aeruginosa PA01
gccaccagcaugcccagcg

SEQ ID NO: 1426267 - RNA, 13 nt, Pseudomonas aeruginosa PA01
gccaccagcgugg

SEQ ID NO: 1426268 - RNA, 16 nt, Pseudomonas aeruginosa PA01
gccaccagcguggcgc

SEQ ID NO: 1426269 - RNA, 21 nt, Pseudomonas aeruginosa PA01
gccacccgcaucgaggccgcc

SEQ ID NO: 1426270 - RNA, 23 nt, Pseudomonas aeruginosa PA01
gccacccgcaucgaggccgccca

SEQ ID NO: 1426271 - RNA, 17 nt, Pseudomonas aeruginosa PA01
gccacccgcgggcagca

SEQ ID NO: 1426272 - RNA, 17 nt, Pseudomonas aeruginosa PA01
gccacccgccucgucgc

SEQ ID NO: 1426273 - RNA, 21 nt, Pseudomonas aeruginosa PA01
gccacccgccucgucgccaug

SEQ ID NO: 1426274 - RNA, 22 nt, Pseudomonas aeruginosa PA01
gccacccgccucgucgccaugc

SEQ ID NO: 1426275 - RNA, 17 nt, Pseudomonas aeruginosa PA01
gccacccgcucgaccuu

SEQ ID NO: 1426276 - RNA, 15 nt, Pseudomonas aeruginosa PA01
gccacccggcgcccg

SEQ ID NO: 1426277 - RNA, 18 nt, Pseudomonas aeruginosa PA01
gccacccggcgcccggcg

SEQ ID NO: 1426278 - RNA, 19 nt, Pseudomonas aeruginosa PA01
gccacccggcgcccggcgc

SEQ ID NO: 1426279 - RNA, 16 nt, Pseudomonas aeruginosa PA01
gccaccccgccgcgca

SEQ ID NO: 1426280 - RNA, 22 nt, Pseudomonas aeruginosa PA01
gccaccccgccgcuggcggcau

SEQ ID NO: 1426281 - RNA, 16 nt, Pseudomonas aeruginosa PA01
gccaccccgccggcgu

SEQ ID NO: 1426282 - RNA, 17 nt, Pseudomonas aeruginosa PA01
gccaccaggccgcugcc

SEQ ID NO: 1426283 - RNA, 18 nt, Pseudomonas aeruginosa PA01
gccaccaggccgcugccg

SEQ ID NO: 1426284 - RNA, 19 nt, Pseudomonas aeruginosa PA01
gccaccaggcuuacccgcg

SEQ ID NO: 1426285 - RNA, 22 nt, Pseudomonas aeruginosa PA01
gccaccaggcuuacccgcgacc

SEQ ID NO: 1426286 - RNA, 17 nt, Pseudomonas aeruginosa PA01
gccaccagggccuugcc

SEQ ID NO: 1426287 - RNA, 15 nt, Pseudomonas aeruginosa PA01
gccaccaucacgucg

SEQ ID NO: 1426288 - RNA, 21 nt, Pseudomonas aeruginosa PA01
gccaccaucacgucgcgcacc

SEQ ID NO: 1426289 - RNA, 16 nt, Pseudomonas aeruginosa PA01
gccaccaucgcggcga

SEQ ID NO: 1426290 - RNA, 22 nt, Pseudomonas aeruginosa PA01
gccaccgguacgcucaccacca

SEQ ID NO: 1426291 - RNA, 13 nt, Pseudomonas aeruginosa PA01
gccaccgguggac

SEQ ID NO: 1426292 - RNA, 20 nt, Pseudomonas aeruginosa PA01
gccaccggcguuauccgccg

SEQ ID NO: 1426293 - RNA, 20 nt, Pseudomonas aeruginosa PA01
gccaccgggugcagguucac

SEQ ID NO: 1426294 - RNA, 18 nt, Pseudomonas aeruginosa PA01
gccaccgggaucagcggc

SEQ ID NO: 1426295 - RNA, 15 nt, Pseudomonas aeruginosa PA01
gccaccgggaucugg

SEQ ID NO: 1426296 - RNA, 22 nt, Pseudomonas aeruginosa PA01
gccaccgggaucuggcccugca

SEQ ID NO: 1426297 - RNA, 20 nt, Pseudomonas aeruginosa PA01
gccacccuuguggccgaucu

SEQ ID NO: 1426298 - RNA, 13 nt, Pseudomonas aeruginosa PA01
gccacccuugcgc

SEQ ID NO: 1426299 - RNA, 20 nt, Pseudomonas aeruginosa PA01
gccacccuuggagccgcccu

SEQ ID NO: 1426300 - RNA, 17 nt, Pseudomonas aeruginosa PA01
gccacccguuccuugcg

SEQ ID NO: 1426301 - RNA, 22 nt, Pseudomonas aeruginosa PA01
gccacccguuccuugcgcggca

SEQ ID NO: 1426302 - RNA, 21 nt, Pseudomonas aeruginosa PA01
gccaccgaaucgaugcuguag

SEQ ID NO: 1426303 - RNA, 16 nt, Pseudomonas aeruginosa PA01
gccaccgauucgccgg

SEQ ID NO: 1426304 - RNA, 17 nt, Pseudomonas aeruginosa PA01
gccaccgauucgccggc

SEQ ID NO: 1426305 - RNA, 19 nt, Pseudomonas aeruginosa PA01
gccaccgauucgccggcca

SEQ ID NO: 1426306 - RNA, 22 nt, Pseudomonas aeruginosa PA01
gccaccgauagcggcgcgaggc

SEQ ID NO: 1426307 - RNA, 14 nt, Pseudomonas aeruginosa PA01
gccaccgacccucg

SEQ ID NO: 1426308 - RNA, 18 nt, Pseudomonas aeruginosa PA01
gccaccgccaccgccgga

SEQ ID NO: 1426309 - RNA, 18 nt, Pseudomonas aeruginosa PA01
gccaccgcggcguccgcg

SEQ ID NO: 1426310 - RNA, 19 nt, Pseudomonas aeruginosa PA01
gccaccgcggcguccgcgu

SEQ ID NO: 1426311 - RNA, 13 nt, Pseudomonas aeruginosa PA01
gccaccgcgcgcc

SEQ ID NO: 1426312 - RNA, 16 nt, Pseudomonas aeruginosa PA01
gccaccgcgacgcgcu

SEQ ID NO: 1426313 - RNA, 19 nt, Pseudomonas aeruginosa PA01
gccaccgcgacgcgcugga

SEQ ID NO: 1426314 - RNA, 12 nt, Pseudomonas aeruginosa PA01
gccaccgccagg

SEQ ID NO: 1426315 - RNA, 13 nt, Pseudomonas aeruginosa PA01
gccaccgccagga

SEQ ID NO: 1426316 - RNA, 15 nt, Pseudomonas aeruginosa PA01
gccaccgccaggacc

SEQ ID NO: 1426317 - RNA, 16 nt, Pseudomonas aeruginosa PA01
gccaccgccaggaccu

SEQ ID NO: 1426318 - RNA, 12 nt, Pseudomonas aeruginosa PA01
gccaccgccugg

SEQ ID NO: 1426319 - RNA, 16 nt, Pseudomonas aeruginosa PA01
gccaccgccuggucgc

SEQ ID NO: 1426320 - RNA, 20 nt, Pseudomonas aeruginosa PA01
gccaccgccuggucgccggg

SEQ ID NO: 1426321 - RNA, 13 nt, Pseudomonas aeruginosa PA01
gaccgcgaauggc

SEQ ID NO: 1426322 - RNA, 22 nt, Pseudomonas aeruginosa PA01
gaccgccucgaccaucggcggc

SEQ ID NO: 1426323 - RNA, 13 nt, Pseudomonas aeruginosa PA01
gaccgccgccgcc

SEQ ID NO: 1426324 - RNA, 12 nt, Pseudomonas aeruginosa PA01
gaccgccgcuca

SEQ ID NO: 1426325 - RNA, 13 nt, Pseudomonas aeruginosa PA01
gaccgccgcucau

SEQ ID NO: 1426326 - RNA, 20 nt, Pseudomonas aeruginosa PA01
gaccgcgaguucgccggcca

SEQ ID NO: 1426327 - RNA, 22 nt, Pseudomonas aeruginosa PA01
gaccgcgaguucgccggccagg

SEQ ID NO: 1426328 - RNA, 13 nt, Pseudomonas aeruginosa PA01
gaccgcgccggcg

SEQ ID NO: 1426329 - RNA, 14 nt, Pseudomonas aeruginosa PA01
gaccgcgccggcga

SEQ ID NO: 1426330 - RNA, 15 nt, Pseudomonas aeruginosa PA01
gaccgcgcgccugca

SEQ ID NO: 1426331 - RNA, 21 nt, Pseudomonas aeruginosa PA01
gaccgcgcgccugcaacgcca

SEQ ID NO: 1426332 - RNA, 19 nt, Pseudomonas aeruginosa PA01
gaccgcgcgcauggucgcg

SEQ ID NO: 1426333 - RNA, 21 nt, Pseudomonas aeruginosa PA01
gacccugguaguccagcaggu

SEQ ID NO: 1426334 - RNA, 12 nt, Pseudomonas aeruginosa PA01
gacccuggcgcu

SEQ ID NO: 1426335 - RNA, 18 nt, Pseudomonas aeruginosa PA01
gacccuggcgcugucgcc

SEQ ID NO: 1426336 - RNA, 15 nt, Pseudomonas aeruginosa PA01
gacccuggggucgcc

SEQ ID NO: 1426337 - RNA, 20 nt, Pseudomonas aeruginosa PA01
gaccgaacaucagcagcagg

SEQ ID NO: 1426338 - RNA, 12 nt, Pseudomonas aeruginosa PA01
gacccuggccgc

SEQ ID NO: 1426339 - RNA, 13 nt, Pseudomonas aeruginosa PA01
gacccuggccgcg

SEQ ID NO: 1426340 - RNA, 18 nt, Pseudomonas aeruginosa PA01
gacccuggccgcgcggcu

SEQ ID NO: 1426341 - RNA, 15 nt, Pseudomonas aeruginosa PA01
gacccuggcgccgac

SEQ ID NO: 1426342 - RNA, 19 nt, Pseudomonas aeruginosa PA01
gacccuggcgccgaccucc

SEQ ID NO: 1426343 - RNA, 19 nt, Pseudomonas aeruginosa PA01
gacccugcuggccggugcc

SEQ ID NO: 1426344 - RNA, 14 nt, Pseudomonas aeruginosa PA01
gacccucggcgagg

SEQ ID NO: 1426345 - RNA, 17 nt, Pseudomonas aeruginosa PA01
gacccuagggucggcgu

SEQ ID NO: 1426346 - RNA, 16 nt, Pseudomonas aeruginosa PA01
gacccguugccgaccg

SEQ ID NO: 1426347 - RNA, 22 nt, Pseudomonas aeruginosa PA01
gacccguugccgaccgagcagc

SEQ ID NO: 1426348 - RNA, 15 nt, Pseudomonas aeruginosa PA01
gacccguugcgccuc

SEQ ID NO: 1426349 - RNA, 20 nt, Pseudomonas aeruginosa PA01
gacccguugcgccucgccgc

SEQ ID NO: 1426350 - RNA, 18 nt, Pseudomonas aeruginosa PA01
gaccgcccaggcugccgc

SEQ ID NO: 1426351 - RNA, 19 nt, Pseudomonas aeruginosa PA01
gaccgcccaggcugccgcc

SEQ ID NO: 1426352 - RNA, 20 nt, Pseudomonas aeruginosa PA01
gaccgcccaggcugccgccg

SEQ ID NO: 1426353 - RNA, 21 nt, Pseudomonas aeruginosa PA01
gaccgcccaggcugccgccgc

SEQ ID NO: 1426354 - RNA, 19 nt, Pseudomonas aeruginosa PA01
gaccgcccagggggccggg

SEQ ID NO: 1426355 - RNA, 21 nt, Pseudomonas aeruginosa PA01
gaccgcccagggggccgggcc

SEQ ID NO: 1426356 - RNA, 11 nt, Pseudomonas aeruginosa PA01
gaccgccgccu

SEQ ID NO: 1426357 - RNA, 22 nt, Pseudomonas aeruginosa PA01
gaccgccgccuggguggcgacg

SEQ ID NO: 1426358 - RNA, 23 nt, Pseudomonas aeruginosa PA01
gaccgccgccuggguggcgacga

SEQ ID NO: 1426359 - RNA, 15 nt, Pseudomonas aeruginosa PA01
gaccgccaggcggcc

SEQ ID NO: 1426360 - RNA, 12 nt, Pseudomonas aeruginosa PA01
gaccgccauggc

SEQ ID NO: 1426361 - RNA, 14 nt, Pseudomonas aeruginosa PA01
gaccgccauggcgc

SEQ ID NO: 1426362 - RNA, 22 nt, Pseudomonas aeruginosa PA01
gaccgccagacaggccagcucg

SEQ ID NO: 1426363 - RNA, 22 nt, Pseudomonas aeruginosa PA01
gaccacccggcgguccgccgcg

SEQ ID NO: 1426364 - RNA, 23 nt, Pseudomonas aeruginosa PA01
gaccacccggcgguccgccgcgg

SEQ ID NO: 1426365 - RNA, 14 nt, Pseudomonas aeruginosa PA01
gaccacccggcugc

SEQ ID NO: 1426366 - RNA, 20 nt, Pseudomonas aeruginosa PA01
gaccacccggcugcaugccg

SEQ ID NO: 1426367 - RNA, 19 nt, Pseudomonas aeruginosa PA01
gaccaccaugugcuggcgg

SEQ ID NO: 1426368 - RNA, 17 nt, Pseudomonas aeruginosa PA01
gaccaccaucaccgcca

SEQ ID NO: 1426369 - RNA, 18 nt, Pseudomonas aeruginosa PA01
gaccaccaucaccgccau

SEQ ID NO: 1426370 - RNA, 22 nt, Pseudomonas aeruginosa PA01
gaccaccagggcgauggucccc

SEQ ID NO: 1426371 - RNA, 23 nt, Pseudomonas aeruginosa PA01
gaccaccagcgugguaccgcugc

SEQ ID NO: 1426372 - RNA, 16 nt, Pseudomonas aeruginosa PA01
gaccaccaggaagcgu

SEQ ID NO: 1426373 - RNA, 19 nt, Pseudomonas aeruginosa PA01
gaccacccuguccugcucc

SEQ ID NO: 1426374 - RNA, 21 nt, Pseudomonas aeruginosa PA01
gaccaccgcgaauccgcggcc

SEQ ID NO: 1426375 - RNA, 21 nt, Pseudomonas aeruginosa PA01
gaccaugguguuggcggccug

SEQ ID NO: 1426376 - RNA, 22 nt, Pseudomonas aeruginosa PA01
gaccaugguguuggcggccugg

SEQ ID NO: 1426377 - RNA, 21 nt, Pseudomonas aeruginosa PA01
gaccauuucccgcgagcagcc

SEQ ID NO: 1426378 - RNA, 14 nt, Pseudomonas aeruginosa PA01
gacccacugaagac

SEQ ID NO: 1426379 - RNA, 15 nt, Pseudomonas aeruginosa PA01
gacccacuccggcag

SEQ ID NO: 1426380 - RNA, 21 nt, Pseudomonas aeruginosa PA01
gacccacuccggcaggcgcuc

SEQ ID NO: 1426381 - RNA, 23 nt, Pseudomonas aeruginosa PA01
gacccagaaaccgaucagcaccg

SEQ ID NO: 1426382 - RNA, 15 nt, Pseudomonas aeruginosa PA01
gacccagagccgcuc

SEQ ID NO: 1426383 - RNA, 17 nt, Pseudomonas aeruginosa PA01
gacccagagccgcucgg

SEQ ID NO: 1426384 - RNA, 20 nt, Pseudomonas aeruginosa PA01
gacccagagccgcucggcgg

SEQ ID NO: 1426385 - RNA, 22 nt, Pseudomonas aeruginosa PA01
gacccagaugaucuucaucccg

SEQ ID NO: 1426386 - RNA, 18 nt, Pseudomonas aeruginosa PA01
gacccaggcccagccggu

SEQ ID NO: 1426387 - RNA, 14 nt, Pseudomonas aeruginosa PA01
gacccaggccgaca

SEQ ID NO: 1426388 - RNA, 22 nt, Pseudomonas aeruginosa PA01
gacccaggccgacagcggcugg

SEQ ID NO: 1426389 - RNA, 20 nt, Pseudomonas aeruginosa PA01
gacccaggcuucggcgcgcu

SEQ ID NO: 1426390 - RNA, 18 nt, Pseudomonas aeruginosa PA01
gacccaggugcgcaggcg

SEQ ID NO: 1426391 - RNA, 20 nt, Pseudomonas aeruginosa PA01
gacccaggugcgcaggcgcu

SEQ ID NO: 1426392 - RNA, 22 nt, Pseudomonas aeruginosa PA01
gacccaggugcgcaggcgcucg

SEQ ID NO: 1426393 - RNA, 14 nt, Pseudomonas aeruginosa PA01
gacccaugccgcua

SEQ ID NO: 1426394 - RNA, 17 nt, Pseudomonas aeruginosa PA01
gacccaguugggccagg

SEQ ID NO: 1426395 - RNA, 19 nt, Pseudomonas aeruginosa PA01
gaccccaccggucuuggcg

SEQ ID NO: 1426396 - RNA, 14 nt, Pseudomonas aeruginosa PA01
gaccccacgccggc

SEQ ID NO: 1426397 - RNA, 17 nt, Pseudomonas aeruginosa PA01
gaccccacgccggccgg

SEQ ID NO: 1426398 - RNA, 16 nt, Pseudomonas aeruginosa PA01
gaccccgaggucggcg

SEQ ID NO: 1426399 - RNA, 23 nt, Pseudomonas aeruginosa PA01
gaccccgccggggcgugcaggcc

SEQ ID NO: 1426400 - RNA, 17 nt, Pseudomonas aeruginosa PA01
gacccgggucaggccga

SEQ ID NO: 1426401 - RNA, 18 nt, Pseudomonas aeruginosa PA01
gacccgguuaccggcgac

SEQ ID NO: 1426402 - RNA, 20 nt, Pseudomonas aeruginosa PA01
gacccgguuaccggcgacca

SEQ ID NO: 1426403 - RNA, 15 nt, Pseudomonas aeruginosa PA01
gacccgguacagcgc

SEQ ID NO: 1426404 - RNA, 17 nt, Pseudomonas aeruginosa PA01
gacccgguacagcgccu

SEQ ID NO: 1426405 - RNA, 19 nt, Pseudomonas aeruginosa PA01
gacccgguacagcgccugg

SEQ ID NO: 1426406 - RNA, 20 nt, Pseudomonas aeruginosa PA01
gacccgguacagcgccuggu

SEQ ID NO: 1426407 - RNA, 23 nt, Pseudomonas aeruginosa PA01
gacccgguacagcgccuggucgg

SEQ ID NO: 1426408 - RNA, 13 nt, Pseudomonas aeruginosa PA01
gacccggucgcug

SEQ ID NO: 1426409 - RNA, 23 nt, Pseudomonas aeruginosa PA01
gacccggucgcugaccagcccgg

SEQ ID NO: 1426410 - RNA, 14 nt, Pseudomonas aeruginosa PA01
gacccgcggcaggu

SEQ ID NO: 1426411 - RNA, 14 nt, Pseudomonas aeruginosa PA01
gacccgcgccggca

SEQ ID NO: 1426412 - RNA, 16 nt, Pseudomonas aeruginosa PA01
gacccgcgccggcagc

SEQ ID NO: 1426413 - RNA, 22 nt, Pseudomonas aeruginosa PA01
gacccgccgaccagcacggcga

SEQ ID NO: 1426414 - RNA, 23 nt, Pseudomonas aeruginosa PA01
gacccgcuguccgccggccucga

SEQ ID NO: 1426415 - RNA, 13 nt, Pseudomonas aeruginosa PA01
gacccgcucgccg

SEQ ID NO: 1426416 - RNA, 14 nt, Pseudomonas aeruginosa PA01
gacccgcucgccgg

SEQ ID NO: 1426417 - RNA, 13 nt, Pseudomonas aeruginosa PA01
gacccgcucggcc

SEQ ID NO: 1426418 - RNA, 15 nt, Pseudomonas aeruginosa PA01
gacccgcucggccuu

SEQ ID NO: 1426419 - RNA, 14 nt, Pseudomonas aeruginosa PA01
gaccguuucgccgc

SEQ ID NO: 1426420 - RNA, 16 nt, Pseudomonas aeruginosa PA01
gaccguuucgccgccg

SEQ ID NO: 1426421 - RNA, 20 nt, Pseudomonas aeruginosa PA01
gaccguuucgccgccggcca

SEQ ID NO: 1426422 - RNA, 20 nt, Pseudomonas aeruginosa PA01
gaccucagaccacgcccugc

SEQ ID NO: 1426423 - RNA, 16 nt, Pseudomonas aeruginosa PA01
gaccucccgcgccagc

SEQ ID NO: 1426424 - RNA, 22 nt, Pseudomonas aeruginosa PA01
gaccuccaggccgaagccgccg

SEQ ID NO: 1426425 - RNA, 14 nt, Pseudomonas aeruginosa PA01
gaccuccagccggc

SEQ ID NO: 1426426 - RNA, 16 nt, Pseudomonas aeruginosa PA01
gaccuccagccggcca

SEQ ID NO: 1426427 - RNA, 17 nt, Pseudomonas aeruginosa PA01
gaccuccagccggccau

SEQ ID NO: 1426428 - RNA, 14 nt, Pseudomonas aeruginosa PA01
gaccucgacgccga

SEQ ID NO: 1426429 - RNA, 15 nt, Pseudomonas aeruginosa PA01
gaccucgacgccgag

SEQ ID NO: 1426430 - RNA, 16 nt, Pseudomonas aeruginosa PA01
gaccucgacgccgagc

SEQ ID NO: 1426431 - RNA, 17 nt, Pseudomonas aeruginosa PA01
gaccucgaagcuggcca

SEQ ID NO: 1426432 - RNA, 18 nt, Pseudomonas aeruginosa PA01
gaccucgaagcuggccag

SEQ ID NO: 1426433 - RNA, 13 nt, Pseudomonas aeruginosa PA01
gaccuccuggcgc

SEQ ID NO: 1426434 - RNA, 14 nt, Pseudomonas aeruginosa PA01
gaccuccggcgcca

SEQ ID NO: 1426435 - RNA, 16 nt, Pseudomonas aeruginosa PA01
gaccuccggcgccagg

SEQ ID NO: 1426436 - RNA, 14 nt, Pseudomonas aeruginosa PA01
gaccuccucgauga

SEQ ID NO: 1426437 - RNA, 14 nt, Pseudomonas aeruginosa PA01
gaccuccgccagga

SEQ ID NO: 1426438 - RNA, 14 nt, Pseudomonas aeruginosa PA01
gaccuccgccaggu

SEQ ID NO: 1426439 - RNA, 12 nt, Pseudomonas aeruginosa PA01
gaccucgcccau

SEQ ID NO: 1426440 - RNA, 17 nt, Pseudomonas aeruginosa PA01
gaccugcagcaggauca

SEQ ID NO: 1426441 - RNA, 21 nt, Pseudomonas aeruginosa PA01
gaccugcggcaagugggucac

SEQ ID NO: 1426442 - RNA, 20 nt, Pseudomonas aeruginosa PA01
gaccugcucgaaccggaaaa

SEQ ID NO: 1426443 - RNA, 19 nt, Pseudomonas aeruginosa PA01
gaccugcgaggcgucgauc

SEQ ID NO: 1426444 - RNA, 14 nt, Pseudomonas aeruginosa PA01
gaccugcccgcugu

SEQ ID NO: 1426445 - RNA, 14 nt, Pseudomonas aeruginosa PA01
gaccugcagcgccu

SEQ ID NO: 1426446 - RNA, 16 nt, Pseudomonas aeruginosa PA01
gaccugcagcgccucg

SEQ ID NO: 1426447 - RNA, 15 nt, Pseudomonas aeruginosa PA01
gaccugccgcccggc

SEQ ID NO: 1426448 - RNA, 16 nt, Pseudomonas aeruginosa PA01
gaccugccgcccggcc

SEQ ID NO: 1426449 - RNA, 17 nt, Pseudomonas aeruginosa PA01
gaccugccgcccggcca

SEQ ID NO: 1426450 - RNA, 18 nt, Pseudomonas aeruginosa PA01
gaccugccgcccggccag

SEQ ID NO: 1426451 - RNA, 19 nt, Pseudomonas aeruginosa PA01
gaccugccgcccggccagg

SEQ ID NO: 1426452 - RNA, 17 nt, Pseudomonas aeruginosa PA01
gaccgcgugggccggca

SEQ ID NO: 1426453 - RNA, 18 nt, Pseudomonas aeruginosa PA01
gaccgcguccaugccgua

SEQ ID NO: 1426454 - RNA, 13 nt, Pseudomonas aeruginosa PA01
gaccgcuggacca

SEQ ID NO: 1426455 - RNA, 15 nt, Pseudomonas aeruginosa PA01
gaccgcucgucaggc

SEQ ID NO: 1426456 - RNA, 16 nt, Pseudomonas aeruginosa PA01
gaccgcucgucaggcg

SEQ ID NO: 1426457 - RNA, 23 nt, Pseudomonas aeruginosa PA01
gaccggaucuaaggggcggcucg

SEQ ID NO: 1426458 - RNA, 13 nt, Pseudomonas aeruginosa PA01
gaccgucggccgg

SEQ ID NO: 1426459 - RNA, 23 nt, Pseudomonas aeruginosa PA01
gaccgucggccggggucaggccg

SEQ ID NO: 1426460 - RNA, 20 nt, Pseudomonas aeruginosa PA01
gaccgucggcaagcaggccg

SEQ ID NO: 1426461 - RNA, 15 nt, Pseudomonas aeruginosa PA01
gaccguccgccugcg

SEQ ID NO: 1426462 - RNA, 14 nt, Pseudomonas aeruginosa PA01
gaccguccggucgc

SEQ ID NO: 1426463 - RNA, 15 nt, Pseudomonas aeruginosa PA01
gaccguccuggcccu

SEQ ID NO: 1426464 - RNA, 18 nt, Pseudomonas aeruginosa PA01
gaccguccuggcccugcc

SEQ ID NO: 1426465 - RNA, 22 nt, Pseudomonas aeruginosa PA01
gaccgucgcgauagacgccggc

SEQ ID NO: 1426466 - RNA, 12 nt, Pseudomonas aeruginosa PA01
gaccggcagcgc

SEQ ID NO: 1426467 - RNA, 16 nt, Pseudomonas aeruginosa PA01
gaccggcagcgccgcc

SEQ ID NO: 1426468 - RNA, 18 nt, Pseudomonas aeruginosa PA01
gaccggcagcgccgccag

SEQ ID NO: 1426469 - RNA, 19 nt, Pseudomonas aeruginosa PA01
gaccggcagcgccgccagc

SEQ ID NO: 1426470 - RNA, 21 nt, Pseudomonas aeruginosa PA01
gaccggcagcgccgccagcag

SEQ ID NO: 1426471 - RNA, 22 nt, Pseudomonas aeruginosa PA01
gaccggcagcgccgccagcagg

SEQ ID NO: 1426472 - RNA, 23 nt, Pseudomonas aeruginosa PA01
gaccggcaggucgggcaacggcu

SEQ ID NO: 1426473 - RNA, 12 nt, Pseudomonas aeruginosa PA01
gaccggcagccg

SEQ ID NO: 1426474 - RNA, 22 nt, Pseudomonas aeruginosa PA01
gaccguccacggcgcgucggcg

SEQ ID NO: 1426475 - RNA, 16 nt, Pseudomonas aeruginosa PA01
gaccguccagcgcgcc

SEQ ID NO: 1426476 - RNA, 19 nt, Pseudomonas aeruginosa PA01
gaccguccagcgcgccgcg

SEQ ID NO: 1426477 - RNA, 16 nt, Pseudomonas aeruginosa PA01
gaccgucagccaggcu

SEQ ID NO: 1426478 - RNA, 23 nt, Pseudomonas aeruginosa PA01
gaccgucauguuguucgcgcacc

SEQ ID NO: 1426479 - RNA, 21 nt, Pseudomonas aeruginosa PA01
gacgacaccugcaacgcccgc

SEQ ID NO: 1426480 - RNA, 15 nt, Pseudomonas aeruginosa PA01
gacgaagcgcaccgg

SEQ ID NO: 1426481 - RNA, 13 nt, Pseudomonas aeruginosa PA01
gacgaagcgccgg

SEQ ID NO: 1426482 - RNA, 22 nt, Pseudomonas aeruginosa PA01
gacgaagcccaggcugacccgg

SEQ ID NO: 1426483 - RNA, 16 nt, Pseudomonas aeruginosa PA01
gacgaacggaucgcuc

SEQ ID NO: 1426484 - RNA, 18 nt, Pseudomonas aeruginosa PA01
gacgaacucgacgcgcca

SEQ ID NO: 1426485 - RNA, 21 nt, Pseudomonas aeruginosa PA01
gacgaacucgacgcgccaggu

SEQ ID NO: 1426486 - RNA, 12 nt, Pseudomonas aeruginosa PA01
gaccugucggcu

SEQ ID NO: 1426487 - RNA, 22 nt, Pseudomonas aeruginosa PA01
gaccugucggcucgcgccggcg

SEQ ID NO: 1426488 - RNA, 20 nt, Pseudomonas aeruginosa PA01
gaccuguccagucaccaggu

SEQ ID NO: 1426489 - RNA, 21 nt, Pseudomonas aeruginosa PA01
gaccugucccgauuccgcgca

SEQ ID NO: 1426490 - RNA, 15 nt, Pseudomonas aeruginosa PA01
gaccuggucguugcg

SEQ ID NO: 1426491 - RNA, 17 nt, Pseudomonas aeruginosa PA01
gaccugguggcgccggc

SEQ ID NO: 1426492 - RNA, 20 nt, Pseudomonas aeruginosa PA01
gaccugguggcgccggcuga

SEQ ID NO: 1426493 - RNA, 17 nt, Pseudomonas aeruginosa PA01
gaccugguagucgcggu

SEQ ID NO: 1426494 - RNA, 18 nt, Pseudomonas aeruginosa PA01
gaccugguagucgcgguu

SEQ ID NO: 1426495 - RNA, 15 nt, Pseudomonas aeruginosa PA01
gacgaacgagaagcc

SEQ ID NO: 1426496 - RNA, 13 nt, Pseudomonas aeruginosa PA01
gaccuucacuucg

SEQ ID NO: 1426497 - RNA, 14 nt, Pseudomonas aeruginosa PA01
gaccuucagcaccu

SEQ ID NO: 1426498 - RNA, 17 nt, Pseudomonas aeruginosa PA01
gaccuucagcaccugcg

SEQ ID NO: 1426499 - RNA, 22 nt, Pseudomonas aeruginosa PA01
gaccuucaucaggcggcacucg

SEQ ID NO: 1426500 - RNA, 17 nt, Pseudomonas aeruginosa PA01
gaccuuccagccgcgcg

SEQ ID NO: 1426501 - RNA, 20 nt, Pseudomonas aeruginosa PA01
gaccuuccagccgcgcgcgu

SEQ ID NO: 1426502 - RNA, 23 nt, Pseudomonas aeruginosa PA01
gaccuguucgaaguucuccagca

SEQ ID NO: 1426503 - RNA, 17 nt, Pseudomonas aeruginosa PA01
gaccuguucgcgcccgu

SEQ ID NO: 1426504 - RNA, 19 nt, Pseudomonas aeruginosa PA01
gaccuguucgcgcccgucg

SEQ ID NO: 1426505 - RNA, 19 nt, Pseudomonas aeruginosa PA01
gaccuucaacgguggugga

SEQ ID NO: 1426506 - RNA, 14 nt, Pseudomonas aeruginosa PA01
gaccuuccgccagc

SEQ ID NO: 1426507 - RNA, 18 nt, Pseudomonas aeruginosa PA01
gaccuuccgccagcaggc

SEQ ID NO: 1426508 - RNA, 17 nt, Pseudomonas aeruginosa PA01
gaccuucgacggcaggu

SEQ ID NO: 1426509 - RNA, 17 nt, Pseudomonas aeruginosa PA01
gacgagcagcucgccgg

SEQ ID NO: 1426510 - RNA, 18 nt, Pseudomonas aeruginosa PA01
gacgagcagcucgccggc

SEQ ID NO: 1426511 - RNA, 19 nt, Pseudomonas aeruginosa PA01
gacgagcagcucgccggcg

SEQ ID NO: 1426512 - RNA, 22 nt, Pseudomonas aeruginosa PA01
gacgagccgcgacgcgaccucc

SEQ ID NO: 1426513 - RNA, 16 nt, Pseudomonas aeruginosa PA01
gacgagccggacggcg

SEQ ID NO: 1426514 - RNA, 20 nt, Pseudomonas aeruginosa PA01
gacgaggaaggcgcgcacca

SEQ ID NO: 1426515 - RNA, 13 nt, Pseudomonas aeruginosa PA01
gacgaggacgccg

SEQ ID NO: 1426516 - RNA, 14 nt, Pseudomonas aeruginosa PA01
gacgacugcggcag

SEQ ID NO: 1426517 - RNA, 22 nt, Pseudomonas aeruginosa PA01
gacgacugcggcagcuuggcga

SEQ ID NO: 1426518 - RNA, 22 nt, Pseudomonas aeruginosa PA01
gacgagaaaaagcccggcauuc

SEQ ID NO: 1426519 - RNA, 17 nt, Pseudomonas aeruginosa PA01
gacgagacgccgaggag

SEQ ID NO: 1426520 - RNA, 19 nt, Pseudomonas aeruginosa PA01
gacgagacguugacgaucg

SEQ ID NO: 1426521 - RNA, 21 nt, Pseudomonas aeruginosa PA01
gacgaccucagaccacgcccu

SEQ ID NO: 1426522 - RNA, 23 nt, Pseudomonas aeruginosa PA01
gacgacgaagugaccgcgcgcca

SEQ ID NO: 1426523 - RNA, 18 nt, Pseudomonas aeruginosa PA01
gacgacgaaagaagccgc

SEQ ID NO: 1426524 - RNA, 17 nt, Pseudomonas aeruginosa PA01
gacgacgaaaggccgcg

SEQ ID NO: 1426525 - RNA, 19 nt, Pseudomonas aeruginosa PA01
gacgacgaacgccuuggug

SEQ ID NO: 1426526 - RNA, 14 nt, Pseudomonas aeruginosa PA01
gacgacgcuggccu

SEQ ID NO: 1426527 - RNA, 15 nt, Pseudomonas aeruginosa PA01
gacgacgcuggccug

SEQ ID NO: 1426528 - RNA, 14 nt, Pseudomonas aeruginosa PA01
gacggugcggccgu

SEQ ID NO: 1426529 - RNA, 19 nt, Pseudomonas aeruginosa PA01
gacggugcuguuguugccg

SEQ ID NO: 1426530 - RNA, 16 nt, Pseudomonas aeruginosa PA01
gacgguggaggcgggc

SEQ ID NO: 1426531 - RNA, 20 nt, Pseudomonas aeruginosa PA01
gacggugaccuugucgcggu

SEQ ID NO: 1426532 - RNA, 19 nt, Pseudomonas aeruginosa PA01
gacgggcauugucccugcg

SEQ ID NO: 1426533 - RNA, 13 nt, Pseudomonas aeruginosa PA01
gacggucucgccg

SEQ ID NO: 1426534 - RNA, 15 nt, Pseudomonas aeruginosa PA01
gacggucucgccgcc

SEQ ID NO: 1426535 - RNA, 14 nt, Pseudomonas aeruginosa PA01
gacggugcaggccg

SEQ ID NO: 1426536 - RNA, 17 nt, Pseudomonas aeruginosa PA01
gacggugcaggccgacg

SEQ ID NO: 1426537 - RNA, 22 nt, Pseudomonas aeruginosa PA01
gacggugauucguccggagccg

SEQ ID NO: 1426538 - RNA, 22 nt, Pseudomonas aeruginosa PA01
gacggugcagccacccagcagc

SEQ ID NO: 1426539 - RNA, 21 nt, Pseudomonas aeruginosa PA01
gacggugaaguagaucgcccg

SEQ ID NO: 1426540 - RNA, 15 nt, Pseudomonas aeruginosa PA01
gacggugaucgccgc

SEQ ID NO: 1426541 - RNA, 16 nt, Pseudomonas aeruginosa PA01
gacggugaucgccgcg

SEQ ID NO: 1426542 - RNA, 17 nt, Pseudomonas aeruginosa PA01
gacggugaucgccgcga

SEQ ID NO: 1426543 - RNA, 17 nt, Pseudomonas aeruginosa PA01
gacggggccucgcugcc

SEQ ID NO: 1426544 - RNA, 20 nt, Pseudomonas aeruginosa PA01
gacggggaucacucgccgcc

SEQ ID NO: 1426545 - RNA, 22 nt, Pseudomonas aeruginosa PA01
gacggggaucacucgccgccgu

SEQ ID NO: 1426546 - RNA, 20 nt, Pseudomonas aeruginosa PA01
gacgggagcgcgaggcgcag

SEQ ID NO: 1426547 - RNA, 20 nt, Pseudomonas aeruginosa PA01
gacgggcgacgcccauguag

SEQ ID NO: 1426548 - RNA, 13 nt, Pseudomonas aeruginosa PA01
gacgggccgcgcc

SEQ ID NO: 1426549 - RNA, 15 nt, Pseudomonas aeruginosa PA01
gacgggccgcgccgc

SEQ ID NO: 1426550 - RNA, 12 nt, Pseudomonas aeruginosa PA01
gacgucgacgca

SEQ ID NO: 1426551 - RNA, 14 nt, Pseudomonas aeruginosa PA01
gacgucgacgcagc

SEQ ID NO: 1426552 - RNA, 16 nt, Pseudomonas aeruginosa PA01
gacguccuccaccgcu

SEQ ID NO: 1426553 - RNA, 14 nt, Pseudomonas aeruginosa PA01
gacguccuggccga

SEQ ID NO: 1426554 - RNA, 17 nt, Pseudomonas aeruginosa PA01
gacguccuggccgagcc

SEQ ID NO: 1426555 - RNA, 17 nt, Pseudomonas aeruginosa PA01
gacgucgaggaaggcca

SEQ ID NO: 1426556 - RNA, 20 nt, Pseudomonas aeruginosa PA01
gacgucgaggaaggccaggu

SEQ ID NO: 1426557 - RNA, 22 nt, Pseudomonas aeruginosa PA01
gacgucgaggucgacggcggcc

SEQ ID NO: 1426558 - RNA, 17 nt, Pseudomonas aeruginosa PA01
gacgucgacuucgucga

SEQ ID NO: 1426559 - RNA, 17 nt, Pseudomonas aeruginosa PA01
gacguccaucagcgucu

SEQ ID NO: 1426560 - RNA, 16 nt, Pseudomonas aeruginosa PA01
gacguccagcgccacu

SEQ ID NO: 1426561 - RNA, 22 nt, Pseudomonas aeruginosa PA01
gacguccagcgccacuuccagg

SEQ ID NO: 1426562 - RNA, 14 nt, Pseudomonas aeruginosa PA01
gacguccagcgcca

SEQ ID NO: 1426563 - RNA, 17 nt, Pseudomonas aeruginosa PA01
gacguccacugcguccu

SEQ ID NO: 1426564 - RNA, 19 nt, Pseudomonas aeruginosa PA01
gacguccacugcguccugg

SEQ ID NO: 1426565 - RNA, 13 nt, Pseudomonas aeruginosa PA01
gacguccagcgcc

SEQ ID NO: 1426566 - RNA, 19 nt, Pseudomonas aeruginosa PA01
gacgucauaggccuuggcg

SEQ ID NO: 1426567 - RNA, 23 nt, Pseudomonas aeruginosa PA01
gacgucacggauaggcggcggau

SEQ ID NO: 1426568 - RNA, 23 nt, Pseudomonas aeruginosa PA01
gacggccuuggucucgcgggcga

SEQ ID NO: 1426569 - RNA, 14 nt, Pseudomonas aeruginosa PA01
gacggcccuccggc

SEQ ID NO: 1426570 - RNA, 19 nt, Pseudomonas aeruginosa PA01
gacggccgcgccggcuccc

SEQ ID NO: 1426571 - RNA, 12 nt, Pseudomonas aeruginosa PA01
gacggccugcgc

SEQ ID NO: 1426572 - RNA, 14 nt, Pseudomonas aeruginosa PA01
gacggcgcgcugcg

SEQ ID NO: 1426573 - RNA, 21 nt, Pseudomonas aeruginosa PA01
gacgggaagcgaaccaggcaa

SEQ ID NO: 1426574 - RNA, 20 nt, Pseudomonas aeruginosa PA01
gacggcuugaucacgccgaa

SEQ ID NO: 1426575 - RNA, 17 nt, Pseudomonas aeruginosa PA01
gacggcugcuccggauc

SEQ ID NO: 1426576 - RNA, 13 nt, Pseudomonas aeruginosa PA01
gacggcuuccagg

SEQ ID NO: 1426577 - RNA, 16 nt, Pseudomonas aeruginosa PA01
gacgcuccagcggcag

SEQ ID NO: 1426578 - RNA, 13 nt, Pseudomonas aeruginosa PA01
gacgcuccaggug

SEQ ID NO: 1426579 - RNA, 21 nt, Pseudomonas aeruginosa PA01
gacgcuccaggugcacggcca

SEQ ID NO: 1426580 - RNA, 22 nt, Pseudomonas aeruginosa PA01
gacgcuacguuccagggccugg

SEQ ID NO: 1426581 - RNA, 11 nt, Pseudomonas aeruginosa PA01
gacgcguccgg

SEQ ID NO: 1426582 - RNA, 21 nt, Pseudomonas aeruginosa PA01
gacgcggcggcuccggcgcca

SEQ ID NO: 1426583 - RNA, 16 nt, Pseudomonas aeruginosa PA01
gacggcagggucagcc

SEQ ID NO: 1426584 - RNA, 23 nt, Pseudomonas aeruginosa PA01
gacggcagggucagccgaugcuc

SEQ ID NO: 1426585 - RNA, 13 nt, Pseudomonas aeruginosa PA01
gacggcagguggc

SEQ ID NO: 1426586 - RNA, 23 nt, Pseudomonas aeruginosa PA01
gacggcagguggcgggucggcgg

SEQ ID NO: 1426587 - RNA, 12 nt, Pseudomonas aeruginosa PA01
gacggcaggccc

SEQ ID NO: 1426588 - RNA, 23 nt, Pseudomonas aeruginosa PA01
gacggcauuccugguccagccag

SEQ ID NO: 1426589 - RNA, 14 nt, Pseudomonas aeruginosa PA01
gacggcccgccccg

SEQ ID NO: 1426590 - RNA, 17 nt, Pseudomonas aeruginosa PA01
gacggcccgccccgcaa

SEQ ID NO: 1426591 - RNA, 13 nt, Pseudomonas aeruginosa PA01
gacgccaccagcc

SEQ ID NO: 1426592 - RNA, 14 nt, Pseudomonas aeruginosa PA01
gacgccaccagcca

SEQ ID NO: 1426593 - RNA, 16 nt, Pseudomonas aeruginosa PA01
gacgccaccaggccgc

SEQ ID NO: 1426594 - RNA, 13 nt, Pseudomonas aeruginosa PA01
gacgccacccgca

SEQ ID NO: 1426595 - RNA, 23 nt, Pseudomonas aeruginosa PA01
gacgccacccgcaucgaggccgc

SEQ ID NO: 1426596 - RNA, 17 nt, Pseudomonas aeruginosa PA01
gacgccagccgcccugg

SEQ ID NO: 1426597 - RNA, 13 nt, Pseudomonas aeruginosa PA01
gacgccgcccggc

SEQ ID NO: 1426598 - RNA, 15 nt, Pseudomonas aeruginosa PA01
gacgccgcccggcac

SEQ ID NO: 1426599 - RNA, 16 nt, Pseudomonas aeruginosa PA01
gacgccgcccggcacc

SEQ ID NO: 1426600 - RNA, 14 nt, Pseudomonas aeruginosa PA01
gacgccgcggccgg

SEQ ID NO: 1426601 - RNA, 16 nt, Pseudomonas aeruginosa PA01
gacgccgcggccggcg

SEQ ID NO: 1426602 - RNA, 21 nt, Pseudomonas aeruginosa PA01
gacgccgcgauggcucgcggc

SEQ ID NO: 1426603 - RNA, 16 nt, Pseudomonas aeruginosa PA01
gacgccgcuggcggcg

SEQ ID NO: 1426604 - RNA, 17 nt, Pseudomonas aeruginosa PA01
gacgccgcuggcggcgc

SEQ ID NO: 1426605 - RNA, 22 nt, Pseudomonas aeruginosa PA01
gacgccgucccauuccucggcg

SEQ ID NO: 1426606 - RNA, 13 nt, Pseudomonas aeruginosa PA01
gacgccgcguccc

SEQ ID NO: 1426607 - RNA, 16 nt, Pseudomonas aeruginosa PA01
gacgccgcuggaaccg

SEQ ID NO: 1426608 - RNA, 17 nt, Pseudomonas aeruginosa PA01
gacgccgcuggaaccgg

SEQ ID NO: 1426609 - RNA, 21 nt, Pseudomonas aeruginosa PA01
gacgccgcuggaaccggccgg

SEQ ID NO: 1426610 - RNA, 22 nt, Pseudomonas aeruginosa PA01
gacgccgcuggaaccggccggc

SEQ ID NO: 1426611 - RNA, 13 nt, Pseudomonas aeruginosa PA01
gacgccucgucgg

SEQ ID NO: 1426612 - RNA, 15 nt, Pseudomonas aeruginosa PA01
gacgccucgucggag

SEQ ID NO: 1426613 - RNA, 17 nt, Pseudomonas aeruginosa PA01
gacgccucgucggaggc

SEQ ID NO: 1426614 - RNA, 17 nt, Pseudomonas aeruginosa PA01
gacgccuucguggccgc

SEQ ID NO: 1426615 - RNA, 15 nt, Pseudomonas aeruginosa PA01
gacgccugucggcac

SEQ ID NO: 1426616 - RNA, 15 nt, Pseudomonas aeruginosa PA01
gacgcggaugcccug

SEQ ID NO: 1426617 - RNA, 17 nt, Pseudomonas aeruginosa PA01
gacgcggaugcccuggu

SEQ ID NO: 1426618 - RNA, 19 nt, Pseudomonas aeruginosa PA01
gacgcggauuggccgggcc

SEQ ID NO: 1426619 - RNA, 14 nt, Pseudomonas aeruginosa PA01
gacgcggacagccu

SEQ ID NO: 1426620 - RNA, 16 nt, Pseudomonas aeruginosa PA01
gacgcggacagccugg

SEQ ID NO: 1426621 - RNA, 12 nt, Pseudomonas aeruginosa PA01
gacgcggccugg

SEQ ID NO: 1426622 - RNA, 18 nt, Pseudomonas aeruginosa PA01
gacgcggccugggccgaa

SEQ ID NO: 1426623 - RNA, 19 nt, Pseudomonas aeruginosa PA01
gacgcggccugggccgaag

SEQ ID NO: 1426624 - RNA, 12 nt, Pseudomonas aeruginosa PA01
gacgcgcggcug

SEQ ID NO: 1426625 - RNA, 14 nt, Pseudomonas aeruginosa PA01
gacgcgcggcugcu

SEQ ID NO: 1426626 - RNA, 15 nt, Pseudomonas aeruginosa PA01
gacgcgcugccccug

SEQ ID NO: 1426627 - RNA, 12 nt, Pseudomonas aeruginosa PA01
gacgcgcuggac

SEQ ID NO: 1426628 - RNA, 14 nt, Pseudomonas aeruginosa PA01
gacgcgcuuguccu

SEQ ID NO: 1426629 - RNA, 21 nt, Pseudomonas aeruginosa PA01
gacgcgcuuguccuccagcug

SEQ ID NO: 1426630 - RNA, 22 nt, Pseudomonas aeruginosa PA01
gacgcgcgcugccugcgaugga

SEQ ID NO: 1426631 - RNA, 14 nt, Pseudomonas aeruginosa PA01
gacgcgccggcgga

SEQ ID NO: 1426632 - RNA, 17 nt, Pseudomonas aeruginosa PA01
gacgcgccaggugcgcu

SEQ ID NO: 1426633 - RNA, 19 nt, Pseudomonas aeruginosa PA01
gacgcgccaggugcgcugg

SEQ ID NO: 1426634 - RNA, 20 nt, Pseudomonas aeruginosa PA01
gacgcgaccuccggcgccag

SEQ ID NO: 1426635 - RNA, 22 nt, Pseudomonas aeruginosa PA01
gacgcgaccuccggcgccaggc

SEQ ID NO: 1426636 - RNA, 23 nt, Pseudomonas aeruginosa PA01
gacgcgaccuccggcgccaggcc

SEQ ID NO: 1426637 - RNA, 14 nt, Pseudomonas aeruginosa PA01
gacgcgaucccgcu

SEQ ID NO: 1426638 - RNA, 17 nt, Pseudomonas aeruginosa PA01
gacgaucgccccgcuac

SEQ ID NO: 1426639 - RNA, 21 nt, Pseudomonas aeruginosa PA01
gacgaucgccccgcuacccug

SEQ ID NO: 1426640 - RNA, 15 nt, Pseudomonas aeruginosa PA01
gacgauccggccgau

SEQ ID NO: 1426641 - RNA, 22 nt, Pseudomonas aeruginosa PA01
gacgauccggccgaucuccugg

SEQ ID NO: 1426642 - RNA, 22 nt, Pseudomonas aeruginosa PA01
gacgaucaggugcaggaacagc

SEQ ID NO: 1426643 - RNA, 14 nt, Pseudomonas aeruginosa PA01
gacgaucagcggcc

SEQ ID NO: 1426644 - RNA, 16 nt, Pseudomonas aeruginosa PA01
gacgaucagcucuucc

SEQ ID NO: 1426645 - RNA, 19 nt, Pseudomonas aeruginosa PA01
gacgaucucccgcgauucg

SEQ ID NO: 1426646 - RNA, 23 nt, Pseudomonas aeruginosa PA01
gacgaucucccgcgauucgccgg

SEQ ID NO: 1426647 - RNA, 16 nt, Pseudomonas aeruginosa PA01
gacgaucuccugcugg

SEQ ID NO: 1426648 - RNA, 20 nt, Pseudomonas aeruginosa PA01
gacgaucuccugcugggcgu

SEQ ID NO: 1426649 - RNA, 17 nt, Pseudomonas aeruginosa PA01
gacgaucuggcagucgu

SEQ ID NO: 1426650 - RNA, 15 nt, Pseudomonas aeruginosa PA01
gacgaucugcgagcg

SEQ ID NO: 1426651 - RNA, 17 nt, Pseudomonas aeruginosa PA01
gacgauaucggcgccgg

SEQ ID NO: 1426652 - RNA, 23 nt, Pseudomonas aeruginosa PA01
gacgauaucggcgccggccucca

SEQ ID NO: 1426653 - RNA, 22 nt, Pseudomonas aeruginosa PA01
gacgaucacccccagcgagccg

SEQ ID NO: 1426654 - RNA, 16 nt, Pseudomonas aeruginosa PA01
gacgaucacucccugc

SEQ ID NO: 1426655 - RNA, 13 nt, Pseudomonas aeruginosa PA01
gacgaucagcccg

SEQ ID NO: 1426656 - RNA, 18 nt, Pseudomonas aeruginosa PA01
gacgaucagcccgccggc

SEQ ID NO: 1426657 - RNA, 20 nt, Pseudomonas aeruginosa PA01
gacgaggauggucaggccgg

SEQ ID NO: 1426658 - RNA, 22 nt, Pseudomonas aeruginosa PA01
gacgaggauggucaggccggcg

SEQ ID NO: 1426659 - RNA, 20 nt, Pseudomonas aeruginosa PA01
gacgaggggcugcggagcgu

SEQ ID NO: 1426660 - RNA, 19 nt, Pseudomonas aeruginosa PA01
gacgaguaaaacggcaggc

SEQ ID NO: 1426661 - RNA, 17 nt, Pseudomonas aeruginosa PA01
gacgcacucauagcuca

SEQ ID NO: 1426662 - RNA, 21 nt, Pseudomonas aeruginosa PA01
gacgcagagcgccaugacccg

SEQ ID NO: 1426663 - RNA, 14 nt, Pseudomonas aeruginosa PA01
gacgcaccagcagg

SEQ ID NO: 1426664 - RNA, 15 nt, Pseudomonas aeruginosa PA01
gacgcaagcgcucgg

SEQ ID NO: 1426665 - RNA, 18 nt, Pseudomonas aeruginosa PA01
gacgauggccagcccgga

SEQ ID NO: 1426666 - RNA, 18 nt, Pseudomonas aeruginosa PA01
gacgauggaacgcggguu

SEQ ID NO: 1426667 - RNA, 16 nt, Pseudomonas aeruginosa PA01
gacgauggucgccgcg

SEQ ID NO: 1426668 - RNA, 13 nt, Pseudomonas aeruginosa PA01
gacgauggcgccu

SEQ ID NO: 1426669 - RNA, 22 nt, Pseudomonas aeruginosa PA01
gacgauguucgaggcgccgacc

SEQ ID NO: 1426670 - RNA, 23 nt, Pseudomonas aeruginosa PA01
gacgauguucuccacgucguccg

SEQ ID NO: 1426671 - RNA, 20 nt, Pseudomonas aeruginosa PA01
gacgauguuguugcccacca

SEQ ID NO: 1426672 - RNA, 14 nt, Pseudomonas aeruginosa PA01
gacgauggugcgcu

SEQ ID NO: 1426673 - RNA, 17 nt, Pseudomonas aeruginosa PA01
gacgaugaucaccagga

SEQ ID NO: 1426674 - RNA, 14 nt, Pseudomonas aeruginosa PA01
gacgaugccgaucu

SEQ ID NO: 1426675 - RNA, 16 nt, Pseudomonas aeruginosa PA01
gacgaugccgccgccg

SEQ ID NO: 1426676 - RNA, 22 nt, Pseudomonas aeruginosa PA01
gacgaugccguucaggcgcgga

SEQ ID NO: 1426677 - RNA, 18 nt, Pseudomonas aeruginosa PA01
gacgaugcgccccagcgc

SEQ ID NO: 1426678 - RNA, 22 nt, Pseudomonas aeruginosa PA01
gacgaugcgccccagcgccugg

SEQ ID NO: 1426679 - RNA, 23 nt, Pseudomonas aeruginosa PA01
gacgaugcgccccagcgccuggg

SEQ ID NO: 1426680 - RNA, 13 nt, Pseudomonas aeruginosa PA01
gacgaugcggccc

SEQ ID NO: 1426681 - RNA, 14 nt, Pseudomonas aeruginosa PA01
gacgaugcggcccg

SEQ ID NO: 1426682 - RNA, 14 nt, Pseudomonas aeruginosa PA01
gaacgucggcgggg

SEQ ID NO: 1426683 - RNA, 15 nt, Pseudomonas aeruginosa PA01
gaacuggucgcucca

SEQ ID NO: 1426684 - RNA, 16 nt, Pseudomonas aeruginosa PA01
gaacuggucgcuccag

SEQ ID NO: 1426685 - RNA, 14 nt, Pseudomonas aeruginosa PA01
gaacugggcgagca

SEQ ID NO: 1426686 - RNA, 17 nt, Pseudomonas aeruginosa PA01
gaacuggaucggcccca

SEQ ID NO: 1426687 - RNA, 11 nt, Pseudomonas aeruginosa PA01
gaacuggcguu

SEQ ID NO: 1426688 - RNA, 20 nt, Pseudomonas aeruginosa PA01
gaacguucaguucugggcgg

SEQ ID NO: 1426689 - RNA, 23 nt, Pseudomonas aeruginosa PA01
gaacguucaguucugggcggcca

SEQ ID NO: 1426690 - RNA, 22 nt, Pseudomonas aeruginosa PA01
gaagaagccauugccgaugugc

SEQ ID NO: 1426691 - RNA, 19 nt, Pseudomonas aeruginosa PA01
gaagaacaccacgcggugc

SEQ ID NO: 1426692 - RNA, 19 nt, Pseudomonas aeruginosa PA01
gaagaaccccggcucaugg

SEQ ID NO: 1426693 - RNA, 16 nt, Pseudomonas aeruginosa PA01
gaagaacaggcgcuuc

SEQ ID NO: 1426694 - RNA, 21 nt, Pseudomonas aeruginosa PA01
gaacuugcgcaccgcgccggg

SEQ ID NO: 1426695 - RNA, 23 nt, Pseudomonas aeruginosa PA01
gaacuucuccagguacagccgca

SEQ ID NO: 1426696 - RNA, 17 nt, Pseudomonas aeruginosa PA01
gaacuugccggcgccau

SEQ ID NO: 1426697 - RNA, 15 nt, Pseudomonas aeruginosa PA01
gaacuugucgccgcu

SEQ ID NO: 1426698 - RNA, 16 nt, Pseudomonas aeruginosa PA01
gaacuugucgccgcug

SEQ ID NO: 1426699 - RNA, 19 nt, Pseudomonas aeruginosa PA01
gaacuugucgccgcuggac

SEQ ID NO: 1426700 - RNA, 14 nt, Pseudomonas aeruginosa PA01
gaagacgcccagca

SEQ ID NO: 1426701 - RNA, 16 nt, Pseudomonas aeruginosa PA01
gaagacgcccagcagg

SEQ ID NO: 1426702 - RNA, 12 nt, Pseudomonas aeruginosa PA01
gaagacgaucuc

SEQ ID NO: 1426703 - RNA, 15 nt, Pseudomonas aeruginosa PA01
gaagaccggccggcu

SEQ ID NO: 1426704 - RNA, 23 nt, Pseudomonas aeruginosa PA01
gaagaagccgaucaccaccagca

SEQ ID NO: 1426705 - RNA, 20 nt, Pseudomonas aeruginosa PA01
gaagaagcgcaccaccugca

SEQ ID NO: 1426706 - RNA, 14 nt, Pseudomonas aeruginosa PA01
gaagaagcugccgg

SEQ ID NO: 1426707 - RNA, 16 nt, Pseudomonas aeruginosa PA01
gaagaagcugccggca

SEQ ID NO: 1426708 - RNA, 12 nt, Pseudomonas aeruginosa PA01
gaagaaggcgau

SEQ ID NO: 1426709 - RNA, 20 nt, Pseudomonas aeruginosa PA01
gaagaaguaaucaccuuccu

SEQ ID NO: 1426710 - RNA, 20 nt, Pseudomonas aeruginosa PA01
gaagaccagucggccguugc

SEQ ID NO: 1426711 - RNA, 19 nt, Pseudomonas aeruginosa PA01
gaagacccccugccgcccu

SEQ ID NO: 1426712 - RNA, 22 nt, Pseudomonas aeruginosa PA01
gaagacccccugcggcccgagg

SEQ ID NO: 1426713 - RNA, 12 nt, Pseudomonas aeruginosa PA01
gaagacccugca

SEQ ID NO: 1426714 - RNA, 20 nt, Pseudomonas aeruginosa PA01
gaagaugcacaccagcuccc

SEQ ID NO: 1426715 - RNA, 12 nt, Pseudomonas aeruginosa PA01
gaagaucgccac

SEQ ID NO: 1426716 - RNA, 19 nt, Pseudomonas aeruginosa PA01
gaagaucgccugcuggccg

SEQ ID NO: 1426717 - RNA, 14 nt, Pseudomonas aeruginosa PA01
gaagaucgacaggc

SEQ ID NO: 1426718 - RNA, 17 nt, Pseudomonas aeruginosa PA01
gaagaucaucugggucc

SEQ ID NO: 1426719 - RNA, 21 nt, Pseudomonas aeruginosa PA01
gaagaucaucuggguccuggu

SEQ ID NO: 1426720 - RNA, 23 nt, Pseudomonas aeruginosa PA01
gaagaguucgcugaaggucgccg

SEQ ID NO: 1426721 - RNA, 19 nt, Pseudomonas aeruginosa PA01
gaagaggaucgcgaagcgc

SEQ ID NO: 1426722 - RNA, 19 nt, Pseudomonas aeruginosa PA01
gaagagcaucucgccggca

SEQ ID NO: 1426723 - RNA, 24 nt, Pseudomonas aeruginosa PA01
gaagagcaccuugucgcugaccgg

SEQ ID NO: 1426724 - RNA, 14 nt, Pseudomonas aeruginosa PA01
gaaacgcucggcgu

SEQ ID NO: 1426725 - RNA, 19 nt, Pseudomonas aeruginosa PA01
gaaacgcgccuccggcagc

SEQ ID NO: 1426726 - RNA, 20 nt, Pseudomonas aeruginosa PA01
gaaacggcggaauuccugcu

SEQ ID NO: 1426727 - RNA, 15 nt, Pseudomonas aeruginosa PA01
gaaacgcuggcggcc

SEQ ID NO: 1426728 - RNA, 18 nt, Pseudomonas aeruginosa PA01
gaaacgcuggcggccgag

SEQ ID NO: 1426729 - RNA, 20 nt, Pseudomonas aeruginosa PA01
gaaacgcuugagcuggcgcu

SEQ ID NO: 1426730 - RNA, 23 nt, Pseudomonas aeruginosa PA01
gaaacgcuugagcuggcgcuggu

SEQ ID NO: 1426731 - RNA, 15 nt, Pseudomonas aeruginosa PA01
gaaaccucgccgguc

SEQ ID NO: 1426732 - RNA, 14 nt, Pseudomonas aeruginosa PA01
gaaaccguggucgc

SEQ ID NO: 1426733 - RNA, 20 nt, Pseudomonas aeruginosa PA01
gaaaccugugcugcgcgccg

SEQ ID NO: 1426734 - RNA, 22 nt, Pseudomonas aeruginosa PA01
gaaaccugugcugcgcgccgca

SEQ ID NO: 1426735 - RNA, 18 nt, Pseudomonas aeruginosa PA01
gaaaccuucgguggcgac

SEQ ID NO: 1426736 - RNA, 20 nt, Pseudomonas aeruginosa PA01
gaaaccugcaacucggcgcc

SEQ ID NO: 1426737 - RNA, 15 nt, Pseudomonas aeruginosa PA01
gaaacgcagggccgg

SEQ ID NO: 1426738 - RNA, 19 nt, Pseudomonas aeruginosa PA01
gaaacgcagggccucuucg

SEQ ID NO: 1426739 - RNA, 23 nt, Pseudomonas aeruginosa PA01
gaacgacuccagcuucuucugca

SEQ ID NO: 1426740 - RNA, 14 nt, Pseudomonas aeruginosa PA01
gaaacgguccacca

SEQ ID NO: 1426741 - RNA, 23 nt, Pseudomonas aeruginosa PA01
gaacgagaagccgaucaggucgc

SEQ ID NO: 1426742 - RNA, 18 nt, Pseudomonas aeruginosa PA01
gaacgacucgucgcccca

SEQ ID NO: 1426743 - RNA, 20 nt, Pseudomonas aeruginosa PA01
gaacgaggcgacccggguca

SEQ ID NO: 1426744 - RNA, 15 nt, Pseudomonas aeruginosa PA01
gaacgaugccgcagg

SEQ ID NO: 1426745 - RNA, 21 nt, Pseudomonas aeruginosa PA01
gaacgaguugggcgaccugcu

SEQ ID NO: 1426746 - RNA, 15 nt, Pseudomonas aeruginosa PA01
gaacgaugguggucg

SEQ ID NO: 1426747 - RNA, 20 nt, Pseudomonas aeruginosa PA01
gaacgaggcucggucgcgcg

SEQ ID NO: 1426748 - RNA, 23 nt, Pseudomonas aeruginosa PA01
gaacgcguaggggaccaccccgg

SEQ ID NO: 1426749 - RNA, 18 nt, Pseudomonas aeruginosa PA01
gaacgccaggaucggcau

SEQ ID NO: 1426750 - RNA, 13 nt, Pseudomonas aeruginosa PA01
gaacgccaggcag

SEQ ID NO: 1426751 - RNA, 15 nt, Pseudomonas aeruginosa PA01
gaacgccccaguaga

SEQ ID NO: 1426752 - RNA, 13 nt, Pseudomonas aeruginosa PA01
gaacgccccgcaa

SEQ ID NO: 1426753 - RNA, 23 nt, Pseudomonas aeruginosa PA01
gaacgccccgcauugcggggcgu

SEQ ID NO: 1426754 - RNA, 23 nt, Pseudomonas aeruginosa PA01
gaacgcgugaagcuggagcagca

SEQ ID NO: 1426755 - RNA, 20 nt, Pseudomonas aeruginosa PA01
gaacgccaccagggccuugc

SEQ ID NO: 1426756 - RNA, 16 nt, Pseudomonas aeruginosa PA01
gaacgcaggggcaccg

SEQ ID NO: 1426757 - RNA, 19 nt, Pseudomonas aeruginosa PA01
gaacgcaggggcaccggcg

SEQ ID NO: 1426758 - RNA, 22 nt, Pseudomonas aeruginosa PA01
gaacgcacuucguccgccacca

SEQ ID NO: 1426759 - RNA, 18 nt, Pseudomonas aeruginosa PA01
gaacggcuggucggcuuc

SEQ ID NO: 1426760 - RNA, 19 nt, Pseudomonas aeruginosa PA01
gaacggcgugagggucgcg

SEQ ID NO: 1426761 - RNA, 22 nt, Pseudomonas aeruginosa PA01
gaacggcgugagggucgcgccg

SEQ ID NO: 1426762 - RNA, 19 nt, Pseudomonas aeruginosa PA01
gaacggcucgcgaccgaga

SEQ ID NO: 1426763 - RNA, 12 nt, Pseudomonas aeruginosa PA01
gaacggcgcuuc

SEQ ID NO: 1426764 - RNA, 14 nt, Pseudomonas aeruginosa PA01
gaacggcgcuucaa

SEQ ID NO: 1426765 - RNA, 18 nt, Pseudomonas aeruginosa PA01
gaacgggacgccuggcgu

SEQ ID NO: 1426766 - RNA, 18 nt, Pseudomonas aeruginosa PA01
gaacgguugucgaugcgc

SEQ ID NO: 1426767 - RNA, 21 nt, Pseudomonas aeruginosa PA01
gaacggcuuguucagcucggc

SEQ ID NO: 1426768 - RNA, 18 nt, Pseudomonas aeruginosa PA01
gaagcgguucucguccag

SEQ ID NO: 1426769 - RNA, 19 nt, Pseudomonas aeruginosa PA01
gaagcgguagugggcgagg

SEQ ID NO: 1426770 - RNA, 23 nt, Pseudomonas aeruginosa PA01
gaagcguccgagguggcugaagc

SEQ ID NO: 1426771 - RNA, 22 nt, Pseudomonas aeruginosa PA01
gaagcgucgugcgccggccucu

SEQ ID NO: 1426772 - RNA, 14 nt, Pseudomonas aeruginosa PA01
gaagcguugcucga

SEQ ID NO: 1426773 - RNA, 16 nt, Pseudomonas aeruginosa PA01
gaagcgugggcggccg

SEQ ID NO: 1426774 - RNA, 21 nt, Pseudomonas aeruginosa PA01
gaagcgugggcggccggccag

SEQ ID NO: 1426775 - RNA, 15 nt, Pseudomonas aeruginosa PA01
gaagcguucgccgag

SEQ ID NO: 1426776 - RNA, 17 nt, Pseudomonas aeruginosa PA01
gaagcguucgccgaggg

SEQ ID NO: 1426777 - RNA, 19 nt, Pseudomonas aeruginosa PA01
gaagcguucgccgagggca

SEQ ID NO: 1426778 - RNA, 22 nt, Pseudomonas aeruginosa PA01
gaagcucaccuugaagccuucg

SEQ ID NO: 1426779 - RNA, 15 nt, Pseudomonas aeruginosa PA01
gaagcucucgccgcg

SEQ ID NO: 1426780 - RNA, 16 nt, Pseudomonas aeruginosa PA01
gaagcucucgccgcgc

SEQ ID NO: 1426781 - RNA, 19 nt, Pseudomonas aeruginosa PA01
gaagcucucgccgcgcucg

SEQ ID NO: 1426782 - RNA, 23 nt, Pseudomonas aeruginosa PA01
gaagcucucgccgcgcucgcgca

SEQ ID NO: 1426783 - RNA, 14 nt, Pseudomonas aeruginosa PA01
gaagcugaggccgg

SEQ ID NO: 1426784 - RNA, 17 nt, Pseudomonas aeruginosa PA01
gaagcugaggccggugu

SEQ ID NO: 1426785 - RNA, 14 nt, Pseudomonas aeruginosa PA01
gaagcugccggcau

SEQ ID NO: 1426786 - RNA, 17 nt, Pseudomonas aeruginosa PA01
gaagcugccuuccagca

SEQ ID NO: 1426787 - RNA, 18 nt, Pseudomonas aeruginosa PA01
gaagcugccuuccagcag

SEQ ID NO: 1426788 - RNA, 23 nt, Pseudomonas aeruginosa PA01
gaagcggggcuuuuuccaacgcg

SEQ ID NO: 1426789 - RNA, 19 nt, Pseudomonas aeruginosa PA01
gaagcggguucccugcgcc

SEQ ID NO: 1426790 - RNA, 13 nt, Pseudomonas aeruginosa PA01
gaagcggucgccg

SEQ ID NO: 1426791 - RNA, 15 nt, Pseudomonas aeruginosa PA01
gaagcggucgccggc

SEQ ID NO: 1426792 - RNA, 17 nt, Pseudomonas aeruginosa PA01
gaagcggucgccggcgc

SEQ ID NO: 1426793 - RNA, 20 nt, Pseudomonas aeruginosa PA01
gaagcggucgccggcgcgca

SEQ ID NO: 1426794 - RNA, 14 nt, Pseudomonas aeruginosa PA01
gaagcggcuggccg

SEQ ID NO: 1426795 - RNA, 17 nt, Pseudomonas aeruginosa PA01
gaagcggcuggccgcgg

SEQ ID NO: 1426796 - RNA, 14 nt, Pseudomonas aeruginosa PA01
gaagcggcucggcc

SEQ ID NO: 1426797 - RNA, 16 nt, Pseudomonas aeruginosa PA01
gaagcggcucggccag

SEQ ID NO: 1426798 - RNA, 18 nt, Pseudomonas aeruginosa PA01
gaagcggaucucgucgcc

SEQ ID NO: 1426799 - RNA, 16 nt, Pseudomonas aeruginosa PA01
gaagcgcucggucagc

SEQ ID NO: 1426800 - RNA, 16 nt, Pseudomonas aeruginosa PA01
gaagcgcugcucgacc

SEQ ID NO: 1426801 - RNA, 22 nt, Pseudomonas aeruginosa PA01
gaagcgcugcugggcggcgacc

SEQ ID NO: 1426802 - RNA, 14 nt, Pseudomonas aeruginosa PA01
gaagcgcucgcgcu

SEQ ID NO: 1426803 - RNA, 16 nt, Pseudomonas aeruginosa PA01
gaagcgcucccagacc

SEQ ID NO: 1426804 - RNA, 19 nt, Pseudomonas aeruginosa PA01
gaagcgcucccagaccucg

SEQ ID NO: 1426805 - RNA, 22 nt, Pseudomonas aeruginosa PA01
gaagcgcucgacauacuccgcc

SEQ ID NO: 1426806 - RNA, 16 nt, Pseudomonas aeruginosa PA01
gaagcggaagccggga

SEQ ID NO: 1426807 - RNA, 23 nt, Pseudomonas aeruginosa PA01
gaagcggcaauguccgagcaggu

SEQ ID NO: 1426808 - RNA, 22 nt, Pseudomonas aeruginosa PA01
gaagcggcccuugucgccgcug

SEQ ID NO: 1426809 - RNA, 15 nt, Pseudomonas aeruginosa PA01
gaagcggccgaccag

SEQ ID NO: 1426810 - RNA, 17 nt, Pseudomonas aeruginosa PA01
gaagcggccgaccaggc

SEQ ID NO: 1426811 - RNA, 12 nt, Pseudomonas aeruginosa PA01
gaagcggccgag

SEQ ID NO: 1426812 - RNA, 23 nt, Pseudomonas aeruginosa PA01
gaagcggccgagauccugcagca

SEQ ID NO: 1426813 - RNA, 14 nt, Pseudomonas aeruginosa PA01
gaagcggccgagca

SEQ ID NO: 1426814 - RNA, 13 nt, Pseudomonas aeruginosa PA01
gaagcggccgccg

SEQ ID NO: 1426815 - RNA, 15 nt, Pseudomonas aeruginosa PA01
gaagcggccgccgaa

SEQ ID NO: 1426816 - RNA, 13 nt, Pseudomonas aeruginosa PA01
gaaggcggcgcgg

SEQ ID NO: 1426817 - RNA, 18 nt, Pseudomonas aeruginosa PA01
gaaggcggcgcggcgggu

SEQ ID NO: 1426818 - RNA, 17 nt, Pseudomonas aeruginosa PA01
gaaggcguagaccucgc

SEQ ID NO: 1426819 - RNA, 17 nt, Pseudomonas aeruginosa PA01
gaaggcgucgaaggccu

SEQ ID NO: 1426820 - RNA, 17 nt, Pseudomonas aeruginosa PA01
gaaggcgcggggcgagg

SEQ ID NO: 1426821 - RNA, 14 nt, Pseudomonas aeruginosa PA01
gaaggcgcuccgga

SEQ ID NO: 1426822 - RNA, 20 nt, Pseudomonas aeruginosa PA01
gaaggcgcuccggaacgccu

SEQ ID NO: 1426823 - RNA, 17 nt, Pseudomonas aeruginosa PA01
gaaggcgcugagcgccu

SEQ ID NO: 1426824 - RNA, 17 nt, Pseudomonas aeruginosa PA01
gaaggcgcugggcggcu

SEQ ID NO: 1426825 - RNA, 13 nt, Pseudomonas aeruginosa PA01
gaaggcgccggca

SEQ ID NO: 1426826 - RNA, 18 nt, Pseudomonas aeruginosa PA01
gaaggcgcgcaccagcgg

SEQ ID NO: 1426827 - RNA, 21 nt, Pseudomonas aeruginosa PA01
gaaggcgcgcaccagcggguc

SEQ ID NO: 1426828 - RNA, 14 nt, Pseudomonas aeruginosa PA01
gaaggcgcgcucga

SEQ ID NO: 1426829 - RNA, 23 nt, Pseudomonas aeruginosa PA01
gaaggcgaaccacaccaggucgc

SEQ ID NO: 1426830 - RNA, 20 nt, Pseudomonas aeruginosa PA01
gaaggcgaucaucgccaccg

SEQ ID NO: 1426831 - RNA, 19 nt, Pseudomonas aeruginosa PA01
gaaggcccgcgagccgcgc

SEQ ID NO: 1426832 - RNA, 21 nt, Pseudomonas aeruginosa PA01
gaaggccaguccggcaccgcu

SEQ ID NO: 1426833 - RNA, 13 nt, Pseudomonas aeruginosa PA01
gaaggccgcgccg

SEQ ID NO: 1426834 - RNA, 15 nt, Pseudomonas aeruginosa PA01
gaaggccgcggucgg

SEQ ID NO: 1426835 - RNA, 18 nt, Pseudomonas aeruginosa PA01
gaaggccgcuucgccgcc

SEQ ID NO: 1426836 - RNA, 18 nt, Pseudomonas aeruginosa PA01
gaaggccucggucaggcg

SEQ ID NO: 1426837 - RNA, 21 nt, Pseudomonas aeruginosa PA01
gaaggccucggucaggcgcug

SEQ ID NO: 1426838 - RNA, 13 nt, Pseudomonas aeruginosa PA01
gaaggccugcgcu

SEQ ID NO: 1426839 - RNA, 21 nt, Pseudomonas aeruginosa PA01
gaaggccuggaacaccaggcc

SEQ ID NO: 1426840 - RNA, 17 nt, Pseudomonas aeruginosa PA01
gaaggccuggccguugc

SEQ ID NO: 1426841 - RNA, 18 nt, Pseudomonas aeruginosa PA01
gaaggccuggccguugcg

SEQ ID NO: 1426842 - RNA, 22 nt, Pseudomonas aeruginosa PA01
gaaggaacgguugucgaugcgc

SEQ ID NO: 1426843 - RNA, 14 nt, Pseudomonas aeruginosa PA01
gaaggacaggucgc

SEQ ID NO: 1426844 - RNA, 14 nt, Pseudomonas aeruginosa PA01
gaaggaaugcugcc

SEQ ID NO: 1426845 - RNA, 15 nt, Pseudomonas aeruginosa PA01
gaaggaaugcugcca

SEQ ID NO: 1426846 - RNA, 23 nt, Pseudomonas aeruginosa PA01
gaaggaaugcugccacccggcuc

SEQ ID NO: 1426847 - RNA, 18 nt, Pseudomonas aeruginosa PA01
gaagcuuuuccagcgcac

SEQ ID NO: 1426848 - RNA, 21 nt, Pseudomonas aeruginosa PA01
gaaggaaucaccacucgccag

SEQ ID NO: 1426849 - RNA, 19 nt, Pseudomonas aeruginosa PA01
gaagcuguucuugauccgc

SEQ ID NO: 1426850 - RNA, 16 nt, Pseudomonas aeruginosa PA01
gaagcuucgcuggguu

SEQ ID NO: 1426851 - RNA, 14 nt, Pseudomonas aeruginosa PA01
gaagcugcgcucgg

SEQ ID NO: 1426852 - RNA, 18 nt, Pseudomonas aeruginosa PA01
gaagcuggagcagcagcg

SEQ ID NO: 1426853 - RNA, 12 nt, Pseudomonas aeruginosa PA01
gaagcuggcgca

SEQ ID NO: 1426854 - RNA, 16 nt, Pseudomonas aeruginosa PA01
gaaggccagcucgucg

SEQ ID NO: 1426855 - RNA, 22 nt, Pseudomonas aeruginosa PA01
gaaggccagcuugucggccuug

SEQ ID NO: 1426856 - RNA, 17 nt, Pseudomonas aeruginosa PA01
gaaggccaggaccgcga

SEQ ID NO: 1426857 - RNA, 22 nt, Pseudomonas aeruginosa PA01
gaaggccaggaccgcgauggua

SEQ ID NO: 1426858 - RNA, 14 nt, Pseudomonas aeruginosa PA01
gaaggccaggccgg

SEQ ID NO: 1426859 - RNA, 17 nt, Pseudomonas aeruginosa PA01
gaaggccaggccggcgc

SEQ ID NO: 1426860 - RNA, 16 nt, Pseudomonas aeruginosa PA01
gaaggccaggucgccc

SEQ ID NO: 1426861 - RNA, 21 nt, Pseudomonas aeruginosa PA01
gaaggccaccaucgcggcgau

SEQ ID NO: 1426862 - RNA, 22 nt, Pseudomonas aeruginosa PA01
gaaggccacgccgacgccgagu

SEQ ID NO: 1426863 - RNA, 20 nt, Pseudomonas aeruginosa PA01
gaaggccacuauuccuugcg

SEQ ID NO: 1426864 - RNA, 15 nt, Pseudomonas aeruginosa PA01
gaaggcaacagcccg

SEQ ID NO: 1426865 - RNA, 23 nt, Pseudomonas aeruginosa PA01
gaaggcaacagcccgcgccgcga

SEQ ID NO: 1426866 - RNA, 18 nt, Pseudomonas aeruginosa PA01
gaaggaucgagccagcgc

SEQ ID NO: 1426867 - RNA, 19 nt, Pseudomonas aeruginosa PA01
gaagccggauucgcgcagc

SEQ ID NO: 1426868 - RNA, 19 nt, Pseudomonas aeruginosa PA01
gaagccggcacgguagccg

SEQ ID NO: 1426869 - RNA, 15 nt, Pseudomonas aeruginosa PA01
gaagccgcuggcauu

SEQ ID NO: 1426870 - RNA, 12 nt, Pseudomonas aeruginosa PA01
gaagccgcucgg

SEQ ID NO: 1426871 - RNA, 14 nt, Pseudomonas aeruginosa PA01
gaagccgccgccca

SEQ ID NO: 1426872 - RNA, 15 nt, Pseudomonas aeruginosa PA01
gaagccgccgcccag

SEQ ID NO: 1426873 - RNA, 23 nt, Pseudomonas aeruginosa PA01
gaagccgccgcccagcagcacca

SEQ ID NO: 1426874 - RNA, 15 nt, Pseudomonas aeruginosa PA01
gaagccgcgcccggc

SEQ ID NO: 1426875 - RNA, 18 nt, Pseudomonas aeruginosa PA01
gaagccgcgcccggccuc

SEQ ID NO: 1426876 - RNA, 17 nt, Pseudomonas aeruginosa PA01
gaagccgcgcucgcgga

SEQ ID NO: 1426877 - RNA, 16 nt, Pseudomonas aeruginosa PA01
gaagccgcacuuccag

SEQ ID NO: 1426878 - RNA, 18 nt, Pseudomonas aeruginosa PA01
gaagccgcacuuccaggc

SEQ ID NO: 1426879 - RNA, 19 nt, Pseudomonas aeruginosa PA01
gaagccgcacuuccaggcg

SEQ ID NO: 1426880 - RNA, 20 nt, Pseudomonas aeruginosa PA01
gaagccgcacuuccaggcgc

SEQ ID NO: 1426881 - RNA, 21 nt, Pseudomonas aeruginosa PA01
gaagccgcacuuccaggcgcc

SEQ ID NO: 1426882 - RNA, 21 nt, Pseudomonas aeruginosa PA01
gaagccgcacuuccaggugcc

SEQ ID NO: 1426883 - RNA, 21 nt, Pseudomonas aeruginosa PA01
gaagccgcccacgggcggcuu

SEQ ID NO: 1426884 - RNA, 22 nt, Pseudomonas aeruginosa PA01
gaagcccugcaaagcggcgacg

SEQ ID NO: 1426885 - RNA, 14 nt, Pseudomonas aeruginosa PA01
gaagccguggcggg

SEQ ID NO: 1426886 - RNA, 17 nt, Pseudomonas aeruginosa PA01
gaagccguggcgggcca

SEQ ID NO: 1426887 - RNA, 18 nt, Pseudomonas aeruginosa PA01
gaagccguggcgggccau

SEQ ID NO: 1426888 - RNA, 13 nt, Pseudomonas aeruginosa PA01
gaagccgucggcg

SEQ ID NO: 1426889 - RNA, 12 nt, Pseudomonas aeruginosa PA01
gaagccggcggc

SEQ ID NO: 1426890 - RNA, 21 nt, Pseudomonas aeruginosa PA01
gaagccggcggcgcggcagug

SEQ ID NO: 1426891 - RNA, 18 nt, Pseudomonas aeruginosa PA01
gaagccgggaagccgcuc

SEQ ID NO: 1426892 - RNA, 19 nt, Pseudomonas aeruginosa PA01
gaagccgggaagccgcucg

SEQ ID NO: 1426893 - RNA, 17 nt, Pseudomonas aeruginosa PA01
gaagccggggcaggcau

SEQ ID NO: 1426894 - RNA, 20 nt, Pseudomonas aeruginosa PA01
gaagcgcaguacccggccgc

SEQ ID NO: 1426895 - RNA, 15 nt, Pseudomonas aeruginosa PA01
gaagcgccaggcgug

SEQ ID NO: 1426896 - RNA, 22 nt, Pseudomonas aeruginosa PA01
gaagcgccaggcgugcagaccg

SEQ ID NO: 1426897 - RNA, 15 nt, Pseudomonas aeruginosa PA01
gaagcgcagcuccgg

SEQ ID NO: 1426898 - RNA, 20 nt, Pseudomonas aeruginosa PA01
gaagcgcagcuccggcagca

SEQ ID NO: 1426899 - RNA, 14 nt, Pseudomonas aeruginosa PA01
gaagcgcaggccgc

SEQ ID NO: 1426900 - RNA, 18 nt, Pseudomonas aeruginosa PA01
gaagcgcaggccgccggc

SEQ ID NO: 1426901 - RNA, 21 nt, Pseudomonas aeruginosa PA01
gaagcgcaggccgccggcggc

SEQ ID NO: 1426902 - RNA, 23 nt, Pseudomonas aeruginosa PA01
gaagcgcaggccgccggcggcca

SEQ ID NO: 1426903 - RNA, 14 nt, Pseudomonas aeruginosa PA01
gaagcgccgcggcc

SEQ ID NO: 1426904 - RNA, 16 nt, Pseudomonas aeruginosa PA01
gaagcgccgcggcccg

SEQ ID NO: 1426905 - RNA, 19 nt, Pseudomonas aeruginosa PA01
gaagcgccgcggcccggcg

SEQ ID NO: 1426906 - RNA, 13 nt, Pseudomonas aeruginosa PA01
gaagcgccggcgg

SEQ ID NO: 1426907 - RNA, 14 nt, Pseudomonas aeruginosa PA01
gaagcgcgccugcu

SEQ ID NO: 1426908 - RNA, 19 nt, Pseudomonas aeruginosa PA01
gaagcgcgccugcucuucg

SEQ ID NO: 1426909 - RNA, 13 nt, Pseudomonas aeruginosa PA01
gaagcgcgcgcca

SEQ ID NO: 1426910 - RNA, 20 nt, Pseudomonas aeruginosa PA01
gaagcgcgcgguacccagcu

SEQ ID NO: 1426911 - RNA, 13 nt, Pseudomonas aeruginosa PA01
gaagcgcggcggc

SEQ ID NO: 1426912 - RNA, 20 nt, Pseudomonas aeruginosa PA01
gaagcgcggcggcgcggaga

SEQ ID NO: 1426913 - RNA, 16 nt, Pseudomonas aeruginosa PA01
gaagccugccagaccg

SEQ ID NO: 1426914 - RNA, 14 nt, Pseudomonas aeruginosa PA01
gaagccuucgccca

SEQ ID NO: 1426915 - RNA, 20 nt, Pseudomonas aeruginosa PA01
gaagccuucgcccagguagg

SEQ ID NO: 1426916 - RNA, 23 nt, Pseudomonas aeruginosa PA01
gaagccuucgcccggcucgaccu

SEQ ID NO: 1426917 - RNA, 14 nt, Pseudomonas aeruginosa PA01
gaagcagccauggc

SEQ ID NO: 1426918 - RNA, 17 nt, Pseudomonas aeruginosa PA01
gaagcauggccggcuac

SEQ ID NO: 1426919 - RNA, 15 nt, Pseudomonas aeruginosa PA01
gaagcccaccaccac

SEQ ID NO: 1426920 - RNA, 16 nt, Pseudomonas aeruginosa PA01
gaagccgagcugccgg

SEQ ID NO: 1426921 - RNA, 17 nt, Pseudomonas aeruginosa PA01
gaagccgaggcuuucca

SEQ ID NO: 1426922 - RNA, 23 nt, Pseudomonas aeruginosa PA01
gaagccgaggcuuuccagcaggc

SEQ ID NO: 1426923 - RNA, 16 nt, Pseudomonas aeruginosa PA01
gaagccgaucaggucg

SEQ ID NO: 1426924 - RNA, 22 nt, Pseudomonas aeruginosa PA01
gaagccgauacccugggagccg

SEQ ID NO: 1426925 - RNA, 18 nt, Pseudomonas aeruginosa PA01
gaagccgaucaccaccag

SEQ ID NO: 1426926 - RNA, 19 nt, Pseudomonas aeruginosa PA01
gaagccgaucaccaccagc

SEQ ID NO: 1426927 - RNA, 17 nt, Pseudomonas aeruginosa PA01
gaagccgaccggcgccg

SEQ ID NO: 1426928 - RNA, 21 nt, Pseudomonas aeruginosa PA01
gaagccgaccuugcgucuucg

SEQ ID NO: 1426929 - RNA, 14 nt, Pseudomonas aeruginosa PA01
gaagcccaggcgcu

SEQ ID NO: 1426930 - RNA, 16 nt, Pseudomonas aeruginosa PA01
gaagcccaggcgcucg

SEQ ID NO: 1426931 - RNA, 17 nt, Pseudomonas aeruginosa PA01
gaagcccaggcgcucgg

SEQ ID NO: 1426932 - RNA, 14 nt, Pseudomonas aeruginosa PA01
gaagcccaggcguc

SEQ ID NO: 1426933 - RNA, 13 nt, Pseudomonas aeruginosa PA01
gaagcccaggcug

SEQ ID NO: 1426934 - RNA, 15 nt, Pseudomonas aeruginosa PA01
gaagcccagcgccgc

SEQ ID NO: 1426935 - RNA, 13 nt, Pseudomonas aeruginosa PA01
gaagcccucgcga

SEQ ID NO: 1426936 - RNA, 14 nt, Pseudomonas aeruginosa PA01
gaagcccucgcgac

SEQ ID NO: 1426937 - RNA, 18 nt, Pseudomonas aeruginosa PA01
gaagcccucgcgacggca

SEQ ID NO: 1426938 - RNA, 14 nt, Pseudomonas aeruginosa PA01
gaagccccgcagcc

SEQ ID NO: 1426939 - RNA, 19 nt, Pseudomonas aeruginosa PA01
gaagccccgcagccgcggg

SEQ ID NO: 1426940 - RNA, 16 nt, Pseudomonas aeruginosa PA01
gaagccccagccucca

SEQ ID NO: 1426941 - RNA, 19 nt, Pseudomonas aeruginosa PA01
gacagagcggccggcgcgg

SEQ ID NO: 1426942 - RNA, 17 nt, Pseudomonas aeruginosa PA01
gacacgugccccaggcc

SEQ ID NO: 1426943 - RNA, 18 nt, Pseudomonas aeruginosa PA01
gacacgugccccaggccg

SEQ ID NO: 1426944 - RNA, 14 nt, Pseudomonas aeruginosa PA01
gacacucugguagc

SEQ ID NO: 1426945 - RNA, 21 nt, Pseudomonas aeruginosa PA01
gacacucugguagcugcggcc

SEQ ID NO: 1426946 - RNA, 23 nt, Pseudomonas aeruginosa PA01
gacacgguccaggaucauccgca

SEQ ID NO: 1426947 - RNA, 20 nt, Pseudomonas aeruginosa PA01
gacacggauauccgggccca

SEQ ID NO: 1426948 - RNA, 20 nt, Pseudomonas aeruginosa PA01
gacaacccggcgcuggccgc

SEQ ID NO: 1426949 - RNA, 22 nt, Pseudomonas aeruginosa PA01
gacaacccggcgcuggccgcgc

SEQ ID NO: 1426950 - RNA, 23 nt, Pseudomonas aeruginosa PA01
gacaacccggcgcuggccgcgcg

SEQ ID NO: 1426951 - RNA, 20 nt, Pseudomonas aeruginosa PA01
gacaacaggccgggcggcgg

SEQ ID NO: 1426952 - RNA, 22 nt, Pseudomonas aeruginosa PA01
gacaacaggccgggcggcggcg

SEQ ID NO: 1426953 - RNA, 16 nt, Pseudomonas aeruginosa PA01
gacacgaaaaagccgg

SEQ ID NO: 1426954 - RNA, 18 nt, Pseudomonas aeruginosa PA01
gacacgaaaaagccggcg

SEQ ID NO: 1426955 - RNA, 19 nt, Pseudomonas aeruginosa PA01
gacacgcacucauagcuca

SEQ ID NO: 1426956 - RNA, 14 nt, Pseudomonas aeruginosa PA01
gacacgcaggcgcc

SEQ ID NO: 1426957 - RNA, 16 nt, Pseudomonas aeruginosa PA01
gacacgagccgcugcg

SEQ ID NO: 1426958 - RNA, 14 nt, Pseudomonas aeruginosa PA01
gacauacaggcgcg

SEQ ID NO: 1426959 - RNA, 18 nt, Pseudomonas aeruginosa PA01
gacauacaggcgcgccug

SEQ ID NO: 1426960 - RNA, 19 nt, Pseudomonas aeruginosa PA01
gacauacaggcgcgccugg

SEQ ID NO: 1426961 - RNA, 14 nt, Pseudomonas aeruginosa PA01
gacauacuccgccg

SEQ ID NO: 1426962 - RNA, 14 nt, Pseudomonas aeruginosa PA01
gacaguucgccgcc

SEQ ID NO: 1426963 - RNA, 14 nt, Pseudomonas aeruginosa PA01
gacauagcggcugc

SEQ ID NO: 1426964 - RNA, 15 nt, Pseudomonas aeruginosa PA01
gacaucaccacgcga

SEQ ID NO: 1426965 - RNA, 16 nt, Pseudomonas aeruginosa PA01
gacaucaccacgcgau

SEQ ID NO: 1426966 - RNA, 16 nt, Pseudomonas aeruginosa PA01
gacagcccgcgcucgg

SEQ ID NO: 1426967 - RNA, 18 nt, Pseudomonas aeruginosa PA01
gacagcgucugggugacc

SEQ ID NO: 1426968 - RNA, 12 nt, Pseudomonas aeruginosa PA01
gacagcucgcgg

SEQ ID NO: 1426969 - RNA, 20 nt, Pseudomonas aeruginosa PA01
gacagcucguggcuggcgcc

SEQ ID NO: 1426970 - RNA, 20 nt, Pseudomonas aeruginosa PA01
gacagcuugacccguugcgc

SEQ ID NO: 1426971 - RNA, 21 nt, Pseudomonas aeruginosa PA01
gacagcuuggccagcaggccg

SEQ ID NO: 1426972 - RNA, 18 nt, Pseudomonas aeruginosa PA01
gacaggaagagcaggcgg

SEQ ID NO: 1426973 - RNA, 22 nt, Pseudomonas aeruginosa PA01
gacaggaaucgacccagccgca

SEQ ID NO: 1426974 - RNA, 15 nt, Pseudomonas aeruginosa PA01
gacaucgucucgcga

SEQ ID NO: 1426975 - RNA, 15 nt, Pseudomonas aeruginosa PA01
gacaucggcgauggc

SEQ ID NO: 1426976 - RNA, 16 nt, Pseudomonas aeruginosa PA01
gacaugaaaaagccgg

SEQ ID NO: 1426977 - RNA, 16 nt, Pseudomonas aeruginosa PA01
gacaucuccaggccgc

SEQ ID NO: 1426978 - RNA, 13 nt, Pseudomonas aeruginosa PA01
gacaugcaggccg

SEQ ID NO: 1426979 - RNA, 14 nt, Pseudomonas aeruginosa PA01
gacaugcaggccgg

SEQ ID NO: 1426980 - RNA, 17 nt, Pseudomonas aeruginosa PA01
gacaugcaggccggccu

SEQ ID NO: 1426981 - RNA, 20 nt, Pseudomonas aeruginosa PA01
gacaugcaggccggccucca

SEQ ID NO: 1426982 - RNA, 19 nt, Pseudomonas aeruginosa PA01
gacaugccgguucccgcag

SEQ ID NO: 1426983 - RNA, 15 nt, Pseudomonas aeruginosa PA01
gacaugccccgccga

SEQ ID NO: 1426984 - RNA, 21 nt, Pseudomonas aeruginosa PA01
gacaugggccgcgcagaucgc

SEQ ID NO: 1426985 - RNA, 17 nt, Pseudomonas aeruginosa PA01
gacauggaucaccgcca

SEQ ID NO: 1426986 - RNA, 12 nt, Pseudomonas aeruginosa PA01
gaccaacugcgc

SEQ ID NO: 1426987 - RNA, 15 nt, Pseudomonas aeruginosa PA01
gaccaacugcgcccc

SEQ ID NO: 1426988 - RNA, 23 nt, Pseudomonas aeruginosa PA01
gaccaacugcgcccccagcgccc

SEQ ID NO: 1426989 - RNA, 13 nt, Pseudomonas aeruginosa PA01
gaccaacgggcug

SEQ ID NO: 1426990 - RNA, 23 nt, Pseudomonas aeruginosa PA01
gaaguuguagguauacgacaggc

SEQ ID NO: 1426991 - RNA, 16 nt, Pseudomonas aeruginosa PA01
gaaguuguucgaugcg

SEQ ID NO: 1426992 - RNA, 16 nt, Pseudomonas aeruginosa PA01
gaaguuggcggccgac

SEQ ID NO: 1426993 - RNA, 23 nt, Pseudomonas aeruginosa PA01
gaaguugcaggccagcgccaggu

SEQ ID NO: 1426994 - RNA, 14 nt, Pseudomonas aeruginosa PA01
gaaguugccgccag

SEQ ID NO: 1426995 - RNA, 13 nt, Pseudomonas aeruginosa PA01
gaaguugccgccg

SEQ ID NO: 1426996 - RNA, 23 nt, Pseudomonas aeruginosa PA01
gaaguugcgcacccgcucggccu

SEQ ID NO: 1426997 - RNA, 13 nt, Pseudomonas aeruginosa PA01
gaagugaagcgau

SEQ ID NO: 1426998 - RNA, 15 nt, Pseudomonas aeruginosa PA01
gaaguggaucggccc

SEQ ID NO: 1426999 - RNA, 22 nt, Pseudomonas aeruginosa PA01
gaagucgucguccaucgccgcg

SEQ ID NO: 1427000 - RNA, 20 nt, Pseudomonas aeruginosa PA01
gaagucguucccggccuggc

SEQ ID NO: 1427001 - RNA, 14 nt, Pseudomonas aeruginosa PA01
gaagucggcgagcc

SEQ ID NO: 1427002 - RNA, 18 nt, Pseudomonas aeruginosa PA01
gaagucggcgagccggcg

SEQ ID NO: 1427003 - RNA, 14 nt, Pseudomonas aeruginosa PA01
gaagucggcgcgcc

SEQ ID NO: 1427004 - RNA, 18 nt, Pseudomonas aeruginosa PA01
gaagucggcggccgccuu

SEQ ID NO: 1427005 - RNA, 13 nt, Pseudomonas aeruginosa PA01
gaagucgccggca

SEQ ID NO: 1427006 - RNA, 14 nt, Pseudomonas aeruginosa PA01
gaagucgcagucgu

SEQ ID NO: 1427007 - RNA, 18 nt, Pseudomonas aeruginosa PA01
gaagucgcagucguagcg

SEQ ID NO: 1427008 - RNA, 19 nt, Pseudomonas aeruginosa PA01
gaagucgcagucguagcgc

SEQ ID NO: 1427009 - RNA, 22 nt, Pseudomonas aeruginosa PA01
gaagucgcccgccggcgugccg

SEQ ID NO: 1427010 - RNA, 21 nt, Pseudomonas aeruginosa PA01
gaaguccaccaggcgccgggu

SEQ ID NO: 1427011 - RNA, 15 nt, Pseudomonas aeruginosa PA01
gaagucgaagcagcc

SEQ ID NO: 1427012 - RNA, 21 nt, Pseudomonas aeruginosa PA01
gaagucccauugcaucugcgc

SEQ ID NO: 1427013 - RNA, 13 nt, Pseudomonas aeruginosa PA01
gaaguccuggccg

SEQ ID NO: 1427014 - RNA, 16 nt, Pseudomonas aeruginosa PA01
gaaguagugcagcugc

SEQ ID NO: 1427015 - RNA, 23 nt, Pseudomonas aeruginosa PA01
gaaguagucgccccgguuggcgc

SEQ ID NO: 1427016 - RNA, 19 nt, Pseudomonas aeruginosa PA01
gaaguccgggcgcggcugg

SEQ ID NO: 1427017 - RNA, 16 nt, Pseudomonas aeruginosa PA01
gaaguccggguugagc

SEQ ID NO: 1427018 - RNA, 23 nt, Pseudomonas aeruginosa PA01
gaaguauucggcgggaacgccgg

SEQ ID NO: 1427019 - RNA, 22 nt, Pseudomonas aeruginosa PA01
gaagguccuugggccaggcauc

SEQ ID NO: 1427020 - RNA, 20 nt, Pseudomonas aeruginosa PA01
gaaggucgaaggcgcggcgg

SEQ ID NO: 1427021 - RNA, 19 nt, Pseudomonas aeruginosa PA01
gaaggucaaugccacgugc

SEQ ID NO: 1427022 - RNA, 13 nt, Pseudomonas aeruginosa PA01
gaagguccaggcc

SEQ ID NO: 1427023 - RNA, 15 nt, Pseudomonas aeruginosa PA01
gaagguaucggccau

SEQ ID NO: 1427024 - RNA, 20 nt, Pseudomonas aeruginosa PA01
gaagguaucggccauggccg

SEQ ID NO: 1427025 - RNA, 21 nt, Pseudomonas aeruginosa PA01
gaagggcucagcccaggcgcc

SEQ ID NO: 1427026 - RNA, 24 nt, Pseudomonas aeruginosa PA01
gaagggcucagcccaggcgccgcu

SEQ ID NO: 1427027 - RNA, 15 nt, Pseudomonas aeruginosa PA01
gaagggcacgccgcu

SEQ ID NO: 1427028 - RNA, 18 nt, Pseudomonas aeruginosa PA01
gaagggcacgccgcucug

SEQ ID NO: 1427029 - RNA, 24 nt, Pseudomonas aeruginosa PA01
gaagggucugcuugcgcuggccgg

SEQ ID NO: 1427030 - RNA, 22 nt, Pseudomonas aeruginosa PA01
gaaggguuggccgcagcagcgg

SEQ ID NO: 1427031 - RNA, 16 nt, Pseudomonas aeruginosa PA01
gaaggcgugggcgccg

SEQ ID NO: 1427032 - RNA, 20 nt, Pseudomonas aeruginosa PA01
gaaggcgugggcgccggcgc

SEQ ID NO: 1427033 - RNA, 23 nt, Pseudomonas aeruginosa PA01
gaaggcgugccgcuggccgacca

SEQ ID NO: 1427034 - RNA, 21 nt, Pseudomonas aeruginosa PA01
gaaggcguucucguccucggc

SEQ ID NO: 1427035 - RNA, 17 nt, Pseudomonas aeruginosa PA01
gaaggcuucuuccuggc

SEQ ID NO: 1427036 - RNA, 19 nt, Pseudomonas aeruginosa PA01
gaaggcuucuuccuggccg

SEQ ID NO: 1427037 - RNA, 21 nt, Pseudomonas aeruginosa PA01
gaaggcuugccacugcgcgcc

SEQ ID NO: 1427038 - RNA, 23 nt, Pseudomonas aeruginosa PA01
gaaggcuugccacugcgcgccag

SEQ ID NO: 1427039 - RNA, 22 nt, Pseudomonas aeruginosa PA01
gaaggcuuguccuuggccuccg

SEQ ID NO: 1427040 - RNA, 12 nt, Pseudomonas aeruginosa PA01
gaagggcgcgcc

SEQ ID NO: 1427041 - RNA, 13 nt, Pseudomonas aeruginosa PA01
gaagggccggacg

SEQ ID NO: 1427042 - RNA, 19 nt, Pseudomonas aeruginosa PA01
gaagggccggacguuucca

SEQ ID NO: 1427043 - RNA, 15 nt, Pseudomonas aeruginosa PA01
gaaggcuggagcgcu

SEQ ID NO: 1427044 - RNA, 19 nt, Pseudomonas aeruginosa PA01
gaaggcuggagcgcugcgg

SEQ ID NO: 1427045 - RNA, 16 nt, Pseudomonas aeruginosa PA01
gaagggaaacaccagg

SEQ ID NO: 1427046 - RNA, 20 nt, Pseudomonas aeruginosa PA01
gaagggaaacaccaggccga

SEQ ID NO: 1427047 - RNA, 16 nt, Pseudomonas aeruginosa PA01
gaaggugcccagggcg

SEQ ID NO: 1427048 - RNA, 16 nt, Pseudomonas aeruginosa PA01
gaaggucucgccgccg

SEQ ID NO: 1427049 - RNA, 17 nt, Pseudomonas aeruginosa PA01
gaaggucugccccggcu

SEQ ID NO: 1427050 - RNA, 19 nt, Pseudomonas aeruginosa PA01
gaaggucugcccguggcgc

SEQ ID NO: 1427051 - RNA, 14 nt, Pseudomonas aeruginosa PA01
gaaggucggcggca

SEQ ID NO: 1427052 - RNA, 15 nt, Pseudomonas aeruginosa PA01
gaaggucggcggcag

SEQ ID NO: 1427053 - RNA, 16 nt, Pseudomonas aeruginosa PA01
gaaggucggcggcagc

SEQ ID NO: 1427054 - RNA, 19 nt, Pseudomonas aeruginosa PA01
gaaggucggcggcagcugc

SEQ ID NO: 1427055 - RNA, 16 nt, Pseudomonas aeruginosa PA01
gaaggucgccgggcuc

SEQ ID NO: 1427056 - RNA, 19 nt, Pseudomonas aeruginosa PA01
gaaggucguuggcaaagcc

SEQ ID NO: 1427057 - RNA, 16 nt, Pseudomonas aeruginosa PA01
gaaguacuggucgcgc

SEQ ID NO: 1427058 - RNA, 16 nt, Pseudomonas aeruginosa PA01
gaagguucucggccac

SEQ ID NO: 1427059 - RNA, 22 nt, Pseudomonas aeruginosa PA01
gaagguucucggccaccaccac

SEQ ID NO: 1427060 - RNA, 23 nt, Pseudomonas aeruginosa PA01
gaaucgcuaauaucacuccugcg

SEQ ID NO: 1427061 - RNA, 23 nt, Pseudomonas aeruginosa PA01
gaaucgucacggcgugccgcagg

SEQ ID NO: 1427062 - RNA, 12 nt, Pseudomonas aeruginosa PA01
gaaucaagcaau

SEQ ID NO: 1427063 - RNA, 18 nt, Pseudomonas aeruginosa PA01
gaaucgaacccccgaccu

SEQ ID NO: 1427064 - RNA, 14 nt, Pseudomonas aeruginosa PA01
gaaucgacccagcc

SEQ ID NO: 1427065 - RNA, 18 nt, Pseudomonas aeruginosa PA01
gaaucgccgaggcgucga

SEQ ID NO: 1427066 - RNA, 21 nt, Pseudomonas aeruginosa PA01
gaauaguggaucgcccgaacg

SEQ ID NO: 1427067 - RNA, 18 nt, Pseudomonas aeruginosa PA01
gaauaaaaaaccggccaa

SEQ ID NO: 1427068 - RNA, 17 nt, Pseudomonas aeruginosa PA01
gaaugcccgugcgcugc

SEQ ID NO: 1427069 - RNA, 17 nt, Pseudomonas aeruginosa PA01
gaaugauguacucgcgg

SEQ ID NO: 1427070 - RNA, 18 nt, Pseudomonas aeruginosa PA01
gaaugcaaaaagcccacu

SEQ ID NO: 1427071 - RNA, 16 nt, Pseudomonas aeruginosa PA01
gaaugccuugaggccu

SEQ ID NO: 1427072 - RNA, 23 nt, Pseudomonas aeruginosa PA01
gaaugccggccggggccggcacc

SEQ ID NO: 1427073 - RNA, 22 nt, Pseudomonas aeruginosa PA01
gaauuccagcaggucggcagcg

SEQ ID NO: 1427074 - RNA, 13 nt, Pseudomonas aeruginosa PA01
gaauucaggcuuc

SEQ ID NO: 1427075 - RNA, 14 nt, Pseudomonas aeruginosa PA01
gaauucaggcuucc

SEQ ID NO: 1427076 - RNA, 17 nt, Pseudomonas aeruginosa PA01
gaauucgucgccgccga

SEQ ID NO: 1427077 - RNA, 14 nt, Pseudomonas aeruginosa PA01
cuggaugucgcugg

SEQ ID NO: 1427078 - RNA, 21 nt, Pseudomonas aeruginosa PA01
cuggaccuccuggcgcgucgg

SEQ ID NO: 1427079 - RNA, 13 nt, Pseudomonas aeruginosa PA01
cuggaccuggccg

SEQ ID NO: 1427080 - RNA, 21 nt, Pseudomonas aeruginosa PA01
cuggaccaccguggcgccggc

SEQ ID NO: 1427081 - RNA, 20 nt, Pseudomonas aeruginosa PA01
cuggacccgggccuccuggc

SEQ ID NO: 1427082 - RNA, 23 nt, Pseudomonas aeruginosa PA01
cuggacccguugccgaccgagca

SEQ ID NO: 1427083 - RNA, 14 nt, Pseudomonas aeruginosa PA01
cuggacccgcaccu

SEQ ID NO: 1427084 - RNA, 20 nt, Pseudomonas aeruginosa PA01
cuggacccgcaccuggaccg

SEQ ID NO: 1427085 - RNA, 23 nt, Pseudomonas aeruginosa PA01
cuggcaacggcgggccgcucagg

SEQ ID NO: 1427086 - RNA, 23 nt, Pseudomonas aeruginosa PA01
cuggcauggcuuuccaggcgccg

SEQ ID NO: 1427087 - RNA, 17 nt, Pseudomonas aeruginosa PA01
cuggccaguuccauguc

SEQ ID NO: 1427088 - RNA, 13 nt, Pseudomonas aeruginosa PA01
cuggccaccagca

SEQ ID NO: 1427089 - RNA, 20 nt, Pseudomonas aeruginosa PA01
cuggcauaccgcguucaccg

SEQ ID NO: 1427090 - RNA, 21 nt, Pseudomonas aeruginosa PA01
cuggcagguugauccugggcg

SEQ ID NO: 1427091 - RNA, 22 nt, Pseudomonas aeruginosa PA01
cuggcagguugauccugggcgc

SEQ ID NO: 1427092 - RNA, 20 nt, Pseudomonas aeruginosa PA01
cuggcagguugcacggccgg

SEQ ID NO: 1427093 - RNA, 17 nt, Pseudomonas aeruginosa PA01
cuggcagucgucgcagc

SEQ ID NO: 1427094 - RNA, 18 nt, Pseudomonas aeruginosa PA01
cuggcauacacaugcagg

SEQ ID NO: 1427095 - RNA, 16 nt, Pseudomonas aeruginosa PA01
cuggcagugcgccggc

SEQ ID NO: 1427096 - RNA, 17 nt, Pseudomonas aeruginosa PA01
cuggcagugcgccggca

SEQ ID NO: 1427097 - RNA, 21 nt, Pseudomonas aeruginosa PA01
cuggccaugcguugcggcaug

SEQ ID NO: 1427098 - RNA, 14 nt, Pseudomonas aeruginosa PA01
cuggccagcgucgc

SEQ ID NO: 1427099 - RNA, 14 nt, Pseudomonas aeruginosa PA01
cuggccagggcaug

SEQ ID NO: 1427100 - RNA, 20 nt, Pseudomonas aeruginosa PA01
cuggccauccgcccugcggg

SEQ ID NO: 1427101 - RNA, 20 nt, Pseudomonas aeruginosa PA01
cuggcccaguugcccggccu

SEQ ID NO: 1427102 - RNA, 16 nt, Pseudomonas aeruginosa PA01
cuggcccacggcgccu

SEQ ID NO: 1427103 - RNA, 17 nt, Pseudomonas aeruginosa PA01
cuggccgagcaucagca

SEQ ID NO: 1427104 - RNA, 23 nt, Pseudomonas aeruginosa PA01
cuggccgagccgcuuggagcggg

SEQ ID NO: 1427105 - RNA, 18 nt, Pseudomonas aeruginosa PA01
cuggccgagcgccgccug

SEQ ID NO: 1427106 - RNA, 19 nt, Pseudomonas aeruginosa PA01
cuggccgagcgccgccugg

SEQ ID NO: 1427107 - RNA, 19 nt, Pseudomonas aeruginosa PA01
cuggccgaugccgaccuug

SEQ ID NO: 1427108 - RNA, 16 nt, Pseudomonas aeruginosa PA01
cuggccgagcgggaag

SEQ ID NO: 1427109 - RNA, 16 nt, Pseudomonas aeruginosa PA01
cuggccgagcugccgc

SEQ ID NO: 1427110 - RNA, 17 nt, Pseudomonas aeruginosa PA01
cuggccgagcugccgca

SEQ ID NO: 1427111 - RNA, 23 nt, Pseudomonas aeruginosa PA01
cuggccgccaaaguucaguagcg

SEQ ID NO: 1427112 - RNA, 19 nt, Pseudomonas aeruginosa PA01
cuggccgccucgcgccgcg

SEQ ID NO: 1427113 - RNA, 15 nt, Pseudomonas aeruginosa PA01
cuggccgccuggccg

SEQ ID NO: 1427114 - RNA, 16 nt, Pseudomonas aeruginosa PA01
cuggccgccuggccgg

SEQ ID NO: 1427115 - RNA, 18 nt, Pseudomonas aeruginosa PA01
cuggccgccuggccggcc

SEQ ID NO: 1427116 - RNA, 22 nt, Pseudomonas aeruginosa PA01
cuggccgccuggccggccagcc

SEQ ID NO: 1427117 - RNA, 20 nt, Pseudomonas aeruginosa PA01
cuggccgcgcgaccgcggcg

SEQ ID NO: 1427118 - RNA, 20 nt, Pseudomonas aeruginosa PA01
cuggccgcgcggcuugccgg

SEQ ID NO: 1427119 - RNA, 19 nt, Pseudomonas aeruginosa PA01
cuggccgcgcuccaacagg

SEQ ID NO: 1427120 - RNA, 22 nt, Pseudomonas aeruginosa PA01
cuggccgcggugggcuccagcg

SEQ ID NO: 1427121 - RNA, 19 nt, Pseudomonas aeruginosa PA01
cuggccggcaacgaacuuc

SEQ ID NO: 1427122 - RNA, 13 nt, Pseudomonas aeruginosa PA01
cuggccggccucg

SEQ ID NO: 1427123 - RNA, 13 nt, Pseudomonas aeruginosa PA01
cuggccggccagc

SEQ ID NO: 1427124 - RNA, 16 nt, Pseudomonas aeruginosa PA01
cuggccggcgaccuug

SEQ ID NO: 1427125 - RNA, 13 nt, Pseudomonas aeruginosa PA01
cuggccggcgaug

SEQ ID NO: 1427126 - RNA, 17 nt, Pseudomonas aeruginosa PA01
cuggccggcgauggccg

SEQ ID NO: 1427127 - RNA, 23 nt, Pseudomonas aeruginosa PA01
cuggccggcgauggccgccugca

SEQ ID NO: 1427128 - RNA, 20 nt, Pseudomonas aeruginosa PA01
cuggaaaggccucggcgaug

SEQ ID NO: 1427129 - RNA, 23 nt, Pseudomonas aeruginosa PA01
cuggaaaucggcguccuggucga

SEQ ID NO: 1427130 - RNA, 20 nt, Pseudomonas aeruginosa PA01
cuggaaauggcggucgccga

SEQ ID NO: 1427131 - RNA, 15 nt, Pseudomonas aeruginosa PA01
cuggaaauucagcgc

SEQ ID NO: 1427132 - RNA, 17 nt, Pseudomonas aeruginosa PA01
cuggaaauucagcgcuu

SEQ ID NO: 1427133 - RNA, 20 nt, Pseudomonas aeruginosa PA01
cugcuugggcgccucgccgc

SEQ ID NO: 1427134 - RNA, 21 nt, Pseudomonas aeruginosa PA01
cugcuugggcgccucgccgcg

SEQ ID NO: 1427135 - RNA, 14 nt, Pseudomonas aeruginosa PA01
cugcuuggccagcg

SEQ ID NO: 1427136 - RNA, 16 nt, Pseudomonas aeruginosa PA01
cugcuuggccagcgcg

SEQ ID NO: 1427137 - RNA, 21 nt, Pseudomonas aeruginosa PA01
cugcuuggccagcgcggugcg

SEQ ID NO: 1427138 - RNA, 20 nt, Pseudomonas aeruginosa PA01
cugcuugucgauggucagga

SEQ ID NO: 1427139 - RNA, 19 nt, Pseudomonas aeruginosa PA01
cugcuucgaacgugcgcgc

SEQ ID NO: 1427140 - RNA, 12 nt, Pseudomonas aeruginosa PA01
cugcuugcgcgc

SEQ ID NO: 1427141 - RNA, 15 nt, Pseudomonas aeruginosa PA01
cugcuugcgcgccgc

SEQ ID NO: 1427142 - RNA, 16 nt, Pseudomonas aeruginosa PA01
cugcuugcgcgccgcc

SEQ ID NO: 1427143 - RNA, 14 nt, Pseudomonas aeruginosa PA01
cugcuugcgcgcgg

SEQ ID NO: 1427144 - RNA, 16 nt, Pseudomonas aeruginosa PA01
cugcuugcgcgcggcg

SEQ ID NO: 1427145 - RNA, 13 nt, Pseudomonas aeruginosa PA01
cugcuugaccuug

SEQ ID NO: 1427146 - RNA, 15 nt, Pseudomonas aeruginosa PA01
cuggacaggcgcagg

SEQ ID NO: 1427147 - RNA, 20 nt, Pseudomonas aeruginosa PA01
cuggaaugccggccggggcc

SEQ ID NO: 1427148 - RNA, 22 nt, Pseudomonas aeruginosa PA01
cuggaauucaggcuuccucgaa

SEQ ID NO: 1427149 - RNA, 21 nt, Pseudomonas aeruginosa PA01
cuggaauucgccgcgcgccau

SEQ ID NO: 1427150 - RNA, 17 nt, Pseudomonas aeruginosa PA01
cuggaccaguucagcgc

SEQ ID NO: 1427151 - RNA, 19 nt, Pseudomonas aeruginosa PA01
cuggaccaguucagcgcgc

SEQ ID NO: 1427152 - RNA, 17 nt, Pseudomonas aeruginosa PA01
cuggaccauggccggcg

SEQ ID NO: 1427153 - RNA, 16 nt, Pseudomonas aeruginosa PA01
cuggaauaccccgcgg

SEQ ID NO: 1427154 - RNA, 17 nt, Pseudomonas aeruginosa PA01
cuggaauaccccgcgga

SEQ ID NO: 1427155 - RNA, 15 nt, Pseudomonas aeruginosa PA01
cuggaagucgcccug

SEQ ID NO: 1427156 - RNA, 24 nt, Pseudomonas aeruginosa PA01
cuggaagucguccagcagguucgg

SEQ ID NO: 1427157 - RNA, 17 nt, Pseudomonas aeruginosa PA01
cuggaaggcgcugggcg

SEQ ID NO: 1427158 - RNA, 19 nt, Pseudomonas aeruginosa PA01
cuggaaggccgcgccgaga

SEQ ID NO: 1427159 - RNA, 18 nt, Pseudomonas aeruginosa PA01
cuggaaccggccggcagg

SEQ ID NO: 1427160 - RNA, 23 nt, Pseudomonas aeruginosa PA01
cuggaagcggguucccugcgccu

SEQ ID NO: 1427161 - RNA, 20 nt, Pseudomonas aeruginosa PA01
cuggaagaaggcgaucaucg

SEQ ID NO: 1427162 - RNA, 14 nt, Pseudomonas aeruginosa PA01
cuggaacaccaggc

SEQ ID NO: 1427163 - RNA, 18 nt, Pseudomonas aeruginosa PA01
cuggaacaccaggccgca

SEQ ID NO: 1427164 - RNA, 20 nt, Pseudomonas aeruginosa PA01
cugcugguagcugcugccgg

SEQ ID NO: 1427165 - RNA, 21 nt, Pseudomonas aeruginosa PA01
cugcugguagcugcugccggc

SEQ ID NO: 1427166 - RNA, 14 nt, Pseudomonas aeruginosa PA01
cugcuguccagcgc

SEQ ID NO: 1427167 - RNA, 23 nt, Pseudomonas aeruginosa PA01
cugcuggugggugaucucgcuga

SEQ ID NO: 1427168 - RNA, 14 nt, Pseudomonas aeruginosa PA01
cugcugguugacca

SEQ ID NO: 1427169 - RNA, 23 nt, Pseudomonas aeruginosa PA01
cugcuggggaacugggcgagcau

SEQ ID NO: 1427170 - RNA, 14 nt, Pseudomonas aeruginosa PA01
cugcugggucaucg

SEQ ID NO: 1427171 - RNA, 20 nt, Pseudomonas aeruginosa PA01
cugcugggucaucgaggcca

SEQ ID NO: 1427172 - RNA, 14 nt, Pseudomonas aeruginosa PA01
cugcugggcgucga

SEQ ID NO: 1427173 - RNA, 16 nt, Pseudomonas aeruginosa PA01
cugcugggcgucgaac

SEQ ID NO: 1427174 - RNA, 22 nt, Pseudomonas aeruginosa PA01
cugcugggcgucgaacaccggc

SEQ ID NO: 1427175 - RNA, 13 nt, Pseudomonas aeruginosa PA01
cugcugucgaggg

SEQ ID NO: 1427176 - RNA, 14 nt, Pseudomonas aeruginosa PA01
cugcugugcgucga

SEQ ID NO: 1427177 - RNA, 14 nt, Pseudomonas aeruginosa PA01
cugcuucagcccgg

SEQ ID NO: 1427178 - RNA, 16 nt, Pseudomonas aeruginosa PA01
cugcuucagcccggca

SEQ ID NO: 1427179 - RNA, 14 nt, Pseudomonas aeruginosa PA01
cugcuucaggcgcg

SEQ ID NO: 1427180 - RNA, 15 nt, Pseudomonas aeruginosa PA01
cugcuucaggcgcgc

SEQ ID NO: 1427181 - RNA, 16 nt, Pseudomonas aeruginosa PA01
cugcuuccagaccucg

SEQ ID NO: 1427182 - RNA, 18 nt, Pseudomonas aeruginosa PA01
cugcuuccagaccucgag

SEQ ID NO: 1427183 - RNA, 12 nt, Pseudomonas aeruginosa PA01
cugcuggccgcg

SEQ ID NO: 1427184 - RNA, 16 nt, Pseudomonas aeruginosa PA01
cugcuggccgcgcagg

SEQ ID NO: 1427185 - RNA, 11 nt, Pseudomonas aeruginosa PA01
cugcuggccgc

SEQ ID NO: 1427186 - RNA, 14 nt, Pseudomonas aeruginosa PA01
cugcuggccggugc

SEQ ID NO: 1427187 - RNA, 20 nt, Pseudomonas aeruginosa PA01
cugcuggccggugccgcccu

SEQ ID NO: 1427188 - RNA, 21 nt, Pseudomonas aeruginosa PA01
cugcuggccugggacggcgug

SEQ ID NO: 1427189 - RNA, 16 nt, Pseudomonas aeruginosa PA01
cugcugggccagcgcc

SEQ ID NO: 1427190 - RNA, 16 nt, Pseudomonas aeruginosa PA01
cugcuggcgaagcugg

SEQ ID NO: 1427191 - RNA, 16 nt, Pseudomonas aeruginosa PA01
cugcuggcgcagccag

SEQ ID NO: 1427192 - RNA, 18 nt, Pseudomonas aeruginosa PA01
cugcuggcgcagccaggc

SEQ ID NO: 1427193 - RNA, 20 nt, Pseudomonas aeruginosa PA01
cugcuggcgcagccaggcga

SEQ ID NO: 1427194 - RNA, 23 nt, Pseudomonas aeruginosa PA01
cugcuggcugcccaguugcgcgg

SEQ ID NO: 1427195 - RNA, 16 nt, Pseudomonas aeruginosa PA01
cugcugcugcggcuuc

SEQ ID NO: 1427196 - RNA, 17 nt, Pseudomonas aeruginosa PA01
cugcugcugcggcuucg

SEQ ID NO: 1427197 - RNA, 14 nt, Pseudomonas aeruginosa PA01
cugcugcugcucag

SEQ ID NO: 1427198 - RNA, 15 nt, Pseudomonas aeruginosa PA01
cugcugcugcucagc

SEQ ID NO: 1427199 - RNA, 16 nt, Pseudomonas aeruginosa PA01
cugcugcggggccgga

SEQ ID NO: 1427200 - RNA, 21 nt, Pseudomonas aeruginosa PA01
cugcugcggggccggacgcga

SEQ ID NO: 1427201 - RNA, 22 nt, Pseudomonas aeruginosa PA01
cugcugcucgaccgccugcucg

SEQ ID NO: 1427202 - RNA, 17 nt, Pseudomonas aeruginosa PA01
cugcugcucagcgcgcu

SEQ ID NO: 1427203 - RNA, 15 nt, Pseudomonas aeruginosa PA01
cugcuggacggcgga

SEQ ID NO: 1427204 - RNA, 12 nt, Pseudomonas aeruginosa PA01
cugcuggccacc

SEQ ID NO: 1427205 - RNA, 18 nt, Pseudomonas aeruginosa PA01
cugcuggccaccgcggcg

SEQ ID NO: 1427206 - RNA, 20 nt, Pseudomonas aeruginosa PA01
cugcuggccaccgcggcguc

SEQ ID NO: 1427207 - RNA, 14 nt, Pseudomonas aeruginosa PA01
cuggcgugccgcca

SEQ ID NO: 1427208 - RNA, 18 nt, Pseudomonas aeruginosa PA01
cuggcgugccgccaggcc

SEQ ID NO: 1427209 - RNA, 15 nt, Pseudomonas aeruginosa PA01
cuggcguggccggcg

SEQ ID NO: 1427210 - RNA, 21 nt, Pseudomonas aeruginosa PA01
cuggcgucgaaugcggcgugg

SEQ ID NO: 1427211 - RNA, 16 nt, Pseudomonas aeruginosa PA01
cuggcgucgacgccga

SEQ ID NO: 1427212 - RNA, 18 nt, Pseudomonas aeruginosa PA01
cuggcggcgacgaagguc

SEQ ID NO: 1427213 - RNA, 20 nt, Pseudomonas aeruginosa PA01
cuggcggcccugguugcgga

SEQ ID NO: 1427214 - RNA, 12 nt, Pseudomonas aeruginosa PA01
cuggcggccgag

SEQ ID NO: 1427215 - RNA, 13 nt, Pseudomonas aeruginosa PA01
cuggcggccuucg

SEQ ID NO: 1427216 - RNA, 21 nt, Pseudomonas aeruginosa PA01
cuggcguagcguugcgcgagc

SEQ ID NO: 1427217 - RNA, 15 nt, Pseudomonas aeruginosa PA01
cuggcguugcugauc

SEQ ID NO: 1427218 - RNA, 23 nt, Pseudomonas aeruginosa PA01
cuggcguuguugccgccgaagcc

SEQ ID NO: 1427219 - RNA, 15 nt, Pseudomonas aeruginosa PA01
cuggcuacgcuccgu

SEQ ID NO: 1427220 - RNA, 12 nt, Pseudomonas aeruginosa PA01
cuggcugaagac

SEQ ID NO: 1427221 - RNA, 18 nt, Pseudomonas aeruginosa PA01
cuggcugaagacccugca

SEQ ID NO: 1427222 - RNA, 16 nt, Pseudomonas aeruginosa PA01
cuggcugaagccgggc

SEQ ID NO: 1427223 - RNA, 17 nt, Pseudomonas aeruginosa PA01
cuggcugaagccgggca

SEQ ID NO: 1427224 - RNA, 18 nt, Pseudomonas aeruginosa PA01
cuggcucuguuccucggc

SEQ ID NO: 1427225 - RNA, 22 nt, Pseudomonas aeruginosa PA01
cuggcucuguuccucggcggcg

SEQ ID NO: 1427226 - RNA, 17 nt, Pseudomonas aeruginosa PA01
cuggcuauucgcccagu

SEQ ID NO: 1427227 - RNA, 21 nt, Pseudomonas aeruginosa PA01
cuggcuagcccgucggcgacg

SEQ ID NO: 1427228 - RNA, 13 nt, Pseudomonas aeruginosa PA01
cuggcuccacugc

SEQ ID NO: 1427229 - RNA, 17 nt, Pseudomonas aeruginosa PA01
cuggcuccacugcuugg

SEQ ID NO: 1427230 - RNA, 14 nt, Pseudomonas aeruginosa PA01
cuggcucgaucggc

SEQ ID NO: 1427231 - RNA, 17 nt, Pseudomonas aeruginosa PA01
cuggcucgaucggcagg

SEQ ID NO: 1427232 - RNA, 18 nt, Pseudomonas aeruginosa PA01
cuggccgggggucgcggc

SEQ ID NO: 1427233 - RNA, 21 nt, Pseudomonas aeruginosa PA01
cuggccggucguucgcccuuc

SEQ ID NO: 1427234 - RNA, 14 nt, Pseudomonas aeruginosa PA01
cuggccggugacga

SEQ ID NO: 1427235 - RNA, 18 nt, Pseudomonas aeruginosa PA01
cuggccggccucggcggc

SEQ ID NO: 1427236 - RNA, 20 nt, Pseudomonas aeruginosa PA01
cuggccggcguacuucggcg

SEQ ID NO: 1427237 - RNA, 22 nt, Pseudomonas aeruginosa PA01
cuggccgucccugaccagcagg

SEQ ID NO: 1427238 - RNA, 23 nt, Pseudomonas aeruginosa PA01
cuggccgucccugaccagcaggg

SEQ ID NO: 1427239 - RNA, 19 nt, Pseudomonas aeruginosa PA01
cuggccgucgaggucggcg

SEQ ID NO: 1427240 - RNA, 17 nt, Pseudomonas aeruginosa PA01
cuggccgugcucgauga

SEQ ID NO: 1427241 - RNA, 22 nt, Pseudomonas aeruginosa PA01
cuggccgugcucgaugaucgac

SEQ ID NO: 1427242 - RNA, 15 nt, Pseudomonas aeruginosa PA01
cuggccguuggcgaa

SEQ ID NO: 1427243 - RNA, 17 nt, Pseudomonas aeruginosa PA01
cuggccguugaccagcg

SEQ ID NO: 1427244 - RNA, 19 nt, Pseudomonas aeruginosa PA01
cuggccguugaccagcgcg

SEQ ID NO: 1427245 - RNA, 13 nt, Pseudomonas aeruginosa PA01
cuggccugcagca

SEQ ID NO: 1427246 - RNA, 15 nt, Pseudomonas aeruginosa PA01
cuggccugcagcagg

SEQ ID NO: 1427247 - RNA, 21 nt, Pseudomonas aeruginosa PA01
cuggccucggcgaucgccagg

SEQ ID NO: 1427248 - RNA, 13 nt, Pseudomonas aeruginosa PA01
cuggccucggcgu

SEQ ID NO: 1427249 - RNA, 19 nt, Pseudomonas aeruginosa PA01
cuggcgcguacgcccgcag

SEQ ID NO: 1427250 - RNA, 19 nt, Pseudomonas aeruginosa PA01
cuggcgcgucaugccgccg

SEQ ID NO: 1427251 - RNA, 22 nt, Pseudomonas aeruginosa PA01
cuggcgcgucaugccgccgucg

SEQ ID NO: 1427252 - RNA, 14 nt, Pseudomonas aeruginosa PA01
cuggcgcgucgcug

SEQ ID NO: 1427253 - RNA, 23 nt, Pseudomonas aeruginosa PA01
cuggcgcgucgcugccgccgcgc

SEQ ID NO: 1427254 - RNA, 14 nt, Pseudomonas aeruginosa PA01
cuggcgcgucggcc

SEQ ID NO: 1427255 - RNA, 13 nt, Pseudomonas aeruginosa PA01
cuggcgcuggucc

SEQ ID NO: 1427256 - RNA, 22 nt, Pseudomonas aeruginosa PA01
cuggcgcugguccuugaucgga

SEQ ID NO: 1427257 - RNA, 18 nt, Pseudomonas aeruginosa PA01
cuggcgcugucgcccggg

SEQ ID NO: 1427258 - RNA, 17 nt, Pseudomonas aeruginosa PA01
cuggcgcugcgcggcgu

SEQ ID NO: 1427259 - RNA, 17 nt, Pseudomonas aeruginosa PA01
cuggcgcguugugccgc

SEQ ID NO: 1427260 - RNA, 19 nt, Pseudomonas aeruginosa PA01
cuggcgcguugugccgcca

SEQ ID NO: 1427261 - RNA, 22 nt, Pseudomonas aeruginosa PA01
cuggcgcguugugccgccaccu

SEQ ID NO: 1427262 - RNA, 17 nt, Pseudomonas aeruginosa PA01
cuggcgcuaccgcgcau

SEQ ID NO: 1427263 - RNA, 19 nt, Pseudomonas aeruginosa PA01
cuggcgcuaccgcgcaugg

SEQ ID NO: 1427264 - RNA, 19 nt, Pseudomonas aeruginosa PA01
cuggcgcucucgaacacca

SEQ ID NO: 1427265 - RNA, 21 nt, Pseudomonas aeruginosa PA01
cuggcgcucucgaacaccagg

SEQ ID NO: 1427266 - RNA, 14 nt, Pseudomonas aeruginosa PA01
cuggcgcugaacaa

SEQ ID NO: 1427267 - RNA, 16 nt, Pseudomonas aeruginosa PA01
cuggcgcugaacaagc

SEQ ID NO: 1427268 - RNA, 19 nt, Pseudomonas aeruginosa PA01
cuggcgcugaacaagcccu

SEQ ID NO: 1427269 - RNA, 20 nt, Pseudomonas aeruginosa PA01
cuggcgcugaacaagcccug

SEQ ID NO: 1427270 - RNA, 17 nt, Pseudomonas aeruginosa PA01
cuggcggaacagcucgg

SEQ ID NO: 1427271 - RNA, 14 nt, Pseudomonas aeruginosa PA01
cuggcggaucuucg

SEQ ID NO: 1427272 - RNA, 23 nt, Pseudomonas aeruginosa PA01
cuggcggauguaguccagcgccg

SEQ ID NO: 1427273 - RNA, 17 nt, Pseudomonas aeruginosa PA01
cuggcggcacuccagga

SEQ ID NO: 1427274 - RNA, 20 nt, Pseudomonas aeruginosa PA01
cuggcggcauaggcccggcg

SEQ ID NO: 1427275 - RNA, 15 nt, Pseudomonas aeruginosa PA01
cuggcggcaucggcg

SEQ ID NO: 1427276 - RNA, 15 nt, Pseudomonas aeruginosa PA01
cuggcggaccgccuc

SEQ ID NO: 1427277 - RNA, 19 nt, Pseudomonas aeruginosa PA01
cuggcggauaucgcgccgc

SEQ ID NO: 1427278 - RNA, 20 nt, Pseudomonas aeruginosa PA01
cuggcggauaucgcgccgcg

SEQ ID NO: 1427279 - RNA, 19 nt, Pseudomonas aeruginosa PA01
cuggcggaucaccggcugg

SEQ ID NO: 1427280 - RNA, 22 nt, Pseudomonas aeruginosa PA01
cuggcggaucaccggcuggccc

SEQ ID NO: 1427281 - RNA, 23 nt, Pseudomonas aeruginosa PA01
cuggcggaucaccggcuggcccu

SEQ ID NO: 1427282 - RNA, 19 nt, Pseudomonas aeruginosa PA01
cuggcgcuugggcgcggag

SEQ ID NO: 1427283 - RNA, 14 nt, Pseudomonas aeruginosa PA01
cuggcgcuugccgc

SEQ ID NO: 1427284 - RNA, 23 nt, Pseudomonas aeruginosa PA01
cuggcgcuugccgcgcccggcca

SEQ ID NO: 1427285 - RNA, 16 nt, Pseudomonas aeruginosa PA01
cuggucauccuggccc

SEQ ID NO: 1427286 - RNA, 21 nt, Pseudomonas aeruginosa PA01
cugguccggguuggcgcaggc

SEQ ID NO: 1427287 - RNA, 17 nt, Pseudomonas aeruginosa PA01
cugguccgucucgucga

SEQ ID NO: 1427288 - RNA, 22 nt, Pseudomonas aeruginosa PA01
cugguccuuauucggcccaugc

SEQ ID NO: 1427289 - RNA, 16 nt, Pseudomonas aeruginosa PA01
cugguccagccagccg

SEQ ID NO: 1427290 - RNA, 22 nt, Pseudomonas aeruginosa PA01
cugguccaaccgggcaucgccg

SEQ ID NO: 1427291 - RNA, 23 nt, Pseudomonas aeruginosa PA01
cugguccaaccgggcaucgccga

SEQ ID NO: 1427292 - RNA, 16 nt, Pseudomonas aeruginosa PA01
cugguccaccagcccg

SEQ ID NO: 1427293 - RNA, 17 nt, Pseudomonas aeruginosa PA01
cugguccaccagcccgc

SEQ ID NO: 1427294 - RNA, 20 nt, Pseudomonas aeruginosa PA01
cugguaggccucgaugaucg

SEQ ID NO: 1427295 - RNA, 17 nt, Pseudomonas aeruginosa PA01
cugggucgacugcuggg

SEQ ID NO: 1427296 - RNA, 17 nt, Pseudomonas aeruginosa PA01
cugggucgcgcagggca

SEQ ID NO: 1427297 - RNA, 16 nt, Pseudomonas aeruginosa PA01
cugguagucgccgguc

SEQ ID NO: 1427298 - RNA, 17 nt, Pseudomonas aeruginosa PA01
cugguaguccagcaggu

SEQ ID NO: 1427299 - RNA, 15 nt, Pseudomonas aeruginosa PA01
cugguagugcuggcg

SEQ ID NO: 1427300 - RNA, 13 nt, Pseudomonas aeruginosa PA01
cugggucggcugg

SEQ ID NO: 1427301 - RNA, 16 nt, Pseudomonas aeruginosa PA01
cugggucggcuggcag

SEQ ID NO: 1427302 - RNA, 23 nt, Pseudomonas aeruginosa PA01
cugggucggcuggcagggcgcgu

SEQ ID NO: 1427303 - RNA, 23 nt, Pseudomonas aeruginosa PA01
cugguaggagccgucgccggcga

SEQ ID NO: 1427304 - RNA, 16 nt, Pseudomonas aeruginosa PA01
cugguaggccagcagg

SEQ ID NO: 1427305 - RNA, 23 nt, Pseudomonas aeruginosa PA01
cuggguaugcgcggucaccaggg

SEQ ID NO: 1427306 - RNA, 17 nt, Pseudomonas aeruginosa PA01
cuggggcggccucaggc

SEQ ID NO: 1427307 - RNA, 18 nt, Pseudomonas aeruginosa PA01
cuggggcaugggcgcggg

SEQ ID NO: 1427308 - RNA, 15 nt, Pseudomonas aeruginosa PA01
cugggguagccggcc

SEQ ID NO: 1427309 - RNA, 13 nt, Pseudomonas aeruginosa PA01
cuggggugcagca

SEQ ID NO: 1427310 - RNA, 20 nt, Pseudomonas aeruginosa PA01
cuggguaccgacggucggca

SEQ ID NO: 1427311 - RNA, 16 nt, Pseudomonas aeruginosa PA01
cuggguacgcaccggc

SEQ ID NO: 1427312 - RNA, 21 nt, Pseudomonas aeruginosa PA01
cuggguacgguuggccagcga

SEQ ID NO: 1427313 - RNA, 21 nt, Pseudomonas aeruginosa PA01
cugggguugcggcgcccgcca

SEQ ID NO: 1427314 - RNA, 22 nt, Pseudomonas aeruginosa PA01
cugggguugcggcgcccgccaa

SEQ ID NO: 1427315 - RNA, 16 nt, Pseudomonas aeruginosa PA01
cugggcgcgaauggca

SEQ ID NO: 1427316 - RNA, 13 nt, Pseudomonas aeruginosa PA01
cugggcggccagg

SEQ ID NO: 1427317 - RNA, 11 nt, Pseudomonas aeruginosa PA01
cugggcggcgg

SEQ ID NO: 1427318 - RNA, 17 nt, Pseudomonas aeruginosa PA01
cugggcggcgaccaucc

SEQ ID NO: 1427319 - RNA, 22 nt, Pseudomonas aeruginosa PA01
cugggcggcgaggccgaccuug

SEQ ID NO: 1427320 - RNA, 13 nt, Pseudomonas aeruginosa PA01
cugggcgccggca

SEQ ID NO: 1427321 - RNA, 15 nt, Pseudomonas aeruginosa PA01
cugggcgccggcagg

SEQ ID NO: 1427322 - RNA, 19 nt, Pseudomonas aeruginosa PA01
cugggcgccggcaggccuu

SEQ ID NO: 1427323 - RNA, 17 nt, Pseudomonas aeruginosa PA01
cugggcgccgccggugc

SEQ ID NO: 1427324 - RNA, 17 nt, Pseudomonas aeruginosa PA01
cugggcgccagccgcca

SEQ ID NO: 1427325 - RNA, 19 nt, Pseudomonas aeruginosa PA01
cugggcgaucacgccgcgc

SEQ ID NO: 1427326 - RNA, 12 nt, Pseudomonas aeruginosa PA01
cugggcgccagc

SEQ ID NO: 1427327 - RNA, 19 nt, Pseudomonas aeruginosa PA01
cugggcgaagucgacgauc

SEQ ID NO: 1427328 - RNA, 15 nt, Pseudomonas aeruginosa PA01
cugggcgaugcggcg

SEQ ID NO: 1427329 - RNA, 16 nt, Pseudomonas aeruginosa PA01
cugggcgaugcggcgg

SEQ ID NO: 1427330 - RNA, 23 nt, Pseudomonas aeruginosa PA01
cugggcgauguccuggaucggca

SEQ ID NO: 1427331 - RNA, 16 nt, Pseudomonas aeruginosa PA01
cugggcgcaggccgag

SEQ ID NO: 1427332 - RNA, 12 nt, Pseudomonas aeruginosa PA01
cugggcgcaggg

SEQ ID NO: 1427333 - RNA, 13 nt, Pseudomonas aeruginosa PA01
cugggcgcagggg

SEQ ID NO: 1427334 - RNA, 20 nt, Pseudomonas aeruginosa PA01
cugggcgcaggggcgcgccg

SEQ ID NO: 1427335 - RNA, 21 nt, Pseudomonas aeruginosa PA01
cuggcugcccaguugcgcggc

SEQ ID NO: 1427336 - RNA, 22 nt, Pseudomonas aeruginosa PA01
cuggcugcccaguugcgcggcg

SEQ ID NO: 1427337 - RNA, 18 nt, Pseudomonas aeruginosa PA01
cuggcucuugccgcgagc

SEQ ID NO: 1427338 - RNA, 14 nt, Pseudomonas aeruginosa PA01
cuggcuggccagca

SEQ ID NO: 1427339 - RNA, 13 nt, Pseudomonas aeruginosa PA01
cuggcugcuggcg

SEQ ID NO: 1427340 - RNA, 15 nt, Pseudomonas aeruginosa PA01
cuggcugcuggcgaa

SEQ ID NO: 1427341 - RNA, 20 nt, Pseudomonas aeruginosa PA01
cugggccuugagcaggcguu

SEQ ID NO: 1427342 - RNA, 23 nt, Pseudomonas aeruginosa PA01
cugggccggcguaugguggagga

SEQ ID NO: 1427343 - RNA, 14 nt, Pseudomonas aeruginosa PA01
cugggccgcgaggu

SEQ ID NO: 1427344 - RNA, 14 nt, Pseudomonas aeruginosa PA01
cugggccggcgcca

SEQ ID NO: 1427345 - RNA, 19 nt, Pseudomonas aeruginosa PA01
cugggccggcgccagcagg

SEQ ID NO: 1427346 - RNA, 19 nt, Pseudomonas aeruginosa PA01
cugggccgguugcggcgcc

SEQ ID NO: 1427347 - RNA, 20 nt, Pseudomonas aeruginosa PA01
cugggccgguugcggcgccg

SEQ ID NO: 1427348 - RNA, 19 nt, Pseudomonas aeruginosa PA01
cugcggacuaccuucgauc

SEQ ID NO: 1427349 - RNA, 23 nt, Pseudomonas aeruginosa PA01
cugcggacuaccuucgaucaccc

SEQ ID NO: 1427350 - RNA, 21 nt, Pseudomonas aeruginosa PA01
cugcggaccgcagaaccagac

SEQ ID NO: 1427351 - RNA, 12 nt, Pseudomonas aeruginosa PA01
cugcggaccaca

SEQ ID NO: 1427352 - RNA, 23 nt, Pseudomonas aeruginosa PA01
cugcggaucgaggaauuccggca

SEQ ID NO: 1427353 - RNA, 12 nt, Pseudomonas aeruginosa PA01
cugcggaucgau

SEQ ID NO: 1427354 - RNA, 13 nt, Pseudomonas aeruginosa PA01
cugcgcuccaggc

SEQ ID NO: 1427355 - RNA, 16 nt, Pseudomonas aeruginosa PA01
cugcgcucggcgcucg

SEQ ID NO: 1427356 - RNA, 15 nt, Pseudomonas aeruginosa PA01
cugcgcugccagcgc

SEQ ID NO: 1427357 - RNA, 21 nt, Pseudomonas aeruginosa PA01
cugcgcugccagcgccgccgc

SEQ ID NO: 1427358 - RNA, 12 nt, Pseudomonas aeruginosa PA01
cugcgcuggccg

SEQ ID NO: 1427359 - RNA, 22 nt, Pseudomonas aeruginosa PA01
cugcggccccaaggggccgcgc

SEQ ID NO: 1427360 - RNA, 23 nt, Pseudomonas aeruginosa PA01
cugcggccccaaggggccgcgcu

SEQ ID NO: 1427361 - RNA, 16 nt, Pseudomonas aeruginosa PA01
cugcggccagcgccag

SEQ ID NO: 1427362 - RNA, 17 nt, Pseudomonas aeruginosa PA01
cugcggccagcgccagg

SEQ ID NO: 1427363 - RNA, 18 nt, Pseudomonas aeruginosa PA01
cugcggccagcgccagga

SEQ ID NO: 1427364 - RNA, 15 nt, Pseudomonas aeruginosa PA01
cugcggcccgagggc

SEQ ID NO: 1427365 - RNA, 17 nt, Pseudomonas aeruginosa PA01
cugcggcccgagggcgg

SEQ ID NO: 1427366 - RNA, 23 nt, Pseudomonas aeruginosa PA01
cugcggccgagcauguaggcgca

SEQ ID NO: 1427367 - RNA, 13 nt, Pseudomonas aeruginosa PA01
cugcggccggcgc

SEQ ID NO: 1427368 - RNA, 13 nt, Pseudomonas aeruginosa PA01
cugcggccgggug

SEQ ID NO: 1427369 - RNA, 15 nt, Pseudomonas aeruginosa PA01
cugcggauggcgcgg

SEQ ID NO: 1427370 - RNA, 22 nt, Pseudomonas aeruginosa PA01
cugcggcacgaaccauugcggc

SEQ ID NO: 1427371 - RNA, 13 nt, Pseudomonas aeruginosa PA01
cugcgcgggcaug

SEQ ID NO: 1427372 - RNA, 13 nt, Pseudomonas aeruginosa PA01
cugcgcggccugc

SEQ ID NO: 1427373 - RNA, 18 nt, Pseudomonas aeruginosa PA01
cugcgcggccugcgccgg

SEQ ID NO: 1427374 - RNA, 22 nt, Pseudomonas aeruginosa PA01
cugcgcggacguaacggcuuga

SEQ ID NO: 1427375 - RNA, 18 nt, Pseudomonas aeruginosa PA01
cugcgcguacaucccgcc

SEQ ID NO: 1427376 - RNA, 20 nt, Pseudomonas aeruginosa PA01
cugcgcguacaucccgccga

SEQ ID NO: 1427377 - RNA, 21 nt, Pseudomonas aeruginosa PA01
cugcgcgggucguacaccgcg

SEQ ID NO: 1427378 - RNA, 23 nt, Pseudomonas aeruginosa PA01
cugcgcguguacccccaccgggc

SEQ ID NO: 1427379 - RNA, 12 nt, Pseudomonas aeruginosa PA01
cugcgcucaccu

SEQ ID NO: 1427380 - RNA, 13 nt, Pseudomonas aeruginosa PA01
cugcgcgcggccc

SEQ ID NO: 1427381 - RNA, 20 nt, Pseudomonas aeruginosa PA01
cugcgcgccucuucgcagga

SEQ ID NO: 1427382 - RNA, 13 nt, Pseudomonas aeruginosa PA01
cugcgcgccgggu

SEQ ID NO: 1427383 - RNA, 15 nt, Pseudomonas aeruginosa PA01
cugcgcgcaccaggc

SEQ ID NO: 1427384 - RNA, 19 nt, Pseudomonas aeruginosa PA01
cugcgcgccaccaccguca

SEQ ID NO: 1427385 - RNA, 21 nt, Pseudomonas aeruginosa PA01
cugcgcgccaccaccgucacg

SEQ ID NO: 1427386 - RNA, 16 nt, Pseudomonas aeruginosa PA01
cugcgcgaagccagga

SEQ ID NO: 1427387 - RNA, 16 nt, Pseudomonas aeruginosa PA01
cugcgcgaucccccgc

SEQ ID NO: 1427388 - RNA, 18 nt, Pseudomonas aeruginosa PA01
cugcgcgaucccccgccc

SEQ ID NO: 1427389 - RNA, 13 nt, Pseudomonas aeruginosa PA01
cugcgcgaggagc

SEQ ID NO: 1427390 - RNA, 17 nt, Pseudomonas aeruginosa PA01
cugcgcgaggagccgua

SEQ ID NO: 1427391 - RNA, 21 nt, Pseudomonas aeruginosa PA01
cugcgcccucaagucuccagc

SEQ ID NO: 1427392 - RNA, 13 nt, Pseudomonas aeruginosa PA01
cugcgccgaaggc

SEQ ID NO: 1427393 - RNA, 14 nt, Pseudomonas aeruginosa PA01
cugcgccgaaggcg

SEQ ID NO: 1427394 - RNA, 14 nt, Pseudomonas aeruginosa PA01
cugcgccaggccgu

SEQ ID NO: 1427395 - RNA, 19 nt, Pseudomonas aeruginosa PA01
cugcgccccggucucgcgc

SEQ ID NO: 1427396 - RNA, 20 nt, Pseudomonas aeruginosa PA01
cugcgccccggucucgcgca

SEQ ID NO: 1427397 - RNA, 20 nt, Pseudomonas aeruginosa PA01
cugcgccaugccguucaggc

SEQ ID NO: 1427398 - RNA, 23 nt, Pseudomonas aeruginosa PA01
cugcgccaugccguucaggccgg

SEQ ID NO: 1427399 - RNA, 24 nt, Pseudomonas aeruginosa PA01
cugcgccaugccguucaggccggc

SEQ ID NO: 1427400 - RNA, 21 nt, Pseudomonas aeruginosa PA01
cugcgcccagggacgcgccgg

SEQ ID NO: 1427401 - RNA, 22 nt, Pseudomonas aeruginosa PA01
cugcgcccagggacgcgccggc

SEQ ID NO: 1427402 - RNA, 13 nt, Pseudomonas aeruginosa PA01
cugcgccaggcuu

SEQ ID NO: 1427403 - RNA, 20 nt, Pseudomonas aeruginosa PA01
cugcgccgggaugcucaccg

SEQ ID NO: 1427404 - RNA, 22 nt, Pseudomonas aeruginosa PA01
cugcgccgggaugcucaccgcg

SEQ ID NO: 1427405 - RNA, 24 nt, Pseudomonas aeruginosa PA01
cugcgccgggaugcucaccgcgcu

SEQ ID NO: 1427406 - RNA, 20 nt, Pseudomonas aeruginosa PA01
cugcgccgcguucgccgagc

SEQ ID NO: 1427407 - RNA, 15 nt, Pseudomonas aeruginosa PA01
cugcgccgcugcggc

SEQ ID NO: 1427408 - RNA, 19 nt, Pseudomonas aeruginosa PA01
cugcgccggcacggcaucg

SEQ ID NO: 1427409 - RNA, 16 nt, Pseudomonas aeruginosa PA01
cugcgccgcagcggcc

SEQ ID NO: 1427410 - RNA, 17 nt, Pseudomonas aeruginosa PA01
cugcgccgcagcggcca

SEQ ID NO: 1427411 - RNA, 13 nt, Pseudomonas aeruginosa PA01
cugcgccuggccg

SEQ ID NO: 1427412 - RNA, 14 nt, Pseudomonas aeruginosa PA01
cugcgccuggccgc

SEQ ID NO: 1427413 - RNA, 17 nt, Pseudomonas aeruginosa PA01
cugcgccuggccgcgca

SEQ ID NO: 1427414 - RNA, 19 nt, Pseudomonas aeruginosa PA01
cugcgccuggccgcgcagg

SEQ ID NO: 1427415 - RNA, 13 nt, Pseudomonas aeruginosa PA01
cugcgccucgcug

SEQ ID NO: 1427416 - RNA, 15 nt, Pseudomonas aeruginosa PA01
cugcgccucgcuggc

SEQ ID NO: 1427417 - RNA, 23 nt, Pseudomonas aeruginosa PA01
cugcgccucgcuggcguucucca

SEQ ID NO: 1427418 - RNA, 20 nt, Pseudomonas aeruginosa PA01
cugcgccucggcccuggcgg

SEQ ID NO: 1427419 - RNA, 13 nt, Pseudomonas aeruginosa PA01
cugcgcaggccga

SEQ ID NO: 1427420 - RNA, 16 nt, Pseudomonas aeruginosa PA01
cugcgcaccucggcca

SEQ ID NO: 1427421 - RNA, 13 nt, Pseudomonas aeruginosa PA01
cugcgcaucgccu

SEQ ID NO: 1427422 - RNA, 16 nt, Pseudomonas aeruginosa PA01
cugcgcaucgccuggg

SEQ ID NO: 1427423 - RNA, 16 nt, Pseudomonas aeruginosa PA01
cugcgcauuguucggg

SEQ ID NO: 1427424 - RNA, 18 nt, Pseudomonas aeruginosa PA01
cugcgauggaacgagcgc

SEQ ID NO: 1427425 - RNA, 19 nt, Pseudomonas aeruginosa PA01
cugcgcaacugccggucgg

SEQ ID NO: 1427426 - RNA, 15 nt, Pseudomonas aeruginosa PA01
cugcgcaccaugccc

SEQ ID NO: 1427427 - RNA, 20 nt, Pseudomonas aeruginosa PA01
cugcgaguugaucggcgugg

SEQ ID NO: 1427428 - RNA, 12 nt, Pseudomonas aeruginosa PA01
cugcacgcccau

SEQ ID NO: 1427429 - RNA, 22 nt, Pseudomonas aeruginosa PA01
cugcacgcccaucgccaccagc

SEQ ID NO: 1427430 - RNA, 16 nt, Pseudomonas aeruginosa PA01
cugcacgcacgcgccu

SEQ ID NO: 1427431 - RNA, 15 nt, Pseudomonas aeruginosa PA01
cugcucuuccagcgg

SEQ ID NO: 1427432 - RNA, 17 nt, Pseudomonas aeruginosa PA01
cugcucuuccagcgggc

SEQ ID NO: 1427433 - RNA, 13 nt, Pseudomonas aeruginosa PA01
cugcucgucgaug

SEQ ID NO: 1427434 - RNA, 14 nt, Pseudomonas aeruginosa PA01
cugcucgucgaugc

SEQ ID NO: 1427435 - RNA, 22 nt, Pseudomonas aeruginosa PA01
cugcugaauucccgcuccaggc

SEQ ID NO: 1427436 - RNA, 21 nt, Pseudomonas aeruginosa PA01
cugcugaaaaacgccugggcg

SEQ ID NO: 1427437 - RNA, 13 nt, Pseudomonas aeruginosa PA01
cugcugcgccggc

SEQ ID NO: 1427438 - RNA, 13 nt, Pseudomonas aeruginosa PA01
cugcugcgcgggu

SEQ ID NO: 1427439 - RNA, 13 nt, Pseudomonas aeruginosa PA01
cugcugcgcgcac

SEQ ID NO: 1427440 - RNA, 18 nt, Pseudomonas aeruginosa PA01
cugcugcgccuggccgcg

SEQ ID NO: 1427441 - RNA, 19 nt, Pseudomonas aeruginosa PA01
cugcugccauccgcgccga

SEQ ID NO: 1427442 - RNA, 21 nt, Pseudomonas aeruginosa PA01
cugcugccauccgcgccgacc

SEQ ID NO: 1427443 - RNA, 22 nt, Pseudomonas aeruginosa PA01
cugcugccauccgcgccgacca

SEQ ID NO: 1427444 - RNA, 21 nt, Pseudomonas aeruginosa PA01
cugcugaucaggaggaucgcc

SEQ ID NO: 1427445 - RNA, 17 nt, Pseudomonas aeruginosa PA01
cugcugagcagucgccu

SEQ ID NO: 1427446 - RNA, 19 nt, Pseudomonas aeruginosa PA01
cugcugagcagucgccugg

SEQ ID NO: 1427447 - RNA, 20 nt, Pseudomonas aeruginosa PA01
cugcugagcagucgccuggc

SEQ ID NO: 1427448 - RNA, 22 nt, Pseudomonas aeruginosa PA01
cugcugcaacauggcgucggcg

SEQ ID NO: 1427449 - RNA, 23 nt, Pseudomonas aeruginosa PA01
cugcugcaacauggcgucggcga

SEQ ID NO: 1427450 - RNA, 14 nt, Pseudomonas aeruginosa PA01
cugcucgcggcugg

SEQ ID NO: 1427451 - RNA, 11 nt, Pseudomonas aeruginosa PA01
cugcucgcggg

SEQ ID NO: 1427452 - RNA, 22 nt, Pseudomonas aeruginosa PA01
cugcucggcauucgacccgccg

SEQ ID NO: 1427453 - RNA, 17 nt, Pseudomonas aeruginosa PA01
cugcucgcugcccgacg

SEQ ID NO: 1427454 - RNA, 13 nt, Pseudomonas aeruginosa PA01
cugcucggccugc

SEQ ID NO: 1427455 - RNA, 17 nt, Pseudomonas aeruginosa PA01
cugcucggcguccagca

SEQ ID NO: 1427456 - RNA, 18 nt, Pseudomonas aeruginosa PA01
cugcucggccagcgccac

SEQ ID NO: 1427457 - RNA, 18 nt, Pseudomonas aeruginosa PA01
cugcucguccaggccgca

SEQ ID NO: 1427458 - RNA, 20 nt, Pseudomonas aeruginosa PA01
cugcucguccaggccgcagg

SEQ ID NO: 1427459 - RNA, 17 nt, Pseudomonas aeruginosa PA01
cugcucgccucgggcca

SEQ ID NO: 1427460 - RNA, 11 nt, Pseudomonas aeruginosa PA01
cugcucgcgca

SEQ ID NO: 1427461 - RNA, 15 nt, Pseudomonas aeruginosa PA01
cugcucgccggcgcg

SEQ ID NO: 1427462 - RNA, 16 nt, Pseudomonas aeruginosa PA01
cugcucgccggcgcgg

SEQ ID NO: 1427463 - RNA, 18 nt, Pseudomonas aeruginosa PA01
cugcucgcgcagccaggc

SEQ ID NO: 1427464 - RNA, 19 nt, Pseudomonas aeruginosa PA01
cugcucgcgcagccaggcg

SEQ ID NO: 1427465 - RNA, 11 nt, Pseudomonas aeruginosa PA01
cugcucgcgcu

SEQ ID NO: 1427466 - RNA, 13 nt, Pseudomonas aeruginosa PA01
cugcucgccgccg

SEQ ID NO: 1427467 - RNA, 14 nt, Pseudomonas aeruginosa PA01
cugcucgccgccgg

SEQ ID NO: 1427468 - RNA, 15 nt, Pseudomonas aeruginosa PA01
cugcucgccgccggc

SEQ ID NO: 1427469 - RNA, 12 nt, Pseudomonas aeruginosa PA01
cugcucgccgcu

SEQ ID NO: 1427470 - RNA, 15 nt, Pseudomonas aeruginosa PA01
cugcucgcagccggu

SEQ ID NO: 1427471 - RNA, 23 nt, Pseudomonas aeruginosa PA01
cugcucgaacaucagcagcgcca

SEQ ID NO: 1427472 - RNA, 20 nt, Pseudomonas aeruginosa PA01
cugcuccugaaggaccagcu

SEQ ID NO: 1427473 - RNA, 14 nt, Pseudomonas aeruginosa PA01
cugcuccugcaggc

SEQ ID NO: 1427474 - RNA, 17 nt, Pseudomonas aeruginosa PA01
cugcucgauccagccgg

SEQ ID NO: 1427475 - RNA, 16 nt, Pseudomonas aeruginosa PA01
cugcucgauggcggcc

SEQ ID NO: 1427476 - RNA, 19 nt, Pseudomonas aeruginosa PA01
cugcucgauggcggccugg

SEQ ID NO: 1427477 - RNA, 21 nt, Pseudomonas aeruginosa PA01
cugcuccuuucggaacagcgc

SEQ ID NO: 1427478 - RNA, 23 nt, Pseudomonas aeruginosa PA01
cugcuccuuucggaacagcgccu

SEQ ID NO: 1427479 - RNA, 19 nt, Pseudomonas aeruginosa PA01
cugcucgaaagccuccagc

SEQ ID NO: 1427480 - RNA, 23 nt, Pseudomonas aeruginosa PA01
cugcucgaaagccuccagcagcu

SEQ ID NO: 1427481 - RNA, 23 nt, Pseudomonas aeruginosa PA01
cugcuccucgccguacagcaggc

SEQ ID NO: 1427482 - RNA, 14 nt, Pseudomonas aeruginosa PA01
cugcucgacgaucu

SEQ ID NO: 1427483 - RNA, 18 nt, Pseudomonas aeruginosa PA01
cugcucgacggcaccagc

SEQ ID NO: 1427484 - RNA, 13 nt, Pseudomonas aeruginosa PA01
cugcuccagcaau

SEQ ID NO: 1427485 - RNA, 12 nt, Pseudomonas aeruginosa PA01
cugcuccagcag

SEQ ID NO: 1427486 - RNA, 16 nt, Pseudomonas aeruginosa PA01
cugcuccagcagggcc

SEQ ID NO: 1427487 - RNA, 17 nt, Pseudomonas aeruginosa PA01
cugcucauucggccagc

SEQ ID NO: 1427488 - RNA, 20 nt, Pseudomonas aeruginosa PA01
cugcucauucggccagcgcg

SEQ ID NO: 1427489 - RNA, 22 nt, Pseudomonas aeruginosa PA01
cugcucauucggccagcgcggc

SEQ ID NO: 1427490 - RNA, 18 nt, Pseudomonas aeruginosa PA01
cugcuccaucaguugcgc

SEQ ID NO: 1427491 - RNA, 20 nt, Pseudomonas aeruginosa PA01
cugcuccaucaguugcgcgc

SEQ ID NO: 1427492 - RNA, 15 nt, Pseudomonas aeruginosa PA01
cugcuccagcccggc

SEQ ID NO: 1427493 - RNA, 22 nt, Pseudomonas aeruginosa PA01
cugcuccuccccguccuggcgg

SEQ ID NO: 1427494 - RNA, 15 nt, Pseudomonas aeruginosa PA01
cugcuccuccgacgc

SEQ ID NO: 1427495 - RNA, 17 nt, Pseudomonas aeruginosa PA01
cugcgugccagcaccuu

SEQ ID NO: 1427496 - RNA, 16 nt, Pseudomonas aeruginosa PA01
cugcgugcgccguagc

SEQ ID NO: 1427497 - RNA, 21 nt, Pseudomonas aeruginosa PA01
cugcguggguagccauggcgg

SEQ ID NO: 1427498 - RNA, 22 nt, Pseudomonas aeruginosa PA01
cugcguggguagccgcccaccg

SEQ ID NO: 1427499 - RNA, 13 nt, Pseudomonas aeruginosa PA01
cugcucagcgcgc

SEQ ID NO: 1427500 - RNA, 19 nt, Pseudomonas aeruginosa PA01
cugcucagcgcgcucggcc

SEQ ID NO: 1427501 - RNA, 18 nt, Pseudomonas aeruginosa PA01
cugcucagggccgcgccg

SEQ ID NO: 1427502 - RNA, 21 nt, Pseudomonas aeruginosa PA01
cugcuaggcuggaagccgcgc

SEQ ID NO: 1427503 - RNA, 18 nt, Pseudomonas aeruginosa PA01
cugcgucguuggccggcu

SEQ ID NO: 1427504 - RNA, 19 nt, Pseudomonas aeruginosa PA01
cugcgucguuggccggcug

SEQ ID NO: 1427505 - RNA, 14 nt, Pseudomonas aeruginosa PA01
cugcgucgucgcgg

SEQ ID NO: 1427506 - RNA, 19 nt, Pseudomonas aeruginosa PA01
cugcgucgucgcggcgccu

SEQ ID NO: 1427507 - RNA, 14 nt, Pseudomonas aeruginosa PA01
cugcgucagcgagg

SEQ ID NO: 1427508 - RNA, 15 nt, Pseudomonas aeruginosa PA01
cugcgucagcgaggc

SEQ ID NO: 1427509 - RNA, 22 nt, Pseudomonas aeruginosa PA01
cugcgucagcgaggcgggcgcg

SEQ ID NO: 1427510 - RNA, 18 nt, Pseudomonas aeruginosa PA01
cugcguaguugagcccca

SEQ ID NO: 1427511 - RNA, 19 nt, Pseudomonas aeruginosa PA01
cugcguaguugagccccag

SEQ ID NO: 1427512 - RNA, 16 nt, Pseudomonas aeruginosa PA01
cugcggcggaaggcgg

SEQ ID NO: 1427513 - RNA, 19 nt, Pseudomonas aeruginosa PA01
cugcggcggaaggcggcgu

SEQ ID NO: 1427514 - RNA, 22 nt, Pseudomonas aeruginosa PA01
cugcggcggaaggcggcgucgu

SEQ ID NO: 1427515 - RNA, 16 nt, Pseudomonas aeruginosa PA01
cugcggcggcaccacg

SEQ ID NO: 1427516 - RNA, 24 nt, Pseudomonas aeruginosa PA01
cugcggcggcaggucggacaggca

SEQ ID NO: 1427517 - RNA, 22 nt, Pseudomonas aeruginosa PA01
cugcggcggucccuucgugggc

SEQ ID NO: 1427518 - RNA, 14 nt, Pseudomonas aeruginosa PA01
cugcggcguagugg

SEQ ID NO: 1427519 - RNA, 14 nt, Pseudomonas aeruginosa PA01
cugcggcucgccga

SEQ ID NO: 1427520 - RNA, 20 nt, Pseudomonas aeruginosa PA01
cugcgggaugcccgucaggc

SEQ ID NO: 1427521 - RNA, 22 nt, Pseudomonas aeruginosa PA01
cugcgggaugcccgucaggccu

SEQ ID NO: 1427522 - RNA, 22 nt, Pseudomonas aeruginosa PA01
cugcgggaacuuggcgcgcagg

SEQ ID NO: 1427523 - RNA, 16 nt, Pseudomonas aeruginosa PA01
cugcggcuggcgaacc

SEQ ID NO: 1427524 - RNA, 23 nt, Pseudomonas aeruginosa PA01
cugcggcugcagggccagggagg

SEQ ID NO: 1427525 - RNA, 16 nt, Pseudomonas aeruginosa PA01
cugcggguucagucgg

SEQ ID NO: 1427526 - RNA, 17 nt, Pseudomonas aeruginosa PA01
cugcgggccguagggcg

SEQ ID NO: 1427527 - RNA, 15 nt, Pseudomonas aeruginosa PA01
cugcggggccugcug

SEQ ID NO: 1427528 - RNA, 18 nt, Pseudomonas aeruginosa PA01
cugcggggccugcugcgg

SEQ ID NO: 1427529 - RNA, 19 nt, Pseudomonas aeruginosa PA01
cugcgguugaaauggcaac

SEQ ID NO: 1427530 - RNA, 23 nt, Pseudomonas aeruginosa PA01
cugcggguucggcgagaggucgg

SEQ ID NO: 1427531 - RNA, 16 nt, Pseudomonas aeruginosa PA01
cugcgguaccagcgca

SEQ ID NO: 1427532 - RNA, 20 nt, Pseudomonas aeruginosa PA01
cugcgguaccagcgcaccag

SEQ ID NO: 1427533 - RNA, 22 nt, Pseudomonas aeruginosa PA01
cugcgguaccagcgcaccaggg

SEQ ID NO: 1427534 - RNA, 16 nt, Pseudomonas aeruginosa PA01
cuugcguccugccucg

SEQ ID NO: 1427535 - RNA, 17 nt, Pseudomonas aeruginosa PA01
cuuggacagcucgcggg

SEQ ID NO: 1427536 - RNA, 17 nt, Pseudomonas aeruginosa PA01
cuugcggggcggcgcau

SEQ ID NO: 1427537 - RNA, 17 nt, Pseudomonas aeruginosa PA01
cuugcgggugcgcaggc

SEQ ID NO: 1427538 - RNA, 16 nt, Pseudomonas aeruginosa PA01
cuugcguucgcuccag

SEQ ID NO: 1427539 - RNA, 15 nt, Pseudomonas aeruginosa PA01
cuugcguaccagcgc

SEQ ID NO: 1427540 - RNA, 19 nt, Pseudomonas aeruginosa PA01
cuugcguaccagcgcgcag

SEQ ID NO: 1427541 - RNA, 20 nt, Pseudomonas aeruginosa PA01
cuugcguaccagcgcgcagc

SEQ ID NO: 1427542 - RNA, 12 nt, Pseudomonas aeruginosa PA01
cuugccggcgcc

SEQ ID NO: 1427543 - RNA, 16 nt, Pseudomonas aeruginosa PA01
cuugcgguuauccgcc

SEQ ID NO: 1427544 - RNA, 17 nt, Pseudomonas aeruginosa PA01
cuugcgguuauccgccg

SEQ ID NO: 1427545 - RNA, 18 nt, Pseudomonas aeruginosa PA01
cuugcgguuauccgccgc

SEQ ID NO: 1427546 - RNA, 23 nt, Pseudomonas aeruginosa PA01
cuugcgguuauccgccgccgggc

SEQ ID NO: 1427547 - RNA, 18 nt, Pseudomonas aeruginosa PA01
cuugcgguuauccgccgu

SEQ ID NO: 1427548 - RNA, 18 nt, Pseudomonas aeruginosa PA01
cuugccaagguguggccg

SEQ ID NO: 1427549 - RNA, 15 nt, Pseudomonas aeruginosa PA01
cuugccgccgccgga

SEQ ID NO: 1427550 - RNA, 16 nt, Pseudomonas aeruginosa PA01
cuugccgcugcgcauc

SEQ ID NO: 1427551 - RNA, 21 nt, Pseudomonas aeruginosa PA01
cuugccgcuggugaucgacca

SEQ ID NO: 1427552 - RNA, 15 nt, Pseudomonas aeruginosa PA01
cuugccgcuguuacu

SEQ ID NO: 1427553 - RNA, 22 nt, Pseudomonas aeruginosa PA01
cuugccgcgagcuuggcccugg

SEQ ID NO: 1427554 - RNA, 19 nt, Pseudomonas aeruginosa PA01
cuugccggugcggucguug

SEQ ID NO: 1427555 - RNA, 16 nt, Pseudomonas aeruginosa PA01
cuugccgguaucgcgc

SEQ ID NO: 1427556 - RNA, 17 nt, Pseudomonas aeruginosa PA01
cuugccgguaucgcgcu

SEQ ID NO: 1427557 - RNA, 17 nt, Pseudomonas aeruginosa PA01
cuugccggccgccagca

SEQ ID NO: 1427558 - RNA, 16 nt, Pseudomonas aeruginosa PA01
cuugccggcggcgcug

SEQ ID NO: 1427559 - RNA, 17 nt, Pseudomonas aeruginosa PA01
cuugccggcggcgcuga

SEQ ID NO: 1427560 - RNA, 18 nt, Pseudomonas aeruginosa PA01
cuugccggcugcgccgcg

SEQ ID NO: 1427561 - RNA, 18 nt, Pseudomonas aeruginosa PA01
cuugcggcccaccaccac

SEQ ID NO: 1427562 - RNA, 16 nt, Pseudomonas aeruginosa PA01
cuugcggcccgccucg

SEQ ID NO: 1427563 - RNA, 19 nt, Pseudomonas aeruginosa PA01
cuugccguccagccggcgc

SEQ ID NO: 1427564 - RNA, 15 nt, Pseudomonas aeruginosa PA01
cuugccguccagcga

SEQ ID NO: 1427565 - RNA, 20 nt, Pseudomonas aeruginosa PA01
cuugcggcgcggcccguccg

SEQ ID NO: 1427566 - RNA, 19 nt, Pseudomonas aeruginosa PA01
cuugguauccaccucgccc

SEQ ID NO: 1427567 - RNA, 15 nt, Pseudomonas aeruginosa PA01
cuuggucacgccguu

SEQ ID NO: 1427568 - RNA, 17 nt, Pseudomonas aeruginosa PA01
cuuguacagggcgcgga

SEQ ID NO: 1427569 - RNA, 16 nt, Pseudomonas aeruginosa PA01
cuugggaucggcgauc

SEQ ID NO: 1427570 - RNA, 17 nt, Pseudomonas aeruginosa PA01
cuuggcgauguucaccg

SEQ ID NO: 1427571 - RNA, 15 nt, Pseudomonas aeruginosa PA01
cuuggcuuccuggcg

SEQ ID NO: 1427572 - RNA, 14 nt, Pseudomonas aeruginosa PA01
cuuggcggcgccau

SEQ ID NO: 1427573 - RNA, 23 nt, Pseudomonas aeruginosa PA01
cuuggcggucagcgacuggcccu

SEQ ID NO: 1427574 - RNA, 23 nt, Pseudomonas aeruginosa PA01
cuuggcgcgcgacagauagcagg

SEQ ID NO: 1427575 - RNA, 14 nt, Pseudomonas aeruginosa PA01
cuuggcgcgcaggg

SEQ ID NO: 1427576 - RNA, 16 nt, Pseudomonas aeruginosa PA01
cuuggcgcgacugucg

SEQ ID NO: 1427577 - RNA, 19 nt, Pseudomonas aeruginosa PA01
cuuggccuccggacgcugc

SEQ ID NO: 1427578 - RNA, 19 nt, Pseudomonas aeruginosa PA01
cuuggcgaggcgcgccugg

SEQ ID NO: 1427579 - RNA, 22 nt, Pseudomonas aeruginosa PA01
cuuggcgaaaucgagcugcucg

SEQ ID NO: 1427580 - RNA, 16 nt, Pseudomonas aeruginosa PA01
cuuggcagucgccgcc

SEQ ID NO: 1427581 - RNA, 23 nt, Pseudomonas aeruginosa PA01
cuuggcaaucaucgcgucgccga

SEQ ID NO: 1427582 - RNA, 13 nt, Pseudomonas aeruginosa PA01
cuuggcaccgcgc

SEQ ID NO: 1427583 - RNA, 16 nt, Pseudomonas aeruginosa PA01
cuuggcaccgcgcagc

SEQ ID NO: 1427584 - RNA, 14 nt, Pseudomonas aeruginosa PA01
cuuggcaucgccgc

SEQ ID NO: 1427585 - RNA, 23 nt, Pseudomonas aeruginosa PA01
cuugagcauccacagggucggca

SEQ ID NO: 1427586 - RNA, 23 nt, Pseudomonas aeruginosa PA01
cuugagcaggcggccguccucgg

SEQ ID NO: 1427587 - RNA, 23 nt, Pseudomonas aeruginosa PA01
cuugagcagggcguucuuggccg

SEQ ID NO: 1427588 - RNA, 13 nt, Pseudomonas aeruginosa PA01
cuugagcgccagc

SEQ ID NO: 1427589 - RNA, 14 nt, Pseudomonas aeruginosa PA01
cuugagcgccagca

SEQ ID NO: 1427590 - RNA, 16 nt, Pseudomonas aeruginosa PA01
cuugagcgccagcagg

SEQ ID NO: 1427591 - RNA, 17 nt, Pseudomonas aeruginosa PA01
cuugagcgccagcaggu

SEQ ID NO: 1427592 - RNA, 16 nt, Pseudomonas aeruginosa PA01
cuugagcacgguccgc

SEQ ID NO: 1427593 - RNA, 14 nt, Pseudomonas aeruginosa PA01
cuugagcuggcgcu

SEQ ID NO: 1427594 - RNA, 16 nt, Pseudomonas aeruginosa PA01
cuugagcggaucgucg

SEQ ID NO: 1427595 - RNA, 19 nt, Pseudomonas aeruginosa PA01
cuugagcggaucgucgcgg

SEQ ID NO: 1427596 - RNA, 16 nt, Pseudomonas aeruginosa PA01
cuugaggaugucgcgg

SEQ ID NO: 1427597 - RNA, 19 nt, Pseudomonas aeruginosa PA01
cuugaggaugucgcggcug

SEQ ID NO: 1427598 - RNA, 20 nt, Pseudomonas aeruginosa PA01
cuugaggcgggccagcaggg

SEQ ID NO: 1427599 - RNA, 16 nt, Pseudomonas aeruginosa PA01
cuugagguaggccagc

SEQ ID NO: 1427600 - RNA, 20 nt, Pseudomonas aeruginosa PA01
cuugaguagcuggcgcaggg

SEQ ID NO: 1427601 - RNA, 14 nt, Pseudomonas aeruginosa PA01
cuugagucgcaggc

SEQ ID NO: 1427602 - RNA, 22 nt, Pseudomonas aeruginosa PA01
cuugaguucccagaccuggccg

SEQ ID NO: 1427603 - RNA, 19 nt, Pseudomonas aeruginosa PA01
cuugaccucgacgccgagc

SEQ ID NO: 1427604 - RNA, 13 nt, Pseudomonas aeruginosa PA01
cuugaccgccgcc

SEQ ID NO: 1427605 - RNA, 15 nt, Pseudomonas aeruginosa PA01
cuugaccgccgccgc

SEQ ID NO: 1427606 - RNA, 17 nt, Pseudomonas aeruginosa PA01
cuugaccgccgccuggg

SEQ ID NO: 1427607 - RNA, 16 nt, Pseudomonas aeruginosa PA01
cuugaccuugcucuuc

SEQ ID NO: 1427608 - RNA, 23 nt, Pseudomonas aeruginosa PA01
cuugaccuugcucuucuggcuga

SEQ ID NO: 1427609 - RNA, 14 nt, Pseudomonas aeruginosa PA01
cuugacgaaaaagc

SEQ ID NO: 1427610 - RNA, 19 nt, Pseudomonas aeruginosa PA01
cuugacgaaggcggcagcg

SEQ ID NO: 1427611 - RNA, 18 nt, Pseudomonas aeruginosa PA01
cuugaacaccucuucgcc

SEQ ID NO: 1427612 - RNA, 14 nt, Pseudomonas aeruginosa PA01
cuugaacucgcccg

SEQ ID NO: 1427613 - RNA, 20 nt, Pseudomonas aeruginosa PA01
cuugaccaccgccaggcugg

SEQ ID NO: 1427614 - RNA, 16 nt, Pseudomonas aeruginosa PA01
cuugaccacggcgagg

SEQ ID NO: 1427615 - RNA, 14 nt, Pseudomonas aeruginosa PA01
cuugaccagcggcc

SEQ ID NO: 1427616 - RNA, 16 nt, Pseudomonas aeruginosa PA01
cuugauggugugcagc

SEQ ID NO: 1427617 - RNA, 20 nt, Pseudomonas aeruginosa PA01
cuugauguaggacaggccga

SEQ ID NO: 1427618 - RNA, 13 nt, Pseudomonas aeruginosa PA01
cuugaucagcgcg

SEQ ID NO: 1427619 - RNA, 18 nt, Pseudomonas aeruginosa PA01
cuugaucaccaccacgcc

SEQ ID NO: 1427620 - RNA, 14 nt, Pseudomonas aeruginosa PA01
cuugaucaccgcgg

SEQ ID NO: 1427621 - RNA, 20 nt, Pseudomonas aeruginosa PA01
cuugaucaccgcggugcgga

SEQ ID NO: 1427622 - RNA, 17 nt, Pseudomonas aeruginosa PA01
cuugaucacggugaugg

SEQ ID NO: 1427623 - RNA, 21 nt, Pseudomonas aeruginosa PA01
cuugaugaccguccacggcgc

SEQ ID NO: 1427624 - RNA, 18 nt, Pseudomonas aeruginosa PA01
cuugaucgcacggcggga

SEQ ID NO: 1427625 - RNA, 19 nt, Pseudomonas aeruginosa PA01
cuugaucgagucgccggcg

SEQ ID NO: 1427626 - RNA, 20 nt, Pseudomonas aeruginosa PA01
cuugcaauccgugcgccggg

SEQ ID NO: 1427627 - RNA, 18 nt, Pseudomonas aeruginosa PA01
cuugcagcaacucgccgc

SEQ ID NO: 1427628 - RNA, 21 nt, Pseudomonas aeruginosa PA01
cuugcagcaacucgccgccga

SEQ ID NO: 1427629 - RNA, 20 nt, Pseudomonas aeruginosa PA01
cuuucgaugguugccggugu

SEQ ID NO: 1427630 - RNA, 16 nt, Pseudomonas aeruginosa PA01
cuuucguuucagcgcc

SEQ ID NO: 1427631 - RNA, 22 nt, Pseudomonas aeruginosa PA01
cuuucggggugcaggggcgcag

SEQ ID NO: 1427632 - RNA, 15 nt, Pseudomonas aeruginosa PA01
cuuucgcucaggccu

SEQ ID NO: 1427633 - RNA, 15 nt, Pseudomonas aeruginosa PA01
cuuucugcccggcuu

SEQ ID NO: 1427634 - RNA, 11 nt, Pseudomonas aeruginosa PA01
cuuugcgcagc

SEQ ID NO: 1427635 - RNA, 14 nt, Pseudomonas aeruginosa PA01
cuuuccgaaaccag

SEQ ID NO: 1427636 - RNA, 22 nt, Pseudomonas aeruginosa PA01
cuuuccgaagccccggaccggc

SEQ ID NO: 1427637 - RNA, 21 nt, Pseudomonas aeruginosa PA01
cuuuccgccgagcguugggcc

SEQ ID NO: 1427638 - RNA, 15 nt, Pseudomonas aeruginosa PA01
cuuuccggcgcggcc

SEQ ID NO: 1427639 - RNA, 16 nt, Pseudomonas aeruginosa PA01
cuuuccggcgcggccu

SEQ ID NO: 1427640 - RNA, 14 nt, Pseudomonas aeruginosa PA01
cuuuccaggcgccg

SEQ ID NO: 1427641 - RNA, 22 nt, Pseudomonas aeruginosa PA01
cuuuccacccgaaagccgaagc

SEQ ID NO: 1427642 - RNA, 15 nt, Pseudomonas aeruginosa PA01
cuuuccaccgccagc

SEQ ID NO: 1427643 - RNA, 15 nt, Pseudomonas aeruginosa PA01
cuuucagcggcugcc

SEQ ID NO: 1427644 - RNA, 13 nt, Pseudomonas aeruginosa PA01
cuuucagcgccgc

SEQ ID NO: 1427645 - RNA, 23 nt, Pseudomonas aeruginosa PA01
cuuucagcgccgcucggcgagcc

SEQ ID NO: 1427646 - RNA, 13 nt, Pseudomonas aeruginosa PA01
cuugucgaucagg

SEQ ID NO: 1427647 - RNA, 18 nt, Pseudomonas aeruginosa PA01
cuugucgauggucaggau

SEQ ID NO: 1427648 - RNA, 15 nt, Pseudomonas aeruginosa PA01
cuuguacucgccggu

SEQ ID NO: 1427649 - RNA, 17 nt, Pseudomonas aeruginosa PA01
cuuguagaacggcggca

SEQ ID NO: 1427650 - RNA, 19 nt, Pseudomonas aeruginosa PA01
cuuguauaccagcggcugg

SEQ ID NO: 1427651 - RNA, 14 nt, Pseudomonas aeruginosa PA01
cuuguccaucggcu

SEQ ID NO: 1427652 - RNA, 17 nt, Pseudomonas aeruginosa PA01
cuuguccgagaccggca

SEQ ID NO: 1427653 - RNA, 21 nt, Pseudomonas aeruginosa PA01
cuuguccggcaccaccagcgc

SEQ ID NO: 1427654 - RNA, 15 nt, Pseudomonas aeruginosa PA01
cuuguccuccagcug

SEQ ID NO: 1427655 - RNA, 18 nt, Pseudomonas aeruginosa PA01
cuuguccugcggccgggu

SEQ ID NO: 1427656 - RNA, 21 nt, Pseudomonas aeruginosa PA01
cuuguccuggauaagccgcgc

SEQ ID NO: 1427657 - RNA, 21 nt, Pseudomonas aeruginosa PA01
cuuguccuuccagcucucgcu

SEQ ID NO: 1427658 - RNA, 18 nt, Pseudomonas aeruginosa PA01
cuugucgaccagcggcgg

SEQ ID NO: 1427659 - RNA, 14 nt, Pseudomonas aeruginosa PA01
gaaaccgaucagca

SEQ ID NO: 1427660 - RNA, 18 nt, Pseudomonas aeruginosa PA01
gaaaccggccagcgcggc

SEQ ID NO: 1427661 - RNA, 20 nt, Pseudomonas aeruginosa PA01
gaaaccgaaguagucgcccc

SEQ ID NO: 1427662 - RNA, 21 nt, Pseudomonas aeruginosa PA01
gaaaccgaaguagucgccccg

SEQ ID NO: 1427663 - RNA, 14 nt, Pseudomonas aeruginosa PA01
gaaaccccggccug

SEQ ID NO: 1427664 - RNA, 17 nt, Pseudomonas aeruginosa PA01
gaaaccccggccuggcg

SEQ ID NO: 1427665 - RNA, 17 nt, Pseudomonas aeruginosa PA01
gaaacagggcgacgccg

SEQ ID NO: 1427666 - RNA, 21 nt, Pseudomonas aeruginosa PA01
gaaacagggcgacgccgaugc

SEQ ID NO: 1427667 - RNA, 15 nt, Pseudomonas aeruginosa PA01
gaaaacaucacggca

SEQ ID NO: 1427668 - RNA, 19 nt, Pseudomonas aeruginosa PA01
gaaaagcgguuucgccacc

SEQ ID NO: 1427669 - RNA, 16 nt, Pseudomonas aeruginosa PA01
gaaaaggaucgccgcg

SEQ ID NO: 1427670 - RNA, 22 nt, Pseudomonas aeruginosa PA01
gaaaaggcccggcguccucgcg

SEQ ID NO: 1427671 - RNA, 11 nt, Pseudomonas aeruginosa PA01
gaaaaggccgc

SEQ ID NO: 1427672 - RNA, 14 nt, Pseudomonas aeruginosa PA01
gaaaaaaaggcgcu

SEQ ID NO: 1427673 - RNA, 16 nt, Pseudomonas aeruginosa PA01
gaaaaaacgccgguca

SEQ ID NO: 1427674 - RNA, 18 nt, Pseudomonas aeruginosa PA01
gaaaaacccaugcgguuc

SEQ ID NO: 1427675 - RNA, 15 nt, Pseudomonas aeruginosa PA01
gaaaaacgccggcga

SEQ ID NO: 1427676 - RNA, 18 nt, Pseudomonas aeruginosa PA01
gaaaaacggggcuccccu

SEQ ID NO: 1427677 - RNA, 14 nt, Pseudomonas aeruginosa PA01
gaaaaagcccggca

SEQ ID NO: 1427678 - RNA, 15 nt, Pseudomonas aeruginosa PA01
gaaaaagccggaagc

SEQ ID NO: 1427679 - RNA, 15 nt, Pseudomonas aeruginosa PA01
gaaaaaggccggugc

SEQ ID NO: 1427680 - RNA, 19 nt, Pseudomonas aeruginosa PA01
gaaaaagggaugccgccgg

SEQ ID NO: 1427681 - RNA, 21 nt, Pseudomonas aeruginosa PA01
gaaaaagggaugccgccggca

SEQ ID NO: 1427682 - RNA, 21 nt, Pseudomonas aeruginosa PA01
gaaaaagggaugccggcggca

SEQ ID NO: 1427683 - RNA, 21 nt, Pseudomonas aeruginosa PA01
gaaaaauggccgcuugaagcg

SEQ ID NO: 1427684 - RNA, 16 nt, Pseudomonas aeruginosa PA01
cuucgccgaucaccag

SEQ ID NO: 1427685 - RNA, 17 nt, Pseudomonas aeruginosa PA01
cuucgccgaucaccagg

SEQ ID NO: 1427686 - RNA, 21 nt, Pseudomonas aeruginosa PA01
cuucgccgaaagcacgcgcau

SEQ ID NO: 1427687 - RNA, 20 nt, Pseudomonas aeruginosa PA01
cuucgccggaagcuucaggc

SEQ ID NO: 1427688 - RNA, 17 nt, Pseudomonas aeruginosa PA01
cuucgccggccugcgcg

SEQ ID NO: 1427689 - RNA, 18 nt, Pseudomonas aeruginosa PA01
cuucgccggccugcgcgc

SEQ ID NO: 1427690 - RNA, 22 nt, Pseudomonas aeruginosa PA01
cuucgccgaccagguccgccac

SEQ ID NO: 1427691 - RNA, 21 nt, Pseudomonas aeruginosa PA01
cuucgcccucagcagcgccgc

SEQ ID NO: 1427692 - RNA, 14 nt, Pseudomonas aeruginosa PA01
cuucgcccggcucg

SEQ ID NO: 1427693 - RNA, 14 nt, Pseudomonas aeruginosa PA01
cuucgccgcccgcg

SEQ ID NO: 1427694 - RNA, 16 nt, Pseudomonas aeruginosa PA01
cuucgccgcccgcgcc

SEQ ID NO: 1427695 - RNA, 18 nt, Pseudomonas aeruginosa PA01
cuucgccgcccucgcagu

SEQ ID NO: 1427696 - RNA, 12 nt, Pseudomonas aeruginosa PA01
cuucgccgccgc

SEQ ID NO: 1427697 - RNA, 15 nt, Pseudomonas aeruginosa PA01
cuucgccgccgcgcg

SEQ ID NO: 1427698 - RNA, 17 nt, Pseudomonas aeruginosa PA01
cuucgguguaucggcgg

SEQ ID NO: 1427699 - RNA, 16 nt, Pseudomonas aeruginosa PA01
cuucgguggcgaccag

SEQ ID NO: 1427700 - RNA, 18 nt, Pseudomonas aeruginosa PA01
cuucgguggcggcgacga

SEQ ID NO: 1427701 - RNA, 17 nt, Pseudomonas aeruginosa PA01
cuucgguaccugguccg

SEQ ID NO: 1427702 - RNA, 15 nt, Pseudomonas aeruginosa PA01
cuucuaccuggcgcu

SEQ ID NO: 1427703 - RNA, 21 nt, Pseudomonas aeruginosa PA01
cuucuacgccuugcggcgccg

SEQ ID NO: 1427704 - RNA, 15 nt, Pseudomonas aeruginosa PA01
cuucuccucggccga

SEQ ID NO: 1427705 - RNA, 17 nt, Pseudomonas aeruginosa PA01
cuucuccucggccgaca

SEQ ID NO: 1427706 - RNA, 16 nt, Pseudomonas aeruginosa PA01
cuucucgaagcgcgcc

SEQ ID NO: 1427707 - RNA, 19 nt, Pseudomonas aeruginosa PA01
cuucucgacgaaggcgcgc

SEQ ID NO: 1427708 - RNA, 18 nt, Pseudomonas aeruginosa PA01
cuucuccggggcccggca

SEQ ID NO: 1427709 - RNA, 20 nt, Pseudomonas aeruginosa PA01
cuucuccggggcccggcagg

SEQ ID NO: 1427710 - RNA, 22 nt, Pseudomonas aeruginosa PA01
cuucuccggggcccggcaggca

SEQ ID NO: 1427711 - RNA, 15 nt, Pseudomonas aeruginosa PA01
cuucuccgccacccg

SEQ ID NO: 1427712 - RNA, 20 nt, Pseudomonas aeruginosa PA01
cuucuccagguacagccgca

SEQ ID NO: 1427713 - RNA, 18 nt, Pseudomonas aeruginosa PA01
cuucuccgccgcgugcgc

SEQ ID NO: 1427714 - RNA, 15 nt, Pseudomonas aeruginosa PA01
cuucuugacccgcug

SEQ ID NO: 1427715 - RNA, 16 nt, Pseudomonas aeruginosa PA01
cuucuugagcccuucg

SEQ ID NO: 1427716 - RNA, 14 nt, Pseudomonas aeruginosa PA01
cuucuggcugauca

SEQ ID NO: 1427717 - RNA, 15 nt, Pseudomonas aeruginosa PA01
cuucuucaccaggcc

SEQ ID NO: 1427718 - RNA, 22 nt, Pseudomonas aeruginosa PA01
cuucuucagcagcgggcguccg

SEQ ID NO: 1427719 - RNA, 15 nt, Pseudomonas aeruginosa PA01
cuucuuccuggccgg

SEQ ID NO: 1427720 - RNA, 14 nt, Pseudomonas aeruginosa PA01
cuucuuucgacaug

SEQ ID NO: 1427721 - RNA, 20 nt, Pseudomonas aeruginosa PA01
cuucuuguauaccagcggcu

SEQ ID NO: 1427722 - RNA, 14 nt, Pseudomonas aeruginosa PA01
cuucuugucgucgg

SEQ ID NO: 1427723 - RNA, 16 nt, Pseudomonas aeruginosa PA01
cuucuugucgucggac

SEQ ID NO: 1427724 - RNA, 20 nt, Pseudomonas aeruginosa PA01
cuucuuuuuuucaccgcuca

SEQ ID NO: 1427725 - RNA, 19 nt, Pseudomonas aeruginosa PA01
cuucuuuuauacccggcgc

SEQ ID NO: 1427726 - RNA, 15 nt, Pseudomonas aeruginosa PA01
cuucucguagcgcuc

SEQ ID NO: 1427727 - RNA, 21 nt, Pseudomonas aeruginosa PA01
cuucucguagcgcucguaggu

SEQ ID NO: 1427728 - RNA, 14 nt, Pseudomonas aeruginosa PA01
cuucucgucgccgc

SEQ ID NO: 1427729 - RNA, 17 nt, Pseudomonas aeruginosa PA01
cuucucgucgccgcccg

SEQ ID NO: 1427730 - RNA, 11 nt, Pseudomonas aeruginosa PA01
cuucucggcga

SEQ ID NO: 1427731 - RNA, 17 nt, Pseudomonas aeruginosa PA01
cuucucgguagggccga

SEQ ID NO: 1427732 - RNA, 19 nt, Pseudomonas aeruginosa PA01
cuucucuuucaccuggucg

SEQ ID NO: 1427733 - RNA, 15 nt, Pseudomonas aeruginosa PA01
cuucugcaggccgug

SEQ ID NO: 1427734 - RNA, 14 nt, Pseudomonas aeruginosa PA01
cuucugcagggcgg

SEQ ID NO: 1427735 - RNA, 23 nt, Pseudomonas aeruginosa PA01
cuucugcaauugcuugcgcucga

SEQ ID NO: 1427736 - RNA, 19 nt, Pseudomonas aeruginosa PA01
cuucugcaccccgucgacg

SEQ ID NO: 1427737 - RNA, 17 nt, Pseudomonas aeruginosa PA01
cuucugcaccuuggcca

SEQ ID NO: 1427738 - RNA, 17 nt, Pseudomonas aeruginosa PA01
cuucugcgagccgcgcg

SEQ ID NO: 1427739 - RNA, 13 nt, Pseudomonas aeruginosa PA01
cuucugcucggcc

SEQ ID NO: 1427740 - RNA, 14 nt, Pseudomonas aeruginosa PA01
cuucugcuggccgc

SEQ ID NO: 1427741 - RNA, 15 nt, Pseudomonas aeruginosa PA01
cuucugcuggccgcg

SEQ ID NO: 1427742 - RNA, 18 nt, Pseudomonas aeruginosa PA01
cuucuggaaggcggucag

SEQ ID NO: 1427743 - RNA, 19 nt, Pseudomonas aeruginosa PA01
cuucugucccugggccaug

SEQ ID NO: 1427744 - RNA, 14 nt, Pseudomonas aeruginosa PA01
cuucugugggcagc

SEQ ID NO: 1427745 - RNA, 20 nt, Pseudomonas aeruginosa PA01
cuuccacuugcgccggcugc

SEQ ID NO: 1427746 - RNA, 21 nt, Pseudomonas aeruginosa PA01
cuucccagccgaggcagccgu

SEQ ID NO: 1427747 - RNA, 13 nt, Pseudomonas aeruginosa PA01
cuuccccccgcgu

SEQ ID NO: 1427748 - RNA, 16 nt, Pseudomonas aeruginosa PA01
cuucccgcggcuccag

SEQ ID NO: 1427749 - RNA, 16 nt, Pseudomonas aeruginosa PA01
cuucccguaaggccag

SEQ ID NO: 1427750 - RNA, 17 nt, Pseudomonas aeruginosa PA01
cuucccguaaggccagg

SEQ ID NO: 1427751 - RNA, 22 nt, Pseudomonas aeruginosa PA01
cuucccguaaggccaggcucgg

SEQ ID NO: 1427752 - RNA, 17 nt, Pseudomonas aeruginosa PA01
cuuccacgccuucgcgg

SEQ ID NO: 1427753 - RNA, 19 nt, Pseudomonas aeruginosa PA01
cuuccacgccuucgcggcc

SEQ ID NO: 1427754 - RNA, 23 nt, Pseudomonas aeruginosa PA01
cuuccacgcgccgauccaggcgu

SEQ ID NO: 1427755 - RNA, 14 nt, Pseudomonas aeruginosa PA01
cuuccaccguggcg

SEQ ID NO: 1427756 - RNA, 17 nt, Pseudomonas aeruginosa PA01
cuuccagaacgccgcgc

SEQ ID NO: 1427757 - RNA, 20 nt, Pseudomonas aeruginosa PA01
cuucccagacguccagcgcc

SEQ ID NO: 1427758 - RNA, 21 nt, Pseudomonas aeruginosa PA01
cuucccagacguccagcgcca

SEQ ID NO: 1427759 - RNA, 17 nt, Pseudomonas aeruginosa PA01
cuuccagcacgccgauc

SEQ ID NO: 1427760 - RNA, 19 nt, Pseudomonas aeruginosa PA01
cuuccagcacgccgauccc

SEQ ID NO: 1427761 - RNA, 14 nt, Pseudomonas aeruginosa PA01
cuuccagccgcgcg

SEQ ID NO: 1427762 - RNA, 15 nt, Pseudomonas aeruginosa PA01
cuuccagccgcgcgc

SEQ ID NO: 1427763 - RNA, 12 nt, Pseudomonas aeruginosa PA01
cuucaccaccag

SEQ ID NO: 1427764 - RNA, 20 nt, Pseudomonas aeruginosa PA01
cuucacauggugggcgccgc

SEQ ID NO: 1427765 - RNA, 15 nt, Pseudomonas aeruginosa PA01
cuuccaccaccaggg

SEQ ID NO: 1427766 - RNA, 16 nt, Pseudomonas aeruginosa PA01
cuuccaccggcuugcc

SEQ ID NO: 1427767 - RNA, 20 nt, Pseudomonas aeruginosa PA01
cuuccaccgggaagcagguc

SEQ ID NO: 1427768 - RNA, 22 nt, Pseudomonas aeruginosa PA01
cuuccgacucuccgcgccgcgg

SEQ ID NO: 1427769 - RNA, 15 nt, Pseudomonas aeruginosa PA01
cuucccugccggcgg

SEQ ID NO: 1427770 - RNA, 14 nt, Pseudomonas aeruginosa PA01
cuuccgccucgcgc

SEQ ID NO: 1427771 - RNA, 13 nt, Pseudomonas aeruginosa PA01
cuuccgccgccag

SEQ ID NO: 1427772 - RNA, 16 nt, Pseudomonas aeruginosa PA01
cuuccgcaucggccga

SEQ ID NO: 1427773 - RNA, 15 nt, Pseudomonas aeruginosa PA01
cuuccgccagcaggc

SEQ ID NO: 1427774 - RNA, 18 nt, Pseudomonas aeruginosa PA01
cuuccgccaggcgcagcc

SEQ ID NO: 1427775 - RNA, 13 nt, Pseudomonas aeruginosa PA01
cuuccgcgcggcg

SEQ ID NO: 1427776 - RNA, 13 nt, Pseudomonas aeruginosa PA01
cuuccggcccggc

SEQ ID NO: 1427777 - RNA, 14 nt, Pseudomonas aeruginosa PA01
cuuccggcccggcc

SEQ ID NO: 1427778 - RNA, 17 nt, Pseudomonas aeruginosa PA01
cuuccggcccggccagg

SEQ ID NO: 1427779 - RNA, 17 nt, Pseudomonas aeruginosa PA01
cuuccggacugcccagc

SEQ ID NO: 1427780 - RNA, 17 nt, Pseudomonas aeruginosa PA01
cuuccggcagccagccg

SEQ ID NO: 1427781 - RNA, 19 nt, Pseudomonas aeruginosa PA01
cuuccggcagccagccgcc

SEQ ID NO: 1427782 - RNA, 20 nt, Pseudomonas aeruginosa PA01
cuuccggcagccagccgccg

SEQ ID NO: 1427783 - RNA, 22 nt, Pseudomonas aeruginosa PA01
cuuccggcagccagccgccgaa

SEQ ID NO: 1427784 - RNA, 16 nt, Pseudomonas aeruginosa PA01
cuuccuuggcgggaug

SEQ ID NO: 1427785 - RNA, 16 nt, Pseudomonas aeruginosa PA01
cuuccggcucgccgcg

SEQ ID NO: 1427786 - RNA, 22 nt, Pseudomonas aeruginosa PA01
cuuccggcuuuuucauucggcu

SEQ ID NO: 1427787 - RNA, 21 nt, Pseudomonas aeruginosa PA01
cuuccgggaacacgucguugg

SEQ ID NO: 1427788 - RNA, 14 nt, Pseudomonas aeruginosa PA01
cuuccggugcaugc

SEQ ID NO: 1427789 - RNA, 17 nt, Pseudomonas aeruginosa PA01
cuuccggugcaugcgca

SEQ ID NO: 1427790 - RNA, 17 nt, Pseudomonas aeruginosa PA01
cuucgccagcggccagg

SEQ ID NO: 1427791 - RNA, 14 nt, Pseudomonas aeruginosa PA01
cuucgcccgccgcc

SEQ ID NO: 1427792 - RNA, 15 nt, Pseudomonas aeruginosa PA01
cuucgcccgcugcgc

SEQ ID NO: 1427793 - RNA, 20 nt, Pseudomonas aeruginosa PA01
cuucgcccagguaggcgaug

SEQ ID NO: 1427794 - RNA, 20 nt, Pseudomonas aeruginosa PA01
cuucgcccauggcacgcagg

SEQ ID NO: 1427795 - RNA, 21 nt, Pseudomonas aeruginosa PA01
cuucgacaugggccgcgcaga

SEQ ID NO: 1427796 - RNA, 18 nt, Pseudomonas aeruginosa PA01
cuucgcaggagucgacga

SEQ ID NO: 1427797 - RNA, 17 nt, Pseudomonas aeruginosa PA01
cuucgagccuggccagg

SEQ ID NO: 1427798 - RNA, 19 nt, Pseudomonas aeruginosa PA01
cuucgagccuggccaggcg

SEQ ID NO: 1427799 - RNA, 20 nt, Pseudomonas aeruginosa PA01
cuucgagccuggccaggcgc

SEQ ID NO: 1427800 - RNA, 17 nt, Pseudomonas aeruginosa PA01
cuucgagcaacacaugc

SEQ ID NO: 1427801 - RNA, 17 nt, Pseudomonas aeruginosa PA01
cuucgagcaccccgagc

SEQ ID NO: 1427802 - RNA, 16 nt, Pseudomonas aeruginosa PA01
cuucgaagccgagcug

SEQ ID NO: 1427803 - RNA, 16 nt, Pseudomonas aeruginosa PA01
cuucgaacgugcgcgc

SEQ ID NO: 1427804 - RNA, 17 nt, Pseudomonas aeruginosa PA01
cuucgaacgugcgcgca

SEQ ID NO: 1427805 - RNA, 19 nt, Pseudomonas aeruginosa PA01
cuucgaacccgcccucgug

SEQ ID NO: 1427806 - RNA, 14 nt, Pseudomonas aeruginosa PA01
cuucgaaccgcaga

SEQ ID NO: 1427807 - RNA, 15 nt, Pseudomonas aeruginosa PA01
cuuaccuugccggug

SEQ ID NO: 1427808 - RNA, 16 nt, Pseudomonas aeruginosa PA01
cuguuucaggccggcg

SEQ ID NO: 1427809 - RNA, 20 nt, Pseudomonas aeruginosa PA01
cuguuucuccaguucggcga

SEQ ID NO: 1427810 - RNA, 23 nt, Pseudomonas aeruginosa PA01
cuguuacugagcgugacccgcgc

SEQ ID NO: 1427811 - RNA, 21 nt, Pseudomonas aeruginosa PA01
cuguugguggggcgccggcuc

SEQ ID NO: 1427812 - RNA, 19 nt, Pseudomonas aeruginosa PA01
cuguuggccaaccaggaag

SEQ ID NO: 1427813 - RNA, 17 nt, Pseudomonas aeruginosa PA01
cuucaaccgcuggucgg

SEQ ID NO: 1427814 - RNA, 22 nt, Pseudomonas aeruginosa PA01
cuucaaccgcuggucggcaucc

SEQ ID NO: 1427815 - RNA, 21 nt, Pseudomonas aeruginosa PA01
cuucaaaggaaucuucggcgc

SEQ ID NO: 1427816 - RNA, 23 nt, Pseudomonas aeruginosa PA01
cuucaaaggaaucuucggcgccc

SEQ ID NO: 1427817 - RNA, 14 nt, Pseudomonas aeruginosa PA01
cuucaagcggccau

SEQ ID NO: 1427818 - RNA, 12 nt, Pseudomonas aeruginosa PA01
cuucaacggugg

SEQ ID NO: 1427819 - RNA, 16 nt, Pseudomonas aeruginosa PA01
cugucucgccagcccg

SEQ ID NO: 1427820 - RNA, 13 nt, Pseudomonas aeruginosa PA01
cugucucgccgau

SEQ ID NO: 1427821 - RNA, 20 nt, Pseudomonas aeruginosa PA01
cugucuaucccgugccgggc

SEQ ID NO: 1427822 - RNA, 22 nt, Pseudomonas aeruginosa PA01
cugugaucaggcuguccacgcc

SEQ ID NO: 1427823 - RNA, 20 nt, Pseudomonas aeruginosa PA01
cugugcucgaggaagcgccc

SEQ ID NO: 1427824 - RNA, 20 nt, Pseudomonas aeruginosa PA01
cuguggaaguacggcgcggu

SEQ ID NO: 1427825 - RNA, 20 nt, Pseudomonas aeruginosa PA01
cuguggaauguccugccgca

SEQ ID NO: 1427826 - RNA, 14 nt, Pseudomonas aeruginosa PA01
cuguggagccggug

SEQ ID NO: 1427827 - RNA, 20 nt, Pseudomonas aeruginosa PA01
cuguggauaaaaaggcccgg

SEQ ID NO: 1427828 - RNA, 21 nt, Pseudomonas aeruginosa PA01
cuguggauaaaaaggcccgga

SEQ ID NO: 1427829 - RNA, 20 nt, Pseudomonas aeruginosa PA01
cuguggauaacucugugggc

SEQ ID NO: 1427830 - RNA, 16 nt, Pseudomonas aeruginosa PA01
cugugcugcgcgccgc

SEQ ID NO: 1427831 - RNA, 15 nt, Pseudomonas aeruginosa PA01
cugugcuggccaccc

SEQ ID NO: 1427832 - RNA, 16 nt, Pseudomonas aeruginosa PA01
cugugcuggccacccu

SEQ ID NO: 1427833 - RNA, 23 nt, Pseudomonas aeruginosa PA01
cugugcgguauagcucauggcca

SEQ ID NO: 1427834 - RNA, 18 nt, Pseudomonas aeruginosa PA01
cugugcugcaccagcagg

SEQ ID NO: 1427835 - RNA, 14 nt, Pseudomonas aeruginosa PA01
cuguguccggcgga

SEQ ID NO: 1427836 - RNA, 15 nt, Pseudomonas aeruginosa PA01
cuguguccggcggau

SEQ ID NO: 1427837 - RNA, 19 nt, Pseudomonas aeruginosa PA01
cugugggucgggucggcga

SEQ ID NO: 1427838 - RNA, 21 nt, Pseudomonas aeruginosa PA01
cugugggucgggucggcgaag

SEQ ID NO: 1427839 - RNA, 14 nt, Pseudomonas aeruginosa PA01
cuggucgaaagccu

SEQ ID NO: 1427840 - RNA, 20 nt, Pseudomonas aeruginosa PA01
cuggucgaaagccugccggg

SEQ ID NO: 1427841 - RNA, 23 nt, Pseudomonas aeruginosa PA01
cuggucgaaagccugccgggcaa

SEQ ID NO: 1427842 - RNA, 20 nt, Pseudomonas aeruginosa PA01
cuggucgacauagcgcagca

SEQ ID NO: 1427843 - RNA, 13 nt, Pseudomonas aeruginosa PA01
cugucacgccggg

SEQ ID NO: 1427844 - RNA, 15 nt, Pseudomonas aeruginosa PA01
cugucagggcgcaau

SEQ ID NO: 1427845 - RNA, 23 nt, Pseudomonas aeruginosa PA01
cugucagacacgaaaaagccggc

SEQ ID NO: 1427846 - RNA, 14 nt, Pseudomonas aeruginosa PA01
cugucagcgcccgg

SEQ ID NO: 1427847 - RNA, 17 nt, Pseudomonas aeruginosa PA01
cuguccguugcgcagca

SEQ ID NO: 1427848 - RNA, 16 nt, Pseudomonas aeruginosa PA01
cuguccuccagcggcg

SEQ ID NO: 1427849 - RNA, 18 nt, Pseudomonas aeruginosa PA01
cuguccuccagcggcggg

SEQ ID NO: 1427850 - RNA, 15 nt, Pseudomonas aeruginosa PA01
cuguccgccgccgcg

SEQ ID NO: 1427851 - RNA, 22 nt, Pseudomonas aeruginosa PA01
cuguccgccggccucgaagaac

SEQ ID NO: 1427852 - RNA, 16 nt, Pseudomonas aeruginosa PA01
cugucgacgcagccgg

SEQ ID NO: 1427853 - RNA, 17 nt, Pseudomonas aeruginosa PA01
cugucgacgcagccggg

SEQ ID NO: 1427854 - RNA, 16 nt, Pseudomonas aeruginosa PA01
cugucguccagcgggu

SEQ ID NO: 1427855 - RNA, 18 nt, Pseudomonas aeruginosa PA01
cugucgauaccagcgccg

SEQ ID NO: 1427856 - RNA, 19 nt, Pseudomonas aeruginosa PA01
cugucgauaccagcgccgc

SEQ ID NO: 1427857 - RNA, 22 nt, Pseudomonas aeruginosa PA01
cugucgauaccagcgccgcucc

SEQ ID NO: 1427858 - RNA, 21 nt, Pseudomonas aeruginosa PA01
cugucguuccggcucagccgc

SEQ ID NO: 1427859 - RNA, 13 nt, Pseudomonas aeruginosa PA01
cugucgucgaggg

SEQ ID NO: 1427860 - RNA, 16 nt, Pseudomonas aeruginosa PA01
cugucgucggcgcggc

SEQ ID NO: 1427861 - RNA, 16 nt, Pseudomonas aeruginosa PA01
cugucgucuucggcca

SEQ ID NO: 1427862 - RNA, 18 nt, Pseudomonas aeruginosa PA01
cugucgucuucggccagu

SEQ ID NO: 1427863 - RNA, 19 nt, Pseudomonas aeruginosa PA01
cggugcggucguugaucac

SEQ ID NO: 1427864 - RNA, 23 nt, Pseudomonas aeruginosa PA01
cggugcgguuggagcggaucacg

SEQ ID NO: 1427865 - RNA, 14 nt, Pseudomonas aeruginosa PA01
cggugcggucggcg

SEQ ID NO: 1427866 - RNA, 23 nt, Pseudomonas aeruginosa PA01
cggugcgggcagacaccaccagg

SEQ ID NO: 1427867 - RNA, 17 nt, Pseudomonas aeruginosa PA01
cggugcgggccuugacc

SEQ ID NO: 1427868 - RNA, 14 nt, Pseudomonas aeruginosa PA01
cggugcggguaucg

SEQ ID NO: 1427869 - RNA, 19 nt, Pseudomonas aeruginosa PA01
cggugcggguggucgccgc

SEQ ID NO: 1427870 - RNA, 20 nt, Pseudomonas aeruginosa PA01
cggugcggguggucgccgcc

SEQ ID NO: 1427871 - RNA, 13 nt, Pseudomonas aeruginosa PA01
cggugcggcauuc

SEQ ID NO: 1427872 - RNA, 20 nt, Pseudomonas aeruginosa PA01
cggugcggcauuccgggcga

SEQ ID NO: 1427873 - RNA, 17 nt, Pseudomonas aeruginosa PA01
cggugcggccgaggaac

SEQ ID NO: 1427874 - RNA, 23 nt, Pseudomonas aeruginosa PA01
cggugcuagcggguggcaacugc

SEQ ID NO: 1427875 - RNA, 17 nt, Pseudomonas aeruginosa PA01
cggugcucaggcggccg

SEQ ID NO: 1427876 - RNA, 21 nt, Pseudomonas aeruginosa PA01
cggugcucaggcggccgaacu

SEQ ID NO: 1427877 - RNA, 15 nt, Pseudomonas aeruginosa PA01
cggugcguucgcggg

SEQ ID NO: 1427878 - RNA, 14 nt, Pseudomonas aeruginosa PA01
cggugcguagcgac

SEQ ID NO: 1427879 - RNA, 16 nt, Pseudomonas aeruginosa PA01
cggugcguagcgacag

SEQ ID NO: 1427880 - RNA, 14 nt, Pseudomonas aeruginosa PA01
cggugcuggcgagc

SEQ ID NO: 1427881 - RNA, 12 nt, Pseudomonas aeruginosa PA01
cggugcgcgcca

SEQ ID NO: 1427882 - RNA, 13 nt, Pseudomonas aeruginosa PA01
cggugcgccggcg

SEQ ID NO: 1427883 - RNA, 15 nt, Pseudomonas aeruginosa PA01
cggugcgccggcggg

SEQ ID NO: 1427884 - RNA, 17 nt, Pseudomonas aeruginosa PA01
cggugcgccggcgggau

SEQ ID NO: 1427885 - RNA, 16 nt, Pseudomonas aeruginosa PA01
cggugcgccccaggug

SEQ ID NO: 1427886 - RNA, 13 nt, Pseudomonas aeruginosa PA01
cggugccgggaag

SEQ ID NO: 1427887 - RNA, 21 nt, Pseudomonas aeruginosa PA01
cggugccuucccagccgaggc

SEQ ID NO: 1427888 - RNA, 14 nt, Pseudomonas aeruginosa PA01
cggugccuucggcg

SEQ ID NO: 1427889 - RNA, 17 nt, Pseudomonas aeruginosa PA01
cggugccuucggcggcg

SEQ ID NO: 1427890 - RNA, 13 nt, Pseudomonas aeruginosa PA01
cggugcgaaccgg

SEQ ID NO: 1427891 - RNA, 11 nt, Pseudomonas aeruginosa PA01
cgguggcggcg

SEQ ID NO: 1427892 - RNA, 18 nt, Pseudomonas aeruginosa PA01
cgguggcguuauccgccc

SEQ ID NO: 1427893 - RNA, 19 nt, Pseudomonas aeruginosa PA01
cgguggcguuauccgcccc

SEQ ID NO: 1427894 - RNA, 18 nt, Pseudomonas aeruginosa PA01
cgguggcguuauucgccc

SEQ ID NO: 1427895 - RNA, 17 nt, Pseudomonas aeruginosa PA01
cgguggcggcgacgaag

SEQ ID NO: 1427896 - RNA, 21 nt, Pseudomonas aeruginosa PA01
cggugggaagagcaucucgcc

SEQ ID NO: 1427897 - RNA, 22 nt, Pseudomonas aeruginosa PA01
cggugggaagagcaucucgccg

SEQ ID NO: 1427898 - RNA, 16 nt, Pseudomonas aeruginosa PA01
cggugggccuugagca

SEQ ID NO: 1427899 - RNA, 17 nt, Pseudomonas aeruginosa PA01
cggugggccuugagcau

SEQ ID NO: 1427900 - RNA, 16 nt, Pseudomonas aeruginosa PA01
cggugggcgagggcgc

SEQ ID NO: 1427901 - RNA, 18 nt, Pseudomonas aeruginosa PA01
cggugggcgagggcgcgc

SEQ ID NO: 1427902 - RNA, 14 nt, Pseudomonas aeruginosa PA01
cgguggccgugggc

SEQ ID NO: 1427903 - RNA, 20 nt, Pseudomonas aeruginosa PA01
cgguggccgugggccgccga

SEQ ID NO: 1427904 - RNA, 14 nt, Pseudomonas aeruginosa PA01
cgguggcgaccagg

SEQ ID NO: 1427905 - RNA, 19 nt, Pseudomonas aeruginosa PA01
cgguggcgacgcgcaggcc

SEQ ID NO: 1427906 - RNA, 21 nt, Pseudomonas aeruginosa PA01
cgguggcgacgcgcaggccgg

SEQ ID NO: 1427907 - RNA, 16 nt, Pseudomonas aeruginosa PA01
cgguggcgcccagcca

SEQ ID NO: 1427908 - RNA, 22 nt, Pseudomonas aeruginosa PA01
cgguggcaggaaaugccuggcu

SEQ ID NO: 1427909 - RNA, 21 nt, Pseudomonas aeruginosa PA01
cgguggcccacuccagauagu

SEQ ID NO: 1427910 - RNA, 20 nt, Pseudomonas aeruginosa PA01
cgguggccacgucgccccag

SEQ ID NO: 1427911 - RNA, 18 nt, Pseudomonas aeruginosa PA01
cgguggagcacgucgagc

SEQ ID NO: 1427912 - RNA, 20 nt, Pseudomonas aeruginosa PA01
cgguggagcacgucgagcag

SEQ ID NO: 1427913 - RNA, 21 nt, Pseudomonas aeruginosa PA01
cgguggagcagaacuugcgca

SEQ ID NO: 1427914 - RNA, 17 nt, Pseudomonas aeruginosa PA01
cgguggaggcgucggcc

SEQ ID NO: 1427915 - RNA, 19 nt, Pseudomonas aeruginosa PA01
cgguggaggucugccacca

SEQ ID NO: 1427916 - RNA, 18 nt, Pseudomonas aeruginosa PA01
cgguggaugccgguggcg

SEQ ID NO: 1427917 - RNA, 20 nt, Pseudomonas aeruginosa PA01
cgguggaugccgguggcgcc

SEQ ID NO: 1427918 - RNA, 14 nt, Pseudomonas aeruginosa PA01
cgguggaggcggcg

SEQ ID NO: 1427919 - RNA, 18 nt, Pseudomonas aeruginosa PA01
cgguggaggcggcgguca

SEQ ID NO: 1427920 - RNA, 18 nt, Pseudomonas aeruginosa PA01
cggugcuguaguaggcgg

SEQ ID NO: 1427921 - RNA, 17 nt, Pseudomonas aeruginosa PA01
cggugcuuugcauggcc

SEQ ID NO: 1427922 - RNA, 19 nt, Pseudomonas aeruginosa PA01
cgguggaauaccgcugcgc

SEQ ID NO: 1427923 - RNA, 20 nt, Pseudomonas aeruginosa PA01
cgguggaauaccgcugcgcg

SEQ ID NO: 1427924 - RNA, 19 nt, Pseudomonas aeruginosa PA01
cggugcaccaggcgaugcg

SEQ ID NO: 1427925 - RNA, 21 nt, Pseudomonas aeruginosa PA01
cggugauguaggacgccucgu

SEQ ID NO: 1427926 - RNA, 22 nt, Pseudomonas aeruginosa PA01
cggugauguaggacgccucguc

SEQ ID NO: 1427927 - RNA, 15 nt, Pseudomonas aeruginosa PA01
cggugaugucggcgc

SEQ ID NO: 1427928 - RNA, 22 nt, Pseudomonas aeruginosa PA01
cggugauucguccggagccggg

SEQ ID NO: 1427929 - RNA, 18 nt, Pseudomonas aeruginosa PA01
cggugcaugaaggcgcug

SEQ ID NO: 1427930 - RNA, 17 nt, Pseudomonas aeruginosa PA01
cggugcaugcgcacggu

SEQ ID NO: 1427931 - RNA, 21 nt, Pseudomonas aeruginosa PA01
cggugcagccacccagcagca

SEQ ID NO: 1427932 - RNA, 13 nt, Pseudomonas aeruginosa PA01
cggugcaggccga

SEQ ID NO: 1427933 - RNA, 16 nt, Pseudomonas aeruginosa PA01
cggugcaggccgacgu

SEQ ID NO: 1427934 - RNA, 14 nt, Pseudomonas aeruginosa PA01
cggugcaggccgag

SEQ ID NO: 1427935 - RNA, 18 nt, Pseudomonas aeruginosa PA01
cggugccccgcuggccca

SEQ ID NO: 1427936 - RNA, 14 nt, Pseudomonas aeruginosa PA01
cggugccagggcgg

SEQ ID NO: 1427937 - RNA, 18 nt, Pseudomonas aeruginosa PA01
cggugccauacagcgccc

SEQ ID NO: 1427938 - RNA, 19 nt, Pseudomonas aeruginosa PA01
cggugccauacucggacgg

SEQ ID NO: 1427939 - RNA, 21 nt, Pseudomonas aeruginosa PA01
cggugccauggaucaccaggg

SEQ ID NO: 1427940 - RNA, 14 nt, Pseudomonas aeruginosa PA01
cggugccgcgcagc

SEQ ID NO: 1427941 - RNA, 12 nt, Pseudomonas aeruginosa PA01
cggugccgccgg

SEQ ID NO: 1427942 - RNA, 19 nt, Pseudomonas aeruginosa PA01
cggugccgccggcgccgcc

SEQ ID NO: 1427943 - RNA, 14 nt, Pseudomonas aeruginosa PA01
cggugccgcccggc

SEQ ID NO: 1427944 - RNA, 17 nt, Pseudomonas aeruginosa PA01
cggugccgcccggcgcc

SEQ ID NO: 1427945 - RNA, 21 nt, Pseudomonas aeruginosa PA01
cggugccgcccggcgccaccg

SEQ ID NO: 1427946 - RNA, 12 nt, Pseudomonas aeruginosa PA01
cggugacgcugc

SEQ ID NO: 1427947 - RNA, 19 nt, Pseudomonas aeruginosa PA01
cggugaccguuucgccgcc

SEQ ID NO: 1427948 - RNA, 21 nt, Pseudomonas aeruginosa PA01
cggugaccguuucgccgccgg

SEQ ID NO: 1427949 - RNA, 14 nt, Pseudomonas aeruginosa PA01
cggugacgaacgaa

SEQ ID NO: 1427950 - RNA, 17 nt, Pseudomonas aeruginosa PA01
cggugagcacgccgcga

SEQ ID NO: 1427951 - RNA, 18 nt, Pseudomonas aeruginosa PA01
cggugagcugaucgcgaa

SEQ ID NO: 1427952 - RNA, 15 nt, Pseudomonas aeruginosa PA01
cggugagcaggcgcc

SEQ ID NO: 1427953 - RNA, 16 nt, Pseudomonas aeruginosa PA01
cggugagcaggcgccg

SEQ ID NO: 1427954 - RNA, 19 nt, Pseudomonas aeruginosa PA01
cggugaggcgcagcagcgc

SEQ ID NO: 1427955 - RNA, 14 nt, Pseudomonas aeruginosa PA01
cggugagggcgacg

SEQ ID NO: 1427956 - RNA, 17 nt, Pseudomonas aeruginosa PA01
cggugagggcgacggcg

SEQ ID NO: 1427957 - RNA, 22 nt, Pseudomonas aeruginosa PA01
cggugagguagcagaucucguc

SEQ ID NO: 1427958 - RNA, 19 nt, Pseudomonas aeruginosa PA01
cggugaggaccuggccgcg

SEQ ID NO: 1427959 - RNA, 18 nt, Pseudomonas aeruginosa PA01
cggugagguugccgccga

SEQ ID NO: 1427960 - RNA, 20 nt, Pseudomonas aeruginosa PA01
cggugagguugccgccgauc

SEQ ID NO: 1427961 - RNA, 23 nt, Pseudomonas aeruginosa PA01
cggugagguugccgccgaucagc

SEQ ID NO: 1427962 - RNA, 17 nt, Pseudomonas aeruginosa PA01
cggugauaccgccggcg

SEQ ID NO: 1427963 - RNA, 22 nt, Pseudomonas aeruginosa PA01
cggugauaccgccggcggcgau

SEQ ID NO: 1427964 - RNA, 20 nt, Pseudomonas aeruginosa PA01
cggugaucgagacgccguag

SEQ ID NO: 1427965 - RNA, 16 nt, Pseudomonas aeruginosa PA01
cggugaucgagccgcc

SEQ ID NO: 1427966 - RNA, 17 nt, Pseudomonas aeruginosa PA01
cggugaucgagccgccg

SEQ ID NO: 1427967 - RNA, 19 nt, Pseudomonas aeruginosa PA01
cggugaugguaucgccguc

SEQ ID NO: 1427968 - RNA, 21 nt, Pseudomonas aeruginosa PA01
cggugaugguaucgccguccu

SEQ ID NO: 1427969 - RNA, 17 nt, Pseudomonas aeruginosa PA01
cggugaucucgcggcgc

SEQ ID NO: 1427970 - RNA, 15 nt, Pseudomonas aeruginosa PA01
cggugaucgccgcga

SEQ ID NO: 1427971 - RNA, 11 nt, Pseudomonas aeruginosa PA01
cggugaucgcc

SEQ ID NO: 1427972 - RNA, 21 nt, Pseudomonas aeruginosa PA01
cguaaucgccauuggccaggg

SEQ ID NO: 1427973 - RNA, 18 nt, Pseudomonas aeruginosa PA01
cguaaucgcgccaggccg

SEQ ID NO: 1427974 - RNA, 19 nt, Pseudomonas aeruginosa PA01
cguaaucgcgccaggccgc

SEQ ID NO: 1427975 - RNA, 18 nt, Pseudomonas aeruginosa PA01
cguacacguuggccgucu

SEQ ID NO: 1427976 - RNA, 20 nt, Pseudomonas aeruginosa PA01
cguacagcccccgccggccg

SEQ ID NO: 1427977 - RNA, 21 nt, Pseudomonas aeruginosa PA01
cguacagcaggcaggcauggu

SEQ ID NO: 1427978 - RNA, 13 nt, Pseudomonas aeruginosa PA01
cguacagcgcgac

SEQ ID NO: 1427979 - RNA, 14 nt, Pseudomonas aeruginosa PA01
cguacagcgcgaca

SEQ ID NO: 1427980 - RNA, 18 nt, Pseudomonas aeruginosa PA01
cguacaggccccaggcga

SEQ ID NO: 1427981 - RNA, 17 nt, Pseudomonas aeruginosa PA01
cguacagcgggucggcg

SEQ ID NO: 1427982 - RNA, 20 nt, Pseudomonas aeruginosa PA01
cguacagcgggucggcgaag

SEQ ID NO: 1427983 - RNA, 19 nt, Pseudomonas aeruginosa PA01
cguacaggucggcgccggu

SEQ ID NO: 1427984 - RNA, 16 nt, Pseudomonas aeruginosa PA01
cguacaccgcgcggca

SEQ ID NO: 1427985 - RNA, 19 nt, Pseudomonas aeruginosa PA01
cgguuucguggaugcugau

SEQ ID NO: 1427986 - RNA, 22 nt, Pseudomonas aeruginosa PA01
cgguuuccaggaugcaaccgcc

SEQ ID NO: 1427987 - RNA, 15 nt, Pseudomonas aeruginosa PA01
cgguuucgcagcgcu

SEQ ID NO: 1427988 - RNA, 13 nt, Pseudomonas aeruginosa PA01
cgguuucgccgag

SEQ ID NO: 1427989 - RNA, 17 nt, Pseudomonas aeruginosa PA01
cgguuucgccgaggccc

SEQ ID NO: 1427990 - RNA, 19 nt, Pseudomonas aeruginosa PA01
cgguuucgaccggcgcgcc

SEQ ID NO: 1427991 - RNA, 16 nt, Pseudomonas aeruginosa PA01
cgguuucaggccuugc

SEQ ID NO: 1427992 - RNA, 22 nt, Pseudomonas aeruginosa PA01
cgguucgacacgcucagccccg

SEQ ID NO: 1427993 - RNA, 14 nt, Pseudomonas aeruginosa PA01
cgguuccuggcugg

SEQ ID NO: 1427994 - RNA, 16 nt, Pseudomonas aeruginosa PA01
cgguuccuggcuggag

SEQ ID NO: 1427995 - RNA, 16 nt, Pseudomonas aeruginosa PA01
cgguucgccgagcgcc

SEQ ID NO: 1427996 - RNA, 17 nt, Pseudomonas aeruginosa PA01
cgguucgccgagcgccg

SEQ ID NO: 1427997 - RNA, 20 nt, Pseudomonas aeruginosa PA01
cgguucgccgagcgccgcca

SEQ ID NO: 1427998 - RNA, 17 nt, Pseudomonas aeruginosa PA01
cgguucgcaggccaggc

SEQ ID NO: 1427999 - RNA, 18 nt, Pseudomonas aeruginosa PA01
cgguucgcaggccaggcg

SEQ ID NO: 1428000 - RNA, 21 nt, Pseudomonas aeruginosa PA01
cgguucgcaggccaggcgcag

SEQ ID NO: 1428001 - RNA, 18 nt, Pseudomonas aeruginosa PA01
cgguucggcaaggcgcag

SEQ ID NO: 1428002 - RNA, 22 nt, Pseudomonas aeruginosa PA01
cgguugaagauauaacgcgagc

SEQ ID NO: 1428003 - RNA, 19 nt, Pseudomonas aeruginosa PA01
cgguugaaacugcgcaggc

SEQ ID NO: 1428004 - RNA, 21 nt, Pseudomonas aeruginosa PA01
cgguugaaacugcgcaggcug

SEQ ID NO: 1428005 - RNA, 16 nt, Pseudomonas aeruginosa PA01
cgguucucgccccagc

SEQ ID NO: 1428006 - RNA, 21 nt, Pseudomonas aeruginosa PA01
cgguucucguccagguccgca

SEQ ID NO: 1428007 - RNA, 18 nt, Pseudomonas aeruginosa PA01
cgguucucgucgaugucg

SEQ ID NO: 1428008 - RNA, 15 nt, Pseudomonas aeruginosa PA01
cgguucugcgcacca

SEQ ID NO: 1428009 - RNA, 23 nt, Pseudomonas aeruginosa PA01
cgguucguugaccguccacaccg

SEQ ID NO: 1428010 - RNA, 18 nt, Pseudomonas aeruginosa PA01
cgguuagaauaccggccu

SEQ ID NO: 1428011 - RNA, 20 nt, Pseudomonas aeruginosa PA01
cgguuagaauaccggccugu

SEQ ID NO: 1428012 - RNA, 14 nt, Pseudomonas aeruginosa PA01
cgguuagccggcga

SEQ ID NO: 1428013 - RNA, 19 nt, Pseudomonas aeruginosa PA01
cgguuaccggcgaccaccg

SEQ ID NO: 1428014 - RNA, 20 nt, Pseudomonas aeruginosa PA01
cgguuaccggcgaccaccgc

SEQ ID NO: 1428015 - RNA, 15 nt, Pseudomonas aeruginosa PA01
cgguuauccgccgcc

SEQ ID NO: 1428016 - RNA, 17 nt, Pseudomonas aeruginosa PA01
cgguuauccgccgccgg

SEQ ID NO: 1428017 - RNA, 19 nt, Pseudomonas aeruginosa PA01
cgguuauccgccgccgggc

SEQ ID NO: 1428018 - RNA, 16 nt, Pseudomonas aeruginosa PA01
cgguuauccgccgccu

SEQ ID NO: 1428019 - RNA, 15 nt, Pseudomonas aeruginosa PA01
cgguuauccgccgcu

SEQ ID NO: 1428020 - RNA, 17 nt, Pseudomonas aeruginosa PA01
cgguuauccgccgugga

SEQ ID NO: 1428021 - RNA, 20 nt, Pseudomonas aeruginosa PA01
cgguuaucgaggcgucggcg

SEQ ID NO: 1428022 - RNA, 22 nt, Pseudomonas aeruginosa PA01
cgguuaucgaggcgucggcggg

SEQ ID NO: 1428023 - RNA, 14 nt, Pseudomonas aeruginosa PA01
cgguucccgcagcg

SEQ ID NO: 1428024 - RNA, 22 nt, Pseudomonas aeruginosa PA01
cgguucccgcagcgaucagcac

SEQ ID NO: 1428025 - RNA, 17 nt, Pseudomonas aeruginosa PA01
cgguuauucgcccuacc

SEQ ID NO: 1428026 - RNA, 15 nt, Pseudomonas aeruginosa PA01
cgguuccagcucguc

SEQ ID NO: 1428027 - RNA, 21 nt, Pseudomonas aeruginosa PA01
cggugugccgucaggcaccuc

SEQ ID NO: 1428028 - RNA, 15 nt, Pseudomonas aeruginosa PA01
cggugugcucaggcg

SEQ ID NO: 1428029 - RNA, 21 nt, Pseudomonas aeruginosa PA01
cgguggugugauccugcuggu

SEQ ID NO: 1428030 - RNA, 16 nt, Pseudomonas aeruginosa PA01
cgguguccauguugcc

SEQ ID NO: 1428031 - RNA, 19 nt, Pseudomonas aeruginosa PA01
cgguguccgcggugccgcc

SEQ ID NO: 1428032 - RNA, 17 nt, Pseudomonas aeruginosa PA01
cggugucaggccgaggu

SEQ ID NO: 1428033 - RNA, 18 nt, Pseudomonas aeruginosa PA01
cgguguccaccaccagca

SEQ ID NO: 1428034 - RNA, 14 nt, Pseudomonas aeruginosa PA01
cgguggggccgccg

SEQ ID NO: 1428035 - RNA, 21 nt, Pseudomonas aeruginosa PA01
cgguggggccgccgaugccga

SEQ ID NO: 1428036 - RNA, 16 nt, Pseudomonas aeruginosa PA01
cggugggcuugccggg

SEQ ID NO: 1428037 - RNA, 15 nt, Pseudomonas aeruginosa PA01
cguaggccgucgcug

SEQ ID NO: 1428038 - RNA, 19 nt, Pseudomonas aeruginosa PA01
cguaggcgaacacgucggc

SEQ ID NO: 1428039 - RNA, 23 nt, Pseudomonas aeruginosa PA01
cguaggcgaacacgucggcgcgc

SEQ ID NO: 1428040 - RNA, 18 nt, Pseudomonas aeruginosa PA01
cguaggccacuucccggc

SEQ ID NO: 1428041 - RNA, 23 nt, Pseudomonas aeruginosa PA01
cguaggccacuucccggcgcaga

SEQ ID NO: 1428042 - RNA, 13 nt, Pseudomonas aeruginosa PA01
cguaggccaggca

SEQ ID NO: 1428043 - RNA, 21 nt, Pseudomonas aeruginosa PA01
cguaggccaggcagaccagcg

SEQ ID NO: 1428044 - RNA, 20 nt, Pseudomonas aeruginosa PA01
cguagcccuucuccgccagc

SEQ ID NO: 1428045 - RNA, 15 nt, Pseudomonas aeruginosa PA01
cguaggagccggcca

SEQ ID NO: 1428046 - RNA, 23 nt, Pseudomonas aeruginosa PA01
cguaggauacgucuucgauggcg

SEQ ID NO: 1428047 - RNA, 22 nt, Pseudomonas aeruginosa PA01
cguaggacgcauaaccgcuugc

SEQ ID NO: 1428048 - RNA, 19 nt, Pseudomonas aeruginosa PA01
cguagcccauggucagcgg

SEQ ID NO: 1428049 - RNA, 13 nt, Pseudomonas aeruginosa PA01
cguagccgcgcgc

SEQ ID NO: 1428050 - RNA, 14 nt, Pseudomonas aeruginosa PA01
cguagccgcgcgcc

SEQ ID NO: 1428051 - RNA, 15 nt, Pseudomonas aeruginosa PA01
cguagccgcgcgcca

SEQ ID NO: 1428052 - RNA, 17 nt, Pseudomonas aeruginosa PA01
cguagccgcgcgccagc

SEQ ID NO: 1428053 - RNA, 14 nt, Pseudomonas aeruginosa PA01
cguagucgaucagg

SEQ ID NO: 1428054 - RNA, 17 nt, Pseudomonas aeruginosa PA01
cguagucguucagcgcc

SEQ ID NO: 1428055 - RNA, 21 nt, Pseudomonas aeruginosa PA01
cguagugcuggguggaggccc

SEQ ID NO: 1428056 - RNA, 23 nt, Pseudomonas aeruginosa PA01
cguagugcaucagccuggccagc

SEQ ID NO: 1428057 - RNA, 17 nt, Pseudomonas aeruginosa PA01
cguagucggcagucgcc

SEQ ID NO: 1428058 - RNA, 14 nt, Pseudomonas aeruginosa PA01
cguaggcgcgcacc

SEQ ID NO: 1428059 - RNA, 18 nt, Pseudomonas aeruginosa PA01
cguaggcgcgcaccugcg

SEQ ID NO: 1428060 - RNA, 17 nt, Pseudomonas aeruginosa PA01
cguaccagccgcggucc

SEQ ID NO: 1428061 - RNA, 20 nt, Pseudomonas aeruginosa PA01
cguacuggcggaucaccggc

SEQ ID NO: 1428062 - RNA, 22 nt, Pseudomonas aeruginosa PA01
cguaccaagcgagacgccgccc

SEQ ID NO: 1428063 - RNA, 12 nt, Pseudomonas aeruginosa PA01
cguaccccgacg

SEQ ID NO: 1428064 - RNA, 14 nt, Pseudomonas aeruginosa PA01
cguagaccggcucc

SEQ ID NO: 1428065 - RNA, 19 nt, Pseudomonas aeruginosa PA01
cguagaccggcuccagggc

SEQ ID NO: 1428066 - RNA, 17 nt, Pseudomonas aeruginosa PA01
cguagauggucagcaac

SEQ ID NO: 1428067 - RNA, 12 nt, Pseudomonas aeruginosa PA01
cguagcccaggc

SEQ ID NO: 1428068 - RNA, 17 nt, Pseudomonas aeruginosa PA01
cguagccaugcccggcu

SEQ ID NO: 1428069 - RNA, 23 nt, Pseudomonas aeruginosa PA01
cguagaccaucgccggcgagccg

SEQ ID NO: 1428070 - RNA, 14 nt, Pseudomonas aeruginosa PA01
cguagaccaccagc

SEQ ID NO: 1428071 - RNA, 18 nt, Pseudomonas aeruginosa PA01
cguagaccaccagcagca

SEQ ID NO: 1428072 - RNA, 19 nt, Pseudomonas aeruginosa PA01
cguagaccaccagcagcag

SEQ ID NO: 1428073 - RNA, 16 nt, Pseudomonas aeruginosa PA01
cguagaaacgcgccuc

SEQ ID NO: 1428074 - RNA, 16 nt, Pseudomonas aeruginosa PA01
cguagaacgccaggau

SEQ ID NO: 1428075 - RNA, 15 nt, Pseudomonas aeruginosa PA01
cguacuuggcccggc

SEQ ID NO: 1428076 - RNA, 16 nt, Pseudomonas aeruginosa PA01
cguacuuggcccggcg

SEQ ID NO: 1428077 - RNA, 16 nt, Pseudomonas aeruginosa PA01
cguacuucagcgucac

SEQ ID NO: 1428078 - RNA, 23 nt, Pseudomonas aeruginosa PA01
cguacuucagcgucaccgcgccg

SEQ ID NO: 1428079 - RNA, 14 nt, Pseudomonas aeruginosa PA01
cguacuucggcgcg

SEQ ID NO: 1428080 - RNA, 19 nt, Pseudomonas aeruginosa PA01
cguaucgaugcgcgcggcg

SEQ ID NO: 1428081 - RNA, 13 nt, Pseudomonas aeruginosa PA01
cguaucccagcgc

SEQ ID NO: 1428082 - RNA, 14 nt, Pseudomonas aeruginosa PA01
cguaucccagcgcg

SEQ ID NO: 1428083 - RNA, 24 nt, Pseudomonas aeruginosa PA01
cguaucccagcgcgugcaggcgcc

SEQ ID NO: 1428084 - RNA, 13 nt, Pseudomonas aeruginosa PA01
cguauaggcgcug

SEQ ID NO: 1428085 - RNA, 15 nt, Pseudomonas aeruginosa PA01
cguaguggcgcaaca

SEQ ID NO: 1428086 - RNA, 17 nt, Pseudomonas aeruginosa PA01
cguaguugacccgcccc

SEQ ID NO: 1428087 - RNA, 21 nt, Pseudomonas aeruginosa PA01
cguaguugagccccagguagg

SEQ ID NO: 1428088 - RNA, 20 nt, Pseudomonas aeruginosa PA01
cguaguugaugaagccgcga

SEQ ID NO: 1428089 - RNA, 22 nt, Pseudomonas aeruginosa PA01
cguaguugaugaagccgcgacc

SEQ ID NO: 1428090 - RNA, 15 nt, Pseudomonas aeruginosa PA01
cgucagcgcgccagc

SEQ ID NO: 1428091 - RNA, 14 nt, Pseudomonas aeruginosa PA01
cgucaccgcgucgg

SEQ ID NO: 1428092 - RNA, 13 nt, Pseudomonas aeruginosa PA01
cgucaccgcgccg

SEQ ID NO: 1428093 - RNA, 13 nt, Pseudomonas aeruginosa PA01
cgucaccggcgcc

SEQ ID NO: 1428094 - RNA, 14 nt, Pseudomonas aeruginosa PA01
cgucacggcgugcc

SEQ ID NO: 1428095 - RNA, 19 nt, Pseudomonas aeruginosa PA01
cgucacggcgugccgcagg

SEQ ID NO: 1428096 - RNA, 15 nt, Pseudomonas aeruginosa PA01
cgucaccucggcgcc

SEQ ID NO: 1428097 - RNA, 16 nt, Pseudomonas aeruginosa PA01
cgucaccucggcgcca

SEQ ID NO: 1428098 - RNA, 17 nt, Pseudomonas aeruginosa PA01
cgucaccuguucggcgc

SEQ ID NO: 1428099 - RNA, 14 nt, Pseudomonas aeruginosa PA01
cgucggccaccagg

SEQ ID NO: 1428100 - RNA, 17 nt, Pseudomonas aeruginosa PA01
cgucggcaagcaggccg

SEQ ID NO: 1428101 - RNA, 18 nt, Pseudomonas aeruginosa PA01
cgucggcaagcaggccgc

SEQ ID NO: 1428102 - RNA, 13 nt, Pseudomonas aeruginosa PA01
cgucggcagccau

SEQ ID NO: 1428103 - RNA, 17 nt, Pseudomonas aeruginosa PA01
cgucggcagccaucgca

SEQ ID NO: 1428104 - RNA, 20 nt, Pseudomonas aeruginosa PA01
cgucggcaauucuucaaggu

SEQ ID NO: 1428105 - RNA, 12 nt, Pseudomonas aeruginosa PA01
cgucggcacgcc

SEQ ID NO: 1428106 - RNA, 18 nt, Pseudomonas aeruginosa PA01
cgucggcccuccccuggc

SEQ ID NO: 1428107 - RNA, 20 nt, Pseudomonas aeruginosa PA01
cgucggcccuccccuggccc

SEQ ID NO: 1428108 - RNA, 23 nt, Pseudomonas aeruginosa PA01
cgucggcccuccccuggcccugc

SEQ ID NO: 1428109 - RNA, 19 nt, Pseudomonas aeruginosa PA01
cgucggccggggucaggcc

SEQ ID NO: 1428110 - RNA, 16 nt, Pseudomonas aeruginosa PA01
cgucgcugcgcaacug

SEQ ID NO: 1428111 - RNA, 15 nt, Pseudomonas aeruginosa PA01
cgucgcugccgccgc

SEQ ID NO: 1428112 - RNA, 17 nt, Pseudomonas aeruginosa PA01
cgucgcugccgccgcgc

SEQ ID NO: 1428113 - RNA, 18 nt, Pseudomonas aeruginosa PA01
cgucgcugcgcgggucgu

SEQ ID NO: 1428114 - RNA, 16 nt, Pseudomonas aeruginosa PA01
cgucgcugcacgcacg

SEQ ID NO: 1428115 - RNA, 15 nt, Pseudomonas aeruginosa PA01
cgucgcggccucuuc

SEQ ID NO: 1428116 - RNA, 15 nt, Pseudomonas aeruginosa PA01
cgucgcggcgccugg

SEQ ID NO: 1428117 - RNA, 17 nt, Pseudomonas aeruginosa PA01
cgucgcggcgccuggcg

SEQ ID NO: 1428118 - RNA, 13 nt, Pseudomonas aeruginosa PA01
cgucgcggcgcga

SEQ ID NO: 1428119 - RNA, 14 nt, Pseudomonas aeruginosa PA01
cgucgcggcgcgag

SEQ ID NO: 1428120 - RNA, 20 nt, Pseudomonas aeruginosa PA01
cgucgcggccaucggcgaag

SEQ ID NO: 1428121 - RNA, 20 nt, Pseudomonas aeruginosa PA01
cgucgcuguagcggcucgcc

SEQ ID NO: 1428122 - RNA, 23 nt, Pseudomonas aeruginosa PA01
cgucgcuguagcggcucgccgaa

SEQ ID NO: 1428123 - RNA, 20 nt, Pseudomonas aeruginosa PA01
cgucggauggccguccaggc

SEQ ID NO: 1428124 - RNA, 22 nt, Pseudomonas aeruginosa PA01
cgucggauggccguccaggcug

SEQ ID NO: 1428125 - RNA, 20 nt, Pseudomonas aeruginosa PA01
cgucggagagauagucgccg

SEQ ID NO: 1428126 - RNA, 21 nt, Pseudomonas aeruginosa PA01
cgucggagagauagucgccgu

SEQ ID NO: 1428127 - RNA, 18 nt, Pseudomonas aeruginosa PA01
cgucggacucgacgucau

SEQ ID NO: 1428128 - RNA, 13 nt, Pseudomonas aeruginosa PA01
cgucggacuugcg

SEQ ID NO: 1428129 - RNA, 15 nt, Pseudomonas aeruginosa PA01
cgucggacuugcggc

SEQ ID NO: 1428130 - RNA, 14 nt, Pseudomonas aeruginosa PA01
cgucgcaggcgaug

SEQ ID NO: 1428131 - RNA, 21 nt, Pseudomonas aeruginosa PA01
cgucgcaggcgaugccgacgc

SEQ ID NO: 1428132 - RNA, 20 nt, Pseudomonas aeruginosa PA01
cgucgcagguaacccgcggc

SEQ ID NO: 1428133 - RNA, 21 nt, Pseudomonas aeruginosa PA01
cgucgcagguaacccgcggcg

SEQ ID NO: 1428134 - RNA, 14 nt, Pseudomonas aeruginosa PA01
cgucgcauccacca

SEQ ID NO: 1428135 - RNA, 20 nt, Pseudomonas aeruginosa PA01
cgucgcacugcugcuugcuc

SEQ ID NO: 1428136 - RNA, 20 nt, Pseudomonas aeruginosa PA01
cgucgcaccuguuccagcaa

SEQ ID NO: 1428137 - RNA, 19 nt, Pseudomonas aeruginosa PA01
cgucgcagagacgcagcgc

SEQ ID NO: 1428138 - RNA, 17 nt, Pseudomonas aeruginosa PA01
cgucgccaacgcgccgu

SEQ ID NO: 1428139 - RNA, 20 nt, Pseudomonas aeruginosa PA01
cgucgccaacgcgccgucgc

SEQ ID NO: 1428140 - RNA, 17 nt, Pseudomonas aeruginosa PA01
cgucgccaagcccggcg

SEQ ID NO: 1428141 - RNA, 20 nt, Pseudomonas aeruginosa PA01
cgucgccaagcccggcgaga

SEQ ID NO: 1428142 - RNA, 15 nt, Pseudomonas aeruginosa PA01
cgucgaugaucccga

SEQ ID NO: 1428143 - RNA, 21 nt, Pseudomonas aeruginosa PA01
cgucgaugaucugcauggcgc

SEQ ID NO: 1428144 - RNA, 22 nt, Pseudomonas aeruginosa PA01
cgucgcacccggcccauggcga

SEQ ID NO: 1428145 - RNA, 13 nt, Pseudomonas aeruginosa PA01
cgucgcaccaggu

SEQ ID NO: 1428146 - RNA, 19 nt, Pseudomonas aeruginosa PA01
cgucgaucuugaggaagug

SEQ ID NO: 1428147 - RNA, 17 nt, Pseudomonas aeruginosa PA01
cgucgaugacgauggcg

SEQ ID NO: 1428148 - RNA, 15 nt, Pseudomonas aeruginosa PA01
cgucgaucucgccga

SEQ ID NO: 1428149 - RNA, 16 nt, Pseudomonas aeruginosa PA01
cgucgaucugcucguc

SEQ ID NO: 1428150 - RNA, 22 nt, Pseudomonas aeruginosa PA01
cgucgaucucgagcaugucggc

SEQ ID NO: 1428151 - RNA, 23 nt, Pseudomonas aeruginosa PA01
cgucgagcguuucgcggaaggcg

SEQ ID NO: 1428152 - RNA, 12 nt, Pseudomonas aeruginosa PA01
cgucgccagccc

SEQ ID NO: 1428153 - RNA, 13 nt, Pseudomonas aeruginosa PA01
cgucgccagcccg

SEQ ID NO: 1428154 - RNA, 14 nt, Pseudomonas aeruginosa PA01
cgucgccgacugcg

SEQ ID NO: 1428155 - RNA, 14 nt, Pseudomonas aeruginosa PA01
cgucgccaggccgu

SEQ ID NO: 1428156 - RNA, 21 nt, Pseudomonas aeruginosa PA01
cgucgccgccgaggcgcgcca

SEQ ID NO: 1428157 - RNA, 13 nt, Pseudomonas aeruginosa PA01
cgucgccgcccgg

SEQ ID NO: 1428158 - RNA, 17 nt, Pseudomonas aeruginosa PA01
cgucgccgcccggcagc

SEQ ID NO: 1428159 - RNA, 18 nt, Pseudomonas aeruginosa PA01
cgucgccgcccggcagcg

SEQ ID NO: 1428160 - RNA, 20 nt, Pseudomonas aeruginosa PA01
cgucgcgauagacgccggcg

SEQ ID NO: 1428161 - RNA, 21 nt, Pseudomonas aeruginosa PA01
cgucgcgauagacgccggcga

SEQ ID NO: 1428162 - RNA, 15 nt, Pseudomonas aeruginosa PA01
cgucgcgcguccagc

SEQ ID NO: 1428163 - RNA, 21 nt, Pseudomonas aeruginosa PA01
cgucgcgcgugccccguggcg

SEQ ID NO: 1428164 - RNA, 18 nt, Pseudomonas aeruginosa PA01
cgucgccugccaggcggg

SEQ ID NO: 1428165 - RNA, 22 nt, Pseudomonas aeruginosa PA01
cgucgcggaucaacgggcccug

SEQ ID NO: 1428166 - RNA, 21 nt, Pseudomonas aeruginosa PA01
cgucgcggagaauccgcucgg

SEQ ID NO: 1428167 - RNA, 17 nt, Pseudomonas aeruginosa PA01
cgucgcgcuugagcagg

SEQ ID NO: 1428168 - RNA, 21 nt, Pseudomonas aeruginosa PA01
cgucgccguggaugucgagga

SEQ ID NO: 1428169 - RNA, 23 nt, Pseudomonas aeruginosa PA01
cgucgccguggaugucgaggaac

SEQ ID NO: 1428170 - RNA, 23 nt, Pseudomonas aeruginosa PA01
cgucgcgaaccacauccuugccg

SEQ ID NO: 1428171 - RNA, 16 nt, Pseudomonas aeruginosa PA01
cgucgccuucgcugag

SEQ ID NO: 1428172 - RNA, 21 nt, Pseudomonas aeruginosa PA01
cgucgccuucgcugagaccga

SEQ ID NO: 1428173 - RNA, 17 nt, Pseudomonas aeruginosa PA01
cgucgccuucggagaac

SEQ ID NO: 1428174 - RNA, 17 nt, Pseudomonas aeruginosa PA01
cgucgaccucgauggcg

SEQ ID NO: 1428175 - RNA, 18 nt, Pseudomonas aeruginosa PA01
cgucgaccucgauggcga

SEQ ID NO: 1428176 - RNA, 19 nt, Pseudomonas aeruginosa PA01
cgucgaccucgauggcgau

SEQ ID NO: 1428177 - RNA, 23 nt, Pseudomonas aeruginosa PA01
cgucgaccugcggguuggucggc

SEQ ID NO: 1428178 - RNA, 16 nt, Pseudomonas aeruginosa PA01
cgucgagcgcagcgac

SEQ ID NO: 1428179 - RNA, 16 nt, Pseudomonas aeruginosa PA01
cgucgagcgggcgguc

SEQ ID NO: 1428180 - RNA, 15 nt, Pseudomonas aeruginosa PA01
cgucgaagcgcagca

SEQ ID NO: 1428181 - RNA, 18 nt, Pseudomonas aeruginosa PA01
cgucgaagcgcagcaggu

SEQ ID NO: 1428182 - RNA, 23 nt, Pseudomonas aeruginosa PA01
cgucgaagcgcaguacccggccg

SEQ ID NO: 1428183 - RNA, 15 nt, Pseudomonas aeruginosa PA01
cgucgaagcucggcg

SEQ ID NO: 1428184 - RNA, 16 nt, Pseudomonas aeruginosa PA01
cgucgaagcucggcgc

SEQ ID NO: 1428185 - RNA, 18 nt, Pseudomonas aeruginosa PA01
cgucgaaggccucgucgc

SEQ ID NO: 1428186 - RNA, 19 nt, Pseudomonas aeruginosa PA01
cgucgaaggccucgucgcc

SEQ ID NO: 1428187 - RNA, 21 nt, Pseudomonas aeruginosa PA01
cgucgaaggccucgucgcccg

SEQ ID NO: 1428188 - RNA, 19 nt, Pseudomonas aeruginosa PA01
cgucgaacaccggcgccgc

SEQ ID NO: 1428189 - RNA, 22 nt, Pseudomonas aeruginosa PA01
cgucgaacaccggcgccgccug

SEQ ID NO: 1428190 - RNA, 16 nt, Pseudomonas aeruginosa PA01
cgucgaaacgcuggcg

SEQ ID NO: 1428191 - RNA, 18 nt, Pseudomonas aeruginosa PA01
cgucgaaacgcuggcggc

SEQ ID NO: 1428192 - RNA, 16 nt, Pseudomonas aeruginosa PA01
cgucgaagggcacgcc

SEQ ID NO: 1428193 - RNA, 17 nt, Pseudomonas aeruginosa PA01
cgucgaagggcacgccg

SEQ ID NO: 1428194 - RNA, 13 nt, Pseudomonas aeruginosa PA01
cgucgaacagcag

SEQ ID NO: 1428195 - RNA, 21 nt, Pseudomonas aeruginosa PA01
cgucgaacagcagcucgccgc

SEQ ID NO: 1428196 - RNA, 13 nt, Pseudomonas aeruginosa PA01
cgucgaaggcggc

SEQ ID NO: 1428197 - RNA, 14 nt, Pseudomonas aeruginosa PA01
cgucgaaggcggcg

SEQ ID NO: 1428198 - RNA, 17 nt, Pseudomonas aeruginosa PA01
cgucgaaggcggcgcgg

SEQ ID NO: 1428199 - RNA, 19 nt, Pseudomonas aeruginosa PA01
cgucgaaggcggcgcggcg

SEQ ID NO: 1428200 - RNA, 22 nt, Pseudomonas aeruginosa PA01
cgucgaagucguugaagcggcc

SEQ ID NO: 1428201 - RNA, 23 nt, Pseudomonas aeruginosa PA01
cgucgaaguuggaaggaucgagc

SEQ ID NO: 1428202 - RNA, 17 nt, Pseudomonas aeruginosa PA01
cgucgaagcugucguag

SEQ ID NO: 1428203 - RNA, 18 nt, Pseudomonas aeruginosa PA01
cgucgaaugcggcgugga

SEQ ID NO: 1428204 - RNA, 17 nt, Pseudomonas aeruginosa PA01
cgucgaauuggacagca

SEQ ID NO: 1428205 - RNA, 19 nt, Pseudomonas aeruginosa PA01
cgucgaauuggacagcagg

SEQ ID NO: 1428206 - RNA, 13 nt, Pseudomonas aeruginosa PA01
cguccuucggccg

SEQ ID NO: 1428207 - RNA, 14 nt, Pseudomonas aeruginosa PA01
cguccuucggccgc

SEQ ID NO: 1428208 - RNA, 13 nt, Pseudomonas aeruginosa PA01
cguccuucggcgc

SEQ ID NO: 1428209 - RNA, 19 nt, Pseudomonas aeruginosa PA01
cguccuugguguagccgac

SEQ ID NO: 1428210 - RNA, 22 nt, Pseudomonas aeruginosa PA01
cguccuugaguagcuggcgcag

SEQ ID NO: 1428211 - RNA, 19 nt, Pseudomonas aeruginosa PA01
cguccugcccuccugcucg

SEQ ID NO: 1428212 - RNA, 22 nt, Pseudomonas aeruginosa PA01
cguccugcccuccugcucgauc

SEQ ID NO: 1428213 - RNA, 17 nt, Pseudomonas aeruginosa PA01
cguccugccggugcucg

SEQ ID NO: 1428214 - RNA, 14 nt, Pseudomonas aeruginosa PA01
cguccugccucgga

SEQ ID NO: 1428215 - RNA, 23 nt, Pseudomonas aeruginosa PA01
cguccugcggauucaucggcggc

SEQ ID NO: 1428216 - RNA, 18 nt, Pseudomonas aeruginosa PA01
cguccugcggccguucgc

SEQ ID NO: 1428217 - RNA, 16 nt, Pseudomonas aeruginosa PA01
cguccugcugcuggcc

SEQ ID NO: 1428218 - RNA, 23 nt, Pseudomonas aeruginosa PA01
cguccggcagggccucgggcggg

SEQ ID NO: 1428219 - RNA, 22 nt, Pseudomonas aeruginosa PA01
cguccggcaggucuucgagaag

SEQ ID NO: 1428220 - RNA, 14 nt, Pseudomonas aeruginosa PA01
cguccggagccggg

SEQ ID NO: 1428221 - RNA, 15 nt, Pseudomonas aeruginosa PA01
cguccggagccgggc

SEQ ID NO: 1428222 - RNA, 16 nt, Pseudomonas aeruginosa PA01
cguccggagccgggca

SEQ ID NO: 1428223 - RNA, 18 nt, Pseudomonas aeruginosa PA01
cguccggaccgggcggca

SEQ ID NO: 1428224 - RNA, 19 nt, Pseudomonas aeruginosa PA01
cguccggaccgggcggcag

SEQ ID NO: 1428225 - RNA, 18 nt, Pseudomonas aeruginosa PA01
cguccggccagccuggcc

SEQ ID NO: 1428226 - RNA, 21 nt, Pseudomonas aeruginosa PA01
cguccggcgugguggcgggga

SEQ ID NO: 1428227 - RNA, 17 nt, Pseudomonas aeruginosa PA01
cguccggagugaugccg

SEQ ID NO: 1428228 - RNA, 18 nt, Pseudomonas aeruginosa PA01
cguccggcgagcacggcg

SEQ ID NO: 1428229 - RNA, 20 nt, Pseudomonas aeruginosa PA01
cguccggccgcccgagccgc

SEQ ID NO: 1428230 - RNA, 12 nt, Pseudomonas aeruginosa PA01
cgucccuuggcg

SEQ ID NO: 1428231 - RNA, 19 nt, Pseudomonas aeruginosa PA01
cgucccuuggcgucgcggc

SEQ ID NO: 1428232 - RNA, 12 nt, Pseudomonas aeruginosa PA01
cguccgaacgcg

SEQ ID NO: 1428233 - RNA, 15 nt, Pseudomonas aeruginosa PA01
cguccgaacgcgcug

SEQ ID NO: 1428234 - RNA, 22 nt, Pseudomonas aeruginosa PA01
cguccgaacgcgcugacggcaa

SEQ ID NO: 1428235 - RNA, 16 nt, Pseudomonas aeruginosa PA01
cgucccuuccccgauc

SEQ ID NO: 1428236 - RNA, 16 nt, Pseudomonas aeruginosa PA01
cgucccguuccgcuca

SEQ ID NO: 1428237 - RNA, 22 nt, Pseudomonas aeruginosa PA01
cgucccguuccggcgcagcgga

SEQ ID NO: 1428238 - RNA, 14 nt, Pseudomonas aeruginosa PA01
cgucccucagguag

SEQ ID NO: 1428239 - RNA, 18 nt, Pseudomonas aeruginosa PA01
cguccucgaaagccgccg

SEQ ID NO: 1428240 - RNA, 14 nt, Pseudomonas aeruginosa PA01
cguccucgaugccc

SEQ ID NO: 1428241 - RNA, 21 nt, Pseudomonas aeruginosa PA01
cguccucgaugcccgccucgc

SEQ ID NO: 1428242 - RNA, 15 nt, Pseudomonas aeruginosa PA01
cguccuccaggacca

SEQ ID NO: 1428243 - RNA, 17 nt, Pseudomonas aeruginosa PA01
cguccuccaggcucagg

SEQ ID NO: 1428244 - RNA, 16 nt, Pseudomonas aeruginosa PA01
cguccgggcgguacag

SEQ ID NO: 1428245 - RNA, 15 nt, Pseudomonas aeruginosa PA01
cguccgggcacgcau

SEQ ID NO: 1428246 - RNA, 14 nt, Pseudomonas aeruginosa PA01
cguccucguggcgc

SEQ ID NO: 1428247 - RNA, 15 nt, Pseudomonas aeruginosa PA01
cguccucguggcgcg

SEQ ID NO: 1428248 - RNA, 20 nt, Pseudomonas aeruginosa PA01
cguccucggcguagccggcc

SEQ ID NO: 1428249 - RNA, 13 nt, Pseudomonas aeruginosa PA01
cguccucgcccug

SEQ ID NO: 1428250 - RNA, 16 nt, Pseudomonas aeruginosa PA01
cguccucgcccugcuu

SEQ ID NO: 1428251 - RNA, 17 nt, Pseudomonas aeruginosa PA01
cguccaucuguaccacc

SEQ ID NO: 1428252 - RNA, 15 nt, Pseudomonas aeruginosa PA01
cguccaucgccaggc

SEQ ID NO: 1428253 - RNA, 15 nt, Pseudomonas aeruginosa PA01
cguccaucgccgcgg

SEQ ID NO: 1428254 - RNA, 16 nt, Pseudomonas aeruginosa PA01
cguccaucgccgcggc

SEQ ID NO: 1428255 - RNA, 18 nt, Pseudomonas aeruginosa PA01
cguccaucgccgcggcga

SEQ ID NO: 1428256 - RNA, 13 nt, Pseudomonas aeruginosa PA01
cguccauggcggc

SEQ ID NO: 1428257 - RNA, 17 nt, Pseudomonas aeruginosa PA01
cguccauggcggcgaug

SEQ ID NO: 1428258 - RNA, 22 nt, Pseudomonas aeruginosa PA01
cgucccgcugcguagggcgagu

SEQ ID NO: 1428259 - RNA, 17 nt, Pseudomonas aeruginosa PA01
cgucauaggccuuggcg

SEQ ID NO: 1428260 - RNA, 17 nt, Pseudomonas aeruginosa PA01
cgucaguuccgcaucgg

SEQ ID NO: 1428261 - RNA, 18 nt, Pseudomonas aeruginosa PA01
cgucaucaggcucaggcc

SEQ ID NO: 1428262 - RNA, 20 nt, Pseudomonas aeruginosa PA01
cgucaggcaccucguccagc

SEQ ID NO: 1428263 - RNA, 19 nt, Pseudomonas aeruginosa PA01
cgugaggcgcgcgccgaac

SEQ ID NO: 1428264 - RNA, 20 nt, Pseudomonas aeruginosa PA01
cgugaggcgcgcgccgaacu

SEQ ID NO: 1428265 - RNA, 15 nt, Pseudomonas aeruginosa PA01
cgugagggucgcgcc

SEQ ID NO: 1428266 - RNA, 17 nt, Pseudomonas aeruginosa PA01
cgugaagccgccgccca

SEQ ID NO: 1428267 - RNA, 17 nt, Pseudomonas aeruginosa PA01
cgugaaguagccgccgg

SEQ ID NO: 1428268 - RNA, 18 nt, Pseudomonas aeruginosa PA01
cgugaagcuggagcagca

SEQ ID NO: 1428269 - RNA, 18 nt, Pseudomonas aeruginosa PA01
cgugaagccccuggcgcu

SEQ ID NO: 1428270 - RNA, 22 nt, Pseudomonas aeruginosa PA01
cgugaaaggaagaagcccgccu

SEQ ID NO: 1428271 - RNA, 14 nt, Pseudomonas aeruginosa PA01
cgugaacgcggcga

SEQ ID NO: 1428272 - RNA, 17 nt, Pseudomonas aeruginosa PA01
cgugaaaagcggcgugc

SEQ ID NO: 1428273 - RNA, 13 nt, Pseudomonas aeruginosa PA01
cgugaaacgccag

SEQ ID NO: 1428274 - RNA, 16 nt, Pseudomonas aeruginosa PA01
cgucuugucgaagccc

SEQ ID NO: 1428275 - RNA, 16 nt, Pseudomonas aeruginosa PA01
cgugcaggaucaccug

SEQ ID NO: 1428276 - RNA, 12 nt, Pseudomonas aeruginosa PA01
cgugcaggccga

SEQ ID NO: 1428277 - RNA, 13 nt, Pseudomonas aeruginosa PA01
cgugcaggccgau

SEQ ID NO: 1428278 - RNA, 13 nt, Pseudomonas aeruginosa PA01
cgugcagcggcag

SEQ ID NO: 1428279 - RNA, 15 nt, Pseudomonas aeruginosa PA01
cgugcagcggcagcg

SEQ ID NO: 1428280 - RNA, 14 nt, Pseudomonas aeruginosa PA01
cgugcagcucggca

SEQ ID NO: 1428281 - RNA, 23 nt, Pseudomonas aeruginosa PA01
cgugcagcucggcacgcagcagc

SEQ ID NO: 1428282 - RNA, 19 nt, Pseudomonas aeruginosa PA01
cgugcagcccggucacgcc

SEQ ID NO: 1428283 - RNA, 21 nt, Pseudomonas aeruginosa PA01
cgugcagcaagccgcagcgcc

SEQ ID NO: 1428284 - RNA, 16 nt, Pseudomonas aeruginosa PA01
cgugcagcagcgccuu

SEQ ID NO: 1428285 - RNA, 21 nt, Pseudomonas aeruginosa PA01
cgugcagcagcgccuucaccg

SEQ ID NO: 1428286 - RNA, 22 nt, Pseudomonas aeruginosa PA01
cgugaugcccagcggcgccagc

SEQ ID NO: 1428287 - RNA, 18 nt, Pseudomonas aeruginosa PA01
cgugaucccgcgcgggcc

SEQ ID NO: 1428288 - RNA, 23 nt, Pseudomonas aeruginosa PA01
cgugccggguauccagcacccgc

SEQ ID NO: 1428289 - RNA, 18 nt, Pseudomonas aeruginosa PA01
cgugccgggcagugcgcc

SEQ ID NO: 1428290 - RNA, 16 nt, Pseudomonas aeruginosa PA01
cgugccgggccggcca

SEQ ID NO: 1428291 - RNA, 18 nt, Pseudomonas aeruginosa PA01
cgugccgggccggccagg

SEQ ID NO: 1428292 - RNA, 15 nt, Pseudomonas aeruginosa PA01
cgugccuccagccuc

SEQ ID NO: 1428293 - RNA, 12 nt, Pseudomonas aeruginosa PA01
cgugccucggcg

SEQ ID NO: 1428294 - RNA, 14 nt, Pseudomonas aeruginosa PA01
cgugccucggcgga

SEQ ID NO: 1428295 - RNA, 24 nt, Pseudomonas aeruginosa PA01
cgugccguggaccaacagccggcg

SEQ ID NO: 1428296 - RNA, 17 nt, Pseudomonas aeruginosa PA01
cgugccguggcucggcg

SEQ ID NO: 1428297 - RNA, 15 nt, Pseudomonas aeruginosa PA01
cgugccgccaggccu

SEQ ID NO: 1428298 - RNA, 17 nt, Pseudomonas aeruginosa PA01
cgugccgccaggccuuc

SEQ ID NO: 1428299 - RNA, 23 nt, Pseudomonas aeruginosa PA01
cgugccgccaucgccucgccggc

SEQ ID NO: 1428300 - RNA, 14 nt, Pseudomonas aeruginosa PA01
cgugccgccggacc

SEQ ID NO: 1428301 - RNA, 20 nt, Pseudomonas aeruginosa PA01
cgugccgccggaccgucgcg

SEQ ID NO: 1428302 - RNA, 12 nt, Pseudomonas aeruginosa PA01
cgugccgccggg

SEQ ID NO: 1428303 - RNA, 20 nt, Pseudomonas aeruginosa PA01
cgugccgccugggcggucgg

SEQ ID NO: 1428304 - RNA, 13 nt, Pseudomonas aeruginosa PA01
cgugccgcuggcc

SEQ ID NO: 1428305 - RNA, 14 nt, Pseudomonas aeruginosa PA01
cgugccgcuggccg

SEQ ID NO: 1428306 - RNA, 17 nt, Pseudomonas aeruginosa PA01
cgugccgcuggccgacc

SEQ ID NO: 1428307 - RNA, 20 nt, Pseudomonas aeruginosa PA01
cgugccgcuggccgaccagu

SEQ ID NO: 1428308 - RNA, 23 nt, Pseudomonas aeruginosa PA01
cgugcagguagcagccguccagc

SEQ ID NO: 1428309 - RNA, 13 nt, Pseudomonas aeruginosa PA01
cgugcagguagcc

SEQ ID NO: 1428310 - RNA, 20 nt, Pseudomonas aeruginosa PA01
cgugcagguagccgcgccgg

SEQ ID NO: 1428311 - RNA, 23 nt, Pseudomonas aeruginosa PA01
cgugcaggguauuuuccagcagg

SEQ ID NO: 1428312 - RNA, 14 nt, Pseudomonas aeruginosa PA01
cgugcagggucagg

SEQ ID NO: 1428313 - RNA, 16 nt, Pseudomonas aeruginosa PA01
cgugcaggccgccgag

SEQ ID NO: 1428314 - RNA, 12 nt, Pseudomonas aeruginosa PA01
cgugcuccaccu

SEQ ID NO: 1428315 - RNA, 19 nt, Pseudomonas aeruginosa PA01
cgugcucggcgaucucgcc

SEQ ID NO: 1428316 - RNA, 19 nt, Pseudomonas aeruginosa PA01
cgugcucgaugaucgacug

SEQ ID NO: 1428317 - RNA, 14 nt, Pseudomonas aeruginosa PA01
cgugcuccgugucg

SEQ ID NO: 1428318 - RNA, 18 nt, Pseudomonas aeruginosa PA01
cgugcuccgugucggcgg

SEQ ID NO: 1428319 - RNA, 19 nt, Pseudomonas aeruginosa PA01
cgugcggggugcgcuggaa

SEQ ID NO: 1428320 - RNA, 19 nt, Pseudomonas aeruginosa PA01
cgugcgggaacgaugccgc

SEQ ID NO: 1428321 - RNA, 21 nt, Pseudomonas aeruginosa PA01
cgugcgaacacaccgaccgcg

SEQ ID NO: 1428322 - RNA, 17 nt, Pseudomonas aeruginosa PA01
cgugcgagggcggcggc

SEQ ID NO: 1428323 - RNA, 18 nt, Pseudomonas aeruginosa PA01
cgugcgagggcggcggcu

SEQ ID NO: 1428324 - RNA, 20 nt, Pseudomonas aeruginosa PA01
cgucgggcaguacucaugac

SEQ ID NO: 1428325 - RNA, 15 nt, Pseudomonas aeruginosa PA01
cgucgggcauggcga

SEQ ID NO: 1428326 - RNA, 16 nt, Pseudomonas aeruginosa PA01
cgucgggcauggcgau

SEQ ID NO: 1428327 - RNA, 19 nt, Pseudomonas aeruginosa PA01
cgucgggacgcaugcgcgg

SEQ ID NO: 1428328 - RNA, 23 nt, Pseudomonas aeruginosa PA01
cgucgggcagaguggcgcggcug

SEQ ID NO: 1428329 - RNA, 24 nt, Pseudomonas aeruginosa PA01
cgucgggcagaguggcgcggcuga

SEQ ID NO: 1428330 - RNA, 21 nt, Pseudomonas aeruginosa PA01
cgucggucauguccggggcga

SEQ ID NO: 1428331 - RNA, 13 nt, Pseudomonas aeruginosa PA01
cgucggucggcgu

SEQ ID NO: 1428332 - RNA, 14 nt, Pseudomonas aeruginosa PA01
cgucggucggcguc

SEQ ID NO: 1428333 - RNA, 16 nt, Pseudomonas aeruginosa PA01
cgucggucaggacagc

SEQ ID NO: 1428334 - RNA, 20 nt, Pseudomonas aeruginosa PA01
cgucgggcgaaacggcaggc

SEQ ID NO: 1428335 - RNA, 21 nt, Pseudomonas aeruginosa PA01
cgucgggcgaaacggcaggcc

SEQ ID NO: 1428336 - RNA, 23 nt, Pseudomonas aeruginosa PA01
cgucgggcgaaacggcaggccag

SEQ ID NO: 1428337 - RNA, 17 nt, Pseudomonas aeruginosa PA01
cgucgguucagcgcgga

SEQ ID NO: 1428338 - RNA, 22 nt, Pseudomonas aeruginosa PA01
cgucgguucagcgcggagcguc

SEQ ID NO: 1428339 - RNA, 13 nt, Pseudomonas aeruginosa PA01
cgucggugccgcc

SEQ ID NO: 1428340 - RNA, 18 nt, Pseudomonas aeruginosa PA01
cgucggcgcuuugcugca

SEQ ID NO: 1428341 - RNA, 22 nt, Pseudomonas aeruginosa PA01
cgucgggaaaggccgccacggc

SEQ ID NO: 1428342 - RNA, 20 nt, Pseudomonas aeruginosa PA01
cgucggcggggcgcaccgcc

SEQ ID NO: 1428343 - RNA, 14 nt, Pseudomonas aeruginosa PA01
cgucggcgggguga

SEQ ID NO: 1428344 - RNA, 20 nt, Pseudomonas aeruginosa PA01
cgucggcggucagcuugccc

SEQ ID NO: 1428345 - RNA, 16 nt, Pseudomonas aeruginosa PA01
cgucggcgcggccggc

SEQ ID NO: 1428346 - RNA, 15 nt, Pseudomonas aeruginosa PA01
cgucggcgcgggcgc

SEQ ID NO: 1428347 - RNA, 18 nt, Pseudomonas aeruginosa PA01
cgucggcgcgggcgccga

SEQ ID NO: 1428348 - RNA, 21 nt, Pseudomonas aeruginosa PA01
cgucggcgcgggcgccgaugc

SEQ ID NO: 1428349 - RNA, 13 nt, Pseudomonas aeruginosa PA01
cgucggcgcgcau

SEQ ID NO: 1428350 - RNA, 13 nt, Pseudomonas aeruginosa PA01
cgucggcgaucgc

SEQ ID NO: 1428351 - RNA, 16 nt, Pseudomonas aeruginosa PA01
cgucggcgaucgccag

SEQ ID NO: 1428352 - RNA, 14 nt, Pseudomonas aeruginosa PA01
cgucggcgaucacg

SEQ ID NO: 1428353 - RNA, 14 nt, Pseudomonas aeruginosa PA01
cgucggcgaccuug

SEQ ID NO: 1428354 - RNA, 16 nt, Pseudomonas aeruginosa PA01
cgucggcgaacgaggc

SEQ ID NO: 1428355 - RNA, 19 nt, Pseudomonas aeruginosa PA01
cgucggccugcuugcagga

SEQ ID NO: 1428356 - RNA, 17 nt, Pseudomonas aeruginosa PA01
cgucggccuggcgcagc

SEQ ID NO: 1428357 - RNA, 20 nt, Pseudomonas aeruginosa PA01
cgucggccuggcgcagcggc

SEQ ID NO: 1428358 - RNA, 21 nt, Pseudomonas aeruginosa PA01
cgucggccuggcgcagcggca

SEQ ID NO: 1428359 - RNA, 12 nt, Pseudomonas aeruginosa PA01
cgucggccuuga

SEQ ID NO: 1428360 - RNA, 13 nt, Pseudomonas aeruginosa PA01
cgucuccgccgcu

SEQ ID NO: 1428361 - RNA, 17 nt, Pseudomonas aeruginosa PA01
cgucuccgccgcuaucg

SEQ ID NO: 1428362 - RNA, 22 nt, Pseudomonas aeruginosa PA01
cgucugaacgaagaagccggcc

SEQ ID NO: 1428363 - RNA, 13 nt, Pseudomonas aeruginosa PA01
cgucugccgcucg

SEQ ID NO: 1428364 - RNA, 14 nt, Pseudomonas aeruginosa PA01
cgucugccgcucgu

SEQ ID NO: 1428365 - RNA, 18 nt, Pseudomonas aeruginosa PA01
cgucugccgcucguuggc

SEQ ID NO: 1428366 - RNA, 16 nt, Pseudomonas aeruginosa PA01
cgucuugcaggcucac

SEQ ID NO: 1428367 - RNA, 16 nt, Pseudomonas aeruginosa PA01
cgucugggacggcagc

SEQ ID NO: 1428368 - RNA, 17 nt, Pseudomonas aeruginosa PA01
cgucuucgauggcggcc

SEQ ID NO: 1428369 - RNA, 20 nt, Pseudomonas aeruginosa PA01
cgucuucgauggcggccgcc

SEQ ID NO: 1428370 - RNA, 13 nt, Pseudomonas aeruginosa PA01
cgucuucgccgau

SEQ ID NO: 1428371 - RNA, 16 nt, Pseudomonas aeruginosa PA01
cgucuucggcggcgcc

SEQ ID NO: 1428372 - RNA, 18 nt, Pseudomonas aeruginosa PA01
cgucuggcgcauccgccc

SEQ ID NO: 1428373 - RNA, 17 nt, Pseudomonas aeruginosa PA01
cgucuggcgccuggccu

SEQ ID NO: 1428374 - RNA, 19 nt, Pseudomonas aeruginosa PA01
cgucuggcgccuggccugg

SEQ ID NO: 1428375 - RNA, 17 nt, Pseudomonas aeruginosa PA01
cgucuggggugaggccg

SEQ ID NO: 1428376 - RNA, 20 nt, Pseudomonas aeruginosa PA01
cgucuggggugaggccgagc

SEQ ID NO: 1428377 - RNA, 19 nt, Pseudomonas aeruginosa PA01
cgucugggugaccagcagg

SEQ ID NO: 1428378 - RNA, 13 nt, Pseudomonas aeruginosa PA01
cgucguucagccc

SEQ ID NO: 1428379 - RNA, 22 nt, Pseudomonas aeruginosa PA01
cgucguucagcccacccccggc

SEQ ID NO: 1428380 - RNA, 14 nt, Pseudomonas aeruginosa PA01
cgucguucagcggc

SEQ ID NO: 1428381 - RNA, 17 nt, Pseudomonas aeruginosa PA01
cgucuccagcucggcga

SEQ ID NO: 1428382 - RNA, 16 nt, Pseudomonas aeruginosa PA01
cgucuccaggcgcgcc

SEQ ID NO: 1428383 - RNA, 22 nt, Pseudomonas aeruginosa PA01
cgucuccaugcgggagagcgcc

SEQ ID NO: 1428384 - RNA, 17 nt, Pseudomonas aeruginosa PA01
cgucucagaccuuccug

SEQ ID NO: 1428385 - RNA, 20 nt, Pseudomonas aeruginosa PA01
cgucucagaccuuccugacg

SEQ ID NO: 1428386 - RNA, 22 nt, Pseudomonas aeruginosa PA01
cgucucagcgguagaacaggcg

SEQ ID NO: 1428387 - RNA, 21 nt, Pseudomonas aeruginosa PA01
cgucucauggaacagcagcca

SEQ ID NO: 1428388 - RNA, 14 nt, Pseudomonas aeruginosa PA01
cgucguccugcgcg

SEQ ID NO: 1428389 - RNA, 15 nt, Pseudomonas aeruginosa PA01
cgucguccugcgcgg

SEQ ID NO: 1428390 - RNA, 16 nt, Pseudomonas aeruginosa PA01
cgucguccugcgcggc

SEQ ID NO: 1428391 - RNA, 20 nt, Pseudomonas aeruginosa PA01
cgucguccugcgcggcgacg

SEQ ID NO: 1428392 - RNA, 21 nt, Pseudomonas aeruginosa PA01
cgucguccugcgcggcgacga

SEQ ID NO: 1428393 - RNA, 15 nt, Pseudomonas aeruginosa PA01
cgucguccggcgcca

SEQ ID NO: 1428394 - RNA, 22 nt, Pseudomonas aeruginosa PA01
cgucguccggguucaugucggu

SEQ ID NO: 1428395 - RNA, 21 nt, Pseudomonas aeruginosa PA01
cgucguccucgaaagccgccg

SEQ ID NO: 1428396 - RNA, 19 nt, Pseudomonas aeruginosa PA01
cgucgugguccuugaacgg

SEQ ID NO: 1428397 - RNA, 23 nt, Pseudomonas aeruginosa PA01
cgucguccaccgaguggcgcagc

SEQ ID NO: 1428398 - RNA, 14 nt, Pseudomonas aeruginosa PA01
cgucguccagcgcc

SEQ ID NO: 1428399 - RNA, 15 nt, Pseudomonas aeruginosa PA01
cgucguccagcgccg

SEQ ID NO: 1428400 - RNA, 13 nt, Pseudomonas aeruginosa PA01
cgucguccagcgg

SEQ ID NO: 1428401 - RNA, 16 nt, Pseudomonas aeruginosa PA01
cgucguccagcggcuc

SEQ ID NO: 1428402 - RNA, 16 nt, Pseudomonas aeruginosa PA01
cgucguccagcgggcc

SEQ ID NO: 1428403 - RNA, 23 nt, Pseudomonas aeruginosa PA01
cgucguccagcgggcccauggcg

SEQ ID NO: 1428404 - RNA, 19 nt, Pseudomonas aeruginosa PA01
cgucguccaucgccgcggc

SEQ ID NO: 1428405 - RNA, 17 nt, Pseudomonas aeruginosa PA01
cgucguccgaggcggau

SEQ ID NO: 1428406 - RNA, 13 nt, Pseudomonas aeruginosa PA01
cguuucagcgcca

SEQ ID NO: 1428407 - RNA, 15 nt, Pseudomonas aeruginosa PA01
cguuucagcgccagc

SEQ ID NO: 1428408 - RNA, 20 nt, Pseudomonas aeruginosa PA01
cguuucagaacgucggcggg

SEQ ID NO: 1428409 - RNA, 13 nt, Pseudomonas aeruginosa PA01
cguuguggcaggc

SEQ ID NO: 1428410 - RNA, 20 nt, Pseudomonas aeruginosa PA01
cguuguuggucaggcugcgc

SEQ ID NO: 1428411 - RNA, 21 nt, Pseudomonas aeruginosa PA01
cguuguuggucaggcugcgca

SEQ ID NO: 1428412 - RNA, 16 nt, Pseudomonas aeruginosa PA01
cguuguugccgcgcac

SEQ ID NO: 1428413 - RNA, 21 nt, Pseudomonas aeruginosa PA01
cguuguugccgcgcaccaccg

SEQ ID NO: 1428414 - RNA, 14 nt, Pseudomonas aeruginosa PA01
cguuguucagcagg

SEQ ID NO: 1428415 - RNA, 19 nt, Pseudomonas aeruginosa PA01
cguugugcagguacggcgc

SEQ ID NO: 1428416 - RNA, 21 nt, Pseudomonas aeruginosa PA01
cguugucggccagcagcaugg

SEQ ID NO: 1428417 - RNA, 15 nt, Pseudomonas aeruginosa PA01
cguuguccucggcgg

SEQ ID NO: 1428418 - RNA, 17 nt, Pseudomonas aeruginosa PA01
cguuguccucggcggcu

SEQ ID NO: 1428419 - RNA, 23 nt, Pseudomonas aeruginosa PA01
cguuguccaggcuguggcgcggc

SEQ ID NO: 1428420 - RNA, 16 nt, Pseudomonas aeruginosa PA01
cguugucccugucccg

SEQ ID NO: 1428421 - RNA, 21 nt, Pseudomonas aeruginosa PA01
cguugucccugucccgccgcg

SEQ ID NO: 1428422 - RNA, 23 nt, Pseudomonas aeruginosa PA01
cguugucccugucccgccgcgcc

SEQ ID NO: 1428423 - RNA, 15 nt, Pseudomonas aeruginosa PA01
cguuggcgugcucgc

SEQ ID NO: 1428424 - RNA, 19 nt, Pseudomonas aeruginosa PA01
cguuggcgugcucgcgcau

SEQ ID NO: 1428425 - RNA, 17 nt, Pseudomonas aeruginosa PA01
cguuggcuccgggccga

SEQ ID NO: 1428426 - RNA, 21 nt, Pseudomonas aeruginosa PA01
cguuggcgaacuucaggccgg

SEQ ID NO: 1428427 - RNA, 21 nt, Pseudomonas aeruginosa PA01
cguuggcgaaguucccgccgc

SEQ ID NO: 1428428 - RNA, 22 nt, Pseudomonas aeruginosa PA01
cguuggcgaaguucccgccgcu

SEQ ID NO: 1428429 - RNA, 19 nt, Pseudomonas aeruginosa PA01
cguuggcgcgggcgaaggc

SEQ ID NO: 1428430 - RNA, 13 nt, Pseudomonas aeruginosa PA01
cguuggcggccag

SEQ ID NO: 1428431 - RNA, 16 nt, Pseudomonas aeruginosa PA01
cguuggcggugccgca

SEQ ID NO: 1428432 - RNA, 17 nt, Pseudomonas aeruginosa PA01
cguuggcggugccgcag

SEQ ID NO: 1428433 - RNA, 18 nt, Pseudomonas aeruginosa PA01
cguugggccucgcugcgc

SEQ ID NO: 1428434 - RNA, 19 nt, Pseudomonas aeruginosa PA01
cguugggccucgcugcgca

SEQ ID NO: 1428435 - RNA, 18 nt, Pseudomonas aeruginosa PA01
cguuggucaacggcgauu

SEQ ID NO: 1428436 - RNA, 17 nt, Pseudomonas aeruginosa PA01
cguuguaguucggcaug

SEQ ID NO: 1428437 - RNA, 18 nt, Pseudomonas aeruginosa PA01
cguuguagaucggcagca

SEQ ID NO: 1428438 - RNA, 15 nt, Pseudomonas aeruginosa PA01
cguuguacuggccga

SEQ ID NO: 1428439 - RNA, 16 nt, Pseudomonas aeruginosa PA01
cguuguagaacacggc

SEQ ID NO: 1428440 - RNA, 19 nt, Pseudomonas aeruginosa PA01
cguuguagcguucggcgac

SEQ ID NO: 1428441 - RNA, 17 nt, Pseudomonas aeruginosa PA01
cuaaacaagccaccuuc

SEQ ID NO: 1428442 - RNA, 16 nt, Pseudomonas aeruginosa PA01
cguuugccgucggcgc

SEQ ID NO: 1428443 - RNA, 17 nt, Pseudomonas aeruginosa PA01
cguuugccgucggcgcg

SEQ ID NO: 1428444 - RNA, 21 nt, Pseudomonas aeruginosa PA01
cguuucugcggaucgaucagc

SEQ ID NO: 1428445 - RNA, 18 nt, Pseudomonas aeruginosa PA01
cguuucuuuuugccgguc

SEQ ID NO: 1428446 - RNA, 21 nt, Pseudomonas aeruginosa PA01
cguuuccgcuguccgccgccg

SEQ ID NO: 1428447 - RNA, 17 nt, Pseudomonas aeruginosa PA01
cguuucgaagccgccgc

SEQ ID NO: 1428448 - RNA, 19 nt, Pseudomonas aeruginosa PA01
cguuucgccgccggccagc

SEQ ID NO: 1428449 - RNA, 18 nt, Pseudomonas aeruginosa PA01
cguuucauucgucgcugc

SEQ ID NO: 1428450 - RNA, 19 nt, Pseudomonas aeruginosa PA01
cguuucggcgagauugcgc

SEQ ID NO: 1428451 - RNA, 13 nt, Pseudomonas aeruginosa PA01
cguuuucaggcga

SEQ ID NO: 1428452 - RNA, 22 nt, Pseudomonas aeruginosa PA01
cguuuucaggcgacgccgcgcu

SEQ ID NO: 1428453 - RNA, 12 nt, Pseudomonas aeruginosa PA01
cguuuugccgcu

SEQ ID NO: 1428454 - RNA, 14 nt, Pseudomonas aeruginosa PA01
cguuccgacccggc

SEQ ID NO: 1428455 - RNA, 16 nt, Pseudomonas aeruginosa PA01
cguuccgacccggccg

SEQ ID NO: 1428456 - RNA, 21 nt, Pseudomonas aeruginosa PA01
cguuccgcucaccaggcccgc

SEQ ID NO: 1428457 - RNA, 15 nt, Pseudomonas aeruginosa PA01
cguuccuccucgccg

SEQ ID NO: 1428458 - RNA, 16 nt, Pseudomonas aeruginosa PA01
cguuccuccucgccgc

SEQ ID NO: 1428459 - RNA, 18 nt, Pseudomonas aeruginosa PA01
cguuccuccucgccgccg

SEQ ID NO: 1428460 - RNA, 16 nt, Pseudomonas aeruginosa PA01
cguuccggcucagccg

SEQ ID NO: 1428461 - RNA, 18 nt, Pseudomonas aeruginosa PA01
cguuccggcucagccgcu

SEQ ID NO: 1428462 - RNA, 20 nt, Pseudomonas aeruginosa PA01
cguuccggcucagccgcugg

SEQ ID NO: 1428463 - RNA, 20 nt, Pseudomonas aeruginosa PA01
cguuccgggcagcggcgcaa

SEQ ID NO: 1428464 - RNA, 13 nt, Pseudomonas aeruginosa PA01
cguuccuggaagc

SEQ ID NO: 1428465 - RNA, 14 nt, Pseudomonas aeruginosa PA01
cguuccggcgcagc

SEQ ID NO: 1428466 - RNA, 17 nt, Pseudomonas aeruginosa PA01
cguucgucgccgacugc

SEQ ID NO: 1428467 - RNA, 23 nt, Pseudomonas aeruginosa PA01
cguucggucaggcugaucggcgc

SEQ ID NO: 1428468 - RNA, 21 nt, Pseudomonas aeruginosa PA01
cguucgacgaagggcucagcc

SEQ ID NO: 1428469 - RNA, 21 nt, Pseudomonas aeruginosa PA01
cguucggggcccuccaggcga

SEQ ID NO: 1428470 - RNA, 21 nt, Pseudomonas aeruginosa PA01
cguuccuugcgcggcaggccg

SEQ ID NO: 1428471 - RNA, 20 nt, Pseudomonas aeruginosa PA01
cgugcuugcagucgcggaag

SEQ ID NO: 1428472 - RNA, 19 nt, Pseudomonas aeruginosa PA01
cgugcuuggcgaggcgcgc

SEQ ID NO: 1428473 - RNA, 18 nt, Pseudomonas aeruginosa PA01
cgugcuuggugucggccg

SEQ ID NO: 1428474 - RNA, 20 nt, Pseudomonas aeruginosa PA01
cguucccccuuuuucggcgc

SEQ ID NO: 1428475 - RNA, 21 nt, Pseudomonas aeruginosa PA01
cguucccccuuuuucggcgcg

SEQ ID NO: 1428476 - RNA, 16 nt, Pseudomonas aeruginosa PA01
cguucccggccuggcg

SEQ ID NO: 1428477 - RNA, 21 nt, Pseudomonas aeruginosa PA01
cguucccggucgagguugcgc

SEQ ID NO: 1428478 - RNA, 16 nt, Pseudomonas aeruginosa PA01
cguggaacagcgcguc

SEQ ID NO: 1428479 - RNA, 16 nt, Pseudomonas aeruginosa PA01
cguggaaccgauggcc

SEQ ID NO: 1428480 - RNA, 18 nt, Pseudomonas aeruginosa PA01
cguggaaccgauggccag

SEQ ID NO: 1428481 - RNA, 23 nt, Pseudomonas aeruginosa PA01
cgugcucggggaacacgcgcugg

SEQ ID NO: 1428482 - RNA, 18 nt, Pseudomonas aeruginosa PA01
cguugaugucgaccacga

SEQ ID NO: 1428483 - RNA, 14 nt, Pseudomonas aeruginosa PA01
cguugcacagcgcc

SEQ ID NO: 1428484 - RNA, 20 nt, Pseudomonas aeruginosa PA01
cguugcacagcgcccagaca

SEQ ID NO: 1428485 - RNA, 14 nt, Pseudomonas aeruginosa PA01
cguugcacgcaggc

SEQ ID NO: 1428486 - RNA, 22 nt, Pseudomonas aeruginosa PA01
cguugcacguacuuuggucgag

SEQ ID NO: 1428487 - RNA, 22 nt, Pseudomonas aeruginosa PA01
cguugcaauugcaggcccggcc

SEQ ID NO: 1428488 - RNA, 15 nt, Pseudomonas aeruginosa PA01
cguugacgcggaugc

SEQ ID NO: 1428489 - RNA, 23 nt, Pseudomonas aeruginosa PA01
cguugaguucgaagcgccaggcg

SEQ ID NO: 1428490 - RNA, 18 nt, Pseudomonas aeruginosa PA01
cguugaucggcaacgagc

SEQ ID NO: 1428491 - RNA, 20 nt, Pseudomonas aeruginosa PA01
cguugaucggcaacgagcag

SEQ ID NO: 1428492 - RNA, 13 nt, Pseudomonas aeruginosa PA01
cguugauccgcgu

SEQ ID NO: 1428493 - RNA, 18 nt, Pseudomonas aeruginosa PA01
cguugauccgcguggcgu

SEQ ID NO: 1428494 - RNA, 17 nt, Pseudomonas aeruginosa PA01
cguugaucacgaacagc

SEQ ID NO: 1428495 - RNA, 22 nt, Pseudomonas aeruginosa PA01
cguugaucacgaacagcuugcc

SEQ ID NO: 1428496 - RNA, 19 nt, Pseudomonas aeruginosa PA01
cguugaccacgcucagccg

SEQ ID NO: 1428497 - RNA, 23 nt, Pseudomonas aeruginosa PA01
cguugaccacgcucagccguggc

SEQ ID NO: 1428498 - RNA, 16 nt, Pseudomonas aeruginosa PA01
cguugacgaucgcccc

SEQ ID NO: 1428499 - RNA, 18 nt, Pseudomonas aeruginosa PA01
cguugacgaucugcgagc

SEQ ID NO: 1428500 - RNA, 16 nt, Pseudomonas aeruginosa PA01
cguugaccugcgaggc

SEQ ID NO: 1428501 - RNA, 13 nt, Pseudomonas aeruginosa PA01
cguugaccagcgc

SEQ ID NO: 1428502 - RNA, 23 nt, Pseudomonas aeruginosa PA01
cguugaccagcgcgucgaccacc

SEQ ID NO: 1428503 - RNA, 23 nt, Pseudomonas aeruginosa PA01
cguugaccgugaugcccagcggc

SEQ ID NO: 1428504 - RNA, 16 nt, Pseudomonas aeruginosa PA01
cguucucggccaggua

SEQ ID NO: 1428505 - RNA, 17 nt, Pseudomonas aeruginosa PA01
cguucucggugaccacc

SEQ ID NO: 1428506 - RNA, 18 nt, Pseudomonas aeruginosa PA01
cguucucgaucaucgcca

SEQ ID NO: 1428507 - RNA, 21 nt, Pseudomonas aeruginosa PA01
cguucgugcauuuccuggacg

SEQ ID NO: 1428508 - RNA, 19 nt, Pseudomonas aeruginosa PA01
cguucucgaagagcuggcg

SEQ ID NO: 1428509 - RNA, 22 nt, Pseudomonas aeruginosa PA01
cguucucgaagagcuggcggcc

SEQ ID NO: 1428510 - RNA, 19 nt, Pseudomonas aeruginosa PA01
cguucuccaggucgaacag

SEQ ID NO: 1428511 - RNA, 13 nt, Pseudomonas aeruginosa PA01
cguugcaggccca

SEQ ID NO: 1428512 - RNA, 14 nt, Pseudomonas aeruginosa PA01
cguugcaggcccag

SEQ ID NO: 1428513 - RNA, 13 nt, Pseudomonas aeruginosa PA01
cguugcagcgccu

SEQ ID NO: 1428514 - RNA, 14 nt, Pseudomonas aeruginosa PA01
cguugcagcgucug

SEQ ID NO: 1428515 - RNA, 20 nt, Pseudomonas aeruginosa PA01
cguugcauguccucggcgcc

SEQ ID NO: 1428516 - RNA, 15 nt, Pseudomonas aeruginosa PA01
cguugcaguccaggc

SEQ ID NO: 1428517 - RNA, 18 nt, Pseudomonas aeruginosa PA01
cguugcaguccaggccgu

SEQ ID NO: 1428518 - RNA, 13 nt, Pseudomonas aeruginosa PA01
cguugccagccgg

SEQ ID NO: 1428519 - RNA, 16 nt, Pseudomonas aeruginosa PA01
cguugccauagccgac

SEQ ID NO: 1428520 - RNA, 18 nt, Pseudomonas aeruginosa PA01
cguugccauagccgacga

SEQ ID NO: 1428521 - RNA, 17 nt, Pseudomonas aeruginosa PA01
cguugccauccagcgcc

SEQ ID NO: 1428522 - RNA, 20 nt, Pseudomonas aeruginosa PA01
cguugccauccagcgccugg

SEQ ID NO: 1428523 - RNA, 20 nt, Pseudomonas aeruginosa PA01
cguugccgaccgagcagcgg

SEQ ID NO: 1428524 - RNA, 23 nt, Pseudomonas aeruginosa PA01
cguugcccagccccaccgccagg

SEQ ID NO: 1428525 - RNA, 16 nt, Pseudomonas aeruginosa PA01
cguugcccggcuugcc

SEQ ID NO: 1428526 - RNA, 22 nt, Pseudomonas aeruginosa PA01
cguugcccuuguacagcuucag

SEQ ID NO: 1428527 - RNA, 20 nt, Pseudomonas aeruginosa PA01
cguugccuucgccgucgagc

SEQ ID NO: 1428528 - RNA, 22 nt, Pseudomonas aeruginosa PA01
cguugcgagggcucgggcgcgg

SEQ ID NO: 1428529 - RNA, 14 nt, Pseudomonas aeruginosa PA01
cguugccgucgagc

SEQ ID NO: 1428530 - RNA, 20 nt, Pseudomonas aeruginosa PA01
cguugccggcauugcacuuc

SEQ ID NO: 1428531 - RNA, 22 nt, Pseudomonas aeruginosa PA01
cguugccggcauugcacuucca

SEQ ID NO: 1428532 - RNA, 21 nt, Pseudomonas aeruginosa PA01
cguugccgcgcgggccggcga

SEQ ID NO: 1428533 - RNA, 16 nt, Pseudomonas aeruginosa PA01
cguugcuccugcggcu

SEQ ID NO: 1428534 - RNA, 22 nt, Pseudomonas aeruginosa PA01
cguugcucgagccguuccaggc

SEQ ID NO: 1428535 - RNA, 16 nt, Pseudomonas aeruginosa PA01
cguugcucgcaccagg

SEQ ID NO: 1428536 - RNA, 18 nt, Pseudomonas aeruginosa PA01
cguugcggcccuucauca

SEQ ID NO: 1428537 - RNA, 19 nt, Pseudomonas aeruginosa PA01
cguugcggaaagcgacgcc

SEQ ID NO: 1428538 - RNA, 17 nt, Pseudomonas aeruginosa PA01
cguugcgcuaucggccc

SEQ ID NO: 1428539 - RNA, 13 nt, Pseudomonas aeruginosa PA01
cguugcgcggcag

SEQ ID NO: 1428540 - RNA, 16 nt, Pseudomonas aeruginosa PA01
cguugcgcggcaggug

SEQ ID NO: 1428541 - RNA, 14 nt, Pseudomonas aeruginosa PA01
cguugcgcagcacc

SEQ ID NO: 1428542 - RNA, 12 nt, Pseudomonas aeruginosa PA01
cguugcgcaggc

SEQ ID NO: 1428543 - RNA, 18 nt, Pseudomonas aeruginosa PA01
cguugcgcaggggcgcgg

SEQ ID NO: 1428544 - RNA, 20 nt, Pseudomonas aeruginosa PA01
cguugcgcauuugcacgucg

SEQ ID NO: 1428545 - RNA, 14 nt, Pseudomonas aeruginosa PA01
cguugcgccagacc

SEQ ID NO: 1428546 - RNA, 13 nt, Pseudomonas aeruginosa PA01
cguugcgccccgg

SEQ ID NO: 1428547 - RNA, 20 nt, Pseudomonas aeruginosa PA01
cguugcgccggcccagcagg

SEQ ID NO: 1428548 - RNA, 16 nt, Pseudomonas aeruginosa PA01
cguugcgccucgccgc

SEQ ID NO: 1428549 - RNA, 14 nt, Pseudomonas aeruginosa PA01
cguugcgccgcagc

SEQ ID NO: 1428550 - RNA, 18 nt, Pseudomonas aeruginosa PA01
cguugcgcgcauagcagg

SEQ ID NO: 1428551 - RNA, 20 nt, Pseudomonas aeruginosa PA01
cguugcgcgcauagcaggcc

SEQ ID NO: 1428552 - RNA, 14 nt, Pseudomonas aeruginosa PA01
cguugcgcgccagc

SEQ ID NO: 1428553 - RNA, 15 nt, Pseudomonas aeruginosa PA01
cguugcgcgccagcg

SEQ ID NO: 1428554 - RNA, 19 nt, Pseudomonas aeruginosa PA01
cguugcgcgccagcgccac

SEQ ID NO: 1428555 - RNA, 20 nt, Pseudomonas aeruginosa PA01
cguuggccaggcgcgacagc

SEQ ID NO: 1428556 - RNA, 23 nt, Pseudomonas aeruginosa PA01
cguuggccgaggaggccagcagc

SEQ ID NO: 1428557 - RNA, 19 nt, Pseudomonas aeruginosa PA01
cguuggccggcugcuccgg

SEQ ID NO: 1428558 - RNA, 23 nt, Pseudomonas aeruginosa PA01
cguuggccgggguauccgggcac

SEQ ID NO: 1428559 - RNA, 14 nt, Pseudomonas aeruginosa PA01
cguuggccagcagg

SEQ ID NO: 1428560 - RNA, 18 nt, Pseudomonas aeruginosa PA01
cguuggccagcaggcgcc

SEQ ID NO: 1428561 - RNA, 22 nt, Pseudomonas aeruginosa PA01
cguuggccagcaggcgccgcgc

SEQ ID NO: 1428562 - RNA, 14 nt, Pseudomonas aeruginosa PA01
cguuggccagcgcc

SEQ ID NO: 1428563 - RNA, 15 nt, Pseudomonas aeruginosa PA01
cguuggccagcgcca

SEQ ID NO: 1428564 - RNA, 16 nt, Pseudomonas aeruginosa PA01
cguuggccagcgccac

SEQ ID NO: 1428565 - RNA, 20 nt, Pseudomonas aeruginosa PA01
cguugcugugcugcaccagc

SEQ ID NO: 1428566 - RNA, 17 nt, Pseudomonas aeruginosa PA01
cguuggaucaccggggu

SEQ ID NO: 1428567 - RNA, 12 nt, Pseudomonas aeruginosa PA01
cuaacgccgagg

SEQ ID NO: 1428568 - RNA, 15 nt, Pseudomonas aeruginosa PA01
cuaaccggcguccgg

SEQ ID NO: 1428569 - RNA, 16 nt, Pseudomonas aeruginosa PA01
cuaaccggcguccggg

SEQ ID NO: 1428570 - RNA, 22 nt, Pseudomonas aeruginosa PA01
cuaccagguucugccagagcgc

SEQ ID NO: 1428571 - RNA, 23 nt, Pseudomonas aeruginosa PA01
cuaccaggcgguuggcccgcgcc

SEQ ID NO: 1428572 - RNA, 18 nt, Pseudomonas aeruginosa PA01
cuaccagcgcuucggcgg

SEQ ID NO: 1428573 - RNA, 18 nt, Pseudomonas aeruginosa PA01
cuaccaggaagcucggca

SEQ ID NO: 1428574 - RNA, 13 nt, Pseudomonas aeruginosa PA01
cuaccccacgcga

SEQ ID NO: 1428575 - RNA, 18 nt, Pseudomonas aeruginosa PA01
cuaccccaggggucggca

SEQ ID NO: 1428576 - RNA, 21 nt, Pseudomonas aeruginosa PA01
cuaccccaggggucggcaucg

SEQ ID NO: 1428577 - RNA, 23 nt, Pseudomonas aeruginosa PA01
cuaccggggcgcgggcgaagcgc

SEQ ID NO: 1428578 - RNA, 19 nt, Pseudomonas aeruginosa PA01
cuacccgacaggcagcgcc

SEQ ID NO: 1428579 - RNA, 20 nt, Pseudomonas aeruginosa PA01
cuacccgacaggcagcgccg

SEQ ID NO: 1428580 - RNA, 23 nt, Pseudomonas aeruginosa PA01
cuacccgagcaacugcucgggcg

SEQ ID NO: 1428581 - RNA, 22 nt, Pseudomonas aeruginosa PA01
cuacaaugauggcccuucgccc

SEQ ID NO: 1428582 - RNA, 17 nt, Pseudomonas aeruginosa PA01
cuaucgccgccgcagcc

SEQ ID NO: 1428583 - RNA, 19 nt, Pseudomonas aeruginosa PA01
cuaucgccgccgcagccgu

SEQ ID NO: 1428584 - RNA, 21 nt, Pseudomonas aeruginosa PA01
cuaucgaucacugccuggcag

SEQ ID NO: 1428585 - RNA, 14 nt, Pseudomonas aeruginosa PA01
cuaugggcaccgcg

SEQ ID NO: 1428586 - RNA, 16 nt, Pseudomonas aeruginosa PA01
cuaucgcuggcgcagc

SEQ ID NO: 1428587 - RNA, 16 nt, Pseudomonas aeruginosa PA01
cuaucgcuuucagcaa

SEQ ID NO: 1428588 - RNA, 21 nt, Pseudomonas aeruginosa PA01
cuaucgggcagggcagccgcc

SEQ ID NO: 1428589 - RNA, 22 nt, Pseudomonas aeruginosa PA01
cuaucgggcagggcagccgccg

SEQ ID NO: 1428590 - RNA, 16 nt, Pseudomonas aeruginosa PA01
cuaucgggccgaucga

SEQ ID NO: 1428591 - RNA, 13 nt, Pseudomonas aeruginosa PA01
cuagggucggcgu

SEQ ID NO: 1428592 - RNA, 21 nt, Pseudomonas aeruginosa PA01
cuagggcgcccucgccaauca

SEQ ID NO: 1428593 - RNA, 22 nt, Pseudomonas aeruginosa PA01
cuaggccaugaucuggcugucg

SEQ ID NO: 1428594 - RNA, 19 nt, Pseudomonas aeruginosa PA01
cuaggcuggaagccgcgcu

SEQ ID NO: 1428595 - RNA, 22 nt, Pseudomonas aeruginosa PA01
cuaggcuggaagccgcgcucgc

SEQ ID NO: 1428596 - RNA, 15 nt, Pseudomonas aeruginosa PA01
cuacgcucgccgacg

SEQ ID NO: 1428597 - RNA, 21 nt, Pseudomonas aeruginosa PA01
cuacgcucggggugcgcggcg

SEQ ID NO: 1428598 - RNA, 16 nt, Pseudomonas aeruginosa PA01
cuacgcaacccgcccg

SEQ ID NO: 1428599 - RNA, 19 nt, Pseudomonas aeruginosa PA01
cuaccugcgugcgccguag

SEQ ID NO: 1428600 - RNA, 12 nt, Pseudomonas aeruginosa PA01
cuaccuggcgcu

SEQ ID NO: 1428601 - RNA, 22 nt, Pseudomonas aeruginosa PA01
cuaccuggggauggccggcgcg

SEQ ID NO: 1428602 - RNA, 15 nt, Pseudomonas aeruginosa PA01
cuaccugucccggac

SEQ ID NO: 1428603 - RNA, 13 nt, Pseudomonas aeruginosa PA01
cuaccuucgauca

SEQ ID NO: 1428604 - RNA, 23 nt, Pseudomonas aeruginosa PA01
cuacgaaggcgugccgcuggccg

SEQ ID NO: 1428605 - RNA, 23 nt, Pseudomonas aeruginosa PA01
cuauucugauugcguaacguuac

SEQ ID NO: 1428606 - RNA, 18 nt, Pseudomonas aeruginosa PA01
cuauuccuugcgccaugc

SEQ ID NO: 1428607 - RNA, 13 nt, Pseudomonas aeruginosa PA01
cucacccugcugg

SEQ ID NO: 1428608 - RNA, 17 nt, Pseudomonas aeruginosa PA01
cucacccugcugggcgg

SEQ ID NO: 1428609 - RNA, 18 nt, Pseudomonas aeruginosa PA01
cucacccugcugggcggg

SEQ ID NO: 1428610 - RNA, 17 nt, Pseudomonas aeruginosa PA01
cucacccugucccauca

SEQ ID NO: 1428611 - RNA, 16 nt, Pseudomonas aeruginosa PA01
cucaccgcauagucgc

SEQ ID NO: 1428612 - RNA, 13 nt, Pseudomonas aeruginosa PA01
cucaccgcccugc

SEQ ID NO: 1428613 - RNA, 20 nt, Pseudomonas aeruginosa PA01
cucaggcagcgaucgccgcc

SEQ ID NO: 1428614 - RNA, 15 nt, Pseudomonas aeruginosa PA01
cucaggccuggcgca

SEQ ID NO: 1428615 - RNA, 16 nt, Pseudomonas aeruginosa PA01
cucaggccuuggcuuc

SEQ ID NO: 1428616 - RNA, 20 nt, Pseudomonas aeruginosa PA01
cucaggccuuggcuucgaag

SEQ ID NO: 1428617 - RNA, 15 nt, Pseudomonas aeruginosa PA01
cucaguucggccagc

SEQ ID NO: 1428618 - RNA, 19 nt, Pseudomonas aeruginosa PA01
cucaguucggccagcggca

SEQ ID NO: 1428619 - RNA, 19 nt, Pseudomonas aeruginosa PA01
cucaguugcugaucaggcc

SEQ ID NO: 1428620 - RNA, 20 nt, Pseudomonas aeruginosa PA01
cucaguugcugaucaggccg

SEQ ID NO: 1428621 - RNA, 23 nt, Pseudomonas aeruginosa PA01
cucaguugcugaucaggccgagg

SEQ ID NO: 1428622 - RNA, 22 nt, Pseudomonas aeruginosa PA01
cucaggcgcagcguccugcccu

SEQ ID NO: 1428623 - RNA, 13 nt, Pseudomonas aeruginosa PA01
cucaggcgccgcu

SEQ ID NO: 1428624 - RNA, 14 nt, Pseudomonas aeruginosa PA01
cucaggcgccgcug

SEQ ID NO: 1428625 - RNA, 21 nt, Pseudomonas aeruginosa PA01
cucaggcgccgcugucuaucu

SEQ ID NO: 1428626 - RNA, 19 nt, Pseudomonas aeruginosa PA01
cucaggaccuuccgccagc

SEQ ID NO: 1428627 - RNA, 21 nt, Pseudomonas aeruginosa PA01
cucaggaccuuccgccagcag

SEQ ID NO: 1428628 - RNA, 18 nt, Pseudomonas aeruginosa PA01
cucaggacguccuggccg

SEQ ID NO: 1428629 - RNA, 19 nt, Pseudomonas aeruginosa PA01
cucaggacguccuggccga

SEQ ID NO: 1428630 - RNA, 19 nt, Pseudomonas aeruginosa PA01
cucaggagcgccgcgcagc

SEQ ID NO: 1428631 - RNA, 13 nt, Pseudomonas aeruginosa PA01
cucaggccgccgc

SEQ ID NO: 1428632 - RNA, 14 nt, Pseudomonas aeruginosa PA01
cucaggccgccgcg

SEQ ID NO: 1428633 - RNA, 12 nt, Pseudomonas aeruginosa PA01
cucagccgcgcc

SEQ ID NO: 1428634 - RNA, 15 nt, Pseudomonas aeruginosa PA01
cucagcccucggccc

SEQ ID NO: 1428635 - RNA, 15 nt, Pseudomonas aeruginosa PA01
cucagccgaccaccu

SEQ ID NO: 1428636 - RNA, 19 nt, Pseudomonas aeruginosa PA01
cucagccgaggucgccgcc

SEQ ID NO: 1428637 - RNA, 14 nt, Pseudomonas aeruginosa PA01
cucagccagcggcg

SEQ ID NO: 1428638 - RNA, 18 nt, Pseudomonas aeruginosa PA01
cucagccccgaucgccuc

SEQ ID NO: 1428639 - RNA, 14 nt, Pseudomonas aeruginosa PA01
cucagcagcgccgc

SEQ ID NO: 1428640 - RNA, 18 nt, Pseudomonas aeruginosa PA01
cucagaacagcggcagcu

SEQ ID NO: 1428641 - RNA, 15 nt, Pseudomonas aeruginosa PA01
cucacgcaccucguc

SEQ ID NO: 1428642 - RNA, 19 nt, Pseudomonas aeruginosa PA01
cucacgcaccucgucgagc

SEQ ID NO: 1428643 - RNA, 16 nt, Pseudomonas aeruginosa PA01
cuccaccgcgcuccgc

SEQ ID NO: 1428644 - RNA, 17 nt, Pseudomonas aeruginosa PA01
cuccacccguucgccgg

SEQ ID NO: 1428645 - RNA, 14 nt, Pseudomonas aeruginosa PA01
cuccacccaggcgc

SEQ ID NO: 1428646 - RNA, 16 nt, Pseudomonas aeruginosa PA01
cuccaccgauggcgcg

SEQ ID NO: 1428647 - RNA, 20 nt, Pseudomonas aeruginosa PA01
cuccacgaggaugucggcga

SEQ ID NO: 1428648 - RNA, 23 nt, Pseudomonas aeruginosa PA01
cuccaccggaucgcccuggcgcc

SEQ ID NO: 1428649 - RNA, 14 nt, Pseudomonas aeruginosa PA01
cuccaccgcuccgg

SEQ ID NO: 1428650 - RNA, 23 nt, Pseudomonas aeruginosa PA01
cuccaccgcuccggcgccgaggu

SEQ ID NO: 1428651 - RNA, 19 nt, Pseudomonas aeruginosa PA01
cuccaccucgacccuggcg

SEQ ID NO: 1428652 - RNA, 18 nt, Pseudomonas aeruginosa PA01
cuccaccagcgccggcgg

SEQ ID NO: 1428653 - RNA, 21 nt, Pseudomonas aeruginosa PA01
cuccaccagcgccggcggcgc

SEQ ID NO: 1428654 - RNA, 18 nt, Pseudomonas aeruginosa PA01
cuccacacccggucgcgc

SEQ ID NO: 1428655 - RNA, 18 nt, Pseudomonas aeruginosa PA01
cuccacccccaucgcccg

SEQ ID NO: 1428656 - RNA, 18 nt, Pseudomonas aeruginosa PA01
cuccacccccgcaaccgc

SEQ ID NO: 1428657 - RNA, 22 nt, Pseudomonas aeruginosa PA01
cuccacccccgcaaccgcugcc

SEQ ID NO: 1428658 - RNA, 16 nt, Pseudomonas aeruginosa PA01
cuccacccgcagccgc

SEQ ID NO: 1428659 - RNA, 14 nt, Pseudomonas aeruginosa PA01
cuccaacuggcggc

SEQ ID NO: 1428660 - RNA, 13 nt, Pseudomonas aeruginosa PA01
cuccaacagcagg

SEQ ID NO: 1428661 - RNA, 23 nt, Pseudomonas aeruginosa PA01
cucauacgaaaaaaaggcgcugc

SEQ ID NO: 1428662 - RNA, 14 nt, Pseudomonas aeruginosa PA01
cuccaucagcgccu

SEQ ID NO: 1428663 - RNA, 23 nt, Pseudomonas aeruginosa PA01
cuccccaccaacucagucgaggu

SEQ ID NO: 1428664 - RNA, 23 nt, Pseudomonas aeruginosa PA01
cucccagugcgagucggcgacga

SEQ ID NO: 1428665 - RNA, 21 nt, Pseudomonas aeruginosa PA01
cucccaggcgucgccgacuuc

SEQ ID NO: 1428666 - RNA, 16 nt, Pseudomonas aeruginosa PA01
cucccaggcuggcggc

SEQ ID NO: 1428667 - RNA, 16 nt, Pseudomonas aeruginosa PA01
cuccaguucggcgaug

SEQ ID NO: 1428668 - RNA, 19 nt, Pseudomonas aeruginosa PA01
cuccagucggggcaggcgc

SEQ ID NO: 1428669 - RNA, 15 nt, Pseudomonas aeruginosa PA01
cuccagguucggcgc

SEQ ID NO: 1428670 - RNA, 18 nt, Pseudomonas aeruginosa PA01
cuccagguucggcgccag

SEQ ID NO: 1428671 - RNA, 22 nt, Pseudomonas aeruginosa PA01
cuccagguucggcgccagcucg

SEQ ID NO: 1428672 - RNA, 23 nt, Pseudomonas aeruginosa PA01
cuccagguucggcgccagcucgg

SEQ ID NO: 1428673 - RNA, 19 nt, Pseudomonas aeruginosa PA01
cuccaucaguugcgcgcgg

SEQ ID NO: 1428674 - RNA, 21 nt, Pseudomonas aeruginosa PA01
cuccauccagucuucgccggc

SEQ ID NO: 1428675 - RNA, 15 nt, Pseudomonas aeruginosa PA01
cuccaguugcagcac

SEQ ID NO: 1428676 - RNA, 17 nt, Pseudomonas aeruginosa PA01
cuccaguugcagcaccc

SEQ ID NO: 1428677 - RNA, 21 nt, Pseudomonas aeruginosa PA01
cuccaggucgcccugcagcgc

SEQ ID NO: 1428678 - RNA, 20 nt, Pseudomonas aeruginosa PA01
cuccagauagugcggccagg

SEQ ID NO: 1428679 - RNA, 23 nt, Pseudomonas aeruginosa PA01
cuccagauagugcggccaggcgu

SEQ ID NO: 1428680 - RNA, 15 nt, Pseudomonas aeruginosa PA01
cuccagcaacgccgc

SEQ ID NO: 1428681 - RNA, 19 nt, Pseudomonas aeruginosa PA01
cuccagcaacggcaucgcu

SEQ ID NO: 1428682 - RNA, 18 nt, Pseudomonas aeruginosa PA01
cuccacugcuuggccagg

SEQ ID NO: 1428683 - RNA, 18 nt, Pseudomonas aeruginosa PA01
cuccagaaucucccgcag

SEQ ID NO: 1428684 - RNA, 19 nt, Pseudomonas aeruginosa PA01
cuccagaggaacaguucgg

SEQ ID NO: 1428685 - RNA, 20 nt, Pseudomonas aeruginosa PA01
cuccagagugcgcagcagcg

SEQ ID NO: 1428686 - RNA, 16 nt, Pseudomonas aeruginosa PA01
cuccacgucggcccgg

SEQ ID NO: 1428687 - RNA, 14 nt, Pseudomonas aeruginosa PA01
cucgcuucagcgag

SEQ ID NO: 1428688 - RNA, 20 nt, Pseudomonas aeruginosa PA01
cucgcuucagcgagcggucg

SEQ ID NO: 1428689 - RNA, 15 nt, Pseudomonas aeruginosa PA01
cucgcuccgagcagg

SEQ ID NO: 1428690 - RNA, 15 nt, Pseudomonas aeruginosa PA01
cucgcuccuccgggc

SEQ ID NO: 1428691 - RNA, 15 nt, Pseudomonas aeruginosa PA01
cucgcugucgccgag

SEQ ID NO: 1428692 - RNA, 16 nt, Pseudomonas aeruginosa PA01
cucgcugucgccgagc

SEQ ID NO: 1428693 - RNA, 16 nt, Pseudomonas aeruginosa PA01
cucgcugucgcucagc

SEQ ID NO: 1428694 - RNA, 19 nt, Pseudomonas aeruginosa PA01
cucgcugucgcucagcggg

SEQ ID NO: 1428695 - RNA, 12 nt, Pseudomonas aeruginosa PA01
cucgcuguccau

SEQ ID NO: 1428696 - RNA, 15 nt, Pseudomonas aeruginosa PA01
cucggaaucggcgau

SEQ ID NO: 1428697 - RNA, 16 nt, Pseudomonas aeruginosa PA01
cucggaaucggcgauc

SEQ ID NO: 1428698 - RNA, 14 nt, Pseudomonas aeruginosa PA01
cucggagagcagcc

SEQ ID NO: 1428699 - RNA, 22 nt, Pseudomonas aeruginosa PA01
cucggccaaugcccggaccugg

SEQ ID NO: 1428700 - RNA, 14 nt, Pseudomonas aeruginosa PA01
cucggccaccacca

SEQ ID NO: 1428701 - RNA, 20 nt, Pseudomonas aeruginosa PA01
cucgcguagcgcuucccgcg

SEQ ID NO: 1428702 - RNA, 14 nt, Pseudomonas aeruginosa PA01
cucgcguccgcagu

SEQ ID NO: 1428703 - RNA, 19 nt, Pseudomonas aeruginosa PA01
cucgcguccgcaguucgcc

SEQ ID NO: 1428704 - RNA, 14 nt, Pseudomonas aeruginosa PA01
cucgcuacggaagg

SEQ ID NO: 1428705 - RNA, 21 nt, Pseudomonas aeruginosa PA01
cucgcuacggaaggucgccgg

SEQ ID NO: 1428706 - RNA, 23 nt, Pseudomonas aeruginosa PA01
cucgcuacggaaggucgccgggc

SEQ ID NO: 1428707 - RNA, 17 nt, Pseudomonas aeruginosa PA01
cucgcguucgcggucgg

SEQ ID NO: 1428708 - RNA, 14 nt, Pseudomonas aeruginosa PA01
cucgcuccagagga

SEQ ID NO: 1428709 - RNA, 15 nt, Pseudomonas aeruginosa PA01
cucgcggaucugcuc

SEQ ID NO: 1428710 - RNA, 11 nt, Pseudomonas aeruginosa PA01
cucgcgcuucc

SEQ ID NO: 1428711 - RNA, 17 nt, Pseudomonas aeruginosa PA01
cucgcggaagucggcgg

SEQ ID NO: 1428712 - RNA, 21 nt, Pseudomonas aeruginosa PA01
cucgcggaagucggcgggucc

SEQ ID NO: 1428713 - RNA, 13 nt, Pseudomonas aeruginosa PA01
cucgcggaccucg

SEQ ID NO: 1428714 - RNA, 14 nt, Pseudomonas aeruginosa PA01
cucgcggagcugga

SEQ ID NO: 1428715 - RNA, 14 nt, Pseudomonas aeruginosa PA01
cucgcggcgcggcg

SEQ ID NO: 1428716 - RNA, 17 nt, Pseudomonas aeruginosa PA01
cucgcgguuauccgccg

SEQ ID NO: 1428717 - RNA, 18 nt, Pseudomonas aeruginosa PA01
cucgcgguuauccgccgc

SEQ ID NO: 1428718 - RNA, 19 nt, Pseudomonas aeruginosa PA01
cucgcgguuauccgccgcc

SEQ ID NO: 1428719 - RNA, 22 nt, Pseudomonas aeruginosa PA01
cucgcgguuauccgccgccggg

SEQ ID NO: 1428720 - RNA, 15 nt, Pseudomonas aeruginosa PA01
cucgcggucccggga

SEQ ID NO: 1428721 - RNA, 21 nt, Pseudomonas aeruginosa PA01
cucgauguaggccucggccug

SEQ ID NO: 1428722 - RNA, 20 nt, Pseudomonas aeruginosa PA01
cucgauggugaacgccaggc

SEQ ID NO: 1428723 - RNA, 21 nt, Pseudomonas aeruginosa PA01
cucgauggugaucacgucggc

SEQ ID NO: 1428724 - RNA, 22 nt, Pseudomonas aeruginosa PA01
cucgauggugaucacgucggcg

SEQ ID NO: 1428725 - RNA, 23 nt, Pseudomonas aeruginosa PA01
cucgauggugaucacgucggcgu

SEQ ID NO: 1428726 - RNA, 19 nt, Pseudomonas aeruginosa PA01
cucgccgggaaucgccagc

SEQ ID NO: 1428727 - RNA, 22 nt, Pseudomonas aeruginosa PA01
cucgccgggaaucgccagcagg

SEQ ID NO: 1428728 - RNA, 17 nt, Pseudomonas aeruginosa PA01
cucgcaaaggucggcga

SEQ ID NO: 1428729 - RNA, 20 nt, Pseudomonas aeruginosa PA01
cucgcaaaggucggcgaagg

SEQ ID NO: 1428730 - RNA, 17 nt, Pseudomonas aeruginosa PA01
cucgccgggucgccgca

SEQ ID NO: 1428731 - RNA, 19 nt, Pseudomonas aeruginosa PA01
cucgccggguuguccaggc

SEQ ID NO: 1428732 - RNA, 19 nt, Pseudomonas aeruginosa PA01
cucgccggucagguaggca

SEQ ID NO: 1428733 - RNA, 15 nt, Pseudomonas aeruginosa PA01
cucgccggucgcgcu

SEQ ID NO: 1428734 - RNA, 16 nt, Pseudomonas aeruginosa PA01
cucgccggucgcgcuc

SEQ ID NO: 1428735 - RNA, 20 nt, Pseudomonas aeruginosa PA01
cucgccggucgcgcucaggc

SEQ ID NO: 1428736 - RNA, 20 nt, Pseudomonas aeruginosa PA01
cucgccguacagcaggcagg

SEQ ID NO: 1428737 - RNA, 22 nt, Pseudomonas aeruginosa PA01
cucgccguacagcaggcaggca

SEQ ID NO: 1428738 - RNA, 19 nt, Pseudomonas aeruginosa PA01
cucgccgucaucgagcagu

SEQ ID NO: 1428739 - RNA, 17 nt, Pseudomonas aeruginosa PA01
cucgccguccgcgaugc

SEQ ID NO: 1428740 - RNA, 23 nt, Pseudomonas aeruginosa PA01
cucgccggugcggguaucgaucu

SEQ ID NO: 1428741 - RNA, 14 nt, Pseudomonas aeruginosa PA01
cucgccgucggcgg

SEQ ID NO: 1428742 - RNA, 17 nt, Pseudomonas aeruginosa PA01
cucgccgucggcgguca

SEQ ID NO: 1428743 - RNA, 17 nt, Pseudomonas aeruginosa PA01
cucgccgucgucgggau

SEQ ID NO: 1428744 - RNA, 14 nt, Pseudomonas aeruginosa PA01
cucgcgcguggccg

SEQ ID NO: 1428745 - RNA, 20 nt, Pseudomonas aeruginosa PA01
cucgcgccagagaucgccca

SEQ ID NO: 1428746 - RNA, 20 nt, Pseudomonas aeruginosa PA01
cucgcgcugcccggcgcgac

SEQ ID NO: 1428747 - RNA, 13 nt, Pseudomonas aeruginosa PA01
cucgcgcggcacc

SEQ ID NO: 1428748 - RNA, 14 nt, Pseudomonas aeruginosa PA01
cucgcgcggggcgc

SEQ ID NO: 1428749 - RNA, 17 nt, Pseudomonas aeruginosa PA01
cucgcgcaccgcggcga

SEQ ID NO: 1428750 - RNA, 19 nt, Pseudomonas aeruginosa PA01
cucgcgccgcgccagcagg

SEQ ID NO: 1428751 - RNA, 20 nt, Pseudomonas aeruginosa PA01
cucgcgccgcgccagcaggc

SEQ ID NO: 1428752 - RNA, 14 nt, Pseudomonas aeruginosa PA01
cucgcgccggcgcg

SEQ ID NO: 1428753 - RNA, 13 nt, Pseudomonas aeruginosa PA01
cucgcgcagcagg

SEQ ID NO: 1428754 - RNA, 14 nt, Pseudomonas aeruginosa PA01
cucgcgcagccagg

SEQ ID NO: 1428755 - RNA, 18 nt, Pseudomonas aeruginosa PA01
cucgcgcagggucgaggc

SEQ ID NO: 1428756 - RNA, 22 nt, Pseudomonas aeruginosa PA01
cucggcggcaggcugcgccgcu

SEQ ID NO: 1428757 - RNA, 19 nt, Pseudomonas aeruginosa PA01
cucggcggccauugccgcg

SEQ ID NO: 1428758 - RNA, 14 nt, Pseudomonas aeruginosa PA01
cucggcggcggccu

SEQ ID NO: 1428759 - RNA, 22 nt, Pseudomonas aeruginosa PA01
cucggcggcgcgaaccagcagc

SEQ ID NO: 1428760 - RNA, 16 nt, Pseudomonas aeruginosa PA01
cucggcggcgagcggg

SEQ ID NO: 1428761 - RNA, 20 nt, Pseudomonas aeruginosa PA01
cucggcggucaggccaagcu

SEQ ID NO: 1428762 - RNA, 17 nt, Pseudomonas aeruginosa PA01
cucggcggugaccggau

SEQ ID NO: 1428763 - RNA, 18 nt, Pseudomonas aeruginosa PA01
cucggcggcggucgcgau

SEQ ID NO: 1428764 - RNA, 16 nt, Pseudomonas aeruginosa PA01
cucggcgggacggcgc

SEQ ID NO: 1428765 - RNA, 22 nt, Pseudomonas aeruginosa PA01
cucggcgggagagggcggcgac

SEQ ID NO: 1428766 - RNA, 16 nt, Pseudomonas aeruginosa PA01
cucggcggcgcgcagc

SEQ ID NO: 1428767 - RNA, 17 nt, Pseudomonas aeruginosa PA01
cucggcgggcugccgcg

SEQ ID NO: 1428768 - RNA, 14 nt, Pseudomonas aeruginosa PA01
cucggcggggcgca

SEQ ID NO: 1428769 - RNA, 20 nt, Pseudomonas aeruginosa PA01
cucggcggggcgcagcagga

SEQ ID NO: 1428770 - RNA, 20 nt, Pseudomonas aeruginosa PA01
cucggcuaaccgccuucgcg

SEQ ID NO: 1428771 - RNA, 14 nt, Pseudomonas aeruginosa PA01
cucggcuacgaacc

SEQ ID NO: 1428772 - RNA, 20 nt, Pseudomonas aeruginosa PA01
cucggcguucaccgcgcaaa

SEQ ID NO: 1428773 - RNA, 17 nt, Pseudomonas aeruginosa PA01
cucggcgugccgggccg

SEQ ID NO: 1428774 - RNA, 19 nt, Pseudomonas aeruginosa PA01
cucggcgugccgggccggc

SEQ ID NO: 1428775 - RNA, 17 nt, Pseudomonas aeruginosa PA01
cucggcgucgucgaucg

SEQ ID NO: 1428776 - RNA, 18 nt, Pseudomonas aeruginosa PA01
cucggcguagugcuggua

SEQ ID NO: 1428777 - RNA, 19 nt, Pseudomonas aeruginosa PA01
cucggcguagccggccagg

SEQ ID NO: 1428778 - RNA, 20 nt, Pseudomonas aeruginosa PA01
cucggcguagccggcgaucc

SEQ ID NO: 1428779 - RNA, 18 nt, Pseudomonas aeruginosa PA01
cucggcgguggggaagcg

SEQ ID NO: 1428780 - RNA, 22 nt, Pseudomonas aeruginosa PA01
cucggcguccuugggaucgucg

SEQ ID NO: 1428781 - RNA, 17 nt, Pseudomonas aeruginosa PA01
cucggcgucgcgcaggc

SEQ ID NO: 1428782 - RNA, 16 nt, Pseudomonas aeruginosa PA01
cucggcgucggcaugg

SEQ ID NO: 1428783 - RNA, 17 nt, Pseudomonas aeruginosa PA01
cucgggcaccagcacgg

SEQ ID NO: 1428784 - RNA, 17 nt, Pseudomonas aeruginosa PA01
cucgggaugcaguucgu

SEQ ID NO: 1428785 - RNA, 14 nt, Pseudomonas aeruginosa PA01
cucggcuccagcca

SEQ ID NO: 1428786 - RNA, 20 nt, Pseudomonas aeruginosa PA01
cucggcuccaggaccggcag

SEQ ID NO: 1428787 - RNA, 21 nt, Pseudomonas aeruginosa PA01
cucggcuccaggaccggcagg

SEQ ID NO: 1428788 - RNA, 14 nt, Pseudomonas aeruginosa PA01
cucggcugccgcca

SEQ ID NO: 1428789 - RNA, 16 nt, Pseudomonas aeruginosa PA01
cucggcugcuugccgg

SEQ ID NO: 1428790 - RNA, 19 nt, Pseudomonas aeruginosa PA01
cucggcgaguucgcgcagg

SEQ ID NO: 1428791 - RNA, 22 nt, Pseudomonas aeruginosa PA01
cucggcgaucacccggcgaagc

SEQ ID NO: 1428792 - RNA, 18 nt, Pseudomonas aeruginosa PA01
cucggcgagccgccgggc

SEQ ID NO: 1428793 - RNA, 13 nt, Pseudomonas aeruginosa PA01
cucggcgacuucg

SEQ ID NO: 1428794 - RNA, 15 nt, Pseudomonas aeruginosa PA01
cucggcgaccuugcg

SEQ ID NO: 1428795 - RNA, 14 nt, Pseudomonas aeruginosa PA01
cucggcgaccaccc

SEQ ID NO: 1428796 - RNA, 15 nt, Pseudomonas aeruginosa PA01
cucggcgaccacccg

SEQ ID NO: 1428797 - RNA, 17 nt, Pseudomonas aeruginosa PA01
cucggcgaccacccggc

SEQ ID NO: 1428798 - RNA, 19 nt, Pseudomonas aeruginosa PA01
cucggcgaacuccgccagc

SEQ ID NO: 1428799 - RNA, 20 nt, Pseudomonas aeruginosa PA01
cucggcgaacgacagcacca

SEQ ID NO: 1428800 - RNA, 14 nt, Pseudomonas aeruginosa PA01
cucggccagcucgc

SEQ ID NO: 1428801 - RNA, 17 nt, Pseudomonas aeruginosa PA01
cucggccagcucgccga

SEQ ID NO: 1428802 - RNA, 14 nt, Pseudomonas aeruginosa PA01
cucggccagcgccg

SEQ ID NO: 1428803 - RNA, 13 nt, Pseudomonas aeruginosa PA01
cucggccagcguc

SEQ ID NO: 1428804 - RNA, 22 nt, Pseudomonas aeruginosa PA01
cucggccagccagggcagcagg

SEQ ID NO: 1428805 - RNA, 19 nt, Pseudomonas aeruginosa PA01
cucggccagcaaugcccgc

SEQ ID NO: 1428806 - RNA, 13 nt, Pseudomonas aeruginosa PA01
cucggccagcgcc

SEQ ID NO: 1428807 - RNA, 18 nt, Pseudomonas aeruginosa PA01
cucggccagcgccacggc

SEQ ID NO: 1428808 - RNA, 13 nt, Pseudomonas aeruginosa PA01
cucggcgcuggcc

SEQ ID NO: 1428809 - RNA, 20 nt, Pseudomonas aeruginosa PA01
cucggcggacagcccgcgcu

SEQ ID NO: 1428810 - RNA, 20 nt, Pseudomonas aeruginosa PA01
cucggcgcgcgcccccuggc

SEQ ID NO: 1428811 - RNA, 22 nt, Pseudomonas aeruginosa PA01
cucggcgcgcgcccccuggccg

SEQ ID NO: 1428812 - RNA, 23 nt, Pseudomonas aeruginosa PA01
cucggcgcgcgcccccuggccgu

SEQ ID NO: 1428813 - RNA, 19 nt, Pseudomonas aeruginosa PA01
cucggcgcgauccuccgcc

SEQ ID NO: 1428814 - RNA, 17 nt, Pseudomonas aeruginosa PA01
cucggcgccgucgauca

SEQ ID NO: 1428815 - RNA, 23 nt, Pseudomonas aeruginosa PA01
cucggcgccgucgaucagguagg

SEQ ID NO: 1428816 - RNA, 15 nt, Pseudomonas aeruginosa PA01
cucggcgauggcgcg

SEQ ID NO: 1428817 - RNA, 21 nt, Pseudomonas aeruginosa PA01
cucggcgauggcgcgcgggcc

SEQ ID NO: 1428818 - RNA, 23 nt, Pseudomonas aeruginosa PA01
cucggcgauggcgcgcgggccuu

SEQ ID NO: 1428819 - RNA, 20 nt, Pseudomonas aeruginosa PA01
cucggcgauggcguagaggc

SEQ ID NO: 1428820 - RNA, 18 nt, Pseudomonas aeruginosa PA01
cucggcgauccgcgcuuc

SEQ ID NO: 1428821 - RNA, 17 nt, Pseudomonas aeruginosa PA01
cucggcgaugccgccgg

SEQ ID NO: 1428822 - RNA, 19 nt, Pseudomonas aeruginosa PA01
cucggcgaugccgccgggc

SEQ ID NO: 1428823 - RNA, 23 nt, Pseudomonas aeruginosa PA01
cucggcgaugccggagagcagca

SEQ ID NO: 1428824 - RNA, 19 nt, Pseudomonas aeruginosa PA01
cucggcgccgaucuccgcu

SEQ ID NO: 1428825 - RNA, 14 nt, Pseudomonas aeruginosa PA01
cucggcgccgagca

SEQ ID NO: 1428826 - RNA, 15 nt, Pseudomonas aeruginosa PA01
cucggcgcaggcaug

SEQ ID NO: 1428827 - RNA, 13 nt, Pseudomonas aeruginosa PA01
cucggcgcccgcc

SEQ ID NO: 1428828 - RNA, 15 nt, Pseudomonas aeruginosa PA01
cucggcgcccgccug

SEQ ID NO: 1428829 - RNA, 14 nt, Pseudomonas aeruginosa PA01
cucggcgcccuggc

SEQ ID NO: 1428830 - RNA, 20 nt, Pseudomonas aeruginosa PA01
cucgaugaaaccggccucga

SEQ ID NO: 1428831 - RNA, 22 nt, Pseudomonas aeruginosa PA01
cucgaugaaaccggccucgaca

SEQ ID NO: 1428832 - RNA, 21 nt, Pseudomonas aeruginosa PA01
cucgaugaaugcgcaggucgc

SEQ ID NO: 1428833 - RNA, 19 nt, Pseudomonas aeruginosa PA01
cucgaugaccuugccgcga

SEQ ID NO: 1428834 - RNA, 17 nt, Pseudomonas aeruginosa PA01
cucgaugaucgccgggu

SEQ ID NO: 1428835 - RNA, 17 nt, Pseudomonas aeruginosa PA01
cucgaugcccgccagca

SEQ ID NO: 1428836 - RNA, 19 nt, Pseudomonas aeruginosa PA01
cucgaugcccgccagcagg

SEQ ID NO: 1428837 - RNA, 20 nt, Pseudomonas aeruginosa PA01
cucgaugcccgccagcaggc

SEQ ID NO: 1428838 - RNA, 21 nt, Pseudomonas aeruginosa PA01
cucgaugcccgccagcaggcg

SEQ ID NO: 1428839 - RNA, 22 nt, Pseudomonas aeruginosa PA01
cucgaugcccgccagcaggcgc

SEQ ID NO: 1428840 - RNA, 15 nt, Pseudomonas aeruginosa PA01
cucgaugcccgccuc

SEQ ID NO: 1428841 - RNA, 18 nt, Pseudomonas aeruginosa PA01
cucgaugcccgccucgcg

SEQ ID NO: 1428842 - RNA, 20 nt, Pseudomonas aeruginosa PA01
cucgaugcccgccucgcgca

SEQ ID NO: 1428843 - RNA, 15 nt, Pseudomonas aeruginosa PA01
cucgauggcggcggc

SEQ ID NO: 1428844 - RNA, 16 nt, Pseudomonas aeruginosa PA01
cucgauggcggcggcg

SEQ ID NO: 1428845 - RNA, 12 nt, Pseudomonas aeruginosa PA01
cucgauggcgau

SEQ ID NO: 1428846 - RNA, 12 nt, Pseudomonas aeruginosa PA01
cucgauggcgaa

SEQ ID NO: 1428847 - RNA, 15 nt, Pseudomonas aeruginosa PA01
cucgauggcgaagcg

SEQ ID NO: 1428848 - RNA, 19 nt, Pseudomonas aeruginosa PA01
cucgauggcgaagcgcuug

SEQ ID NO: 1428849 - RNA, 20 nt, Pseudomonas aeruginosa PA01
cucgauggcagccuuggcca

SEQ ID NO: 1428850 - RNA, 14 nt, Pseudomonas aeruginosa PA01
cucgaucagcccgc

SEQ ID NO: 1428851 - RNA, 15 nt, Pseudomonas aeruginosa PA01
cucgaucagccggcg

SEQ ID NO: 1428852 - RNA, 13 nt, Pseudomonas aeruginosa PA01
cucgaucacccgc

SEQ ID NO: 1428853 - RNA, 23 nt, Pseudomonas aeruginosa PA01
cucgaucacccgcgaggccggcc

SEQ ID NO: 1428854 - RNA, 14 nt, Pseudomonas aeruginosa PA01
cucgaucaucgcca

SEQ ID NO: 1428855 - RNA, 19 nt, Pseudomonas aeruginosa PA01
cucgaucaucgccagcggc

SEQ ID NO: 1428856 - RNA, 14 nt, Pseudomonas aeruginosa PA01
cucgauccagccgg

SEQ ID NO: 1428857 - RNA, 16 nt, Pseudomonas aeruginosa PA01
cucgauccagccggca

SEQ ID NO: 1428858 - RNA, 15 nt, Pseudomonas aeruginosa PA01
cucgaucagcgccgg

SEQ ID NO: 1428859 - RNA, 17 nt, Pseudomonas aeruginosa PA01
cucgaucagcgccgggu

SEQ ID NO: 1428860 - RNA, 18 nt, Pseudomonas aeruginosa PA01
cucgaucagcgccgggug

SEQ ID NO: 1428861 - RNA, 13 nt, Pseudomonas aeruginosa PA01
cucgaucagcgcg

SEQ ID NO: 1428862 - RNA, 16 nt, Pseudomonas aeruginosa PA01
cucgaucagcgcggcc

SEQ ID NO: 1428863 - RNA, 14 nt, Pseudomonas aeruginosa PA01
cucgaucagcgccg

SEQ ID NO: 1428864 - RNA, 23 nt, Pseudomonas aeruginosa PA01
cucgaucggcagggcgccgacca

SEQ ID NO: 1428865 - RNA, 16 nt, Pseudomonas aeruginosa PA01
cucgaucggcccgggc

SEQ ID NO: 1428866 - RNA, 13 nt, Pseudomonas aeruginosa PA01
cucgaucgccucg

SEQ ID NO: 1428867 - RNA, 17 nt, Pseudomonas aeruginosa PA01
cucgaucaggcugugca

SEQ ID NO: 1428868 - RNA, 12 nt, Pseudomonas aeruginosa PA01
cucgaucaggua

SEQ ID NO: 1428869 - RNA, 21 nt, Pseudomonas aeruginosa PA01
cucgaucagugcaucggccgc

SEQ ID NO: 1428870 - RNA, 14 nt, Pseudomonas aeruginosa PA01
cucgaucccggcgc

SEQ ID NO: 1428871 - RNA, 15 nt, Pseudomonas aeruginosa PA01
cucgaucccggcgcg

SEQ ID NO: 1428872 - RNA, 15 nt, Pseudomonas aeruginosa PA01
cucgauccgcugggc

SEQ ID NO: 1428873 - RNA, 15 nt, Pseudomonas aeruginosa PA01
cucgaccagcgccgc

SEQ ID NO: 1428874 - RNA, 21 nt, Pseudomonas aeruginosa PA01
cucgaccagcgccgcggcgac

SEQ ID NO: 1428875 - RNA, 19 nt, Pseudomonas aeruginosa PA01
cucgaccagaucggcaugg

SEQ ID NO: 1428876 - RNA, 22 nt, Pseudomonas aeruginosa PA01
cucgaccagaucggcauggccg

SEQ ID NO: 1428877 - RNA, 16 nt, Pseudomonas aeruginosa PA01
cucgaccccggaaagg

SEQ ID NO: 1428878 - RNA, 15 nt, Pseudomonas aeruginosa PA01
cucgaccaucggcgg

SEQ ID NO: 1428879 - RNA, 20 nt, Pseudomonas aeruginosa PA01
cucgaccaucggcggcggcc

SEQ ID NO: 1428880 - RNA, 18 nt, Pseudomonas aeruginosa PA01
cucgaccgccugcucgcg

SEQ ID NO: 1428881 - RNA, 22 nt, Pseudomonas aeruginosa PA01
cucgaccgccugcucgcggcug

SEQ ID NO: 1428882 - RNA, 14 nt, Pseudomonas aeruginosa PA01
cucgaccgcgccgg

SEQ ID NO: 1428883 - RNA, 13 nt, Pseudomonas aeruginosa PA01
cucgacccuggcg

SEQ ID NO: 1428884 - RNA, 19 nt, Pseudomonas aeruginosa PA01
cucgacccuggcgccgacc

SEQ ID NO: 1428885 - RNA, 14 nt, Pseudomonas aeruginosa PA01
cucgacccgcucga

SEQ ID NO: 1428886 - RNA, 14 nt, Pseudomonas aeruginosa PA01
cucgaguucgcgcg

SEQ ID NO: 1428887 - RNA, 23 nt, Pseudomonas aeruginosa PA01
cucgaguucgcgcgggucgucga

SEQ ID NO: 1428888 - RNA, 19 nt, Pseudomonas aeruginosa PA01
cucgaggucggccuggcug

SEQ ID NO: 1428889 - RNA, 16 nt, Pseudomonas aeruginosa PA01
cucgagcaucuccggc

SEQ ID NO: 1428890 - RNA, 12 nt, Pseudomonas aeruginosa PA01
cucgaggggcga

SEQ ID NO: 1428891 - RNA, 20 nt, Pseudomonas aeruginosa PA01
cucgagggugucguagaggc

SEQ ID NO: 1428892 - RNA, 13 nt, Pseudomonas aeruginosa PA01
cucgacuuccgcc

SEQ ID NO: 1428893 - RNA, 15 nt, Pseudomonas aeruginosa PA01
cucgacagcgucgua

SEQ ID NO: 1428894 - RNA, 16 nt, Pseudomonas aeruginosa PA01
cucgaccaccucggcg

SEQ ID NO: 1428895 - RNA, 13 nt, Pseudomonas aeruginosa PA01
cuccuggcggcgu

SEQ ID NO: 1428896 - RNA, 13 nt, Pseudomonas aeruginosa PA01
cucgaaggucagc

SEQ ID NO: 1428897 - RNA, 14 nt, Pseudomonas aeruginosa PA01
cuccugcucgaucc

SEQ ID NO: 1428898 - RNA, 16 nt, Pseudomonas aeruginosa PA01
cuccuggaggacgcgg

SEQ ID NO: 1428899 - RNA, 23 nt, Pseudomonas aeruginosa PA01
cuccuggagguagcugcgccgcc

SEQ ID NO: 1428900 - RNA, 18 nt, Pseudomonas aeruginosa PA01
cuccuggaugcuccgcgc

SEQ ID NO: 1428901 - RNA, 18 nt, Pseudomonas aeruginosa PA01
cuccuggaaagaccggcg

SEQ ID NO: 1428902 - RNA, 20 nt, Pseudomonas aeruginosa PA01
cuccuggaaagaccggcgcc

SEQ ID NO: 1428903 - RNA, 20 nt, Pseudomonas aeruginosa PA01
cuccugcaacgccuggugca

SEQ ID NO: 1428904 - RNA, 20 nt, Pseudomonas aeruginosa PA01
cuccucagaggcgaccagcc

SEQ ID NO: 1428905 - RNA, 14 nt, Pseudomonas aeruginosa PA01
cuccgugcuggccg

SEQ ID NO: 1428906 - RNA, 17 nt, Pseudomonas aeruginosa PA01
cuccgugucggcggcgc

SEQ ID NO: 1428907 - RNA, 19 nt, Pseudomonas aeruginosa PA01
cuccgucuguucggccagg

SEQ ID NO: 1428908 - RNA, 22 nt, Pseudomonas aeruginosa PA01
cuccgucaaugcggccugcaac

SEQ ID NO: 1428909 - RNA, 16 nt, Pseudomonas aeruginosa PA01
cuccggugucaggccg

SEQ ID NO: 1428910 - RNA, 19 nt, Pseudomonas aeruginosa PA01
cuccggugucaggccgagg

SEQ ID NO: 1428911 - RNA, 16 nt, Pseudomonas aeruginosa PA01
cuccgguucggcaagg

SEQ ID NO: 1428912 - RNA, 21 nt, Pseudomonas aeruginosa PA01
cuccgguucggcaaggcgcag

SEQ ID NO: 1428913 - RNA, 13 nt, Pseudomonas aeruginosa PA01
cuccggugccagg

SEQ ID NO: 1428914 - RNA, 13 nt, Pseudomonas aeruginosa PA01
cuccguccagugc

SEQ ID NO: 1428915 - RNA, 19 nt, Pseudomonas aeruginosa PA01
cuccgguacccguacgcug

SEQ ID NO: 1428916 - RNA, 22 nt, Pseudomonas aeruginosa PA01
cuccgguacccguacgcugcca

SEQ ID NO: 1428917 - RNA, 20 nt, Pseudomonas aeruginosa PA01
cuccgggcuggccaccagca

SEQ ID NO: 1428918 - RNA, 22 nt, Pseudomonas aeruginosa PA01
cuccggggucaguuccaggucg

SEQ ID NO: 1428919 - RNA, 13 nt, Pseudomonas aeruginosa PA01
cuccgggucgggc

SEQ ID NO: 1428920 - RNA, 19 nt, Pseudomonas aeruginosa PA01
cuccggguugaccgccaga

SEQ ID NO: 1428921 - RNA, 17 nt, Pseudomonas aeruginosa PA01
cuccggguacuggcgcu

SEQ ID NO: 1428922 - RNA, 15 nt, Pseudomonas aeruginosa PA01
cucccgcggcccaag

SEQ ID NO: 1428923 - RNA, 16 nt, Pseudomonas aeruginosa PA01
cucccgcgccagcgcc

SEQ ID NO: 1428924 - RNA, 17 nt, Pseudomonas aeruginosa PA01
cucccgcgccagcgccg

SEQ ID NO: 1428925 - RNA, 21 nt, Pseudomonas aeruginosa PA01
cucccgcgccagcgccgccag

SEQ ID NO: 1428926 - RNA, 22 nt, Pseudomonas aeruginosa PA01
cucccgcgcgcugugcacgguc

SEQ ID NO: 1428927 - RNA, 20 nt, Pseudomonas aeruginosa PA01
cucccccucuucggagcgag

SEQ ID NO: 1428928 - RNA, 15 nt, Pseudomonas aeruginosa PA01
cuccccacucggcca

SEQ ID NO: 1428929 - RNA, 15 nt, Pseudomonas aeruginosa PA01
cuccccagcaggcag

SEQ ID NO: 1428930 - RNA, 16 nt, Pseudomonas aeruginosa PA01
cuccccagcaggcagg

SEQ ID NO: 1428931 - RNA, 15 nt, Pseudomonas aeruginosa PA01
cucccccgcgccgcc

SEQ ID NO: 1428932 - RNA, 17 nt, Pseudomonas aeruginosa PA01
cucccccgcgccgccgg

SEQ ID NO: 1428933 - RNA, 18 nt, Pseudomonas aeruginosa PA01
cuccccgcucccgcggcc

SEQ ID NO: 1428934 - RNA, 12 nt, Pseudomonas aeruginosa PA01
cuccccgccgcc

SEQ ID NO: 1428935 - RNA, 14 nt, Pseudomonas aeruginosa PA01
cuccccgccgccag

SEQ ID NO: 1428936 - RNA, 18 nt, Pseudomonas aeruginosa PA01
cuccccggcccgcgccgc

SEQ ID NO: 1428937 - RNA, 23 nt, Pseudomonas aeruginosa PA01
cuccccggcccgcgccgccucga

SEQ ID NO: 1428938 - RNA, 15 nt, Pseudomonas aeruginosa PA01
cuccccucaggcgcc

SEQ ID NO: 1428939 - RNA, 17 nt, Pseudomonas aeruginosa PA01
cuccccucaggcgccgc

SEQ ID NO: 1428940 - RNA, 18 nt, Pseudomonas aeruginosa PA01
cuccccugccgaaccgcc

SEQ ID NO: 1428941 - RNA, 17 nt, Pseudomonas aeruginosa PA01
cuccccuggaaugccgg

SEQ ID NO: 1428942 - RNA, 19 nt, Pseudomonas aeruginosa PA01
cuccccuggaaugccggcc

SEQ ID NO: 1428943 - RNA, 21 nt, Pseudomonas aeruginosa PA01
cuccccuggaaugccggccgg

SEQ ID NO: 1428944 - RNA, 22 nt, Pseudomonas aeruginosa PA01
cuccccuggcccugcaucgcga

SEQ ID NO: 1428945 - RNA, 20 nt, Pseudomonas aeruginosa PA01
cuccccuguggucaggcgcc

SEQ ID NO: 1428946 - RNA, 21 nt, Pseudomonas aeruginosa PA01
cuccccuguggucaggcgcca

SEQ ID NO: 1428947 - RNA, 23 nt, Pseudomonas aeruginosa PA01
cuccccuguggucaggcgccagg

SEQ ID NO: 1428948 - RNA, 13 nt, Pseudomonas aeruginosa PA01
cucccgcgauucg

SEQ ID NO: 1428949 - RNA, 18 nt, Pseudomonas aeruginosa PA01
cucccgcgauucgccggg

SEQ ID NO: 1428950 - RNA, 19 nt, Pseudomonas aeruginosa PA01
cucccgcaggcgcuucagc

SEQ ID NO: 1428951 - RNA, 15 nt, Pseudomonas aeruginosa PA01
cucccgccccuccag

SEQ ID NO: 1428952 - RNA, 23 nt, Pseudomonas aeruginosa PA01
cucccgcagauagggcaucagcc

SEQ ID NO: 1428953 - RNA, 16 nt, Pseudomonas aeruginosa PA01
cucccgcaaccugcca

SEQ ID NO: 1428954 - RNA, 14 nt, Pseudomonas aeruginosa PA01
cugagaucagcgcc

SEQ ID NO: 1428955 - RNA, 19 nt, Pseudomonas aeruginosa PA01
cugagaccuuccugccagc

SEQ ID NO: 1428956 - RNA, 20 nt, Pseudomonas aeruginosa PA01
cugagaccuuccugccagcg

SEQ ID NO: 1428957 - RNA, 15 nt, Pseudomonas aeruginosa PA01
cugagcagcaggugg

SEQ ID NO: 1428958 - RNA, 23 nt, Pseudomonas aeruginosa PA01
cugagcaggaacucgaucagcgc

SEQ ID NO: 1428959 - RNA, 20 nt, Pseudomonas aeruginosa PA01
cugagcaggacccaucgaug

SEQ ID NO: 1428960 - RNA, 14 nt, Pseudomonas aeruginosa PA01
cugagcaggccgac

SEQ ID NO: 1428961 - RNA, 17 nt, Pseudomonas aeruginosa PA01
cugagcaggccgacggc

SEQ ID NO: 1428962 - RNA, 20 nt, Pseudomonas aeruginosa PA01
cugagcaggccgacggcgcg

SEQ ID NO: 1428963 - RNA, 19 nt, Pseudomonas aeruginosa PA01
cugagcagucgccuggccc

SEQ ID NO: 1428964 - RNA, 17 nt, Pseudomonas aeruginosa PA01
cugacgcucauaccggu

SEQ ID NO: 1428965 - RNA, 16 nt, Pseudomonas aeruginosa PA01
cugacgcgcagcgccg

SEQ ID NO: 1428966 - RNA, 19 nt, Pseudomonas aeruginosa PA01
cugacgcgcagcgccgccg

SEQ ID NO: 1428967 - RNA, 20 nt, Pseudomonas aeruginosa PA01
cugacgcgcagcgccgccgc

SEQ ID NO: 1428968 - RNA, 22 nt, Pseudomonas aeruginosa PA01
cugacgcgcagcgccgccgcgu

SEQ ID NO: 1428969 - RNA, 19 nt, Pseudomonas aeruginosa PA01
cugacguugccgcgcgggc

SEQ ID NO: 1428970 - RNA, 18 nt, Pseudomonas aeruginosa PA01
cugaagcgccgcggcccg

SEQ ID NO: 1428971 - RNA, 19 nt, Pseudomonas aeruginosa PA01
cugaagcgccgcggcccgg

SEQ ID NO: 1428972 - RNA, 21 nt, Pseudomonas aeruginosa PA01
cugaagcggccgccgaaaugc

SEQ ID NO: 1428973 - RNA, 13 nt, Pseudomonas aeruginosa PA01
cugaaggaccagc

SEQ ID NO: 1428974 - RNA, 23 nt, Pseudomonas aeruginosa PA01
cugaaggcgcggggcgaggucgg

SEQ ID NO: 1428975 - RNA, 21 nt, Pseudomonas aeruginosa PA01
cugaaggcgguguagaccacc

SEQ ID NO: 1428976 - RNA, 15 nt, Pseudomonas aeruginosa PA01
cugaaggucgccgcg

SEQ ID NO: 1428977 - RNA, 18 nt, Pseudomonas aeruginosa PA01
cugaaggugagauggucg

SEQ ID NO: 1428978 - RNA, 18 nt, Pseudomonas aeruginosa PA01
cugaccgucgggucgacc

SEQ ID NO: 1428979 - RNA, 24 nt, Pseudomonas aeruginosa PA01
cugaagcccaggcgucgcgccagc

SEQ ID NO: 1428980 - RNA, 16 nt, Pseudomonas aeruginosa PA01
cugaagauaucgccuu

SEQ ID NO: 1428981 - RNA, 15 nt, Pseudomonas aeruginosa PA01
cugaagacccggcgu

SEQ ID NO: 1428982 - RNA, 13 nt, Pseudomonas aeruginosa PA01
cugaagaucgcca

SEQ ID NO: 1428983 - RNA, 16 nt, Pseudomonas aeruginosa PA01
cugaagaucgccacga

SEQ ID NO: 1428984 - RNA, 13 nt, Pseudomonas aeruginosa PA01
cugaacagcgcca

SEQ ID NO: 1428985 - RNA, 18 nt, Pseudomonas aeruginosa PA01
cugaacagcgccaccagc

SEQ ID NO: 1428986 - RNA, 21 nt, Pseudomonas aeruginosa PA01
cugacgcaagcgcucggccug

SEQ ID NO: 1428987 - RNA, 20 nt, Pseudomonas aeruginosa PA01
cugaccuggucguugcgcgc

SEQ ID NO: 1428988 - RNA, 24 nt, Pseudomonas aeruginosa PA01
cugacgaagugauggaagagcgcc

SEQ ID NO: 1428989 - RNA, 15 nt, Pseudomonas aeruginosa PA01
cugacgaacaucgcc

SEQ ID NO: 1428990 - RNA, 20 nt, Pseudomonas aeruginosa PA01
cugaugugccgcacggugcg

SEQ ID NO: 1428991 - RNA, 20 nt, Pseudomonas aeruginosa PA01
cugcaccgggccgaccugcc

SEQ ID NO: 1428992 - RNA, 12 nt, Pseudomonas aeruginosa PA01
cugcaccgcgcg

SEQ ID NO: 1428993 - RNA, 19 nt, Pseudomonas aeruginosa PA01
cugcacagggacgcggcgu

SEQ ID NO: 1428994 - RNA, 17 nt, Pseudomonas aeruginosa PA01
cugcacagccauagcgc

SEQ ID NO: 1428995 - RNA, 22 nt, Pseudomonas aeruginosa PA01
cugcacagccauagcgccggca

SEQ ID NO: 1428996 - RNA, 20 nt, Pseudomonas aeruginosa PA01
cugcaauuccaccggcuggc

SEQ ID NO: 1428997 - RNA, 14 nt, Pseudomonas aeruginosa PA01
cugcaauucgucgg

SEQ ID NO: 1428998 - RNA, 22 nt, Pseudomonas aeruginosa PA01
cugcaauucgucggccugcucg

SEQ ID NO: 1428999 - RNA, 19 nt, Pseudomonas aeruginosa PA01
cugcaauggggcggccggc

SEQ ID NO: 1429000 - RNA, 13 nt, Pseudomonas aeruginosa PA01
cugcaaggcggug

SEQ ID NO: 1429001 - RNA, 19 nt, Pseudomonas aeruginosa PA01
cugcaaggcggugaccagc

SEQ ID NO: 1429002 - RNA, 22 nt, Pseudomonas aeruginosa PA01
cugcaaggcggugaccagcggc

SEQ ID NO: 1429003 - RNA, 21 nt, Pseudomonas aeruginosa PA01
cugcaaggcuucggcggucag

SEQ ID NO: 1429004 - RNA, 18 nt, Pseudomonas aeruginosa PA01
cugaguuucacgucgagc

SEQ ID NO: 1429005 - RNA, 20 nt, Pseudomonas aeruginosa PA01
cugaguuugcccagcgccgc

SEQ ID NO: 1429006 - RNA, 16 nt, Pseudomonas aeruginosa PA01
cugaggaucagccagc

SEQ ID NO: 1429007 - RNA, 19 nt, Pseudomonas aeruginosa PA01
cugaggccgacgaacagcc

SEQ ID NO: 1429008 - RNA, 16 nt, Pseudomonas aeruginosa PA01
cugaggccguagccga

SEQ ID NO: 1429009 - RNA, 16 nt, Pseudomonas aeruginosa PA01
cugagggucagccgca

SEQ ID NO: 1429010 - RNA, 15 nt, Pseudomonas aeruginosa PA01
cugauaagcucggcu

SEQ ID NO: 1429011 - RNA, 15 nt, Pseudomonas aeruginosa PA01
cugaugccgcgguag

SEQ ID NO: 1429012 - RNA, 22 nt, Pseudomonas aeruginosa PA01
cugaugccguucucccgcgcgc

SEQ ID NO: 1429013 - RNA, 14 nt, Pseudomonas aeruginosa PA01
cucgggcugccgca

SEQ ID NO: 1429014 - RNA, 18 nt, Pseudomonas aeruginosa PA01
cucgggcugccgcagauc

SEQ ID NO: 1429015 - RNA, 16 nt, Pseudomonas aeruginosa PA01
cucggggaagcgcggc

SEQ ID NO: 1429016 - RNA, 20 nt, Pseudomonas aeruginosa PA01
cucggggcgccuccagcggg

SEQ ID NO: 1429017 - RNA, 20 nt, Pseudomonas aeruginosa PA01
cucggggccgaggucgacca

SEQ ID NO: 1429018 - RNA, 23 nt, Pseudomonas aeruginosa PA01
cucggggauguccgccgcccagu

SEQ ID NO: 1429019 - RNA, 19 nt, Pseudomonas aeruginosa PA01
cucgggggugcccaucagg

SEQ ID NO: 1429020 - RNA, 20 nt, Pseudomonas aeruginosa PA01
cucggggucgucgcuggcgg

SEQ ID NO: 1429021 - RNA, 13 nt, Pseudomonas aeruginosa PA01
cucgggccgcagg

SEQ ID NO: 1429022 - RNA, 23 nt, Pseudomonas aeruginosa PA01
cucgggcggaucgagcagcggcg

SEQ ID NO: 1429023 - RNA, 12 nt, Pseudomonas aeruginosa PA01
cucgggcgccgu

SEQ ID NO: 1429024 - RNA, 22 nt, Pseudomonas aeruginosa PA01
cucgggcgggaucuccgcgcca

SEQ ID NO: 1429025 - RNA, 14 nt, Pseudomonas aeruginosa PA01
cucggucagcggcg

SEQ ID NO: 1429026 - RNA, 18 nt, Pseudomonas aeruginosa PA01
cucggucagcggcgcagc

SEQ ID NO: 1429027 - RNA, 17 nt, Pseudomonas aeruginosa PA01
cucgguagggccgaggu

SEQ ID NO: 1429028 - RNA, 19 nt, Pseudomonas aeruginosa PA01
cucgguagggccgaggucg

SEQ ID NO: 1429029 - RNA, 17 nt, Pseudomonas aeruginosa PA01
cucgguauggcugcugu

SEQ ID NO: 1429030 - RNA, 23 nt, Pseudomonas aeruginosa PA01
cucgguagaccccggugugcgcu

SEQ ID NO: 1429031 - RNA, 14 nt, Pseudomonas aeruginosa PA01
cucgguagccggcc

SEQ ID NO: 1429032 - RNA, 17 nt, Pseudomonas aeruginosa PA01
cucgucggaggcgagga

SEQ ID NO: 1429033 - RNA, 20 nt, Pseudomonas aeruginosa PA01
cucgucgcuauagcggaugu

SEQ ID NO: 1429034 - RNA, 15 nt, Pseudomonas aeruginosa PA01
cucgucgccaugcgg

SEQ ID NO: 1429035 - RNA, 22 nt, Pseudomonas aeruginosa PA01
cucgucgcccuucaggucgaca

SEQ ID NO: 1429036 - RNA, 13 nt, Pseudomonas aeruginosa PA01
cucgucgccgacc

SEQ ID NO: 1429037 - RNA, 12 nt, Pseudomonas aeruginosa PA01
cucgucgccgcc

SEQ ID NO: 1429038 - RNA, 17 nt, Pseudomonas aeruginosa PA01
cucgucgccgcccggca

SEQ ID NO: 1429039 - RNA, 13 nt, Pseudomonas aeruginosa PA01
cucgucgccgccg

SEQ ID NO: 1429040 - RNA, 14 nt, Pseudomonas aeruginosa PA01
cucgucgccgccgu

SEQ ID NO: 1429041 - RNA, 17 nt, Pseudomonas aeruginosa PA01
cucgucgaucucgccga

SEQ ID NO: 1429042 - RNA, 14 nt, Pseudomonas aeruginosa PA01
cucgucacccgcgc

SEQ ID NO: 1429043 - RNA, 16 nt, Pseudomonas aeruginosa PA01
cucguauuccacgucg

SEQ ID NO: 1429044 - RNA, 20 nt, Pseudomonas aeruginosa PA01
cucgucauggcgcacgccgc

SEQ ID NO: 1429045 - RNA, 13 nt, Pseudomonas aeruginosa PA01
cucguccaggccg

SEQ ID NO: 1429046 - RNA, 14 nt, Pseudomonas aeruginosa PA01
cucguccaggccgc

SEQ ID NO: 1429047 - RNA, 20 nt, Pseudomonas aeruginosa PA01
cucguccaggccgcagguga

SEQ ID NO: 1429048 - RNA, 15 nt, Pseudomonas aeruginosa PA01
cucguccagguccgc

SEQ ID NO: 1429049 - RNA, 21 nt, Pseudomonas aeruginosa PA01
cucggugagcaggcgccggac

SEQ ID NO: 1429050 - RNA, 18 nt, Pseudomonas aeruginosa PA01
cucggugauaccgccggc

SEQ ID NO: 1429051 - RNA, 19 nt, Pseudomonas aeruginosa PA01
cucggugauaccgccggcg

SEQ ID NO: 1429052 - RNA, 22 nt, Pseudomonas aeruginosa PA01
cucggugauaccgccggcggcg

SEQ ID NO: 1429053 - RNA, 23 nt, Pseudomonas aeruginosa PA01
cucggugauaccgccggcggcga

SEQ ID NO: 1429054 - RNA, 17 nt, Pseudomonas aeruginosa PA01
cucgguccagaucgcca

SEQ ID NO: 1429055 - RNA, 16 nt, Pseudomonas aeruginosa PA01
cucggucgccgccagc

SEQ ID NO: 1429056 - RNA, 12 nt, Pseudomonas aeruginosa PA01
cucggugaccac

SEQ ID NO: 1429057 - RNA, 19 nt, Pseudomonas aeruginosa PA01
cucggugaccaccaggcgg

SEQ ID NO: 1429058 - RNA, 22 nt, Pseudomonas aeruginosa PA01
cucggugccgucaugcacuucg

SEQ ID NO: 1429059 - RNA, 20 nt, Pseudomonas aeruginosa PA01
cucggugccuucccagccga

SEQ ID NO: 1429060 - RNA, 16 nt, Pseudomonas aeruginosa PA01
cucggugaugcguucg

SEQ ID NO: 1429061 - RNA, 18 nt, Pseudomonas aeruginosa PA01
cucguagacuguggugua

SEQ ID NO: 1429062 - RNA, 20 nt, Pseudomonas aeruginosa PA01
cucguagagauauucccgcg

SEQ ID NO: 1429063 - RNA, 17 nt, Pseudomonas aeruginosa PA01
cucggugcggccgagga

SEQ ID NO: 1429064 - RNA, 18 nt, Pseudomonas aeruginosa PA01
cucguagccggcgcggcg

SEQ ID NO: 1429065 - RNA, 15 nt, Pseudomonas aeruginosa PA01
cucguaggcggcgcg

SEQ ID NO: 1429066 - RNA, 19 nt, Pseudomonas aeruginosa PA01
cucguaggcguccuggcga

SEQ ID NO: 1429067 - RNA, 18 nt, Pseudomonas aeruginosa PA01
cugaaacgcgcguccuuc

SEQ ID NO: 1429068 - RNA, 21 nt, Pseudomonas aeruginosa PA01
cucuucggagcgaggcgcgug

SEQ ID NO: 1429069 - RNA, 23 nt, Pseudomonas aeruginosa PA01
cucuucacauggugggcgccgcu

SEQ ID NO: 1429070 - RNA, 21 nt, Pseudomonas aeruginosa PA01
cucugucggagagggagcgcc

SEQ ID NO: 1429071 - RNA, 23 nt, Pseudomonas aeruginosa PA01
cucugugcgguauagcucauggc

SEQ ID NO: 1429072 - RNA, 18 nt, Pseudomonas aeruginosa PA01
cucuguuccucggcggcg

SEQ ID NO: 1429073 - RNA, 14 nt, Pseudomonas aeruginosa PA01
cucuucgccgcggc

SEQ ID NO: 1429074 - RNA, 19 nt, Pseudomonas aeruginosa PA01
cucuucccggcucggcacg

SEQ ID NO: 1429075 - RNA, 16 nt, Pseudomonas aeruginosa PA01
cucuuccacgcgccga

SEQ ID NO: 1429076 - RNA, 20 nt, Pseudomonas aeruginosa PA01
cucuuccagcaugcucgggc

SEQ ID NO: 1429077 - RNA, 14 nt, Pseudomonas aeruginosa PA01
cucugguuggccga

SEQ ID NO: 1429078 - RNA, 21 nt, Pseudomonas aeruginosa PA01
cucugguagcugcggccgagc

SEQ ID NO: 1429079 - RNA, 13 nt, Pseudomonas aeruginosa PA01
cucuggcgcaggg

SEQ ID NO: 1429080 - RNA, 21 nt, Pseudomonas aeruginosa PA01
cucugggccaugaccucggcc

SEQ ID NO: 1429081 - RNA, 12 nt, Pseudomonas aeruginosa PA01
cucuggcccagc

SEQ ID NO: 1429082 - RNA, 20 nt, Pseudomonas aeruginosa PA01
cucuccccagacccucuccc

SEQ ID NO: 1429083 - RNA, 17 nt, Pseudomonas aeruginosa PA01
cucuccacuaccgccga

SEQ ID NO: 1429084 - RNA, 18 nt, Pseudomonas aeruginosa PA01
cucucgccgcgcucgcgc

SEQ ID NO: 1429085 - RNA, 11 nt, Pseudomonas aeruginosa PA01
cucucgccggc

SEQ ID NO: 1429086 - RNA, 16 nt, Pseudomonas aeruginosa PA01
cucucgccucggcggg

SEQ ID NO: 1429087 - RNA, 11 nt, Pseudomonas aeruginosa PA01
cucucgcgcag

SEQ ID NO: 1429088 - RNA, 15 nt, Pseudomonas aeruginosa PA01
cucucgacuugaaca

SEQ ID NO: 1429089 - RNA, 21 nt, Pseudomonas aeruginosa PA01
cucucgaacaccaggcgccag

SEQ ID NO: 1429090 - RNA, 14 nt, Pseudomonas aeruginosa PA01
cucucgaacagcag

SEQ ID NO: 1429091 - RNA, 21 nt, Pseudomonas aeruginosa PA01
cucgugcagguagccgcgccg

SEQ ID NO: 1429092 - RNA, 18 nt, Pseudomonas aeruginosa PA01
cucgugcagcaagccgca

SEQ ID NO: 1429093 - RNA, 21 nt, Pseudomonas aeruginosa PA01
cucgugcuuggugucggccgc

SEQ ID NO: 1429094 - RNA, 22 nt, Pseudomonas aeruginosa PA01
cucgugcuuggugucggccgcc

SEQ ID NO: 1429095 - RNA, 23 nt, Pseudomonas aeruginosa PA01
cucgugcaacggcacgaccuucu

SEQ ID NO: 1429096 - RNA, 16 nt, Pseudomonas aeruginosa PA01
cucucaggagcgccgc

SEQ ID NO: 1429097 - RNA, 17 nt, Pseudomonas aeruginosa PA01
cucucaggagcgccgcg

SEQ ID NO: 1429098 - RNA, 19 nt, Pseudomonas aeruginosa PA01
cucucaggagcgccgcgca

SEQ ID NO: 1429099 - RNA, 16 nt, Pseudomonas aeruginosa PA01
cucguggaacagcgcg

SEQ ID NO: 1429100 - RNA, 13 nt, Pseudomonas aeruginosa PA01
cucguggcgcgau

SEQ ID NO: 1429101 - RNA, 13 nt, Pseudomonas aeruginosa PA01
cucguggcuggcg

SEQ ID NO: 1429102 - RNA, 14 nt, Pseudomonas aeruginosa PA01
cucguggcuggcgc

SEQ ID NO: 1429103 - RNA, 16 nt, Pseudomonas aeruginosa PA01
cucgucguucagccca

SEQ ID NO: 1429104 - RNA, 23 nt, Pseudomonas aeruginosa PA01
cucgucguucagcccacccccag

SEQ ID NO: 1429105 - RNA, 23 nt, Pseudomonas aeruginosa PA01
cucgugcagguagccgcgccggc

SEQ ID NO: 1429106 - RNA, 17 nt, Pseudomonas aeruginosa PA01
cucgugccaucaggccg

SEQ ID NO: 1429107 - RNA, 13 nt, Pseudomonas aeruginosa PA01
cucgugucgacuc

SEQ ID NO: 1429108 - RNA, 13 nt, Pseudomonas aeruginosa PA01
cucgugggccagc

SEQ ID NO: 1429109 - RNA, 14 nt, Pseudomonas aeruginosa PA01
cucgugggccagca

SEQ ID NO: 1429110 - RNA, 14 nt, Pseudomonas aeruginosa PA01
cucguggggccaga

SEQ ID NO: 1429111 - RNA, 20 nt, Pseudomonas aeruginosa PA01
cucguggggccagaagcgcu

SEQ ID NO: 1429112 - RNA, 14 nt, Pseudomonas aeruginosa PA01
cucgugguugaggc

SEQ ID NO: 1429113 - RNA, 20 nt, Pseudomonas aeruginosa PA01
cucgugguugaggcgcucgu

SEQ ID NO: 1429114 - RNA, 15 nt, Pseudomonas aeruginosa PA01
cucguggcgcgccgc

SEQ ID NO: 1429115 - RNA, 18 nt, Pseudomonas aeruginosa PA01
cucguggcuggcgccgcg

SEQ ID NO: 1429116 - RNA, 19 nt, Pseudomonas aeruginosa PA01
cucgucgccaugcggcagg

SEQ ID NO: 1429117 - RNA, 20 nt, Pseudomonas aeruginosa PA01
cucgucgccaugcggcaggc

SEQ ID NO: 1429118 - RNA, 13 nt, Pseudomonas aeruginosa PA01
cucgucgccgccc

SEQ ID NO: 1429119 - RNA, 16 nt, Pseudomonas aeruginosa PA01
cucgucgccgcccggc

SEQ ID NO: 1429120 - RNA, 20 nt, Pseudomonas aeruginosa PA01
cucgucgccgcccggcagcg

SEQ ID NO: 1429121 - RNA, 23 nt, Pseudomonas aeruginosa PA01
cucgucgccgcccggcagcggcu

SEQ ID NO: 1429122 - RNA, 14 nt, Pseudomonas aeruginosa PA01
cucgucgcgccagg

SEQ ID NO: 1429123 - RNA, 17 nt, Pseudomonas aeruginosa PA01
cucgucguacuggcgga

SEQ ID NO: 1429124 - RNA, 17 nt, Pseudomonas aeruginosa PA01
cucgucguccagcggcu

SEQ ID NO: 1429125 - RNA, 13 nt, Pseudomonas aeruginosa PA01
cucuucggcggcc

SEQ ID NO: 1429126 - RNA, 16 nt, Pseudomonas aeruginosa PA01
cucuucggcggccagc

SEQ ID NO: 1429127 - RNA, 18 nt, Pseudomonas aeruginosa PA01
cucugagggacacggcga

SEQ ID NO: 1429128 - RNA, 16 nt, Pseudomonas aeruginosa PA01
cucucucgccucggcg

SEQ ID NO: 1429129 - RNA, 14 nt, Pseudomonas aeruginosa PA01
cucuuccucgcugc

SEQ ID NO: 1429130 - RNA, 19 nt, Pseudomonas aeruginosa PA01
cucguugcacgcaggccgc

SEQ ID NO: 1429131 - RNA, 22 nt, Pseudomonas aeruginosa PA01
cucguugcaggcacggaagcgc

SEQ ID NO: 1429132 - RNA, 13 nt, Pseudomonas aeruginosa PA01
cucguucagcagc

SEQ ID NO: 1429133 - RNA, 14 nt, Pseudomonas aeruginosa PA01
cucguucagcagca

SEQ ID NO: 1429134 - RNA, 21 nt, Pseudomonas aeruginosa PA01
cucguuccacgggucgcagcc

SEQ ID NO: 1429135 - RNA, 22 nt, Pseudomonas aeruginosa PA01
cucguuccacgggucgcagccg

SEQ ID NO: 1429136 - RNA, 16 nt, Pseudomonas aeruginosa PA01
cucguuggccaccugc

SEQ ID NO: 1429137 - RNA, 21 nt, Pseudomonas aeruginosa PA01
cucuccaggucggucggcggc

SEQ ID NO: 1429138 - RNA, 22 nt, Pseudomonas aeruginosa PA01
cucucccugaagggagagggaa

SEQ ID NO: 1429139 - RNA, 19 nt, Pseudomonas aeruginosa PA01
cucuccccaaccuucuccc

SEQ ID NO: 1429140 - RNA, 15 nt, Pseudomonas aeruginosa PA01
cucucccgaggcgau

SEQ ID NO: 1429141 - RNA, 16 nt, Pseudomonas aeruginosa PA01
cucucggugaccacca

SEQ ID NO: 1429142 - RNA, 17 nt, Pseudomonas aeruginosa PA01
cucucggugaccaccag

SEQ ID NO: 1429143 - RNA, 21 nt, Pseudomonas aeruginosa PA01
cucucggugaccaccaggcgg

SEQ ID NO: 1429144 - RNA, 14 nt, Pseudomonas aeruginosa PA01
cucucgccucggcg

SEQ ID NO: 1429145 - RNA, 12 nt, Pseudomonas aeruginosa PA01
cucucgcugcgc

SEQ ID NO: 1429146 - RNA, 23 nt, Pseudomonas aeruginosa PA01
cucucgcugcgcgggucguccuc

SEQ ID NO: 1429147 - RNA, 14 nt, Pseudomonas aeruginosa PA01
cucuccgcgccgcg

SEQ ID NO: 1429148 - RNA, 15 nt, Pseudomonas aeruginosa PA01
cucucgccgccuucg

SEQ ID NO: 1429149 - RNA, 12 nt, Pseudomonas aeruginosa PA01
cucucgccggcc

SEQ ID NO: 1429150 - RNA, 18 nt, Pseudomonas aeruginosa PA01
cucggugagcaggcgccg

SEQ ID NO: 1429151 - RNA, 23 nt, Pseudomonas aeruginosa PA01
cucggugaggaacuugucgacca

SEQ ID NO: 1429152 - RNA, 13 nt, Pseudomonas aeruginosa PA01
cucggugaccacc

SEQ ID NO: 1429153 - RNA, 14 nt, Pseudomonas aeruginosa PA01
cucggugaccacca

SEQ ID NO: 1429154 - RNA, 14 nt, Pseudomonas aeruginosa PA01
cucggucgggcggg

SEQ ID NO: 1429155 - RNA, 16 nt, Pseudomonas aeruginosa PA01
cucggucucgaucggc

SEQ ID NO: 1429156 - RNA, 19 nt, Pseudomonas aeruginosa PA01
cucggucucgaucggcccg

SEQ ID NO: 1429157 - RNA, 23 nt, Pseudomonas aeruginosa PA01
cucggugcguagcgacaggcccu

SEQ ID NO: 1429158 - RNA, 15 nt, Pseudomonas aeruginosa PA01
cucggugcucaggcg

SEQ ID NO: 1429159 - RNA, 21 nt, Pseudomonas aeruginosa PA01
cucggugccuucccagccgag

SEQ ID NO: 1429160 - RNA, 22 nt, Pseudomonas aeruginosa PA01
cucggugccuucccagccgagg

SEQ ID NO: 1429161 - RNA, 23 nt, Pseudomonas aeruginosa PA01
cucggugccuucccagccgaggc

SEQ ID NO: 1429162 - RNA, 19 nt, Pseudomonas aeruginosa PA01
cucggguuuggcgcccgcc

SEQ ID NO: 1429163 - RNA, 21 nt, Pseudomonas aeruginosa PA01
cucggguuuggcgcccgccuu

SEQ ID NO: 1429164 - RNA, 16 nt, Pseudomonas aeruginosa PA01
cucgguagggccgagg

SEQ ID NO: 1429165 - RNA, 21 nt, Pseudomonas aeruginosa PA01
cucgguagggccgaggucgag

SEQ ID NO: 1429166 - RNA, 19 nt, Pseudomonas aeruginosa PA01
cucggucaggcgcugguga

SEQ ID NO: 1429167 - RNA, 21 nt, Pseudomonas aeruginosa PA01
cucggucagcggcgcagccuc

SEQ ID NO: 1429168 - RNA, 15 nt, Pseudomonas aeruginosa PA01
cucgguaaagcccag

SEQ ID NO: 1429169 - RNA, 13 nt, Pseudomonas aeruginosa PA01
cucggucgccgcc

SEQ ID NO: 1429170 - RNA, 22 nt, Pseudomonas aeruginosa PA01
cucggucagguauucgccggcc

SEQ ID NO: 1429171 - RNA, 23 nt, Pseudomonas aeruginosa PA01
cucgguccaacccauguggcgca

SEQ ID NO: 1429172 - RNA, 16 nt, Pseudomonas aeruginosa PA01
cucgucgcaccuguuc

SEQ ID NO: 1429173 - RNA, 18 nt, Pseudomonas aeruginosa PA01
cucgucgcaccuguucca

SEQ ID NO: 1429174 - RNA, 15 nt, Pseudomonas aeruginosa PA01
cucgucgagcgcagc

SEQ ID NO: 1429175 - RNA, 18 nt, Pseudomonas aeruginosa PA01
cucgucgagcgcagcgac

SEQ ID NO: 1429176 - RNA, 19 nt, Pseudomonas aeruginosa PA01
cucgucgagcagcgcgcgg

SEQ ID NO: 1429177 - RNA, 20 nt, Pseudomonas aeruginosa PA01
cucgucgagcagcgcgcggc

SEQ ID NO: 1429178 - RNA, 14 nt, Pseudomonas aeruginosa PA01
cucguccagguccg

SEQ ID NO: 1429179 - RNA, 21 nt, Pseudomonas aeruginosa PA01
cucguccggucgcaccgccag

SEQ ID NO: 1429180 - RNA, 20 nt, Pseudomonas aeruginosa PA01
cucgucgaagcgcaguaccc

SEQ ID NO: 1429181 - RNA, 14 nt, Pseudomonas aeruginosa PA01
cucguccucggcgu

SEQ ID NO: 1429182 - RNA, 16 nt, Pseudomonas aeruginosa PA01
cucguccucggggaag

SEQ ID NO: 1429183 - RNA, 13 nt, Pseudomonas aeruginosa PA01
cucguccgacagc

SEQ ID NO: 1429184 - RNA, 16 nt, Pseudomonas aeruginosa PA01
cucguccgacagcagg

SEQ ID NO: 1429185 - RNA, 14 nt, Pseudomonas aeruginosa PA01
cucguagucgauca

SEQ ID NO: 1429186 - RNA, 20 nt, Pseudomonas aeruginosa PA01
cucguagucgaucaggaaca

SEQ ID NO: 1429187 - RNA, 22 nt, Pseudomonas aeruginosa PA01
cucguauuccacgucgccgacc

SEQ ID NO: 1429188 - RNA, 13 nt, Pseudomonas aeruginosa PA01
cucguagccggcg

SEQ ID NO: 1429189 - RNA, 15 nt, Pseudomonas aeruginosa PA01
cucguaggcguccug

SEQ ID NO: 1429190 - RNA, 20 nt, Pseudomonas aeruginosa PA01
cucguaggcguccuggcgag

SEQ ID NO: 1429191 - RNA, 22 nt, Pseudomonas aeruginosa PA01
cucguagggguaggggucggcc

SEQ ID NO: 1429192 - RNA, 21 nt, Pseudomonas aeruginosa PA01
cucgucauggcgcacgccgcg

SEQ ID NO: 1429193 - RNA, 22 nt, Pseudomonas aeruginosa PA01
cucgucauggcgcacgccgcgg

SEQ ID NO: 1429194 - RNA, 16 nt, Pseudomonas aeruginosa PA01
cucguccagcaggccc

SEQ ID NO: 1429195 - RNA, 20 nt, Pseudomonas aeruginosa PA01
cucguccagcaggcccagcc

SEQ ID NO: 1429196 - RNA, 14 nt, Pseudomonas aeruginosa PA01
cucguccaggcaag

SEQ ID NO: 1429197 - RNA, 19 nt, Pseudomonas aeruginosa PA01
cucguccaggcaagcgcau

SEQ ID NO: 1429198 - RNA, 22 nt, Pseudomonas aeruginosa PA01
cucgguuccagcucgucgauga

SEQ ID NO: 1429199 - RNA, 14 nt, Pseudomonas aeruginosa PA01
cucguaggccgacu

SEQ ID NO: 1429200 - RNA, 20 nt, Pseudomonas aeruginosa PA01
cucguaggccgacucgcgau

SEQ ID NO: 1429201 - RNA, 21 nt, Pseudomonas aeruginosa PA01
cucguaggccgacucgcgauc

SEQ ID NO: 1429202 - RNA, 13 nt, Pseudomonas aeruginosa PA01
cucgguugccagg

SEQ ID NO: 1429203 - RNA, 17 nt, Pseudomonas aeruginosa PA01
cucgguugccaggccgg

SEQ ID NO: 1429204 - RNA, 19 nt, Pseudomonas aeruginosa PA01
cucggugugaucaccagcc

SEQ ID NO: 1429205 - RNA, 17 nt, Pseudomonas aeruginosa PA01
cucggugucggccaacu

SEQ ID NO: 1429206 - RNA, 17 nt, Pseudomonas aeruginosa PA01
cucgguguaggcgaucu

SEQ ID NO: 1429207 - RNA, 18 nt, Pseudomonas aeruginosa PA01
cucggcuaccccacgcga

SEQ ID NO: 1429208 - RNA, 14 nt, Pseudomonas aeruginosa PA01
cucggcggucaggc

SEQ ID NO: 1429209 - RNA, 17 nt, Pseudomonas aeruginosa PA01
cucggcggucaggccaa

SEQ ID NO: 1429210 - RNA, 18 nt, Pseudomonas aeruginosa PA01
cucggcgggagagggcgg

SEQ ID NO: 1429211 - RNA, 19 nt, Pseudomonas aeruginosa PA01
cucggcgggagagggcggc

SEQ ID NO: 1429212 - RNA, 19 nt, Pseudomonas aeruginosa PA01
cucggcggggcgcagcagg

SEQ ID NO: 1429213 - RNA, 21 nt, Pseudomonas aeruginosa PA01
cucggcggguauccgccgggc

SEQ ID NO: 1429214 - RNA, 23 nt, Pseudomonas aeruginosa PA01
cucggcggcggccugcucgcgca

SEQ ID NO: 1429215 - RNA, 17 nt, Pseudomonas aeruginosa PA01
cucggcggcggucgcga

SEQ ID NO: 1429216 - RNA, 21 nt, Pseudomonas aeruginosa PA01
cucggcggcgcgaaccagcag

SEQ ID NO: 1429217 - RNA, 13 nt, Pseudomonas aeruginosa PA01
cucggcggcgagc

SEQ ID NO: 1429218 - RNA, 18 nt, Pseudomonas aeruginosa PA01
cucggcggcgagcgccgc

SEQ ID NO: 1429219 - RNA, 19 nt, Pseudomonas aeruginosa PA01
cucggcggcgagcgccgcg

SEQ ID NO: 1429220 - RNA, 21 nt, Pseudomonas aeruginosa PA01
cucggcggcgagcgccgcggc

SEQ ID NO: 1429221 - RNA, 22 nt, Pseudomonas aeruginosa PA01
cucggcggcgagcgccgcggcg

SEQ ID NO: 1429222 - RNA, 19 nt, Pseudomonas aeruginosa PA01
cucggcugcuugccggugc

SEQ ID NO: 1429223 - RNA, 19 nt, Pseudomonas aeruginosa PA01
cucggcuuccaucaccgcg

SEQ ID NO: 1429224 - RNA, 20 nt, Pseudomonas aeruginosa PA01
cucggcuuccaucaccgcgu

SEQ ID NO: 1429225 - RNA, 15 nt, Pseudomonas aeruginosa PA01
cucggcugccgccag

SEQ ID NO: 1429226 - RNA, 16 nt, Pseudomonas aeruginosa PA01
cucggcugccgccagc

SEQ ID NO: 1429227 - RNA, 16 nt, Pseudomonas aeruginosa PA01
cucggcuccagccagg

SEQ ID NO: 1429228 - RNA, 20 nt, Pseudomonas aeruginosa PA01
cucggcuccagccaggcccg

SEQ ID NO: 1429229 - RNA, 14 nt, Pseudomonas aeruginosa PA01
cucgggccgcaggg

SEQ ID NO: 1429230 - RNA, 15 nt, Pseudomonas aeruginosa PA01
cucgggccggagcag

SEQ ID NO: 1429231 - RNA, 16 nt, Pseudomonas aeruginosa PA01
cucgggccggagcagg

SEQ ID NO: 1429232 - RNA, 22 nt, Pseudomonas aeruginosa PA01
cucgggcgagaaucgccgaggc

SEQ ID NO: 1429233 - RNA, 23 nt, Pseudomonas aeruginosa PA01
cucgggcgggaucuccgcgccac

SEQ ID NO: 1429234 - RNA, 15 nt, Pseudomonas aeruginosa PA01
cucgggcgucuccug

SEQ ID NO: 1429235 - RNA, 13 nt, Pseudomonas aeruginosa PA01
cucggggaagcgc

SEQ ID NO: 1429236 - RNA, 19 nt, Pseudomonas aeruginosa PA01
cucggggauguccgccgcc

SEQ ID NO: 1429237 - RNA, 20 nt, Pseudomonas aeruginosa PA01
cucggggauguccgccgccc

SEQ ID NO: 1429238 - RNA, 15 nt, Pseudomonas aeruginosa PA01
cucggggugcgcggc

SEQ ID NO: 1429239 - RNA, 17 nt, Pseudomonas aeruginosa PA01
cucggggugcgcggcga

SEQ ID NO: 1429240 - RNA, 18 nt, Pseudomonas aeruginosa PA01
cucggggugcgcggcgaa

SEQ ID NO: 1429241 - RNA, 23 nt, Pseudomonas aeruginosa PA01
cucggcgaccuugcgcaccaggg

SEQ ID NO: 1429242 - RNA, 13 nt, Pseudomonas aeruginosa PA01
cucggcgacgagg

SEQ ID NO: 1429243 - RNA, 13 nt, Pseudomonas aeruginosa PA01
cucggcgaccacc

SEQ ID NO: 1429244 - RNA, 16 nt, Pseudomonas aeruginosa PA01
cucggcgaccacccgg

SEQ ID NO: 1429245 - RNA, 18 nt, Pseudomonas aeruginosa PA01
cucggcgaccacccggcg

SEQ ID NO: 1429246 - RNA, 14 nt, Pseudomonas aeruginosa PA01
cucggcgaccaccg

SEQ ID NO: 1429247 - RNA, 17 nt, Pseudomonas aeruginosa PA01
cucggccagcaaugccc

SEQ ID NO: 1429248 - RNA, 18 nt, Pseudomonas aeruginosa PA01
cucggccagcaaugcccg

SEQ ID NO: 1429249 - RNA, 15 nt, Pseudomonas aeruginosa PA01
cucggccagcgccgc

SEQ ID NO: 1429250 - RNA, 16 nt, Pseudomonas aeruginosa PA01
cucggccagcgccgcc

SEQ ID NO: 1429251 - RNA, 18 nt, Pseudomonas aeruginosa PA01
cucggcauucgacccgcc

SEQ ID NO: 1429252 - RNA, 22 nt, Pseudomonas aeruginosa PA01
cucggcauucgacccgccgacc

SEQ ID NO: 1429253 - RNA, 16 nt, Pseudomonas aeruginosa PA01
cucggccaacggccgc

SEQ ID NO: 1429254 - RNA, 17 nt, Pseudomonas aeruginosa PA01
cucggcaucgucgaagc

SEQ ID NO: 1429255 - RNA, 16 nt, Pseudomonas aeruginosa PA01
cucggcgaucucgccc

SEQ ID NO: 1429256 - RNA, 17 nt, Pseudomonas aeruginosa PA01
cucggcgauucgcggcg

SEQ ID NO: 1429257 - RNA, 18 nt, Pseudomonas aeruginosa PA01
cucggcgauucgcggcga

SEQ ID NO: 1429258 - RNA, 19 nt, Pseudomonas aeruginosa PA01
cucggcgauucgcggcgac

SEQ ID NO: 1429259 - RNA, 15 nt, Pseudomonas aeruginosa PA01
cucggcgaucacccg

SEQ ID NO: 1429260 - RNA, 18 nt, Pseudomonas aeruginosa PA01
cucggcgaucacccggcg

SEQ ID NO: 1429261 - RNA, 16 nt, Pseudomonas aeruginosa PA01
cucggcgauccgcgcu

SEQ ID NO: 1429262 - RNA, 19 nt, Pseudomonas aeruginosa PA01
cucggcgauccgcgcuucc

SEQ ID NO: 1429263 - RNA, 18 nt, Pseudomonas aeruginosa PA01
cucggcgaguucgcgcag

SEQ ID NO: 1429264 - RNA, 20 nt, Pseudomonas aeruginosa PA01
cucggcgaguucgcgcaggc

SEQ ID NO: 1429265 - RNA, 22 nt, Pseudomonas aeruginosa PA01
cucggcgaguucgcgcaggcgg

SEQ ID NO: 1429266 - RNA, 14 nt, Pseudomonas aeruginosa PA01
cucggcgacuucgc

SEQ ID NO: 1429267 - RNA, 20 nt, Pseudomonas aeruginosa PA01
cucggcgacuucgcauucca

SEQ ID NO: 1429268 - RNA, 17 nt, Pseudomonas aeruginosa PA01
cucggcgaggaacagca

SEQ ID NO: 1429269 - RNA, 22 nt, Pseudomonas aeruginosa PA01
cucggcgaggaacagcaccagc

SEQ ID NO: 1429270 - RNA, 17 nt, Pseudomonas aeruginosa PA01
cucggcgaggccggcga

SEQ ID NO: 1429271 - RNA, 16 nt, Pseudomonas aeruginosa PA01
cucggcgagccgccgg

SEQ ID NO: 1429272 - RNA, 12 nt, Pseudomonas aeruginosa PA01
cucggcgcgauc

SEQ ID NO: 1429273 - RNA, 23 nt, Pseudomonas aeruginosa PA01
cucggcgcgauccuccgccagcc

SEQ ID NO: 1429274 - RNA, 21 nt, Pseudomonas aeruginosa PA01
cucggcgccguuguucaggcg

SEQ ID NO: 1429275 - RNA, 14 nt, Pseudomonas aeruginosa PA01
cucggcgccgucga

SEQ ID NO: 1429276 - RNA, 16 nt, Pseudomonas aeruginosa PA01
cucggcgccgucgauc

SEQ ID NO: 1429277 - RNA, 13 nt, Pseudomonas aeruginosa PA01
cucggcgccgagc

SEQ ID NO: 1429278 - RNA, 13 nt, Pseudomonas aeruginosa PA01
cucggcgccgauc

SEQ ID NO: 1429279 - RNA, 20 nt, Pseudomonas aeruginosa PA01
cucggcgccauaggccagca

SEQ ID NO: 1429280 - RNA, 13 nt, Pseudomonas aeruginosa PA01
cucggcgauggcg

SEQ ID NO: 1429281 - RNA, 20 nt, Pseudomonas aeruginosa PA01
cucggcgauggcgcgcgggc

SEQ ID NO: 1429282 - RNA, 14 nt, Pseudomonas aeruginosa PA01
cucggcgcccaggg

SEQ ID NO: 1429283 - RNA, 16 nt, Pseudomonas aeruginosa PA01
cucgcaaucagcgcga

SEQ ID NO: 1429284 - RNA, 16 nt, Pseudomonas aeruginosa PA01
cucgccaccccgcucc

SEQ ID NO: 1429285 - RNA, 18 nt, Pseudomonas aeruginosa PA01
cucgccaccccgcuccgc

SEQ ID NO: 1429286 - RNA, 23 nt, Pseudomonas aeruginosa PA01
cucgccaagcuggcgaucgaccu

SEQ ID NO: 1429287 - RNA, 22 nt, Pseudomonas aeruginosa PA01
cucgccagcgcgcgccgacagg

SEQ ID NO: 1429288 - RNA, 13 nt, Pseudomonas aeruginosa PA01
cucgcccagcagg

SEQ ID NO: 1429289 - RNA, 17 nt, Pseudomonas aeruginosa PA01
cucgccagcccggcagg

SEQ ID NO: 1429290 - RNA, 19 nt, Pseudomonas aeruginosa PA01
cucgccacgcuucugcgcc

SEQ ID NO: 1429291 - RNA, 21 nt, Pseudomonas aeruginosa PA01
cucgccacgcuucugcgccuc

SEQ ID NO: 1429292 - RNA, 15 nt, Pseudomonas aeruginosa PA01
cucgcgacaccgggc

SEQ ID NO: 1429293 - RNA, 17 nt, Pseudomonas aeruginosa PA01
cucgcgacccuggccgc

SEQ ID NO: 1429294 - RNA, 22 nt, Pseudomonas aeruginosa PA01
cucgcgacccuggccgcgcggc

SEQ ID NO: 1429295 - RNA, 17 nt, Pseudomonas aeruginosa PA01
cucgcgaucgaucggcu

SEQ ID NO: 1429296 - RNA, 22 nt, Pseudomonas aeruginosa PA01
cucgcgaucgaucggcuggucg

SEQ ID NO: 1429297 - RNA, 15 nt, Pseudomonas aeruginosa PA01
cucgcgacggcauuc

SEQ ID NO: 1429298 - RNA, 23 nt, Pseudomonas aeruginosa PA01
cucgcgacggcauuccuggucca

SEQ ID NO: 1429299 - RNA, 17 nt, Pseudomonas aeruginosa PA01
cucgcgacugccgucgg

SEQ ID NO: 1429300 - RNA, 15 nt, Pseudomonas aeruginosa PA01
cucgcgacugcugau

SEQ ID NO: 1429301 - RNA, 20 nt, Pseudomonas aeruginosa PA01
cucgcccagggcguggucgg

SEQ ID NO: 1429302 - RNA, 15 nt, Pseudomonas aeruginosa PA01
cucgcgagauggcgu

SEQ ID NO: 1429303 - RNA, 15 nt, Pseudomonas aeruginosa PA01
cucgcgcaaccagcc

SEQ ID NO: 1429304 - RNA, 19 nt, Pseudomonas aeruginosa PA01
cucgcgcaacgccgacggc

SEQ ID NO: 1429305 - RNA, 19 nt, Pseudomonas aeruginosa PA01
cucgcgcaagcgcccggcg

SEQ ID NO: 1429306 - RNA, 20 nt, Pseudomonas aeruginosa PA01
cucgcgcaagcgcccggcga

SEQ ID NO: 1429307 - RNA, 16 nt, Pseudomonas aeruginosa PA01
cucgcgcggggcgcgc

SEQ ID NO: 1429308 - RNA, 19 nt, Pseudomonas aeruginosa PA01
cucgcgcggggcgcgcugc

SEQ ID NO: 1429309 - RNA, 16 nt, Pseudomonas aeruginosa PA01
cucgcgcaccgcggcc

SEQ ID NO: 1429310 - RNA, 17 nt, Pseudomonas aeruginosa PA01
cucgcgcaccgcggcca

SEQ ID NO: 1429311 - RNA, 20 nt, Pseudomonas aeruginosa PA01
cucgcgcaccgcggccaguu

SEQ ID NO: 1429312 - RNA, 20 nt, Pseudomonas aeruginosa PA01
cucgcgcaccgccucgugca

SEQ ID NO: 1429313 - RNA, 16 nt, Pseudomonas aeruginosa PA01
cucgcgcucggcggcc

SEQ ID NO: 1429314 - RNA, 19 nt, Pseudomonas aeruginosa PA01
cucgcgcucggcggccucg

SEQ ID NO: 1429315 - RNA, 21 nt, Pseudomonas aeruginosa PA01
cucgcgcguggccgccagggu

SEQ ID NO: 1429316 - RNA, 17 nt, Pseudomonas aeruginosa PA01
cucgcggacgcuggcga

SEQ ID NO: 1429317 - RNA, 18 nt, Pseudomonas aeruginosa PA01
cucgcggacgcuggcgau

SEQ ID NO: 1429318 - RNA, 18 nt, Pseudomonas aeruginosa PA01
cucgcggaagcguugcuc

SEQ ID NO: 1429319 - RNA, 19 nt, Pseudomonas aeruginosa PA01
cucgcgcugcccggcgcga

SEQ ID NO: 1429320 - RNA, 13 nt, Pseudomonas aeruginosa PA01
cucgcgcuggacc

SEQ ID NO: 1429321 - RNA, 20 nt, Pseudomonas aeruginosa PA01
cucgcgcuggacccgcaccu

SEQ ID NO: 1429322 - RNA, 16 nt, Pseudomonas aeruginosa PA01
cucgcgguuauccgcc

SEQ ID NO: 1429323 - RNA, 21 nt, Pseudomonas aeruginosa PA01
cucgcgguuauccgccgccgg

SEQ ID NO: 1429324 - RNA, 18 nt, Pseudomonas aeruginosa PA01
cucgcgguuauccgccgg

SEQ ID NO: 1429325 - RNA, 16 nt, Pseudomonas aeruginosa PA01
cucgcgguucgaggac

SEQ ID NO: 1429326 - RNA, 17 nt, Pseudomonas aeruginosa PA01
cucgcggcaucccgccc

SEQ ID NO: 1429327 - RNA, 15 nt, Pseudomonas aeruginosa PA01
cucgcugccgccgca

SEQ ID NO: 1429328 - RNA, 12 nt, Pseudomonas aeruginosa PA01
cucgcugccgaa

SEQ ID NO: 1429329 - RNA, 23 nt, Pseudomonas aeruginosa PA01
cucgcugcgugcguugcgcggca

SEQ ID NO: 1429330 - RNA, 17 nt, Pseudomonas aeruginosa PA01
cucgcugccggcgcgca

SEQ ID NO: 1429331 - RNA, 20 nt, Pseudomonas aeruginosa PA01
cucgcugccuggggacggca

SEQ ID NO: 1429332 - RNA, 22 nt, Pseudomonas aeruginosa PA01
cucgcugccuggggacggcagg

SEQ ID NO: 1429333 - RNA, 14 nt, Pseudomonas aeruginosa PA01
cucgcucugcgccg

SEQ ID NO: 1429334 - RNA, 15 nt, Pseudomonas aeruginosa PA01
cucgcucugcgccgc

SEQ ID NO: 1429335 - RNA, 18 nt, Pseudomonas aeruginosa PA01
cucgcucugcgccgcggc

SEQ ID NO: 1429336 - RNA, 23 nt, Pseudomonas aeruginosa PA01
cucgcugaguuugcccagcgccg

SEQ ID NO: 1429337 - RNA, 19 nt, Pseudomonas aeruginosa PA01
cucgcugaaauccaccagc

SEQ ID NO: 1429338 - RNA, 20 nt, Pseudomonas aeruginosa PA01
cucgcugaaauccaccagca

SEQ ID NO: 1429339 - RNA, 19 nt, Pseudomonas aeruginosa PA01
cucgcguucaucgucggca

SEQ ID NO: 1429340 - RNA, 20 nt, Pseudomonas aeruginosa PA01
cucgcguucgcggucgguga

SEQ ID NO: 1429341 - RNA, 20 nt, Pseudomonas aeruginosa PA01
cucgcuagucuuccugcacg

SEQ ID NO: 1429342 - RNA, 19 nt, Pseudomonas aeruginosa PA01
cucgcuccaacgcaggcgc

SEQ ID NO: 1429343 - RNA, 12 nt, Pseudomonas aeruginosa PA01
cucgcuccagag

SEQ ID NO: 1429344 - RNA, 15 nt, Pseudomonas aeruginosa PA01
cucgcuccccugccg

SEQ ID NO: 1429345 - RNA, 17 nt, Pseudomonas aeruginosa PA01
cuccugaaggaccagcu

SEQ ID NO: 1429346 - RNA, 17 nt, Pseudomonas aeruginosa PA01
cuccugauagggggcug

SEQ ID NO: 1429347 - RNA, 18 nt, Pseudomonas aeruginosa PA01
cuccucgucguacuggcg

SEQ ID NO: 1429348 - RNA, 16 nt, Pseudomonas aeruginosa PA01
cuccucuaccaggcgg

SEQ ID NO: 1429349 - RNA, 13 nt, Pseudomonas aeruginosa PA01
cuccucggccaac

SEQ ID NO: 1429350 - RNA, 22 nt, Pseudomonas aeruginosa PA01
cuccucggccugggcgcaggcc

SEQ ID NO: 1429351 - RNA, 12 nt, Pseudomonas aeruginosa PA01
cuccucggccuu

SEQ ID NO: 1429352 - RNA, 11 nt, Pseudomonas aeruginosa PA01
cuccucggccu

SEQ ID NO: 1429353 - RNA, 23 nt, Pseudomonas aeruginosa PA01
cuccguugaacucggcgcccagg

SEQ ID NO: 1429354 - RNA, 11 nt, Pseudomonas aeruginosa PA01
cuccucgcgcu

SEQ ID NO: 1429355 - RNA, 14 nt, Pseudomonas aeruginosa PA01
cuccucgcgcugcc

SEQ ID NO: 1429356 - RNA, 14 nt, Pseudomonas aeruginosa PA01
cuccucgcuccaga

SEQ ID NO: 1429357 - RNA, 15 nt, Pseudomonas aeruginosa PA01
cuccucggcagcgcu

SEQ ID NO: 1429358 - RNA, 15 nt, Pseudomonas aeruginosa PA01
cuccgugcuggccgg

SEQ ID NO: 1429359 - RNA, 19 nt, Pseudomonas aeruginosa PA01
cuccgugcuggccggcagc

SEQ ID NO: 1429360 - RNA, 21 nt, Pseudomonas aeruginosa PA01
cuccgugcuggccggcagcag

SEQ ID NO: 1429361 - RNA, 22 nt, Pseudomonas aeruginosa PA01
cuccgugucggcggcgccuucg

SEQ ID NO: 1429362 - RNA, 12 nt, Pseudomonas aeruginosa PA01
cuccucgccgcc

SEQ ID NO: 1429363 - RNA, 14 nt, Pseudomonas aeruginosa PA01
cuccucgccgccga

SEQ ID NO: 1429364 - RNA, 12 nt, Pseudomonas aeruginosa PA01
cuccucgccgcu

SEQ ID NO: 1429365 - RNA, 18 nt, Pseudomonas aeruginosa PA01
cuccucgccguacagcag

SEQ ID NO: 1429366 - RNA, 13 nt, Pseudomonas aeruginosa PA01
cuccucgcgcagc

SEQ ID NO: 1429367 - RNA, 18 nt, Pseudomonas aeruginosa PA01
cuccguccagugcggcag

SEQ ID NO: 1429368 - RNA, 22 nt, Pseudomonas aeruginosa PA01
cuccguccagugcggcagucgg

SEQ ID NO: 1429369 - RNA, 19 nt, Pseudomonas aeruginosa PA01
cuccguagggcgacgcccg

SEQ ID NO: 1429370 - RNA, 17 nt, Pseudomonas aeruginosa PA01
cuccgucuguucggcca

SEQ ID NO: 1429371 - RNA, 18 nt, Pseudomonas aeruginosa PA01
cuccgucgcuucgcccgc

SEQ ID NO: 1429372 - RNA, 18 nt, Pseudomonas aeruginosa PA01
cucgaacaacuggacgaa

SEQ ID NO: 1429373 - RNA, 16 nt, Pseudomonas aeruginosa PA01
cucgaacaccaggcgc

SEQ ID NO: 1429374 - RNA, 18 nt, Pseudomonas aeruginosa PA01
cucgaacaccaggcgcca

SEQ ID NO: 1429375 - RNA, 21 nt, Pseudomonas aeruginosa PA01
cucgaacaccaggcgccaggg

SEQ ID NO: 1429376 - RNA, 17 nt, Pseudomonas aeruginosa PA01
cucgaaaaugucggugc

SEQ ID NO: 1429377 - RNA, 13 nt, Pseudomonas aeruginosa PA01
cuccugccgccga

SEQ ID NO: 1429378 - RNA, 17 nt, Pseudomonas aeruginosa PA01
cucgaacagcagcaagc

SEQ ID NO: 1429379 - RNA, 17 nt, Pseudomonas aeruginosa PA01
cucgaaccccuggcgcu

SEQ ID NO: 1429380 - RNA, 16 nt, Pseudomonas aeruginosa PA01
cucgaacgccaggcag

SEQ ID NO: 1429381 - RNA, 13 nt, Pseudomonas aeruginosa PA01
cuccggucaaggc

SEQ ID NO: 1429382 - RNA, 17 nt, Pseudomonas aeruginosa PA01
cuccggugucaggccga

SEQ ID NO: 1429383 - RNA, 15 nt, Pseudomonas aeruginosa PA01
cuccgguggcgguug

SEQ ID NO: 1429384 - RNA, 17 nt, Pseudomonas aeruginosa PA01
cuccggugccagggcgg

SEQ ID NO: 1429385 - RNA, 23 nt, Pseudomonas aeruginosa PA01
cuccggugccagggcggucggcc

SEQ ID NO: 1429386 - RNA, 24 nt, Pseudomonas aeruginosa PA01
cuccggcguaccguuggcgaugau

SEQ ID NO: 1429387 - RNA, 15 nt, Pseudomonas aeruginosa PA01
cuccggcuccgcgca

SEQ ID NO: 1429388 - RNA, 12 nt, Pseudomonas aeruginosa PA01
cuccggcgccgg

SEQ ID NO: 1429389 - RNA, 15 nt, Pseudomonas aeruginosa PA01
cuccggcgccgggcu

SEQ ID NO: 1429390 - RNA, 17 nt, Pseudomonas aeruginosa PA01
cuccggcgcagcccagc

SEQ ID NO: 1429391 - RNA, 19 nt, Pseudomonas aeruginosa PA01
cuccggcgcagcccagccg

SEQ ID NO: 1429392 - RNA, 13 nt, Pseudomonas aeruginosa PA01
cuccggcaggcgc

SEQ ID NO: 1429393 - RNA, 18 nt, Pseudomonas aeruginosa PA01
cuccgccggggguguuga

SEQ ID NO: 1429394 - RNA, 18 nt, Pseudomonas aeruginosa PA01
cuccgccgcuuccgccgg

SEQ ID NO: 1429395 - RNA, 19 nt, Pseudomonas aeruginosa PA01
cuccgccgcuuccgccggc

SEQ ID NO: 1429396 - RNA, 12 nt, Pseudomonas aeruginosa PA01
cuccgccggcgu

SEQ ID NO: 1429397 - RNA, 13 nt, Pseudomonas aeruginosa PA01
cuccgccuggcgg

SEQ ID NO: 1429398 - RNA, 14 nt, Pseudomonas aeruginosa PA01
cuccgccuggcgga

SEQ ID NO: 1429399 - RNA, 24 nt, Pseudomonas aeruginosa PA01
cuccgccuggcggauaucgcgugg

SEQ ID NO: 1429400 - RNA, 14 nt, Pseudomonas aeruginosa PA01
cuccgccucgaucu

SEQ ID NO: 1429401 - RNA, 16 nt, Pseudomonas aeruginosa PA01
cuccgccugaccgcug

SEQ ID NO: 1429402 - RNA, 17 nt, Pseudomonas aeruginosa PA01
cuccgccugaccgcuga

SEQ ID NO: 1429403 - RNA, 16 nt, Pseudomonas aeruginosa PA01
cuccgccugcacgucg

SEQ ID NO: 1429404 - RNA, 20 nt, Pseudomonas aeruginosa PA01
cuccgccgaacgccaccagg

SEQ ID NO: 1429405 - RNA, 19 nt, Pseudomonas aeruginosa PA01
cuccgccgcgugcgcgccc

SEQ ID NO: 1429406 - RNA, 14 nt, Pseudomonas aeruginosa PA01
cuccgccgccguga

SEQ ID NO: 1429407 - RNA, 19 nt, Pseudomonas aeruginosa PA01
cuccgccacccgcuccggc

SEQ ID NO: 1429408 - RNA, 19 nt, Pseudomonas aeruginosa PA01
cuccgcgauguccccggcc

SEQ ID NO: 1429409 - RNA, 20 nt, Pseudomonas aeruginosa PA01
cuccgcgauguccccggcca

SEQ ID NO: 1429410 - RNA, 23 nt, Pseudomonas aeruginosa PA01
cuccgcgauguccccggccagca

SEQ ID NO: 1429411 - RNA, 20 nt, Pseudomonas aeruginosa PA01
cuccgcgccgggcuggccgu

SEQ ID NO: 1429412 - RNA, 22 nt, Pseudomonas aeruginosa PA01
cuccgcgccgggcuggccgucg

SEQ ID NO: 1429413 - RNA, 16 nt, Pseudomonas aeruginosa PA01
cuccgcgccacgcgca

SEQ ID NO: 1429414 - RNA, 18 nt, Pseudomonas aeruginosa PA01
cuccgcgccacgcgcauc

SEQ ID NO: 1429415 - RNA, 20 nt, Pseudomonas aeruginosa PA01
cuccgcggccggcuucagca

SEQ ID NO: 1429416 - RNA, 22 nt, Pseudomonas aeruginosa PA01
cucgauggcagccuuggccacg

SEQ ID NO: 1429417 - RNA, 20 nt, Pseudomonas aeruginosa PA01
cucgaucagugcaucggccg

SEQ ID NO: 1429418 - RNA, 17 nt, Pseudomonas aeruginosa PA01
cucgauguccgggaugc

SEQ ID NO: 1429419 - RNA, 23 nt, Pseudomonas aeruginosa PA01
cucgauguccgggaugccggugc

SEQ ID NO: 1429420 - RNA, 15 nt, Pseudomonas aeruginosa PA01
cucgauggcggcauu

SEQ ID NO: 1429421 - RNA, 23 nt, Pseudomonas aeruginosa PA01
cucgauggcggcauugagggcga

SEQ ID NO: 1429422 - RNA, 14 nt, Pseudomonas aeruginosa PA01
cucgauggcgcggu

SEQ ID NO: 1429423 - RNA, 23 nt, Pseudomonas aeruginosa PA01
cucgauggugaacgccaggcagu

SEQ ID NO: 1429424 - RNA, 19 nt, Pseudomonas aeruginosa PA01
cucgagccguuccaggcgg

SEQ ID NO: 1429425 - RNA, 16 nt, Pseudomonas aeruginosa PA01
cucgagcaugucggcg

SEQ ID NO: 1429426 - RNA, 17 nt, Pseudomonas aeruginosa PA01
cucgagcaugucggcgg

SEQ ID NO: 1429427 - RNA, 18 nt, Pseudomonas aeruginosa PA01
cucgaucagcccgccaac

SEQ ID NO: 1429428 - RNA, 14 nt, Pseudomonas aeruginosa PA01
cucgaucagccggc

SEQ ID NO: 1429429 - RNA, 17 nt, Pseudomonas aeruginosa PA01
cucgaucagccggcgcg

SEQ ID NO: 1429430 - RNA, 17 nt, Pseudomonas aeruginosa PA01
cucgaucacccgcgagg

SEQ ID NO: 1429431 - RNA, 18 nt, Pseudomonas aeruginosa PA01
cucgaucacccgcgaggc

SEQ ID NO: 1429432 - RNA, 15 nt, Pseudomonas aeruginosa PA01
cucgaucagcgaguc

SEQ ID NO: 1429433 - RNA, 13 nt, Pseudomonas aeruginosa PA01
cucgaucagcgcc

SEQ ID NO: 1429434 - RNA, 15 nt, Pseudomonas aeruginosa PA01
cucgaucagcgcggc

SEQ ID NO: 1429435 - RNA, 13 nt, Pseudomonas aeruginosa PA01
cucgaucaucgcc

SEQ ID NO: 1429436 - RNA, 17 nt, Pseudomonas aeruginosa PA01
cucgaucaucgccagcg

SEQ ID NO: 1429437 - RNA, 15 nt, Pseudomonas aeruginosa PA01
cucgaugaucgccgg

SEQ ID NO: 1429438 - RNA, 16 nt, Pseudomonas aeruginosa PA01
cucgaugcccgccagc

SEQ ID NO: 1429439 - RNA, 16 nt, Pseudomonas aeruginosa PA01
cucgaugccaucgagg

SEQ ID NO: 1429440 - RNA, 20 nt, Pseudomonas aeruginosa PA01
cucgaugccaucgaggccag

SEQ ID NO: 1429441 - RNA, 19 nt, Pseudomonas aeruginosa PA01
cucgacaucgucucgcgac

SEQ ID NO: 1429442 - RNA, 20 nt, Pseudomonas aeruginosa PA01
cucgacaucgucucgcgaca

SEQ ID NO: 1429443 - RNA, 23 nt, Pseudomonas aeruginosa PA01
cucgacaucgucucgcgacacgu

SEQ ID NO: 1429444 - RNA, 18 nt, Pseudomonas aeruginosa PA01
cucgacauggaucaccgc

SEQ ID NO: 1429445 - RNA, 19 nt, Pseudomonas aeruginosa PA01
cucgacauggaucaccgcc

SEQ ID NO: 1429446 - RNA, 20 nt, Pseudomonas aeruginosa PA01
cucgacauggaucaccgcca

SEQ ID NO: 1429447 - RNA, 16 nt, Pseudomonas aeruginosa PA01
cucgacauacuccgcc

SEQ ID NO: 1429448 - RNA, 18 nt, Pseudomonas aeruginosa PA01
cucgacauacuccgccgc

SEQ ID NO: 1429449 - RNA, 19 nt, Pseudomonas aeruginosa PA01
cucgacauacuccgccgcu

SEQ ID NO: 1429450 - RNA, 18 nt, Pseudomonas aeruginosa PA01
cucgacauugcugccgag

SEQ ID NO: 1429451 - RNA, 15 nt, Pseudomonas aeruginosa PA01
cucgacaggucggcg

SEQ ID NO: 1429452 - RNA, 16 nt, Pseudomonas aeruginosa PA01
cucgacaggucggcga

SEQ ID NO: 1429453 - RNA, 16 nt, Pseudomonas aeruginosa PA01
cucgaccagcgccgcg

SEQ ID NO: 1429454 - RNA, 17 nt, Pseudomonas aeruginosa PA01
cucgaccagcgccgcgg

SEQ ID NO: 1429455 - RNA, 18 nt, Pseudomonas aeruginosa PA01
cucgaccagcgccgcggc

SEQ ID NO: 1429456 - RNA, 23 nt, Pseudomonas aeruginosa PA01
cucgaccagaucggcauggccga

SEQ ID NO: 1429457 - RNA, 14 nt, Pseudomonas aeruginosa PA01
cucgaccaccucgg

SEQ ID NO: 1429458 - RNA, 18 nt, Pseudomonas aeruginosa PA01
cucgaccaucggcggcgg

SEQ ID NO: 1429459 - RNA, 13 nt, Pseudomonas aeruginosa PA01
cucgaccuggcca

SEQ ID NO: 1429460 - RNA, 16 nt, Pseudomonas aeruginosa PA01
cucgacgagccgcgac

SEQ ID NO: 1429461 - RNA, 17 nt, Pseudomonas aeruginosa PA01
cucgaccagguccggca

SEQ ID NO: 1429462 - RNA, 18 nt, Pseudomonas aeruginosa PA01
cucgaccagguccggcag

SEQ ID NO: 1429463 - RNA, 14 nt, Pseudomonas aeruginosa PA01
cucgaccuugcccu

SEQ ID NO: 1429464 - RNA, 14 nt, Pseudomonas aeruginosa PA01
cucgaccuugccga

SEQ ID NO: 1429465 - RNA, 18 nt, Pseudomonas aeruginosa PA01
cucgaccuugcuggugcc

SEQ ID NO: 1429466 - RNA, 14 nt, Pseudomonas aeruginosa PA01
cucgagcaggccga

SEQ ID NO: 1429467 - RNA, 21 nt, Pseudomonas aeruginosa PA01
cucgagauugucgcgauccac

SEQ ID NO: 1429468 - RNA, 15 nt, Pseudomonas aeruginosa PA01
cucgacuuccgccuu

SEQ ID NO: 1429469 - RNA, 16 nt, Pseudomonas aeruginosa PA01
cucgacuucuucgcug

SEQ ID NO: 1429470 - RNA, 19 nt, Pseudomonas aeruginosa PA01
cucgacuucuucgcuggac

SEQ ID NO: 1429471 - RNA, 20 nt, Pseudomonas aeruginosa PA01
cucgacuucuucgcuggacc

SEQ ID NO: 1429472 - RNA, 14 nt, Pseudomonas aeruginosa PA01
cucgagcaccgcgg

SEQ ID NO: 1429473 - RNA, 23 nt, Pseudomonas aeruginosa PA01
cucgagcaccaccacucgcgagc

SEQ ID NO: 1429474 - RNA, 17 nt, Pseudomonas aeruginosa PA01
cucgacgcagagcgcca

SEQ ID NO: 1429475 - RNA, 22 nt, Pseudomonas aeruginosa PA01
cucgacgcccgcuugcgccgcc

SEQ ID NO: 1429476 - RNA, 13 nt, Pseudomonas aeruginosa PA01
cucgacgccgagc

SEQ ID NO: 1429477 - RNA, 20 nt, Pseudomonas aeruginosa PA01
cucgacgccgagccagccgc

SEQ ID NO: 1429478 - RNA, 22 nt, Pseudomonas aeruginosa PA01
cucgacgccgagccagccgcgg

SEQ ID NO: 1429479 - RNA, 21 nt, Pseudomonas aeruginosa PA01
cuccaccgauggcgcgcuuuc

SEQ ID NO: 1429480 - RNA, 18 nt, Pseudomonas aeruginosa PA01
cuccacccguucgccggc

SEQ ID NO: 1429481 - RNA, 19 nt, Pseudomonas aeruginosa PA01
cuccacccguucgccggcc

SEQ ID NO: 1429482 - RNA, 19 nt, Pseudomonas aeruginosa PA01
cuccagacucuccaggucg

SEQ ID NO: 1429483 - RNA, 19 nt, Pseudomonas aeruginosa PA01
cuccagagccaugggccgg

SEQ ID NO: 1429484 - RNA, 21 nt, Pseudomonas aeruginosa PA01
cuccaccggaucgcccuggcg

SEQ ID NO: 1429485 - RNA, 16 nt, Pseudomonas aeruginosa PA01
cuccagagugcgcagc

SEQ ID NO: 1429486 - RNA, 18 nt, Pseudomonas aeruginosa PA01
cuccagagugcgcagcag

SEQ ID NO: 1429487 - RNA, 19 nt, Pseudomonas aeruginosa PA01
cuccagagugcgcagcagc

SEQ ID NO: 1429488 - RNA, 21 nt, Pseudomonas aeruginosa PA01
cuccagagugcgcagcagcgu

SEQ ID NO: 1429489 - RNA, 22 nt, Pseudomonas aeruginosa PA01
cuccagagugcgcagcagcguc

SEQ ID NO: 1429490 - RNA, 14 nt, Pseudomonas aeruginosa PA01
cuccaccaguagcc

SEQ ID NO: 1429491 - RNA, 17 nt, Pseudomonas aeruginosa PA01
cuccacccaggcgccga

SEQ ID NO: 1429492 - RNA, 19 nt, Pseudomonas aeruginosa PA01
cuccacccaggcgccgauc

SEQ ID NO: 1429493 - RNA, 22 nt, Pseudomonas aeruginosa PA01
cuccaccaggccauagcgcgcc

SEQ ID NO: 1429494 - RNA, 14 nt, Pseudomonas aeruginosa PA01
cuccaccagcgccg

SEQ ID NO: 1429495 - RNA, 16 nt, Pseudomonas aeruginosa PA01
cuccaccagcgccggc

SEQ ID NO: 1429496 - RNA, 14 nt, Pseudomonas aeruginosa PA01
cuccacacccgguc

SEQ ID NO: 1429497 - RNA, 14 nt, Pseudomonas aeruginosa PA01
cucauggcgccgcc

SEQ ID NO: 1429498 - RNA, 19 nt, Pseudomonas aeruginosa PA01
cucaugcccagcuuggcca

SEQ ID NO: 1429499 - RNA, 13 nt, Pseudomonas aeruginosa PA01
cucaugcaggccg

SEQ ID NO: 1429500 - RNA, 17 nt, Pseudomonas aeruginosa PA01
cucaugccguugcccuc

SEQ ID NO: 1429501 - RNA, 15 nt, Pseudomonas aeruginosa PA01
cucaugaccgccgcu

SEQ ID NO: 1429502 - RNA, 12 nt, Pseudomonas aeruginosa PA01
cucauccgcgag

SEQ ID NO: 1429503 - RNA, 22 nt, Pseudomonas aeruginosa PA01
cucaucgcguagguggcgccgc

SEQ ID NO: 1429504 - RNA, 23 nt, Pseudomonas aeruginosa PA01
cucaucgcguagguggcgccgcc

SEQ ID NO: 1429505 - RNA, 24 nt, Pseudomonas aeruginosa PA01
cucaucgcguagguggcgccgccg

SEQ ID NO: 1429506 - RNA, 13 nt, Pseudomonas aeruginosa PA01
cucauaggucagg

SEQ ID NO: 1429507 - RNA, 17 nt, Pseudomonas aeruginosa PA01
cucaucaggcugccgag

SEQ ID NO: 1429508 - RNA, 18 nt, Pseudomonas aeruginosa PA01
cucaucaggcugccgagc

SEQ ID NO: 1429509 - RNA, 19 nt, Pseudomonas aeruginosa PA01
cucagucgcccccaccgcc

SEQ ID NO: 1429510 - RNA, 15 nt, Pseudomonas aeruginosa PA01
cucagugcgccgggu

SEQ ID NO: 1429511 - RNA, 16 nt, Pseudomonas aeruginosa PA01
cucaguucggccagcg

SEQ ID NO: 1429512 - RNA, 14 nt, Pseudomonas aeruginosa PA01
cucaggugauggcg

SEQ ID NO: 1429513 - RNA, 23 nt, Pseudomonas aeruginosa PA01
cucaggucggucgaacugaccac

SEQ ID NO: 1429514 - RNA, 17 nt, Pseudomonas aeruginosa PA01
cucaggguggucgauga

SEQ ID NO: 1429515 - RNA, 20 nt, Pseudomonas aeruginosa PA01
cucagcggcggugcgccggc

SEQ ID NO: 1429516 - RNA, 21 nt, Pseudomonas aeruginosa PA01
cucagcggcggugcgccggcg

SEQ ID NO: 1429517 - RNA, 22 nt, Pseudomonas aeruginosa PA01
cucagcggcggugcgccggcgg

SEQ ID NO: 1429518 - RNA, 13 nt, Pseudomonas aeruginosa PA01
cucagcggcccag

SEQ ID NO: 1429519 - RNA, 17 nt, Pseudomonas aeruginosa PA01
cucagcggcccagcgcc

SEQ ID NO: 1429520 - RNA, 22 nt, Pseudomonas aeruginosa PA01
cucagcggcccagcgccccgcc

SEQ ID NO: 1429521 - RNA, 16 nt, Pseudomonas aeruginosa PA01
cucagcgcggcggcgg

SEQ ID NO: 1429522 - RNA, 21 nt, Pseudomonas aeruginosa PA01
cucagcgcggcggcggccgca

SEQ ID NO: 1429523 - RNA, 15 nt, Pseudomonas aeruginosa PA01
cucagcgcuucucgg

SEQ ID NO: 1429524 - RNA, 18 nt, Pseudomonas aeruginosa PA01
cucagcgcgcucggccug

SEQ ID NO: 1429525 - RNA, 23 nt, Pseudomonas aeruginosa PA01
cucagcgcgccgaguucgccgcg

SEQ ID NO: 1429526 - RNA, 20 nt, Pseudomonas aeruginosa PA01
cucaggggccgacgcgcugc

SEQ ID NO: 1429527 - RNA, 23 nt, Pseudomonas aeruginosa PA01
cucaggcugugcaggaaggcgac

SEQ ID NO: 1429528 - RNA, 21 nt, Pseudomonas aeruginosa PA01
cucagggaagaugcacaccag

SEQ ID NO: 1429529 - RNA, 16 nt, Pseudomonas aeruginosa PA01
cucagggccgcgccga

SEQ ID NO: 1429530 - RNA, 23 nt, Pseudomonas aeruginosa PA01
cucagggccgcgccgagccggcu

SEQ ID NO: 1429531 - RNA, 18 nt, Pseudomonas aeruginosa PA01
cucagggcgcgaaguagc

SEQ ID NO: 1429532 - RNA, 15 nt, Pseudomonas aeruginosa PA01
cucagcgggccgauc

SEQ ID NO: 1429533 - RNA, 21 nt, Pseudomonas aeruginosa PA01
cucagcgggccgauccgcgaa

SEQ ID NO: 1429534 - RNA, 15 nt, Pseudomonas aeruginosa PA01
cucagcgggcgcggu

SEQ ID NO: 1429535 - RNA, 21 nt, Pseudomonas aeruginosa PA01
cucagcggccuucgacgaugc

SEQ ID NO: 1429536 - RNA, 16 nt, Pseudomonas aeruginosa PA01
cucagccucacccugc

SEQ ID NO: 1429537 - RNA, 19 nt, Pseudomonas aeruginosa PA01
cucagccucacccugcugg

SEQ ID NO: 1429538 - RNA, 18 nt, Pseudomonas aeruginosa PA01
cucagcgaaacucgugcu

SEQ ID NO: 1429539 - RNA, 12 nt, Pseudomonas aeruginosa PA01
cucagcgccggu

SEQ ID NO: 1429540 - RNA, 12 nt, Pseudomonas aeruginosa PA01
cucagcgcgaca

SEQ ID NO: 1429541 - RNA, 18 nt, Pseudomonas aeruginosa PA01
cucagcgcgacaggcugg

SEQ ID NO: 1429542 - RNA, 22 nt, Pseudomonas aeruginosa PA01
cucagccgaggucgccgccagc

SEQ ID NO: 1429543 - RNA, 18 nt, Pseudomonas aeruginosa PA01
cucagccgcuggcgucga

SEQ ID NO: 1429544 - RNA, 13 nt, Pseudomonas aeruginosa PA01
cucagccggcgcu

SEQ ID NO: 1429545 - RNA, 13 nt, Pseudomonas aeruginosa PA01
cucccucgccgac

SEQ ID NO: 1429546 - RNA, 14 nt, Pseudomonas aeruginosa PA01
cucccucgccgacc

SEQ ID NO: 1429547 - RNA, 14 nt, Pseudomonas aeruginosa PA01
cucccggcucgccg

SEQ ID NO: 1429548 - RNA, 15 nt, Pseudomonas aeruginosa PA01
cucccggcucgccga

SEQ ID NO: 1429549 - RNA, 15 nt, Pseudomonas aeruginosa PA01
cucccggcuggucag

SEQ ID NO: 1429550 - RNA, 17 nt, Pseudomonas aeruginosa PA01
cucccugccgcccuucg

SEQ ID NO: 1429551 - RNA, 14 nt, Pseudomonas aeruginosa PA01
cucccugcucgcgc

SEQ ID NO: 1429552 - RNA, 16 nt, Pseudomonas aeruginosa PA01
cucccguaccagcgcg

SEQ ID NO: 1429553 - RNA, 14 nt, Pseudomonas aeruginosa PA01
cucccgcgccagcg

SEQ ID NO: 1429554 - RNA, 18 nt, Pseudomonas aeruginosa PA01
cucccgcgccagcgccgc

SEQ ID NO: 1429555 - RNA, 14 nt, Pseudomonas aeruginosa PA01
cucccgcgccagcu

SEQ ID NO: 1429556 - RNA, 20 nt, Pseudomonas aeruginosa PA01
cucccgcgccagcucgaaca

SEQ ID NO: 1429557 - RNA, 19 nt, Pseudomonas aeruginosa PA01
cucccgcgauucgccgggc

SEQ ID NO: 1429558 - RNA, 14 nt, Pseudomonas aeruginosa PA01
cucccgcaggcgcu

SEQ ID NO: 1429559 - RNA, 22 nt, Pseudomonas aeruginosa PA01
cucccgcaggcgcuucagcgcc

SEQ ID NO: 1429560 - RNA, 23 nt, Pseudomonas aeruginosa PA01
cucccgcaggcgcuucagcgccu

SEQ ID NO: 1429561 - RNA, 22 nt, Pseudomonas aeruginosa PA01
cuccgaagggaacccgcggcgc

SEQ ID NO: 1429562 - RNA, 20 nt, Pseudomonas aeruginosa PA01
cuccgagacgcugcaccgcg

SEQ ID NO: 1429563 - RNA, 22 nt, Pseudomonas aeruginosa PA01
cuccgacgcgucguccgaggcg

SEQ ID NO: 1429564 - RNA, 19 nt, Pseudomonas aeruginosa PA01
cuccgcaucuucugcgcgu

SEQ ID NO: 1429565 - RNA, 14 nt, Pseudomonas aeruginosa PA01
cuccgccagcacca

SEQ ID NO: 1429566 - RNA, 19 nt, Pseudomonas aeruginosa PA01
cuccgccagcaccacccgg

SEQ ID NO: 1429567 - RNA, 21 nt, Pseudomonas aeruginosa PA01
cuccgccagcaccacccggcc

SEQ ID NO: 1429568 - RNA, 16 nt, Pseudomonas aeruginosa PA01
cuccgccagccagccg

SEQ ID NO: 1429569 - RNA, 23 nt, Pseudomonas aeruginosa PA01
cuccgccagccagccgcgcgccg

SEQ ID NO: 1429570 - RNA, 17 nt, Pseudomonas aeruginosa PA01
cuccgccagccccaggc

SEQ ID NO: 1429571 - RNA, 21 nt, Pseudomonas aeruginosa PA01
cuccgccagcuuguccgccgg

SEQ ID NO: 1429572 - RNA, 13 nt, Pseudomonas aeruginosa PA01
cuccgccaggacc

SEQ ID NO: 1429573 - RNA, 18 nt, Pseudomonas aeruginosa PA01
cuccgccaggaccuccug

SEQ ID NO: 1429574 - RNA, 17 nt, Pseudomonas aeruginosa PA01
cuccgccaggccgcgca

SEQ ID NO: 1429575 - RNA, 14 nt, Pseudomonas aeruginosa PA01
cuccgccaggcgcu

SEQ ID NO: 1429576 - RNA, 17 nt, Pseudomonas aeruginosa PA01
cuccgccaggcggccga

SEQ ID NO: 1429577 - RNA, 20 nt, Pseudomonas aeruginosa PA01
cuccgccaggucgaucccca

SEQ ID NO: 1429578 - RNA, 17 nt, Pseudomonas aeruginosa PA01
cuccgaugaagcaggcg

SEQ ID NO: 1429579 - RNA, 21 nt, Pseudomonas aeruginosa PA01
cuccgaugaagcaggcggagu

SEQ ID NO: 1429580 - RNA, 21 nt, Pseudomonas aeruginosa PA01
cuccgagggaggaggcgccgg

SEQ ID NO: 1429581 - RNA, 16 nt, Pseudomonas aeruginosa PA01
cuccagcaaugccagc

SEQ ID NO: 1429582 - RNA, 17 nt, Pseudomonas aeruginosa PA01
cuccagcaaugccagcg

SEQ ID NO: 1429583 - RNA, 20 nt, Pseudomonas aeruginosa PA01
cuccagcaaugccagcgcca

SEQ ID NO: 1429584 - RNA, 13 nt, Pseudomonas aeruginosa PA01
cuccagcaagccg

SEQ ID NO: 1429585 - RNA, 15 nt, Pseudomonas aeruginosa PA01
cuccagaucgccguu

SEQ ID NO: 1429586 - RNA, 20 nt, Pseudomonas aeruginosa PA01
cuccagcaccgccuggcgca

SEQ ID NO: 1429587 - RNA, 17 nt, Pseudomonas aeruginosa PA01
cuccagcaccggcggcg

SEQ ID NO: 1429588 - RNA, 18 nt, Pseudomonas aeruginosa PA01
cuccagcaccggcggcgc

SEQ ID NO: 1429589 - RNA, 20 nt, Pseudomonas aeruginosa PA01
cuccagcaccggcggcgcca

SEQ ID NO: 1429590 - RNA, 22 nt, Pseudomonas aeruginosa PA01
cuccagcaccggcggcgccagg

SEQ ID NO: 1429591 - RNA, 17 nt, Pseudomonas aeruginosa PA01
cuccagcaccagcacgc

SEQ ID NO: 1429592 - RNA, 18 nt, Pseudomonas aeruginosa PA01
cuccagcaccagcacgcc

SEQ ID NO: 1429593 - RNA, 13 nt, Pseudomonas aeruginosa PA01
cuccagcagcgca

SEQ ID NO: 1429594 - RNA, 18 nt, Pseudomonas aeruginosa PA01
cuccagcagcgcacgcuu

SEQ ID NO: 1429595 - RNA, 18 nt, Pseudomonas aeruginosa PA01
cuccagcaguucgucgcc

SEQ ID NO: 1429596 - RNA, 16 nt, Pseudomonas aeruginosa PA01
cuccagccaggcccgg

SEQ ID NO: 1429597 - RNA, 22 nt, Pseudomonas aeruginosa PA01
cuccagccccacuggaagaagg

SEQ ID NO: 1429598 - RNA, 22 nt, Pseudomonas aeruginosa PA01
cuccagccccgcgauugcagcu

SEQ ID NO: 1429599 - RNA, 16 nt, Pseudomonas aeruginosa PA01
cuccagcaggaccugg

SEQ ID NO: 1429600 - RNA, 11 nt, Pseudomonas aeruginosa PA01
cuccagcaggg

SEQ ID NO: 1429601 - RNA, 17 nt, Pseudomonas aeruginosa PA01
cuccagcagggccagcg

SEQ ID NO: 1429602 - RNA, 16 nt, Pseudomonas aeruginosa PA01
cuccccgccgccaggc

SEQ ID NO: 1429603 - RNA, 15 nt, Pseudomonas aeruginosa PA01
cucccccagcgggcg

SEQ ID NO: 1429604 - RNA, 21 nt, Pseudomonas aeruginosa PA01
cucccccagcgggcggucgcg

SEQ ID NO: 1429605 - RNA, 20 nt, Pseudomonas aeruginosa PA01
cucccgaggcgaucgccgcg

SEQ ID NO: 1429606 - RNA, 20 nt, Pseudomonas aeruginosa PA01
cucccgaguucaccaccccg

SEQ ID NO: 1429607 - RNA, 13 nt, Pseudomonas aeruginosa PA01
cuccagccggcaa

SEQ ID NO: 1429608 - RNA, 23 nt, Pseudomonas aeruginosa PA01
cuccagccggccauccagccagg

SEQ ID NO: 1429609 - RNA, 15 nt, Pseudomonas aeruginosa PA01
cuccagccggcgacg

SEQ ID NO: 1429610 - RNA, 22 nt, Pseudomonas aeruginosa PA01
cuccagccgggcuccgccgcga

SEQ ID NO: 1429611 - RNA, 21 nt, Pseudomonas aeruginosa PA01
cuccagcgaauggacaggcgc

SEQ ID NO: 1429612 - RNA, 13 nt, Pseudomonas aeruginosa PA01
cuccagccgcugc

SEQ ID NO: 1429613 - RNA, 20 nt, Pseudomonas aeruginosa PA01
cuccagcgccgcauuggcca

SEQ ID NO: 1429614 - RNA, 22 nt, Pseudomonas aeruginosa PA01
cuccagcgccgcauuggccagg

SEQ ID NO: 1429615 - RNA, 14 nt, Pseudomonas aeruginosa PA01
cuccagcgccgcca

SEQ ID NO: 1429616 - RNA, 16 nt, Pseudomonas aeruginosa PA01
cuccagcauccagcga

SEQ ID NO: 1429617 - RNA, 15 nt, Pseudomonas aeruginosa PA01
cuccagcgccgccag

SEQ ID NO: 1429618 - RNA, 18 nt, Pseudomonas aeruginosa PA01
cuccccacucggccagca

SEQ ID NO: 1429619 - RNA, 15 nt, Pseudomonas aeruginosa PA01
cguucggaucggccc

SEQ ID NO: 1429620 - RNA, 19 nt, Pseudomonas aeruginosa PA01
cguucggaucggcccggcg

SEQ ID NO: 1429621 - RNA, 15 nt, Pseudomonas aeruginosa PA01
cguucgucguggcca

SEQ ID NO: 1429622 - RNA, 17 nt, Pseudomonas aeruginosa PA01
cguucucauugcgccgc

SEQ ID NO: 1429623 - RNA, 18 nt, Pseudomonas aeruginosa PA01
cguucucauugcgccgcc

SEQ ID NO: 1429624 - RNA, 18 nt, Pseudomonas aeruginosa PA01
cguucucggccagguacu

SEQ ID NO: 1429625 - RNA, 17 nt, Pseudomonas aeruginosa PA01
cguucucguccucggcg

SEQ ID NO: 1429626 - RNA, 21 nt, Pseudomonas aeruginosa PA01
cguucuccaggucgaacagcg

SEQ ID NO: 1429627 - RNA, 15 nt, Pseudomonas aeruginosa PA01
cguucucccgcgcgc

SEQ ID NO: 1429628 - RNA, 14 nt, Pseudomonas aeruginosa PA01
cguucucccugagc

SEQ ID NO: 1429629 - RNA, 17 nt, Pseudomonas aeruginosa PA01
cguucugccgcagcgcc

SEQ ID NO: 1429630 - RNA, 19 nt, Pseudomonas aeruginosa PA01
cguucugccgcagcgccuc

SEQ ID NO: 1429631 - RNA, 16 nt, Pseudomonas aeruginosa PA01
cguugagcaucaccgc

SEQ ID NO: 1429632 - RNA, 17 nt, Pseudomonas aeruginosa PA01
cguugagcaccucgacc

SEQ ID NO: 1429633 - RNA, 22 nt, Pseudomonas aeruginosa PA01
cguugcaggcacggaagcgcug

SEQ ID NO: 1429634 - RNA, 13 nt, Pseudomonas aeruginosa PA01
cguugcaggucga

SEQ ID NO: 1429635 - RNA, 17 nt, Pseudomonas aeruginosa PA01
cguugcagugcgccgca

SEQ ID NO: 1429636 - RNA, 19 nt, Pseudomonas aeruginosa PA01
cguugcauguccucggcgc

SEQ ID NO: 1429637 - RNA, 15 nt, Pseudomonas aeruginosa PA01
cguugcacgcaggcc

SEQ ID NO: 1429638 - RNA, 21 nt, Pseudomonas aeruginosa PA01
cguugcacgcaggccgcugcc

SEQ ID NO: 1429639 - RNA, 15 nt, Pseudomonas aeruginosa PA01
cguugcagcgccugu

SEQ ID NO: 1429640 - RNA, 23 nt, Pseudomonas aeruginosa PA01
cguugcagcgccuguuccagggc

SEQ ID NO: 1429641 - RNA, 18 nt, Pseudomonas aeruginosa PA01
cguugcagcgucuguacc

SEQ ID NO: 1429642 - RNA, 21 nt, Pseudomonas aeruginosa PA01
cguugaguucgaagcgccagg

SEQ ID NO: 1429643 - RNA, 20 nt, Pseudomonas aeruginosa PA01
cguugaggccgucgaagugg

SEQ ID NO: 1429644 - RNA, 12 nt, Pseudomonas aeruginosa PA01
cguuggccaggc

SEQ ID NO: 1429645 - RNA, 14 nt, Pseudomonas aeruginosa PA01
cguuggccaggcgc

SEQ ID NO: 1429646 - RNA, 16 nt, Pseudomonas aeruginosa PA01
cguuggccaggcgcga

SEQ ID NO: 1429647 - RNA, 15 nt, Pseudomonas aeruginosa PA01
cguuggccagcaggc

SEQ ID NO: 1429648 - RNA, 17 nt, Pseudomonas aeruginosa PA01
cguuggccagcaggcgc

SEQ ID NO: 1429649 - RNA, 23 nt, Pseudomonas aeruginosa PA01
cguuggccagcgccaccagcagg

SEQ ID NO: 1429650 - RNA, 23 nt, Pseudomonas aeruginosa PA01
cguugcugugcugcaccagcagg

SEQ ID NO: 1429651 - RNA, 15 nt, Pseudomonas aeruginosa PA01
cguugcuccugcggc

SEQ ID NO: 1429652 - RNA, 22 nt, Pseudomonas aeruginosa PA01
cguugcuccugcggcuggcgaa

SEQ ID NO: 1429653 - RNA, 19 nt, Pseudomonas aeruginosa PA01
cguugcucgcaccaggcca

SEQ ID NO: 1429654 - RNA, 20 nt, Pseudomonas aeruginosa PA01
cguugcucgcaccaggccag

SEQ ID NO: 1429655 - RNA, 15 nt, Pseudomonas aeruginosa PA01
cguugcugcccuggc

SEQ ID NO: 1429656 - RNA, 22 nt, Pseudomonas aeruginosa PA01
cguugcugcccuggcgcgcgcc

SEQ ID NO: 1429657 - RNA, 23 nt, Pseudomonas aeruginosa PA01
cguugcccaccgaauccuugauc

SEQ ID NO: 1429658 - RNA, 15 nt, Pseudomonas aeruginosa PA01
cguugcccagcccca

SEQ ID NO: 1429659 - RNA, 20 nt, Pseudomonas aeruginosa PA01
cguugccauagccgacgaag

SEQ ID NO: 1429660 - RNA, 18 nt, Pseudomonas aeruginosa PA01
cguugccauccagcgccu

SEQ ID NO: 1429661 - RNA, 13 nt, Pseudomonas aeruginosa PA01
cguugcgccgcuc

SEQ ID NO: 1429662 - RNA, 22 nt, Pseudomonas aeruginosa PA01
cguugcgccgcuccuggcaggc

SEQ ID NO: 1429663 - RNA, 23 nt, Pseudomonas aeruginosa PA01
cguugcgccgcuccuggcaggcu

SEQ ID NO: 1429664 - RNA, 21 nt, Pseudomonas aeruginosa PA01
cguugcgccggcccagcaggc

SEQ ID NO: 1429665 - RNA, 22 nt, Pseudomonas aeruginosa PA01
cguugcgccggcccagcaggcc

SEQ ID NO: 1429666 - RNA, 17 nt, Pseudomonas aeruginosa PA01
cguugcgccucgccgcc

SEQ ID NO: 1429667 - RNA, 16 nt, Pseudomonas aeruginosa PA01
cguugccagccggccu

SEQ ID NO: 1429668 - RNA, 12 nt, Pseudomonas aeruginosa PA01
cguugcgccccg

SEQ ID NO: 1429669 - RNA, 18 nt, Pseudomonas aeruginosa PA01
cguugcgcgagcaccgcg

SEQ ID NO: 1429670 - RNA, 22 nt, Pseudomonas aeruginosa PA01
cguugcgcgagcaccgcgcaga

SEQ ID NO: 1429671 - RNA, 23 nt, Pseudomonas aeruginosa PA01
cguugcgcgagcaccgcgcagac

SEQ ID NO: 1429672 - RNA, 16 nt, Pseudomonas aeruginosa PA01
cguugcgcgccagcgc

SEQ ID NO: 1429673 - RNA, 22 nt, Pseudomonas aeruginosa PA01
cguugcgcgccagcgccacggc

SEQ ID NO: 1429674 - RNA, 14 nt, Pseudomonas aeruginosa PA01
cguugcgcggcagg

SEQ ID NO: 1429675 - RNA, 14 nt, Pseudomonas aeruginosa PA01
cguugcggaaagcg

SEQ ID NO: 1429676 - RNA, 14 nt, Pseudomonas aeruginosa PA01
cguugcggaacgcg

SEQ ID NO: 1429677 - RNA, 20 nt, Pseudomonas aeruginosa PA01
cguugcgcuaucggcccggg

SEQ ID NO: 1429678 - RNA, 17 nt, Pseudomonas aeruginosa PA01
cguugcgccgcagcaag

SEQ ID NO: 1429679 - RNA, 17 nt, Pseudomonas aeruginosa PA01
cguugcgccgcagcggc

SEQ ID NO: 1429680 - RNA, 20 nt, Pseudomonas aeruginosa PA01
cguucgccgaaauagcgcgc

SEQ ID NO: 1429681 - RNA, 21 nt, Pseudomonas aeruginosa PA01
cguucgccgaaauagcgcgcc

SEQ ID NO: 1429682 - RNA, 18 nt, Pseudomonas aeruginosa PA01
cguucgccggccuccagc

SEQ ID NO: 1429683 - RNA, 15 nt, Pseudomonas aeruginosa PA01
cguucgcgcgaggcg

SEQ ID NO: 1429684 - RNA, 23 nt, Pseudomonas aeruginosa PA01
cguucgcggucggugagcacgcc

SEQ ID NO: 1429685 - RNA, 21 nt, Pseudomonas aeruginosa PA01
cguucgacgccuugcccggcg

SEQ ID NO: 1429686 - RNA, 24 nt, Pseudomonas aeruginosa PA01
cguucgaaucuucguaggucaugc

SEQ ID NO: 1429687 - RNA, 18 nt, Pseudomonas aeruginosa PA01
cguucgaucuccucgcgc

SEQ ID NO: 1429688 - RNA, 14 nt, Pseudomonas aeruginosa PA01
cguucgcccagacc

SEQ ID NO: 1429689 - RNA, 12 nt, Pseudomonas aeruginosa PA01
cguucgccgagc

SEQ ID NO: 1429690 - RNA, 13 nt, Pseudomonas aeruginosa PA01
cguucgccgaggc

SEQ ID NO: 1429691 - RNA, 14 nt, Pseudomonas aeruginosa PA01
cguucgccgaggcg

SEQ ID NO: 1429692 - RNA, 16 nt, Pseudomonas aeruginosa PA01
cguucgcccgcggcgg

SEQ ID NO: 1429693 - RNA, 17 nt, Pseudomonas aeruginosa PA01
cguucgcccgcggcggc

SEQ ID NO: 1429694 - RNA, 16 nt, Pseudomonas aeruginosa PA01
cguuccuugcgcggca

SEQ ID NO: 1429695 - RNA, 20 nt, Pseudomonas aeruginosa PA01
cguuccuuuuccucgaucag

SEQ ID NO: 1429696 - RNA, 14 nt, Pseudomonas aeruginosa PA01
cguucccagcagcg

SEQ ID NO: 1429697 - RNA, 17 nt, Pseudomonas aeruginosa PA01
cguucccagcagcgccu

SEQ ID NO: 1429698 - RNA, 13 nt, Pseudomonas aeruginosa PA01
cguuccuccucgu

SEQ ID NO: 1429699 - RNA, 16 nt, Pseudomonas aeruginosa PA01
cguuccaggcggcgga

SEQ ID NO: 1429700 - RNA, 16 nt, Pseudomonas aeruginosa PA01
cguuccaccgccugga

SEQ ID NO: 1429701 - RNA, 16 nt, Pseudomonas aeruginosa PA01
cguuccaccuggcgca

SEQ ID NO: 1429702 - RNA, 18 nt, Pseudomonas aeruginosa PA01
cguuccaguacacccagg

SEQ ID NO: 1429703 - RNA, 13 nt, Pseudomonas aeruginosa PA01
cguuccaguucgg

SEQ ID NO: 1429704 - RNA, 16 nt, Pseudomonas aeruginosa PA01
cguuccaguucggccg

SEQ ID NO: 1429705 - RNA, 21 nt, Pseudomonas aeruginosa PA01
cguuccacgggucgcagccga

SEQ ID NO: 1429706 - RNA, 22 nt, Pseudomonas aeruginosa PA01
cguuccacgggucgcagccgag

SEQ ID NO: 1429707 - RNA, 19 nt, Pseudomonas aeruginosa PA01
cguuccagcgccucgggcc

SEQ ID NO: 1429708 - RNA, 17 nt, Pseudomonas aeruginosa PA01
cguucagugccagcaga

SEQ ID NO: 1429709 - RNA, 14 nt, Pseudomonas aeruginosa PA01
cguucaucgucggc

SEQ ID NO: 1429710 - RNA, 16 nt, Pseudomonas aeruginosa PA01
cguucaucgucggcag

SEQ ID NO: 1429711 - RNA, 13 nt, Pseudomonas aeruginosa PA01
cgugucggcggcg

SEQ ID NO: 1429712 - RNA, 17 nt, Pseudomonas aeruginosa PA01
cgugugccugagcuggc

SEQ ID NO: 1429713 - RNA, 20 nt, Pseudomonas aeruginosa PA01
cgugugccugagcuggcugu

SEQ ID NO: 1429714 - RNA, 16 nt, Pseudomonas aeruginosa PA01
cguuauccgccccacc

SEQ ID NO: 1429715 - RNA, 21 nt, Pseudomonas aeruginosa PA01
cguucaguucugggcggccag

SEQ ID NO: 1429716 - RNA, 13 nt, Pseudomonas aeruginosa PA01
cguucaguugccu

SEQ ID NO: 1429717 - RNA, 20 nt, Pseudomonas aeruginosa PA01
cguuaccgcgggcucaggcu

SEQ ID NO: 1429718 - RNA, 18 nt, Pseudomonas aeruginosa PA01
cguggauauugugcgaga

SEQ ID NO: 1429719 - RNA, 15 nt, Pseudomonas aeruginosa PA01
cguggaucgcccggc

SEQ ID NO: 1429720 - RNA, 17 nt, Pseudomonas aeruginosa PA01
aaccgcagacuccggcg

SEQ ID NO: 1429721 - RNA, 20 nt, Pseudomonas aeruginosa PA01
cgugcuuggcgaggcgcgcc

SEQ ID NO: 1429722 - RNA, 17 nt, Pseudomonas aeruginosa PA01
cgugcuuggugucggcc

SEQ ID NO: 1429723 - RNA, 20 nt, Pseudomonas aeruginosa PA01
cgugcuuggugucggccgcc

SEQ ID NO: 1429724 - RNA, 21 nt, Pseudomonas aeruginosa PA01
cgugcuuacggagaagggcgc

SEQ ID NO: 1429725 - RNA, 18 nt, Pseudomonas aeruginosa PA01
cgugcuugcagucgcgga

SEQ ID NO: 1429726 - RNA, 22 nt, Pseudomonas aeruginosa PA01
cguggcaggugacgcagggcgg

SEQ ID NO: 1429727 - RNA, 14 nt, Pseudomonas aeruginosa PA01
cguggccagcgaac

SEQ ID NO: 1429728 - RNA, 22 nt, Pseudomonas aeruginosa PA01
cguggccagcgaacccaggccg

SEQ ID NO: 1429729 - RNA, 14 nt, Pseudomonas aeruginosa PA01
cguggccagcgccc

SEQ ID NO: 1429730 - RNA, 18 nt, Pseudomonas aeruginosa PA01
cguggccagcgcccaggc

SEQ ID NO: 1429731 - RNA, 21 nt, Pseudomonas aeruginosa PA01
cguggccagcgcccaggccgg

SEQ ID NO: 1429732 - RNA, 21 nt, Pseudomonas aeruginosa PA01
cguggccauggguaucguuga

SEQ ID NO: 1429733 - RNA, 17 nt, Pseudomonas aeruginosa PA01
cguggauuucagcaggc

SEQ ID NO: 1429734 - RNA, 21 nt, Pseudomonas aeruginosa PA01
cguggauuucagcaggccgag

SEQ ID NO: 1429735 - RNA, 23 nt, Pseudomonas aeruginosa PA01
cguggcacguacguccagggcac

SEQ ID NO: 1429736 - RNA, 16 nt, Pseudomonas aeruginosa PA01
cguggcaccaggucgu

SEQ ID NO: 1429737 - RNA, 16 nt, Pseudomonas aeruginosa PA01
cguggcacccaggcca

SEQ ID NO: 1429738 - RNA, 19 nt, Pseudomonas aeruginosa PA01
cguggcacccaggccacgc

SEQ ID NO: 1429739 - RNA, 12 nt, Pseudomonas aeruginosa PA01
cguggcaggcgc

SEQ ID NO: 1429740 - RNA, 13 nt, Pseudomonas aeruginosa PA01
cguggcaggcgcc

SEQ ID NO: 1429741 - RNA, 16 nt, Pseudomonas aeruginosa PA01
cguggcaggcgcccgg

SEQ ID NO: 1429742 - RNA, 17 nt, Pseudomonas aeruginosa PA01
cguggcaggcgcccggu

SEQ ID NO: 1429743 - RNA, 20 nt, Pseudomonas aeruginosa PA01
cguggcaggcgcccggucag

SEQ ID NO: 1429744 - RNA, 22 nt, Pseudomonas aeruginosa PA01
cgugcggcacgcugcuugcgca

SEQ ID NO: 1429745 - RNA, 13 nt, Pseudomonas aeruginosa PA01
cgugcgcugcgcg

SEQ ID NO: 1429746 - RNA, 22 nt, Pseudomonas aeruginosa PA01
cgugcggaaaccgcggccggcu

SEQ ID NO: 1429747 - RNA, 15 nt, Pseudomonas aeruginosa PA01
cgugcggagggucag

SEQ ID NO: 1429748 - RNA, 21 nt, Pseudomonas aeruginosa PA01
cgugcggagggucaggccgag

SEQ ID NO: 1429749 - RNA, 14 nt, Pseudomonas aeruginosa PA01
cgugcuggccggca

SEQ ID NO: 1429750 - RNA, 16 nt, Pseudomonas aeruginosa PA01
cgugcuccucauggaa

SEQ ID NO: 1429751 - RNA, 22 nt, Pseudomonas aeruginosa PA01
cgugcuccucauggaacugcag

SEQ ID NO: 1429752 - RNA, 21 nt, Pseudomonas aeruginosa PA01
cgucucggagugaggccgagc

SEQ ID NO: 1429753 - RNA, 12 nt, Pseudomonas aeruginosa PA01
cgucucggcgaa

SEQ ID NO: 1429754 - RNA, 14 nt, Pseudomonas aeruginosa PA01
cgucucggcgaacg

SEQ ID NO: 1429755 - RNA, 22 nt, Pseudomonas aeruginosa PA01
cgugcgcuccgccaggccgcgc

SEQ ID NO: 1429756 - RNA, 13 nt, Pseudomonas aeruginosa PA01
cguggcccggcgc

SEQ ID NO: 1429757 - RNA, 19 nt, Pseudomonas aeruginosa PA01
cguggcccggcgcggcggc

SEQ ID NO: 1429758 - RNA, 23 nt, Pseudomonas aeruginosa PA01
cguggcccggcgcggcggccgcc

SEQ ID NO: 1429759 - RNA, 14 nt, Pseudomonas aeruginosa PA01
cguggccgccaggg

SEQ ID NO: 1429760 - RNA, 12 nt, Pseudomonas aeruginosa PA01
cguggccggcga

SEQ ID NO: 1429761 - RNA, 14 nt, Pseudomonas aeruginosa PA01
cguggccggcgagg

SEQ ID NO: 1429762 - RNA, 14 nt, Pseudomonas aeruginosa PA01
cguggcgucggcgc

SEQ ID NO: 1429763 - RNA, 15 nt, Pseudomonas aeruginosa PA01
cguggcgucggcgcu

SEQ ID NO: 1429764 - RNA, 14 nt, Pseudomonas aeruginosa PA01
cguggcucggcggc

SEQ ID NO: 1429765 - RNA, 15 nt, Pseudomonas aeruginosa PA01
cguggcucggcggca

SEQ ID NO: 1429766 - RNA, 18 nt, Pseudomonas aeruginosa PA01
cguggcucggcggcaggc

SEQ ID NO: 1429767 - RNA, 21 nt, Pseudomonas aeruginosa PA01
cguggcucgaucagccggcgc

SEQ ID NO: 1429768 - RNA, 23 nt, Pseudomonas aeruginosa PA01
cguggcucgaucagccggcgcgc

SEQ ID NO: 1429769 - RNA, 17 nt, Pseudomonas aeruginosa PA01
cguggcgugcucggcga

SEQ ID NO: 1429770 - RNA, 16 nt, Pseudomonas aeruginosa PA01
cguggcguucucgugu

SEQ ID NO: 1429771 - RNA, 13 nt, Pseudomonas aeruginosa PA01
cguggcuggcgcc

SEQ ID NO: 1429772 - RNA, 15 nt, Pseudomonas aeruginosa PA01
cgugggcgccggcgc

SEQ ID NO: 1429773 - RNA, 21 nt, Pseudomonas aeruginosa PA01
cgugggugccgggggcggcga

SEQ ID NO: 1429774 - RNA, 13 nt, Pseudomonas aeruginosa PA01
cgugggucgccuc

SEQ ID NO: 1429775 - RNA, 17 nt, Pseudomonas aeruginosa PA01
cgugggucgccucgaac

SEQ ID NO: 1429776 - RNA, 19 nt, Pseudomonas aeruginosa PA01
cguggggcggcgcagaucg

SEQ ID NO: 1429777 - RNA, 14 nt, Pseudomonas aeruginosa PA01
cgugggcggccggc

SEQ ID NO: 1429778 - RNA, 23 nt, Pseudomonas aeruginosa PA01
cgugggcguaguagggacggugc

SEQ ID NO: 1429779 - RNA, 18 nt, Pseudomonas aeruginosa PA01
cgugggcuucgccgccgc

SEQ ID NO: 1429780 - RNA, 21 nt, Pseudomonas aeruginosa PA01
cguguaaugacuccggucaag

SEQ ID NO: 1429781 - RNA, 23 nt, Pseudomonas aeruginosa PA01
cguguaccuggguugccgcgccg

SEQ ID NO: 1429782 - RNA, 14 nt, Pseudomonas aeruginosa PA01
cguguaggguucgc

SEQ ID NO: 1429783 - RNA, 17 nt, Pseudomonas aeruginosa PA01
cgugucgaggaaggcca

SEQ ID NO: 1429784 - RNA, 16 nt, Pseudomonas aeruginosa PA01
cgugucgaagccuucg

SEQ ID NO: 1429785 - RNA, 14 nt, Pseudomonas aeruginosa PA01
cgugguaucggcgc

SEQ ID NO: 1429786 - RNA, 20 nt, Pseudomonas aeruginosa PA01
cguggucagcaccagggcca

SEQ ID NO: 1429787 - RNA, 18 nt, Pseudomonas aeruginosa PA01
cgugguagucgagccgga

SEQ ID NO: 1429788 - RNA, 22 nt, Pseudomonas aeruginosa PA01
cgugguaccgcugcgugccagg

SEQ ID NO: 1429789 - RNA, 13 nt, Pseudomonas aeruginosa PA01
cguggucgccgcu

SEQ ID NO: 1429790 - RNA, 14 nt, Pseudomonas aeruginosa PA01
cguggucgccgcuc

SEQ ID NO: 1429791 - RNA, 14 nt, Pseudomonas aeruginosa PA01
cgugguccgccagc

SEQ ID NO: 1429792 - RNA, 15 nt, Pseudomonas aeruginosa PA01
cgugguccgccagca

SEQ ID NO: 1429793 - RNA, 18 nt, Pseudomonas aeruginosa PA01
cgugguccgccagcaggc

SEQ ID NO: 1429794 - RNA, 19 nt, Pseudomonas aeruginosa PA01
cgugguccgccagcaggcg

SEQ ID NO: 1429795 - RNA, 20 nt, Pseudomonas aeruginosa PA01
cguggucauggcgcagacga

SEQ ID NO: 1429796 - RNA, 20 nt, Pseudomonas aeruginosa PA01
cgugguccagcucggucagc

SEQ ID NO: 1429797 - RNA, 19 nt, Pseudomonas aeruginosa PA01
cuacagcccccccagcacg

SEQ ID NO: 1429798 - RNA, 15 nt, Pseudomonas aeruginosa PA01
cuacaucgucugcgc

SEQ ID NO: 1429799 - RNA, 19 nt, Pseudomonas aeruginosa PA01
cuacaucgucugcgcggcg

SEQ ID NO: 1429800 - RNA, 21 nt, Pseudomonas aeruginosa PA01
cuacccagguggucgaccagg

SEQ ID NO: 1429801 - RNA, 21 nt, Pseudomonas aeruginosa PA01
cuacccgacaggcagcgccgc

SEQ ID NO: 1429802 - RNA, 20 nt, Pseudomonas aeruginosa PA01
cuacccgagcaacugcucgg

SEQ ID NO: 1429803 - RNA, 16 nt, Pseudomonas aeruginosa PA01
cuaccagaccgcagcc

SEQ ID NO: 1429804 - RNA, 22 nt, Pseudomonas aeruginosa PA01
cuaccaguaguucuccaccgcc

SEQ ID NO: 1429805 - RNA, 22 nt, Pseudomonas aeruginosa PA01
cuaaggggcggcucggcuccag

SEQ ID NO: 1429806 - RNA, 18 nt, Pseudomonas aeruginosa PA01
cuaaggaaaaacccggcc

SEQ ID NO: 1429807 - RNA, 23 nt, Pseudomonas aeruginosa PA01
cuaaggaaaaacccggcccaggc

SEQ ID NO: 1429808 - RNA, 17 nt, Pseudomonas aeruginosa PA01
cuaccugucccggacga

SEQ ID NO: 1429809 - RNA, 16 nt, Pseudomonas aeruginosa PA01
cuacgcuccguagggc

SEQ ID NO: 1429810 - RNA, 13 nt, Pseudomonas aeruginosa PA01
cuacgcucgccga

SEQ ID NO: 1429811 - RNA, 15 nt, Pseudomonas aeruginosa PA01
cuacgcucggggugc

SEQ ID NO: 1429812 - RNA, 22 nt, Pseudomonas aeruginosa PA01
cuacgcucggggugcgcggcga

SEQ ID NO: 1429813 - RNA, 16 nt, Pseudomonas aeruginosa PA01
cuacggaaggucgccg

SEQ ID NO: 1429814 - RNA, 17 nt, Pseudomonas aeruginosa PA01
cuacgccuugcggcgcc

SEQ ID NO: 1429815 - RNA, 18 nt, Pseudomonas aeruginosa PA01
cuacgccuugcggcgccg

SEQ ID NO: 1429816 - RNA, 20 nt, Pseudomonas aeruginosa PA01
cuacgccuugcggcgccgag

SEQ ID NO: 1429817 - RNA, 18 nt, Pseudomonas aeruginosa PA01
cuacgcgaccggucaggc

SEQ ID NO: 1429818 - RNA, 11 nt, Pseudomonas aeruginosa PA01
cuacgccaccu

SEQ ID NO: 1429819 - RNA, 17 nt, Pseudomonas aeruginosa PA01
cuacgcaacccgcccgg

SEQ ID NO: 1429820 - RNA, 19 nt, Pseudomonas aeruginosa PA01
cuacgcaacccgcccggcu

SEQ ID NO: 1429821 - RNA, 16 nt, Pseudomonas aeruginosa PA01
cuacgaaagcgccuuc

SEQ ID NO: 1429822 - RNA, 15 nt, Pseudomonas aeruginosa PA01
cuacgaaagcggugc

SEQ ID NO: 1429823 - RNA, 14 nt, Pseudomonas aeruginosa PA01
cuaccugcgugcgc

SEQ ID NO: 1429824 - RNA, 23 nt, Pseudomonas aeruginosa PA01
cuaccgcgcauggcggcgaccgc

SEQ ID NO: 1429825 - RNA, 20 nt, Pseudomonas aeruginosa PA01
cuaccggcagggucacgccg

SEQ ID NO: 1429826 - RNA, 15 nt, Pseudomonas aeruginosa PA01
cuaccgucggccugc

SEQ ID NO: 1429827 - RNA, 16 nt, Pseudomonas aeruginosa PA01
cuaccgucggccugca

SEQ ID NO: 1429828 - RNA, 15 nt, Pseudomonas aeruginosa PA01
cuaccgccgagggcg

SEQ ID NO: 1429829 - RNA, 16 nt, Pseudomonas aeruginosa PA01
cuaccgccgagggcgc

SEQ ID NO: 1429830 - RNA, 14 nt, Pseudomonas aeruginosa PA01
cuaccgccagcgca

SEQ ID NO: 1429831 - RNA, 13 nt, Pseudomonas aeruginosa PA01
cuacccgcgcuuc

SEQ ID NO: 1429832 - RNA, 20 nt, Pseudomonas aeruginosa PA01
cuacccucuccccaaccuuc

SEQ ID NO: 1429833 - RNA, 15 nt, Pseudomonas aeruginosa PA01
cuagcgccccggccg

SEQ ID NO: 1429834 - RNA, 16 nt, Pseudomonas aeruginosa PA01
cuagcgccccggccgc

SEQ ID NO: 1429835 - RNA, 22 nt, Pseudomonas aeruginosa PA01
cuagcgccccggccgcgccagc

SEQ ID NO: 1429836 - RNA, 15 nt, Pseudomonas aeruginosa PA01
cuagcgcauggcgac

SEQ ID NO: 1429837 - RNA, 13 nt, Pseudomonas aeruginosa PA01
cuacugcgcgggc

SEQ ID NO: 1429838 - RNA, 16 nt, Pseudomonas aeruginosa PA01
cuacugcuggacggcg

SEQ ID NO: 1429839 - RNA, 23 nt, Pseudomonas aeruginosa PA01
cuacugggcguggcggccgccgg

SEQ ID NO: 1429840 - RNA, 17 nt, Pseudomonas aeruginosa PA01
cuacuugaucagccgca

SEQ ID NO: 1429841 - RNA, 20 nt, Pseudomonas aeruginosa PA01
cuaggcuggaagccgcgcuc

SEQ ID NO: 1429842 - RNA, 13 nt, Pseudomonas aeruginosa PA01
cuaggcgacccgg

SEQ ID NO: 1429843 - RNA, 16 nt, Pseudomonas aeruginosa PA01
cuaggcgacccggcau

SEQ ID NO: 1429844 - RNA, 21 nt, Pseudomonas aeruginosa PA01
cguuucagcgcuugcuggcgc

SEQ ID NO: 1429845 - RNA, 14 nt, Pseudomonas aeruginosa PA01
cguuuccaugcggu

SEQ ID NO: 1429846 - RNA, 14 nt, Pseudomonas aeruginosa PA01
cguuuccgcugucc

SEQ ID NO: 1429847 - RNA, 13 nt, Pseudomonas aeruginosa PA01
cguuuccggcagg

SEQ ID NO: 1429848 - RNA, 17 nt, Pseudomonas aeruginosa PA01
cguuuccggcaggcuca

SEQ ID NO: 1429849 - RNA, 14 nt, Pseudomonas aeruginosa PA01
cguuucgccgggcc

SEQ ID NO: 1429850 - RNA, 16 nt, Pseudomonas aeruginosa PA01
cguuucgaagccgccg

SEQ ID NO: 1429851 - RNA, 12 nt, Pseudomonas aeruginosa PA01
cguuucgacgau

SEQ ID NO: 1429852 - RNA, 16 nt, Pseudomonas aeruginosa PA01
cguuuagcgcccgacg

SEQ ID NO: 1429853 - RNA, 18 nt, Pseudomonas aeruginosa PA01
cguuuagcgcccgacggc

SEQ ID NO: 1429854 - RNA, 16 nt, Pseudomonas aeruginosa PA01
cguuuacgcgccaagg

SEQ ID NO: 1429855 - RNA, 14 nt, Pseudomonas aeruginosa PA01
cguuguccucggcg

SEQ ID NO: 1429856 - RNA, 16 nt, Pseudomonas aeruginosa PA01
cguuguccucggcggc

SEQ ID NO: 1429857 - RNA, 22 nt, Pseudomonas aeruginosa PA01
cguugucccugucccgccgcgc

SEQ ID NO: 1429858 - RNA, 18 nt, Pseudomonas aeruginosa PA01
cguugucggccagcagca

SEQ ID NO: 1429859 - RNA, 14 nt, Pseudomonas aeruginosa PA01
cguuguugaccgca

SEQ ID NO: 1429860 - RNA, 22 nt, Pseudomonas aeruginosa PA01
cguuguucuucgacgcugguca

SEQ ID NO: 1429861 - RNA, 14 nt, Pseudomonas aeruginosa PA01
cguuguggcggcgc

SEQ ID NO: 1429862 - RNA, 18 nt, Pseudomonas aeruginosa PA01
cguuguguagucauggcc

SEQ ID NO: 1429863 - RNA, 16 nt, Pseudomonas aeruginosa PA01
cguuguuggucaggcu

SEQ ID NO: 1429864 - RNA, 13 nt, Pseudomonas aeruginosa PA01
cguuguugccgcg

SEQ ID NO: 1429865 - RNA, 15 nt, Pseudomonas aeruginosa PA01
cguuguugccgcgca

SEQ ID NO: 1429866 - RNA, 19 nt, Pseudomonas aeruginosa PA01
cguuggcgacgacgggagc

SEQ ID NO: 1429867 - RNA, 20 nt, Pseudomonas aeruginosa PA01
cguuggccgucuccaggcgc

SEQ ID NO: 1429868 - RNA, 21 nt, Pseudomonas aeruginosa PA01
cguuggccuugaugccggcga

SEQ ID NO: 1429869 - RNA, 20 nt, Pseudomonas aeruginosa PA01
cguuggcgaacaaucggucg

SEQ ID NO: 1429870 - RNA, 23 nt, Pseudomonas aeruginosa PA01
cguuggcgaacaaucggucgccc

SEQ ID NO: 1429871 - RNA, 23 nt, Pseudomonas aeruginosa PA01
cguuggcgaacuucaggccggcg

SEQ ID NO: 1429872 - RNA, 20 nt, Pseudomonas aeruginosa PA01
cguuggcgaaguucccgccg

SEQ ID NO: 1429873 - RNA, 17 nt, Pseudomonas aeruginosa PA01
cguuggccgagcgcgag

SEQ ID NO: 1429874 - RNA, 18 nt, Pseudomonas aeruginosa PA01
cguuggccgagcgcgagu

SEQ ID NO: 1429875 - RNA, 20 nt, Pseudomonas aeruginosa PA01
cguuggccgaggaggccagc

SEQ ID NO: 1429876 - RNA, 14 nt, Pseudomonas aeruginosa PA01
cguuggcccagacc

SEQ ID NO: 1429877 - RNA, 12 nt, Pseudomonas aeruginosa PA01
cguuggccggcu

SEQ ID NO: 1429878 - RNA, 17 nt, Pseudomonas aeruginosa PA01
cguuggccggcugcucc

SEQ ID NO: 1429879 - RNA, 15 nt, Pseudomonas aeruginosa PA01
cguuggcgcgaccgc

SEQ ID NO: 1429880 - RNA, 13 nt, Pseudomonas aeruginosa PA01
cguuggcgcgggc

SEQ ID NO: 1429881 - RNA, 14 nt, Pseudomonas aeruginosa PA01
cguuggcggccagc

SEQ ID NO: 1429882 - RNA, 13 nt, Pseudomonas aeruginosa PA01
cguuggcggccau

SEQ ID NO: 1429883 - RNA, 14 nt, Pseudomonas aeruginosa PA01
cguuggcggccauc

SEQ ID NO: 1429884 - RNA, 20 nt, Pseudomonas aeruginosa PA01
cguuggcggccaucaggcgc

SEQ ID NO: 1429885 - RNA, 15 nt, Pseudomonas aeruginosa PA01
cguuggcggugccgc

SEQ ID NO: 1429886 - RNA, 20 nt, Pseudomonas aeruginosa PA01
cguuggcgucaacggugacg

SEQ ID NO: 1429887 - RNA, 17 nt, Pseudomonas aeruginosa PA01
cguuggcgugcucgcgc

SEQ ID NO: 1429888 - RNA, 18 nt, Pseudomonas aeruginosa PA01
cguuggcgugcucgcgca

SEQ ID NO: 1429889 - RNA, 16 nt, Pseudomonas aeruginosa PA01
cguuggcuccgggccg

SEQ ID NO: 1429890 - RNA, 15 nt, Pseudomonas aeruginosa PA01
cguugggccagggcc

SEQ ID NO: 1429891 - RNA, 18 nt, Pseudomonas aeruginosa PA01
cguugguacagcucgcgc

SEQ ID NO: 1429892 - RNA, 18 nt, Pseudomonas aeruginosa PA01
cguuguagcugaccacga

SEQ ID NO: 1429893 - RNA, 15 nt, Pseudomonas aeruginosa PA01
cguuguagagacaga

SEQ ID NO: 1429894 - RNA, 15 nt, Pseudomonas aeruginosa PA01
cguuguagaucggca

SEQ ID NO: 1429895 - RNA, 17 nt, Pseudomonas aeruginosa PA01
cguuguagaucggcagc

SEQ ID NO: 1429896 - RNA, 20 nt, Pseudomonas aeruginosa PA01
cguuguagaucugcaccgcc

SEQ ID NO: 1429897 - RNA, 14 nt, Pseudomonas aeruginosa PA01
cguuguacccggcg

SEQ ID NO: 1429898 - RNA, 22 nt, Pseudomonas aeruginosa PA01
cguuggugauguugcggucgau

SEQ ID NO: 1429899 - RNA, 17 nt, Pseudomonas aeruginosa PA01
cuaaccggcguccgggu

SEQ ID NO: 1429900 - RNA, 20 nt, Pseudomonas aeruginosa PA01
cguuuuuuuauccucgcgga

SEQ ID NO: 1429901 - RNA, 15 nt, Pseudomonas aeruginosa PA01
cguuuucccaggugg

SEQ ID NO: 1429902 - RNA, 18 nt, Pseudomonas aeruginosa PA01
cguuuucguugccgcgcu

SEQ ID NO: 1429903 - RNA, 20 nt, Pseudomonas aeruginosa PA01
cguuuucguuggcgcgaccg

SEQ ID NO: 1429904 - RNA, 16 nt, Pseudomonas aeruginosa PA01
cguuugucgaccugcc

SEQ ID NO: 1429905 - RNA, 18 nt, Pseudomonas aeruginosa PA01
cguuugcgucauccgccu

SEQ ID NO: 1429906 - RNA, 21 nt, Pseudomonas aeruginosa PA01
cguuugcucucaucccugugc

SEQ ID NO: 1429907 - RNA, 16 nt, Pseudomonas aeruginosa PA01
cguuucucagcgccgu

SEQ ID NO: 1429908 - RNA, 14 nt, Pseudomonas aeruginosa PA01
cggucgggcgggcg

SEQ ID NO: 1429909 - RNA, 16 nt, Pseudomonas aeruginosa PA01
cggucggccuugaggc

SEQ ID NO: 1429910 - RNA, 14 nt, Pseudomonas aeruginosa PA01
cggucggcucagcc

SEQ ID NO: 1429911 - RNA, 16 nt, Pseudomonas aeruginosa PA01
cggucggugagcacgc

SEQ ID NO: 1429912 - RNA, 15 nt, Pseudomonas aeruginosa PA01
cggucgguugcggcc

SEQ ID NO: 1429913 - RNA, 18 nt, Pseudomonas aeruginosa PA01
cggucgguugcggccuga

SEQ ID NO: 1429914 - RNA, 14 nt, Pseudomonas aeruginosa PA01
cggucgggugaagg

SEQ ID NO: 1429915 - RNA, 14 nt, Pseudomonas aeruginosa PA01
cggucguagcccau

SEQ ID NO: 1429916 - RNA, 17 nt, Pseudomonas aeruginosa PA01
cggucguagcccauggu

SEQ ID NO: 1429917 - RNA, 13 nt, Pseudomonas aeruginosa PA01
cggucgugcagca

SEQ ID NO: 1429918 - RNA, 15 nt, Pseudomonas aeruginosa PA01
cggucgugcagcagc

SEQ ID NO: 1429919 - RNA, 16 nt, Pseudomonas aeruginosa PA01
cggucgugcagcagcg

SEQ ID NO: 1429920 - RNA, 17 nt, Pseudomonas aeruginosa PA01
cggucgugcagcagcgc

SEQ ID NO: 1429921 - RNA, 18 nt, Pseudomonas aeruginosa PA01
cggucgugcagcagcgcc

SEQ ID NO: 1429922 - RNA, 19 nt, Pseudomonas aeruginosa PA01
cggucgugcagcagcgccu

SEQ ID NO: 1429923 - RNA, 15 nt, Pseudomonas aeruginosa PA01
cggucggccaggcgg

SEQ ID NO: 1429924 - RNA, 19 nt, Pseudomonas aeruginosa PA01
cggucggccaggcggccga

SEQ ID NO: 1429925 - RNA, 22 nt, Pseudomonas aeruginosa PA01
cggucggccaucuggcugccga

SEQ ID NO: 1429926 - RNA, 13 nt, Pseudomonas aeruginosa PA01
cggucggcgccuu

SEQ ID NO: 1429927 - RNA, 14 nt, Pseudomonas aeruginosa PA01
cggucggcgagggc

SEQ ID NO: 1429928 - RNA, 21 nt, Pseudomonas aeruginosa PA01
cggucggccuguucgcccaag

SEQ ID NO: 1429929 - RNA, 20 nt, Pseudomonas aeruginosa PA01
cggucggaaagcagggcgau

SEQ ID NO: 1429930 - RNA, 12 nt, Pseudomonas aeruginosa PA01
cggucggccagg

SEQ ID NO: 1429931 - RNA, 14 nt, Pseudomonas aeruginosa PA01
cggucgcgccccgc

SEQ ID NO: 1429932 - RNA, 21 nt, Pseudomonas aeruginosa PA01
cggucgcgccccgccaggagc

SEQ ID NO: 1429933 - RNA, 19 nt, Pseudomonas aeruginosa PA01
cggucgcgcucaggcgcag

SEQ ID NO: 1429934 - RNA, 21 nt, Pseudomonas aeruginosa PA01
cggucgcgcgggugcggcugg

SEQ ID NO: 1429935 - RNA, 23 nt, Pseudomonas aeruginosa PA01
cggucgcgcgggugcggcuggcg

SEQ ID NO: 1429936 - RNA, 21 nt, Pseudomonas aeruginosa PA01
cggucgcggggaauuuccggc

SEQ ID NO: 1429937 - RNA, 18 nt, Pseudomonas aeruginosa PA01
cggucgcuuuuuccgcug

SEQ ID NO: 1429938 - RNA, 21 nt, Pseudomonas aeruginosa PA01
cggucgcuuuuuccgcugccg

SEQ ID NO: 1429939 - RNA, 14 nt, Pseudomonas aeruginosa PA01
cggguaccugcucg

SEQ ID NO: 1429940 - RNA, 14 nt, Pseudomonas aeruginosa PA01
cggucgccggcgcg

SEQ ID NO: 1429941 - RNA, 16 nt, Pseudomonas aeruginosa PA01
cggucgccggcgcgca

SEQ ID NO: 1429942 - RNA, 15 nt, Pseudomonas aeruginosa PA01
cggucgcgcagcacc

SEQ ID NO: 1429943 - RNA, 14 nt, Pseudomonas aeruginosa PA01
cggguacagcgcca

SEQ ID NO: 1429944 - RNA, 15 nt, Pseudomonas aeruginosa PA01
cggguacagcgccac

SEQ ID NO: 1429945 - RNA, 14 nt, Pseudomonas aeruginosa PA01
cggguacuggcgcu

SEQ ID NO: 1429946 - RNA, 22 nt, Pseudomonas aeruginosa PA01
cggugacccacuccggcaggcg

SEQ ID NO: 1429947 - RNA, 23 nt, Pseudomonas aeruginosa PA01
cggugacccacuccggcaggcgc

SEQ ID NO: 1429948 - RNA, 13 nt, Pseudomonas aeruginosa PA01
cggugacccgcac

SEQ ID NO: 1429949 - RNA, 18 nt, Pseudomonas aeruginosa PA01
cggugacccgcacggcga

SEQ ID NO: 1429950 - RNA, 20 nt, Pseudomonas aeruginosa PA01
cggugacccgcacggcgacg

SEQ ID NO: 1429951 - RNA, 23 nt, Pseudomonas aeruginosa PA01
cggugaccaccuugauccgcgac

SEQ ID NO: 1429952 - RNA, 15 nt, Pseudomonas aeruginosa PA01
cggugacauucgaca

SEQ ID NO: 1429953 - RNA, 20 nt, Pseudomonas aeruginosa PA01
cggugacauucgacagcagg

SEQ ID NO: 1429954 - RNA, 12 nt, Pseudomonas aeruginosa PA01
cggugaccacca

SEQ ID NO: 1429955 - RNA, 18 nt, Pseudomonas aeruginosa PA01
cggugaccaccaggcggu

SEQ ID NO: 1429956 - RNA, 16 nt, Pseudomonas aeruginosa PA01
cggugacacccugccg

SEQ ID NO: 1429957 - RNA, 18 nt, Pseudomonas aeruginosa PA01
cggugacacccugccgcg

SEQ ID NO: 1429958 - RNA, 20 nt, Pseudomonas aeruginosa PA01
cggugacacccugccgcgcc

SEQ ID NO: 1429959 - RNA, 17 nt, Pseudomonas aeruginosa PA01
cggucuuggcgcgcgac

SEQ ID NO: 1429960 - RNA, 18 nt, Pseudomonas aeruginosa PA01
cggucuuggcggcgaucg

SEQ ID NO: 1429961 - RNA, 19 nt, Pseudomonas aeruginosa PA01
cggucuuggcggcgaucgc

SEQ ID NO: 1429962 - RNA, 16 nt, Pseudomonas aeruginosa PA01
cggugaaccaggcgcc

SEQ ID NO: 1429963 - RNA, 17 nt, Pseudomonas aeruginosa PA01
cggugaaccaggcgccg

SEQ ID NO: 1429964 - RNA, 17 nt, Pseudomonas aeruginosa PA01
cggugaaacggaucacg

SEQ ID NO: 1429965 - RNA, 23 nt, Pseudomonas aeruginosa PA01
cggugaaacggaucacgaucgcg

SEQ ID NO: 1429966 - RNA, 17 nt, Pseudomonas aeruginosa PA01
cggugaagguccgcgcc

SEQ ID NO: 1429967 - RNA, 18 nt, Pseudomonas aeruginosa PA01
cggugaagguccgcgcca

SEQ ID NO: 1429968 - RNA, 20 nt, Pseudomonas aeruginosa PA01
cggugaagguccgcgccaug

SEQ ID NO: 1429969 - RNA, 21 nt, Pseudomonas aeruginosa PA01
cggugaagguccgcgccaugc

SEQ ID NO: 1429970 - RNA, 21 nt, Pseudomonas aeruginosa PA01
cggugaaguagaucgcccgca

SEQ ID NO: 1429971 - RNA, 15 nt, Pseudomonas aeruginosa PA01
cggugaaggcgaagu

SEQ ID NO: 1429972 - RNA, 20 nt, Pseudomonas aeruginosa PA01
cggucucgcgcagcggcgga

SEQ ID NO: 1429973 - RNA, 14 nt, Pseudomonas aeruginosa PA01
cggucucgaucggc

SEQ ID NO: 1429974 - RNA, 15 nt, Pseudomonas aeruginosa PA01
cggucucgaucggcc

SEQ ID NO: 1429975 - RNA, 22 nt, Pseudomonas aeruginosa PA01
cggucucgaucggcccgggcgc

SEQ ID NO: 1429976 - RNA, 23 nt, Pseudomonas aeruginosa PA01
cggucucgauggcagccuuggcc

SEQ ID NO: 1429977 - RNA, 19 nt, Pseudomonas aeruginosa PA01
cggucucgccgccgagcag

SEQ ID NO: 1429978 - RNA, 16 nt, Pseudomonas aeruginosa PA01
cggucucagccggcgc

SEQ ID NO: 1429979 - RNA, 15 nt, Pseudomonas aeruginosa PA01
cggucucgaacgcca

SEQ ID NO: 1429980 - RNA, 18 nt, Pseudomonas aeruginosa PA01
cggucucgaacgccaggc

SEQ ID NO: 1429981 - RNA, 20 nt, Pseudomonas aeruginosa PA01
cggucucgaacgccaggcag

SEQ ID NO: 1429982 - RNA, 13 nt, Pseudomonas aeruginosa PA01
cggucuagccggg

SEQ ID NO: 1429983 - RNA, 14 nt, Pseudomonas aeruginosa PA01
cggucuagccgggc

SEQ ID NO: 1429984 - RNA, 15 nt, Pseudomonas aeruginosa PA01
cggucuagccgggcc

SEQ ID NO: 1429985 - RNA, 19 nt, Pseudomonas aeruginosa PA01
cggucuagcgccccggccg

SEQ ID NO: 1429986 - RNA, 21 nt, Pseudomonas aeruginosa PA01
cggucuagcgccccggccgcg

SEQ ID NO: 1429987 - RNA, 23 nt, Pseudomonas aeruginosa PA01
cggucuagcgccccggccgcgcc

SEQ ID NO: 1429988 - RNA, 14 nt, Pseudomonas aeruginosa PA01
cggucguucgcccu

SEQ ID NO: 1429989 - RNA, 18 nt, Pseudomonas aeruginosa PA01
cggucuugccggcugcgc

SEQ ID NO: 1429990 - RNA, 17 nt, Pseudomonas aeruginosa PA01
cggucuugcgcuugccg

SEQ ID NO: 1429991 - RNA, 20 nt, Pseudomonas aeruginosa PA01
cggucuugcgcuugccggcc

SEQ ID NO: 1429992 - RNA, 20 nt, Pseudomonas aeruginosa PA01
cggucuucccguaaggccag

SEQ ID NO: 1429993 - RNA, 16 nt, Pseudomonas aeruginosa PA01
cggucuucaucaccuu

SEQ ID NO: 1429994 - RNA, 20 nt, Pseudomonas aeruginosa PA01
cggucucggcgauguugcgc

SEQ ID NO: 1429995 - RNA, 12 nt, Pseudomonas aeruginosa PA01
cggucucggcgg

SEQ ID NO: 1429996 - RNA, 12 nt, Pseudomonas aeruginosa PA01
cggucugccagc

SEQ ID NO: 1429997 - RNA, 15 nt, Pseudomonas aeruginosa PA01
cggugccgccggcgc

SEQ ID NO: 1429998 - RNA, 16 nt, Pseudomonas aeruginosa PA01
cggugccgccggcgcc

SEQ ID NO: 1429999 - RNA, 17 nt, Pseudomonas aeruginosa PA01
cggugccgccggcgccg

SEQ ID NO: 1430000 - RNA, 20 nt, Pseudomonas aeruginosa PA01
cggugccgccggcgccgccg

SEQ ID NO: 1430001 - RNA, 13 nt, Pseudomonas aeruginosa PA01
cggugccgccggc

SEQ ID NO: 1430002 - RNA, 18 nt, Pseudomonas aeruginosa PA01
cggugccgccggccacca

SEQ ID NO: 1430003 - RNA, 23 nt, Pseudomonas aeruginosa PA01
cggugccgccggccaccagcagc

SEQ ID NO: 1430004 - RNA, 14 nt, Pseudomonas aeruginosa PA01
cggugccgccggcg

SEQ ID NO: 1430005 - RNA, 13 nt, Pseudomonas aeruginosa PA01
cggugccgcccgg

SEQ ID NO: 1430006 - RNA, 18 nt, Pseudomonas aeruginosa PA01
cggugccgcccggcgcca

SEQ ID NO: 1430007 - RNA, 19 nt, Pseudomonas aeruginosa PA01
cggugccgcccggcgccac

SEQ ID NO: 1430008 - RNA, 22 nt, Pseudomonas aeruginosa PA01
cggugccgcccggcgccaccgc

SEQ ID NO: 1430009 - RNA, 19 nt, Pseudomonas aeruginosa PA01
cggugccggucugguagcg

SEQ ID NO: 1430010 - RNA, 22 nt, Pseudomonas aeruginosa PA01
cggugccgucaugcacuucgac

SEQ ID NO: 1430011 - RNA, 13 nt, Pseudomonas aeruginosa PA01
cggugccggcggc

SEQ ID NO: 1430012 - RNA, 14 nt, Pseudomonas aeruginosa PA01
cggugccggcggcg

SEQ ID NO: 1430013 - RNA, 14 nt, Pseudomonas aeruginosa PA01
cggugccggcaggc

SEQ ID NO: 1430014 - RNA, 15 nt, Pseudomonas aeruginosa PA01
cggugcaggccgacg

SEQ ID NO: 1430015 - RNA, 13 nt, Pseudomonas aeruginosa PA01
cggugcaccuggg

SEQ ID NO: 1430016 - RNA, 16 nt, Pseudomonas aeruginosa PA01
cggugcagcggaagcc

SEQ ID NO: 1430017 - RNA, 17 nt, Pseudomonas aeruginosa PA01
cggugcagcggaagccc

SEQ ID NO: 1430018 - RNA, 15 nt, Pseudomonas aeruginosa PA01
cggugcagccaccca

SEQ ID NO: 1430019 - RNA, 17 nt, Pseudomonas aeruginosa PA01
cggugcagccacccagc

SEQ ID NO: 1430020 - RNA, 20 nt, Pseudomonas aeruginosa PA01
cggugcagccacccagcagc

SEQ ID NO: 1430021 - RNA, 15 nt, Pseudomonas aeruginosa PA01
cggugcaccaggcga

SEQ ID NO: 1430022 - RNA, 18 nt, Pseudomonas aeruginosa PA01
cggugcaccaggcgaugc

SEQ ID NO: 1430023 - RNA, 14 nt, Pseudomonas aeruginosa PA01
cggugcaugcgcac

SEQ ID NO: 1430024 - RNA, 21 nt, Pseudomonas aeruginosa PA01
cggugccagggcggucggcca

SEQ ID NO: 1430025 - RNA, 22 nt, Pseudomonas aeruginosa PA01
cggugccagggcggucggccag

SEQ ID NO: 1430026 - RNA, 18 nt, Pseudomonas aeruginosa PA01
cggugccauacucggacg

SEQ ID NO: 1430027 - RNA, 20 nt, Pseudomonas aeruginosa PA01
cggugccauacucggacggc

SEQ ID NO: 1430028 - RNA, 20 nt, Pseudomonas aeruginosa PA01
cggugccauggaucaccagg

SEQ ID NO: 1430029 - RNA, 16 nt, Pseudomonas aeruginosa PA01
cggugcaugcgcacgg

SEQ ID NO: 1430030 - RNA, 16 nt, Pseudomonas aeruginosa PA01
cggugcccucgcggac

SEQ ID NO: 1430031 - RNA, 16 nt, Pseudomonas aeruginosa PA01
cggugacguuggccgg

SEQ ID NO: 1430032 - RNA, 19 nt, Pseudomonas aeruginosa PA01
cggugacguuggccggggu

SEQ ID NO: 1430033 - RNA, 15 nt, Pseudomonas aeruginosa PA01
cggugacgucgagga

SEQ ID NO: 1430034 - RNA, 15 nt, Pseudomonas aeruginosa PA01
cggugacggugcagc

SEQ ID NO: 1430035 - RNA, 16 nt, Pseudomonas aeruginosa PA01
cggugacggugcagcc

SEQ ID NO: 1430036 - RNA, 14 nt, Pseudomonas aeruginosa PA01
cggugagcacgccg

SEQ ID NO: 1430037 - RNA, 16 nt, Pseudomonas aeruginosa PA01
cggugagcacgccgcg

SEQ ID NO: 1430038 - RNA, 16 nt, Pseudomonas aeruginosa PA01
cggugagguugccgcc

SEQ ID NO: 1430039 - RNA, 17 nt, Pseudomonas aeruginosa PA01
cggugagguugccgccg

SEQ ID NO: 1430040 - RNA, 22 nt, Pseudomonas aeruginosa PA01
cggugagguugccgccgaucag

SEQ ID NO: 1430041 - RNA, 16 nt, Pseudomonas aeruginosa PA01
cggugaggaccuggcc

SEQ ID NO: 1430042 - RNA, 18 nt, Pseudomonas aeruginosa PA01
cggugaggaccuggccgc

SEQ ID NO: 1430043 - RNA, 16 nt, Pseudomonas aeruginosa PA01
cggugacgcugcucac

SEQ ID NO: 1430044 - RNA, 17 nt, Pseudomonas aeruginosa PA01
cggugaccugguagucg

SEQ ID NO: 1430045 - RNA, 22 nt, Pseudomonas aeruginosa PA01
cggugaccugguagucgcgguu

SEQ ID NO: 1430046 - RNA, 22 nt, Pseudomonas aeruginosa PA01
cggugaccguuucgccgccggc

SEQ ID NO: 1430047 - RNA, 23 nt, Pseudomonas aeruginosa PA01
cggugaccguuucgccgccggcc

SEQ ID NO: 1430048 - RNA, 22 nt, Pseudomonas aeruginosa PA01
cggugaucuggaaauucagcgc

SEQ ID NO: 1430049 - RNA, 15 nt, Pseudomonas aeruginosa PA01
cggugaugaagaagc

SEQ ID NO: 1430050 - RNA, 18 nt, Pseudomonas aeruginosa PA01
cggugaugguaucgccgu

SEQ ID NO: 1430051 - RNA, 18 nt, Pseudomonas aeruginosa PA01
cggugauguaggacgccu

SEQ ID NO: 1430052 - RNA, 19 nt, Pseudomonas aeruginosa PA01
cggugaugucggcgcuguc

SEQ ID NO: 1430053 - RNA, 13 nt, Pseudomonas aeruginosa PA01
cggugaucaggcg

SEQ ID NO: 1430054 - RNA, 19 nt, Pseudomonas aeruginosa PA01
cggugauagagcacgccca

SEQ ID NO: 1430055 - RNA, 16 nt, Pseudomonas aeruginosa PA01
cggugauaccgccggc

SEQ ID NO: 1430056 - RNA, 18 nt, Pseudomonas aeruginosa PA01
cggugauaccgccggcgg

SEQ ID NO: 1430057 - RNA, 20 nt, Pseudomonas aeruginosa PA01
cggugauaccgccggcggcg

SEQ ID NO: 1430058 - RNA, 14 nt, Pseudomonas aeruginosa PA01
cggugaucgccgcg

SEQ ID NO: 1430059 - RNA, 22 nt, Pseudomonas aeruginosa PA01
cggugaucgagccgccggggaa

SEQ ID NO: 1430060 - RNA, 15 nt, Pseudomonas aeruginosa PA01
cggugaucucgcggc

SEQ ID NO: 1430061 - RNA, 18 nt, Pseudomonas aeruginosa PA01
cggugaucucgcggcgcg

SEQ ID NO: 1430062 - RNA, 16 nt, Pseudomonas aeruginosa PA01
cggugcuggugcggcc

SEQ ID NO: 1430063 - RNA, 20 nt, Pseudomonas aeruginosa PA01
cggugcuggugcggccgaug

SEQ ID NO: 1430064 - RNA, 14 nt, Pseudomonas aeruginosa PA01
cggugcucggccug

SEQ ID NO: 1430065 - RNA, 23 nt, Pseudomonas aeruginosa PA01
cggugcuggcgucgccuuccacc

SEQ ID NO: 1430066 - RNA, 15 nt, Pseudomonas aeruginosa PA01
cggugcggucguuga

SEQ ID NO: 1430067 - RNA, 17 nt, Pseudomonas aeruginosa PA01
cggugcggucguugauc

SEQ ID NO: 1430068 - RNA, 20 nt, Pseudomonas aeruginosa PA01
cggugcguucgcgggcgccg

SEQ ID NO: 1430069 - RNA, 17 nt, Pseudomonas aeruginosa PA01
cgguggacugguugacc

SEQ ID NO: 1430070 - RNA, 16 nt, Pseudomonas aeruginosa PA01
cggugcuuugcauggc

SEQ ID NO: 1430071 - RNA, 15 nt, Pseudomonas aeruginosa PA01
cgguggaggcgucgg

SEQ ID NO: 1430072 - RNA, 14 nt, Pseudomonas aeruginosa PA01
cgguggagcacguc

SEQ ID NO: 1430073 - RNA, 19 nt, Pseudomonas aeruginosa PA01
cgguggagcacgucgagca

SEQ ID NO: 1430074 - RNA, 21 nt, Pseudomonas aeruginosa PA01
cggugcggguaucgaucucga

SEQ ID NO: 1430075 - RNA, 21 nt, Pseudomonas aeruginosa PA01
cggugcggguggucgccgccc

SEQ ID NO: 1430076 - RNA, 22 nt, Pseudomonas aeruginosa PA01
cggugcggguggucgccgccca

SEQ ID NO: 1430077 - RNA, 23 nt, Pseudomonas aeruginosa PA01
cggugcgggccuugaccaccgcc

SEQ ID NO: 1430078 - RNA, 18 nt, Pseudomonas aeruginosa PA01
cggugcggcauuccgggc

SEQ ID NO: 1430079 - RNA, 16 nt, Pseudomonas aeruginosa PA01
cggugcgcgccaucaa

SEQ ID NO: 1430080 - RNA, 16 nt, Pseudomonas aeruginosa PA01
cggugcgccuccagga

SEQ ID NO: 1430081 - RNA, 22 nt, Pseudomonas aeruginosa PA01
cggugcgcuccuguugcuggcc

SEQ ID NO: 1430082 - RNA, 17 nt, Pseudomonas aeruginosa PA01
cggugccuucccagccg

SEQ ID NO: 1430083 - RNA, 19 nt, Pseudomonas aeruginosa PA01
cggugccuucccagccgag

SEQ ID NO: 1430084 - RNA, 15 nt, Pseudomonas aeruginosa PA01
cggugccuucggcgg

SEQ ID NO: 1430085 - RNA, 16 nt, Pseudomonas aeruginosa PA01
cggugccuucggcggc

SEQ ID NO: 1430086 - RNA, 18 nt, Pseudomonas aeruginosa PA01
cggugccuucggcggcgc

SEQ ID NO: 1430087 - RNA, 16 nt, Pseudomonas aeruginosa PA01
cggugcgcaugucguc

SEQ ID NO: 1430088 - RNA, 17 nt, Pseudomonas aeruginosa PA01
cggugcgccccaggugc

SEQ ID NO: 1430089 - RNA, 16 nt, Pseudomonas aeruginosa PA01
cggugcgccggcggga

SEQ ID NO: 1430090 - RNA, 16 nt, Pseudomonas aeruginosa PA01
cggugggcuccagcgg

SEQ ID NO: 1430091 - RNA, 14 nt, Pseudomonas aeruginosa PA01
cggugggcuugccg

SEQ ID NO: 1430092 - RNA, 15 nt, Pseudomonas aeruginosa PA01
cgguggggccgccga

SEQ ID NO: 1430093 - RNA, 18 nt, Pseudomonas aeruginosa PA01
cgguggggccgccgaugc

SEQ ID NO: 1430094 - RNA, 19 nt, Pseudomonas aeruginosa PA01
cgguggucgguucgucgag

SEQ ID NO: 1430095 - RNA, 21 nt, Pseudomonas aeruginosa PA01
cgguggucgguucgucgagga

SEQ ID NO: 1430096 - RNA, 22 nt, Pseudomonas aeruginosa PA01
cgguggucgguucgucgaggau

SEQ ID NO: 1430097 - RNA, 17 nt, Pseudomonas aeruginosa PA01
cgguggcguuauccgcc

SEQ ID NO: 1430098 - RNA, 15 nt, Pseudomonas aeruginosa PA01
cgguggcgguugcgg

SEQ ID NO: 1430099 - RNA, 18 nt, Pseudomonas aeruginosa PA01
cggugggacugagccgcu

SEQ ID NO: 1430100 - RNA, 19 nt, Pseudomonas aeruginosa PA01
cggugggacugagccgcug

SEQ ID NO: 1430101 - RNA, 14 nt, Pseudomonas aeruginosa PA01
cgguggcggcgacg

SEQ ID NO: 1430102 - RNA, 22 nt, Pseudomonas aeruginosa PA01
cgguggcggcgacgaagcccag

SEQ ID NO: 1430103 - RNA, 13 nt, Pseudomonas aeruginosa PA01
cgguggcgcccag

SEQ ID NO: 1430104 - RNA, 22 nt, Pseudomonas aeruginosa PA01
cgguggccuccugcaacgccug

SEQ ID NO: 1430105 - RNA, 18 nt, Pseudomonas aeruginosa PA01
cgguggcgacgcgcaggc

SEQ ID NO: 1430106 - RNA, 12 nt, Pseudomonas aeruginosa PA01
cgguggccagga

SEQ ID NO: 1430107 - RNA, 21 nt, Pseudomonas aeruginosa PA01
cgguggccaggacgcuggcga

SEQ ID NO: 1430108 - RNA, 22 nt, Pseudomonas aeruginosa PA01
cgguggccaggacgcuggcgau

SEQ ID NO: 1430109 - RNA, 12 nt, Pseudomonas aeruginosa PA01
cgguggccaggc

SEQ ID NO: 1430110 - RNA, 17 nt, Pseudomonas aeruginosa PA01
cgguggccaggcucuuc

SEQ ID NO: 1430111 - RNA, 22 nt, Pseudomonas aeruginosa PA01
cgguggcaugguguccggcggc

SEQ ID NO: 1430112 - RNA, 23 nt, Pseudomonas aeruginosa PA01
cgguggcaugguguccggcggcg

SEQ ID NO: 1430113 - RNA, 16 nt, Pseudomonas aeruginosa PA01
cgguggccacgucgcc

SEQ ID NO: 1430114 - RNA, 19 nt, Pseudomonas aeruginosa PA01
cgguggccacgucgcccca

SEQ ID NO: 1430115 - RNA, 19 nt, Pseudomonas aeruginosa PA01
cggugucggugcccucgcg

SEQ ID NO: 1430116 - RNA, 17 nt, Pseudomonas aeruginosa PA01
cggugucgcgguugcgc

SEQ ID NO: 1430117 - RNA, 20 nt, Pseudomonas aeruginosa PA01
cggugucgcgguugcgcugc

SEQ ID NO: 1430118 - RNA, 13 nt, Pseudomonas aeruginosa PA01
cggugucggccaa

SEQ ID NO: 1430119 - RNA, 12 nt, Pseudomonas aeruginosa PA01
cggugucggcga

SEQ ID NO: 1430120 - RNA, 22 nt, Pseudomonas aeruginosa PA01
cggugucggcgauucguucgag

SEQ ID NO: 1430121 - RNA, 16 nt, Pseudomonas aeruginosa PA01
cggugugcucaggcga

SEQ ID NO: 1430122 - RNA, 13 nt, Pseudomonas aeruginosa PA01
cggugugcgcugc

SEQ ID NO: 1430123 - RNA, 20 nt, Pseudomonas aeruginosa PA01
cggugugcgcugcaucggcg

SEQ ID NO: 1430124 - RNA, 21 nt, Pseudomonas aeruginosa PA01
cggugugcgcugcaucggcgc

SEQ ID NO: 1430125 - RNA, 15 nt, Pseudomonas aeruginosa PA01
cgguggucuucagca

SEQ ID NO: 1430126 - RNA, 17 nt, Pseudomonas aeruginosa PA01
cgguguagaccaccagc

SEQ ID NO: 1430127 - RNA, 21 nt, Pseudomonas aeruginosa PA01
cgguguagaccaccagcagga

SEQ ID NO: 1430128 - RNA, 15 nt, Pseudomonas aeruginosa PA01
cgguguaucggcgga

SEQ ID NO: 1430129 - RNA, 15 nt, Pseudomonas aeruginosa PA01
cgguguccaccacca

SEQ ID NO: 1430130 - RNA, 16 nt, Pseudomonas aeruginosa PA01
cgguguccaccaccag

SEQ ID NO: 1430131 - RNA, 20 nt, Pseudomonas aeruginosa PA01
cgguguccaccaccagcagg

SEQ ID NO: 1430132 - RNA, 14 nt, Pseudomonas aeruginosa PA01
cggugucaggccga

SEQ ID NO: 1430133 - RNA, 15 nt, Pseudomonas aeruginosa PA01
cggugucaggccgag

SEQ ID NO: 1430134 - RNA, 16 nt, Pseudomonas aeruginosa PA01
cggugucaggccgagg

SEQ ID NO: 1430135 - RNA, 14 nt, Pseudomonas aeruginosa PA01
cgguugugcgcccg

SEQ ID NO: 1430136 - RNA, 16 nt, Pseudomonas aeruginosa PA01
cgguugucgaugcgcc

SEQ ID NO: 1430137 - RNA, 20 nt, Pseudomonas aeruginosa PA01
cgguugucgaugcgcccgcc

SEQ ID NO: 1430138 - RNA, 22 nt, Pseudomonas aeruginosa PA01
cgguuggcuacccgcagggcuc

SEQ ID NO: 1430139 - RNA, 22 nt, Pseudomonas aeruginosa PA01
cgguuggggaggugcggcggug

SEQ ID NO: 1430140 - RNA, 14 nt, Pseudomonas aeruginosa PA01
cgguuggcccgcgc

SEQ ID NO: 1430141 - RNA, 18 nt, Pseudomonas aeruginosa PA01
cgguuggccucggcccgg

SEQ ID NO: 1430142 - RNA, 22 nt, Pseudomonas aeruginosa PA01
cgguugcugcuugcgcgcggcg

SEQ ID NO: 1430143 - RNA, 19 nt, Pseudomonas aeruginosa PA01
cgguugcugugcacccaga

SEQ ID NO: 1430144 - RNA, 14 nt, Pseudomonas aeruginosa PA01
cgguugcggcgccg

SEQ ID NO: 1430145 - RNA, 15 nt, Pseudomonas aeruginosa PA01
cgguugcggcgccgg

SEQ ID NO: 1430146 - RNA, 19 nt, Pseudomonas aeruginosa PA01
cgguuggaguuggaacugu

SEQ ID NO: 1430147 - RNA, 17 nt, Pseudomonas aeruginosa PA01
cgguuucccucgagcac

SEQ ID NO: 1430148 - RNA, 14 nt, Pseudomonas aeruginosa PA01
cgguuuccgcagcg

SEQ ID NO: 1430149 - RNA, 16 nt, Pseudomonas aeruginosa PA01
cgguuuccgcagcgcu

SEQ ID NO: 1430150 - RNA, 16 nt, Pseudomonas aeruginosa PA01
cgguuuccggccaggc

SEQ ID NO: 1430151 - RNA, 17 nt, Pseudomonas aeruginosa PA01
cgguuuccggccaggcg

SEQ ID NO: 1430152 - RNA, 18 nt, Pseudomonas aeruginosa PA01
cguaaaauggcgcgccuc

SEQ ID NO: 1430153 - RNA, 19 nt, Pseudomonas aeruginosa PA01
cguaaaauggcgcgccucu

SEQ ID NO: 1430154 - RNA, 21 nt, Pseudomonas aeruginosa PA01
cgguuccuccauuagcgucgc

SEQ ID NO: 1430155 - RNA, 13 nt, Pseudomonas aeruginosa PA01
cgguucgucgagg

SEQ ID NO: 1430156 - RNA, 16 nt, Pseudomonas aeruginosa PA01
cgguucgacacgcuca

SEQ ID NO: 1430157 - RNA, 16 nt, Pseudomonas aeruginosa PA01
cgguucugcuccuggg

SEQ ID NO: 1430158 - RNA, 13 nt, Pseudomonas aeruginosa PA01
cgguucucgucga

SEQ ID NO: 1430159 - RNA, 19 nt, Pseudomonas aeruginosa PA01
cgguugagacgaaagccuu

SEQ ID NO: 1430160 - RNA, 17 nt, Pseudomonas aeruginosa PA01
cgguugagauccuggcc

SEQ ID NO: 1430161 - RNA, 19 nt, Pseudomonas aeruginosa PA01
cgguugagauccuggccgg

SEQ ID NO: 1430162 - RNA, 20 nt, Pseudomonas aeruginosa PA01
cgguugagauccuggccggc

SEQ ID NO: 1430163 - RNA, 13 nt, Pseudomonas aeruginosa PA01
cgguugcggccug

SEQ ID NO: 1430164 - RNA, 16 nt, Pseudomonas aeruginosa PA01
cgguuccagcggccgc

SEQ ID NO: 1430165 - RNA, 19 nt, Pseudomonas aeruginosa PA01
cgguuccagcggccgcgag

SEQ ID NO: 1430166 - RNA, 19 nt, Pseudomonas aeruginosa PA01
cgguucccgcagcgaucag

SEQ ID NO: 1430167 - RNA, 14 nt, Pseudomonas aeruginosa PA01
cgguucccgcccgc

SEQ ID NO: 1430168 - RNA, 19 nt, Pseudomonas aeruginosa PA01
cgguucaggucgaggccgc

SEQ ID NO: 1430169 - RNA, 14 nt, Pseudomonas aeruginosa PA01
cguaaggccaggcu

SEQ ID NO: 1430170 - RNA, 18 nt, Pseudomonas aeruginosa PA01
cguaggcgcgccaaggcc

SEQ ID NO: 1430171 - RNA, 15 nt, Pseudomonas aeruginosa PA01
cguaggcggcgaagg

SEQ ID NO: 1430172 - RNA, 16 nt, Pseudomonas aeruginosa PA01
cguaggcggcgaaggc

SEQ ID NO: 1430173 - RNA, 17 nt, Pseudomonas aeruginosa PA01
cguaaugcaacccgccg

SEQ ID NO: 1430174 - RNA, 19 nt, Pseudomonas aeruginosa PA01
cguaaugcaacccgccgcu

SEQ ID NO: 1430175 - RNA, 16 nt, Pseudomonas aeruginosa PA01
cguaggugaagcccag

SEQ ID NO: 1430176 - RNA, 18 nt, Pseudomonas aeruginosa PA01
cguagggcaucgccgaca

SEQ ID NO: 1430177 - RNA, 14 nt, Pseudomonas aeruginosa PA01
cguaggggaccacc

SEQ ID NO: 1430178 - RNA, 15 nt, Pseudomonas aeruginosa PA01
cguaggggaccaccc

SEQ ID NO: 1430179 - RNA, 22 nt, Pseudomonas aeruginosa PA01
cguagggcgaauaaccgcaucg

SEQ ID NO: 1430180 - RNA, 22 nt, Pseudomonas aeruginosa PA01
cguagggcgaauaaccgcucgc

SEQ ID NO: 1430181 - RNA, 21 nt, Pseudomonas aeruginosa PA01
cguagggcgaauaaccgcugc

SEQ ID NO: 1430182 - RNA, 22 nt, Pseudomonas aeruginosa PA01
cguagggcgcauaaccgcucgc

SEQ ID NO: 1430183 - RNA, 19 nt, Pseudomonas aeruginosa PA01
cguagggcgcauaacgcca

SEQ ID NO: 1430184 - RNA, 19 nt, Pseudomonas aeruginosa PA01
cguagggcggauaacgcca

SEQ ID NO: 1430185 - RNA, 20 nt, Pseudomonas aeruginosa PA01
cguagggcguauaaccgcuc

SEQ ID NO: 1430186 - RNA, 22 nt, Pseudomonas aeruginosa PA01
cguagggcguauaaccgcucgc

SEQ ID NO: 1430187 - RNA, 20 nt, Pseudomonas aeruginosa PA01
cguaggcuuggucgggcgcc

SEQ ID NO: 1430188 - RNA, 23 nt, Pseudomonas aeruginosa PA01
cguagugcuggguggaggcccag

SEQ ID NO: 1430189 - RNA, 18 nt, Pseudomonas aeruginosa PA01
cguagugguugcgcacgc

SEQ ID NO: 1430190 - RNA, 14 nt, Pseudomonas aeruginosa PA01
cguagugcaucagc

SEQ ID NO: 1430191 - RNA, 20 nt, Pseudomonas aeruginosa PA01
cguaguggcguuccaggcgg

SEQ ID NO: 1430192 - RNA, 22 nt, Pseudomonas aeruginosa PA01
cguaguugacccgccccugcuc

SEQ ID NO: 1430193 - RNA, 15 nt, Pseudomonas aeruginosa PA01
cgucaagcaacggcg

SEQ ID NO: 1430194 - RNA, 15 nt, Pseudomonas aeruginosa PA01
aacccggcgcuggcc

SEQ ID NO: 1430195 - RNA, 18 nt, Pseudomonas aeruginosa PA01
aacccggccagcccggcc

SEQ ID NO: 1430196 - RNA, 22 nt, Pseudomonas aeruginosa PA01
aacccgggcccaagccgagcgg

SEQ ID NO: 1430197 - RNA, 20 nt, Pseudomonas aeruginosa PA01
cguauuccacgucgccgacc

SEQ ID NO: 1430198 - RNA, 14 nt, Pseudomonas aeruginosa PA01
cguauaggcgcugg

SEQ ID NO: 1430199 - RNA, 21 nt, Pseudomonas aeruginosa PA01
cgucaggccuugcgcggcgcc

SEQ ID NO: 1430200 - RNA, 21 nt, Pseudomonas aeruginosa PA01
cgucaggggcucggcgagcga

SEQ ID NO: 1430201 - RNA, 17 nt, Pseudomonas aeruginosa PA01
cgucaggcaccucgucc

SEQ ID NO: 1430202 - RNA, 22 nt, Pseudomonas aeruginosa PA01
cgucagcgaggcgggcgcggau

SEQ ID NO: 1430203 - RNA, 16 nt, Pseudomonas aeruginosa PA01
cgucagccgcggccgg

SEQ ID NO: 1430204 - RNA, 13 nt, Pseudomonas aeruginosa PA01
cgucaaugcggcc

SEQ ID NO: 1430205 - RNA, 14 nt, Pseudomonas aeruginosa PA01
cgucaaugcggccu

SEQ ID NO: 1430206 - RNA, 16 nt, Pseudomonas aeruginosa PA01
cgucaaugcggccugc

SEQ ID NO: 1430207 - RNA, 22 nt, Pseudomonas aeruginosa PA01
cgucaaugcggccugcaacgcc

SEQ ID NO: 1430208 - RNA, 13 nt, Pseudomonas aeruginosa PA01
cgucacggcgugc

SEQ ID NO: 1430209 - RNA, 21 nt, Pseudomonas aeruginosa PA01
cgucacggcgugccgcaggcc

SEQ ID NO: 1430210 - RNA, 22 nt, Pseudomonas aeruginosa PA01
cgucacggcgugccgcaggccg

SEQ ID NO: 1430211 - RNA, 18 nt, Pseudomonas aeruginosa PA01
cgucacggauaggcggcg

SEQ ID NO: 1430212 - RNA, 22 nt, Pseudomonas aeruginosa PA01
cgucacggcgaaaccggccagc

SEQ ID NO: 1430213 - RNA, 15 nt, Pseudomonas aeruginosa PA01
cgucacuggaacagc

SEQ ID NO: 1430214 - RNA, 16 nt, Pseudomonas aeruginosa PA01
cgucacucgacaggcc

SEQ ID NO: 1430215 - RNA, 17 nt, Pseudomonas aeruginosa PA01
cgucacucgacaggcca

SEQ ID NO: 1430216 - RNA, 20 nt, Pseudomonas aeruginosa PA01
cgucagcaggucucaccgcc

SEQ ID NO: 1430217 - RNA, 23 nt, Pseudomonas aeruginosa PA01
cgucagcaggucucaccgcccug

SEQ ID NO: 1430218 - RNA, 20 nt, Pseudomonas aeruginosa PA01
cguccuggguaugcgcgguc

SEQ ID NO: 1430219 - RNA, 22 nt, Pseudomonas aeruginosa PA01
cguccuucuuguauaccagcgg

SEQ ID NO: 1430220 - RNA, 17 nt, Pseudomonas aeruginosa PA01
cgucgaaacgggcgcuc

SEQ ID NO: 1430221 - RNA, 18 nt, Pseudomonas aeruginosa PA01
cgucgaaacgggcgcucu

SEQ ID NO: 1430222 - RNA, 23 nt, Pseudomonas aeruginosa PA01
cgucgaaacgggcgcucuggccg

SEQ ID NO: 1430223 - RNA, 21 nt, Pseudomonas aeruginosa PA01
cguccuugaguagcuggcgca

SEQ ID NO: 1430224 - RNA, 20 nt, Pseudomonas aeruginosa PA01
cguccuugaguucccagacc

SEQ ID NO: 1430225 - RNA, 13 nt, Pseudomonas aeruginosa PA01
cguccugcgcggc

SEQ ID NO: 1430226 - RNA, 15 nt, Pseudomonas aeruginosa PA01
cguccugcgcggcga

SEQ ID NO: 1430227 - RNA, 17 nt, Pseudomonas aeruginosa PA01
cguccugcgcggcgacg

SEQ ID NO: 1430228 - RNA, 14 nt, Pseudomonas aeruginosa PA01
cguccugcggccgc

SEQ ID NO: 1430229 - RNA, 17 nt, Pseudomonas aeruginosa PA01
cguccugcucccuggcg

SEQ ID NO: 1430230 - RNA, 19 nt, Pseudomonas aeruginosa PA01
cguccugcucccuggcgga

SEQ ID NO: 1430231 - RNA, 20 nt, Pseudomonas aeruginosa PA01
cguccugccggugcucggcc

SEQ ID NO: 1430232 - RNA, 17 nt, Pseudomonas aeruginosa PA01
cguccugccucggaggc

SEQ ID NO: 1430233 - RNA, 15 nt, Pseudomonas aeruginosa PA01
cguccugcugcuggc

SEQ ID NO: 1430234 - RNA, 19 nt, Pseudomonas aeruginosa PA01
cguccugcuuccagaccuc

SEQ ID NO: 1430235 - RNA, 20 nt, Pseudomonas aeruginosa PA01
cguccugcuuccagaccucg

SEQ ID NO: 1430236 - RNA, 17 nt, Pseudomonas aeruginosa PA01
cguccuggcgaguggcg

SEQ ID NO: 1430237 - RNA, 15 nt, Pseudomonas aeruginosa PA01
cgucgaccauggugu

SEQ ID NO: 1430238 - RNA, 18 nt, Pseudomonas aeruginosa PA01
cgucgacccgccucaccc

SEQ ID NO: 1430239 - RNA, 20 nt, Pseudomonas aeruginosa PA01
cgucgaccaucaccagcgcc

SEQ ID NO: 1430240 - RNA, 22 nt, Pseudomonas aeruginosa PA01
cgucgaccaucaccagcgccgu

SEQ ID NO: 1430241 - RNA, 15 nt, Pseudomonas aeruginosa PA01
cgucgaccaccgcgu

SEQ ID NO: 1430242 - RNA, 22 nt, Pseudomonas aeruginosa PA01
cgucgaaacgcuggcggccgag

SEQ ID NO: 1430243 - RNA, 15 nt, Pseudomonas aeruginosa PA01
cgucgaaagccucga

SEQ ID NO: 1430244 - RNA, 19 nt, Pseudomonas aeruginosa PA01
cgucgaaagccucgacgac

SEQ ID NO: 1430245 - RNA, 20 nt, Pseudomonas aeruginosa PA01
cgucgaaagccucgacgaca

SEQ ID NO: 1430246 - RNA, 12 nt, Pseudomonas aeruginosa PA01
cguccgccugcg

SEQ ID NO: 1430247 - RNA, 15 nt, Pseudomonas aeruginosa PA01
cguccgguugcuggc

SEQ ID NO: 1430248 - RNA, 17 nt, Pseudomonas aeruginosa PA01
cguccggucgcaccgcc

SEQ ID NO: 1430249 - RNA, 21 nt, Pseudomonas aeruginosa PA01
cguccggucgcaccgccagca

SEQ ID NO: 1430250 - RNA, 22 nt, Pseudomonas aeruginosa PA01
cguccggguucaugucgguauc

SEQ ID NO: 1430251 - RNA, 18 nt, Pseudomonas aeruginosa PA01
cguccgggugccccaggc

SEQ ID NO: 1430252 - RNA, 21 nt, Pseudomonas aeruginosa PA01
cguccgggugccccaggcgag

SEQ ID NO: 1430253 - RNA, 16 nt, Pseudomonas aeruginosa PA01
cguccugcaacugcuc

SEQ ID NO: 1430254 - RNA, 20 nt, Pseudomonas aeruginosa PA01
cguccugcaacugcucgauc

SEQ ID NO: 1430255 - RNA, 15 nt, Pseudomonas aeruginosa PA01
cguccuacgaaggca

SEQ ID NO: 1430256 - RNA, 18 nt, Pseudomonas aeruginosa PA01
cguccguaaugcaacccg

SEQ ID NO: 1430257 - RNA, 15 nt, Pseudomonas aeruginosa PA01
cguccgccaccacgg

SEQ ID NO: 1430258 - RNA, 18 nt, Pseudomonas aeruginosa PA01
cguccgaugucguugcgc

SEQ ID NO: 1430259 - RNA, 22 nt, Pseudomonas aeruginosa PA01
cguccgccggguccaccgcggc

SEQ ID NO: 1430260 - RNA, 16 nt, Pseudomonas aeruginosa PA01
cguccgcaguucgccc

SEQ ID NO: 1430261 - RNA, 22 nt, Pseudomonas aeruginosa PA01
cguccgcaguucgccccgccgc

SEQ ID NO: 1430262 - RNA, 16 nt, Pseudomonas aeruginosa PA01
cguccgagguggcuga

SEQ ID NO: 1430263 - RNA, 18 nt, Pseudomonas aeruginosa PA01
cguccgagguggcugaag

SEQ ID NO: 1430264 - RNA, 21 nt, Pseudomonas aeruginosa PA01
cguccgagagcagggccuggc

SEQ ID NO: 1430265 - RNA, 22 nt, Pseudomonas aeruginosa PA01
cguccgagagcagggccuggcc

SEQ ID NO: 1430266 - RNA, 14 nt, Pseudomonas aeruginosa PA01
cguccgacagcagg

SEQ ID NO: 1430267 - RNA, 16 nt, Pseudomonas aeruginosa PA01
cguccgacagcagguc

SEQ ID NO: 1430268 - RNA, 17 nt, Pseudomonas aeruginosa PA01
cgucccugaccagcagg

SEQ ID NO: 1430269 - RNA, 15 nt, Pseudomonas aeruginosa PA01
cgucccuggagcagg

SEQ ID NO: 1430270 - RNA, 17 nt, Pseudomonas aeruginosa PA01
cgucccugggccugcag

SEQ ID NO: 1430271 - RNA, 14 nt, Pseudomonas aeruginosa PA01
cgucccugggcgca

SEQ ID NO: 1430272 - RNA, 15 nt, Pseudomonas aeruginosa PA01
cgucccuaccagcgc

SEQ ID NO: 1430273 - RNA, 17 nt, Pseudomonas aeruginosa PA01
cgucccuuggcgucgcg

SEQ ID NO: 1430274 - RNA, 18 nt, Pseudomonas aeruginosa PA01
cgucccuuggcgucgcgg

SEQ ID NO: 1430275 - RNA, 20 nt, Pseudomonas aeruginosa PA01
cgucccuuguuuuccuggcc

SEQ ID NO: 1430276 - RNA, 21 nt, Pseudomonas aeruginosa PA01
cgucccuuguuuuccuggccc

SEQ ID NO: 1430277 - RNA, 23 nt, Pseudomonas aeruginosa PA01
cgucccuuguuuuccuggcccug

SEQ ID NO: 1430278 - RNA, 15 nt, Pseudomonas aeruginosa PA01
cgucauccgccaacc

SEQ ID NO: 1430279 - RNA, 18 nt, Pseudomonas aeruginosa PA01
cgucauaggccuuggcga

SEQ ID NO: 1430280 - RNA, 14 nt, Pseudomonas aeruginosa PA01
cgucaucaggcuca

SEQ ID NO: 1430281 - RNA, 15 nt, Pseudomonas aeruginosa PA01
cgucaucaggcucag

SEQ ID NO: 1430282 - RNA, 19 nt, Pseudomonas aeruginosa PA01
cgucaucaggcucaggccg

SEQ ID NO: 1430283 - RNA, 13 nt, Pseudomonas aeruginosa PA01
cgucaucgagcag

SEQ ID NO: 1430284 - RNA, 22 nt, Pseudomonas aeruginosa PA01
cgucaucgagcaguuccaggcg

SEQ ID NO: 1430285 - RNA, 21 nt, Pseudomonas aeruginosa PA01
cgucaguuccgcaucggccac

SEQ ID NO: 1430286 - RNA, 22 nt, Pseudomonas aeruginosa PA01
cgucauacaacuguugcucggg

SEQ ID NO: 1430287 - RNA, 17 nt, Pseudomonas aeruginosa PA01
cguccacuccggcagca

SEQ ID NO: 1430288 - RNA, 16 nt, Pseudomonas aeruginosa PA01
cguccacugcguccug

SEQ ID NO: 1430289 - RNA, 20 nt, Pseudomonas aeruginosa PA01
cguccacugcguccuggucg

SEQ ID NO: 1430290 - RNA, 21 nt, Pseudomonas aeruginosa PA01
cguccacggcgcgucggcggu

SEQ ID NO: 1430291 - RNA, 15 nt, Pseudomonas aeruginosa PA01
cguccaccgcuucgc

SEQ ID NO: 1430292 - RNA, 17 nt, Pseudomonas aeruginosa PA01
cguccaccgcuucgcgg

SEQ ID NO: 1430293 - RNA, 21 nt, Pseudomonas aeruginosa PA01
cguccaccgaguggcgcagcg

SEQ ID NO: 1430294 - RNA, 22 nt, Pseudomonas aeruginosa PA01
cguccaccgaguggcgcagcgc

SEQ ID NO: 1430295 - RNA, 17 nt, Pseudomonas aeruginosa PA01
cguccaccuggcggcug

SEQ ID NO: 1430296 - RNA, 15 nt, Pseudomonas aeruginosa PA01
cguccaccagccagc

SEQ ID NO: 1430297 - RNA, 15 nt, Pseudomonas aeruginosa PA01
cguccaccagcgccc

SEQ ID NO: 1430298 - RNA, 13 nt, Pseudomonas aeruginosa PA01
cgucccguugcgc

SEQ ID NO: 1430299 - RNA, 13 nt, Pseudomonas aeruginosa PA01
cgucccgcgcgcc

SEQ ID NO: 1430300 - RNA, 18 nt, Pseudomonas aeruginosa PA01
cgucccgcgcgccgagcc

SEQ ID NO: 1430301 - RNA, 20 nt, Pseudomonas aeruginosa PA01
cgucccgcaguagcucgccg

SEQ ID NO: 1430302 - RNA, 16 nt, Pseudomonas aeruginosa PA01
cgucccggcgccgccc

SEQ ID NO: 1430303 - RNA, 17 nt, Pseudomonas aeruginosa PA01
cgucccggcgccgcccu

SEQ ID NO: 1430304 - RNA, 13 nt, Pseudomonas aeruginosa PA01
cguccccaugccc

SEQ ID NO: 1430305 - RNA, 22 nt, Pseudomonas aeruginosa PA01
cguccccaugcccggccuggcg

SEQ ID NO: 1430306 - RNA, 22 nt, Pseudomonas aeruginosa PA01
cgucccaugaccgucagccagg

SEQ ID NO: 1430307 - RNA, 17 nt, Pseudomonas aeruginosa PA01
cgucccauuccucggcg

SEQ ID NO: 1430308 - RNA, 19 nt, Pseudomonas aeruginosa PA01
cgucccgagcaccggccuc

SEQ ID NO: 1430309 - RNA, 19 nt, Pseudomonas aeruginosa PA01
cguccccuuccuccucgcc

SEQ ID NO: 1430310 - RNA, 24 nt, Pseudomonas aeruginosa PA01
cguccccuuccuccucgccgcucc

SEQ ID NO: 1430311 - RNA, 20 nt, Pseudomonas aeruginosa PA01
cguccaguuccagggucagc

SEQ ID NO: 1430312 - RNA, 22 nt, Pseudomonas aeruginosa PA01
cguccaguuccagggucagcug

SEQ ID NO: 1430313 - RNA, 16 nt, Pseudomonas aeruginosa PA01
cguccaggugcggcug

SEQ ID NO: 1430314 - RNA, 13 nt, Pseudomonas aeruginosa PA01
cguccagugcggc

SEQ ID NO: 1430315 - RNA, 21 nt, Pseudomonas aeruginosa PA01
cguccagugcggcagucggua

SEQ ID NO: 1430316 - RNA, 13 nt, Pseudomonas aeruginosa PA01
cgucccagucggc

SEQ ID NO: 1430317 - RNA, 15 nt, Pseudomonas aeruginosa PA01
cgucccagucggcgu

SEQ ID NO: 1430318 - RNA, 19 nt, Pseudomonas aeruginosa PA01
cgucccagucggcguccgc

SEQ ID NO: 1430319 - RNA, 16 nt, Pseudomonas aeruginosa PA01
cguccaucgccaggcc

SEQ ID NO: 1430320 - RNA, 17 nt, Pseudomonas aeruginosa PA01
cguccaucgccaggcca

SEQ ID NO: 1430321 - RNA, 19 nt, Pseudomonas aeruginosa PA01
cguccagaugaaacugccc

SEQ ID NO: 1430322 - RNA, 22 nt, Pseudomonas aeruginosa PA01
cguccagaugaaacugcccggc

SEQ ID NO: 1430323 - RNA, 12 nt, Pseudomonas aeruginosa PA01
cgucuccugccg

SEQ ID NO: 1430324 - RNA, 16 nt, Pseudomonas aeruginosa PA01
cgucuccugccgccga

SEQ ID NO: 1430325 - RNA, 17 nt, Pseudomonas aeruginosa PA01
cgucucagcccucggcc

SEQ ID NO: 1430326 - RNA, 14 nt, Pseudomonas aeruginosa PA01
cgucuccaggcgcg

SEQ ID NO: 1430327 - RNA, 16 nt, Pseudomonas aeruginosa PA01
cgucguuucucggcga

SEQ ID NO: 1430328 - RNA, 21 nt, Pseudomonas aeruginosa PA01
cgucguuucucggcgauggcg

SEQ ID NO: 1430329 - RNA, 16 nt, Pseudomonas aeruginosa PA01
cgucgucggggugccg

SEQ ID NO: 1430330 - RNA, 14 nt, Pseudomonas aeruginosa PA01
cgucgucggcgacg

SEQ ID NO: 1430331 - RNA, 13 nt, Pseudomonas aeruginosa PA01
cgucgucggcgac

SEQ ID NO: 1430332 - RNA, 21 nt, Pseudomonas aeruginosa PA01
cgucguccaucgccgcggcga

SEQ ID NO: 1430333 - RNA, 23 nt, Pseudomonas aeruginosa PA01
cgucguccaucgccgcggcgaag

SEQ ID NO: 1430334 - RNA, 14 nt, Pseudomonas aeruginosa PA01
cgucguacucggcg

SEQ ID NO: 1430335 - RNA, 18 nt, Pseudomonas aeruginosa PA01
cgucguacucggcggggc

SEQ ID NO: 1430336 - RNA, 15 nt, Pseudomonas aeruginosa PA01
cgucguacuggcgga

SEQ ID NO: 1430337 - RNA, 17 nt, Pseudomonas aeruginosa PA01
cgucguacuucagcguc

SEQ ID NO: 1430338 - RNA, 16 nt, Pseudomonas aeruginosa PA01
cgucgguucagcgcgg

SEQ ID NO: 1430339 - RNA, 15 nt, Pseudomonas aeruginosa PA01
cgucggugccgacgg

SEQ ID NO: 1430340 - RNA, 17 nt, Pseudomonas aeruginosa PA01
cgucggugccgcccggc

SEQ ID NO: 1430341 - RNA, 20 nt, Pseudomonas aeruginosa PA01
cgucggugccgcccggcgcc

SEQ ID NO: 1430342 - RNA, 17 nt, Pseudomonas aeruginosa PA01
cgucgguguccgcggug

SEQ ID NO: 1430343 - RNA, 18 nt, Pseudomonas aeruginosa PA01
cgucguaggccgagccca

SEQ ID NO: 1430344 - RNA, 22 nt, Pseudomonas aeruginosa PA01
cgucguagcccuucuccgccag

SEQ ID NO: 1430345 - RNA, 14 nt, Pseudomonas aeruginosa PA01
cgucguagcgcagc

SEQ ID NO: 1430346 - RNA, 17 nt, Pseudomonas aeruginosa PA01
cgucguagcgcagcggc

SEQ ID NO: 1430347 - RNA, 23 nt, Pseudomonas aeruginosa PA01
cgucguaguggccgucgaagggc

SEQ ID NO: 1430348 - RNA, 12 nt, Pseudomonas aeruginosa PA01
cgucguccaccg

SEQ ID NO: 1430349 - RNA, 14 nt, Pseudomonas aeruginosa PA01
cgucguccagcggc

SEQ ID NO: 1430350 - RNA, 18 nt, Pseudomonas aeruginosa PA01
cgucguccagcggcucgc

SEQ ID NO: 1430351 - RNA, 15 nt, Pseudomonas aeruginosa PA01
cgucguccagcgggc

SEQ ID NO: 1430352 - RNA, 17 nt, Pseudomonas aeruginosa PA01
cgucguccagcgggccc

SEQ ID NO: 1430353 - RNA, 22 nt, Pseudomonas aeruginosa PA01
cgucguccagcgggcccauggc

SEQ ID NO: 1430354 - RNA, 14 nt, Pseudomonas aeruginosa PA01
cgucgucacgcagg

SEQ ID NO: 1430355 - RNA, 17 nt, Pseudomonas aeruginosa PA01
cgucgucaccucggcgc

SEQ ID NO: 1430356 - RNA, 18 nt, Pseudomonas aeruginosa PA01
cgucggcgccuuccugcu

SEQ ID NO: 1430357 - RNA, 17 nt, Pseudomonas aeruginosa PA01
cgucggcgaucgccagu

SEQ ID NO: 1430358 - RNA, 14 nt, Pseudomonas aeruginosa PA01
cgucggcgcccuuc

SEQ ID NO: 1430359 - RNA, 19 nt, Pseudomonas aeruginosa PA01
cgucggcggcacccucuuc

SEQ ID NO: 1430360 - RNA, 14 nt, Pseudomonas aeruginosa PA01
cgucggcggcggau

SEQ ID NO: 1430361 - RNA, 14 nt, Pseudomonas aeruginosa PA01
cgucggcggggcgc

SEQ ID NO: 1430362 - RNA, 15 nt, Pseudomonas aeruginosa PA01
cgucggcggggcgca

SEQ ID NO: 1430363 - RNA, 14 nt, Pseudomonas aeruginosa PA01
cgucggcgggaagg

SEQ ID NO: 1430364 - RNA, 19 nt, Pseudomonas aeruginosa PA01
cgucggcgcgggcgccgau

SEQ ID NO: 1430365 - RNA, 16 nt, Pseudomonas aeruginosa PA01
cgucggcgcggggcgu

SEQ ID NO: 1430366 - RNA, 17 nt, Pseudomonas aeruginosa PA01
cgucggcgcggccggcg

SEQ ID NO: 1430367 - RNA, 19 nt, Pseudomonas aeruginosa PA01
cgucggcgcggccggcgcc

SEQ ID NO: 1430368 - RNA, 14 nt, Pseudomonas aeruginosa PA01
cgucggcggucagc

SEQ ID NO: 1430369 - RNA, 15 nt, Pseudomonas aeruginosa PA01
cgucggcgucggcug

SEQ ID NO: 1430370 - RNA, 22 nt, Pseudomonas aeruginosa PA01
cgucggcuucugguucguccgc

SEQ ID NO: 1430371 - RNA, 23 nt, Pseudomonas aeruginosa PA01
cgucgggaucgagcaacagcagg

SEQ ID NO: 1430372 - RNA, 19 nt, Pseudomonas aeruginosa PA01
cgucgggaaaggccgccac

SEQ ID NO: 1430373 - RNA, 23 nt, Pseudomonas aeruginosa PA01
cgucgggaaaggccgccacggcg

SEQ ID NO: 1430374 - RNA, 21 nt, Pseudomonas aeruginosa PA01
cgucggcgugguugccugcug

SEQ ID NO: 1430375 - RNA, 20 nt, Pseudomonas aeruginosa PA01
cgucgggacgcaugcgcggc

SEQ ID NO: 1430376 - RNA, 13 nt, Pseudomonas aeruginosa PA01
cgucggucggcca

SEQ ID NO: 1430377 - RNA, 15 nt, Pseudomonas aeruginosa PA01
cgucggucggccagg

SEQ ID NO: 1430378 - RNA, 19 nt, Pseudomonas aeruginosa PA01
cgucggucggccaggacgc

SEQ ID NO: 1430379 - RNA, 21 nt, Pseudomonas aeruginosa PA01
cgucggucaggacagcgugcg

SEQ ID NO: 1430380 - RNA, 22 nt, Pseudomonas aeruginosa PA01
cgucgggcgaaacggcaggcca

SEQ ID NO: 1430381 - RNA, 20 nt, Pseudomonas aeruginosa PA01
cgucgggcaguuccgccaga

SEQ ID NO: 1430382 - RNA, 21 nt, Pseudomonas aeruginosa PA01
cgucgggcagaguggcgcggc

SEQ ID NO: 1430383 - RNA, 22 nt, Pseudomonas aeruginosa PA01
cgucgggcagaguggcgcggcu

SEQ ID NO: 1430384 - RNA, 17 nt, Pseudomonas aeruginosa PA01
cgucggggugccgccag

SEQ ID NO: 1430385 - RNA, 14 nt, Pseudomonas aeruginosa PA01
cgucgggggcgcgu

SEQ ID NO: 1430386 - RNA, 21 nt, Pseudomonas aeruginosa PA01
cgucggacuugaugaccgucc

SEQ ID NO: 1430387 - RNA, 20 nt, Pseudomonas aeruginosa PA01
cgucggcccuugugaaaggg

SEQ ID NO: 1430388 - RNA, 18 nt, Pseudomonas aeruginosa PA01
cgucggcgaagccugcgg

SEQ ID NO: 1430389 - RNA, 20 nt, Pseudomonas aeruginosa PA01
cgucggcgaagccugcggcg

SEQ ID NO: 1430390 - RNA, 16 nt, Pseudomonas aeruginosa PA01
cgucggccuggcgcag

SEQ ID NO: 1430391 - RNA, 20 nt, Pseudomonas aeruginosa PA01
cgucggcgaacccggcgcgg

SEQ ID NO: 1430392 - RNA, 22 nt, Pseudomonas aeruginosa PA01
cgucggcgaacccggcgcggcg

SEQ ID NO: 1430393 - RNA, 15 nt, Pseudomonas aeruginosa PA01
cgucggcgaucgcca

SEQ ID NO: 1430394 - RNA, 13 nt, Pseudomonas aeruginosa PA01
cgucggcgaucac

SEQ ID NO: 1430395 - RNA, 16 nt, Pseudomonas aeruginosa PA01
cgucggcgagcaggcg

SEQ ID NO: 1430396 - RNA, 15 nt, Pseudomonas aeruginosa PA01
cgucggccugcaaca

SEQ ID NO: 1430397 - RNA, 22 nt, Pseudomonas aeruginosa PA01
cgucggccugcaacacccaggc

SEQ ID NO: 1430398 - RNA, 14 nt, Pseudomonas aeruginosa PA01
cgucggccgcucgg

SEQ ID NO: 1430399 - RNA, 11 nt, Pseudomonas aeruginosa PA01
cgucggccggg

SEQ ID NO: 1430400 - RNA, 21 nt, Pseudomonas aeruginosa PA01
cgucggccggggucaggccga

SEQ ID NO: 1430401 - RNA, 13 nt, Pseudomonas aeruginosa PA01
cgucggccucgcc

SEQ ID NO: 1430402 - RNA, 15 nt, Pseudomonas aeruginosa PA01
cgucggccucgccga

SEQ ID NO: 1430403 - RNA, 17 nt, Pseudomonas aeruginosa PA01
cgucgccuuccaccacc

SEQ ID NO: 1430404 - RNA, 20 nt, Pseudomonas aeruginosa PA01
cgucgccuuccaccaccagg

SEQ ID NO: 1430405 - RNA, 17 nt, Pseudomonas aeruginosa PA01
cgucgcgauagacgccg

SEQ ID NO: 1430406 - RNA, 22 nt, Pseudomonas aeruginosa PA01
cgucgcgauagacgccggcgac

SEQ ID NO: 1430407 - RNA, 14 nt, Pseudomonas aeruginosa PA01
cgucgccgccgcgg

SEQ ID NO: 1430408 - RNA, 17 nt, Pseudomonas aeruginosa PA01
cgucgccugccaggcgg

SEQ ID NO: 1430409 - RNA, 22 nt, Pseudomonas aeruginosa PA01
cgucgccugccaggcggggaug

SEQ ID NO: 1430410 - RNA, 17 nt, Pseudomonas aeruginosa PA01
cgucgcgguacagccgg

SEQ ID NO: 1430411 - RNA, 15 nt, Pseudomonas aeruginosa PA01
cgucgcgucggccug

SEQ ID NO: 1430412 - RNA, 18 nt, Pseudomonas aeruginosa PA01
cgucgcgucggccuggcg

SEQ ID NO: 1430413 - RNA, 22 nt, Pseudomonas aeruginosa PA01
cgucgcggucuuccgccgacug

SEQ ID NO: 1430414 - RNA, 16 nt, Pseudomonas aeruginosa PA01
cgucgcuuccggcgcc

SEQ ID NO: 1430415 - RNA, 17 nt, Pseudomonas aeruginosa PA01
cgucgcuuccggcgcca

SEQ ID NO: 1430416 - RNA, 18 nt, Pseudomonas aeruginosa PA01
cgucgcuuccggcgccaa

SEQ ID NO: 1430417 - RNA, 20 nt, Pseudomonas aeruginosa PA01
cgucgcuuccggcgccaacc

SEQ ID NO: 1430418 - RNA, 14 nt, Pseudomonas aeruginosa PA01
cgucgcuucgcccg

SEQ ID NO: 1430419 - RNA, 17 nt, Pseudomonas aeruginosa PA01
cgucgcuucgcccgccg

SEQ ID NO: 1430420 - RNA, 18 nt, Pseudomonas aeruginosa PA01
cgucgcuucgcccgccgc

SEQ ID NO: 1430421 - RNA, 19 nt, Pseudomonas aeruginosa PA01
cgucgcuucgcccgccgcc

SEQ ID NO: 1430422 - RNA, 15 nt, Pseudomonas aeruginosa PA01
cgucggaagcgucag

SEQ ID NO: 1430423 - RNA, 19 nt, Pseudomonas aeruginosa PA01
cgucggaagcgucagccgc

SEQ ID NO: 1430424 - RNA, 17 nt, Pseudomonas aeruginosa PA01
cgucgcuguagcggcuc

SEQ ID NO: 1430425 - RNA, 21 nt, Pseudomonas aeruginosa PA01
cgucgcuguagcggcucgccg

SEQ ID NO: 1430426 - RNA, 14 nt, Pseudomonas aeruginosa PA01
cgucgaugcguccg

SEQ ID NO: 1430427 - RNA, 16 nt, Pseudomonas aeruginosa PA01
cgucgaugcguccgcg

SEQ ID NO: 1430428 - RNA, 20 nt, Pseudomonas aeruginosa PA01
cgucgaugcguccgcgcagg

SEQ ID NO: 1430429 - RNA, 18 nt, Pseudomonas aeruginosa PA01
cgucgaugccuucggcgg

SEQ ID NO: 1430430 - RNA, 14 nt, Pseudomonas aeruginosa PA01
cgucgaugcgccuc

SEQ ID NO: 1430431 - RNA, 20 nt, Pseudomonas aeruginosa PA01
cgucgaugcgccucagcggc

SEQ ID NO: 1430432 - RNA, 20 nt, Pseudomonas aeruginosa PA01
cgucgaugaucugcauggcg

SEQ ID NO: 1430433 - RNA, 18 nt, Pseudomonas aeruginosa PA01
cgucgaugaggucgcagc

SEQ ID NO: 1430434 - RNA, 21 nt, Pseudomonas aeruginosa PA01
cgucgaugaggucgcagcguu

SEQ ID NO: 1430435 - RNA, 22 nt, Pseudomonas aeruginosa PA01
cgucgaucaccuugcccucgcg

SEQ ID NO: 1430436 - RNA, 17 nt, Pseudomonas aeruginosa PA01
cgucgauauugccgcgg

SEQ ID NO: 1430437 - RNA, 17 nt, Pseudomonas aeruginosa PA01
cgucgauauccagcggc

SEQ ID NO: 1430438 - RNA, 18 nt, Pseudomonas aeruginosa PA01
cgucgauauccagcggca

SEQ ID NO: 1430439 - RNA, 20 nt, Pseudomonas aeruginosa PA01
cgucgauauccagcggcagc

SEQ ID NO: 1430440 - RNA, 18 nt, Pseudomonas aeruginosa PA01
cgucgacgcccugggcga

SEQ ID NO: 1430441 - RNA, 14 nt, Pseudomonas aeruginosa PA01
cgucgacgcagcgc

SEQ ID NO: 1430442 - RNA, 16 nt, Pseudomonas aeruginosa PA01
cgucgacgcagcgcgc

SEQ ID NO: 1430443 - RNA, 13 nt, Pseudomonas aeruginosa PA01
cgucgacggccuu

SEQ ID NO: 1430444 - RNA, 16 nt, Pseudomonas aeruginosa PA01
cgucgagucgcgcagc

SEQ ID NO: 1430445 - RNA, 22 nt, Pseudomonas aeruginosa PA01
cgucgcaccuguuccagcaacg

SEQ ID NO: 1430446 - RNA, 15 nt, Pseudomonas aeruginosa PA01
cgucgcaccaggugc

SEQ ID NO: 1430447 - RNA, 17 nt, Pseudomonas aeruginosa PA01
cgucgcacccggcccau

SEQ ID NO: 1430448 - RNA, 20 nt, Pseudomonas aeruginosa PA01
cgucgcacccggcccauggc

SEQ ID NO: 1430449 - RNA, 20 nt, Pseudomonas aeruginosa PA01
cgucgcagagacgcagcgcu

SEQ ID NO: 1430450 - RNA, 15 nt, Pseudomonas aeruginosa PA01
cgucgcaggccuggu

SEQ ID NO: 1430451 - RNA, 19 nt, Pseudomonas aeruginosa PA01
cgucgcagguaacccgcgg

SEQ ID NO: 1430452 - RNA, 18 nt, Pseudomonas aeruginosa PA01
cgucgccaagcccggcga

SEQ ID NO: 1430453 - RNA, 19 nt, Pseudomonas aeruginosa PA01
cgucgccaacgcgccgucg

SEQ ID NO: 1430454 - RNA, 19 nt, Pseudomonas aeruginosa PA01
cgucgccccacagcggugg

SEQ ID NO: 1430455 - RNA, 21 nt, Pseudomonas aeruginosa PA01
cgucgccccacagcgguggga

SEQ ID NO: 1430456 - RNA, 23 nt, Pseudomonas aeruginosa PA01
cgucgcccaugugcuugaccgcc

SEQ ID NO: 1430457 - RNA, 16 nt, Pseudomonas aeruginosa PA01
cgucgcauccaccagc

SEQ ID NO: 1430458 - RNA, 15 nt, Pseudomonas aeruginosa PA01
cgucgcccaggccgc

SEQ ID NO: 1430459 - RNA, 17 nt, Pseudomonas aeruginosa PA01
cgucgcccaggccgcug

SEQ ID NO: 1430460 - RNA, 15 nt, Pseudomonas aeruginosa PA01
cgucgccgccgaggc

SEQ ID NO: 1430461 - RNA, 20 nt, Pseudomonas aeruginosa PA01
cgucgccgccgaggcgcgcc

SEQ ID NO: 1430462 - RNA, 13 nt, Pseudomonas aeruginosa PA01
cgucgccgccagc

SEQ ID NO: 1430463 - RNA, 16 nt, Pseudomonas aeruginosa PA01
cgucgccgccagcgcc

SEQ ID NO: 1430464 - RNA, 14 nt, Pseudomonas aeruginosa PA01
cgucgccgcccggc

SEQ ID NO: 1430465 - RNA, 16 nt, Pseudomonas aeruginosa PA01
cgucgccgcccggcag

SEQ ID NO: 1430466 - RNA, 20 nt, Pseudomonas aeruginosa PA01
cgucgccgcccggcagcggc

SEQ ID NO: 1430467 - RNA, 23 nt, Pseudomonas aeruginosa PA01
cgucgcccuucaggucgacaugc

SEQ ID NO: 1430468 - RNA, 13 nt, Pseudomonas aeruginosa PA01
cgucgccgacugc

SEQ ID NO: 1430469 - RNA, 16 nt, Pseudomonas aeruginosa PA01
cgucgccgacuucggc

SEQ ID NO: 1430470 - RNA, 23 nt, Pseudomonas aeruginosa PA01
cgucgccgaccaggcggccgucg

SEQ ID NO: 1430471 - RNA, 15 nt, Pseudomonas aeruginosa PA01
cgucgccgacccugc

SEQ ID NO: 1430472 - RNA, 16 nt, Pseudomonas aeruginosa PA01
cgucgccgacccugca

SEQ ID NO: 1430473 - RNA, 14 nt, Pseudomonas aeruginosa PA01
cgucgcccuggccg

SEQ ID NO: 1430474 - RNA, 15 nt, Pseudomonas aeruginosa PA01
cgucgcccuggugca

SEQ ID NO: 1430475 - RNA, 19 nt, Pseudomonas aeruginosa PA01
cgucgcccuggugcacggc

SEQ ID NO: 1430476 - RNA, 16 nt, Pseudomonas aeruginosa PA01
cgucgcccucggcgcu

SEQ ID NO: 1430477 - RNA, 19 nt, Pseudomonas aeruginosa PA01
cgucgcccucggcgcuggc

SEQ ID NO: 1430478 - RNA, 20 nt, Pseudomonas aeruginosa PA01
cgucgcccucggcgcuggcc

SEQ ID NO: 1430479 - RNA, 16 nt, Pseudomonas aeruginosa PA01
cugguuguaggcgccg

SEQ ID NO: 1430480 - RNA, 17 nt, Pseudomonas aeruginosa PA01
cugguuguaggcgccgc

SEQ ID NO: 1430481 - RNA, 16 nt, Pseudomonas aeruginosa PA01
cugguuggccgccugg

SEQ ID NO: 1430482 - RNA, 17 nt, Pseudomonas aeruginosa PA01
cugguuggccgccuggc

SEQ ID NO: 1430483 - RNA, 20 nt, Pseudomonas aeruginosa PA01
cugguugaccugcagcgccu

SEQ ID NO: 1430484 - RNA, 16 nt, Pseudomonas aeruginosa PA01
cugguugaggccgucc

SEQ ID NO: 1430485 - RNA, 17 nt, Pseudomonas aeruginosa PA01
cugguugaggucgacga

SEQ ID NO: 1430486 - RNA, 13 nt, Pseudomonas aeruginosa PA01
cugguugccagca

SEQ ID NO: 1430487 - RNA, 21 nt, Pseudomonas aeruginosa PA01
cugguugcgccauugccgcca

SEQ ID NO: 1430488 - RNA, 23 nt, Pseudomonas aeruginosa PA01
cugguugcgccauugccgccagg

SEQ ID NO: 1430489 - RNA, 23 nt, Pseudomonas aeruginosa PA01
cugguugaacugcgguccggcga

SEQ ID NO: 1430490 - RNA, 16 nt, Pseudomonas aeruginosa PA01
cuggugcggcaccagc

SEQ ID NO: 1430491 - RNA, 20 nt, Pseudomonas aeruginosa PA01
cuggugcggcaccagccagg

SEQ ID NO: 1430492 - RNA, 14 nt, Pseudomonas aeruginosa PA01
cuggugcggccgau

SEQ ID NO: 1430493 - RNA, 13 nt, Pseudomonas aeruginosa PA01
cuggugccgacgc

SEQ ID NO: 1430494 - RNA, 14 nt, Pseudomonas aeruginosa PA01
cuggugccgggcuu

SEQ ID NO: 1430495 - RNA, 15 nt, Pseudomonas aeruginosa PA01
cuggugcugcuccau

SEQ ID NO: 1430496 - RNA, 14 nt, Pseudomonas aeruginosa PA01
cugguggaacagca

SEQ ID NO: 1430497 - RNA, 17 nt, Pseudomonas aeruginosa PA01
cugguggaacagcauca

SEQ ID NO: 1430498 - RNA, 17 nt, Pseudomonas aeruginosa PA01
cugguggaacagccgca

SEQ ID NO: 1430499 - RNA, 21 nt, Pseudomonas aeruginosa PA01
cuggugggcacgagucgaggc

SEQ ID NO: 1430500 - RNA, 15 nt, Pseudomonas aeruginosa PA01
cuggugggcggcggc

SEQ ID NO: 1430501 - RNA, 20 nt, Pseudomonas aeruginosa PA01
cugguggacggucucgccgc

SEQ ID NO: 1430502 - RNA, 22 nt, Pseudomonas aeruginosa PA01
cugguggacggucucgccgccg

SEQ ID NO: 1430503 - RNA, 20 nt, Pseudomonas aeruginosa PA01
cugguggacgucgucggcga

SEQ ID NO: 1430504 - RNA, 20 nt, Pseudomonas aeruginosa PA01
cugguggauguucgccgcca

SEQ ID NO: 1430505 - RNA, 15 nt, Pseudomonas aeruginosa PA01
cuggucgauccgcgc

SEQ ID NO: 1430506 - RNA, 16 nt, Pseudomonas aeruginosa PA01
cuggucgaucucgucg

SEQ ID NO: 1430507 - RNA, 13 nt, Pseudomonas aeruginosa PA01
cuggucgcggcug

SEQ ID NO: 1430508 - RNA, 18 nt, Pseudomonas aeruginosa PA01
cuggucgcggcugcgcgc

SEQ ID NO: 1430509 - RNA, 22 nt, Pseudomonas aeruginosa PA01
cuggucgcggcugcgcgccggg

SEQ ID NO: 1430510 - RNA, 13 nt, Pseudomonas aeruginosa PA01
cuggucgccgaag

SEQ ID NO: 1430511 - RNA, 13 nt, Pseudomonas aeruginosa PA01
cuggucgccgaca

SEQ ID NO: 1430512 - RNA, 17 nt, Pseudomonas aeruginosa PA01
cuggucgcugaggccgc

SEQ ID NO: 1430513 - RNA, 20 nt, Pseudomonas aeruginosa PA01
cuggucgcguuccagcuccg

SEQ ID NO: 1430514 - RNA, 18 nt, Pseudomonas aeruginosa PA01
cuggucgcuccagcccca

SEQ ID NO: 1430515 - RNA, 14 nt, Pseudomonas aeruginosa PA01
cugguagcccaggc

SEQ ID NO: 1430516 - RNA, 20 nt, Pseudomonas aeruginosa PA01
cugguagccgaagucggcgu

SEQ ID NO: 1430517 - RNA, 14 nt, Pseudomonas aeruginosa PA01
cugguaggccagca

SEQ ID NO: 1430518 - RNA, 23 nt, Pseudomonas aeruginosa PA01
cugguagcuaccgucggccugca

SEQ ID NO: 1430519 - RNA, 16 nt, Pseudomonas aeruginosa PA01
cugguagcugcggccg

SEQ ID NO: 1430520 - RNA, 19 nt, Pseudomonas aeruginosa PA01
cugguagcugcggccgagc

SEQ ID NO: 1430521 - RNA, 17 nt, Pseudomonas aeruginosa PA01
cugguaguaggcgcucu

SEQ ID NO: 1430522 - RNA, 19 nt, Pseudomonas aeruginosa PA01
cugguaguaggcgcucugg

SEQ ID NO: 1430523 - RNA, 17 nt, Pseudomonas aeruginosa PA01
cugguaggcgucgucga

SEQ ID NO: 1430524 - RNA, 20 nt, Pseudomonas aeruginosa PA01
cugguaggugcgcuggcgcc

SEQ ID NO: 1430525 - RNA, 14 nt, Pseudomonas aeruginosa PA01
cugguaggcggcga

SEQ ID NO: 1430526 - RNA, 14 nt, Pseudomonas aeruginosa PA01
cuggucgcagccgc

SEQ ID NO: 1430527 - RNA, 17 nt, Pseudomonas aeruginosa PA01
cuggucgcagccgcgca

SEQ ID NO: 1430528 - RNA, 20 nt, Pseudomonas aeruginosa PA01
cuggucggcuuccgccgcca

SEQ ID NO: 1430529 - RNA, 16 nt, Pseudomonas aeruginosa PA01
cuggucggggccggcg

SEQ ID NO: 1430530 - RNA, 20 nt, Pseudomonas aeruginosa PA01
cuggucggggccggcgaugc

SEQ ID NO: 1430531 - RNA, 20 nt, Pseudomonas aeruginosa PA01
cuggucggggcgcaaggcca

SEQ ID NO: 1430532 - RNA, 17 nt, Pseudomonas aeruginosa PA01
cuggucgugguccagcu

SEQ ID NO: 1430533 - RNA, 19 nt, Pseudomonas aeruginosa PA01
cuggucguucagugccagc

SEQ ID NO: 1430534 - RNA, 20 nt, Pseudomonas aeruginosa PA01
cuggucguucagugccagca

SEQ ID NO: 1430535 - RNA, 22 nt, Pseudomonas aeruginosa PA01
cuggucguucagugccagcaga

SEQ ID NO: 1430536 - RNA, 23 nt, Pseudomonas aeruginosa PA01
cuggucgucgcgguacagccggu

SEQ ID NO: 1430537 - RNA, 24 nt, Pseudomonas aeruginosa PA01
cuggugaucgaccacacaugcagg

SEQ ID NO: 1430538 - RNA, 21 nt, Pseudomonas aeruginosa PA01
cuggugaugucgcggcaggcg

SEQ ID NO: 1430539 - RNA, 16 nt, Pseudomonas aeruginosa PA01
cuggugcaccuggcga

SEQ ID NO: 1430540 - RNA, 20 nt, Pseudomonas aeruginosa PA01
cuggucuucgguggcggcga

SEQ ID NO: 1430541 - RNA, 22 nt, Pseudomonas aeruginosa PA01
cuggugacccggacagccuucg

SEQ ID NO: 1430542 - RNA, 18 nt, Pseudomonas aeruginosa PA01
cuggugacggugaccuug

SEQ ID NO: 1430543 - RNA, 17 nt, Pseudomonas aeruginosa PA01
cugggcagcgccgccgg

SEQ ID NO: 1430544 - RNA, 19 nt, Pseudomonas aeruginosa PA01
cugggcagcgccgccgggc

SEQ ID NO: 1430545 - RNA, 17 nt, Pseudomonas aeruginosa PA01
cugggccaccuggcucu

SEQ ID NO: 1430546 - RNA, 23 nt, Pseudomonas aeruginosa PA01
cugggccaccuggcucuguuccu

SEQ ID NO: 1430547 - RNA, 14 nt, Pseudomonas aeruginosa PA01
cugggccagcgccg

SEQ ID NO: 1430548 - RNA, 16 nt, Pseudomonas aeruginosa PA01
cugggcauggcuggcg

SEQ ID NO: 1430549 - RNA, 16 nt, Pseudomonas aeruginosa PA01
cugggccccggccagg

SEQ ID NO: 1430550 - RNA, 16 nt, Pseudomonas aeruginosa PA01
cugggccccggccggc

SEQ ID NO: 1430551 - RNA, 19 nt, Pseudomonas aeruginosa PA01
cugggccccggccggcagg

SEQ ID NO: 1430552 - RNA, 22 nt, Pseudomonas aeruginosa PA01
cugggccccggccggcaggagg

SEQ ID NO: 1430553 - RNA, 19 nt, Pseudomonas aeruginosa PA01
cugggccccggcgccgacc

SEQ ID NO: 1430554 - RNA, 14 nt, Pseudomonas aeruginosa PA01
cugggccaucgccg

SEQ ID NO: 1430555 - RNA, 15 nt, Pseudomonas aeruginosa PA01
cugggccaucgccgg

SEQ ID NO: 1430556 - RNA, 17 nt, Pseudomonas aeruginosa PA01
cugggccaucgccggcc

SEQ ID NO: 1430557 - RNA, 21 nt, Pseudomonas aeruginosa PA01
cugggccaucgccggcccgcg

SEQ ID NO: 1430558 - RNA, 12 nt, Pseudomonas aeruginosa PA01
cugggccaucgu

SEQ ID NO: 1430559 - RNA, 14 nt, Pseudomonas aeruginosa PA01
cugggccaucguca

SEQ ID NO: 1430560 - RNA, 14 nt, Pseudomonas aeruginosa PA01
cugggccaugaccu

SEQ ID NO: 1430561 - RNA, 23 nt, Pseudomonas aeruginosa PA01
cugggccaugaccucggccagcc

SEQ ID NO: 1430562 - RNA, 21 nt, Pseudomonas aeruginosa PA01
cuggccggugccauacagcgc

SEQ ID NO: 1430563 - RNA, 23 nt, Pseudomonas aeruginosa PA01
cuggccggugccauacagcgccc

SEQ ID NO: 1430564 - RNA, 16 nt, Pseudomonas aeruginosa PA01
cuggccggugccgccc

SEQ ID NO: 1430565 - RNA, 20 nt, Pseudomonas aeruginosa PA01
cuggccgucccugaccagca

SEQ ID NO: 1430566 - RNA, 18 nt, Pseudomonas aeruginosa PA01
cuggccgucgacccgccu

SEQ ID NO: 1430567 - RNA, 12 nt, Pseudomonas aeruginosa PA01
cuggccgucgag

SEQ ID NO: 1430568 - RNA, 20 nt, Pseudomonas aeruginosa PA01
cuggccgucgaggucggcga

SEQ ID NO: 1430569 - RNA, 23 nt, Pseudomonas aeruginosa PA01
cuggccgucgggauagucguucu

SEQ ID NO: 1430570 - RNA, 20 nt, Pseudomonas aeruginosa PA01
cuggccgucuuccagggcgg

SEQ ID NO: 1430571 - RNA, 23 nt, Pseudomonas aeruginosa PA01
cuggccgucuuccagggcggcgc

SEQ ID NO: 1430572 - RNA, 14 nt, Pseudomonas aeruginosa PA01
cuggccguucucca

SEQ ID NO: 1430573 - RNA, 17 nt, Pseudomonas aeruginosa PA01
cuggccguucuccaggu

SEQ ID NO: 1430574 - RNA, 19 nt, Pseudomonas aeruginosa PA01
cuggccguucuccaggucg

SEQ ID NO: 1430575 - RNA, 19 nt, Pseudomonas aeruginosa PA01
cuggccguugcgcaggcgg

SEQ ID NO: 1430576 - RNA, 19 nt, Pseudomonas aeruginosa PA01
cuggccgugcucgaugauc

SEQ ID NO: 1430577 - RNA, 16 nt, Pseudomonas aeruginosa PA01
cuggccgucggccugc

SEQ ID NO: 1430578 - RNA, 15 nt, Pseudomonas aeruginosa PA01
cugggaguuccgcgc

SEQ ID NO: 1430579 - RNA, 22 nt, Pseudomonas aeruginosa PA01
cugggcaccaguggcgccgcca

SEQ ID NO: 1430580 - RNA, 14 nt, Pseudomonas aeruginosa PA01
cuggguuggcgcga

SEQ ID NO: 1430581 - RNA, 23 nt, Pseudomonas aeruginosa PA01
cugguaacugggaauggcgaugc

SEQ ID NO: 1430582 - RNA, 17 nt, Pseudomonas aeruginosa PA01
cugguaccugccggcac

SEQ ID NO: 1430583 - RNA, 21 nt, Pseudomonas aeruginosa PA01
cugguagaccaccgugcgcac

SEQ ID NO: 1430584 - RNA, 19 nt, Pseudomonas aeruginosa PA01
cugguacagcacccaggcg

SEQ ID NO: 1430585 - RNA, 20 nt, Pseudomonas aeruginosa PA01
cugguacagcacccaggcga

SEQ ID NO: 1430586 - RNA, 16 nt, Pseudomonas aeruginosa PA01
cuggggugaggccgag

SEQ ID NO: 1430587 - RNA, 17 nt, Pseudomonas aeruginosa PA01
cuggguaggaucgcuau

SEQ ID NO: 1430588 - RNA, 17 nt, Pseudomonas aeruginosa PA01
cuggguacgguuggcca

SEQ ID NO: 1430589 - RNA, 19 nt, Pseudomonas aeruginosa PA01
cuggguacgguuggccagc

SEQ ID NO: 1430590 - RNA, 17 nt, Pseudomonas aeruginosa PA01
cuggguauagaccagca

SEQ ID NO: 1430591 - RNA, 15 nt, Pseudomonas aeruginosa PA01
cuggguaugcgcggu

SEQ ID NO: 1430592 - RNA, 22 nt, Pseudomonas aeruginosa PA01
cugggcgccgccagccagagca

SEQ ID NO: 1430593 - RNA, 18 nt, Pseudomonas aeruginosa PA01
cugggcgccgccggugca

SEQ ID NO: 1430594 - RNA, 19 nt, Pseudomonas aeruginosa PA01
cugggcgccucgucgacgc

SEQ ID NO: 1430595 - RNA, 22 nt, Pseudomonas aeruginosa PA01
cugggcggccagguugaccagu

SEQ ID NO: 1430596 - RNA, 12 nt, Pseudomonas aeruginosa PA01
cugggcggcggg

SEQ ID NO: 1430597 - RNA, 18 nt, Pseudomonas aeruginosa PA01
cuggggcaucucggccac

SEQ ID NO: 1430598 - RNA, 22 nt, Pseudomonas aeruginosa PA01
cuggggcaucucggccaccugc

SEQ ID NO: 1430599 - RNA, 13 nt, Pseudomonas aeruginosa PA01
cugggcggccucg

SEQ ID NO: 1430600 - RNA, 20 nt, Pseudomonas aeruginosa PA01
cugggcggcgaccauccagc

SEQ ID NO: 1430601 - RNA, 17 nt, Pseudomonas aeruginosa PA01
cugggcggcgaccugcg

SEQ ID NO: 1430602 - RNA, 22 nt, Pseudomonas aeruginosa PA01
cugggcggcgaccugcggcaag

SEQ ID NO: 1430603 - RNA, 16 nt, Pseudomonas aeruginosa PA01
cugggcggcgaggccg

SEQ ID NO: 1430604 - RNA, 17 nt, Pseudomonas aeruginosa PA01
cugggcggcgaggccga

SEQ ID NO: 1430605 - RNA, 15 nt, Pseudomonas aeruginosa PA01
cugggcggucggcuc

SEQ ID NO: 1430606 - RNA, 14 nt, Pseudomonas aeruginosa PA01
cugggcggucucgg

SEQ ID NO: 1430607 - RNA, 23 nt, Pseudomonas aeruginosa PA01
cugucuacucgacgcugcccagc

SEQ ID NO: 1430608 - RNA, 21 nt, Pseudomonas aeruginosa PA01
cugucuaucccgugccgggcc

SEQ ID NO: 1430609 - RNA, 15 nt, Pseudomonas aeruginosa PA01
cugucucgccagccc

SEQ ID NO: 1430610 - RNA, 18 nt, Pseudomonas aeruginosa PA01
cugucucgccagcccggc

SEQ ID NO: 1430611 - RNA, 15 nt, Pseudomonas aeruginosa PA01
cugucucgccgaugc

SEQ ID NO: 1430612 - RNA, 21 nt, Pseudomonas aeruginosa PA01
cugucgucgaggguggcgccg

SEQ ID NO: 1430613 - RNA, 22 nt, Pseudomonas aeruginosa PA01
cugucgucgaggguggcgccga

SEQ ID NO: 1430614 - RNA, 19 nt, Pseudomonas aeruginosa PA01
cugucgucggcgcggccgg

SEQ ID NO: 1430615 - RNA, 23 nt, Pseudomonas aeruginosa PA01
cugucgucggcgcggccggcgcc

SEQ ID NO: 1430616 - RNA, 16 nt, Pseudomonas aeruginosa PA01
cugucgauaccagcgc

SEQ ID NO: 1430617 - RNA, 17 nt, Pseudomonas aeruginosa PA01
cugucgauaccagcgcc

SEQ ID NO: 1430618 - RNA, 18 nt, Pseudomonas aeruginosa PA01
cugucgagggucugcucg

SEQ ID NO: 1430619 - RNA, 20 nt, Pseudomonas aeruginosa PA01
cugucguaguccugggccgg

SEQ ID NO: 1430620 - RNA, 21 nt, Pseudomonas aeruginosa PA01
cugucguaguccugggccggu

SEQ ID NO: 1430621 - RNA, 14 nt, Pseudomonas aeruginosa PA01
cugucgcagcgggc

SEQ ID NO: 1430622 - RNA, 16 nt, Pseudomonas aeruginosa PA01
cugucgcagcgggcug

SEQ ID NO: 1430623 - RNA, 19 nt, Pseudomonas aeruginosa PA01
cuguucgcgcccgucgucg

SEQ ID NO: 1430624 - RNA, 23 nt, Pseudomonas aeruginosa PA01
cuguucgucgcgucgcacccggc

SEQ ID NO: 1430625 - RNA, 16 nt, Pseudomonas aeruginosa PA01
cuguucgucuggcgcc

SEQ ID NO: 1430626 - RNA, 18 nt, Pseudomonas aeruginosa PA01
cuguucucuuugaccuug

SEQ ID NO: 1430627 - RNA, 16 nt, Pseudomonas aeruginosa PA01
cuguucgggucgcguu

SEQ ID NO: 1430628 - RNA, 17 nt, Pseudomonas aeruginosa PA01
cuguucgucccgagcac

SEQ ID NO: 1430629 - RNA, 16 nt, Pseudomonas aeruginosa PA01
cuguuccgccguggga

SEQ ID NO: 1430630 - RNA, 16 nt, Pseudomonas aeruginosa PA01
cuguuccucagccccu

SEQ ID NO: 1430631 - RNA, 17 nt, Pseudomonas aeruginosa PA01
cuguuccagcaacgccu

SEQ ID NO: 1430632 - RNA, 19 nt, Pseudomonas aeruginosa PA01
cuguucagcaggagcagcu

SEQ ID NO: 1430633 - RNA, 20 nt, Pseudomonas aeruginosa PA01
cuguccaccgguggcgacgc

SEQ ID NO: 1430634 - RNA, 17 nt, Pseudomonas aeruginosa PA01
cuguccagucaccaggu

SEQ ID NO: 1430635 - RNA, 14 nt, Pseudomonas aeruginosa PA01
cuguaaucgccgcu

SEQ ID NO: 1430636 - RNA, 15 nt, Pseudomonas aeruginosa PA01
cugucccgccgcgcc

SEQ ID NO: 1430637 - RNA, 16 nt, Pseudomonas aeruginosa PA01
cugucccgccgcgccg

SEQ ID NO: 1430638 - RNA, 17 nt, Pseudomonas aeruginosa PA01
cuguccgaacagggcga

SEQ ID NO: 1430639 - RNA, 15 nt, Pseudomonas aeruginosa PA01
cuguccuccagcggc

SEQ ID NO: 1430640 - RNA, 15 nt, Pseudomonas aeruginosa PA01
cuguccgcugcgcga

SEQ ID NO: 1430641 - RNA, 15 nt, Pseudomonas aeruginosa PA01
cuguccggcgcugag

SEQ ID NO: 1430642 - RNA, 19 nt, Pseudomonas aeruginosa PA01
cugucgagcagggucgcga

SEQ ID NO: 1430643 - RNA, 21 nt, Pseudomonas aeruginosa PA01
cugucgagcgaagcgucgaug

SEQ ID NO: 1430644 - RNA, 18 nt, Pseudomonas aeruginosa PA01
cuucacguccagcuguac

SEQ ID NO: 1430645 - RNA, 20 nt, Pseudomonas aeruginosa PA01
cuucacguaguugacccgcc

SEQ ID NO: 1430646 - RNA, 18 nt, Pseudomonas aeruginosa PA01
cuucaccguucccagcag

SEQ ID NO: 1430647 - RNA, 21 nt, Pseudomonas aeruginosa PA01
cuucaccguucccagcagcgc

SEQ ID NO: 1430648 - RNA, 11 nt, Pseudomonas aeruginosa PA01
cuucaccggcg

SEQ ID NO: 1430649 - RNA, 16 nt, Pseudomonas aeruginosa PA01
cuucacccgcagcggc

SEQ ID NO: 1430650 - RNA, 20 nt, Pseudomonas aeruginosa PA01
cuucacccgcagcggcagcg

SEQ ID NO: 1430651 - RNA, 21 nt, Pseudomonas aeruginosa PA01
cuguugcccugggccggcgcc

SEQ ID NO: 1430652 - RNA, 23 nt, Pseudomonas aeruginosa PA01
cuguugcccugggccggcgccag

SEQ ID NO: 1430653 - RNA, 15 nt, Pseudomonas aeruginosa PA01
cuguugccgcgcuug

SEQ ID NO: 1430654 - RNA, 17 nt, Pseudomonas aeruginosa PA01
cuguugccgcugcaggc

SEQ ID NO: 1430655 - RNA, 19 nt, Pseudomonas aeruginosa PA01
cuguugccgcugcaggcca

SEQ ID NO: 1430656 - RNA, 21 nt, Pseudomonas aeruginosa PA01
cuguugccggcaaacgccgcc

SEQ ID NO: 1430657 - RNA, 18 nt, Pseudomonas aeruginosa PA01
cuguugcagagcggccag

SEQ ID NO: 1430658 - RNA, 19 nt, Pseudomonas aeruginosa PA01
cuguugguggggcgccggc

SEQ ID NO: 1430659 - RNA, 18 nt, Pseudomonas aeruginosa PA01
cuuaccagaagccggccg

SEQ ID NO: 1430660 - RNA, 14 nt, Pseudomonas aeruginosa PA01
cuugaggucguugg

SEQ ID NO: 1430661 - RNA, 16 nt, Pseudomonas aeruginosa PA01
cuugaggucguuggcc

SEQ ID NO: 1430662 - RNA, 17 nt, Pseudomonas aeruginosa PA01
cuugauacccaccggcu

SEQ ID NO: 1430663 - RNA, 16 nt, Pseudomonas aeruginosa PA01
cuugaucacgccgaag

SEQ ID NO: 1430664 - RNA, 17 nt, Pseudomonas aeruginosa PA01
cuugaucaccgcggugc

SEQ ID NO: 1430665 - RNA, 22 nt, Pseudomonas aeruginosa PA01
cuugaucgagcccuugcgcggc

SEQ ID NO: 1430666 - RNA, 14 nt, Pseudomonas aeruginosa PA01
cuugaucagcgcgc

SEQ ID NO: 1430667 - RNA, 18 nt, Pseudomonas aeruginosa PA01
cuugauccgcuccagcgc

SEQ ID NO: 1430668 - RNA, 23 nt, Pseudomonas aeruginosa PA01
cuugauccgcuccagcgccucga

SEQ ID NO: 1430669 - RNA, 21 nt, Pseudomonas aeruginosa PA01
cuugaugaagcccgcggcauc

SEQ ID NO: 1430670 - RNA, 22 nt, Pseudomonas aeruginosa PA01
cuugaugaagcccgcggcaucg

SEQ ID NO: 1430671 - RNA, 22 nt, Pseudomonas aeruginosa PA01
cuugaugucagcguagcuguuc

SEQ ID NO: 1430672 - RNA, 19 nt, Pseudomonas aeruginosa PA01
cuugagcaggcggccgucc

SEQ ID NO: 1430673 - RNA, 13 nt, Pseudomonas aeruginosa PA01
cuugagcauggcg

SEQ ID NO: 1430674 - RNA, 13 nt, Pseudomonas aeruginosa PA01
cuugagcgccgaa

SEQ ID NO: 1430675 - RNA, 21 nt, Pseudomonas aeruginosa PA01
cuugagcgccgaaggcgucgg

SEQ ID NO: 1430676 - RNA, 22 nt, Pseudomonas aeruginosa PA01
cuugaggaaguagugcagcugc

SEQ ID NO: 1430677 - RNA, 20 nt, Pseudomonas aeruginosa PA01
cuugaggaaguggccggugu

SEQ ID NO: 1430678 - RNA, 16 nt, Pseudomonas aeruginosa PA01
cuugaggcgggccagc

SEQ ID NO: 1430679 - RNA, 21 nt, Pseudomonas aeruginosa PA01
cuugaguagcuggcgcagggc

SEQ ID NO: 1430680 - RNA, 20 nt, Pseudomonas aeruginosa PA01
cuugaguucccagaccuggc

SEQ ID NO: 1430681 - RNA, 23 nt, Pseudomonas aeruginosa PA01
cuugaguucccagaccuggccgc

SEQ ID NO: 1430682 - RNA, 15 nt, Pseudomonas aeruginosa PA01
cuugacuggcagucc

SEQ ID NO: 1430683 - RNA, 16 nt, Pseudomonas aeruginosa PA01
cuugagcacccgggcg

SEQ ID NO: 1430684 - RNA, 17 nt, Pseudomonas aeruginosa PA01
cuugagaccuucgcggg

SEQ ID NO: 1430685 - RNA, 20 nt, Pseudomonas aeruginosa PA01
cuugaccuugcucuucuggc

SEQ ID NO: 1430686 - RNA, 18 nt, Pseudomonas aeruginosa PA01
cuugccgaugucgccggc

SEQ ID NO: 1430687 - RNA, 13 nt, Pseudomonas aeruginosa PA01
cuugccgcgaccg

SEQ ID NO: 1430688 - RNA, 19 nt, Pseudomonas aeruginosa PA01
cuugccgcgagcuuggccc

SEQ ID NO: 1430689 - RNA, 21 nt, Pseudomonas aeruginosa PA01
cuugccgaucaugggggccag

SEQ ID NO: 1430690 - RNA, 20 nt, Pseudomonas aeruginosa PA01
cuugccgagcgcgaucagcc

SEQ ID NO: 1430691 - RNA, 23 nt, Pseudomonas aeruginosa PA01
cuugccgaggaagucggcggccg

SEQ ID NO: 1430692 - RNA, 24 nt, Pseudomonas aeruginosa PA01
cuugccgaggaagucggcggccgc

SEQ ID NO: 1430693 - RNA, 20 nt, Pseudomonas aeruginosa PA01
cuugccgaccuucaucaggc

SEQ ID NO: 1430694 - RNA, 22 nt, Pseudomonas aeruginosa PA01
cuugccgacgccgcggccggcg

SEQ ID NO: 1430695 - RNA, 17 nt, Pseudomonas aeruginosa PA01
cuugcccuugaagcgcu

SEQ ID NO: 1430696 - RNA, 12 nt, Pseudomonas aeruginosa PA01
cuugcccuggcc

SEQ ID NO: 1430697 - RNA, 13 nt, Pseudomonas aeruginosa PA01
cuugcccuggccg

SEQ ID NO: 1430698 - RNA, 22 nt, Pseudomonas aeruginosa PA01
cuugcccggauuuugggcagcg

SEQ ID NO: 1430699 - RNA, 14 nt, Pseudomonas aeruginosa PA01
cuugcccucgcgga

SEQ ID NO: 1430700 - RNA, 17 nt, Pseudomonas aeruginosa PA01
cuugcccucggcgcccg

SEQ ID NO: 1430701 - RNA, 18 nt, Pseudomonas aeruginosa PA01
cuugcccucggcgcccgc

SEQ ID NO: 1430702 - RNA, 23 nt, Pseudomonas aeruginosa PA01
cuugcccucggcgcccgccugca

SEQ ID NO: 1430703 - RNA, 17 nt, Pseudomonas aeruginosa PA01
cuugcccgucgggcaag

SEQ ID NO: 1430704 - RNA, 20 nt, Pseudomonas aeruginosa PA01
cuugcccucagggaagaugc

SEQ ID NO: 1430705 - RNA, 20 nt, Pseudomonas aeruginosa PA01
cuugcccgaggugucgccgc

SEQ ID NO: 1430706 - RNA, 21 nt, Pseudomonas aeruginosa PA01
cuugcccgaggugucgccgcg

SEQ ID NO: 1430707 - RNA, 15 nt, Pseudomonas aeruginosa PA01
cuugcagggccgcca

SEQ ID NO: 1430708 - RNA, 17 nt, Pseudomonas aeruginosa PA01
cuugcagggccgccagc

SEQ ID NO: 1430709 - RNA, 20 nt, Pseudomonas aeruginosa PA01
cuugcagggccgccagccgc

SEQ ID NO: 1430710 - RNA, 16 nt, Pseudomonas aeruginosa PA01
cuugcagucgcggaag

SEQ ID NO: 1430711 - RNA, 20 nt, Pseudomonas aeruginosa PA01
cuugcagcaccgccuggucg

SEQ ID NO: 1430712 - RNA, 20 nt, Pseudomonas aeruginosa PA01
cuugcagccagccgucgucg

SEQ ID NO: 1430713 - RNA, 21 nt, Pseudomonas aeruginosa PA01
cuugcagccagccgucgucgu

SEQ ID NO: 1430714 - RNA, 22 nt, Pseudomonas aeruginosa PA01
cuugccaagguguggccgagcc

SEQ ID NO: 1430715 - RNA, 14 nt, Pseudomonas aeruginosa PA01
cuugccagggcagg

SEQ ID NO: 1430716 - RNA, 22 nt, Pseudomonas aeruginosa PA01
cuugccagggcagggaguccgc

SEQ ID NO: 1430717 - RNA, 21 nt, Pseudomonas aeruginosa PA01
cuuggccaggucgcgcagggc

SEQ ID NO: 1430718 - RNA, 17 nt, Pseudomonas aeruginosa PA01
cuuggcccugcgcgcgc

SEQ ID NO: 1430719 - RNA, 16 nt, Pseudomonas aeruginosa PA01
cuugcgggugcgcagg

SEQ ID NO: 1430720 - RNA, 17 nt, Pseudomonas aeruginosa PA01
cuugcggguggucuugc

SEQ ID NO: 1430721 - RNA, 18 nt, Pseudomonas aeruginosa PA01
cuugcggucauccgccgg

SEQ ID NO: 1430722 - RNA, 19 nt, Pseudomonas aeruginosa PA01
cuugcggucauccgccggc

SEQ ID NO: 1430723 - RNA, 17 nt, Pseudomonas aeruginosa PA01
cuuggccaugaugugcg

SEQ ID NO: 1430724 - RNA, 15 nt, Pseudomonas aeruginosa PA01
cuuggccauggcgcu

SEQ ID NO: 1430725 - RNA, 19 nt, Pseudomonas aeruginosa PA01
cuuggccaugggcacgccg

SEQ ID NO: 1430726 - RNA, 16 nt, Pseudomonas aeruginosa PA01
cuugcggcgccgaggc

SEQ ID NO: 1430727 - RNA, 19 nt, Pseudomonas aeruginosa PA01
cuugcggcgccgaggcccu

SEQ ID NO: 1430728 - RNA, 19 nt, Pseudomonas aeruginosa PA01
cuugcggcaguccucgccg

SEQ ID NO: 1430729 - RNA, 21 nt, Pseudomonas aeruginosa PA01
cuugcggcaguccucgccguu

SEQ ID NO: 1430730 - RNA, 22 nt, Pseudomonas aeruginosa PA01
cuugcggcccccagaccgugga

SEQ ID NO: 1430731 - RNA, 14 nt, Pseudomonas aeruginosa PA01
cuugcgcuggccgg

SEQ ID NO: 1430732 - RNA, 18 nt, Pseudomonas aeruginosa PA01
cuugcgcuggccggcaac

SEQ ID NO: 1430733 - RNA, 14 nt, Pseudomonas aeruginosa PA01
cuuggcgaggcgcg

SEQ ID NO: 1430734 - RNA, 15 nt, Pseudomonas aeruginosa PA01
cuuggcgaggcgcgc

SEQ ID NO: 1430735 - RNA, 13 nt, Pseudomonas aeruginosa PA01
cuuggucgcgguc

SEQ ID NO: 1430736 - RNA, 17 nt, Pseudomonas aeruginosa PA01
cuuggucgggcgccgcg

SEQ ID NO: 1430737 - RNA, 22 nt, Pseudomonas aeruginosa PA01
cuuggccuugccguccagccgg

SEQ ID NO: 1430738 - RNA, 14 nt, Pseudomonas aeruginosa PA01
cuuggugccgaccu

SEQ ID NO: 1430739 - RNA, 17 nt, Pseudomonas aeruginosa PA01
cuuggugccgaccuuca

SEQ ID NO: 1430740 - RNA, 18 nt, Pseudomonas aeruginosa PA01
cuuguacggcagcggcgu

SEQ ID NO: 1430741 - RNA, 15 nt, Pseudomonas aeruginosa PA01
cuuguagcagccgca

SEQ ID NO: 1430742 - RNA, 22 nt, Pseudomonas aeruginosa PA01
cuugcgcaugguuaccucguug

SEQ ID NO: 1430743 - RNA, 19 nt, Pseudomonas aeruginosa PA01
cuugcgccagagcaggcgg

SEQ ID NO: 1430744 - RNA, 18 nt, Pseudomonas aeruginosa PA01
cuugcgccaggcccggcg

SEQ ID NO: 1430745 - RNA, 20 nt, Pseudomonas aeruginosa PA01
cuugcgccaggcccggcgcu

SEQ ID NO: 1430746 - RNA, 15 nt, Pseudomonas aeruginosa PA01
cuugcgccaugcgcc

SEQ ID NO: 1430747 - RNA, 18 nt, Pseudomonas aeruginosa PA01
cuugcgccaugcgcccgc

SEQ ID NO: 1430748 - RNA, 14 nt, Pseudomonas aeruginosa PA01
cuugcgcaccaggg

SEQ ID NO: 1430749 - RNA, 18 nt, Pseudomonas aeruginosa PA01
cuugcgcaccagggccag

SEQ ID NO: 1430750 - RNA, 19 nt, Pseudomonas aeruginosa PA01
cuugcgcaccagggccagg

SEQ ID NO: 1430751 - RNA, 16 nt, Pseudomonas aeruginosa PA01
cuugccuuccugggcg

SEQ ID NO: 1430752 - RNA, 23 nt, Pseudomonas aeruginosa PA01
cuugcgaucgaggaugaucggcu

SEQ ID NO: 1430753 - RNA, 17 nt, Pseudomonas aeruginosa PA01
cuugcgccgccucgcgc

SEQ ID NO: 1430754 - RNA, 16 nt, Pseudomonas aeruginosa PA01
cuugcgcgccaccagc

SEQ ID NO: 1430755 - RNA, 13 nt, Pseudomonas aeruginosa PA01
cuugcgcccggcg

SEQ ID NO: 1430756 - RNA, 12 nt, Pseudomonas aeruginosa PA01
cuugcgccgaag

SEQ ID NO: 1430757 - RNA, 17 nt, Pseudomonas aeruginosa PA01
cuugcgccgaccgcgcg

SEQ ID NO: 1430758 - RNA, 23 nt, Pseudomonas aeruginosa PA01
cuugcgccgaccgcgcgccugca

SEQ ID NO: 1430759 - RNA, 14 nt, Pseudomonas aeruginosa PA01
cuugcgcggcgccg

SEQ ID NO: 1430760 - RNA, 17 nt, Pseudomonas aeruginosa PA01
cuugcgcgugcuggugc

SEQ ID NO: 1430761 - RNA, 18 nt, Pseudomonas aeruginosa PA01
cuugcgcucgagccggcu

SEQ ID NO: 1430762 - RNA, 12 nt, Pseudomonas aeruginosa PA01
cuugcgcggcag

SEQ ID NO: 1430763 - RNA, 19 nt, Pseudomonas aeruginosa PA01
cuugcgcggcaggccgucc

SEQ ID NO: 1430764 - RNA, 17 nt, Pseudomonas aeruginosa PA01
cuugccguuggcgucgc

SEQ ID NO: 1430765 - RNA, 19 nt, Pseudomonas aeruginosa PA01
cuugcgaaaagcccgccac

SEQ ID NO: 1430766 - RNA, 16 nt, Pseudomonas aeruginosa PA01
cuugccuuccaccggg

SEQ ID NO: 1430767 - RNA, 16 nt, Pseudomonas aeruginosa PA01
cuugccggucugcugc

SEQ ID NO: 1430768 - RNA, 21 nt, Pseudomonas aeruginosa PA01
cuugccggucugcugcgcgca

SEQ ID NO: 1430769 - RNA, 23 nt, Pseudomonas aeruginosa PA01
cuugccggucugcugcgcgcacc

SEQ ID NO: 1430770 - RNA, 17 nt, Pseudomonas aeruginosa PA01
cuugccggcugcgccgc

SEQ ID NO: 1430771 - RNA, 15 nt, Pseudomonas aeruginosa PA01
cuugccggggucgag

SEQ ID NO: 1430772 - RNA, 16 nt, Pseudomonas aeruginosa PA01
cuugccgcgcccggcc

SEQ ID NO: 1430773 - RNA, 17 nt, Pseudomonas aeruginosa PA01
cuugccgcgcccggcca

SEQ ID NO: 1430774 - RNA, 19 nt, Pseudomonas aeruginosa PA01
cuugccgcgcccggccagg

SEQ ID NO: 1430775 - RNA, 14 nt, Pseudomonas aeruginosa PA01
cuugccgcugcgca

SEQ ID NO: 1430776 - RNA, 15 nt, Pseudomonas aeruginosa PA01
cuugccgcugcgcgc

SEQ ID NO: 1430777 - RNA, 18 nt, Pseudomonas aeruginosa PA01
cuugccggaaagcaguuc

SEQ ID NO: 1430778 - RNA, 12 nt, Pseudomonas aeruginosa PA01
cuugccggcagc

SEQ ID NO: 1430779 - RNA, 13 nt, Pseudomonas aeruginosa PA01
cuugccggcaucg

SEQ ID NO: 1430780 - RNA, 14 nt, Pseudomonas aeruginosa PA01
cuugccggcgccau

SEQ ID NO: 1430781 - RNA, 16 nt, Pseudomonas aeruginosa PA01
cuucgccgaccagguc

SEQ ID NO: 1430782 - RNA, 17 nt, Pseudomonas aeruginosa PA01
cuucgaugcgccgcagg

SEQ ID NO: 1430783 - RNA, 17 nt, Pseudomonas aeruginosa PA01
cuucgccgcccgcgccu

SEQ ID NO: 1430784 - RNA, 13 nt, Pseudomonas aeruginosa PA01
cuucgccgccgcg

SEQ ID NO: 1430785 - RNA, 24 nt, Pseudomonas aeruginosa PA01
cuucgccgccgcgcgcgcggucga

SEQ ID NO: 1430786 - RNA, 17 nt, Pseudomonas aeruginosa PA01
cuucgaugaaggucagc

SEQ ID NO: 1430787 - RNA, 23 nt, Pseudomonas aeruginosa PA01
cuucgccgaaagcacgcgcaucc

SEQ ID NO: 1430788 - RNA, 17 nt, Pseudomonas aeruginosa PA01
cuucgacuaccugggga

SEQ ID NO: 1430789 - RNA, 15 nt, Pseudomonas aeruginosa PA01
cuucgagccuggcca

SEQ ID NO: 1430790 - RNA, 22 nt, Pseudomonas aeruginosa PA01
cuucgaggcgggcgucggcguc

SEQ ID NO: 1430791 - RNA, 23 nt, Pseudomonas aeruginosa PA01
cuucgaggcgggcgucggcgucg

SEQ ID NO: 1430792 - RNA, 16 nt, Pseudomonas aeruginosa PA01
cuucgacgcuggucag

SEQ ID NO: 1430793 - RNA, 23 nt, Pseudomonas aeruginosa PA01
cuucgacgaacucgacgcgccag

SEQ ID NO: 1430794 - RNA, 19 nt, Pseudomonas aeruginosa PA01
cuucgacgacaccugcaac

SEQ ID NO: 1430795 - RNA, 23 nt, Pseudomonas aeruginosa PA01
cuucgacgacaccugcaacgccc

SEQ ID NO: 1430796 - RNA, 20 nt, Pseudomonas aeruginosa PA01
cuucgagccacucgugcaac

SEQ ID NO: 1430797 - RNA, 20 nt, Pseudomonas aeruginosa PA01
cuucgagcaacacaugcagg

SEQ ID NO: 1430798 - RNA, 15 nt, Pseudomonas aeruginosa PA01
cuucgccuggcgcga

SEQ ID NO: 1430799 - RNA, 16 nt, Pseudomonas aeruginosa PA01
cuucgccuggcgcgac

SEQ ID NO: 1430800 - RNA, 16 nt, Pseudomonas aeruginosa PA01
cuucgccuucggcgug

SEQ ID NO: 1430801 - RNA, 19 nt, Pseudomonas aeruginosa PA01
cuucgccuugcccuggccg

SEQ ID NO: 1430802 - RNA, 22 nt, Pseudomonas aeruginosa PA01
cuucgcgcggauauagcugguc

SEQ ID NO: 1430803 - RNA, 19 nt, Pseudomonas aeruginosa PA01
cuucgcgcgggguggccgu

SEQ ID NO: 1430804 - RNA, 19 nt, Pseudomonas aeruginosa PA01
cuucgcgaucggcguccgc

SEQ ID NO: 1430805 - RNA, 12 nt, Pseudomonas aeruginosa PA01
cuucggccaguu

SEQ ID NO: 1430806 - RNA, 13 nt, Pseudomonas aeruginosa PA01
cuucggcccgcug

SEQ ID NO: 1430807 - RNA, 22 nt, Pseudomonas aeruginosa PA01
cuucggcgacacagacgcagcc

SEQ ID NO: 1430808 - RNA, 16 nt, Pseudomonas aeruginosa PA01
cuucagauacuccagc

SEQ ID NO: 1430809 - RNA, 16 nt, Pseudomonas aeruginosa PA01
cuucagcaucaggucg

SEQ ID NO: 1430810 - RNA, 21 nt, Pseudomonas aeruginosa PA01
cuucagcaucaggucggcgcg

SEQ ID NO: 1430811 - RNA, 22 nt, Pseudomonas aeruginosa PA01
cuucagcaucaggucggcgcgc

SEQ ID NO: 1430812 - RNA, 17 nt, Pseudomonas aeruginosa PA01
cuucagcaccugcgccg

SEQ ID NO: 1430813 - RNA, 14 nt, Pseudomonas aeruginosa PA01
cuucagcacgccca

SEQ ID NO: 1430814 - RNA, 22 nt, Pseudomonas aeruginosa PA01
cuucagcacuucggcgcgcggc

SEQ ID NO: 1430815 - RNA, 16 nt, Pseudomonas aeruginosa PA01
cuucagagcuggacga

SEQ ID NO: 1430816 - RNA, 13 nt, Pseudomonas aeruginosa PA01
cuucagauaacgu

SEQ ID NO: 1430817 - RNA, 19 nt, Pseudomonas aeruginosa PA01
cuucagauaacgucgcagg

SEQ ID NO: 1430818 - RNA, 17 nt, Pseudomonas aeruginosa PA01
cuucccacuccagcgcg

SEQ ID NO: 1430819 - RNA, 13 nt, Pseudomonas aeruginosa PA01
cuuccaucagcuc

SEQ ID NO: 1430820 - RNA, 13 nt, Pseudomonas aeruginosa PA01
cuucagcagcagg

SEQ ID NO: 1430821 - RNA, 15 nt, Pseudomonas aeruginosa PA01
cuuccguagguggau

SEQ ID NO: 1430822 - RNA, 20 nt, Pseudomonas aeruginosa PA01
cuuccccugcaugccggccg

SEQ ID NO: 1430823 - RNA, 16 nt, Pseudomonas aeruginosa PA01
cuucccgcccaucaac

SEQ ID NO: 1430824 - RNA, 13 nt, Pseudomonas aeruginosa PA01
cuucccggcgcag

SEQ ID NO: 1430825 - RNA, 15 nt, Pseudomonas aeruginosa PA01
cuuccgacgccgcgu

SEQ ID NO: 1430826 - RNA, 17 nt, Pseudomonas aeruginosa PA01
cuuccugcacgcugcgc

SEQ ID NO: 1430827 - RNA, 15 nt, Pseudomonas aeruginosa PA01
cuuccugccagcgcg

SEQ ID NO: 1430828 - RNA, 20 nt, Pseudomonas aeruginosa PA01
cuuccugccagcgcgucggc

SEQ ID NO: 1430829 - RNA, 21 nt, Pseudomonas aeruginosa PA01
cuuccugggaauugcgcacgc

SEQ ID NO: 1430830 - RNA, 14 nt, Pseudomonas aeruginosa PA01
cuuccuggaccucc

SEQ ID NO: 1430831 - RNA, 17 nt, Pseudomonas aeruginosa PA01
cuuccuggaccuccgcc

SEQ ID NO: 1430832 - RNA, 20 nt, Pseudomonas aeruginosa PA01
cuuccuggaccuccgccagg

SEQ ID NO: 1430833 - RNA, 23 nt, Pseudomonas aeruginosa PA01
cuuccucgcccucauggcuguag

SEQ ID NO: 1430834 - RNA, 21 nt, Pseudomonas aeruginosa PA01
cuuccucggacuugcuccaga

SEQ ID NO: 1430835 - RNA, 17 nt, Pseudomonas aeruginosa PA01
cuuccucggccgccagg

SEQ ID NO: 1430836 - RNA, 20 nt, Pseudomonas aeruginosa PA01
cuuccucggccgccaggcgc

SEQ ID NO: 1430837 - RNA, 21 nt, Pseudomonas aeruginosa PA01
cuuccucggccgccaggcgcg

SEQ ID NO: 1430838 - RNA, 11 nt, Pseudomonas aeruginosa PA01
cuuccucggcg

SEQ ID NO: 1430839 - RNA, 20 nt, Pseudomonas aeruginosa PA01
cuuccucggcgaccaccgcg

SEQ ID NO: 1430840 - RNA, 19 nt, Pseudomonas aeruginosa PA01
cuugacccucugguuggcc

SEQ ID NO: 1430841 - RNA, 23 nt, Pseudomonas aeruginosa PA01
cuugacccucugguuggccgaaa

SEQ ID NO: 1430842 - RNA, 20 nt, Pseudomonas aeruginosa PA01
cuugacccgguacagcgccu

SEQ ID NO: 1430843 - RNA, 13 nt, Pseudomonas aeruginosa PA01
cuugaccagcggc

SEQ ID NO: 1430844 - RNA, 16 nt, Pseudomonas aeruginosa PA01
cuugaccugcugggcc

SEQ ID NO: 1430845 - RNA, 20 nt, Pseudomonas aeruginosa PA01
cuugaccugcugggccagcg

SEQ ID NO: 1430846 - RNA, 14 nt, Pseudomonas aeruginosa PA01
cuugaccucgacgc

SEQ ID NO: 1430847 - RNA, 18 nt, Pseudomonas aeruginosa PA01
cuugaccucgacgccgag

SEQ ID NO: 1430848 - RNA, 20 nt, Pseudomonas aeruginosa PA01
cuugaccucgacgccgagcc

SEQ ID NO: 1430849 - RNA, 18 nt, Pseudomonas aeruginosa PA01
cuugaccuugucggccga

SEQ ID NO: 1430850 - RNA, 23 nt, Pseudomonas aeruginosa PA01
cuugacgaaaaagccggaagcgc

SEQ ID NO: 1430851 - RNA, 17 nt, Pseudomonas aeruginosa PA01
cuugaagaagcugccgg

SEQ ID NO: 1430852 - RNA, 14 nt, Pseudomonas aeruginosa PA01
cuugaagcggccau

SEQ ID NO: 1430853 - RNA, 17 nt, Pseudomonas aeruginosa PA01
cuugaagccuucgccca

SEQ ID NO: 1430854 - RNA, 23 nt, Pseudomonas aeruginosa PA01
cuugaccaucuuuuccugcuggc

SEQ ID NO: 1430855 - RNA, 17 nt, Pseudomonas aeruginosa PA01
cuugaccaccgccaggc

SEQ ID NO: 1430856 - RNA, 23 nt, Pseudomonas aeruginosa PA01
cuugaccaccaugugcuggcgga

SEQ ID NO: 1430857 - RNA, 18 nt, Pseudomonas aeruginosa PA01
cuugaaaacugucggcgg

SEQ ID NO: 1430858 - RNA, 22 nt, Pseudomonas aeruginosa PA01
cuugaaaccggcgaaccagugc

SEQ ID NO: 1430859 - RNA, 22 nt, Pseudomonas aeruginosa PA01
cuucuuuuaucgaaucggcgca

SEQ ID NO: 1430860 - RNA, 13 nt, Pseudomonas aeruginosa PA01
cuugaacagcagg

SEQ ID NO: 1430861 - RNA, 17 nt, Pseudomonas aeruginosa PA01
cuugaacagcaggaugc

SEQ ID NO: 1430862 - RNA, 17 nt, Pseudomonas aeruginosa PA01
cuugaacgcgcgccuga

SEQ ID NO: 1430863 - RNA, 16 nt, Pseudomonas aeruginosa PA01
cuucucgucgccgccg

SEQ ID NO: 1430864 - RNA, 23 nt, Pseudomonas aeruginosa PA01
cuucucgucgccgccguugagga

SEQ ID NO: 1430865 - RNA, 19 nt, Pseudomonas aeruginosa PA01
cuucucgguagggccgagg

SEQ ID NO: 1430866 - RNA, 16 nt, Pseudomonas aeruginosa PA01
cuucugcagcucggcc

SEQ ID NO: 1430867 - RNA, 23 nt, Pseudomonas aeruginosa PA01
cuucugcagcucggccugguccg

SEQ ID NO: 1430868 - RNA, 19 nt, Pseudomonas aeruginosa PA01
cuucugcaauugcuugcgc

SEQ ID NO: 1430869 - RNA, 22 nt, Pseudomonas aeruginosa PA01
cuucugcaauugcuugcgcucg

SEQ ID NO: 1430870 - RNA, 15 nt, Pseudomonas aeruginosa PA01
cuucugcaccgugcg

SEQ ID NO: 1430871 - RNA, 15 nt, Pseudomonas aeruginosa PA01
cuucugcucggccug

SEQ ID NO: 1430872 - RNA, 22 nt, Pseudomonas aeruginosa PA01
cuucugcuggauccucgccucg

SEQ ID NO: 1430873 - RNA, 19 nt, Pseudomonas aeruginosa PA01
cuucugcgcguugcagcgc

SEQ ID NO: 1430874 - RNA, 22 nt, Pseudomonas aeruginosa PA01
cuucugcgcguugcagcgccug

SEQ ID NO: 1430875 - RNA, 15 nt, Pseudomonas aeruginosa PA01
cuucuguccguugcg

SEQ ID NO: 1430876 - RNA, 19 nt, Pseudomonas aeruginosa PA01
cuucuguccguugcgcagc

SEQ ID NO: 1430877 - RNA, 19 nt, Pseudomonas aeruginosa PA01
cuucugguaggccagcagg

SEQ ID NO: 1430878 - RNA, 19 nt, Pseudomonas aeruginosa PA01
cuucugguucguccgcgcg

SEQ ID NO: 1430879 - RNA, 19 nt, Pseudomonas aeruginosa PA01
cuucucgaagcgcgccugc

SEQ ID NO: 1430880 - RNA, 15 nt, Pseudomonas aeruginosa PA01
cuucuccgauuccug

SEQ ID NO: 1430881 - RNA, 16 nt, Pseudomonas aeruginosa PA01
cuucuccagcaggguc

SEQ ID NO: 1430882 - RNA, 15 nt, Pseudomonas aeruginosa PA01
cuucggcgcgcggca

SEQ ID NO: 1430883 - RNA, 14 nt, Pseudomonas aeruginosa PA01
cuucggcgcucuuc
